United States Patent 7,314,974 (EXPRESSION OF MICROBIAL PROTEINS IN PLANTS FOR PRODUCTION OF PLANTS WITH IMPROVED PROPERTIES) - sequence listing, part 2

SEQ ID NO: 2834 - protein, 332 aa, Synechocystis sp.
MASTDFKDYYQILGVTKTASEAEIKKQFRKLALKYHPDKNPGDKAAEEKFKEISEAYEVLSDPEKRQKYDQFGRYWQQAGTAGQPSGSYGPGVGVDFGGFDFSQYGNFDEFINELLGRFNTPGGGGQRTSYSYSTGGPGFNDFGGFGNAQAPAGDREATLQLTLAEAFRGVEKRLNLGEEMVTVRIPAGAKNGSRVRVRGKGMASPYGQRGDLYLNLQLTPHPFFQFEGDNLVCELAIAPDEAVLGADISVPTPDGMVRMKVPAGVKSGQSLRLKGKGWPNPKQGRGDQLVRLIITAPKNPSAIERECYEKIQAQRTENPRQAVEKYANLLA

SEQ ID NO: 2835 - protein, 210 aa, Synechocystis sp.
MPESSTPSLLIPNFPPRAAAVHRVTKETDVRVSLNLMGSGLCHVATGVPFLDHMLHQIASHGLIDLEVNATGDIEIDDHHTNEDVGITLGQALAEALGDRRGINRFGHFIAPLDEALVQVTLDFSGRPHLSYGLQIPTERVGTYDTQLVREFFVAVVNHSQMTLHIRQLDGINSHHIIEATFKAFARAMRMAIEVDPRRADTIPSSKGVL

SEQ ID NO: 2836 - protein, 245 aa, Synechocystis sp.
MAMLLSSPSSDLVTMTPAEPVVAMENLSHFYGTGNLRKQILFDINLRLDEGEVVILKGPSGSGKTTLLTLMGGLRSAQSGSLRVFGQELNGAKKQDLVQVRRHIGYIFQAHNLLESLTARQNVQMAIELHPQYNAQQAKELSIAMLEAVGLGAHINYNPHNLSGGQKQRVAIARALVSHPKMILADEPTAALDSKSGHDVVELMRKLAREQGSTILIVTHDNRILDVADRIIQLEDGQLCADPGE

SEQ ID NO: 2837 - protein, 322 aa, Synechocystis sp.
MEQPMKPTVIITGASSGVGLYGAKALIDKGWHVIMACRNLDKTQKVADELGFPKDSYTIIKLDLGYLDSVRRFVAQFRELGRPLKALVCNAAVYFPLLDEPLWSADDYELSVATNHLGHFLLCNLLLEDLKACPDADKRLIILGTVTANSKELGGKIPIPAPPDLGNFEGFEAGFKKPIAMINNKKFKSGKAYKDSKLCNMLTTRELHRRFHQETGIVFNSLYPGCVADTPLFRNHYSLFRTIFPWFQKNVTKGYVSQELAGERVAMVVADDKFKDSGVHWSWGNRQQAGREAFVQELSEQGSDAQKAQRMWDLSEKLVGLV

SEQ ID NO: 2838 - protein, 333 aa, Synechocystis sp.
MSAVSRIATLTRQSMLSALSDNNRLRLFSGSSNPSLSQEVARYLGMDIGPMLRKRFADGELYIQIQESIRGGDVYLIQPCCHPVNDNLMELLIMIDACRRASARQITAVLPYYGYARADRKTAGRESISAKLVANLITGAGAQRVLAMDLHSAQIQGYFDIPCDHMYGSPVIIDYLKSKQLTDLVVVSPDVGGVARARAFAKKLNDAPLAIIDKRRQSHNVAEVLNLIGDVDGKTAVLVDDMIDTAGTLSEGSRLLRAQGARQVYACATHAVFSEPAINRLSGGLFEEVIVTNTIPVPDDHHFPQLTILSVANLIGEAIWRIHEESSVSSMFR

SEQ ID NO: 2839 - protein, 580 aa, Synechocystis sp.
MAAPSVKQLLRYLTPHWRAIGAGTFALFLANALGVYIPILMRDSIDDLMPPFEASDVARIVVLIVVLASLMWFIRMASRILIFGVGRQVEYELKQKIFDHLLKLEPLYFTENTIGDLINRATSDVDNIRRLVGFAVLSLINTVFAYALTIPAMFALHIPLTLLAVSVYPLMLMSVNLFSGKLRDYQLEVQEELSALSELVQEDMSGISLIKIYSQEDNERQAFQTRNQKLLQANLKLARIRNFLFPLIEGLAYLSLLILLAFGTGLIQDGSITIGDFIALIILVERLVFPTALLGFTITAYQRGEVSIQRVEAIFHTTPKILTVPQPLPFSPAQATGKITARGLNYCYPGSDLPALEQVDFTVYPGEMVAIVGPIGSGKSTLVNVLPRLLDIAPGQVFIDDYDITQIALSDLRSAIAFVPQESFLFSTTIAENIAYSDPSQTDTAIEQAAHQAHLDQEIANFPQHYQTLVGERGITLSGGQRQRAALARALILDAPLLVLDDALSSVDNQTATRILHYLARRNNTVLFVSHQLSAAAQADRIFVMDHGRIVQTGSHEELLQQSGLYQSLWQQNELEKVLS

SEQ ID NO: 2840 - protein, 483 aa, Synechocystis sp.
MPALINPVKFMRPLSHRTKIVATIGPASSSVEVIRQMVDAGMNVARLNFSHGSYEDHATMVRLLRSVEQEMDTPITLLQDLQGPKIRIGQLPGGEKQLREGEKVSLVPVEIGDRHPGAVGIDYPHLATEAKVGERILLDDGLLEMKVVSIQDPEVICEVVTGGILKSRKGVNLPGLVLTLPSMTTKDKQDLEFGLSQGIDWVSLSFVRKGEDIHTLKQFLAERGHPDLPVIAKIEKPQAIDNLEEIVAVSNGIMVARGDLGVEVNPEKVPRLQKEIIRRCNVRAIPVITATQMLDSMIQNSRPTRAEASDVANAILDGTDAVMLSGESAVGQYPVKSVQMLRKIAEETEVGLHLVNNPPIENTETHALSEALVVIDGILDLKYIVTFTTSGFTSLLASNQRPSVPVIAFTPSEKVYHSLNLVWGIIPFLINEEFDTFEDLIQQAEVLLRDRKMVEKGDQLLIMAGIPTKIPRGTNFLKIHRIS

SEQ ID NO: 2841 - protein, 506 aa, Synechocystis sp.
MVKNQGAWLSRGLWSVLIWGAMATVCRAETIPFTLLQLNDVYEIAPIDNGRWGGLARVANLRQQLEQADPHTYTVLAGDFLSPSALGTALYNGDRLAGKQMVAVLNAMGLDYAAVGNHEFDVNAQQFQQRITESDFQWLSANIADGTGNQFEGIKPYEILTIPGTEGGELKVGILALTIDSNAVDYVTYSDPIATARRYIDNPQGEVDVWVALTHLSLAQDLALAQAIPELDLILGGHEHENIQRNHLIIKPDSSASCPQAKTPIFKADANARTVYIHQLTYDTNRQCLQINSQLQPITAAIASDPATEKVVQQWQEIGFNAFRQQGFEPMAVVVNSPIALDALDAHVRSGSTNLTRLITRAMEQENPDVAMVMFNGGMVRLDDLLSAGAITQYDIIRLLPFGGRVVTVEIQGDLLQKVLAQGEKNSGTGGYLQLGGMAPNSIEPSKTYRVALMEYLLSGQEVGLDYLTTNTPGLKVINYGRDIRSILVDYLQNNAQQAFTDLGEL

SEQ ID NO: 2842 - protein, 244 aa, Synechocystis sp.
MLNIENKVIVITGASSGIGEATAKLLAQNGAKVVLGGRRIDKLEKLIKQIHASGGTAEFKTVDVTDRHDVKAFVEFANDKFGRVDVIFNNAGVMPLSPMNALKVEEWDNMINVNIRGVLNGIAAGLPIMEAQGGGQIINTASIGAHVVVPTAAVYCATKYAVWAISEGLRQESQNIRVTTISPGVVATELGSDITDESSKGLLEELRKTALTSEAIARAVLYAVSQPDDVDVNEIIVRPTASTF

SEQ ID NO: 2843 - protein, 721 aa, Synechocystis sp.
MTQSSPLKTQQMQVGGMDCTSCKLKIEGSLERLKGVAEASVTVATGRLTVTYDPKQVSEITIQERIAALGYTLAEPKSSVTLNGHKHPHSHREEGHSHSHGAGEFNLKQELLPVLTAIALFTIAILFEQPLHNTPGQIAEFAVIIPAYLLSGWTVLKTAGRNILRGQIFDENFLMTIATLGALAIHQLPEAVAVMLFFRVGELFQEYSVGRSRRSIKALLEARPDTANLKRNGTVQQVSPETVQVDDLILVKPGEKVPLDGEILGGTSQVDTSALTGESVPGTVKPGDTILAGMINQSGVLTIRVTKLFSESSIAKVLDLVENASSKKASTEKFITQFARYYTPVIVFLSLAVALLPPLFIPGADRADWVYRALVLLVISCPCGLVISIPLGYFGGIGGAAKHGILIKGSTFLDSLTAVKTVVFDKTGTLTKGTFKVTQVVTKNGFSESELLTLAAKAESHSTHPIALSIREAYAQSIADSEVADYEEIAGHGIRAVVQNQVVIAGNDRLLHREKIDHDTCDVAGTVVHLAVDGRYGGYILIADEIKEDAVQAIRDLKRMGVEKTVMLTGDSEIVAQSVAQQIGLDAFVAELLPEEKVDEIEQLLDPSGKAKLAFVGDGINDAPVIARADVGIAMGGLGSDAAIETADVVLMTDAPSKVAEAIHVARKTRQIVVQNIVLALGIKALFIALGTIGLATLWEAVFADVGVALLAILNATRIAK

SEQ ID NO: 2844 - protein, 790 aa, Synechocystis sp.
MVMNQNNRPYIIVTNQGQSLPPFELTKSKHILGRDSQFADLIVPTDWSIISRCQATLVEDQGNYFIYDGDRLNPSSNKLFINHHLITHDIGYPLQNGDVIKIGQNINILITIKYFTPNGSSPTNLTSLLSINLKQKSVVIGRDETANLQLLSSAVSRQHAVLDYLEPNTYLLHDYSTNGVYVNGTKVNGKILINTAAIIKIVPYTLVLQNDQLFIADTGDNIRLDARNIVRTVQGNQSEEITLLNQISLPIEPGQLVALVGGSGAGKSTFMRTLLGIEPTTSGTVYLNGEDLRNNFNLYRNQIGYVPQKDIIHSSLTVEEALRYAAKLRLPQDADIDEIVEKTLGQIEMQERRHVLVKKLSGGQLKRVSIGVELLVDPKLFFLDEPTSGLDPGLDKKMMQLLRKLADQGRTIVLVTHATGNINLCDRLVFLGQGGNLCYFGTFSDACQFFNLHNGDFADVYIQLDNQSAVIKAAQRYSRSSYQHQYIDQRLGVSNSAVAAPRPSPPRVSPLRQTWILCQRYWQIMARDPVNIGISIATAPIGILLIDLAIATREPFILGSEADPKLAPLAQTVLLVFSCAAIWVGLASSLQEIVKENDIYSRERLVNLNLFAYIASKVTVLSGLALLQTLAMVVIILIAFDHPQPPLLPWGLGLIITSYLTLFSSICLGLMVSTLVKSETQANTALPILLLPQIIFSGVLFQIKGVSQYLSWFMVSRWSIGAYGTLLDINSLVPEPVIFPDGTVLESPFKATLVYDPSWNNLLVNWEILLLQGFVCLVVIFLFKKREDII

SEQ ID NO: 2845 - protein, 945 aa, Synechocystis sp.
MKACCYFFISMPPSASFQGQPLITWHTLSADQVVSDLHGDRQQGLSQQQVAENLQVYGKNELIETGGRTSWNILVDQFTNIMLLLLIAVAVISAAIDIYQAQQLGKFIFPKDAVAIFTVVLLNGILGYVQERGAEKALAALKDLSTSRVRVIREGKTTEVESTELVPGDLILLEAGVKVPADGRILEGANLQIREAALTGEAEAVMKQGDVLLPADSALGDRLNLVYSGTEVVQGRGTVIVTATGMKTELGKIASALQSVEPEPTPLQKRMTQLGNVLVSGSLILVAIVVVGGTLFKPDLFMQLVEVSLSMAVAVVPEGLPAVITVTLALGTQRMAKRNALIRQLSAVETLGSVTTICSDKTGTLTQNKMVVQSIISDRHRLVVTGEGYNPVGEFQAGEGEDLKIENIPEIEKLLMACILCNDAILQKENGQWAILGDPTEGALLALAGKANIFKHEQEQYFPRITEFPFSSERKRMSVIVQDGQGKINTPDSYVMFVKGSPELILERCTHIQVGSEILPISKEKRSYILEKNNDLAGRGLRVLGFASKVWTTLPANTTDDIAEQELTWLGLVGMLDAPRPEVRDAVAKCRAAGIRPVMITGDHPLTAQAIALDLGIAEPGARVVTSRDLDNCSEKELAEIVHTVSVYARVSPEHKLKIVQTLRKQHEVVAMTGDGVNDAPALKQADIGVAMGITGTDVSKEASDMILLDDNFATIVSAVEEGRVVYTNIRRFIRYILGSNIGEVLTIAAAPLMGLGGVPLSPLQILWMNLVTDGVPALALAVEPGKATVMQQSPKDPQESIFARGLGSYMVRQGLILAIVTIVLMVWAYNYTPNHLEGGLSPNRWKTMVFTTLCLAQMGHALAIRSLTSLTVEMNLFSNPFLLVAVVVTSLLQLLLIYVEPLRAFFGTHYLPANELWVCVGFSALIFIWIELEKVSVRLYSSFK

SEQ ID NO: 2846 - protein, 428 aa, Synechocystis sp.
MAGSLFADASKRLEKALKYVAISDDAGERLKYPKTSLSVSIPVRMDDGSLKIFPGYRVRYDDTRGPGKGGVRYHPNVTMDEVQSLAFWMTFKCALLNLPFGGAKGGITLNPKELSRAELERLSRGYIEAIADFIGPDIDILAPDVYTNEMMMGWMMDQYSIIRRKISPAVVTGKPVTMGGSQGRNTATGTGAFYIMQGMLPKFDQYPENTTVAVQGFGNAGMVVAECLYQDGYKVVAISDSQGGIYNEQGIDIPAVIDYKQRHRTLAGMYCDQAICDLGENQQISNAELLALDVDVLIPAALENQITRDNADQVRARYIFEVANGPTTTAADDILASKGIYVFPDILVNAGGVTVSYFEWVQNRSGLYWSAKEVNDRLKEKMVEEAEHVWNITQELDVNVRTAAYIHALNRLSEAMDAKGTRDYYQDS

SEQ ID NO: 2847 - protein, 384 aa, Synechocystis sp.
MGTKRIGILTSGGDCPGLNAVIRAVVKASALKGWEVYGIPYGTDGFVEVAHGKYQAEDLLLTKHGYALPGMLKGLDVLQFLSGSVLGSLSKGHPEQPAIAEAILKGYAILDLEALIVIGGDGSLDIIYDLAQKGNWHIIAIPKTIDNDVPFTDLAVGFSTAVDIVTQALYDLTFTAASHERIIIVQVMGRDAGHLTLHAGIAGGADIILIPEITPCLTSEIIRNCCYQLMNLRKSGRHFALIVISEGVHDQNNKKNKHIADYLAEEISETSQHLCDIKDPAFCDLISLDIRATTLGHLQRSGTPLSFDRLLATVFGIRAVELIEQEIYDQVVIWRSGKVEHADLKPIISIIKECHQENRCPFPVDRDGFMVKTAKSLGIYLGED

SEQ ID NO: 2848 - protein, 720 aa, Synechocystis sp.
MSYSSKYILLISVHGLIRGENLELGRDADTGGQTKYVLELARALVKNPQVARVDLLTRLIKDPKVDADYAQPRELIGDRAQIVRIECGPEEYIAKEMLWDYLDNFADHALDYLKEQPELPDVIHSHYADAGYVGTRLSHQLGIPLVHTGHSLGRSKRTRLLLSGIKADEIESRYNMARRINAEEETLGSAARVITSTHQEIAEQYAQYDYYQPDQMLVIPPGTDLEKFYPPKGNEWETPIVQELQRFLRHPRKPIILALSRPDPRKNIHKLIAAYGQSPQLQAQANLVIVAGNRDDITDLDQGPREVLTDLLLTIDRYDLYGKVAYPKQNQAEDVYALFRLTALSQGVFINPALTEPFGLTLIEAAACGVPIVATEDGGPVDIIKNCQNGYLINPLDEVDIADKLLKVLNDKQQWQFLSESGLEGVKRHYSWPSHVESYLEAINALTQQTSVLKRSDLKRRRTLYYNGALVTSLDQNLLGALQGGLPGDRQTLDELLEVLYQHRKNVGFCIATGRRLDSVLKILREYRIPQPDMLITSMGTEIYSSPDLIPDQSWRNHIDYLWNRNAIVRILGELPGLALQPKEELSAYKISYFYDAAIAPNLEEIRQLLHKGEQTVNTIISFGQFLDILPIRASKGYAVRWLSQQWNIPLEHVFTAGGSGADEDMMRGNTLSVVVANRHHEELSNLGEIEPIYFSEKRYAAGILDGLAHYRFFELLDPV

SEQ ID NO: 2849 - protein, 389 aa, Synechocystis sp.
MVMETAFSRMDLVQSPVIPVVGQWIVDSPGTISLGQGVAFYPPPNEVAVAVRESLEQTPLHQYQPVAGIPSLISALTEKLRRDNDINLSSDQAVVVTAGANMGFLNAVLAITEVGDEIILNTPYYFNHEMAVRIAGCQPVLVPTDDQYQLQLDLIAQAIAPRTRAVVTISPNNPTGAIYPEADLRAVNQLCQERGIYHIHDEAYDYFAYDQTPIFSPEAMGDSGGHTISLYSFSKAYGMAGWRVGYMVIPLELLLAVKKIQDTNLICPVVVSQYAALACLRVGKNYSAQFLPEMAACRQQLLETLGQLSDYCRLVVPQGAFYCLLEVNSPLTDLELVKRLIDEFKVAVLPGSTFGVDSGCYLRIAYGALRQATASVAIARLEQGLKSIC

SEQ ID NO: 2850 - protein, 501 aa, Synechocystis sp.
MTVSPSYDAIVIGSGIGGLVTATQLVSKGLKVLVLERYLIPGGSAGYFEREGYRFDVGASMIFGFGDRGTTNLLTRALAAVGQALETLPDPVQIHYHLPGGLDPKVHREYEAFLQELIAKFPQEAQGIRRFYDECWQVFNCLNTMELLSLEEPRYLMRVFFQHPGACLGLVKYLPQNVGDIARRHIQDPDLLKFIDMECYCWSVVPADLTPMINAGMVFSDRHYGGINYPKGGVGQIAESLVAGLEKFGGKIRYGARVTKIIQENNQAIGVELANGEKIYGRRIVSNATRWDTFGALTGDQPLPGKEKRWRRNYQQSPSFLSLHLGVEADLLPEGTECHHILLEDWDDLEKEQGTIFVSIPTLLDPSLAPDGYHIIHTFTPSWLESWQNLSPQEYEAKKEADSGKLIDRLEAIFPGLDRALDYMEIGTPRSHRRFLGRQNGTYGPIPRRRLPGLLPMPFNRTAIPGLYCVGDSTFPGQGLNAVAFSGFACAHRLAVDLGVR

SEQ ID NO: 2851 - protein, 350 aa, Synechocystis sp.
MTEANDLPYLLRVARGEVVKRPPVWMMRQAGRYMKVYRDLRDKYPSFRERSENPDLAIEISLQPWQAFQPDGVIMFSDILTPLPGIGIPFDIIESKGPIIDPPIRTQAQVDQLHALDPESSLPFIKTILGTLRKEVGNQSTVLGFVGAPWTLAAYAIEGKSSKDYKVIKQMAFSEPAILHSFLDKIAEAIAVYVRYQIDCGAQVVQLFDSWAGQLSPQDYDTFALPYQQKVVKLVKEIHPDTPLILYISGSAGILERMGKSGVDIVSVDWTVDMADARQRLGKEMKVQGNMDPGVLFGSQDFIKERILDTVRKAGQGGHIFNLGHGVLVGTPEDNVRFFFETAKQVDQLL

SEQ ID NO: 2852 - protein, 333 aa, Synechocystis sp.
MGHKYDVYGMGNALVDMEFEVTPEQLASLGIDKGVMTLVEEARENELIAQLAQQRGKQSSGGSAANTLVSLAQLGGTGFYACKVGKDEAGAFYLQDLNDCGLDTNPHHETAGEGITGKCLVFVTPDADRTMNAFLGISGSLSVTEMDWSALKQSQYLYLEGYLVTSPSAKAACIEAKAIAEQSGVKTCLSLSDPNMAKFFQDGLKEMLGSGVDLLFANEAEALEMAGTSDLNQAIAYCKSIAKNFALTRGGAGSLIFDGENLLTIGTPKVQPIDTVGAGDMYAGGFLYGLTHGMDYEKAGQLASETAAKVVTCYGPRLDTEILQEILQSVQAV

SEQ ID NO: 2853 - protein, 469 aa, Synechocystis sp.
MLSTEMPLPTTGSTLLKTPASPSPNQNLLPLTAVINKNGELEIGGCSVPALVEQFGSPLYILDETTLRQAAQQYRQSFQAHYPGSSQVIYASKAWSCLAVVAIAAQEGLGFDVVSGGELFTTVSALKQLGWDEAEIAEKIYFHGNNKSVQELQEAIAINCTIIVDNWLELETLTKLAADSGAPVKIMLRLTPGIECHTHEYIKTGHLDSKFGFDPNQLEAVFTYIAQQPSLHCLGLHAHIGSQIFERQPHKDLGEVLVQWFTKGLTYGLPLTELNIGGGLGICYTESDDPPSIEEWAQVAAISVAKACDRQNIPYPKLIAEPGRSLVGSACVTAYRVGGRKVVPNIRTYISVDGGMSDNPRPITYQSVYRVALANRMNDEITETVTVAGKHCESGDILVKDVALPAAEPGDIMVVAATGAYNHSMASNYNRLGRPAAVLVNQGQANLILQRETYTDLLRQDCLPNRLLS

SEQ ID NO: 2854 - protein, 314 aa, Synechocystis sp.
METIRLGPNGPSIAPLGLGTWSWGDTLFWAYGKDFGPQEVEGAFHASLEAGVTLIDTAEIYGFGESERLIGRFCREKTQKVEIATKYFPLPWRWQRSDITKALTASLERLQMDTICLYQIHWPLEFWLKTPDFMAVLAAEVKKGRIQAVGVSNYSAQQMAIAHECLAAQGIPLASNQVPYSLLNREIESNGILTQARQLNVTILAYSPLAQGLLTGKYRPENSPSLQGARRLDPRFSTKGLRKLAPLLTLLDTLADKHDKTPAQIALNWLIAQGNVIPIPGAKNASQAQQNAGALGWQLNPEEIEQLRSAAQGI

SEQ ID NO: 2855 - protein, 308 aa, Synechocystis sp.
MGIKALAGRDLLAIADLTIEEMKSLLQLAADLKSGVLKPHCRKILGLLFYKASTRTRVSFTAAMYQLGGQVLDLNPSVTQVGRGEPIQDTARVLDRYIDILAVRTFKQTDLQTFADHAKMPIINALSDLEHPCQILADLQTIKECFGKLEGLTVTYLGDGNNVAHSLILGGVMMGMTVRVATPKNYEPLAEIVQQAQQIAAPGGKVELTDDPKAAAQGSHILYTDVWASMGQEDLADSRIPIFQPYQINQELLALADPEAIVLHCLPAHRGEEITDAVMEGPQSRLWDQAENRMHAQKALMVALLGLV

SEQ ID NO: 2856 - protein, 377 aa, Synechocystis sp.
MPGDYYQTLGVTRDADKDEIKRAYRRLARKYHPDVNKEPGAEEKFKEINRAYEVLSEPEIRQRYDQFGEAGVSGGGAQGFDVGNMGDFADIFETIFGGFGGGMGGQQRGRRRANGPTRGDDLRLDLQLTFQEAIFGGEKEIRIPHLESCQVCEGTGAKPGTGVKTCGTCNGAGQVRRATRTPFGSFAQVSACPTCNGSGEVIEQKCEACNGVGRKQETKKLKITIPAGVDDGTRLRVGKEGDAGLRGGPAGDLYVFLMVETDKHFVREGMNIRSNLEVSYLQAILGCRLEVDTVDGKAELTIPAGTQPNTVLTLENKGVPKLGNATIRGDHLITVKVQIPTRINSEERELLERLATIKGESHGKGGLEGFLGGLFHK

SEQ ID NO: 2857 - protein, 445 aa, Synechocystis sp.
MPKYDSHLKCSFCGKSQEQVRKLIAGPGVYICDECVELCNDILDEELLDVPPASTGERDGTGQKQKKSGQPRRRLTLEELPKPTAIKQYLDEYVIGQDEAKKVLSVAVYNHYKRLNLLERNQEIDPGDAVELQKSNILLVGPTGSGKTLLAQTLAKILEVPFAVADATTLTEAGYVGEDVENILLRLLQVADLDVEEAQRGIIYIDEIDKIARKSENPSITRDVSGEGVQQALLKMLEGTVANVPPQGGRKHPYQDCIQIDTSNILFICGGAFVGLEKVIEQRFGKKSMGFVRPGEGPSKEKRTADVLRQAEPDDLVKFGLIPEFIGRIPVMACLNPLDEDALIAILTQPRNAIVKQYQTLLGMDHVELDFQPDAVRAIATEAHRRKTGARALRGIVEELMLDVMYELPSREDLTHCLITREMVEKRSTAELLLHPSSLPKPESA

SEQ ID NO: 2858 - protein, 280 aa, Synechocystis sp.
MDGSAFKGCDLVLASAGGSTSKRWAEEITKAGAVMVDNSSAFRMVPEVPLVVPEINPEAAQNHQGIIANPNCTTILMGVAIYPLHQLQPIKRIVVATYQSASGAGAMAMEEVKHQSRDILEGKIPQAEILPYPLAFNLFPHNSPITANHYCEEEMKMVQETRKIFAAEDIRITATCVRVPVLRAHSEAVNLEFATPFPVELAKTAIAKAPGVKLVEDWQKNYFPMPMDATGQDDVLVGRIRQDISHPNGLDLWLCGDQIRKGAALNAVQIAELLVERGWL

SEQ ID NO: 2859 - protein, 301 aa, Synechocystis sp.
MADFVSTSPFGPVLTAMVTPFNADGGVDYGVAEKLADHLITHGSDGLVVCGTTGESPTLSWEEEHELFRVVKQTVGDRGSVIAGTGSNCTREAMEATQIAAKLGVDGSLQVVPYYNKPPQEGLLAHFQAIANCAPELPLMLYNIPGRTGQSLAPETVYRLAEVENIVAIKEATGSLEQASLIRAHTPDDFAIYAGDDVLTLPLLAVGGAGVVSVASHLVGDRLQAMVQHFAQGATAQALEIHLQLIPLFKILFCATNPIPVKTALGLQGWPVGSFRPPLCALSPGHTEQLRDVLRDLALLP

SEQ ID NO: 2860 - protein, 294 aa, Synechocystis sp.
VWPALGFGFAELGAVTKYAQPGNDRPRLFRLPQDQAVLNRLGANNEGAVAMAAKLKHTWDYYPRTIPIGINLCKSKITPLDQAVEDYVFSFQTLAPVADYFVVNVSSPNTPGLRSLQESDELPRIFAGLQSANHWQKPLLVKISPDLSWEAIAVIIDLVKEHNLSGIVATNTSTRRSGLKTKILPQTGQPIEQEAGGLSGQPIRDRATEVIRYIYQQTGGTIPIIGVGGIFTAEDAWEKIQAGASFLQIYTGWIYGGPWVVSDILQGLGEKLAAGGFSHISEAVGIDTIGKAPE

SEQ ID NO: 2861 - protein, 425 aa, Synechocystis sp.
MEKVDQAKLFLGLDFGTSGARAAVIDQNKELIWQEKVQFSQVPGPQLVTIWRESLFHLLDQIPDELSSQIQAIAIDGTSSTVLLLDSQGNGLMEPLLYNDDRGKEVKHLLSAIAPADHLVQSATSSLAKLLWYSQQPEFERANYFCHQADWLASLLHGGRPVSDYHNALKLGYNPHNLTYPDWLKNASWFALLPPVIAPGKAISRLSPSIANAEKFPKNYLVCAGTTDSIAAFLASGATQPGEAVTSLGSTLVLKLLSEKPVTDLASGIYSHRLGDLWLTGGASNAGGAVLQHYFSSTQLTALSAKINPHQPSDLDYYPLLQPGERFPINDPNLLPRLEPRPENDAIFLQGLLEGLARIEAQGYEKLQKLGATTLTKVFTAGGGAQNLTWQTIRQNLLQVPVQKSVQSEAAYGSACLARSSKSWE

SEQ ID NO: 2862 - protein, 869 aa, Synechocystis sp.
MSFLTFDTESNQRKSFELPGAKPHYNPDRPGQVNHIFLDLKINLEERHLQGVCRIALTPVRAGIEQLTLDAVDLKIAWVLIKGVSQSFDYDGEKLTINPLQPLGTEPVTLEIQYELKNPRRGIYFIQPDRHYPDKPVQVWTQGEDEDSRYWFPCFDYPGQLATSEIRVQVAKPHRVISNGSLIEQKDLGNEQIFHWSQSQIHPTYLMTLAIGDFAEIVDHYGDLPVRYYVEKGREADGQRSMGKTPRMIEFFNQTFGYPYAYPNYDQVCVADFIFGGMENTSTTLLMDRCLLDERAALDNRNTESLVAHELAHQWFGDLVVVKHWSHAWLKEGMASYAEVLWTDHEYGQDEAAYYLLGEARNYLAEDSSRYRRPIVTHVYREAIELYDRHLYEKGACVYHMIRAVLGDELFFRAVHTFVNDHAHGTVETVDLLRAIEKATGFNLLWLFDQYVFRGGHPEFKVSYSWDNDNKLAKLTVTQTQAKANSDHKDLFNLKIPVAFNFLDGEKVTSQVIPLQLKEREQVFYFPLTRKPDFISFDQGNNFLKTVELAYPLTELKAQCTHDPDPIARIQAAIAIGKQGGLEAVEFLGERLQKEAFWGVRVEIAEQLAGINLEQAGTALINGLDKNDHPKVRRAIISALAKVKTEASYEALKKCLTQGETSYYAEAAAATALGALGTGLLKNNEGEIIQQLTEVLKNRSGWNEVVRCGAIAGLSQLTTSAQAVDAILAYTANGTPQPLRLAAIRALGAVSIGQSPEKLTEILERLTAIAQEEFFLTQVSVTSALGQMETPKAIDISQNLANQTPDGRVRRMAEEAVKKVQAKIGSDEKIKNLQTNLEKLQQENQDLQSRLAKLETVIKASTDTSVTNL

SEQ ID NO: 2863 - protein, 337 aa, Synechocystis sp.
MTRVAINGFGRIGRNFLRCWLGRTDSQLEVVGINDTSDPRTNAHLLRYDSMLGKLDADISADENSITVNGKTIKCVSDRNPLNLPWAEWNVDLVIEATGVFVTHEGATKHVQAGAKKVLITAPGKGPNIGTYVVGVNAHEYKHEEYEVISNASCTTNCLAPIAKVINDNFGIIKGTMTTTHSYTGDQRILDASHRDLRRARAAAVNIVPTSTGAAKAVALVIPELQGKLNGIALRVPTPNVSVVDLVVQVEKNTIAEQVNGVLKEAANTSLKGVLEYTDLELVSSDFRGTDCSSTVDGSLTMVMGGDMVKVIAWYDNEWGYSQRVVDLAEIVAKNWK

SEQ ID NO: 2864 - protein, 553 aa, Synechocystis sp.
MGANQFDVVVVGSGAAGLYACLCLPGHYRVALVTKAELKTGASDWAQGGIAAAIAPTDSPQSHYEDTLAAGAGLCDGEAVDFLVNHAPQAIAELVQFGVSFDRHGQHLALTLEAAHSQPRVLHAADTTGRAIVSTLMGQVQARPNVEIFSQAIALSLNIEPTTGHCRGIQVFVNQTIETFHSRAVLLATGGGGQVFAQTTNPKVSTGDGIALAWRSGAQVRDLEFFQFHPTALTKPGVPHFLISEAVRGEGAHLLDRQGKRFAFDYHPRGELAPRDVVSRAIFQHLANTEKDPTQATVFLDLSPIEPERIQRRFPNIIRRCLHWGVDIFREPIPVAPAAHYWMGGITTDINCQTTIPGLYALGETASTGVHGANRLASNSLLECIVFASQLRNLSLPPLASSDSNVNQSIKEIRLDTTNDLALLNHWRSELPRLMWQTAGICRQAETLQMAIAKLEQWQEQWQQLSSSKLLAHLPEDQKISLSGPGLNEFMQLWAETHNLLDIAQLILTSALFREESRGGHYRLDCPDTKREWQSHTVIEGTRVFLQPSQSQD

SEQ ID NO: 2865 - protein, 600 aa, Synechocystis sp.
MALIVQKFGGTSVGTVERIQAVAQRIKRTVQGGNSLVVVVSAMGKSTDVLVDLAQQISPNPCRREMDMLLSTGEQVSIALLSLALQEIDQPAISLTGAQVGIVTEAEHSRARILEIRPDRLEHHLREGKVVVVAGFQGISSVEHLEITTLGRGGSDTSAVALAAALKADFCEIYTDVPGILTTDPRLVPEAQLMAEITCDEMLELASLGAKVLHPRAVEIARNYGIPLVVRSSWSDEPGTKVVAPPVQNRSLVGLEIAKAVDGVEYDADQAKVALLRVPDRPGVASKLFRDIAQQQVDIDLIIQSIHDGNSNDIAFTVVKDLLNTAEAVTSAIAPALRSYPEADQEAEIIVEKGIAKIAIAGAGMIGRPGIAAKMFKTLADVGVNIEMISTSEVKVSCVIDQRDADRAIAALSNAFGVTLSPPKNQTDTSHLPAVRGVALDQDQAQIAIRHVPDRPGMAAQLFTALAEANISVDMIIQSQRCRINQGTPCRDIAFMVAEGDSSQAEAILQPLIKDWLDAAIVVNKAIAKVSIVGSGMIGHPGVAAHFFAALAQENINIEMIATSEIKISCVVPQDRGVDALKAAHSAFNLAGTKTVTVPA

SEQ ID NO: 2866 - protein, 713 aa, Synechocystis sp.
MVYPQTFFLRLKPFRFSITMTHTAVANPLLQGRDLPAFDKIQPTDVEPAVTTLVQELEAQLTELEKSVQPTWEGLVEPLTALEEKLSWTWGTVSHLMGVKNSPELRHGFEQVQPLVVGFISRLGQSRPLYEAFVALRDSAEWGNLEPAQQRIVESNIREAELGGVGLTGEKRDRFNAIQLELAELATKFSNNVLDASQAFELKLTTKEEIAGLPPSLLALAAQTAQQKGEDNATPEEGPWLITLDYPSYLPFMKYSQREDLREKVYRAFIRRAADGQWDNHPLIERILALRLEKAQLLGFETYAELSLSRKMAPNVAAVEKLLEELRVPSYKAAEQEFADLQKFAGVEELHHWDTAYWSERQREQEFDFDAEALRPYFPLPQVLEGLFALAKRLFGVTIQASEEEVPVWHPDVQFFRVLDESGTAIASFYLDAYSRPAEKRGGAWMADCLNRGQELINGQKSLRLPVAYLICNQTPPVGDQPSLMTFYEVTTLFHEFGHGLQHLLTTVNYSGAAGINNVEWDAVELPSQFMENWCYDPTTLFSLAKHYQTGETLPQAEYEKILATRNFMTGSAMLRQINFSLLDLELHHRYRPDGPETIEQIGDRLAKITTILPPLPENAFLCSFGHIFAGGYAAGYYSYKWAEVLSADAFAAFEEVGLDNEAAVQTTGKRFRETVLALGGSLAPAVVFEKFRGRQPQTAPLLRHNGLLPSAT

SEQ ID NO: 2867 - protein, 267 aa, Synechocystis sp.
MSIQLGIIGGGVMAEAILARLIAEKTYAPEEIIVGEPHGARRDYLQKTYQVRVSPDNQEAANVSEVLLLAVKPQVLDRVLASLAGGANRPLVISILAGVSLQRIQKGFPDHAIIRAMPNTPATVGAGMTAIAANKMVEPDQLAKAKAIFSAVGNVVEVPENLMDAVTGVSGSGPAYVALMIEALADGGVLAGLPRAIAQKLALQTVLGTAELIKETEEHPAQIKDKVTSPGGTTIAGVAVLEKMGFRSAIIEAVRAAYRRSQELGKK

SEQ ID NO: 2868 - protein, 695 aa, Synechocystis sp.
MEGQSIELELSVMAMPELIDSTEAGHTAGVKTDSNPQAIAQDRRWTIDDSENLYRITGWGEPYFSINAAGHVTVSPQADHGGALDLYELVKGLRQRNIGLPLLLRFSDILADRINRLNAAFARGIARYRYPNTYRGVYPIKCNQHRHIVESLVRYGTPYNFGLEAGSKPELMIALAMLQPQENPEPDQQNQPLLICNGYKDREYIETALLARRLGHRPIIVVEQVAEVALAIEISSNLGIKPILGVRAKLSTQGMGRWGISTGDRAKFGLTIPEMLTAIEQLRRADMLDSLQLLHFHIGSQISSISVIKEAMTEASQIFVQLAKLGANMRYLDVGGGLGVDYDGSKTNFYASKNYNIQNYVNDVISAVQDACVAAEVPCPVLISESGRAIASHQSVLIFDVVATNDINPPLPKVKGKDHAILRNLMETWETITVDNYQEAYHDVEQFKTEAISLFNFGYLGLKERAKAEELYWACCRKILQICRQQEYVPDDLENLEVNLASIYYANMSVFQSAPDSWAIDQLFPIMPIHRLDEEPTQRGILADITCDSDGKIDQFIDLRDVKSVLELHPLIEVHQPGTPPRVEPYYLGMFLVGAYQEIMGNLHNLFGDINVVHIQMNPKGYQIEHLVRGDTIAEVLGYVQYDPEDLLENMRRYCEQAMEDKRMSLEEAQLLLENYERSLLQYTYLKPTSGIHTS

SEQ ID NO: 2869 - protein, 424 aa, Synechocystis sp.
MWLIRRRPGKGAQPWIRLQGLNFFPLRPNGPIPATLQYIIMPIAAAKPALLVLADGTPYPGWSFGADGTTVGEVVFNTGMTGYQEVMTDPSYCGQIVTFTYPELGNTGVNAEDEESIHPHVKGVVARNITRRPSNWRSTQSLPDYLVEHKIIGIYGIDTRALTRKLRSIGAMNGGISTEILEPEALLHHIQAAPSMAGLNLVKEVTTHEVYEWTDSTNDHWQFGPVAEQQGQPPLTVVALDFGVKRNILRRLASYGCRVIVVPASTSAAEILQYNPDGIFLSNGPGDPSAVEEGIVTTKELLAAKKPMFGICMGHQVLGLSLGAETFKLKFGHRGLNQPCGLEQQVEITSQNHGFAVTEGSLAEEVEITHFNLNDKTVAGLRHKELPFFSVQYHPEASPGPHDADYLFEKFVKLMRQQKAEVAG

SEQ ID NO: 2870 - protein, 290 aa, Synechocystis sp.
MPSITGKTKLLGVIGYPVGHSLSPVMHNAALQAMASDYAYVAFPIAPEDLTIAIAGLGASGVQGLSVTIPHKQVVMPLLTQITETARQVGAVNTLWRDGHGWQGTNTDVEGFLAPLLELKQDWSGRTAVILGYGGAARAVVVGLTQLGCPEIIVVGRSQEKLAQFANSWTDPKIKQALQVLPWEALSTVIPKASLLINSTPVGMAPHPKQSPLDQSLVEKLPPTAIAYDLIYTPRPTRFLQHAQERGLVTIDGAEMLVQQGAAALKIWLQQEVPVDVMRQALLHHLEKSA

SEQ ID NO: 2871 - protein, 348 aa, Synechocystis sp.
MNNYFPRLKQFSAPATFFLTVACLVYPGENAHANASTPNPYTVAQTTASPSVAVENLSGFQGIITALNITPDGKYLAVATADNQITLIDLANQEVVYSQRSPVNNFADLAISADGQWLAIAADNNVDVRRVRDGMRVETLVGHTDKVSGVAFSPDGETIVSVSGGDRTIRIWERASGNLIQTLADNLGPTTSVVFTPDGSQFITGAIGQDRTIKFWDANTFELLGTSPQQPGFINGLAVTPDGRKLVGAVRNFVKAWNLADAKELFSVRGPSLEINTIAVSPNNRWVATANKEGTIMIFDLANGKQVTTLRGHQGWVLSLAFSPDGNTLYSGAEDKTVKIWDLSALAR

SEQ ID NO: 2872 - protein, 469 aa, Synechocystis sp.
MTVAQQAPSALNFDCETGNYHTFCPISCVSWLYQKIEDSFFLVIGTKTCGYFLQNAMGVMIFAEPRYAMAELEEGDISAQLKDYEELKRLCLQIKRDRNPSVIVWIGTCTTEIIKMDLEGLAPQLEAEIGIPIVTARANGLDYAFTQGEDTVLASMAHKCPTSAQVQGEDKEERNAIQKLLTFGRKADQEKVESEYVDHQPLVLFGSLPDPVVTNLTLELKKQGVKVSGWLPAKRYTELPVIDEGYYVAGVNPFLSRTATTLMRRRKCKLIGAPFPIGPDGTRAWIEKICSVLGIEPQGLEEREAQIWASLEDYIQLIRGKSVFFMGDNLLEVSLARFLIRCGMTCPEIGIPYMDKRYQAAELALLEKTCSDMGVPLPNIVEKPDNYNQIQRIKALQPDLVITGMAHANPLEAQGINTKWSVEFTFAQIHGFTNARDILELATRPLRRNSQLGELGWDKLIAKDVPAQV

SEQ ID NO: 2873 - protein, 432 aa, Synechocystis sp. [sequence omitted]

SEQ ID NO: 2874 - protein, 567 aa, Synechocystis sp.
MSKPLIAALHFLQFLYMTSRINPLAGQHPPADSLLDVAKLLDDYYRQQPDPENPAQLVSFGTSGHRGSALNGTFNEAHILAVTQAVVDYRQAQGITGPLYMGMDSHALSEPAQKTALEVLAANQVETFLTTATDLTRFTPTPAVSYAILTHNQGRKEGLADGIIITPSHNPPTDGGFKYNPPSGGPAEPEATQWIQNRANELLKNGNKTVKRLDYEQALKATTTHAHDFVTPYVAGLADIIDLDVIRSAGLRLGVDPLGGANVGYWEPIAAKYNLNISLVNPGVDPTFKFMTLDWDGKIRMDCSSPYAMASLVKIKDHYDIAFGNDTDGDRHGIVTPSVGLMNPNHFLSVAIWYLFSQRQQWSGLSAIGKTLVSSSMIDRVGAMINRQVYEVPVGFKWFVSGLLDGSFGFGGEESAGASFLKKNGTVWTTDKDGTIMDLLAAEITAKTGKDPGLHYQDLTAKLGNPIYQRIDAPATPAQKDRLKKLSPDDVTATSLAGDAITAKLTKAPGNQAAIGGLKVTTAEGWFAARPSGTENVYKIYAESFKDEAHLQAIFTEAEAIVTSALG

SEQ ID NO: 2875 - protein, 733 aa, Synechocystis sp.
MVSLKQNLLGVKNRITCMAKYQWVQQQSGEDCAAASLAIIAKHHGRNIRINRIRALVGTRQGGTTLLGLKYGAQELGFITSAIQAEPEILDELDEWALPAIIFWKGYHFVVLYGQEKDKYVIADPAIGVRYLDRQEVIKGWQGGMMLLLEPDPKGFISQLDEDPVHPVDNLLKRLWEYREIFGKLFPLNLAVGIFSLSTPLLLKFLTDSVLTKSDTQKLTWVAIGVILITVVNAICSFLQSNLVASFAEELQKGLKLEFGLQILNLPITYHEARRSGTAIRRLSDIQRINLLVSQLVIDLPIKTFIGLVALGFIVFYSWQLAAIVAAIGGIMTLSTIAFQPIVRQTTYRSITMAGENAGLLAESFNGALATKTTAASPQLWLEIQHRLQREFKLNYRTAQIRIINNTFSQLMAGIGTVIMLWYGSVLVFGNQLSIGQLIAIYGLQQSFLLLITTLVQFFTDFTQVKAITRLLAELFEYEPENQGDDLKDPIEISPQDDIDCQNISFYYPGRVKLIEDLSVTIPGGKVVGLIGKSGCGKSTLAKILTGLYSVQAGEINIGNHSLGDFSLICLRKQVVLVSQDAFFFHRSIIDNFRLSSPDITLEQVISACQIAQAHEFVSQFPEQYETILGAVAANISGGQKQRLAIARAIVNDPAVLILDESTANLDPVTEAEVLNSLLTKRQGKTTILISHRPKVINCADWIIFLESGKVKFSNTIKKFRSEFGNASDFLSP

SEQ ID NO: 2876 - protein, 279 aa, Synechocystis sp.
MALSFSKYHGLGNDFILVDNRQSTEPCLTPDQAQQLCDRHFGIGADGVIFALPGQGGTDYTMRIFNSDGSEPEMCGNGIRCLAKFLADLEGVEEKTYRIHTLAGVITPQLLADGQVKVDMGEPQLLAELIPTTLAPAGEKVVDLPLAVAGQTWAVTCVSMGNPHCLTFVDDVDSLNLTEIGPLFEHHPQFSQRTNTEFIQVLGSDRLKMRVWERGAGITLACGTGACATVVAAVLTGRGDRRCTVELPGGNLEIEWSAQDNRLYMTGPAQRVFSGQAEI

SEQ ID NO: 2877 - protein, 1006 aa, Synechocystis sp.
MKTLAYANPADLFAFPLDDFQQEAIAALDQDQSVVVCAPTGSGKTVVGEYAIYRAIARGKRVFYTTPLKALSNQKIRDFQEKLEKLGLENAAQLVGLITGDTVINADAPVVVMTTEIFRNMLYETPIGEVGTSLEDVETVVFDEVHYISDRGRGTVWEESIIYCPSTIQLVGLSATIGNPEQLTEWINQVRTGVSLKVLRQGEQRNDSPPCVLVNSDFRPVPLTFHYSTRKGLFPLLNEKKTGVNTRLLPKAGNKNTRSGKNRRMRREDCPYPLLVMQQLQERNLLPVIYVIFSRRGCEQAAQSLEDLSLVEPAEQESIQLQLLDFFFGKNPLLRQKLERDLANGLPDLVQAVVAYLDHPQDSEAAQRLLTALAIDPEGMFKLWGWIAQSSPMTRFEQIEPLLRGIAVHHAGILPDMKTLVEKLFEQGLIKVVFATATLSAGINMPARTTVISALSKRTNEGHAMLSPSEFLQIAGRAGRRGMDTEGHVITVQTPFEGANEASYLALAEAEPLKSWFTPSYGMVLNLLQKHDLEEVKSLLERSFAEYLAQFALEPTKVAIAETVKKLSQLDIKLAGIGEKDLRSYEKFRGRLREEQRLLKILEEQAEKERKQQLKDQLKTLAPGQLLYLKGRHVKIHQPRLAVIVAPLAPAHNLPQWCCLGSDNRWYHVTVGDIYAVPIGNLSPAQWQHLTPPPAELLAPGKSVKGDEETLAIAAGLDPQTYPLEPSPELVEQQARVDHVEKLLAVHPLASQKHPGKLLEQFHQRQELRKTLSKRQQEYDRLQSRQSYYWQEFLDLIDILQEMEALEEYTPTLLGEVAATLRGENELWLGLALISGKFNDLEPEQLAAAASALITETPRSDAWTDFKPSPVVLAALRPSNDLFGLLFCLKHPQPPLALWQAMTVADHLQRLNLWDLRRKLIKAQNQRAIAIPLWLEVDFMGLVEQWALGMEWENLCRQTSLDEGDLVRLFRRTVDLLWQIPQVPHLSPRLKRNARIAVQQMKRFPL

SEQ ID NO: 2878 - protein, 658 aa, Synechocystis sp.
MAVLEKGNITIHTENIFPIIKKSLYTDHEIFLRELISNAVDAISKRKMAAFASDGSGEVPDPQITLVVDKVNKTLSITDNGIGMTADEVKKYINQVAFSSAEEFIEKFQKSANDLIGHFGLGFYSAFMVSQKVEIDTLSYQEGAQAVHWSCDGSPEFELTDSDRQQVGTTVTLTLLDDEQEYLETGRIRQLVKTYSDFMAVPIRFEGETLNKQRAIWKESPQNLTKEDYLEFYRYLYPFQEDPLLWVHLNTDYPFLLNGILYFPKLRPDVDVSKGQIKLFCNQVFVSDHCEEVIPEFLMPLRGVIDSPDIPLNVSRSALTNHRTVRRIADYIAKKVGDRLKSLYDENPAEYLKCWEDIGTFVKFGSLREDKFKQQVEDLLLYRTTYKATAESTEPKVEVLTEDGDAWAETNQSDGVNPYEKEGYTSLKRYLERNKERHENRVFYCTDQATQATYVELYKNQGIEVLFMDSFIDTNYFIPFLEKEYSDVKFSRVDSELDQSLIEEDKASDIVDPATNKSRSEQIKEIFEKALNNPNINIKTQSLKSDDPQSTPPAMVLLPEAMRRLQEMTAMMQQQAMAFPEQHVLAINTNHPLIKNILSLSQGGIVTGSGESPSAELAKSLCQHVYDLALMAQKGFDAEGMKGFIERSNAVLTRLTKQ

SEQ ID NO: 2879 - protein, 439 aa, Synechocystis sp.
MCCWQSRGLLVKRVLAIILGGGAGTRLYPLTKLRAKPAVPLAGKYRLIDIPVSNCINSEIVKIYVLTQFNSASLNRHISRAYNFSGFQEGFVEVLAAQQTKDNPDWFQGTADAVRQYLWLFREWDVDEYLILSGDHLYRMDYAQFVKRHRETNADITLSVVPVDDRKAPELGLMKIDAQGRITDFSEKPQGEALRAMQVDTSVLGLSAEKAKLNPYIASMGIYVFKKEVLHNLLEKYEGATDFGKEIIPDSASDHNLQAYLFDDYWEDIGTIEAFYEANLALTKQPSPDFSFYNEKAPIYTRGRYLPPTKMLNSTVTESMIGEGCMIKQCRIHHSVLGIRSRIESDCTIEDTLVMGNDFYESSSERDTLKARGEIAAGIGSGTTIRRAIIDKNARIGKNVMIVNKENVQEANREELGFYIRNGIVVVIKNVTIADGTVI

SEQ ID NO: 2880 - protein, 336 aa, Synechocystis sp.
MIKAYAALEANGKLQPFEYDPGALGANEVEIEVQYCGVCHSDLSMINNEWGISNYPLVPGHEVVGTVAAMGEGVNHVEVGDLVGLGWHSGYCMTCHSCLSGYHNLCATAESTIVGHYGGFGDRVRAKGVSVVKLPKGIDLASAGPLFCGGITVFSPMVELSLKPTAKVAVIGIGGLGHLAVQFLRAWGCEVTAFTSSARKQTEVLELGAHHILDSTNPEAIASAEGKFDYIISTVNLKLDWNLYISTLAPQGHFHFVGVVLEPLDLNLFPLLMGQRSVSASPVGSPATIATMLDFAVRHDIKPVVEQFSFDQINEAIAHLESGKAHYRVVLSHSKN

SEQ ID NO: 2881 - protein, 400 aa, Synechocystis sp.
MGRAKKVVLAYSGGVDTSVCIPYLMHEWGVEEVITLAADLGQGDELGPIQEKALRCGAVESLVIDGKEEFVKEYAFRSIQANALYENRYPLSTALARPLIAKMLVEAAEKYGADAVAHGCTGKGNDQVRFDISIMALNPNLKVLAPAREWKMSREETIAYGERYGVESPVKKSSPYSIDRNILGRSIEAGPLEDPMTEPTEEIYLMTKAIADTPDEPEYVDIGFEKGIPVSLNGVMLDPVTLVERLNEIAGNHGVGRLDMVENRVVGIKSREIYEAPALLVLIDAHRDLESLTQTADVTHYKNTVEEIYSQLIYRGLWYSPLKEALDAFIVKTQERVTGMVRVKFFKGNANVAGRKSDYSIYDAELATYGMEDQFDHKAAEGFIYIWGLPTKVWAQKMRG

SEQ ID NO: 2882 - protein, 355 aa, Synechocystis sp.
MVVSTVNPTAPMPVTPIFNPTGNDSVENRTIWFGNTTNLMQLNDVRYNWAVGLYQQMRENFWIPQRLDITQDVTDYWNLTNEERYAFDGILSYLTFLDSVQTCNIPHLKSSVTAPEISLCMAEQISQEGMHNQSYQYMIETIIPTEKRDKVYEFWRTDRVLKERCEYIAMLYQKYVDHPTQENYFIALMADYLLEGLYFYNGFIYFYNLASRMLMPGSADIFKMINRDELSHVRLYQKLIPEAMQVFTHSTDQIYEMFDKAVEFECRWTNHIVGNNILGITESSTEQYTKYLANSRLRAIGLDPLYTDARYGKSPYTHLERFSDTKKEAHTKANFFEATVTSYVMSSGVSGWDEI

SEQ ID NO: 2883 - protein, 230 aa, Synechocystis sp.
MSSRSAGRNSPILPLMSHSDLPLANAVPLDKIRYNDQGLVPAIAQDYLDGTVLMLAWMNEAALAKTLATGQVWYWSRSRQELWHKGATSGHFQKLLGIRYDCDSDALLLTIEQKGDIACHTGERSCFHQLDGHKSPPPADMLTELARVIGDRRDHPTPESYTCKLLAGGDNKILKKIGEESAEVVMACKDDDPEAIAGEVADLFYHTLVALAHHNVDLRAVYRKLGDRRR

SEQ ID NO: 2884 - protein, 650 aa, Thermotoga maritima
MTVQQFIKKLVRLVELERNAEINAMLDEMKRLSGEEREKKGRAVLGLTGKFIGEELGYFLVRFGRRKKIDTEIGVGDLVLISKGNPLKSDYTGTVVEKGERFITVAVDRLPSWKLKNVRIDLFASDITFRRQIENLMTLSSEGKKALEFLLGKRKPEESFEEEFTPFDEGLNESQREAVSLALGSSDFFLIHGPFGTGKTRTLVEYIRQEVARGKKILVTAESNLAVDNLVERLWGKVSLVRIGHPSRVSSHLKESTLAHQIETSSEYEKVKKMKEELAKLIKKRDSFTKPSPQWRRGLSDKKILEYAEKNWSARGVSKEKIKEMAEWIKLNSQIQDIRDLIERKEEIIASRIVREAQVVLSTNSSAALEILSGIVFDVVVVDEASQATIPSILIPISKGKKFVLAGDHKQLPPTILSEDAKDLSRTLFEELITRYPEKSSLLDTQYRMNELLMEFPSEEFYDGKLKAAEKVRNITLFDLGVEIPNFGKFWDVVLSPKNVLVFIDTKNRSDRFERQRKDSPSRENPLEAQIVKEVVEKLLSMGVKEDWIGIITPYDDQVNLIRELIEAKVEVHSVDGFQGREKEVIIISFVRSNKNGEIGFLEDLRRLNVSLTRAKRKLIATGDSSTLSVHPTYRRFVEFVKKKGTYVIF

SEQ ID NO: 2885 - protein, 256 aa, Thermotoga maritima
MLEGKVAVVTGGGQGIGAAIAQLFAENGMKVVIAEIDEEAGVEREEMLRERGLDVTFVKTDVADENSVKNMVRKTVEIYGGVDVLVNNAAVMSVKSIFERPLEEWERVIRVNLTGPYICSRYCAEEMIKRGGGVIINIASTRAFQSEPDTEPYSASKGGLVALTHSLAVSLSRYHIRVVSISPGWIETSEWKKKSLRKKPDLRPIDHEQHPAGRVGNPLDIAHLCVFLADDEKAGFITGTNFIVDGGMTVKMIYEE

SEQ ID NO: 2886 - protein, 516 aa, Thermotoga maritima
MERCSVLRIKRLPESLVRKIAAGEVIHNPSFVLKELVENSLDAQADRIVVEIENGGKNMVRVSDNGIGMTREEALLAIEPYTTSKIESEEDLHRIRTYGFRGEALASIVQVSRAKIVTKTEKDALATQLMIAGGKVEEISETHRDTGTTVEVRDLFFNLPVRRKSLKSSAIELRMCREMFERFVLVRNDVDFVFTSDGKIVHSFPRTQNIFERALLILEDLRKGYITFEEELSGLRIKGIVSSREVTRSSRTGEYFYVNGRFVVSEELHEVLMKVYDLPKRSYPVAVLFIEVNPEELDVNIHPSKIVVKFLNEEKVKKSLEETLKRNLARKWYRSVAYEEISSRALSVAEAPSHRWFLVKGKYAVVEVEDGLLFVDLHALHERTIYEEILSKKSWGKRRVKRNITVVLSREEKQKLEEYGFSFQGEEGALKVIEIPEFLTEDVVEEFFRDFPVDEKLKERIALAACKLATKSGEFDEEIASKLLDVFFKKRFERCPHGRPISFKISYEDMDRFFER

SEQ ID NO: 2887 - protein, 120 aa, Thermotoga maritima
MILVKKFSFEAAHNLTRYLGKCERLHGHTYRLVVKIEGPLNEEEMVMDFAELKKIVEELVISKLDHSYLNDMFDQPTTERVAIWIWDQLSKEMEKRGVRLHEIELWETETSGVVYRGEKV

SEQ ID NO: 2888 - protein, 581 aa, Thermotoga maritima
MILSPEKFLLRYAKKYWYLFLVGTVLSLILTVMEILPPRLMKTAIDKFLVESTLSSFERLNGIVITAFIILGIRVLSFLVGFASSYVTGYAGSRIVLLMRKDVFSHVISLPYSFFTGIPSGVVTTRIVNDTQNIQEFFSSVVTSVIMDVLLLGAVVVSLVQLSRELFGHVYYLLPLIVISILLFRYFDRRAYRKVRTNLARLNAFLAEHIAGINVTKILNLEKHKEREFSTVATEYYRSLMEQLYVFGVFRPLMDFLYFLGVSLVLWYGARYIANKTLGFGSLYAFVSYLDMFFRPLRDLSEKYDIIQNSMASSEKILNLLKEEPEVIGNPNGPNKISKGRVRFENVWFSYDGKNWVLKDINLDFQPGKLYAIVGETGGGKSTLMSLINGLYIPQKGNIFIDEIPLLEYNLKLVRKQIAAVPQDVLLFSGTILDNIRLFDESIPEERVLEALKRVHALDIIERLPGGVYYEIVERGTTLSAGERQLIALARAVLFDAKIFILDEATSNVDVITETKIQEALEELSKDRTVIMIAHRLSTVKDVDEIVVVHNGRIVEKGNHYELLEKRGFYYNLYKIQFENA

SEQ ID NO: 2889 - protein, 339 aa, Thermotoga maritima
MKVVTFGEIMLRLSPPDHKRIFQTDSFDVTYGGAEANVAAFLAQMGLDAYFVTKLPNNPLGDAAAGHLRKFGVKTDYIARGGNRIGIYFLEIGASQRPSKVVYDRAHSAISEAKREDFDWEKILDGARWFHFSGITPPLGKELPLILEDALKVANEKGVTVSCDLNYRARLWTKEEAQKVMIPFMEYVDVLIANEEDIEKVLGISVEGLDLKTGKLNREAYAKIAEEVTRKYNFKTVGITLRESISATVNYWSVMVFENGQPHFSNRYEIHIVDRVGAGDSFAGALIYGSLMGFDSQKKAEFAAAASCLKHTIPGDFVVLSIEEIEKLASGATSGRVER

SEQ ID NO: 2890 - protein, 347 aa, Thermotoga maritima
MKILPSVLILLLGCVPVFSSQNVSLRELAEKLNIYIGFAAINNFWSLSDAEKYMEVARREFNILTPENQMKWDTIHPERDRYNFTPAEKHVEFAEENDMIVHGHTLVWHNQLPGWITGREWTKEELLNVLEDHIKTVVSHFKGRVKIWDVVNEAVSDSGTYRESVWYKTIGPEYIEKAFRWAKEADPDAILIYNDYSIEEINAKSNFVYNMIKELKEKGVPVDGIGFQMHIDYRGLNYDSFRRNLERFAKLGLQIYITEMDVRIPLSGSEEYYLKKQAEVCAKIFDICLDNPAVKAIQFWGFTDKYSWVPGFFKGYGKALLFDENYNPKPCYYAIKEVLEKKIEERK

SEQ ID NO: 2891 - protein, 421 aa, Thermotoga maritima
MGKLVVQGGAVLEGEVEISGSKNAALPIMAAAILCDEEVILKNVPRLQDVFVMIDILRSIGFRVEFEENELKIKRENDISQEVPYELVRKMRASFNVLGPIAVRTGRAKVALPGGCSIGVRPVDFHLEGLKKMGFSIKVEHGFVEACFERRIDYVTITLPFPSVGATEHLMTTAALLKGARVVIENAAMEPEIVDLQNFINRMGGHIEGAGTSRIVIEGVEKMQGVEYSIIPDRIEAGTYLVAIAASRGKGLVKNVNPDHLTNFFEKLEETGAKLKVLGNEVEIEMRERPKAVDVTTNPYPGFPTDLQPQMMAYLSTASGVSVITENVFKTRFLHVDELKRMGADIEVSGNVAIVKGVEKLSGAPVEGTDLRATAALLIAGIIADGVTEISNVEHIFRGYEDVIDKFSELGAKIEYVEKEN

SEQ ID NO: 2892 - protein, 387 aa, Thermotoga maritima
MFKISFYLPTEIIFRVGAVDELEERAKKLGKKALIVTGRSSTKKTGLLQRVVDLLKKAGVESFVFDKIVPNPISDHVDEAAEIVRKEKIDFIIGLGGGSPIDSAKAISITAPNEGKFWDYVPVGGGKIPEKSIPVVAIPTTHGTGTEADPFAVITNPQTKEKVGIGYRNTFPVLSLVDPEVMKTLPKDQTAYTSMDAFYHAIEAFLNVNANPYSDVLALDAMKRIVTYLPVAYENGEDMEARTNLAWASTEAGITETLTGVIANHALEHGLSGFYPEITHGLGLCITGPYLFEYIFDHAYERLAIVGREVFGVYETDDRKAGRLAIKKLRDFQEMFGLNKRLSELGVKKEDIPKMAETGYRILNGVVVVTPGNLTAKDMEEIFNRCY

SEQ ID NO: 2893 - protein, 520 aa, Thermotoga maritima
MFPLLAFRGDRMEILKAKGIVKRFPGVVAVDNVDFEVYENEIVSLIGENGAGKSTLIKILTGVLKPDAGEILVNGERVEFHSPVDAFKKGISVIHQELNLCDNMTVAENIFLAYEAVRGQKRTLSSRVDENYMYTRSKELLDLIGAKFSPDALVRNLTTAQRQMVEICKALVKEPRIIFMDEPTSSLTVEETERLFEIIEMLKSRGISVVFVSHRLDEVMRISDRIVVMRDGKRIGELKKGEFDVDTIIKMMVGREVEFFPHGIETRPGEIALEVRNLKWKDKVKNVSFEVRKGEVLGFAGLVGAGRTETMLLVFGVNQKESGDIYVNGRKVEIKNPEDAIKMGIGLIPEDRKLQGLVLRMTVKDNIVLPSLKKISRWGLVLDERKEEEISEDYVKRLSIKTPSIYQITENLSGGNQQKVVLAKWLATNADILIFDEPTRGIDVGAKAEIHRMIRELAAQGKAVIMISSELPEILNLSDRIVVMWEGEITAVLDNREKRVTQEEIMYYASGQKKQNGRVA

SEQ ID NO: 2894 - protein, 492 aa, Thermotoga maritima
MNLYVGLDVGTTGVKGILVNEKGEILATANERLTMFTPQPAWAEQDPLSWWEAVKKILKNLSERSKEMGGKIRAISTSGQMHSLVAIDDNGKVLRNAILWCDQRTYKECEEATQILGGEENVLKLVGNPILPGFTLPKILWIRKHEPEIYGKISKIMLPKDFINYMLTGEVKTEHSDASGTVMYSVSKMEWNKDVLKELNIPESVLPEIIPSNGVVGNVKPEVASDLGLSEDTLVIGGGADNACAALGIAVVEPGDVMVSLGTSGTVLAPTKGNQPDPKGRVHFFAHTVPETRYHMGVMLSATYSLEWFKEKFLSEDYETINEEVDKIPAGSNGIIFLPYLNGERTPHRDPFARGVFFGISSYNTKWDMVRAIFEGVAFGIKDSFDILRELKVVLNSVRITGGGSKSRVWNKMLADMTGLRIQKPAVDEGASYGAAILAVSGSMGENPAKISKEWFRVKSYTDPAVENTETYEKLHEKFKKLYTSLKEMFRS

SEQ ID NO: 2895 - protein, 827 aa, Thermotoga maritima
MKLSDLISRWIDVEPSKNAQIILRDRYFMKDLDGNYLETKWEDVARRVARVVATAELLNPSYKKNEKLDRIKEWEDIFFRVLKARLFIPNSPTLFNAGLGVKHDLLWKPIDQMTLEDYEEIYRSRNHLHMLSACFVVPVGDSIEEIFEAVKEYALITKVGGGVGSNFSELRPKGSFVAGTHGKASGPVSFMHVFNSAISVVKQGYRRRGALMGILNINHPDIEEFIDAKKENTGEAVLNFFNLSVGFPMDKKEILKLYEEDGELELSHPRSTIRKKVKIRELFRKIATNAWKSGDPGLAFLGEMNKYYPLYPHRKINSTNPCGEIGLSDYEACNLGSIDVAKFYNNGFVDLEALQELVQIAVRFLDNVIDVNVFPIDKITKAVKESRRLGLGIMGFADLLYKLEIPYNSQEARDFAANLMAFIALHAHRTSYELGKEKGNFPLLEISRYRTEDNFVPFAMGMSNYDDEIREVMKMTKEFRRNVALLTIAPTGSISNIADTSSGLEPNFLLAYTRFVTKEDGTKEPLLYVNQVLREKLNPEILKRIEKELIEKGSLKDIPDVPEKIKKVFVVALDIDPMDHLLMQDAFQRYVDNNISKTINMPQSATVDDVLNVYLEALRTNVRGITVYRDGSLQTQVLTKALKTPEAPKVQFFVVDEKLKLHPRPRKDTLRSVTRKYKRPDGTTYITISFDDTGEAVEIFISNGSEMAEAIGRLSSIALRAGVSIDEIVEQLSKVKGEYCKGLAEEIKKALEDFAKLWLRTGEEAPESEEEPIEREKFIVAHNLRWQSGYYVDDEGNVYCPVCLSKNSLIKQEGCVSCKNCGWSKCE

SEQ ID NO: 2896 - protein, 205 aa, Thermotoga maritima
MVRVKICGITNLEDALFSVESGADAVGFVFYPKSKRYISPEDARRISVELPPFVFRVGVFVNEEPEKILDVASYVQLNAVQLHGEEPIELCRKIAERILVIKAVGVSNERDMERALNYREFPILLDTKTPEYGGSGKTFDWSLILPYRDRFRYLVLSGGLNPENVRSAIDVVRPFAVDVSSGVEAFPGKKDHDSIKMFIKNAKGL

SEQ ID NO: 2897 - protein, 606 aa, Thermotoga maritima
MCGIVGMVGENLKLEDLVTSLQKLEYRGYDSAGIAYLGDSFGVYKKKGRIDVLKNGLKQKLNDRFFVGIAHTRWATHGEPNDMNAHPHMDCKEEIAVVHNGIIENYREIREFLEQRGHVFSSETDTEVIAHLVEEEFEGDLLDAVLKAVKKLKGAYAIAVVHKNVPDTIVAARKGSPLVAGIGSGVGILASDVTPLLRFTKDVVFLEDGDVMVLRKDGFEIYNTDGVKQQRRVYHVNWDEKAAEKGGYKHFMYKEIMEDPQALVNALVGRVKNDRPFFEELEYYEELLKNADRIRVVSCGTSYYAGLVFKYFLENHTDIDVEIEVSSEFRYKRPHIKEGDVLIAISQSGETADTLESVRLAKKHGAKIVSIVNVVGSTLDRESDVTLFMNAGPEIGVAATKTYVAELAVLYLLGLKIMEINGYWDREAEEILDKLVRMPELLENVLRKDPQIRELSEKYKDYRNFMYIGRGYGYPTALEGALKLKEITYIHATAYQAGELKHGPIALLDVDFPVFAVMPDDSLFFKTKSNVIESKSRNAPVIVLGTEGNRSLEEITGDIIHVPPTHESLYPLMMAPVIQLFAYHIADLKGLDPDKPRNLAKSVTVE

SEQ ID NO: 2898 - protein, 272 aa, Thermotoga maritima
MKKEKVEERIREILRPGWDLLTEEAMLYSATVGGKRIRPLLVLTLGEDLGVEEEKLLDVAVAVELFHTASLIHDDLPPIDNADFRRGKPSCHRTYGEDIALLAGDGLFFLAFSQISKIGNSKIFEEFSETAYKLLLGEAMDVEFERRKMEVSQEMVERMYAFKTGALFAFCFSAPFILKGKDHTKMKLLGEKFGVAFQIYDDLKDILGSFEKVGKDLGKDTEKVTLVKKVGIQKAREMADKYYEEVLKGIESEGLFRTLFLLKELKQMVEER

SEQ ID NO: 2899 - protein, 430 aa, Thermotoga maritima
MAYLEVLRYLYHKRPMGKVKPGLERISMLLSKLGNPHLEYKTIHIGGTNGKGSVANMVSNILVSQGYRVGSYYSPHLSTFRERIRLNEEYISEEDVVKIYETMEPILNELDKEEIFSPSFFEVVTAMAFLYFAEKNVDIAVLEVGLGGRLDATNVVFPLCSTIVTVDRDHEKTLGYTIEQIAWEKSGIIKERVPLVTGERKREALKVMEDVARKKSSRMYVIDKDFSVKVKSLKLHENRFDYCGENTFEDLVLTMNGPHQIENAGVALKTLEATGLPLSEKAIREGLKNAKNLGRFEILEKNGKMYILDGAHNPHGAESLVRSLKLYFNGEPLSLVIGILDDKNREDILRKYTGIFERVIVTRVPSPRMKDMNSLVDMAKKFFKNVEVIEDPLEAIESTERATVVTGSLFLVGYVREFLTTGKINEEWKL

SEQ ID NO: 2900 - protein, 404 aa, Thermotoga maritima
MNTGEMKINWVSRYMPLLNKIAEEYSREKPLSGFTVGMSIHLEAKTAYLAITLSKLGAKVVITGSNPLSTQDDVAEALRSKGITVYARRTHDESIYRENLMKVLDERPDFIIDDGGDLTVISHTEREEVLENLKGVSEETTTGVRRLKALEETGKLRVPVIAVNDSKMKYLFDNRYGTGQSTWDAIMRNTNLLVAGKNVVVAGYGWCGRGIALRAAGLGARVIVTEVDPVKAVEAIMDGFTVMPMKEAVKIADFVITASGNTDVLSKEDILSLKDGAVLANAGHFNVEIPVRVLEEIAVEKFEARPNVTGYTLENGKTVFLLAEGRLVNLAAGDGHPVEIMDLSFALQIFAVLYLLENHRKMSPKVYMLPDEIDERVARMKLDSLGVKIDELTEKQRRYLRSWQ

SEQ ID NO: 2901 - protein, 429 aa, Thermotoga maritima
MRVKYFGTDGIRGIFGETLTDELAFKVGKALGEIVGEGKVIVGKDTRVSGDSLEAAISAGLTSMGVDVLLCGILPTPAVALLTRITRSFGVVISASHNPPEYNGIKVLKGGYKIPDEMEAEIEKRLENGSFLTRSVVGRTKSFREGRDMYIGAVLEMFRDLDLTGEMVSLDLANGATTTTAREVFEFLGAKVEVFNDSQDGLLINQGCGATHPRFLAEEMKNGKVGFTFDGDGDRVIAVDEERNVVNGDRIIGILAVGLKEEGRLNSDTVVGTVMTNGGLEDFLKEKGIRLLRTKVGDKYVLEKMLESGANLGGERSGHIIILDRSTTGDGLITALELMRVLKRSGRKLSDFAKEIPDYPQITKNVRRTERMSLENENLRKIVEESTSRGYRVVIRPSGTEPVIRITVEGKDREEIEKIVEEISRVLES

SEQ ID NO: 2902 - protein, 820 aa, Thermotoga maritima
MFDKFSEKTAQIFVTAQEEAKELGHSYVGTEHLLLAILKVDRSPAVELLEEMGASYSKVRSEIISMVGMGMRGFVPSPQMTPRAKRVTELAYEEAKILGSDKINPEHLLLGILREGEGIAIHILRKLGVDIATLRREIIDIYSYSSNKNLEYEEEEDYTYRSVKQLEGFGVNLTELAAKKELDPVIGREEEIERVMQVLVRRKKNNPVLIGDPGVGKTAIVEGLAQRIVAGDVPEILKNKVIFSLDVAALVAGTKYRGEFEKRMKKLLQIVTKDKNIILFIDEIHTIVGAGSAEGAIDAANILKPALARGEISCIGATTPDEYRRYIEKDAALERRFQKIYVKEPTEEETLEILKGLKRKYEAHHKVIYTDKALEAAVYLSKRYITDHYLPDKAIDVIDEAGARARLKVFVLPPELKDMKLELERIRSDKELAVLNQDYEKAAQLKEEEMELEAEYRKRYAEWRRRAETAVVKVDVDDVAEVVSSWTGVPLRKIEETEVEKLLNLEEALHQRIVAQDEAIKAVARAIRRARSGLKDPRRPIGVFLFLGPTGVGKTELAKALAEYLFGDERALIRFDMSEYMERFSVSRLIGAPPGYVGYEEGGTLTEKVRRRPFSVILFDEIEKAHPDVFNILLQIMDDGRLTDSQGREVDFRNTIIIMTSNIGSSYINKSKRTLGFVGDNNEEKEFEKIKDLVLEEVKRTFRPEFLNRIDETIIFHPLKKEHIEQIIDILLRDLRKRLSEKNMKLVLTKSAKEFLVEKGFDPVYGARPLKRAIQRYVEDPLSEEILRGKFNEGDTIVCRARKDALRFTRKGEKKEKVVQ

SEQ ID NO: 2903 - protein, 171 aa, Thermotoga maritima
MMIKVLIDEETLKKRIKELAREIEEYYLGKTDTIHAVCILKGSIHFFSDLMLNIRKLNVKYSFIHVSSYQGTSSTGKIRVKSWIDESIHDEYVLLVEDIVDTGLTLQHIVRYLKKYNPRDFRIVSLIEKTVHDHGIPLDFVGFRVDDKFLVGYGLDIDEKYRNLPYIGYVE

SEQ ID NO: 2904 - protein, 466 aa, Thermotoga maritima
MRSTKIVCTVGPRTDSYEMIEKMIDLGVNVFRINTSHGDWNEQEQKILKIKDLREKKKKPVAILIDLAGPKIRTGYLEKEFVELKEGQIFTLTTKEILGNEHIVSVNLSSLPKDVKKGDTILLSDGEIVLEVIETTDTEVKTVVKVGGKITHRRGVNVPTADLSVESITDRDREFIKLGTLHDVEFFALSFVRKPEDVLKAKEEIRKHGKEIPVISKIETKKALERLEEIIKVSDGIMVARGDLGVEIPIEEVPIVQKEIIKLSKYYSKPVIVATQILESMIENPFPTRAEVTDIANAIFDGADALLLTAETAVGKHPLEAIKVLSKVAKEAEKKLEFFRTIEYDTSDISEAISHACWQLSESLNAKLIITPTISGSTAVRVSKYNVSQPIVALTPEEKTYYRLSLVRKVIPVLAEKCSQELEFIEKGLKKVEEMGLAEKGDLVVLTSGVPGKVGTTNTIRVLKVD

SEQ ID NO: 2905 - protein, 319 aa, Thermotoga maritima
MKKIAVLTSGGDAPGMNAAVRAVVRYGVRQGLEVIGVRRGYSGLIDGDFVKLEYKDVAGITEKGGTILRTSRCEEFKTEEGRELAAKQIKKHGIEGLVVIGGEGSLTGAHLLYEEHKIPVVGIPATIDNDIGLTDMCIGVDTCLNTVMDAVQKLKDTASSHERAFIVEVMGRHSGYIALMAGLVTGAEAIIVPEIPVDYSQLADRILEERRRGKINSIIIVAEGAASAYTVARHLEYRIGYETRITILGHVQRGGSPTAFDRRLALSMGVEAVDALLDGEVDVMIALQGNKFVRVPIMEALSTKKTIDKKLYEIAHMLS

SEQ ID NO: 2906 - protein, 124 aa, Thermotoga maritima
MKMKKYTKTHEWVSIEDKVATVGITNHAQEQLGDVVYVDLPEVGREVKKGEVVASIESVKAAADVYAPLSGKIVEVNEKLDTEPELINKDPEGEGWLFKMEISDEGELEDLLDEQAYQEFCAQE

SEQ ID NO: 2907 - protein, 438 aa, Thermotoga maritima
MKDILKELKKKLSEEDFNKFNGRVTRVVGLTVESKGPDAFLGEMCKISLQNGKNALAEVVGFREESVILMPYEDVSGLKMGCEVIRTNKVLEVGVSRKMIGRVFDGLGRPIDGKPFVPEDRYPLINNPPNPLKRRRIKDPLPVGIRSIDGFITIGKGQRIGIFAGSGVGKSTLLGMIARNTTADINVLALIGERGREVREFIERDLGEEGLKRSILVVSTSDQPALARVKSLLTATSIAEFFRDLGYDVLLMVDSLTRWAMAQREVGLAVGEPPTTRGYPPSVFAGLPKILERAGNSDKGSITAIYTVLVEADDFNEPISDTVRSIVDGHIILSRRLAESNHYPAVDVLASVSRLMNDIVTEEHREAANRLRSLMSAYESAKDLIEIGAYKSGTNPLVDKAVEMKDEIDSFLKQGVFEKASFEETLQKLLDLYLRSLD

SEQ ID NO: 2908 - protein, 312 aa, Thermotoga maritima
MRIDLSLKPTPVQFLKRLSEKYGFNIYVKRDDLTELVGSGNKIRKLEYLLWEALKKGATTVFTCGGLQSNHARATAYVSRRYGLKPVLFLRKGEKVLNGNLLLDILLGAEIVEVSPEEYERIDEIFDVHKKMREKKGEKVYVIPEGGSNSLGAFGYFNAVLEMKDQLNLESFDAIVCAVGSGGTIAGLSAGISFLEYHVPVVGVNVTTKNSDYFVGKVKRIISGMEEYGLRVNETVFEVVDDYRGPGYAIPSSEDVEILKEVASIEGIILDPVYTAKAFRGMIEMFRNSEKNVLFIHTGGIFGLFAQSRRLV

SEQ ID NO: 2909 - protein, 370 aa, Thermotoga maritima
MRVLGLILAGGKSDRLWPLTKVRASAAVPVFGKYRAIDFTLSNMVNSGIRKVGILTQYNPRSLMDHLGSGKEWDLDRKSGGLFILQPYVGPNREVWYRGTADAIFQNMTILRRGEEDHVLIGSGDHIYKMIYRDLFNYHLKKGADITLVVKELDETYNLSEYGIVQLDDDMRVVEIEEKPAHPKGNIAFLGVYFMNKELLKELLYATVPQGKYDLLLDIVIPNLDRLKVYAYRFDGYWRNVKKGIKEYYRINMDILKKEVRDELFYRNGKVYTKLKDLPPPKFTTTAVVENSLIADGSIVSGTVRNSVIFRNVRIKVGAVVENSIIMENTVVEEGAVLRNVILDKNCIVREGRVIEGDTELPVFEKRAVL

SEQ ID NO: 2910 - protein, 423 aa, Thermotoga maritima
MGNTVAMILAGGQGTRLGVLTERIAKPAVPFGGKYRLIDFTLSNCVNSGIYRVGVLTQYRPHVLSKHIGIGRPWDLDRKDGGVEILPPYVGRHESDWYKGTANAVYQNLEFLEENDAELVLILSGDHVYAMNYNDLIDYHLLKEADGTIACMEVPIEEASRFGIMITDVDGRIVDFEEKPAKPRSNLASLGIYVFNYEFLKKVLIEDENDPNSSHDFGKDVIPRILRENLGSLYAFRFDGYWRDVGTLRSYWEANLELVLPVPPFNLYDPNWRFFTHTEEMPPAYVAPGSKVSTSLVSEGAEVYGNVFNSVIFQGVKIGRGTVVKNSVIMTRTEIGENCYLENVIIAENVKIGSNVRMGVGEDAESKLDPKVYSGLLTVVGMNSVIPDDMVIGKNCVIGIGVRPEDFKSKTLESGDYVIVREE

SEQ ID NO: 2911 - protein, 633 aa, Thermotoga maritima
MSKKVKKYIVVESPAKAKTIKSILGNEYEVFASMGHIIDLPKSKFGVDLEKDFEPEFAVIKGKEKVVEKLKDLAKKGELLIASDMDREGEAIAWHIARVTNTLGRKNRIVFSEITPRVIREAVKNPREIDMKKVRAQLARRILDRIVGYSLSPVLWRNFKSNLSAGRVQSATLKLVCDREREILRFVPKKYHRITVNFDGLTAEIDVKEKKFFDAETLKEIQSIDELVVEEKKVSVKKFAPPEPFKTSTLQQEAYSKLGFSVSKTMMIAQQLYEGVETKDGHIAFITYMRTDSTRVSDYAKEEARNLITEVFGEEYVGSKRERRKSNAKIQDAHEAIRPTNVFMTPEEAGKYLNSDQKKLYELIWKRFLASQMKPSQYEETRFVLRTKDGKYRFKGTVLKKIFDGYEKVWKTERNTGEFPFEEGESVKPVVVKIEEQETKPKPRYTEGSLVKEMERLGIGRPSTYASTIKLLLNRGYIKKIRGYLYPTIVGSVVMDYLEKKYSDVVSVSFTAEMEKDLDEVEQGKKTDKIVLREFYESFSSVFDRNDRIVVDFPTNQKCSCGKEMRLSFGKYGFYLKCECGKTRSVKNDEIAVIDDGKIFLGRKDSESGSPDGRSVEGKGNLSEKRRKGKKGS

SEQ ID NO: 2912 - protein, 881 aa, Thermotoga maritima
MAKKYVYFFANGKAEGRADMKDILGGKGANLAEMTNLGIPVPPGFTISAEVCKYYYDHGRTYPEELKEQVEEAMRRLEEVTGKKFGDPNNPLLVSVRSGAAISMPGMMDTVLNLGLNDETVKGLAKLTNNERFAYDAYRRFLQMFGDVVLKIPHEKFEKALEELKKEKGVKLDTELDAEDLKKLVERYKQIYKEEGKEFPQDPWKQLWLAIDAVFGSWMNERAIKYRQIHGIKEGDLLGTAVNIVAMVFGNMGEDSGTGVAFTRDPNTGEKKPYGEFLPNAQGEDVVAGIRTPLKLEELKNRMPEVYNQLLEIMDKLEKHYRDMQDIEFTVERGKLYILQTRNGKRTSQAAIRIAVDMVHEGLITKEEAILRVRPEDVEQVLHPVFDPKEKAQAKVIAKGLPASPGAATGKVVFNAKKAEELGKAGEQVILVRPETSPEDVGGMAAAQGILTSRGGMTSHAAVVARGMGKPAVVGAESIEVHPEEGYFKVGDVVVKEGEWISIDGTTGEVLLGKVTTIKPQGLEGPVAELLQWADEIRRLGVRTNADIPRDAEVARKFGAEGIGLCRTEHMFFEKDRIPKVRRMILAKTKEEREKALDELLPLQKEDFKGLFRVMKGLPVTIRLIDPPLHEFLPQEDEQIKEVAEQMGVSFEELKNVVENLKELNPMLGHRGCRLTITYPEIAVMQTKAIIGAAIELKKEEGIDVIPEIMIPLVGHVNELRYLKKIIKETADALIKEAGVELTYKIGTMIEVPRAAVTAHQIAEEAEFFSFGTNDLTQMTFGFSRDDVGKFLPEYLEKGILEHDPFKTLDYDGVGELVRMGKEKGRSTRPDLKVGVCGEHGGDPRSILFFDKIGLDYVSCSPYRVPVARLAAAQAALKNKK

SEQ ID NO: 2913 - protein, 315 aa, Thermotoga maritima
MTMPYVKNTKEILEKASKERYAIGAFNFNNMEFLQAILEAAEEEKAPVIVATSEGAIKYIGKGDIETGAKLAVEMVRTYAEKLSVPVALHLDHGRDFKVIMAAIKAGYSSVMIDASHLPFEENLRETKRIVEIAHAVGISVEAELGKLKGIEDNVVEKESVLVDPEEAKVFVKETEVDFLAPAIGTSHGAFKFKGEAQLDFERLKKVKEYTQIPLVLHGASMVPQDIVKLANEYGAELSGAKGVPEDMLKKAIELGINKINTDTDLRITFVAYLRKVLSEDKSQIDPRKIFKPVFEQVKEIVKERIRIFGSSGKA

SEQ ID NO: 2914 - protein, 496 aa, Thermotoga maritima
MIDLKQYEFWFLVGSQYLYGLETLKKVEQQASKIVDSLNDDPIFPSKIVLKPVLKSSSEITEIFEKANADPKCAGVIVWMHTFSPSKMWIRGLSINKKPLLHLHTQYNREIPWDTIDMDYMNLNQSAHGDREHGFIHARMRLPRKVVVGHWEEKEVREKIAKWMRVACAIQDGRMGQIVRFGDNMREVASTEGDKVEAQIKLGWSINTWGVGELAERVKAVPEREVEELLKEYREKYIMPEDEYSLKAIREQAKIEIALREFLKEKNAVGFTTTFEDLHDLPQLPGLAVQRLMEEGYGFGAEGDWKAAGLVRAIKVMGTSLPGGTSFMEDYTYHLTPGNELVLGAHMLEVCPTIAKEKPRIEVHPLSIGGKADPARLVFDGQEGPAVNASIVDMGNRFRLVVNKVLSVPIERKMPKLPTARVLWKPLPDFKRATTAWILAGGSHHTAFSTAIDVEYLIDWAEALEIEYVVIDENLDLEDFKKELRWNELYWGLLKR

SEQ ID NO: 2915 - protein, 484 aa, Thermotoga maritima
MSYRIVVDPKEVVKPISRHIYGHFTEHLGRCIYGGIYEEGSPLSDERGFRKDVLEAVKRIKVPNLRWPGGNFVSNYHWEDGIGPKDQRPVRFDLAWQQEETNRFGTDEFIEYCREIGAEPYISINMGTGTLDEALHWLEYCNGKGNTYYAQLRRKYGHPEPYNVKFWGIGNEMYGEWQVGHMTADEYARAAKEYTKWMKVFDPTIKAIAVGCDDPIWNLRVLQEAGDVIDFISYHFYTGSDDYYETVSTVYLLKERLIGVKKLIDMVDTARKRGVKIALDEWNVWYRVSDNKLEEPYDLKDGIFACGVLVLLQKMSDIVPLANLAQLVNALGAIHTEKDGLILTPVYKAFELIVNHSGEKLVKTHVESETYNIEGVMFINKMPFSVENAPFLDAAASISEDGKKLFIAVVNYRKEDALKVPIRVEGLGQKKATVYTLTGPDVNARNTMENPNVVDITSETITVDTEFEHTFKPFSCSVIEVELE

SEQ ID NO: 2916 - protein, 506 aa, Thermotoga maritima
MYLIGSDIGTQGTKSVIVNEKGEVLAEAFREYEVITPKPNWAEQWPDVWVKAVFETVKEVVEKSGVSKKEIAGIAISGLYGGSGIPVDRNMQPLRPCLIWMDRRAVKETEWVKQNVPKEKLFEITGNYVDSYFGFTKIMWIRNNEPEIWEKIYKFITPKDYVIYQMTGEVVIDYSSAGNLGGVFDIRKLTWSKEMCDVLGIPIEFLPERIVKSSDVVGRVTKEASELCGLLEGTPVVAGGIDAPVAQLSAGALEEGEHVAMVGTSTCWGTVHDGSKLAFGLVNYPYVVYDTERIYTFGGSATTGALARWFKEQFGESETIVGERTGISPYQLFDKEVANIPAGSEGIIVLPYFMGERSPIWDPTARGVFFGVTLYHKRAHLYRALMEGGAYALRHNMEEGLKAGLKLNDECWIVGGVSKSSVWVKIFADVTGFKMRQVASLVEAPYGDAFLAGLGTGVIDKPERIKEWVKYRDPVEPDPENKKIYDRYYEIYRELYERTKDLMARL

SEQ ID NO: 2917 - protein, 577 aa, Thermotoga maritima
MKTLARYLKPYWIFAVLAPLFMVVEVICDLSQPTLLARIVDEGIARGDFSLVLKTGILMLIVALIGAVGGIGCTVFASYASQNFGADLRRDLFRKVLSFSISNVNRFHTSSLITRLTNDVTQLQNLVMMLLRIVVRAPLLFVGGIVMAVSINVKLSSVLIFLIPPIVLLFVWLTKKGNPLFRKIQESTDEVNRVVRENLLGVRVVRAFRREEYENENFRKANESLRRSIISAFSLIVFALPLFIFIVNMGMIAVLWFGGVLVRNNQMEIGSIMAYTNYLMQIMFSLMMIGNILNFIVRASASAKRVLEVLNEKPAIEEADNALALPNVEGSVSFENVEFRYFENTDPVLSGVNFSVKPGSLVAVLGETGSGKSTLMNLIPRLIDPERGRVEVDELDVRTVKLKDLRGHISAVPQETVLFSGTIKENLKWGREDATDDEIVEAAKIAQIHDFIISLPEGYDSRVERGGRNFSGGQKQRLSIARALVKKPKVLILDDCTSSVDPITEKRILDGLKRYTKGCTTFIITQKIPTALLADKILVLHEGKVAGFGTHKELLEHCKPYREIYESQFGNGVMNDA

SEQ ID NO: 2918 - protein, 598 aa, Thermotoga maritima
MPEIRRRPHGPILEKPALKNPTATLRRLLGYLRPHTFTLIMVFVFVTVSSILGVLSPYLIGKTIDVVFVPRRFDLLPRYMLILGTIYALTSLLFWLQGKIMLTLSQDVVFRLRKELFEKLQRVPVGFFDRTPHGDIISRVINDVDNINNVLGNSIIQFFSGIVTLAGAVIMMFRVNVILSLVTLSIVPLTVLITQIVSSQTRKYFYENQRVLGQLNGIIEEDISGLTVIKLFTREEKEMEKFDRVNESLRKVGTKAQIFSGVLPPLMNMVNNLGFALISGFGGWLALKDIITVGTIATFIGYSRQFTRPLNELSNQFNMIQMALASAERIFEILDLEEEKDDPDAVELREVRGEIEFKNVWFSYDKKKPVLKDITFHIKPGQKVALVGPTGSGKTTIVNLLMRFYDVDRGQILVDGIDIRKIKRSSLRSSIGIVLQDTILFSTTVKENLKYGNPGATDEEIKEAAKLTHSDHFIKHLPEGYETVLTDNGEDLSQGQRQLLAITRAFLANPKILILDEATSNVDTKTEKSIQAAMWKLMEGKTSIIIAHRLNTIKNADLIIVLRDGEIVEMGKHDELIQKRGFYYELFTSQYGLVVEKE

SEQ ID NO: 2919 - protein, 419 aa, Thermotoga maritima
MAERLGILVGGGPAPGINSVISSVTIEAINNGLEVIGIYDGFKHLVEGKTNMVKKLSIEDVSRIHIEGGSILRTSRVNPAKSEETLEKTVQTLKKLGIKYLVTIGGDDTAFSASKVCERSKGEIKVVHVPKTIDNDLPLPENMPTFGFETARHVATELVYNLMQDSRTTNRWYFVAMMGREAGHLALGVGKAASATITIIPEEFKEGVTLEEVCDVLDGAILKRKLMGRDDGVAVIGEGIAEKMDPEELANIPGVIVEKDPHGHLRLAEIPLATILKRAIERRYAERGERIHIVDVTIGYELRSARPIPFDIVYTRTLGYGAVRFLLGDYSDLPGGMVCVVGGRIKILPFDAFMDPKTGRTKVRVVDVRSEDYRVARKYMIRLEKKDLEDPETLEKLAKLAKMEPEEFKKKYWHTTELP

SEQ ID NO: 2920 - protein, 418 aa, Thermotoga maritima
MGKTLAEKIFSEHVGRDVKAGEIVLARVDIAMAQDGTGPLMINEFRELGFKEVKVPKAFLFIDHASPSPRKELSNSQKMMREFGKEMGVKVFDAGDGISHQILAEKYVKPGDLVAGADSHTCTAGGLGAFGTGMGSTDVAIIFGLGQNWFKVPETIKVVVNGKLQDGVYAKDIILEIARILGSDGATYKALEFHGSCIENMNVEDRLTISNMAVEVGAKAGLMPSDEKTREFLKKMGREEDFRELKADPDAVYETEIEIDATTLEPLVSLPHYVDNVRKVSEVEKEKIKIDQVFIGTCTNGRLQDLEIALKILEKHGKHPDVRLIVGPASRKVYMDALEKGIIKKFVELGAAVIPPGCGPCVGIHMGVLGDGERVLSTQNRNFKGRMGNPNAEIYLASPATAAATAVTGYITDPRRFI

SEQ ID NO: 2921 - protein, 415 aa, Thermotoga maritima
MDELLEKAKKVREAWDVLRNATTREKNKAIKKIAEKLDERRKEILEANRIDVEKARERGVKESLVDRLALNDKRIDEMIKACETVIGLKDPVGEVIDSWVREDGLRIARVRVPIGPIGIIYESRPNVTVETTILALKSGNTILLRGGSDALNSNKAIVSAIREALKETEIPESSVEFIENTDRSLVLEMIRLREYLSLVIPRGGYGLISFVRDNATVPVLETGVGNCHIFVDESADLKKAVPVIINAKTQRPGTCNAAEKLLVHEKIAKEFLPVIVEELRKHGVEVRGCEKTREIVPDVVPATEDDWPTEYLDLIIAIKVVKNVDEAIEHIKKYSTGHSESILTENYSNAKKFVSEIDAAAVYVNASTRFTDGGQFGFGAEIGISTQRFHARGPVGLRELTTYKFVVLGEYHVRE

SEQ ID NO: 2922 - protein, 315 aa, Thermotoga maritima
MNVLCTGEILIDFISEDKGKNLSQSELFRKKAGGSPLNVAVALKRLGREVSFLGKLGGDQFSEFLLEVMKKEGIDTTHIIFDSSCKTTLAFVARDAQGNPDFVFFREKPADTNLRPEEVNIDPAQFSFLHIGSYSLAVEPSRSAYLKVMETFLEEGKPVSYDPNVRPSLIEDRNTFVKDFLEISSKVDIVKLSDKDLEYIFQEDLETAVDKIPIKENGLLFVTMGERGCLVKFKGEKRMVPSFKVKPVDATGCGDSFTAAVIHKYLEKTPETIEDAVEIGKFANAVAAIVITRVGGVDAMPVLDEVEMFLSNQER

SEQ ID NO: 2923 - protein, 257 aa, Thermotoga maritima
MNILEKLFSLKRKVALVTGGGQGIGKAIAQALAAAGAAVLIMDINEETARRTVEEIKEKGGEADFYVGDVTKEEDCFGAVKKALDRWGKLDIGVNNAGIGDWCEAENYPVEKWKKVIDVNLVGVFLSAKAEFHAMKERKYGKIINIASMSGHIVNKPQKQTAYNASKAGVIHLTRSLAAEWAPYGIRVNSISPGYIRTPLIESPNVKDLVPLWLDMIPLGRLGEVDDLIGAAIFLASPASDYMTGHDLVIDGGYTVW

SEQ ID NO: 2924 - protein, 317 aa, Thermotoga maritima
MKVLLIEKPGVASVVEKEIPVPGEDQTLVKVLACGICGTDYKIFSGGTNANYPVVPGHEIVGVVERSGVFEKGQMVVIDPNRSCGKCDYCRKGMSQFCENLQATGVTEPGGFAEYVLVENSQVYPVRNVPAERAVFAEPLSCVLEGVKMVKHGFYDRILVVGAGSIGVIFGLIFKKIFPGAEIVLAEKDEKRAEYVVQTFGLKVDEPKGEYDLTVECSGTVEGFKTCFEHTGKGGMLLQFSVISKDKMVEISPFEIYRKEMKILGSYLNPFTMKEAVKIIESGEFPFEKLVTDRLDLEGVKEYLSSHKKALMKGIFS

SEQ ID NO: 2925 - protein, 764 aa, Thermotoga maritima
MRFTEGLWRLREGVQLFRPEQVYEYSCDGKKLILRSPFRRVEHRGQTLQGPVFEIEISSPFENVIRIRFRHFKGVLEKPPYYEIYQDESFTPDIKETEGSFIFTSGKAKAIIRKNPFGVEFFYEDRFLTKSDLGYAVAPEGRFCLERLHLSVGEMIYGLGERFSAFVKNAQRVVMWNEDAGTISDMTYKNIPFYVSIRKYGVFVNDPGKVDFEIATEHVEKVQFSVKGETLDYFIIAGKDLKEVLERYTLLTGRPELPPAWSFGLWLTTSFTTQYDERTVMEFVDGMRERDIPLHVFHFDCFWMKEFHWVDLEWNRENFPDPEGLLKRLKEKGLKVCVWINPYVSQFSSLFDEGKEKGYFLKKPDGDVWQTDDWQPGMAIIDFTNPEVRKWFASKLERLIDMGVDCFKTDFGEKIPTDVVYYDGSDPEKMHNYYTYLYNKVVFETIERKLGKRNAVVFARSATAGSQKFPVHWGGDCLASYESMAETLRGGLSLALCGFGFWSHDIGGFEDITTPDLYKRWVAFGLLSSHSRLHGNSMYKVPWNFDEEAVEVLRFFTKLKCKLMPYIFASAVEVHERGIPVMRPMILEFPDDPTCLYLDRQYMLGESLLVAPIFSETGEVTYYLPEGVWTHFLTGERVEGGRWRTEKYDYFGLPLFTRPNSIIPTGSVDDRPDYDYADGVTLNVFEISNKTAHVYNTRGEVELSVKVERKGNEIHVEVLKDSRKPWKLLFWNERLEAVEGAETRELEKGTEVVLSFQRAILKTK

SEQ ID NO: 2926 - protein, 672 aa, Thermotoga maritima
MVNPKLPVIWYGGDYYPEQWDEETFERDIRMFKEAGINVVTIGVFSWSLIQPDENTYDFSFFEKVMDRLYKEGIYVCLATPTSAPPHWMTQKYPEILFTDVNGVKREKGGRQNFCPNSEKYRYFARNIAEKLAEHFKDHPALVLWHVNNEYLNYCYCDICRGKFQNWLKEKYGTLDELNRRWNTRFWSQTFTAWEEIPVPTTRSVLVWRKDRYQSVLPELYLDYRRFMTQSMLECFLEEYRAIKKHTPDIPVTTNLIAATFKEWNYFEWAKHMDVAAWDNYPGYKEDFSVISLRHSLIRCLKEGKPFVLMEQSPSQACWRWYNPQKRPGEMRLWSYHALAHGAETLMFFQLRQSKGGVEKFHGAVITHVDSPNTRVFQEVKRVGEEIKSLSDILDARVVSQTALLFDWESWWAMEDTLTPSVDFRYLNEVQKYFKALVKTGLGVDVVGKDQNFERYRVLVAPVLYMVGKELAQKLKDYVSNGGILILTTMSGIVDEDDQVVLGGYPGYLRDLMGGYVEEIDALPPEEKNEILMFGKRYECSLVFDYIKTTTAEVLGRFGRDYYMNEPAVLRNNYGKGWVYYVGSSTSFDLVWDLVKFMEREHNLRAEIAPPDDVEVIKKIKGEKIFYFLFNHSHELQIVDLPEGMFRDLIKGNLYEKKVKLQPLDVLILLKE

SEQ ID NO: 2927 - protein, 726 aa, Thermotoga maritima
MSDQKTMEDRAAKNEEIKKTFTVTGMTCATCAKTVEKALKKLDGVKFAAVNLATSTGFIVAEKEISFEEIKKAVEEVGYGVTTESPEDVERKRYEESKRNLILAWLVTAPLALLMIYHMFVSEVPYFTWIEVFAGAFVTFYVGRGTIRGAWIALTHKHTNMDTLIFFGAVTSWVTALLDSVGLPVMSFGAIGAMIVAFHITGRFIESYLRDRASKEIKALLKLQAKEARVITDEGEVMMPIEAVKEGFIVLVKPGERIPVDGVIVEGQSSIDESVVTGESIPVLKKENDEVIGGSLNVSSPIKIKVTKVGEDTFLSQMVKLIQEAQGSKVPIQALADRITMWFVPTIIVLAITSALVWYFNYERFLPFVEKAREIFPWIIQTSDPLTFSIFVFVATIVIACPCALGLATPMALVTGTGLAAKKGLLIRNAEAIQTSKDVGVVLTDKTGTLTEGSPKVVDHNLSAELIRIVASIERNSNHPLAKAISELSQDVVEVESVEEIPGEGVRALYGGEEYFVGKPLDYSKYESLLEEGKTIVEVRRNGEVVGFLAIEDPIREDSPEAVRRLKEMGIEPVMITGDNEKTARAVARRLGIEKFHAGVKPSEKLDLVRSYQAQGKKVAMVGDGMNDAAALKGADVGIAIGSGTDLAIDSADIIITKGGISKVVDAIEISRKTFKIIKQNLFWAFFYNVIAIPMAMMGLLHPVIAELAMAFSSITVTLNSMRVRE

SEQ ID NO: 2928 - protein, 251 aa, Thermotoga maritima
MNFQGKVVLITGAGSGIGKKAAVMFAERGAKVAINDISEEKGKETVELIKSMGGEAAFIFGDVAKDAEQIVKKTVETFGRLDILVNNAGIVPYGNIEETSEEDFDKTMAVNVKGPFLLSKYAVEQMKKQGGGVIVNVSSEAGLIGIPRRCVYSVSKAALLGLTRSLAVDYVDYGIRVNAVCPGTTQSEGLMARVKASPNPEELLKKMTSRIPMKRLGKEEEIAFAILFAACDEAGFMTGSIINIDGGSTAV

SEQ ID NO: 2929 - protein, 270 aa, Thermotoga maritima
MLELKPPLVLLSGPAGFGEYLKLMDHRYVGGVLLKTVTLHPKEGNPTPRMADSDFYVINRIGLENPGIHAFVENIPELPVPMIASLGGDSFEEYLEVARVFKKVADRFYAVEFNFSCPNVKEGGLSIVKNAEEWKKLLNTLRKELPDSFLIAKVGVEGIFVEDAAEFVMKTGWDGITLVNTVRGLHFEKDTMILGGLSGPVLKPIALRAVYEVKKRFPELFVIASGGVYSVKDAEEFLKVGADVIGVGSALFKDPGVVEEIGKYLLEVKR

SEQ ID NO: 2930 - protein, 338 aa, Thermotoga maritima
MIVVLKPGSTEEDIRKVVKLAESYNLKCHISKGQERTVIGIIGDDRYVVADKFESLDCVESVVRVLKPYKLVSREFHPEDTVIDLGDVKIGNGYFTIIAGPCSVEGREMLMETAHFLSELGVKVLRGGAYKPRTSPYSFQGLGEKGLEYLREAADKYGMYVVTEALGEDDLPKVAEYADIIQIGARNAQNFRLLSKAGSYNKPVLLKRGFMNTIEEFLLSAEYIANSGNTKIILCERGIRTFEKATRNTLDISAVPIIRKESHLPILVDPSHSGGRRDLVIPLSRAAIAVGAHGIIVEVHPEPEKALSDGKQSLDFELFKELVQEMKKLADALGVKVN

SEQ ID NO: 2931 - protein, 410 aa, Thermotoga maritima
MLSVPPDKSITHRALILSALAETESTLYNLLRCLDTERTHDILEKLGTRFEGDWEKMKVFPKPFAEPIEPLFCGNSGTTTRLMSGVLASYEMFTVLYGDPSLSRRPMRRVIEPLEMMGARFMARQNNYLPMAIKGNHLSGISYKTPVASAQVKSAVLLAGLRASGRTIVIEPAKSRDHTERMLKNLGVPVEVEGTRVVLEPATFRGFTMKVPGDISSAAFFVVLGAIHPNARITVTDVGLNPTRTGLLEVMKLMGANLEWEITEENLEPIGTVRVETSPNLKGVVVPEHLVPLMIDELPLVALLGVFAEGETVVRNAEELRKKESDRIRVLVENFKRLGVEIEEFKDGFKIVGKQSIKGGSVDPEGDHRMAMLFSIAGLVSEEGVDVKDHECVAVSFPNFYELLERVVIS

SEQ ID NO: 2932 - protein, 253 aa, Thermotoga maritima
MKFCIIGYPVRHSISPRLYNEYFKRAGMNHSYGMEEIPPESFDTEIRRILEEYDGFNATIPHKERVMRYVEPSEDAQRIKAVNCVFRGKGYNTDWVGVVKSLEGVEVKEPVVVVGAGGAARAVIYALLQMGVKDIWVVNRTIERAKALDFPVKIFSLDQLDEVVKKAKSLFNTTSVGMKGEELPVSDDSLKNLSLVYDVIYFDTPLVVKARKLGVKHIIKGNLMFYYQAMENLKIWGIYDEEVFKEVFGEVLK

SEQ ID NO: 2933 - protein, 376 aa, Thermotoga maritima
MKLTIAGDSHGKYMVAILEGLPSGIRVDEELIRRDLFRRRNCYGRGKRMKMEEDAFEIVSGLWKGITTGAPVTILIPNRAGNPVKDVRSVPRPGHIDYAAWVKYKLPDLNIYVERSSARWTVALTAAGSLLKSLLKEFGIEVLGFVTRLGNVEARDIPGDFEELKRRRDESVVFCPDPEATKEMVAEIDRAKEEGNTLGGKVKVIARGVPAGIGSYSDLFKKLDSKIGSLFFAIPAVKGVVIGSEEMWYGFDYLDEFELEDGKIKRKTNNLGGIEGGITNGEDVWVNVSVKPIPTTGKPLKSVDLRTMEPAKTPYVRSDVTAVPPASVVCEAALAVVISDALLEHLGDGNIDDLKRRFENENLPRWNDGFWKEHYR

SEQ ID NO: 2934 - protein, 492 aa, Thermotoga maritima
MRIFLVGMMGSGKSTIGKRISEVLDLQFIDMDEEIERREGRSVRRIFEEDGEEYFRLKEKELLKELVERDNVVVATGGGVVVDPENRELLKKEKTLFLYAPPEVLMERVTTENRPLLSEGKERIREIWEKRKQFYAEFRRIDTSRLNEWETTALVVLEALDEKEISTIEKPHLVKIILGGFKRVRNEELVFTTERVEKIYGRYLPENRLLFPDGEEVKTLEHVSRAYYELIRMDFPRGKTIAGVGGGALTDFTGFVASTFKRGVGLSFYPTTLLAQVDASVGGKNAIDFAGVKNVVGTFRMPDYVIIDPTVTLSMDEGRFEEGVVEAFKMTILSGRGVELFDEPEKIEKRNLRVLSEMVKISVEEKARIVMEDPYDMGLRHALNLGHTLGHVYEMLEGVPHGIAVAWGIEKETMYLYRKGIVPKETMRWIVEKVKQIVPIPVPSVDVEKARNLILNDKKILKGSRVRLPYVKEIGKIEFLEVDPLELLEVVD

SEQ ID NO: 2935 - protein, 144 aa, Thermotoga maritima
MKVLVVNGPNLNMLGKRDKNIYGNFSHEDLVKMIEDWGRKNGVEVEVFQSNHEGKILDRLHRLDFDGLVINPGAFTHYSYAIRDALEIVKVPKVEVHISNIHRREEFRRRSVTAEVCDGQISGLGVYGYLLALEYIKKKLEELT

SEQ ID NO: 2936 - protein, 441 aa, Thermotoga maritima
MIGYQIYVRSFRDGNLDGVGDFRGLKNAVSYLKELGIDFVWLMPVFSSISFHGYDVVDFYSFKAEYGSEREFKEMIEAFHDSGIKVVLDLPIHHTGFLHTWFQKALKGDPHYRDYYVWANKETDLDERREWDGEKIWHPLEDGRFYRGLFGPFSPDLNYDNPQVFDEMKRLVLHLLDMGVDGFRFDAAKHMRDTIEQNVRFWKYFLSDLKGIFLAEIWAEARMVDEHGRIFGYMLNFDTSHCIKEAVWKENTRVLIESIERAVIGKDYLPVNFTSNHDMSRLASFEGGFSKEKIKLSISILFTLPGVPLVFYGDELGMKGVYQKPNTEVVLDPFPWNESMCVEGQTFWKWPAYNGPFSGISVEYQKRDPDSILSHTLGWTRFRKENQWIDRAKLEFLCKEDKFLVYRLYDDQHSLKVFHNLSGEEVVFEGVKMKPYKTEVV

SEQ ID NO: 2937 - protein, 596 aa, Thermotoga maritima
MAEKKEFVVGIDLGTTNSVIAWMKPDGTVEVIPNAEGSRVTPSVVAFTKSGEILVGEPAKRQMILNPERTIKSIKRKMGTDYKVRIDDKEYTPQEISAFILKKLKNDAEAYLGGEIKKAVITCPAYFNDAQRQATKEAGIIAGLEVLRIINEPTAAALAYGLDKAGKEEKVLVYDLGGGTFDVSILEIGEGVIEVIATAGNNHLGGDDFDQRLIDWMAEEFKKQHGIDLREDRQALQRLRDAAEKAKIELSTKMETDVSLPFIAVSPSGQPLHLEMRITRSLFESLTRDLVEMTRGPIEQALNDAKLSPQDIDEIILVGGMTRVPMVQRFIKEFFGKEPNKSVNPDEAVAIGAAIQAAILAGTEGAKGRDIVLVDVTPLTLGIEVKGGLFEPIIPRNTKIPVRKSKIFTTVEDGQTEVEIRVYQGERPIARENIFLGSFKLVGIPPAPRGVPQIEVTFDIDSDGIVHVSAKDLGSGKEQSMVVTGRHKLSEDEIKRMIEDAKRYEEQDKRLKEEIELKNRADDLAYSVEKTLKEHGDKIPADLKSRLEDMIRELRDAINRNDIPKVKMLFDDLQKESMKIGEYLYKSATGGETSNQ

SEQ ID NO: 2938 - protein, 449 aa, Thermotoga maritima
MYDAVIIGGGPGGYVCAIKLAQLGKKVALVEKDALGGTCTNRGCIPTKAMLTVSHLMDEMKEKASKYGLKVSGVEYDVAAIMKHVQKSVMMSRKGIEYLLKKNGVEVFKGTAVVENKNTVVVQETGEKLEAKNLVLAHGSVPSVFSPFDIDGVWTSDDVFNLKEFPKSLVIVGGGVIGVEFATFFGSFGVDVTIVEIAEHILPYEDSDVAEEVKKALKRKGVKILEKTKISSLSKVDDGFEVALENGETLKAEKVLLAAGRKPNIPEDVKALGVKIEKGVVTDSRMRTNVENVYAIGDIRSGIMLAHVAMYEGIVAAKNIAGEEEEMDYSAVPSIIFSSPEVASVGVREKDVNPEEVVISKFPVSANGRARTMLENIGFAKVIADKKDGTVLGMSIVSPSATDMIMEGVIAVKFRMKAEDLEKAIHPHPTLTETILGALEGVSGKPIHL

SEQ ID NO: 2939 - protein, 301 aa, Thermotoga maritima
MVVLHSKGGFFLEILKVVDLKKHYGDVKAVDGISFTVERGTVFSFLGPNGAGKTTTVEILEGLRKKDSGEIYYFGERKDVLDRETKRKIGVCLQKSAFFENLTVWETLKLFRGLYGTGLDLKEVMGLFSLENIEKKMVKTLSGGQLQRLAVAVAFINDPEIVFLDEPTTGLDPQARRQIWDTIEHFKNLGKTIFLTTHYMEEAERLSDHVCIIDHGKIIAEGTPSSLISSSGLKTVVEFDCDQDVNVRYLEKKENHYVVETDAPEELIKDLLKNWNVSNIVIRKPNLEDVFLKLTGRDLRE

SEQ ID NO: 2940 - protein, 395 aa, Thermotoga maritima
MRAVRLHAKWDPRPEFKLGPKDIEGKLTWLGSKVWRYPEVRVEEVPEPRIEKPTEIIIKVKACGICGSDVHMAQTDEEGYILYPGLTGFPVTLGHEFSGVVVEAGPEAINRRTNKRFEIGEPVCAEEMLWCGHCRPCAEGFPNHCENLNELGFNVDGAFAEYVKVDAKYAWSLRELEGVYEGDRLFLAGSLVEPTSVAYNAVIVRGGGIRPGDNVVILGGGPIGLAAVAILKHAGASKVILSEPSEVRRNLAKELGADHVIDPTKENFVEAVLDYTNGLGAKLFLEATGVPQLVWPQIEEVIWRARGINATVAIVARADAKIPLTGEVFQVRRAQIVGSQGHSGHGTFPRVISLMASGMDMTKIISKTVSMEEIPEYIKRLQTDKSLVKVTMLNE

SEQ ID NO: 2941 - protein, 364 aa, Thermotoga maritima
MITTTIFPGRYVQGAGAINILEEELSRFGERAFVVIDDFVDKNVLGENFFSSFTKVRVNKQIFGGECSDEEIERLSGLVEEETDVVVGIGGGKTLDTAKAVAYKLKKPVVIVPTIASTDAPCSALSVIYTPNGEFKRYLFLPRNPDVVLVDTEIVAKAPARFLVAGMGDALATWFEAESCKQKYAPNMTGRLGSMTAYALARLCYETLLEYGVLAKRSVEEKSVTPALEKIVEANTLLSGLGFESGGLAAAHAIHNGLTVLENTHKYLHGEKVAIGVLASLFLTDKPRKMIEEVYSFCEEVGLPTTLAEIGLDGVSDEDLMKVAEKACDKNETIHNEPQPVTSKDVFFALKAADRYGRMRKNLT

SEQ ID NO: 2942 - protein, 470 aa, Thermotoga maritima
MPTIVFVGAGSVRYTIKLVGDLAKTPDLYGSRLVLMDIDEERLKATYILVTKYLRELNAEYTVEQTTSLEEALEGADFVINTALYRAPGHEDGYVHYEIMREVGERHGYYRGIDSQELNMVSDYYTLSNYNHLKMSLDIAKAVEKIAPNAWILQTANPVFEITQLVKRLTKAKIVGFCHGYAHVFHLAKVLGVEPEELDWQVAGVNHAIWMNRFRCRGEDLYPKLDEWIEENASRWEPKNPWDVDFSPAAIDMYRFYGMYPIGDTVRSGTWKYHYDLETKKRWYGKFGGIDNEVERPKFYESLREQRKRLMELAKEVEKDPTIELTKVWPEVFTTGSESVEQHIPFINALVNDKKARLVLNVENRGVIKGIPDDVMVEVPVVVDKEGIHPEKIEPDLTDRIKKFYLLPRILRMEWTLEAFISGDRRVLEEILVRDPRTRSYEQAVAVIDDILNLPFNEEMKKHYSKVGKN

SEQ ID NO: 2943 - protein, 469 aa, Thermotoga maritima
MKSHIGLIGLAVMGQNLALNIARKGYKVSVYNRTAQRTEEFVKNRVTNEEIEPHYDIESFVKSLERPRKIILMVKAGKPVDDTISQLLPHLEPGDLIIDGGNSHYMDTERRFKELSEKGILFLGMGVSGGEYGALHGPSLMPGGSREAYNLVEEILLEIAAKTEDGPCCTYVGERSAGHFVKMVHNGIEYAIMQAIAEVYHIMRDVLSLSSEEMSSIFEEWNRGELSSFLVEITYKILRKKDEETGKPMVDVILDKAEQKGTGKWTSQAALDLGIPTPSINLAVVERVISHFKDIRTRLSKLYNKRRSATQGSEEFLRDLRNSLFFAMFMAFSQGMWLIAEASKEFGYGVSLSEVLRIWKGGCIIRAKLIDTLRRYISNENAYLLENEEVMNLLKGKIDSLKNILKASIENEIPVPVLSSSYNYFMSLTEERLPANLIQAQRDFFGAHTFERVDREGVFHINWEEGEIG

SEQ ID NO: 2944 - protein, 255 aa, Thermotoga maritima
MKEVFDLRGRVALVTGGSRGLGFGIAQGLAEAGCSVVVASRNLEEASEAAQKLTEKYGVETMAFRCDVSNYEEVKKLLEAVKEKFGKLDTVVNAAGINRRHPAEEFPLDEFRQVIEVNLFGTYYVCREAFSLLRESDNPSIINIGSLTVEEVTMPNISAYAASKGGVASLTKALAKEWGRYGIRVNVIAPGWYRTKMTEAVFSDPEKLDYMLKRIPLGRTGVPEDLKGVAVFLASEEAKYVTGQIIFVDGGWTAN

SEQ ID NO: 2945 - protein, 476 aa, Thermotoga maritima
MIAAIDIGTESARLMFKSNGEWKVLKKSYRIFFPSPEAAEQDPNEIFSAVFDLLKQVPNEDEVLYVGMSSVFHSIIGLDENLNPVTPLLNWADRRSFREKEELEKKYGVRFFYEKTACPLHPMYWPSKILWMKKNSNAKKFCSIKAYIVNKMTREFVEELSLASGTGMMNIHSLEWDGEILEITGVRKEDLPEIKSPYTQLRVKDEIAKELGFKKVYLVLGGGDGVMTNVGVNVMDPDSATVTIGTSGAFRVVMDRPVIDREGISTWCYLIDEENYVLGGAINNGGIVLMWLRDIMKFKDYNDIIEEAKESPAGANGLVFLPFLNGERAPHWRERYRGVLVGLTSSHRRSDIARAALEGICFRIKDIHNAVKRVGSVDPNRIVATGGFTSSPYWVQLLSDVLGKDIIVTNVENPSAFGAYVMALKSLGEDVEGFIEKEVRVERVFHPDSERNAVYERLYNDYKFLYEKLVDYYYKE

SEQ ID NO: 2946 - protein, 458 aa, Thermotoga maritima
MRKERDYLGKLEIEGEVYYGIHTKRALMNFPSTGEKLDETFIWAYFMVKKACALLNTELGYLDERTGNAIVKACDEWEDLKKHVVVDPLSGGAGTSINMNVNEVIANRATEILGGKKGEYLVDPIDHVNLHQSTNDTFPTSAKIATIVKLRRLIDEVINLQEKIQEKEKEFYSIRKPGRTQLMDGPPIMLGQEFGAFADALARDRWRLYKVEERIRSVNIGGTAIGTGVGAPKDYILKIVEKVREVTKVKIAKAENLIDATQNWDVFAEVHGLLKSLAVNLYKISNDIRLLGSGPNTVIGELILPAVQAGSSIMPGKINPVVSEYVMQICHMVFGHDMILNHACALGNLELNQFAPLIVHLTLKSLTLLTNACRSLASYISKIKANNERCEEHLRRSVSNLTPLIKLFGYEAVSEAIKKANWDIKKAVEILSQEKNIPVEEILKVLNLKKMTGLGYSL

SEQ ID NO: 2947 - protein, 1263 aa, Thermotoga maritima
MKEISCGRRTRVSFGKSREPLPIPDLVEIQKSSYRRFLEEGLLEVLKKFSPIYSQATRSDLRKSDRGFALEFVSTRTGEPAIDPLECKAKGLTYSVPIYATARLTDMKSGEMKEEEVFLGYIPYMTDRGTFIINGAERVVVNQIVVSPGLYFSSEYIDREEYGGYFLPSRGAWLEVILDPYDGVLYAGLDGKKVNLFLFLKTIGYEKDEDILSLYPTYLDADDEDSLLLHVGSILLEDIYDGGRKIAEKWDILTKDLAERILMIDDINQIKIVHPIAQNTFEKMLEVVSSSSEEGEEEEEKTKIYGLNEVTVVDAYLEIFRRLRPEELPRINAAKRYLHDLFFNPERYDLSEVGRYKVNERLRNAYIRYLIEVEGEDPEEARKKVYNETSLVLKPLDIVLASRILFDYFERRYVNDFEIDSYELKNLIRIFKEEYLEKRKTAPYDLRKLVSVFRRNYGVTSDLGVFAAIRYVSNINKELPSIPFDTKDHLGNKRVRTVGELVQREFERLFARAQKAIQERLTLINSLSKVSIQSLINIKSIISTVNQFFAMNQLSQFMDQVNPLSELTHKRRVSAVGPGGLRRESKVFEARNVHYSQYGRLCPIETPEGANIGFITSLAIYAKIDEYGFLMTPYRKVVNGKVTDEVVYLRANEEEEYKIIPATTPVDEEGNIIPERVVARMGEDIRLVPKEEVDFMDVSTKQPFSVSASLIPFLEHDDASRALMGSNMQRQAVPLLKTEAPLVGTGMEWEAAKNSGYVILAEHDGIVKEVDAARVVVHRTDENGNLMYDDKGNPVVDEYRLLKFVRSNQDTMINQKPIVNEGDFVKKGDPIADGPATDMGELALGRNILVAFMPWEGYNYEDAILVSQELLEEDVFTSIHIEVYETQARETRLGPEEITADIPNVSKELLKNLDENGIIRVGAYVVSDYGVGSQAILVGKVTPKGEGDTTPEEKIIRSVFGERGRDVKDTSLRLPHGVEGRVIRVDVYDQNDIAELGAGVLKLVRVYVASRKTLDIGDKLAGRHGNKGVVSNILPKEDMPFLPDGTPVQMVLNPLGIPSRMNVGQILETHLGWLAKLTGKWFATPVFEGAKEDEILRPLYEERKKRGLHLGDDENNPNGKVVLRDGRTGEPFDNPVVVGYMYMLKLIHIAKEKIHARSTGPYSLIHQQPLGGKSHFGGQRLGEMEVWALEAYGAAHTLAEMLTIKSDDIKGRNEAYKAILKNMNIPEPGVPESFRVLIKELRGLALDVRLYDENGNEIDIDKY

SEQ ID NO: 2948 - protein, 235 aa, Thermotoga maritima
MIKVSQLTVRYGELKAVEDLSLEVQRGEILSLVGPSGCGKTTVVKAILGLIPYEGKIEIFTSRLGYCPQKDVLFDWMTVYENAVLPLVLRKEQPPSNIKELFERFGLSGFEEKRPYQLSGGMRQKLSLLRAVLSGEELLVLDEPFSSVDAYTRKKLQIWLSEIVHRMKSTVVLITHDVEEAVFLSDRILILSDRPARILKEIRVPFSKPRTIKTFSDPRFSEIEEEVLETLMNQP

SEQ ID NO: 2949 - protein, 92 aa, Thermotoga maritima
MMKVIPLGERLLIKPIKEEKKTEGGIVLPDSAKEKPMKAEVVAVGKIDDDEKFDIKVGDKVIYSKYAGTEIKIDDEDYIIIDVNDILAKIEE

SEQ ID NO: 2950 - protein, 538 aa, Thermotoga maritima
MPKILKFNEEARRALERGVDKVANAVKVTLGPKGRNVVIEKSWGSPTITNDGVSIAKEIELEDKFENLGAQLVKEVASKTNDVAGDGTTTATVLAQAMIKEGLKNVAAGANPILLKRGIDKAVEKAVEEIKKVSKKLSGREDIAHVAAISANSAEIGELIAEAMDKVGEDGVITVEDSKTLETYVEFTEGMQFDRGYISPYFVTDAEKMEVVLKEPFILITDRKLSAVKPLIPILEKVAQTGKPLLVIAEDVEGEVLTTLVLNKLKGTLQSCAVKAPGFGERRKAMLQDIAILTGGQVASEELGINLEDLTLEDLGRADLVRVKKDETIIIGGKGDPEAIKKRIAQIKAQIEETTSEYEKETLQERMAKLAGGVAVIKVGAATETELKEKKHRIEDALSATRAAVEEGIVPGGGVTLLRARKAVEKVIEELEGDEKIGAQIVYKALSAPIKQIAENAGYDGAVIIEKILSNDDPAYGFDALRGEYCNMFERGIIDPAKVTRSALQNAASIAGMLLTTEVLIVEKPEEKKETPSMPEEF

SEQ ID NO: 2951 - protein, 244 aa, Thermotoga maritima
MGAVVVKDLRKRIGKKEILKGISFEIEEGEIFGLIGPNGAGKTTTLRIISTLIKPSSGIVTVFGKNVVEEPHEVRKLISYLPEEAGAYRNMQGIEYLRFVAGFYASSSSEIEEMVERATEIAGLGEKIKDRVSTYSKGMVRKLLIARALMVNPRLAILDEPTSGLDVLNAREVRKILKQASQEGLTILVSSHNMLEVEFLCDRIALIHNGTIVETGTVEELKERYKAQNIEEVFEEVVKCSENF

SEQ ID NO: 2952 - protein, 348 aa, Thermotoga maritima
MKLGILEKYRRFLPVTDKTPMLSLNEGNTPLIPLVNMSRELGINIYVKYEGSNPTGSFKDRGMVVAVAKALEEGSKAIMCASTGNTSASAAAYAARAGIKAIVLIPEGKIALGKLAQAMIYGAVVLQVRGNFDKCLELVKEITSKYPITLVNSINPYRLEGQKTAAFEIVDELGDAPDYHFIPVGNAGNISAYWMGYKEYYQHGFSTKLPKMMGFQAEGAAPIVRGHPIENPETVATAIRIGNPANWEKAVRARDESGGDIDMVSDEEILRAQRLLAQKEGIFCEPASAASIAGLLKKHRQGIFRGGEIVVCTLTGNGLKDPNIVISQLEPPRIIEGRVEEILEVLDI

SEQ ID NO: 2953 - protein, 739 aa, Thermotoga maritima
MRTYRSFKMFTNSSQGVRKVRVGIAGLGTVGGSIYRILKERGNEIEKRIGEKFIISKVINRSPQKYELLGVPKEEIAFDFDDLILNSDVVVEAIGGTDVAVDLVRRALELGRIVVTPNKNLISEYGNEFSEYIKKRKLFFEASVGGGIPIISLLQDYLIFQKVTRIRGIMNGTTNYILTEMSKGRHFEEVLKEAQELGYAEADPTNDIEGYDVAYKVSVLAGVVTGRFPGINSVQFEGITRIDPEYLKEIVRSGKKLKLIGELDFSTNRYEVRLREVTPEDPFFNVDGVDNAIEVSTDLAGDFLLKGRGAGGYPTASAVIADLFRVAKYKVLGGAEKFSVVVMKFGGAAISDVEKLEKVAEKIIKRKKSGVKPVVVLSAMGDTTDHLIELAKTIDENPDPRELDLLLSTGEIQSVALMSIALRKRGYKAISFTGNQLKIITDKRYGSARIIDINTDIISRYLKQDFIPVVAGFQGITETGDITTLGRGGSDLTAIALAYSLGADLCELYKDVDGVYTADPRIVKDARVIKELSWEEMIELSRHGAQVLQARAAEFARKYGVKVLIKNAHKETRGTLIWEGTKVENPIVRAVTFEDGMAKVVLKDVPDKPGVAARIMRTLSQMGVNIDMIIQGMKSGEYNTVAFIVPESQLGKLDIDLLKTRSEAKEIIIEKGLAKVSIVGVNLTSTPEISATLFETLANEGINIDMISASSSRISVIIDGKYVEDAVKAIHSRFELDRE

SEQ ID NO: 2954 - protein, 417 aa, Thermotoga maritima
MTLAEKILSQKAGRKVEPGEFLLLEPDIALANDITAPLAIKKFKEYGGKKVKYPDRVVLVPDHFTPNKDIKSAMQVKMMREFAREQGIEKFFEIGRMGIEHVLLPEEGIVKSGDLVVGADSHTCTYGALGAFATGVGSTDIAGFYLIGKVWFRVPESIKVTLRGKFKDLVTAKDLVLKLISILGVDGANYKAIEFSGPGVKEISMDGRFTISNMAIEAGGKTGLFPVDEITIAYERERGIEVEEMYPDEDAKYVREVEMDLSELEPQVAYPFLPSNAKDVSEAEKERIKIDQAVIGSCTNGRIEDLRLAAQILKGRTVSPDVRCIIIPGSQKVYKQALKEGLIDIFIDAGCAVSTPTCGPCLGGHMGVLAEGEVAISTTNRNFVGRMGHPNSKVFLASPAVAAASAIKGYIADPRKL

SEQ ID NO: 2955 - protein, 1099 aa, Thermotoga maritima
MPKREDIKRILVIGSGPITIGQAAEFDYSGTQALKALKSAGYEVIIVNSNSATIMTDPEFSDAVYIEPLTVEFLEKIIEKERPDALLPTLGGQTALNLAVELAERGILDKYGVQLIGAKLESIKKAEDRELFKETMEKAGLEVLRSRLVNNLADALETAREFGYPVIIRPSFTLGGTGGGIAFNEEELRDIVTKGLIESPVHTVLIEESVLGWKEYELEVVRDGAGNFIVVCSIENLDPMGIHTGDSITVAPAQTLTDVEYQRMRDAAYKVIDAIGIETGGSNIQFALDPETGRMVVIEMNPRVSRSSALASKATGYPIAKVAALLAVGFTLDEIPNYITGKTMAAFEPSIDYVVVKIPRFQLEKFPGADPRLNTQMKSVGEVMAIGRTFKEALGKALRSLELDAAPKLDLEHIREHLANPTPERISYVFAAFRNGMDVEEVHELTKIDRWFLREMKACIELEEELKLKKFDVEILKKAKQWGYSDREIAEIWGVSEKEIRKMREDNRIFPVYKMVDTCAAEFEAQTPYYYSTYNGVENEAVPSDREKIMILGSGPNRIGQGIEFDYTNVHGVWSFQEEGYETIMVNSNPETVSTDYDTSDRLYFEPLTVEDVLEIVRNEKPKGVVVAFGGQTPLKIAKYLVEERVNIIGTSFESIEIAEDREKFAKLLKQIGLKCPPFGTASSVEEALRVAENLGYPVLVRPSYVLGGRAMAIVDTPQELEMYVKEAAVVSPGYPVLIDKFLEDAIELDVDVVSDGKYVWIAGLMEQIEEAGVHSGDSACVLPPVSLSEKLVEEIEETVYKLVKALKVVGVANIQLAVKDEEIYIIEANPRASRTVPFVSKAIGIPVARIAAKIMVGRNLPELLSEYFPYPTRPGVKVDKLGESEILPTPWPKMFSVKEVVIPFHKFPGTDVLLGPEMRSTGEVMGIGEDFAEAFAKAQIAAGNPLPTTGAILATVADKDKREAVPLLAHLADMGFEIYATRGTAKALQSHGVEVKVVPKVGEGRPDVIDLLEQGKISLVVITQSSDEPALVAVSHGKEPFKVEGRRTVGYMIRTTALKRKIPYLTTVESLRAAVAAIRKMKKGSIVKVRRLTDTWKM

SEQ ID NO: 2956 - protein, 392 aa, Thermotoga maritima
MSKKALLALEDGSFFFGQSLGAEGETFGELVFNTGMTGYQEVLTDPSYTGQIVVMTYPEIGIYGVNDEDVESDGIKVAGFVVYRSVDTPSNWRATMSFPDYLKKYNIVAIEGVDTRALTRKIRVKGAMKGAISTVDLDPDSLVKRVKESPSIVGRDLAGLVSPKEVIVENPEGDFSVVVLDSGVKWGILRDLKRVGAKVMRVPYSVDIDDIKKLNPDGVLISNGPGDPAALLKTIRLIKDLLKEEIPLAGICLGHQLLGLAVGGRTYKMKFGHRGINHPVKDLRTGRVLITTHNHGFAVDPKSFGLPELGSEDQDANVLTKNLQKISVLEGISPQGIKVEITHISLNDGTMEGMRLVDYPAFSVQYHPEASPGPHDAKYFFEEFKRLIKEVR

SEQ ID NO: 2957 - protein, 255 aa, Thermotoga maritima
MTIGIVGVGNMGSIFAEKFSKEAERILLVEKDSEKLSRFNAPPYEIADLEKVREADLIVLAVKPQDAPIVLSALKGFDGILLSIVAGLKIEEIRKYGIHKVARIMPNVAVRVGEGVLATAFSADMSLEERELVKSLLEKLGFVVEIEEKLFSAVTALTGSGPAFIFVVVEAFLDAALKMGIPLDTAKELVYRLFKGSAELLTETGEHPALWKHRVSSPAGTTIEGLITMERFAVRSGVIESLISSYRRALELEEK

SEQ ID NO: 2958 - protein, 610 aa, Thermotoga maritima
MNRSNIWNLLFTILIIVTLFWLARFFYVENSPVSKLSYTSFVQMVEDERSVVSEVVIRDDGVLRVYTKDGRVYEVDAPWAVNDSQLIEKLVSKGIKVSGERSGSSSFWINVLGTLIPTILFIVVWLFIMRSLSGRNNQAFTFTKSRATMYKPSGNKRVTFKDVGGAEEAIEELKEVVEFLKDPSKFNRIGARMPKGILLVGPPGTGKTLLARAVAGEANVPFFHISGSDFVELFVGVGAARVRDLFAQAKAHAPCIVFIDEIDAVGRHRGAGLGGGHDEREQTLNQLLVEMDGFDSKEGIIVMAATNRPDILDPALLRPGRFDKKIVVDPPDMLGRKKILEIHTRNKPLAEDVNLEIIAKRTPGFVGADLENLVNEAALLAAREGRDKITMKDFEEAIDRVIAGPARKSKLISPKEKRIIAYHEAGHAVVSTVVPNGEPVHRISIIPRGYKALGYTLHLPEEDKYLVSRNELLDKLTALLGGRAAEEVVFGDVTSGAANDIERATEIARNMVCQLGMSEELGPLAWGKEEQEVFLGKEITRLRNYSEEVASKIDEEVKKIVTNCYERAKEIIRKYRKQLDNIVEILLEKETIEGDELRRILSEEFEKVVE

SEQ ID NO: 2959 - protein, 434 aa, Thermotoga maritima
MLKEKLLSKTALLGVIGLGYVGLPLAVEKAKAGYRVLGFDIQKKRVDMVNRGENYIGDVVDEDLKDLVEKGMIRATTDFSEMKNCDVVTICVPTPLGKYKEPDLTYVINTAKEIAKYLHREMLVVLESTTYPGTTEEVVLPILESTGLKVGKDFYLAFSPERVDPGNKIYKTKNTPKVVGGVTEKCTELAKILYENVLEAPVHTVSSPRAAEMAKVLENTFRLVNISLINEVAIVARRMGINIWEVIDAAATKPFGFMPFYPGPGAGGHCIPIDPFYLAYKAKEYDVRLDLVEMAGEINDFMPEYVVMRVQDILNERKKPLNGSKVLLLGVAYKGDIDDTRESPALKVWDHLEKKKAVVEFFDPYVPEVKRGDRIHRRVELTEEYLKGVDIVVITTAHKNGVDYDFVVKNAPVVFDTKNITKDVKENRDKIILL

SEQ ID NO: 2960 - protein, 346 aa, Thermotoga maritima
MMGKTEYLDYYSGKRVLVTGGAGAVGSNLVRRLLDLGAFVIVIDNLSSGYTWLLPQDAPNLLFIEGDITNDVDLKRVFNEEPEIIFHLAAFFANQNSVDYPEKDLWVNGFGTLKLLEYTRIYGKVERFVYASSGCSIYPSDAPMPFKEDLPISSWMSTPYQITKALGELYCNYFYKMYDIPITKARFFNSFGPGEVPGQYRNVIPNFIYWAMLGKPLPITGTGEETRDFTYVGDIVDGLLRMGYYREAIGEAFNLAAGREVKIKYLAEKVNELTGNTAGIVFKPRRKWDTKPRMLASNEKAKKVLGFNPDPDFDGRLAETVEWFKQNWELIKKSAEFGPGVSSAVR

SEQ ID NO: 2961 - protein, 81 aa, Thermotoga maritima
MASREEIFSKVKSIISEKLGVDESQVTEEAKLIDDLGADSLDLVDLVMDFESEFGVKVDDADLEKISTVGDIVSYIEKKLG

SEQ ID NO: 2962 - protein, 304 aa, Thermotoga maritima
MPGKRRGFFVVFLITFLILVILFMYGYISFEINRLYGGRVSPFEDWKSYIAFLASKVPFLKDRISYQPLKAESPAEYYSRIYQRYIEIYNQKIDELISKEKELEEQAKVLEAQRNVVEKMIEEIQSLKNQLLEEKNRLESYKKQVDELVNVLLNTDPRNLASALNEVDDETLAVIFKRTDPEYAGEFLEALSGVNPQKAARVMELMVGVESTIERLETLVKQAQEAVKQITEKESQLFQKEAYLKAVADALNNITPEVAVDFLRREKVDPETLRTVLSMMDREHASVLVQYIVQNAPDLLEERK

SEQ ID NO: 2963 - protein, 333 aa, Thermotoga maritima
MARVAINGFGRIGRLVYRIIYERKNPDIEVVAINDLTDTKTLAHLLKYDSVHKKFPGKVEYTENSLIVDGKEIKVFAEPDPSKLPWKDLGVDFVIESTGVFRNREKAELHLQAGAKKVIITAPAKGEDITVVIGCNEDQLKPEHTIISCASCTTNSIAPIVKVLHEKFGIVSGMLTTVHSYTNDQRVLDLPHKDLRRARAAAVNIIPTTTGAAKAVALVVPEVKGKLDGMAIRVPTPDGSITDLTVLVEKETTVEEVNAVMKEATEGRLKGIIGYNDEPIVSSDIIGTTFSGIFDATITNVIGGKLVKVASWYDNEYGYSNRVVDTLELLLKM

SEQ ID NO: 2964 - protein, 654 aa, Thermotoga maritima
MEKMTIRDVDLKGKRVIMRVDFNVPVKDGVVQDDTRIRAALPTIKYALEQGAKVILLSHLGRPKGEPSPEFSLAPVAKRLSELLGKEVKFVPAVVGDEVKKAVEELKEGEVLLLENTRFHPGETKNDPELAKFWASLADIHVNDAFGTAHRAHASNVGIAQFIPSVAGFLMEKEIKFLSKVTYNPEKPYVVVLGGAKVSDKIGVITNLMEKADRILIGGAMMFTFLKALGKEVGSSRVEEDKIDLAKELLEKAKEKGVEIVLPVDAVIAQKIEPGVEKKVVRIDDGIPEGWMGLDIGPETIELFKQKLSDAKTVVWNGPMGVFEIDDFAEGTKQVALAIAALTEKGAITVVGGGDSAAAVNKFGLEDKFSHVSTGGGASLEFLEGKELPGIASIADKKKITRKLILAGNWKMHKTISEAKKFVSLLVNELHDVKEFEIVVCPPFTALSEVGEILSGRNIKLGAQNVFYEDQGAFTGEISPLMLQEIGVEYVIVGHSERRRIFKEDDEFINRKVKAVLEKGMTPILCVGETLEEREKGLTFCVVEKQVREGFYGLDKEEAKRVVIAYEPVWAIGTGRVATPQQAQEVHAFIRKLLSEMYDEETAGSIRILYGGSIKPDNFLGLIVQKDIDGGLVGGASLKESFIELARIMRGVIS

SEQ ID NO: 2965 - protein, 309 aa, Thermotoga maritima
MAFLLTALGIAILVIGANWLVTGASSLALTLGISKLIVGLSVVAFGTSLPELVSSLVSASKGYSSIAISNVVGSNIANVGLCLGLAAVLRAVPVKRSTVRSEIPFMILATISFISLFLKNYYLSWHDGVVFLSFMVIFMYYLITSAKEVVEEELEEIKPQKSVAVSLLMIVGGILALWFGGDLAIENAVKIAETFGLSQAFIGLTVIAVGTSLPELVVSIVSTAKKESDILVGNIVGSNVFNILLILGVSSFFGRLTVDVNYSVDLWFLFITSALLLVFAVSRRRISRFEGAVFLIIYSVYVYFVVLRG

SEQ ID NO: 2966 - protein, 406 aa, Thermotoga maritima
MNIAMFSDTYAPQINGVATSIRVYKKKLTERGHKVVVVAPSAPEEEKDVFVVRSIPFPFEPQHRISIASTKNILEFMRENNVQIIHSHSPFFIGFKALRVQEEMGLPHVHTYHTLLPEYRHYIPKPFTPPKRLVEHFSAWFCNMTNVVIAPTEDIKRELESYGVKRPIEVLPTGIEVEKFEVEAPEELKRKWNPEGKKVVLYAGRIAKEKNLDFLLRVFESLNAPGIAFIMVGDGPEREEVEEFAKEKGLDLKITGFVPHDEIPLYYKLGDVFVFASKTETQGLVLLEALASGLPVVALKWKGVKDVLKNCEAAVLIEEENERLFAEKIKHILKNDRLREELSTKGREFVRKEWSVDRFVQRLEEIYTRAIEEGPVEINTSLMIKEFVKFEKLKEFFSKIEDRIWR

SEQ ID NO: 2967 - protein, 471 aa, Thermotoga maritima
MKISIIGAGSVRFALQLVGDIAQTEELSREDTHIYMMDVHERRLNASYILARKYVEELNSPVKIVKTSSLDEAIDGADFIINTAYPYDPRYHDSGSQRWDEVTKVGEKHGYYRGIDSQELNMVSTYTYVLSSYPDMKLALEIAEKMKKMAPKAYLMQTANPVFEITQAVRRWTGANIVGFCHGVAGVYEVFEKLDLDPEEVDWQVAGVNHGIWLNRFRYRGEDAYPLLDEWIEKKLPEWEPKNPWDTQMSPAAMDMYKFYGMLPIGDTVRNGSWKYHYNLETKKKWFGKFGGIDNEVERPKFHEQLRRARERLIKLAEEVQQNPGMKLTEEHPEIFPKGKLSGEQHIPFINAIANNKRVRLFLNVENQGTLKDFPDDVVMELPVWVDCCGIHREKVEPDLTHRIKIFYLWPRILRMEWNLEAYISRDRKVLEEILIRDPRTKSYEQIVQVLDEIFNLPFNEELRRYYKEKL

SEQ ID NO: 2968 - protein, 471 aa, Thermotoga maritima
MILFGTGGIRGVMRKGEFDEETVKRASLSTALWLKEKGQKSVVIAYDTRKNSKEFAELAGRVFAGEGIEAYVFPEPTPTPVLSFAVRYMKTGGGVVITASHNPPEYNGYKVYTWDGVQAIPEYTNEITEIYKKVDLSHVKEGEIKFVPPEVKESYIKAVLEIVSNLPMKTDLDIAYSPLHGTGANYVPEVLKRLGFKVRLVEEQMKPDPNFSTVPTPNPEEDEALVLLNKKGATLGLATDPDCDRVGVVFKGRRLTGNQVGVLLTDFLLDHVKVENPLVIKTIVTTDMVRPICEEKGAFLEETPTGFKFIGHLIEEHTKKGDRNFVFGFEESCGYLAGNHARDKDGVVGSVLSAVAFSNYDPYEKLEELYQKYGYYMEKLINFKFEDVDRAVEIYRSLKNYDGIIDYSKGYGNVIPNETIAFVFEKSRIFVRPSGTEPKLKVYIHVRGDTREEAEELMKESESKIKEILKL

SEQ ID NO: 2969 - protein, 260 aa, Thermotoga maritima
MDSERRELISLIVARGLTRKFGDFTAVDHIDLSVRPGEIYGFLGPNGAGKTTTIKMLTGVLKPTEGEVEILGMKMSTHEIEIKKSIGVIPDEPKIYSHLTGKEFLDFIIEIYDLKEEEIDKRIAELCEAFKVDYLGKRVGEMSHGMKQKLMLVSVFMRKPKVIFLDEPTVGLDAKSARILKLLLRKYADEGAAIFLTTHILEIAEKMCDRIGIINKGRLIAEGTMEELRKLAGQKEASLEDLFLQLTAEGEEIEEIIKEL

SEQ ID NO: 2970 - protein, 293 aa, Thermotoga maritima
MRAFVFPGQGSQYSGMAKDFSVYESSKEIFERSKKVLGFDITEIMNGDEETLKLTENAQPSIYITSYIAFLELEKRGILPDVVAGHSLGEYTALAVAGVYDFETGLYLVRKRGEYMSKALEPGKGTMAAVIGLNIETIEEVVNSIEGVYIANYNSHDQVVISGLKESVEKAMEILKEKGARRVVELMVSSPFHTPFLEYAREKMKEEVEKVDFKKPRWPIVMNSTAKPTENPEEIKRNIIEQITGPVLWKQSVDTMKKMGVTEFVEVGPKTVLKNLCRRMGANAKHFTEILSE

SEQ ID NO: 2971 - protein, 137 aa, Thermotoga maritima
MNIDYVKSILPHRYPFLLVDGVIEESEDRIVAFKNISISDPVFQGHFPEYPIYPGVLIVEGLAQTAGILLLKSVEGIPLFLGIDEARFKKEVRPGDRLIYEVRKLGEKLGTVQVEGVAKVDDKIVAKARLLLGVKKK

SEQ ID NO: 2972 - protein, 412 aa, Thermotoga maritima
MKRVVITGMGIVSPFGVGKERNLEGLRETKVTIDRISSFDASNLPVQIAAEVRDFKPEEYINPKLVRRTDRFVHFALVSAKEAVEDAGINFEPYADRTATIIGSGMGGFLTLDSENNKFLSQGPSRVSPFLIPMILIDMASGVVAMEYGLKGPNFSSVSACASSLHAVALGALLIRHGYADVAVVGGTEATIAPLPITGFANMRALSRRNDDPKRASRPFDKDRDGFVMGEGGAVLILEAEEVAKSRGAKILAEIKGVGMTDDAYHFSAPDPEGRGAAEAMKLALKESSLAVEDIDYVSCHATSTPAGDEAELKAIKKVLGEHVKNVAINSSKALIGHLLGAAGASELVLAILQMQNSFVHGMPNLDNPIDEAKGTGLVGKEPVQMEIKNFIKNSFGFGGHNVSIVVGRYES

SEQ ID NO: 2973 - protein, 215 aa, Thermotoga maritima
MEGRIPLIGEEFPRVEVKTTHGKKVLPDDFRGKWFVLFSHPADFTPVCTTEFVAFQKRYDEFRKLNTELIGLSIDQVFSHIKWIEWIKEKLGVEIEFPVIADDLGEVSRRLGLIHPNKGTNTVRAVFIVDPNGIIRAIVYYPQEVGRNIDEILRAVKALQTSDEKGVAIPANWPSNELINDSVIVPPASSVEEARKRLESKDFECYDWWFCYKKV

SEQ ID NO: 2974 - protein, 395 aa, Thermotoga maritima
MENFVFHNPTKIVFGRGTIPKIGEEIKNAGIRKVLFLYGGGSIKKNGVYDQVVDSLKKHGIEWVEVSGVKPNPVLSKVHEAVEVAKKEKVEAVLGVGGGSVVDSAKAVAAGALYEGDIWDAFIGKYQIEKALPIFDVLTISATGTEMNGNAVITNEKTKEKYGVSSKALYPKVSIIDPSVQFTLPKEQTVYGAVDAISHILEYYFDGSSPEISNEIAEGTIRTIMKMTERLIEKPDDYEARANLAWSATIALNGTMAVGRRGGEWACHRIEHSLSALYDIAHGAGLAIVFPAWMKYVYRKNPAQFERFAKKIFGFEGEGEELILKGIEAFKNWLKKVGAPVSLKDAGIPEEDIDKIVDNVMLLVEKNLKPKGASLGRIMVLEREDVREILKLAAK

SEQ ID NO: 2975 - protein, 369 aa, Thermotoga maritima
MKKEKKDYYEILGVPRDATQEEIKRAYKRLVKEWHPDRHPENRKEAEQRFKEIQEAYEVLSDPQKRAMYDRFGYVGEQPTYQETESGGFFDDIFRDFENIFNRDIFDVFFGERPHQEERREYARRGEDIRYEIEVTLSDLINGAEIPVEYERYETCPRCGGTGVEPNAGYMDCPSCGGTGRIREERRSFFGYFVSERTCERCGGTGKIPREYCHECGGSGRVLRKVRRTVKIPPNVEDGTHLRITGGGNAGYYGGPYGDLIIIVRVKPDPRFKKSGSDLVYDVTIDYLQAILGTTVEVPLPEGGTTMLKIPPGTQPETVFRLKGKGLPNRYGRRGDLIVNVHVEIPKSLSREERKVLEELAKKRGVTIG

SEQ ID NO: 2976 - protein, 355 aa, Thermotoga maritima
MKKAIVLCAGKGTRLRPLTFTTAKHLIPIANKPILFYSLENIARAGIEEVGIVVSPHNAEEFKSIVGTGENFGLRISYIIQEEPKGLAHAVWVSREFLGDEDFMMYLGDNLILEDLGKFVKDFENSDYAASILLSPVKDPTRFGVAVMEGDRVIKVVEKPKTPPSNLAIVGLYLFRNKIFEGIKNIKPSWRGELEITDAIEYLIEKGEKVRGYIVYGWWKDTGKPEDLLEANRKILMETTEELLGEMDDKSSIQGPVRIGKASKIVNSVIRGPAVIGENCFIKNSYVGPYSSIGNRVILEDCEVENSIVMDECSITGVEKRIDSSILGKGVSVKGSQKRPASLNLILGNMSRVEL

SEQ ID NO: 2977 - protein, 427 aa, Thermotoga maritima
MEIVDVRAREVLDSRGNPTVEAEVVLEDGTMGRAIVPSGASTGKFEALEIRDKDKKRYLGKGVLKAVENVNETIAPALIGMNAFDQPLVDKTLIELDGTENKSKLGANAILAVSMAVARAAANYLGLPLYKYLGGVNAKVLPVPLMNVINGGQHADNNLDLQEFMIVPAGFDSFREALRAGAEIFHTLKKILHEAGHVTAVGDEGGFAPNLSSNEEAIKVLIEAIEKAGYKPGEEVFIALDCAASSFYDEEKGVYYVDGEEKSSEVLMGYYEELVAKYPIISIEDPFAEEDWDAFVEFTKRVGNKVQIVGDDLYVTNVKRLSKGIELKATNSILIKLNQIGTVTETLDAVEMAQKNNMTAIISHRSGESEDTFIADLAVATNAGFIKTGSLSRSERIAKYNQLLRIEEELGKVAEFRGLKSFYSIKR

SEQ ID NO: 2978 - protein, 430 aa, Thermotoga maritima
MDWKKYGYNTRALHAGYEPPEQATGSRAVPIYQTTSYVFRDSDHAARLFALEEPGFIYTRIGNPTVSVLEERIAALEEGVGALAVASGQAAITYAILNIAGPGDEIVSGSALYGGTYNLFRHTLYKKSGIIVKFVDETDPKNIEEAITEKTKAVYLETIGNPGLTVPDFEAIAEIAHRHGVPLIVDNTVAPYIFRPFEHGADIVVYSATKFIGGHGTSIGGLIVDSGKFDWTNGKFPELVEPDPSYHGVSYVETFKEAAYIAKCRTQLLRDLGSCMSPFNAFLFILGLETLSLRMKKHCENALKIVEFLKSHPAVSWVNYPIAEGNKTRENALKYLKEGYGAIVTFGVKGGKEAGKKFIDSLTLISHLANIGDARTLAIHPASTTHQQLTEEEQLKTGVTPDMIRLSVGIEDVEDIIADLDQALRKSQEG

SEQ ID NO: 2979 - protein, 486 aa, Thermotoga maritima
MKVVFVSYEVFPFAKVGGLADVAGTLPKYLKKHGVDVTIVMPKHRIVEKNAEKFGYEIKKVAESLSVSHVKTDQKFDIYESVLPGSDVKTYFVANDYYFSAEDVYAGPDLGEQAIFFCAATLDLVKHLDLKPDIVHVNDWQTALIPVYLKTVYRDDPYFSRTATVLTIHNLGYQGVFDPKYLSFAGLPDYVYTIDGLEFYGQLNFLKGGIVFSDVINTVSPTYAEEIQTEEYGEKLDGVLRMRSKDLYGILNGIDYELYNPATDRYIYVNYDVNRLELKWENKVKLQEELGLPVNKETAVAGLISRLVPQKGLDLLVDVMDYLTLFDLQIVVLGTGDEQYENAFRKFQERYPDKVSANIKFDVELAQKIYAGADIFLMPSRYEPCGLGQMFSMRYGTIPVVRYTGGLADTVKEYDPQSMEGTGFGFKKYDSAHLLKAVSKALHFYYREKDHWRRIMTNAMNTDLSWDRSAKEYVDLYKKALAKVGR

SEQ ID NO: 2980 - protein, 336 aa, Thermotoga maritima
MPEFRKDPIIKRWVIIATERAKRPHDFARTKVEEVREGFCPFDYGNEHTTPPEIFAFRPADTEPNTPGWWVRVVPNKFPAVDPNAPLRKYGRGMYDAAMGFGYHDVVVETPDHNSHLAVMDYKNVEEVIWAYKIRYEQLMKDERIKYILIFKNHGRDAGASLSHPHSQIIALPIMPKRVQEELDGSKEYYEYKERCPFCDIIDEEKRERERIVEENDHFIALEPFAARFPFETWILPKRHMNSFHLISEDEVGSLAKILKNVLYRIYAALDNPPYNLLIHTAPTSLEGKDYYHWHIEIFPRLTKVAGFEWGTGFYINTVPPEDAARYLREVSLEQV

SEQ ID NO: 2981 - protein, 359 aa, Thermotoga maritima
MWEFYMPTDVFFGEKILEKRGNIIDLLGKRALVVTGKSSSKKNGSLDDLKKLLDETEISYEIFDEVEENPSFDNVMKAVERYRNDSFDFVVGLGGGSPMDFAKAVAVLLKEKDLSVEDLYDREKVKHWLPVVEIPTTAGTGSEVTPYSILTDPEGNKRGCTLMFPVYAFLDPRYTYSMSDELTLSTGVDALSHAVEGYLSRKSTPPSDALAIEAMKIIHRNLPKAIEGNREARKKMFVASCLAGMVIAQTGTTLAHALGYPLTTEKGIKHGKATGMVLPFVMEVMKEEIPEKVDTVNHIFGGSLLKFLKELGLYEKVAVSSEELEKWVEKGSRAKHLKNTPGTFTPEKIRNIYREALGV

SEQ ID NO: 2982 - protein, 254 aa, Thermotoga maritima
MGNIYKRFARVFHEGPYTSFSRRIAKNFAKILENFHIRGKKVLDVACGEGTFAVEIAKQGFKVVGVDLSSEMLKFARKRAKEESISVVFLKKDMRELDFHEEFDIVTCWFDSLNYLLDYKDLKKTFEKVHEALKTGGAFLFDMNTVYGLLMANQEGPVYIQQDGKDIFEVQTIEFDLEESVATFYVTVFERKEEELWERFDEIHRERGYRVKEIASALSETGFVFSFYEDLLSKSPLTSYSRRLWCAARKVSAG

SEQ ID NO: 2983 - protein, 439 aa, Thermotoga maritima
MTIETIKRIIEEENVRFIRLQFTDINGTLKNLEITPDVFLESWEDGIMFDGSSIEGFVRIEESDMYLKPVLDTFAVLPWTVDGAKSARVICDVYTPDGKPFEGDPRYRLRRMMEKAEQLGYTPYAGPEMEFFILPINEKGEPVPEFLDHGGYFDLLPLSKVEEIRRDIAIALEKMGITVEATHHEVAPSQHEVDFRYDTFLRTADNAQTVKLVIKTMAIFHGYHATFMPKPFYGVNGSGMHVHMSLFRGDKNAFYDPDDPLGLSKELRYFVGGILKHAKALAAVTNPTINSYKRLVPGYEAPVYISWSVGNRSALIRIPKARGKATRLEYRSPDPSCNIYLAFAAILAAGLDGIINKIEPPAPVEENIYHMTSERREELNIESLPGSLKEAVEELKKDDVIIDALGEHIFEKFVEAAEKDWKEFSTYVTNWELQRYLYL

SEQ ID NO: 2984 - protein, 492 aa, Thermotoga maritima
MYVLAIDQSTSGTKAIIFDEKGGIVHRVTVYHKQYYPKPGWVEHDPEEIFRNTLDACRKVIEESGIKPLEIEALAITNQRETTILWEKKSGKPVYNAVVWQCQRGASLCEEIKKRGLEGKIKEKTGLVVDPYFSASKIRWILDNVEGVKNKAKQGEIAFGTVDSWLIWKLTKGEVHATDFSNASRTLLLNIHELRWDEEVLEIFEIPPEILPELKSSDSVFGYTDLGFLPKKIPIVGVMGDSSAALFGQGGFYSGDIKVTYGTGSSTMLNIGEKPNVSDSPIVCSVGWVVKETSSYVLEGNIHSAGDTIVWLKEKLGIISDPSETEKIALSLENNGGVYLVPAFVGLGAPYWRSDVKAAILGLQRNHGKEHVVRAALESIAYQVRDIFEEMVRISSKEPTEVRADGGITRNRFLMQFQADILNIPVLVSNIEEVSARGVAFVALLHLGAFSDLEEIRQKITYREKYEPRMGDELREMYYEGWKTAIRKLLTE

SEQ ID NO: 2985 - protein, 299 aa, Thermotoga maritima
MFLVISVVGSSNIDIVLKVDHFTKPGETQKAIEMNVFPGGKGANQAVTVAKIGEKGCRFVTCIGNDDYSDLLIENYEKLGITGYIRVSLPTGRAFIEVDKTGQNRIIIFPGANAELKKELIDWNTLSESDILLLQNEIPFETTLECAKRFNGIVIFDPAPAQGINEEIFQYLDYLTPNEKEIEALSKDFFGEFLTVEKAAEKFLELGVKNVIVKLGDKGVLLVNKNEKKHFPTFKVKAVDTTAAGDVFNGAFAVALSEGKNPEEAVIFGTAAAAISVTRLGAQSSIPAREEVEAFLKNL

SEQ ID NO: 2986 - protein, 286 aa, Thermotoga maritima
MQVPKVTLNNGVEMPILGYGVFQIPPEKTEECVYEAIKVGYRLIDTAASYMNEEGVGRAIKRAIDEGIVRREELFVTTKLWVSDVGYESTKKAFEKSLKKLQLEYIDLYLIHQPFGDVHCAWKAMEEMYKDGLVRAIGVSNFYPDRLMDLMVHHEIVPAVNQIEIHPFYQRQEEIEFMRNYNIQPEAWGPFAEGRKNIFQNGVLRSIAEKYGKTVAQVILRWLTQKGIVAIPKTVRRERMKENISIFDFELTQEDMEKIATLDEGQSAFFSHRDPEVVKWICSLKR

SEQ ID NO: 2987 - protein, 416 aa, Thermotoga maritima
MPEKSLYEMAVEQFNRAASLMDLESDLAEVLRRPKRVLIVEFPVRMDDGHVEVFTGYRVQHNVARGPAKGGIRYHPDVTLDEVKALAFWMTWKTAVMNLPFGGGKGGVRVDPKKLSRNELERLSRRFFSEIQVIIGPYNDIPAPDVNTNADVMAWYMDTYSMNVGHTVLGIVTGKPVELGGSKGREEATGRGVKVCAGLAMDVLGIDPKKATVAVQGFGNVGQFAALLISQELGSKVVAVSDSRGGIYNPEGFDVEELIRYKKEHGTVVTYPKGERITNEELLELDVDILVPAALEGAIHAGNAERIKAKAVVEGANGPTTPEADEILSRRGILVVPDILANAGGVTVSYFEWVQDLQSFFWDLDQVRNALEKMMKGAFNDVMKVKEKYNVDMRTAAYILAIDRVAYATKKRGIYP

SEQ ID NO: 2988 - protein, 293 aa, Thermotoga maritima
MSVVEVRDLTKYYGKSRGVEGVTFSVEEGEIFGFIGPNGAGKTTTIRLLLGLIFPDSGLAEIFGKDVLKEGKEIRKNVGYIPGEVSFYPEVTVEEFLRYSASFYEKVDWDYVKELCGVFSLDTKKRIKELSMGNKKKVAIVQALMHRPKLLILDEPTNGLDPIVQNTFFEILKNEKEKGTTVFFSSHILSEVERLCDRVAMIKDGRIIRVEKVENLKGERYKVVRVKGENLEKLKDLAEVNRLKFENGTAEFLFSGNVERLLEILRSLKLSDFWVEEPSLEEIFMSYYREGEE

SEQ ID NO: 2989 - protein, 197 aa, Thermotoga maritima
MMTLYPVVVQERTTGEVLMLAYANEEALELTKKTGYAHFFSRERQKIWKKGETSGNTMRVVEIRRDCDDDAYLYIVDFPEDKVACHTGNRSCFFKVEHRFEETGSPTFWLELYRLVRKRKEEMPEGSYTVKLFKEGKGKIAKKFGEEAVEVITGYLQNDRENLVWEIADMMYHLTVLMADAGVTVQDVMRELEKRRK

SEQ ID NO: 2990 - protein, 253 aa, Thermotoga maritima
MLAKRIIACLDVKDGRVVKGTNFENLRDSGDPVELGKFYSEIGIDELVFLDITASVEKRKTMLELVEKVAEQIDIPFTVGGGIHDFETASELILRGADKVSINTAAVENPSLITQIAQTFGSQAVVVAIDAKRVDGEFMVFTYSGKKNTGILLRDWVVEVEKRGAGEILLTSIDRDGTKSGYDTEMIRFVRPLTTLPIIASGGAGKMEHFLEAFLAGADAALAASVFHFREIDVRELKEYLKKHGVNVRLEGL

SEQ ID NO: 2991 - protein, 195 aa, Thermotoga maritima
MTVERLENGVIVQRNTNEIEISITLDTVHGKLEGSTGVNFFDHLLNTFCHYSGLGLRVSTCESKDGILHHLIEDFGISLGLAFRELFDYTKVRRFGEATVPMNEALVGCYVDLSGRPFFQKNFEFSVEKIEDMPVEGFEEFMCGFVNHARITVHFFKFFGKNDHHISESAMKSFGLAIAKALESSEKKTTKGVID

SEQ ID NO: 2992 - protein, 335 aa, Thermotoga maritima
MNPLDLIAKRAYPYETEKRDKTYLALNENPFPFPEDLVDEVFRRLNSDALRIYYDSPDEELIEKILSYLDTDFLSKNNVSVGNGADEIIYVMMLMFDRSVFFPPTYSCYRIFAKAVGAKFLEVPLTKDLRIPEVNVGEGDVVFIPNPNNPTGHVFEREEIERILKTGAFVALDEAYYEFHGESYVDFLKKYENLAVIRTFSKAFSLAAQRVGYVVASEKFIDAYNRVRLPFNVSYVSQMFAKVALDHREIFEERTKFIVEERERMKSALREMGYRITDSRGNFVFVFMEKEEKERLLEHLRTKNVAVRSFREGVRITIGKREENDMILRELEVFK

SEQ ID NO: 2993 - protein, 428 aa, Thermotoga maritima
MILMNNPGDKEVLRLLKQRMESVSQVEETVKEIIRRVKEEGDRALEEFLKRFEKHPVGIENLRVTEKEISEAQVEEEFVETIKIVIEDLKEFHRRQEERSFFFTTKGGSFLGEMVVPLESVGIYVPGGKVPYFSTLLMCAVPAIVAGVERIAVTTPPNENGGISPYILKTCEILGLKEIYRMGGAHAVAALTYGTETVKPVDKIVGPGGVFVTLAKKHVYGDVGIDSIAGPSEIAIVTDGSADLDLIAADFLSQAEHDENAMSVVITTSKEVFEKLPQVIERHLEALPEERRKTARISTENFGTIILTDSLKRAFEISNLIAPEHLEVLVENPFEPLGHIKNAGSVFLGKYTCESVGDYGAGPNHVLPTFRSARFSSGLRVSDFTKKIFITHLSEEDFRRKSELYSKMARWEGFEAHARAIDVRREKL

SEQ ID NO: 2994 - protein, 236 aa, Thermotoga maritima
MDVLRCENLKKRFGRRYVVNGVNLEFHRGEIVGLLGPNGAGKTTIFNMILGVVVPTSGKIIFRDVDITKFPVYRRARLGITYLQQETSIFGGLTVRENIDLVLRFHEKDKEKRERKIEELLHEFHLKHLENQPASFLSGGEKRKLELARMMCLNPAFILLDEPFSGIDPKTVKEIQKMTLELKQKNFGIVITDHNVDELVEIADRIYVIYKGEILAEGSPERILEDETVREVYLGT

SEQ ID NO: 2995 - protein, 563 aa, Thermotoga maritima
MVRPQRNKKRFILILNGVWNLEVTSKDRPIAVPGSWNEQYQDLCYEEGPFTYKTTFYVPKELSQKHIRLYFAAVNTDCEVFLNGEKVGENHIEYLPFEVDVTGKVKSGENELRVVVENRLKVGGFPSKVPDSGTHTVGFFGSFPPANFDFFPYGGIIRPVLIEFTDHARILDIWVDTSESEPEKKLGKVKVKIEVSEEAVGQEMTIKLGEEEKKIRTSNRFVEGEFILENARFWSLEDPYLYPLKVELEKDEYTLDIGIRTISWDEKRLYLNGKPVFLKGFGKHEEFPVLGQGTFYPLMIKDFNLLKWINANSFRTSHYPYSEEWLDLADRLGILVIDEAPHVGITRYHYNPETQKIAEDNIRRMIDRHKNHPSVIMWSVANEPESNHPDAEGFFKALYETANEMDRTRPVVMVSMMDAPDERTRDVALKYFDIVCVNRYYGWYIYQGRIEEGLQALEKDIEELYARHRKPIFVTEFGADAIAGIHYDPPQMFSEEYQAELVEKTIRLLLKKDYIIGTHVWAFADFKTPQNVRRPILNHKGVFTRDRQPKLVAHVLRRLWSEV

SEQ ID NO: 2996 - protein, 466 aa, Thermotoga maritima
MPTIVFVGAGSVRYTIKLVGDLAKTPDLYGSRLVLMDIDEERLKATYILVTKYLRELNAEYTVEQTTSLEEALEGADFVINTALYRAPGHEDGYVHYEIMREVGERHGYYRGIDSQELNMVSDYYTLSNYNHLKMSLDIAKAVEKIAPNAWILQTANPVFEITQLVKRLTKAKIVGFCHGYAHVFHLAKVLGVEPEELDWQVAGVNHAIWMNRFRCRGEDLYPKLDEWIEENASRWEPKNPWDVDFSPAAIDMYRFYGMYPIGDTVRSGTWKYHYDLETKKRWYGKFGGIDNEVERPKFYESLREQRKRLMELAKEVEKDPTIELTKVWPEVFTTGSESVEQHIPFINALVNDKKARLVLNVENRGVIKGIPDDVMVEVPVVVDKEGIHPEKIEPDLTDRIKKFYLLPRILRMEWALEAFISGDRRVLEEILVRDPRTRSYEQAVAVIDDILNLPFNEEMKKHYGS

SEQ ID NO: 2997 - protein, 476 aa, Thermotoga maritima
MAVKVLSIDLGATNGKIYEVELKDRLTVKEIKRFRTEGTFLPGKDREHFVWNLPGFYEEIKGVLEASDAQSVGVDTWGVDFALLDENGRLVSLPYHYRDVRTKGVMKKAFEVVPKDEIFQRTGIQFMEINTLYQLYSMVLSNDPFLKTTKHLLMIPDVFNFWLSGEMVSEYTIASTSQCYSVPDGEWAYDLLEKLSIPTEIFPKVVPPGTILGKCRVKKGINVIATACHDTASAVVAVPLEGEGIYISSGTWFLVGTELERPLLSKEALERNFTNEGGYGKIRFLKNATGMWLLEECNRIWKKDYSEIIESVRNVPGFQAFLDPDREEFLHPGNMPERIRNYLERTGQKILERIGEISRLIFESLAFNCRWIVEQIKELTGKRYGKIHVVGGAVRNDLLMSFIASATGKTVVAGPVDATPIGNALVQLITLGAIANINEARKIVKESFELKTFEPKNPELWSEKYEEWRRYKGMRV

SEQ ID NO: 2998 - protein, 431 aa, Thermotoga maritima
MVERYSLSPMKDLWTEEAKYRRWLEVELAVTRAYEELGMIPKGVTERIRNNAKIDVELFKKIEEKTNHDVVAFVEGIGSMIGEDSRFFHYGLTSSDVLDTANSLALVEAGKILLESLKEFCDVLWEVANRYKHTPTIGRTHGVHAEPTSFGLKVLGWYSEMKRNVQRLERAIEEVSYGKISGAVGNYANVPPEVEEKALSYLGLKPEPVSTQVVPRDRHAFYLSTLAIVAAGIERIAVEIRHLQRTEVLEVEEPFRKGQRGSSAMPHKKNPITCERLTGLSRMMRAYVDPSLENIALWHERDISHSSVERYVFPDATQTLYYMIVTATNVVRNMKVNEERMKKNIDLTKGLVFSQRVLLKLIEKGLTRKEAYDIVQRNALKTWNSEKHFLEYLLEDEEVKKLVTKEELEELFDISYYLKHVDHIFERFEKE

SEQ ID NO: 2999 - protein, 397 aa, Thermotoga maritima
MNRVVVGLQWGDEGKGKVVTYLSRYHDIVARFSGGANAGHTVNYGDFKVIHHLLPSADFTKNRGIAIGSGVLLDPQVLTEELRELKEKFPDYSGEIFISESAHVVLPVHKEMDRIIDEVLKIGTTKRGIGPACADRVMRVNVRVAELGNEEKLRYFLEKNLSLKKIYGVDFDAEKMMGDLSTFYETIKDFVVSPVQLKRILEEKSVLFEGTQGVLLDLDVGTYPYVTSMNCSSSGVSAGMGFPVEVDEVLGVFKAYTTRVGEGPFPTELTGEEGEKLRKAGHEYGSTTGRPRRCGWLDLPLLRYAIEISGVDSLVMTKADVLNGFEKIKVCVRYSDGRDLVSLRDLEKKEPVYEVFDGWKSLEDKNFERFVDFIERETGRPVRYISTGEKLEDIVEV

SEQ ID NO: 3000 - protein, 313 aa, Thermotoga maritima
MSVNLKGRSLLTLLDFSPEEIRYLLDISKQVKMENRSKLRTERFKGMTLAMIFEKRSTRTRLAFETAFAEEGGHPIFLSPNDIHLGAKESLEDTARVLGRMVDAIMFRGYKQETVEKLAEYSGVPVYNGLTDEFHPTQALADLMTIEENFGRLKGVKVVFMGDTRNNVATSLMIACAKMGMNFVACGPEELKPRSDVFKRCQEIVKETDGSVSFTSNLEEALAGADVVYTDVWASMGEEDKEKERMALLKPYQVNERVMEMTGKSETIFMHCLPAVKGQEVTYEVIEGKQSRVWDEAENRKHTIKAVMIATLL

SEQ ID NO: 3001 - protein, 197 aa, Thermotoga maritima [sequence omitted]

SEQ ID NO: 3002 - protein, 399 aa, Thermotoga maritima
MEKVKVKNPIVELDGDEMARVMWKMIKEKLILPYLDIQLVYFDLGIKKRDETDDQITIEAAKAIKKYGVGVKCATITPDAERVKEYNLKKAWKSPNATIRAYLDGTVFRKPIMVKNVPPLVKRWKKPIIIGRHAYGDIYNAVEAKVEGPAEVELVVRNKENKTLLVHKFEGNGVVMAMHNLEKSIRSFAQSCINYAISEKVDIWFATKDTISKVYHAYFKDIFQEEVDKRKEELEKAGVNYRYMLIDDAAAQILRSEGGMLWACMNYEGDIMSDMIASGFGSLGLMTSVLVSPDGVYEFEAAHGTVRRHYYRYLKGEKTSTNPTASIFAWTGAIRKRGELDGTPEVCEFADKLEKAVINTIESGVITKDLQPFTEPPIDKYVTLEEFIDEVKKNLEKLL

SEQ ID NO: 3003 - protein, 496 aa, Thermotoga maritima
MKCSLGLEKCPDDTLRCFPKIEQPFGIVIFGASGDLTKRKLIPALNRLFEAGILPERFFVLGAARTKMDDKKFRSRFDANPDFLEHCSYISVDYQDPESFKQLKNTIETLIKRIDSSNLVFYLAVPPDLYIPILENLSKTGLNEKPARVVIEKPFGKDLESARRLEDTLQKYFQEDQIFRIDHYLGKETVQNILVFRFANFIFEEIWNNKFVDHVQITMAEDIGVEHRAGYFENVGLLRDIFQNHMLQILALIAMEPPSSFNGENFRNERVKLLRSIRPFPVEELESWIVRGQYGRGVVNGKEVPAYREEPGVAKDSNVETFVAMKLFIDNWRWSGVPFYLRSGKRLPKKITEVAVVFKKIPHSIFAGVPSDELEPNTIVFTLQPNEGISLEFQVKRPCPGMFPQLLSMDFRYEDYFGVKLPDAYERLLLDVILGDPTLFMRRDDLEVSWELLDPVLKAWENDPVRFSPYVYPAGTWGPREADLLIERDGRKWRKL

SEQ ID NO: 3004 - protein, 237 aa, Thermotoga maritima
MELGIRDKGVLVLAASRGIGRAVADVLSQEGAEVTICARNEELLKRSGHRYVVCDLRKDLDLLFEKVKEVDILVLNAGGPKAGFFDELTNEDFKEAIDSLFLNMIKIVRNYLPAMKEKGWGRIVAITSFSVISPIENLYTSNSARMALTGFLKTLSFEVAPYGITVNCVAPGWTETERVKELLSEEKKKQVESQIPMRRMAKPEEIASVVAFLCSEKASYLTGQTIVVDGGLSKFPL

SEQ ID NO: 3005 - protein, 225 aa, Thermotoga maritima
MKKGVLFDLDGTILDFEKSEDQALKRTFLKYGIPLTEDQVFLYREINRKWWKLLAEGKVSKDVVVVARFEEFLKTLNIPLDPRKVAKDYLEFLSEEAHFLPGAEEFLERLKKKDLRMAVVTNGVRFVQEKRSRKLKLDRFFEFVLTSEEAGVEKPDPRIFWLALERMKLKKEEVLYVGDDFSSDLEGARNAGIDFVLFSSDGDSSGDFPVARNFKELEKIVEEFL

SEQ ID NO: 3006 - protein, 1170 aa, Thermotoga maritima
MRLKKLYLKGFKSFGRPSLIGFSDRVTAIVGPNGSGKSNIIDAIKWVFGEQSKKELRASEKFDMIFAGSENLPPAGSAYVELVFEENGEEITVARELKRTGENTYYLNGSPVRLKDIRDRFAGTGLGVDFYSIVGQGQIDRIVNASPEELRLLLEEAAGVSIYREKKKETELNLERTKANLDRVKDVLFERERQMKSLYLKAKRAERFKEYTAQLEELQKIYYGNVLKRERKKLEFYQEEEKKTNEKIKNIQKELVELETKWSTLRSEFGEMDQEIERYTKLLEDYKKRQNDLVEMKGFYSSKLADSENKYVELSTRLDELEKRREEYKKRLEEMEYIFKGVMGDYERKAKELEKFEKEKENLLSRFNDKEKEFLRVRDEISKLEKQILKLENELLRIGETLEDLEKRRKITENQILTRRRELEDKKNEFKEISRRVEELDEEEKKLTEELNAVRERLEEIEGEIRRVNLEIDAKEKRLREIQFEKEMIERDMREYRGFSRAVRAVFEEKERFPGLVDVVSNLIEVDEKYSLAVSVLLGGTAQNIVVRNVDTAKAIVEFLKQNEAGRVTILPLDLIDGSFNRISGLENERGFVGYAVDLVKFPSDLEVLGGFLFGNSVVVETLDDAIRMKKKYRLNTRIATLDGELISGRGAITGGREERSSNVFERRIKLKHLEQEMEETERQIAEKRDELASLKTEQENLKNQEALVQRELFELSRKSSSTKTVLSEILRSINQLQEEVENLEKLLVEYRAKEEGLNARREKIFEEIDELKQNRENLQRSLTEYSEELEKEKKILDELNEKIFTLRAEVGNLLETKDRYEKEMRDTGKMIERIARETEDIKLQMTSLEEEMENYRKFIREHEREIEHLKKEMDSVFEAMKLHRSGKEEKMRELQEVENRMDELKEEKERLRNHLHQIDLALQETRLKIANLLEEFSGNEEDVEELDEEKLEEIYRQIKDLENKIKYLGPVDLTAIDEYEKLREEYEEILKQKEDLEEAKRKLEEIIEKTDREAESLLFDVYQRVNESFNRFISLLFFGGEGRLNIVSEAKSILDAGFEISIRKPGRRDQKLSLLSGGEKALVGLALLFALMEIKPSPFYVLDEVDSPLDDYNAERFKRLLKENSKHTQFIVITHNKIVMEAADLLHGVTMVNGVSAIVPVEVEKILEV

SEQ ID NO: 3007 - protein, 350 aa, Thermotoga maritima
MKVKAPGRINIIGEHTDYNDGYVLPFAVNRYVFLSIEGSERFIFHSENVNETVEMEKIEKLNKWTDYISGVIASFEKRGYRVSPVKISVSSNLPIGAGLSSSAALEVATAYAISEYFGFNVPKLELVKIAREAEVEFVGVRCGIMDQFTAVFGKKDHAIFLDTMTLEYEYVPLKLEGYEINLVDSNVKHELSSSEYNRRRQECEEVLKTLEKKSFREVTKEDLERLSGTLRKRAQHVLEENERVLKSVQALKEGDFETLGKLLFSSHESLRDLYEVSCEETDFIVDYLRGKEGILGARMVGGGFGGGVIVLSKKGAFGKIKEELVESYRKRFGIDLIFHEIESSDGVQKI

SEQ ID NO: 3008 - protein, 318 aa, Thermotoga maritima
MMELRYNPLTDEWVIVSAATQKRPVQPSKTECPICVGGLELPEEYDLVTFENRYPSLKKDPPPVNWKEKGPFRKEESRGVCEVVVYTSDHNTALPGMPLKQIEKLVEMWVDRTRDLSQHDFVKYIFIFENRGKEVGASLPHPHGQIYAFPFLPKRIEVKIGAMRKWYEEKRKCPICEVLESEGEERKVYETEHFLALVPFYARFPYEVHIYPKRHVSTLLEFSKEEKKEFAKVLKVVTAKYDKLFDQEFPYMMMFFQAPFNEEDVSHFFHFHVEFNPPKRDRDKLKWMASVETGTWAFINPVVPEEAARQLRETEVEI

SEQ ID NO: 3009 - protein, 1087 aa, Thermotoga maritima
MKNMPYEWENPQLVSEGTEKSHASFIPYLDPFSGEWEYPEEFISLNGNWRFLFAKNPFEVPEDFFSEKFDDSNWDEIEVPSNWEMKGYGKPIYTNVVYPFEPNPPFVPKDDNPTGVYRRWIEIPEDWFKKEIFLHFEGVRSFFYLWVNGKKIGFSKDSCTPAEFRLTDVLRPGKNLITVEVLKWSDGSYLEDQDMWWFAGIYRDVYLYALPKFHIRDVFVRTDLDENYRNGKIFLDVEMRNLGEEEEKDLEVTLITPDGDEKTLVKETVKPEDRVLSFAFDVKDPKKWSAETPHLYVLKLKLGEDEKKVNFGFRKIEIKDGTLLFNGKPLYIKGVNRHEFDPDRGHAVTVERMIQDIKLMKQHNINTVRTSHYPNQTKWYDLCDYFGLYVIDEANIESHGIDWDPEVTLANRWEWEKAHFDRIKRMVERDKNHPSIIFWSLGNEAGDGVNFEKAALWIKKRDNTRLIHYEGTTRRGESYYVDVFSLMYPKMDILLEYASKKREKPFIMCEYAHAMGNSVGNLKDYWDVIEKYPYLHGGCIWDWVDQGIRKKDENGREFWAYGGDFGDTPNDGNFCINGVVLPDRTPEPELYEVKKVYQNVKIRQVSKDTYEVENRYLFTNLEMFDGAWKIRKDGEVIEEKTFKIFAEPGEKRLLKIPLPEMDDSEYFLEISFSLSEDTPWAEKGHVVAWEQFLLKAPAFEKKSISDGVSLREDGKHLTVEAKDTVYVFSKLTGLLEQILHRRKKILKSPVVPNFWRVPTDNDIGNRMPQRLAIWKRASKERKLFKMHWKKEENRVSVHSVFQLPGNSWVYTTYTVFGNGDVLVDLSLIPAEDVPEIPRIGFQFTVPEEFGTVEWYGRGPHETYWDRKESGLFARYRKAVGEMMHRYVRPQETGNRSDVRWFALSDGETKLFVSGMPQIDFSVWPFSMEDLERVQHISELPERDFVTVNVDFRQMGLGGDDSWGAMPHLEYRLLPKPYRFSFRMRISEEIPSWRVLAAIPETLHVEMSSEDVIREGDTLRVKFSLLNDTPLSKEKQVVLFVDGNEYSVRRVVIPPFKKEELVFKVEGLKKGEHLIHTNLNTRKTIYVR

SEQ ID NO: 3010 - protein, 649 aa, Thermotoga maritima
MLGVCYYPEHWGTEKVEEDFRRMKELGIEYVRIGEFAWSRIESERGKFNWDWLDKTLELAEKMGLKIVLGTPTATPPKWLIDEHPEILPVDKDGRVKNFGSRRHYCFSSPVYREEVKRIVTIIVKRYGKHPAVAGWQTDNEYGCHDTVRCYCPRCKKAFQKWLERKYEGDIKKLNEAWGTVFWSQEYRSFDEIELPNLTPADPNPSHLLDYYRLASDQVVEFNKLQVEIIREYSPGRFITHNFMSGFTDFDHYKLSKDLDFATWDNYPLGHTLVFLRMKGETKNPFDRVGHPDIISFSHDLYRGVGRGRFWVMEQQAGPVNWAPYNLWPAKGAVRLWTWQAFAHGAEVVSYFRWRQAPFAQEQMHSGLLAPDSAPYPGYHEVKQVFEELKNIDINEPVESEVALVFDYETAWVFSIQPHGEGVNYIDLVFRFYSALRRLGLNVDIVPPGSSLDGYKMIVVPSLAIVKEEVLDTFKKYDGLLVLGPRSGSKTETFQIPPEMPPGLLKEIIPVEVRQVESLGDNVETLVWNGKEYPVSIWREDVDPTITEVIARFKDGFGAIFRKENVFYLAFWPNGDFLVDFFEALSKESGIETKRMPEGVRIQRRGEYVFSFNFTSEEVDLEIPTKVQIVLGDQKIPPYGLLIWKENER

SEQ ID NO: 3011 - protein, 648 aa, Thermotoga maritima
MKEYRIRPREANLSFLEDLDEEQRRAVVESEGRCIVIAGPGSGKTRVITYKIAYLLANGVDPSRILLVTFTRAAAREMVERAKAVTGRELSEMLAGTFHHVCNHFLRKYAPYVGLERNYSILDREDAESLMRHARSKYLERKSKEERKNFPQPSVLMAIYSYMKNTLKSLRESIVVKNPKFLDLKEEISEIFDLYEQEKRSQNVVDYEDLLFYAYRLFEENKEIRDREAERFLWILVDEFQDTNYVQYKIVEHLSSKHGNILAVGDDAQSIYSFRGARYENVEDFIRVPGTKIFKIQTNYRSTESIVKFINAMLPRKSVPKELKPVKKDGMKPVVVKTWDRYEEARFVSQRILELIEEGFKPEEIAVLYRSHSHSLELQMELVRSRIDFRVLSGPRFTESAHVKDVLSFLRIVQNPRDKSAWLRAAKLFYGIGDRTASKIADLASAYVEEGLDPFQELKKVSFSGEYSRFIDILDQIRKLDSPGEMIERVLSSFYSEYLEARYPDFREREMDLERLVEIASRYTSLESFLTDLAVTENVEIEREISQKEGKVTLTTVHQAKGLEWRVVFVISVNPGDFPNYFAISEGNLDEEERIFYVAITRAKEQLYISYQVTGTSYPYRGNRFIMRSGENFIDRIPLELVEFWEVK

SEQ ID NO: 3012 - protein, 216 aa, Thermotoga maritima
MEAVIFDMDGVLMDTEPLYFEAYRRVAESYGKPYTEDLHRRIMGVPEREGLPILMEALEIKDSLENFKKRVHEEKKRVFSELLKENPGVREALEFVKSKRIKLALATSTPQREALERLRRLDLEKYFDVMVFGDQVKNGKPDPEIYLLVLERLNVVPEKVVVFEDSKSGVEAAKSAGIERIYGVVHSLNDGKALLEAGAVALVKPEEILNVLKEVL

SEQ ID NO: 3013 - protein, 377 aa, Thermotoga maritima
MVSRRISEIPISKTMELDAKAKALIKKGEDVINLTAGEPDFPTPEPVVEEAVRFLQKGEVKYTDPRGIYELREGIAKRIGERYKKDISPDQVVVTNGAKQALFNAFMALLDPGDEVIVFSPVWVSYIPQIILAGGTVNVVETFMSKNFQPSLEEVEGLLVGKTKAVLINSPNNPTGVVYRREFLEGLVRLAKKRNFYIISDEVYDSLVYTDEFTSILDVSEGFDRIVYINGFSKSHSMTGWRVGYLISSEKVATAVSKIQSHTTSCINTVAQYAALKALEVDNSYMVQTFKERKNFVVERLKKMGVKFVEPEGAFYLFFKVRGDDVKFCERLLEEKKVALVPGSAFLKPGFVRLSFATSIERLTEALDRIEDFLNSR

SEQ ID NO: 3014 - protein, 577 aa, Thermotoga maritima
MKTSSILVDFLKRNWHKYLLGVLSLIAVDLLQVYIPRVIGKIVDMLNTETMNFDTLKIMLFWVMAAASGMFIGRFFWRFFLGGTARKFFLETSNKMFSKLLSLTPGFFDRMKSGELMARFTNDLSLLRRVLGQGAILFFDSFIMIVMVFFFMIGNVGWKLSWISFAPLLLLAPVSMSFGRLIHRKVSEVQRSFSELSGFTEETISSVRIVKSFSVEDVSFKIFENRALKNYEDTLSAIKVSSVFRPLINLIASTAFFLALLYGGRAVINGKISLGDFIAFNSYLGMLVWPMMAYGFMVDLFQRGRAAMRRLDTIFTAQPEVKEPEKPIRIDHFESFEVRNLTYRYPGTEREVLKNVTMKINRGEMIGIAGSVGSGKSTIAKLLVKLYPVERGKIFINGVDINDVSSENIRSIVTLVPQETFLFSDTVRNNITVGLENVDEKKIEEVTKLAAVYDDIMSFPEKFDTIVGERGVTLSGGQKQRITIARALIRDFEVYIFDDCLSAVDPETEERIIDSIRKGMKGKTIVVITHRLKVLKNADRIYVLHEGRVIEEGTHEELMIRDGMYSRMYRKQLIEEG

SEQ ID NO: 3015 - protein, 379 aa, Thermotoga maritima
MNTDDILFSYGEEDIPLKALSFPIFETTNFYFDSFDEMSKALRNGDYEFVYKRGSNPTTRLVEKKLAALEECEDARLVASGMSAISLSILHFLSSGDHVVCVDEAYSWAKKFFNYLSKKFDIEVSYVPPDAERIVEAITKKTKLIYLESPTSMRMKVIDIRKVTEAAGELKIKTVIDNTWASPIFQKPKLLGVDVVVHSATKYISGHGDVMAGVIAGDVEDMKNIFVDEYKNIGPVLSPIEAWLILRGLRTLELRMKKHYENALVVSDFLMDHPKVLEVNYPMNPRSPQYELASSQMSGGSGLMSFRLKTDSAEKVKEFVESLRVFRMAVSWGSHENLVVPRVAYGDCPKKDVNLIRIHVGLGDPEKLVEDLDQALKKI

SEQ ID NO: 3016 - protein, 415 aa, Thermotoga maritima
MRIAVIGGGSSYTPELVKGLLDISEDVRIDEVIFYDIDEEKQKIVVDFVKRLVKDRFKVLISDTFEGAVVDAKYVIFQFRPGGLKGRENDEGIPLKYGLIGQETTGVGGFSAALRAFPIVEEYVDTVRKTSNATIVNFTNPSGHITEFVRNYLEYEKFIGLCNVPINFIREIAEMFSARLEDVFLKYYGLNHLSFIEKVFVKGEDVTEKVFENLKLKLSNIPDEDFPTWFYDSVRLIVNPYLRYYLMEKKMFKKISTHELRAREVMKIEKELFEKYRTAVEIPEELTKRGGSMYSTAAAHLIRDLETDEGKIHIVNTRNNGSIENLPDDYVLEIPCYVRSGRVHTLSQGKGDHFALSFIHAVKMYERLTIEAYLKRSKKLALKALLSHPLGPDVEDAKDLLEEILEANREYVKLG

SEQ ID NO: 3017 - protein, 734 aa, Thermotoga maritima
MKAYAFGFPKIGEKREFKKALEDFWKGKITEEQFEEEMNKLRMYMVENYRKNVDVIPSNELSYYDFVLDTAVMVGAVPERFGEYRGLSTYFDMARGGKALEMTKFFNTNYHYLVPEIETEEFYLLENKPLEDYLFFKSKGIETAPWVIGPFTFLYLSKRNGEWIRRPNQMEKLLESLVSVYKEVFEKLVENGCKEILVNEPAFVCDLEKAHWDLILNVYRELSEFPLTVFTYYDSVSDYEACVSLPVKRLHFDFVSNEENLKNLEKHGFPEDKKLVAGVINGRQPWKVDLRKVASLVEKLGASAISNSCPLFHLPVTLELENNLPGGLKEKLAFAKEKLEELKMLKDFLEGKTFDLPNVSFEDFAVDLQAVERVRNLPEDSFRREKEYTERDRIQRERLNLPLFPTTTIGSFPQTPEVRKMRSKYRKGEISKEEYEAFIKEQIKKAIELQEEIGLDVLVHGEFERTDMVEFFAEKLNGIATTQNGWVLSYGSRCYRPPIIYGTVTRPEPMTLKEITYAQSLTEKPVKGMLTGPVTIMSWSYYREDIPEREIAYQIALAINEEVKDLEEAGIKIVQIDEPAFREKAPIKKSKWPEYFEWAINAFNLAANARPETQIHAHMCYSDFNEIIEYIHQLEFDVISIEASRSKGEIISAFENFKGWIKQIGVGVWDIHSPAVPSINEMREIVERVLRVLPKELIWINPDCGLKTRNWDEVIPSLRNMVALAKEMREKFES

SEQ ID NO: 3018 - protein, 223 aa, Thermotoga maritima
MKLAKKYYAVRKGRVPGIYKTWKEAEEQVKGFPGAEYKSFERLEDAKAYMEGKNECICPELDTETMIAYVDGSYDEVCGSGIVLCYRGKKEEYYFWTNIEEFKDSRNITGEIMAALFAMDYALKKGARKLVLRYDLEGLEKWATEEYRTNKLVTKVYRHYYRKFCQMGLKVVFEKIKSHSGNFCNDEADSLAKKASKKESNVEWMPEDFESIIRTLTKKGGCL

SEQ ID NO: 3019 - protein, 571 aa, Thermotoga maritima
MKFFSASNVRDDIKKFERKYKRYYPIFLLLESLFLTTNVLTPLLIKKTIDSAFYRGSVEEVALFSILYFVVLVSQSFIMYRLNFSVAKHLLNASRAKESKGVYAKILTLPLSFLNSKNTGDYLSIFMRDIPKVASGVYLARLQFFFNLGFFLVVLSLLFILNVKLALVVLASIVLFFVSTSILKKMVIRTSQRDQEAYQRFLKRSREVVEGTPVLKQFSGLLFLRDFLDSSAREWSRASIIHSTVNELSNRNIEMNRWVGSTIVLAFGVYLLWKGEISVGTLLAFESYMNWIYDIVRMALTGLTTFFSTVPNWENFTRVFSLPFERASGIDLERFEKLQLKNVHFKYDETPVLTGLNFEINSGDKIAIVARSGAGKSTLVSLFNRLLSPTEGEILINGVPIEQYSLQSLRRNIVLVRSNDILFDTTIKNNITLFEDFPEDEIENVLKMCECDFVKELENGIDTVVGERGTRLSDGQRQRIVLARALIRKPQVLILDEVTSGVDSETEEKILEKILNEIETVIIVSHRLSTIKKASRIIVLNDGRVEAEGTHEELMKKSPLYREIVKSQLMR

SEQ ID NO: 3020 - protein, 390 aa, Thermotoga maritima
MNRNLLLFASGSFVSLIGTRIYQVALAWWLYSKTGSSEYVGLFMISSFLPAIIVSPFAGTVVDRHSRRNMMVVMDILRGVLFMYLFLMEYFSELTMALLLIVTVLVSVFDSFFNPAVDSLLPDLVRKENLVRANSLYRLLKNLSKILGPALGSLLLKVVGLAGVILINSLSFLISGIFEMFIKVEEKHLKKVSKERNMWQDIKSALLYIRSVRFILVTILVIAIMNFFTGSMHVLLPEHVSKLGKSEWVYGTLMSMLSFGGLIVTFLMATIRTRASVKTLGLNLVGYGLAVFVFAMTGNHWLMFAMYFLIGIFQTLFNINVITLLQLAIPEEMRGKIFSLISAVSFSLLPVSYGFFGFLSSYVATAHIFITTSMALIAGGVLISLQRFEG

SEQ ID NO: 3021 - protein, 259 aa, Thermotoga maritima
MRMNIQKHGEDWKGTVVIVHGLGEHSGRYRRLVREFVSEGVQVVTFDLPGHGKSPGRRGHLRFDDVFKILNEITKDLERFVLFGHSLGGLIAIRFTQIFQPENQKGLVVSAPAILLPDTHSPVLEFMVRFLSFFVPFLTMSNGINPSDLSRNREAVEAYIRDPLVHDRISFKLASDMLSHMKKVLKDAERIKVPVLIFHGTDDRVVSFEGSKKFFEALSTEKKLVSFPGGYHELFEDPEHQKEFFKTIVEWSLEKLGGK

SEQ ID NO: 3022 - protein, 469 aa, Thermotoga maritima
MVRVRFAPSPTGFLHVGGARTALFNFLFARKEKGKFILRIEDTDLERSEREYEEKLMESLRWLGLLWDEGPDVGGDHGPYRQSERVEIYREHAERLVKEGKAYYVYAYPEEIEEMREKLLSEGKAPHYSQEMFEKFDTPERRREYEEKGLRPAVFFKMPRKDYVLNDVVKGEVVFKTGAIGDFVIMRSNGLPTYNFACVVDDMLMEITHVIRGDDHLSNTLRQLALYEAFEKAPPVFAHVSTILGPDGKKLSKRHGATSVEAFRDMGYLPEALVNYLALLGWSHPEGKELLTLEELISSFSLDRLSPNPAIFDPQKLKWMNGYYLRNMPIEKLAELAKPFFEKAGIKIIDEEYFKKVLEITKERVEVLSEFPEESRFFFEDPAPVEIPEEMKEVFSQLKEELQNVRWTMEEITPVFKKVLKQHGVKPKEFYMTLRRVLTGREEGPELVNIIPLLGKEIFLRRIERSLGG

SEQ ID NO: 3023 - protein, 201 aa, Thermotoga maritima
MKLYLIRHGETIWNEKGLWQGVTDVPLNERGREQARKLANSLKRVDAIYSSPLKRSLETAEEIARRFEKEIIVEEDLRECEISLWNGLTVEEAIREYPVEFKKWSSDPNFGMEGLESMRNVQNRVVKAIMKIVSQEKLNGSENVVIVSHSLSLRAFICWILGLPLYLHRNFKLDNASLSVVEIESKPRLVLLNDTCHLKES

SEQ ID NO: 3024 - protein, 271 aa, Thermotoga maritima
MVENIGSGSAELVSYAKLNLYLDVLGKRSDGYHEIVGLFQTISLHDTLTVEICDRGFYLESSVALPSDNTIKRAWEMFRKNTGKEFGLKVTLKKEIPVGSGLGGGSSNAAAVLRYLGEVFKIPLEDLLNIAAQVGSDVPFFLYGGTALVRGRGEIVEKLEDIEGYSVDLFFPGIHSSTKEMYLSLTPEMYRKGPGRVEELHRAYLERNYEKIKELSYNVFEKVFLEKHPEVMDGLRNFGDGSIVKMMTGSGSVFFALYPLDKGNYSFVGGV

SEQ ID NO: 3025 - protein, 173 aa, Thermotoga maritima
MFKLDLKRFIRDIPDFPQKGIVFRDITPLLRNQEAFKEAIDRMCELVFDREFDLVVAPEARGFILGAAMAYKLGKGFVPVRKPGKLPYKTVYEEYQLEYGTEQLHIHEDAIEKGQKVLIVDDVLATGGTAEALIRLVKKLGGEVVSLAFLVELSYLEPRKRLEGYDVKTLIVY

SEQ ID NO: 3026 - protein, 791 aa, Thermotoga maritima
MFNLEEYTEKAQKVMMSIQDIMTRYRQNQLSSEHILLAILEEGNNVGVELLKELNVDINRLKDEVEVFIGKYGVRVPEGASVSQIFITPDARHVIEKAREEARRMGDSKIGTEHLILGMVLSPDSTAFRILSRYGVTPERVYEAIRKIRSTGKTDEAENVEALARFTVDLTQLAREKKLMPVVDREKEIRRVIQILSRRTKNNPVLIGDPGVGKTAVVEGLAQRIVEGKVPLFLRNVRVLKLDMGRLVAGTRFRGDFEERLKRLLDELKRKKGEVILFIDEVHTVVGAGAAEGALDAANIMKPELTTGEIQIIGATTVEEYRKYIEKDRALERRFQPVMVEEPTVEQTIEILKGLRKVFEEHHHVKITDDALEAAAKLSARYITNRFLPDKAVDLIDEAAAYVRLESSYPSEELLKLEEEIKNLEDKINDAVVKGEYEEAAKLKVELQKLKNEYEEKRKKQEKVEPVVDENVVAKIVEQWTGIPVSRIMESEREKLLKLEEFIHQRLVNQEEAVKIVARTIRRARVGIKNPRRPIGVFLFLGPTGVGKTELARTLADVLFGSEDAMIRLDMSEYMEKHSVARLIGAPPGYVGYEEGGQLTEAVRKRPYSVILLDEIEKAHPDVFNILLQVFEDGRLTDGKGNTVDFRNTIIIMTSNIGSEKILEMSENGVRIEIEKELRNTFKPEFLNRIDAIVYFKPLTMEEVKKIVEIMVRQLQEILKEKNISIELTERAKEYLAEAGYVPSLGARPLRRIIELELESMIADKILEGEIKEGDRVLVDADEYGLKIERR

SEQ ID NO: 3027 - protein, 270 aa, Thermotoga maritima
MDDLKTRVITASVVAPFVVLCFVSYESLIGLVSAILILAGYELITLEMKERDARFFYVILLALYPVLYGLVFEEPTQPLSILFITGVVFSLITDKDPSQVFKTVAAFSIALIYVTFFLSFFLPIYRDFGAANALLVLTSTWVFDSFAYFTGLKFGRTRISPRYSPRKSLEGVIGGFLGVVIYTFLYRLVVNDLLSVNVISFRTFLPFAATVAIMDTFGDIFESALKRHYGVKDSGKTLPGHGGMLDRIDGLLFVAPVSYIVFKILEGVVR

SEQ ID NO: 3028 - protein, 306 aa, Thermotoga maritima
MARYRVHVNDPLDKEATQLLMNKEELEVTSEHLEKDELMKIIPEVDVLVVRSATKVTADIIEAGKNLKIIARAGIGLDNIDVQKAKEKGIKVLNTPGASAPSVAELAMGLMLACARHIARATVSLKEGKWEKKALKGKELLGKTLGLIGFGNIGQEVAKRALAFGMKIIAYDPAKPETDLPVEYVDLDTLFKESDFISLHVPLTESTRHIINRESIAKMKDGVIIVNTARGGTIDEEALYEEVVSGKVYAAGLDVFEVEPPTDEIRRKLLSLDNVVATPHIGASTAEAQRRVGIELVEKIFKELGI

SEQ ID NO: 3029 - protein, 327 aa, Thermotoga maritima
MEDIIVVENLVKKFGDFEAVKGVSFSVKKGEIFAFLGPNGAGKTTTIHMLTTLLKPTSGKAWVAGHDVLKEPREVRRKIGIVFQDQSLDRELTAYENMYIHGKIYGYGGEKLKKRILELLEFVELLEFKDKPVKTFSGGMARRLEIARSLIHEPEVLFLDEPTIGLDPHTRAHMWEYISKMKKEHNMTIFLTTHYMDEAEQLADRVAIIDHGKIIALGTPTELKRMVGKEIIYVRFSEAVECLEGDFIESCRKLPDGRLELNVEDSGRAIPKIFELAQQKGLKIEEITYHKPTLNDVFLHLTGRELREEGPENSFKTMARMRMRMRR

SEQ ID NO: 3030 - protein, 432 aa, Thermotoga maritima
MFKPNYHFFPITGWMNDPNGLIFWKGKYHMFYQYNPRKPEWGNICWGHAVSDDLVHWRHLPVALYPDDETHGVFSGSAVEKDGKMFLVYTYYRDPTHNKGEKETQCVAMSENGLDFVKYDGNPVISKPPEEGTHAFRDPKVNRSNGEWRMVLGSGKDEKIGRVLLYTSDDLFHWKYEGVIFEDETTKEIECPDLVRIGEKDILIYSITSTNSVLFSMGELKEGKLNVEKRGLLDHGTDFYAAQTFFGTDRVVVIGWLQSWLRTGLYPTKREGWNGVMSLPRELYVENNELKVKPVDELLALRKRKVFETAKSGTFLLDVKENSYEIVCEFSGEIELRMGNESEEVVITKSRDELIVDTTRSGVSGGEVRKSTVEDEATNRIRAFLDSCSVEFFFNDSIAFSFRIHPENVYNILSVKSNQVKLEVFELENIWL

SEQ ID NO: 3031 - protein, 482 aa, Thermotoga maritima
MKYVLSLDQGTTSSRAIVFDEKGNVVSKVNKEFRQIYPRPGWVEHDPVEIWESQIEVAKKAIEEAGIKPEDIAAIGITNQRETTIVWDKNTGKPVYNAIVWQCRRTAPICDELKEKGYSEFIRERTGLVIDAYFSGTKIKWILDNVEGVREKAEKGEVLFGTVDTWLIWNLTGGRVHVTDYSNASRTMIFNIHKLDWDDEILELLNIPRAMLPQVMPSSHVYGYTAKDIFGVEIPIAGDAGDQQAALFGQACFQPGMLKNTYGTGCFLLMNTGEKAFESKSGLLTTIAWGINGKVYYALEGSIFITGAAVQWLRDGLKIISNAAETEELATKVPDNGGVFFVPAFVGLGAPYWDMYARGLIIGITRGTTREHIVRAVLESIAYQTRDVVEVMEKDSDIKVETLRVDGGAVVNNFLMQFQADILGVPVERPVVNETTALGAAYLAGLAVGYWKDQEEIASLWQLDRRFEPSMNSEERERLYSK

SEQ ID NO: 3032 - protein, 479 aa, Thermotoga maritima
MKAVVIGGGVFGSLIARELTKYDLEVTLIEKNLDVGWGVTKANSAVVHAGYDDPPESVRAQFCASGNAMYEDLSKELDFDFKRIGSFVVAFNDEELKELERLLKQGEENGVPGLTILERDEVLSMEPNLNPEVKYALYAPTAGITEPWMVAIAAVENAVQNGLKLVLGESVVGFEKVNGRVRKVHTSRGEYEADIVINCAGLHADEIAKLAGAEYVPLHPRKGEYILLDKKLQGLVKRVIFPTPTKISKGILVLPTVDGGILLGPTAEDLPEEMKDRPITTREGLEKVREFTRRLVPSLDFSLVVKTFSGLRPESPQKDFFIKVSETVKNFVNVMATRSPGLTAAPAVAKYVVEELIQEKMRIPLEKKKDFKPERKRIVHYSELPLEEWRREIERDPRAGRLVCFCNEVTEKEIVEAIRRGARTLNGVKFRTRAMFGRCQGGFCMARILKILERELGVDMSEIKMKSENSWVVNGKVRE

SEQ ID NO: 3033 - protein, 220 aa, Thermotoga maritima
MGFQIAIDGPAASGKSTIAKLLAEKLGFDHLNTGATYRAVAVYLHEKGLSSSSAEEEIENVLKDLKIDYVNGRVYINGEDYTEKIQSPEAGVLASNFARLEVVRRHLVRIQREICDDKNIVVEGRDIGTVVLPNAHLKIFLTASLEARVERKLKEYQKRGLKVTKEEVERELISRDEQDSKRNVAPLKPAEDAVIIDTTSMSVEEVLDRILKLVRERMNT

SEQ ID NO: 3034 - protein, 276 aa, Thermotoga maritima
MGLKRFKPVTPGRRFMVISDFSDITKTEPEKSLLAPLKKTGGRNHHGRVTVRHRGGGHKRRYRIIDFKRYDKAGIPAKVLAIEYDPNRSARIALLLYADGEKRYILAPKGVNVGDTLMSGPDAEIRPGNALPLEKIPVGTLVHNVEFTPGKGGQIARAAGTYCQIMAKEGNYALLRMPSGELRKVHIKCYATVGVVGNEDHKNEVHGKAGRVRWLGRRPHVRGVAMNPVDHPHGGGEGRGKGHHPTSPWGLPTKGYKTRRGKRPSDKFIVRRRNEV

SEQ ID NO: 3035 - protein, 386 aa, Thermotoga maritima
MDILRKVAEIHGTPTYVYFEETLRKRSRLVKEVFEGVNLLPTFAVKANNNPVLLKILREEGFGMDVVTKGELLAAKLAGVPSHTVVWNGNGKSRDQMEHFLREDVRIVNVDSFEEMEIWRELNPEGVEYFIRVNPEVDAKTHPHISTGLKKHKFGIPLEDLDSFMERFRSMNIRGLHVHIGSQITRVEPFVEAFSKVVRASERYGFEEINIGGGWGINYSGEELDLSSYREKVVPDLKRFKRVIVEIGRYIVAPSGYLLLRVVLVKRRHNKAFVVVDGGMNVLIRPALYSAYHRIFVLGKQGKEMRADVVGPLCESGDVIAYDRELPEVEPGDIIAVENAGAYGYTMSNNYNSTTRPAEVLVRENGRISLIRRRETEMDIFKDVVM

SEQ ID NO: 3036 - protein, 401 aa, Thermotoga maritima
MNVVVQKYGGSSVATPERIKNVAQRIKKKVDEGYKVVVVVSAMGKTTDNLIKLAKEISPRPDSRELDMLLATGEQVSAALLSMALKDLGVKAKSLNAFQVKIKTTPHHTSARIVDIDDSVIRENLKDYDVLVVTGFQGVNEHGDLTTLGRGGSDTSAVALAAKLRVPCEIYSDVDGIYTCDPRVHPRAKKLAYITYDEALELTALGAKVLHSRSVEIAKKYGIPIYCASSFTEEEGTMVVERLPEWLEEPVVTGATISHGQIKVSISFLPKDVKYITAIFEEVGKRALNVDMISLVPSNGKVFLSFTILEDHKEDLDEALKEALRDVEGWKSTYEGGFAKLSIVGVGMRTSPGVAARFFEALERAGVTPELVTTSEIKISCLVPEEKAEEALKSVIEEFEL

SEQ ID NO: 3037 - protein, 216 aa, Thermotoga maritima
MKYGIVGYSGRMGQEIQKVFSEKGHELVLKVDVNGVEELDSPDVVIDFSSPEALPKTVDLCKKYRAGLVLGTTALKEEHLQMLRELSKEVPVVQAYNFSIGINVLKRFLSELVKVLEDWDVEIVETHHRFKKDAPSGTAILLESALGKSVPIHSLRVGGVPGDHVVVFGNIGETIEIKHRAISRTVFAIGALKAAEFLVGKDPGMYSFEEVIFGGE

SEQ ID NO: 3038 - protein, 294 aa, Thermotoga maritima
MFRGVGTAIVTPFKNGELDLESYERLVRYQLENGVNALIVLGTTGESPTVNEDEREKLVSRTLEIVDGKIPVIVGAGTNSTEKTLKLVKQAEKLGANGVLVVTPYYNKPTQEGLYQHYKYISERTDLGIVVYNVPGRTGVNVLPETAARIAADLKNVVGIKEANPDIDQIDRTVSLTKQARSDFMVWSGNDDRTFYLLCAGGDGVISVVSNVAPKQMVELCAEYFSGNLEKSREVHRKLRPLMKALFVETNPIPVKAALNLMGFIENELRLPLVPASEKTVELLRNVLKESGLL

SEQ ID NO: 3039 - protein, 236 aa, Thermotoga maritima
MCYSANGNTFLIVDNTQKRIPEEKKPDFVRENVGDLDGVIFVELVDGKYFMDYYNRDGSMAAFCGNGARAFSQYLIDRGWIKEKEFTFLSRAGEIKVIVDDSIWVRMPGVSEKKEMKVDGYEGYFVVVGVPHFVMEVKGIDELDVEKLGRDLRYKTGANVDFYEVLPDRLKVRTYERGVERETKACGTGVTSVFVVYRDKTGAKEVKIQVPGGTLFLKEENGEIFLRGDVKRCSEE

SEQ ID NO: 3040 - protein, 327 aa, Thermotoga maritima
MKVKVGVVGATGEVGRTMVKVLEEFNVPVTELRLFASERSVGKEIEFKGEKFKVELLTEESMKWKCDYFLFSAGASVSRKFAPIAAENGVTVIDNSSAFRMEKEIPLVVPEVNAYLLKGYTGIIANPNCSTIQMILSIYKLHEVYGIEEIFVSTYQSVSGAGHKGIEELLAQERGENVMKVFPKPIHRNVIPLIGDIQENLFSQEEMKMVNETRKILNDYSIRVYPTTVRVPVLYGHSEAIMVRLKKPYESLEKVREVIASGEDVVVTDDLITPVDVAGKNETYVCRLRATDERSILFWNVADNIRVGAATNAVRILLKHAEMNGKV

SEQ ID NO: 3041 - protein, 274 aa, Thermotoga maritima
MRWAVLLMVVFSALLFSSEVVLTSVGATDISFNGFPVTMELNFWNVKSYEGETWLKFDGEKVEFYADLYNIVLQNPDSWVHGYPEIYYGYKPWAGHNSGVEFLPVKVKDLPDFYVTLDYSIWYENNLPINLAMETWITRSPDQTSVSSGDAEIMVWFYNNVLMPGGQKVDEFTTTVEINGVKQETKWDVYFAPWGWDYLAFRLTTPMKEGKVKINVKDFVQKAAEVVKKHSTRIDNFEELYFCVWEIGTEFGDPNTTAAKFGWTFRDFSVEVVK

SEQ ID NO: 3042 - protein, 438 aa, Thermotoga maritima
MKIEFDVVVVGAGPSGLSCAYVLAKNGLKVAVVEKGEYPGSKNVMGGVLYVHPLKEIMPDFLEKAANSKALERNVIEQNLWLLGNEGVIKIGHRNVEWKENPNAFTVLRANFDRWFAQEVEKAGALIIPKTKVEDFLRNEKGEIAGVVTSRPKGEIHSKAVVIAEGVNPILTMKAGLRKEDLKPHMVAVAVKEVISVPEDVVNRVFGVEGNDGATIELLGSWSEGMFGMGFLYANRSSVSLGCGVLLEDLRKKKIKPYQLLENLKNHPVISDMLGEYRNNTMEYLAHLIPEGGYYAMPKVYGDRVLVCGDAAMLVNSIHREGSNHAITSGRLAAETLLEAFEKGDFSEKILKNYYLRLKESFILKDLEKYKDLMPTMEKNHQFVEIYPDLANDALKRFLQVDGTPKWDVQKQIADMVLSRRSLIGISLDLLRFWRAVR

SEQ ID NO: 3043 - protein, 299 aa, Thermotoga maritima
MTKNKLNQNSYELEKVKERIEQILSQFFPEQIMKDLPLYGKMLRVRLSILSFKNRGVEIGEDAISSLAALELVHLASLLHDDVIDGARFRRGKETINFMYGDKAAVAAGDLVLVSAFHTVEEIGNNKLRRAFLNVIGKMSEAELIEQLSRYKPITKEEYLRIVEGKSGALFGLALQLPALLEGELGEDLYNLGVTIGTIYQMFDDIMDFAGMEKIGKDGFLDLKNGVASFPLVTAMEKFPEARQMFENRDWSGLMSFMREKGILKECEETLKVLVKNVIIENSWLRDFVDGIFKIKISS

SEQ ID NO: 3044 - protein, 90 aa, Thermotoga maritima
MKALKIRVEGIVQGVGFRYFTRRVAKSLGVKGYVMNMDDGSVFIHAEGDENALRRFLNEVAKGPPAAVVTNVSVEETTPEGYEDFTIKYY

SEQ ID NO: 3045 - protein, 422 aa, Thermotoga maritima
MRIDEIVEKYVDRKTQRRFLILTSIAWMFDAAGVMLLSFVLPYVIKEWNLTSTQGATIASATFLGMLFGALSVGFVADLLGRKVSNLFFFIVTITFTFLSGFSSSFETLLVLRGLSGFGYGGLMPSFNAYLAEFTSIRLRGRYLVLLESSWAVGSILIGLFAVNVLPNWRWVFWIFSIGYLFVPVFLRMPETPKYAFLKGGKEALERSLGKRVEEEVELPKKEKVPILALLKREHLKDTVVIWIAWFVVSFVYYALFTWAPRIFSSLGVSVVKSSWFTFYMMVAQLPGYLSAAYFIEKWGRKASLGVYFIGTGLAALLWANVRGDASLLAAALVLSFFCLGVWGLVYAYTPELYPTSLRGTGNGAAGVWARIAGIIAPYYTGFMMEKGKSIAETLAWISAMAMFAGVIVLIFGRETKGKYVD

SEQ ID NO: 3046 - protein, 468 aa, Thermotoga maritima
MAKGSKGFIVSIMGPVVDVKFPEEELPDIYNALEVVNPQTGQKVVLEVEQLIGDGVVRTVAMDSTDGLTKGLEVVDTGAPITAPVGKEVLGRILNVIGEPVDEAGEIKAKERWPIHRPAPELVEQSTEIEILETGIKVIDLLAPFPKGGKIGFFGGAGVGKTVLVMELIRNIAIEHKGFSVFAGVGERTREGNELWLEMQESGVLGNTVLVFGQMNEPPGARFRVALTALTIAEYFRDVEGRDVLLFIDNIFRFVQAGSEVSALLGRMPSAVGYQPTLATDMGELQERITSTRRGSITSVQAIYVPADDITDPAPATTFAHLDATVVLSRRIAELGLYPAVDPLDSSSKILDPAIVGREHYEVARGVQEVLQRYKDLQDIIAILGVEELSPEDKLVVHRARRIQRFLSQPFHVAERFTGRPGRYVPIEETIRGFKEILDGKLDDVPEQAFLMAGNIDEVKERAKEMRS

SEQ ID NO: 3047 - protein, 273 aa, Thermotoga maritima
MLQIKRKINATQSLMKITRAMEMVARAKVRKIESEYQKFKPFYDEVKRLWALVPAESLDPIFFEEGNRDLIVVITSDMGLCGSFNSEILREAERVISESRDPHLILVGLKAINHFKDGKVLKMYDRFYEIPDFRNGSTIVEDILNFLDGKPARVRVIFSRFKNVLIQRPEVHELLPIKKEEKKREDFEYEPRLEQIAPLIFHYYLSATLMELMFQTKIGEYYARQNAMKNATDNAQEVIRELTLAYNKARQASITQELIEIVTGAEALKEIEK

SEQ ID NO: 3048 - protein, 503 aa, Thermotoga maritima
MRINPGEITKVLEEKIKSFEEKIDLEDTGKVIQVGDGIARAYGLNKVMVSELVEFVETGVKGVAFNLEEDNVGIIILGEYKDIKEGHTVRRLKRIIEVPVGEELLGRVVNPLGEPLDGKGPINAKNFRPIEIKAPGVIYRKPVDTPLQTGIKAIDSMIPIGRGQRELIIGDRQTGKTAIAIDTIINQKGQGVYCIYVAIGQKKSAIARIIDKLRQYGAMEYTTVVVASASDPASLQYIAPYAGCAMGEYFAYSGRDALVVYDDLSKHAVAYRQLSLLMRRPPGREAYPGDIFYLHSRLLERAVRLNDKLGGGSLTALPIVETQANDISAYIPTNVISITDGQIYLEPGLFYAGQRPAINVGLSVSRVGGSAQIKAMKQVAGMLRIDLAQYRELETFAQFATELDPATRAQIIRGQRLMELLKQEQYSPMPVEEQVVVLFAGVRGYLDDLPVEEVRRFEKEFLRFMHEKHQDILDDIKTKKELTSETEEKLKKAIEEFKTTFRV

SEQ ID NO: 3049 - protein, 315 aa, Thermotoga maritima
MSFSNEMKVFSGNANRPLAEKIANYLNLQLGDCEVGRFADGEINVRINETVRGHDIFLIQPTSPPVNENLMELLIMIDAFKRASANTIAVVIPYYGYARQDRKAKGRDPISAKLVANLITVAGATRVLTVDLHAEQIQGFFDIPVDNLWSYPVFAEELLKRENIVPEETVVVSPDVGGVRRARRMAERLGTSLAILDKRRPSDNVAEVVNIIGEVEDKVVIMFDDIIDTAHSIVKGAEALKNAGAKRIIACATHGVFSDRALERIENSSIDTVYITDTIYHENLPEKVKVISVANLIGEAIMRIRKHLSVSTLFR

SEQ ID NO: 3050 - protein, 787 aa, Thermotoga maritima
MSKKSKDTEKSFKILEKYASQQEKELEIPDSLPCIPLRNGMGVFPNTVVPFYVGRTGSLIALEEAMEKYNRLLLVVNQKDPSVEIPEPEDLYKVGTVVKVLQIMKLPDDTFKVLVEGLERAQIEEFVSTDPFFLTKIKILKVKYRKTKKLEALMRSVKDKAVRYFNLTHRFPQETLVTLKEMQDPDKLADFVASILPVPLETKQELLETVHPLERLEKILSILVKEIEILEIEEEIEKKVKDRIEKTQREYVLREKLRAIKEELGVEEELEIKELYEKVEKGDYPDYVKEKAYKEIQRLEKMSPYSAEATVVRTYLDWLLNLPWNVATEDRLDIKEARKILDKNHYGLGEVKERILEYLVARKFSKNLKAPILCLVGPPGVGKTSLGRTIAEAMGRKFGRMSLGGLRDEAEIKGHRRTYVGALPGRIIQIIRRLGTKNPVILLDEVDKMGISFQGDPASALLEVLDPEQNKDFVDHYLEVPFDLSQVLFITTANVLHTIPPALRDRMEIIEIPGYSDPEKYHIARDYIIPKIARSYGLSKVMFTPGAIKKIIREYTKEAGVRNLERVIEKVIRKSLVKGEKKSFKITTKDVEELLGPPVFREEEILEEDTVGAVTGLAWTPVGGSVLIVESLLLPGRGNLILTGNMGDVMKESARIALSVVRKMCGEECREVFEKNDIHIHVPEGAVPKDGPSAGITITVALYSAVTGKKVRRDVAMTGEITLRGKILPVGGIKEKLLAAKRAGIKKVILPSRNRPDVEKIPKEYLNGMEIVYCSEIQEVLKEAIVR

SEQ ID NO: 3051 - protein, 527 aa, Thermotoga maritima
MKRDFLGRTLAVIEDLSVEEQMFLYEKTRELKQRWYSGEDVSDFRIKKRNVGIYIVFVEPSTRTKESFINAAKFHSGPNVKVNVFDSEHSSFNKQESYTDTFSMLTGYSDYSIFVVRTRLEGVCRLLERRISEFASRNGIEVPSFINAGDGKHEHPTQELLDEYTFLEQNGFDNSFIHVALVGDLLHGRTVHSKVNGLKIFKNVKVDLVAPEELMMPEHYVEKMKKNGFEVRIFSSIREYLDQKDVAKIWYFTRLQLERMGEDILEKVHVLREAVTFKKEYLDALPEGVKFYHPLPRHKVYPTIPNFLDTLPLNGWETQARNGYWVRIVLLSMFGGALEAPFDTSKKEEKPEEDFIIPAPITHGSKGVQKEGKRGIKPIENGTVIDHIAKGKTPEEIYSTILKIRKILRLYDVDSADGIFRSSDGSFKGYISLPDRYLSKKEIKKLSAISPNTTVNIIKNSTVVEKYRIKLPPTIYGFEELRCKNENCITNPAHGENASPSFVRNEKGQFICEYCETPHSFEEIWSI

SEQ ID NO: 3052 - protein, 395 aa, Thermotoga maritima
MRRLFTSESVTEGHPDKIADQISDAILDAMLEQDPRSRVAVETLVTTGLVIIAGEVTTRAYVEIPDIARKTILEIGYTRAKYGFDGETCGVLTSIHSQSPDIALGVDKALEVKTGEEVADEFEALGAGDQGIMFGYATNETPEYMPLPITLAHKLAMRLAEVRKNGTLPFLRPDGKTQVTIEYEDDKPVRVDTVLISTQHDPDISQADLREAIIEHVINPVIPEQYRDDKMKILVNPTGRFVLGGPMADTGLTGRKIIVDTYGGWVPHGGGAFSGKDPTKVDRSAHYMARYVAKNVVAAGLADKFLIQLSYAIGVAKPVSIMIDTYGTAKVDEDKLLKVITELFDFRPGAIIKKLNLLRPIYRKTAAYGHFGRNEEEFTWEKLDMVDELKRAFNM

SEQ ID NO: 3053 - protein, 793 aa, Thermotoga maritima
MKVTPLMEQYLRIKEQYKDSILLFRLGDFYEAFFEDAKIVSKVLNIVLTRRQDAPMAGIPYHALNTYLKKLVEAGYKVAICDQMEEPSKSKKLIRREVTRVVTPGSIVEDEFLSETNNYMAVVSEEKGRYCTVFCDVSTGEVLVHESSDEQETLDLLKNYSISQIICPEHLKSSLKERFPGVYTETISEWYFSDLEEVEKAYNLKDIHHFELSPLALKALAALIKYVKYTMIAEDLNLKPPLLISQRDYMILDSATVENLSLIPGDRGKNLFDVLNNTETPMGARLLKKWILHPLVDRKQIEERLKAVERLVNDRVSLEEMRNLLSNVRDVERIVSRVEYNRSVPRDLVALRETLEIIPKLNEVLSTFGVFKKLAFPEGLVDLLRKAIEDDPVGSPGEGKVIKRGFSSELDEYRDLLEHAEERLKEFEEKERERTGIQKLRVGYNQVFGYYIEVTKANLDKIPDDYERKQTLVNSERFITPELKEFETKIMAAKERIEELEKELFKSVCEEVKKHKEVLLEISEDLAKIDALSTLAYDAIMYNYTKPVFSEDRLEIKGGRHPVVERFTQNFVENDIYMDNEKRFVVITGPNMSGKSTFIRQVGLISLMAQIGSFVPAQKAILPVFDRIFTRMGARDDLAGGRSTFLVEMNEMALILLKSTNKSLVLLDEVGRGTSTQDGVSIAWAISEELIKRGCKVLFATHFTELTELEKHFPQVQNKTILVKEEGKNVIFTHKVVDGVADRSYGIEVAKIAGIPDRVINRAYEILERNFKNNTKKNGKSNRFSQQIPLFPV

SEQ ID NO: 3054 - protein, 246 aa, Thermotoga maritima
MRLEGKVCLITGAASGIGKATTLLFAQEGATVIAGDISKENLDSLVKEAEGLPGKVDPYVLNVTDRDQIKEVVEKVVQKYGRIDVLVNNAGITRDALLVRMKEEDWDAVINVNLKGVFNVTQMVVPYMIKQRNGSIVNVSSVVGIYGNPGQTNYAASKAGVIGMTKTWAKELAGRNIRVNAVAPGFIETPMTEKLPEKARETALSRIPLGRFGKPEEVAQVILFLASDESSYVTGQVIGIDGGLVI

SEQ ID NO: 3055 - protein, 274 aa, Thermotoga maritima
MLYKELGRTGEEIPALGLGTWGIGGFETPDYSRDEEMVELLKTAIKMGYTHIDTAEYYGGGHTEELIGKAIKDFRREDLFIVSKVWPTHLRRDDLLRSLENTLKRLDTDYVDLYLIHWPNPEIPLEETLSAMAEGVRQGLIRYIGVSNFDRRLLEEAISKSQEPIVCDQVKYNIEDRDPERDGLLEFCQKNGVTLVAYSPLRRTLLSEKTKRTLEEIAKNHGATIYQIMLAWLLAKPNVVAIPKAGRVEHLRENLKATEIKLSEEEMKLLDSLG

SEQ ID NO: 3056 - protein, 635 aa, Thermotoga maritima
MERFPYEKLPESELKELKELGRLCRGDILKMTYIANSGHPGGSMSSIDLYLTVFKYAKLRPVDDPARDRIVISHGHTSPGVYAAMARLGFVDLDEVLAGFRHPASVFEGHVTRGVGIIDWTTGNLGQGLSAGLGFALASRFTGKDYHVFVLMSDAEQAKGQVAEARRVAKKYGVTNLTVIIDYNDAQISGRARDVMPVNIKENYLADGWRVIEIDGHDYEQIYLALKEAVEDELNPVAIIAKTVMGKGVSFMENEVKYHGKPLNREELEKALAELGIENDVDVYIEKRKQLPVEKHKKVYKTYPIKIDTGEPITYTSPTDNRSAFGKAILDLVKKNVNNPETTPIVAVDCDLKGSVKLDLLDKEFPERLLEVGVQEHNAAAMAGALSAEGVITFFADFGVFGISETYNQHRLNAINGTNLKVVVTHCGLNVGEDGKTHHGLDYVSGPMNWYGFKVIVPGDPNQTDRVVRYAAKEYGNFVIAMGRSKLPIILDENGKPFFGEGYTFEYGKIDVVRKGDDAVIITYGSTLCEAVNAADELKKEGVNVAVLNVSCPVDLDIETLKMVDGKPVLVVEDHNVFTGLGSFLGTTLLENGIIPKKYVRVGVPEFAVSGSYTMLYKLYGLDKDGIISRLREML

SEQ ID NO: 3057 - protein, 271 aa, Thermotoga maritima
MWIDCKTIARSIEERTKERVEKLGFTPKLVSVACTDDPSALSYLKSQRKKAEKLGIAFEIMNVSPEEIVSTLKKLGSDESVNGVFVARPFPLGLDEKEILSSVPVEKDVEGVNPANLGLLLYDEEIFPPCTAEAAVRILERETNLSGKRVTVVGRSVTVGKPLALMLLKKGRDATVTVCHSRTVNLEEITKNSDIVVVAVGRAHFLKKNMVKEGAIVIDVGINYVDGKLQGDVDPSVEEIARVTPVPGGVGQVTTALLFEHVVRAAERQRK

SEQ ID NO: 3058 - protein, 608 aa, Thermotoga maritima
MLLDEIKRMSYDELKRLAEDIRKRITEVVLKNGGHLASNLGTIELTLALYRVFDPREDAIIWDTGHQAYTHKILTGRDDLFHTIRTFGGLSGFVTRRESPLDWFGTGHAGTSIAAGLGFEKAFELLGEKRHVVVVIGDGALTSGMALEALNQLKNLNSKMKIILNDNGMSISPNVGGLAYHLSKLRTSPIYLKGKKVLKKVLEKTEIGFEVEEEMKYLRDSLKGMIQGTNFFESLGLKYFGPFDGHNIELLEKVFKRIRDYDYSSVVHVVTKKGKGFTAAEENPTKYHSASPSGKPKMLSYSELLGHTLSRVAREDKKIVAITAAMADGTGLSIFQKEHPDRFFDLGITEQTCVTFGAALGLHGMKPVVAIYSTFLQRAYDQIIHDVALQNAPVLFAIDRSGVVGEDGPTHHGLFDINYLLPVPNMKIISPSSPEEFVNSLYTVLKHLDGPVAIRYPKESFYGEVESLLENMKEIDLGWKILKRGREAAIIATGTILNEVLKIPLDVTVVNALTVKPLDTAVLKEIARDHDLIITVEEAMKIGGFGSFVAQRLQEMGWQGKIVNLGVEDLFVPHGGRKELLSMLGLDSEGLTKTVLTYIKARSREGKV

SEQ ID NO: 3059 - protein, 409 aa, Thermotoga maritima
MKEKVVLAYSGGLDTSVILKWLCEKGFDVIAYVANVGQKDDFVAIKEKALKTGASKVYVEDLRREFVTDYIFTALLGNAMYEGRYLLGTAIARPLIAKRQVEIAEKEGAQYVAHGATGKGNDQVRFELTYAALNPNLKVISPWKDPEFLAKFKGRTDLINYAMEKGIPIKVSKKRPYSEDENLMHISHEAGKLEDPAHIPDEDVFTWTVSPKDAPDEETLLEIHFENGIPVKVVNLKDGTEKTDPLELFEYLNEVGAKNGVGRLDMVENRFIGIKSRGVYETPGATILWIAHRDLEGITMDKEVMHLRDMLAPKFAELIYNGFWFSPEMEFLLAAFRKAQENVTGKVTVSIYKGNVMPVARYSPYSLYNPELSSMDVEGGFDATDSKGFINIHALRLKVHQLVKKGYQR

SEQ ID NO: 3060 - protein, 339 aa, Thermotoga maritima
MIRAGIIGATGYTGLELVRLLKNHPEAKITYLSSRTYAGKKLEEIFPSTLENSILSEFDPEKVSKNCDVLFTALPAGASYDLVRELKGVKIIDLGADFRFDDPGVYREWYGKELSGYENIKRVYGLPELHREEIKNAQVVGNPGCYPTSVILALAPALKHNLVDPETILVDAKSGVSGAGRKEKVDYLFSEVNESLRPYNVAKHRHVPEMEQELGKISGKKVNVVFTPHLVPMTRGILSTIYVKTDKSLEEIHEAYLEFYKNEPFVHVLPMGIYPSTKWCYGSNHVFIGMQMEERTNTLILMSAIDNLVKGASGQAVQNMNIMFGLDETKGLEFTPIYP

SEQ ID NO: 3061 - protein, 397 aa, Thermotoga maritima
MFTPRGFKFAGVHCKIKRKRKDLGIIFSEVPCVAAGVFTTNVVKAAPVIYDMEILKKNPNGIKAVVVNSGVANACTGEQGMINARRMAEKTAEELGVPVESVLVSSTGVIGVQLPMDKVENGIEEAARVLSNDPLPFAEAIMTTDTKVKMHSTKVMIDGKEITVLGIAKGSGMIHPNMATMLSFITTDAKISEEALKKLLKLSVDDSYNMIDVDGDTSTNDMVIVLANGLAGNTTIQPETDGFWKLYEAVHEVNQVLAEKIVEDGEGATKVMEVHVINAPDIKSARLIARSIVSSNLVKTAIYGEDANWGRVIAAAGYSGATFDPEKLDLFFESEAGRIKVAENGQGVSFDEEEAKKILSEKKIRIILDMKQGKETAKAWGCDLTEKYVEINGRYRT

SEQ ID NO: 3062 - protein, 282 aa, Thermotoga maritima
MRIDTVNVLLEALPYIKEFYGKTFVIKFGGSAMKQENAKKAFIQDIILLKYTGIKPIIVHGGGPAISQMMKDLGIEPVFKNGHRVTDEKTMEIVEMVLVGKINKEIVMNLNLHGGRAVGICGKDSKLIVAEKETKHGDIGYVGKVKKVNPEILHALIENDYIPVIAPVGIGEDGHSYNINADTAAAEIAKSLMAEKLILLTDVDGVLKDGKLISTLTPDEAEELIRDGTVTGGMIPKVECAVSAVRGGVGAVHIINGGLEHAILLEIFSRKGIGTMIKELEG

SEQ ID NO: 3063 - protein, 385 aa, Thermotoga maritima
MYLMNTYSRFPATFVYGKGSWIYDEKGNAYLDFTSGIAVNVLGHSHPRLVEAIKDQAEKLIHCSNLFWNRPQMELAELLSKNTFGGKVFFANTGTEANEAAIKIARKYGKKKSEKKYRILSAHNSFHGRTLGSLTATGQPKYQKPFEPLVPGFEYFEFNNVEDLRRKMSEDVCAVFLEPIQGESGIVPATKEFLEEARKLCDEYDALLVFDEVQCGMGRTGKLFAYQKYGVVPDVLTTAKGLGGGVPIGAVIVNERANVLEPGDHGTTFGGNPLACRAGVTVIKELTKEGFLEEVEEKGNYLMKKLQEMKEEYDVVADVRGMGLMIGIQFREEVSNREVATKCFENKLLVVPAGNNTIRFLPPLTVEYGEIDLAVETLKKVLQGI

SEQ ID NO: 3064 - protein, 480 aa, Thermotoga maritima
MPSVKIGIIGAGSAVFSLRLVSDLCKTPGLSGSTVTLMDIDEERLDAILTIAKKYVEEVGADLKFEKTMNLDDVIIDADFVINTAMVGGHTYLEKVRQIGEKYGYYRGIDAQEFNMVSDYYTFSNYNQLKYFVDIARKIEKLSPKAWYLQAANPIFEGTTLVTRTVPIKAVGFCHGHYGVMEIVEKLGLEEEKVDWQVAGVNHGIWLNRFRYNGGNAYPLLDKWIEEKSKDWKPENPFNDQLSPAAIDMYRFYGVMPIGDTVRNSSWRYHRDLETKKKWYGEPWGGADSEIGWKWYQDTLGKVTEITKKVAKFIKENPSVRLSDLGSVLGKDLSEKQFVLEVEKILDPERKSGEQHIPFIDALLNDNKARFVVNIPNKGIIHGIDDDVVVEVPALVDKNGIHPEKIEPPLPDRVVKYYLRPRIMRMEMALEAFLTGDIRIIKELLYRDPRTKSDEQVEKVIEEILALPENEEMRKHYLKR

SEQ ID NO: 3065 - protein, 473 aa, Thermotoga maritima
MMYPMPSWVYDSVVYQIFPDRFFIGKGKTVEDKKDLYLKRGGVIEKWGVPPRKLPGAQHVKIFYGGDLWGIAEKVDYFEELGINVLYLTPIFLSDTNHKYDTIDYFRVDPQFGGKRAFLHLLRVLHERSMKLILDGVFNHVGSQHPWFKKAKKNDPEYVNRFFLYKDRHRSWFDVGSLPELNVEVEEVKEYILKVVEHYLKLGIDGWRLDCGHDLGPTVNLWINMKVKEFSAEKYLVSEIWTYPAGWDMVDGLMNYNFRNLVLSYVNGETDSIGFHLERAYRETKNIFGCWNMLDSHDTPRLATMVPDRDLRKLAVVLQFTYPGVPLVYYGTEIGLTGGEDPECRATMEWNREKWDVDLFEFYKKMIRLRRTDPGLRFGEFVLLNDSPLAFLRKAPHPLQNTIVVVNPGEEKVLVLSIPDGKIMNTTPLVDVFSGERFHVDGGVVKLPLLARSFRILKPEDLRVGKYRLYKRV

SEQ ID NO: 3066 - protein, 556 aa, Thermotoga maritima
MKVVKKPFLLLAFVFLLFLTSCFQTSMSQSLVSSNPHSNSTNTDGTSSNLEEVKYPVVYEIFIRSFYDRDGNGVGDLNGVSQKVDYLKELGVDAVWFMPFNEAVSYHGYDITDYYNVEKDYGTMEDLENMIQVLHENGIKVIMDLVINHTSDEHPWFKDAVENTTSSPYWDYYIMSLEDHSGQDHWHWKINSKGQKVWYFGLFGYNMPDLNHDSQKVREEVKKIVDFWISKGVDGFRIDAAKHIYGWSWDDGIQESAEYFEWFRDYVLSKKPDAILVGEVFSGNTYDLSLYPIPVFNFALMYSIRNYPEGQDGMIENNWVEESFLFLENHDLHRFFSHLQEHYKKFSESDYEFIKKRAALWYFLIFTLKGSPVIYYGGEIGTRGFKWHGPVYDEPVREPMQWYASGTGEGQTFWTKEVYKNAGITFGNADVDGCIYDDPYDGFSVEEQESDPKSLLNFIRFILNFRKDHDAILNGDQTIFRDWKNLIAFYRESSNEKLLVVLNPDPVWQNSFTFEENMTMILEVDFENFIWNESNVSFSAGESFTVDPMKAYIFKK

SEQ ID NO: 3067 - protein, 843 aa, Thermotoga maritima
MKTKLWLLLVLLLSALIFSETTIVVHYHRYDGKYDGWNLWIWPVEPVSQEGKAYQFTGEDDFGKVAVVKLPMDLTKVGIIVRLNEWQAKDVAKDRFIEIKDGKAEVWILQGVEEIFYEKPDTSPRIFFAQARSNKVIEAFLTNPVDTKKKELFKVTVDGKEIPVSRVEKADPTDIDVTNYVRIVLSESLKEEDLRKDVELIIEGYKPARVIMMEILDDYYYDGELGAVYSPEKTIFRVWSPVSKWVKVLLFKNGEDTEPYQVVNMEYKGNGVWEAVVEGDLDGVFYLYQLENYGKIRTTVDPYSKAVYANSKKSAVVNLARTNPEGWENDRGPKIEGYEDAIIYEIHIADITGLENSGVKNKGLYLGLTEENTKGPGGVTTGLSHLVELGVTHVHILPFFDFYTGDELDKDFEKYYNWGYDPYLFMVPEGRYSTDPKNPHTRIREVKEMVKALHKHGIGVIMDMVFPHTYGIGELSAFDQTVPYYFYRIDKTGAYLNESGCGNVIASERPMMRKFIVDTVTYWVKEYHIDGFRFDQMGLIDKKTMLEVERALHKIDPTIILYGEPWGGWGAPIRFGKSDVAGTHVAAFNDEFRDAIRGSVFNPSVKGFVMGGYGKETKIKRGVVGSINYDGKLIKSFALDPEETINYAACHDNHTLWDKNYLAAKADKKKEWTEEELKNAQKLAGAILLTSQGVPFLHGGQDFCRTKNFNDNSYNAPISINGFDYERKLQFIDVFNYHKGLIKLRKEHPAFRLKNAEEIKKHLEFLPGGRRIVAFMLKDHAGGDPWKDIVVIYNGNLEKTTYKLPEGKWNVVVNSQKAGTEVIETVEGTIELDPLSAYVLYRE

SEQ ID NO: 3068 - protein, 1010 aa, Thermotoga maritima
MKGRLWRMLSEIVPYTVLRRERIESWIFSDDAVERIVDPSFEWDFSSAPVRFRKELEPFSVAGEQRAYLKLWFGGETLVLIDGKPYGEINEYHRMLNITPLADGKPHTIEAQVMPRGLFGKPEKPVFTEAFFIVVDEALMKVVKTLELTIKTAEVIEDESLSKKLLDISEEFLSKVWIPRDTGTYLMTALEDPGIKDEIKNTWNTPEFKEFTGVKLPEELRNQILEEFEKFKEKLDRIRKNHPGFGTIHLVGHAHIDYAWLWPVEETKRKILRTFANSVLLSKLYPEFVYTQSSAQMYEDLKQNSPELFEEVRKLVEEGRWEPVGGMWVESDCNVPSIESLVRQFYYGQKFFEREFGKKSKVCWLPDVFGFSWVLPQILKEAGIKYFVTTKLNWNDTNEFPYDLCRWRGIDGSEVIYFSFKNPNEGYNGKIDPDTVYKTWKNFRQKDLTNRVLLSFGHGDGGGGPTEEMLENYEVLKDFPGLPHLEMGTVEEFFKKVEIDEELPVWDGELYLELHRGTYTSQFRTKKLHKEAEDSLYLAELISAFTDKDFSDEIDELWKILLRNEFHDILPGSSIKEVYEDTEKELRHVIEKSKDIVIESLKVLSSENKDVLTILNASSFPKKCLFFLNEDLAISFEGEALLKQKTHDGRYVYFIDREIPPFTKVELKVRKATSEETPSELRETNIMENEFLRVHVNDDGTIQIYDKELDRYVFEEKGNILKLHKNIPAYWDNWDIAENVEKTGYTLRAKNIEKIESGPVREVIRVEHESEGSRITQHYILYRKSRRLDIETKVDWHTRRALLRAYFPTTVLSRKARFDISGGFIERPTHRNTSFEQARFEVPFHRWMDLSQTDFGVSILNDGKYGGSVHQGIMALSLIKAGIFPDFLCDEGEHTFTYSVYVHPGDSLRDVVKESEDLNRSFIVHRGVLNLPSPLLEISPQNFRLTSLRRVKDKIVLRLVEIFGTSGKLSIKLPWHGEIYQTNVLEEKKQKVTFPVVYHPFKIYTFVVEG

SEQ ID NO: 3069 - protein, 319 aa, Thermotoga maritima
MKIGIVGLGRVGSSTAFALLMKGFAREMVLIDVDKKRAEGDALDLIHGTPFTRRANIYAGDYADLKGSDVVIVAAGVPQKPGETRLQLLGRNARVMKEIARNVSKYAPDSIVIVVTNPVDVLTYFFLKESGMDPRKVFGSGTVLDTARLRTLIAQHCGFSPRSVHVYVIGEHGDSEVPVWSGAMIGGIPLQNMCQICQKCDSKILENFAEKTKRAAYEIIERKGATHYAIALAVADIVESIFFDEKRVLTLSVYLEDYLGVKDLCISVPVTLGKHGVERILELNLNEEELEAFRKSASILKNAINEITAEENKHQNTSG

SEQ ID NO: 3070 - protein, 388 aa, Thermotoga maritima
MMEYWIRRALEVVKTPFLLFDLSVVEKKYLEMKAALKKADIYYAVKANSHPRIISLLARLGSNFDVASKGEIEKLLALGVDGKRMSFGNTIKREEDIAFAYKNGIRLFAVDSEMEVEKVAINAPGSFVFVRVETDGADADWPLSRKFGTNPEHALQLLSYASKMKLIPAGLSFHVGSQNLNPESWKKAIEIAGRVFKKAMRSGLNLFLLNVGGGFPVQHTKPIPSMEEIGKAIEEAIDENLWFVHNLKVIAEPGRYMVGEAGWLVTKVLLKSERSGEKWVYIDAGVFHGLAETIQNFEYEIRVLGKEREELEEYHLAGPTCDSVDVIYDRIFLPKSITLNDLVCFINAGAYTVEYNTRFNGIEPPKMVFIEELTEISIEEKIKTRVLD

SEQ ID NO: 3071 - protein, 487 aa, Thermotoga maritima
MFITGAFFDILEVGPKKIRRCFELVRVRFAPSPTGHLHVGGARTALFNWMFARKEGGKFILRIEDTDTERSSREYEQQILESLRWCGLDWDEGPDIGGDFGPYRQSERLEIYREYAEKLVEDKRAYYVVYDKEDPSKELFTTYEYPHEYKEKGHPVTIKFKVLPGKTSFEDLLKGYMEFDNSTLEDFIIMKSNGFPTYNFAVVVDDHLMRISHVFRGEDHLSNTPKQLMIYEAFGWEAPVFMHIPLILGSDRTPLSKRHGATSVEHFRREGILSRALMNYLALLGWRVEGDEIFTIEEKLQSFDPKDISNKGVIFDYQKLEWVNGKHMRRIDLEDLKREFIEWAKYAGKEIPSVDERYFSETLRICREKVNTLSQLYDIMYPFMNDDYEYEKDYVEKFLKREEAERVLEEAKKAFKDLNSWNMEEIEKTLRDLSEKGLASKKVVFQLIRGAVTGKLVTPGLFETIEVLGKERTLKRLERTLQFLKKT

SEQ ID NO: 3072 - protein, 508 aa, Thermotoga maritima
MRKFLVILLALLITALLLGARLTILHVNDTHGHAWAFDEYRNPGIGGLATIATIVEEVKREVESQGGYVIFLHAGDLNTGVPESDLQDAIPDIVGFNMMGLKAMAVGNHEFDNPREVLEKQMKFADFPFLSANIVKEDGEPFFNPYIVEDLGELKIAIIGFTTEETEILEPLYLEGLKFENALKVAQKIAPELKKQADVVIALAHLDWGEPKKEDITTTHQLAGVEGIDVVIAGHSHVLGSDVVDGKIIASAGEYGKYVGRLDLDIEDGKIVAWHWEAIPVNLKVYENEKYRYLGKPYLENRYVAKALEYFKKVGNEKLDTVIGETKIYLDGEREHVRSKSTNLANLIVDAMRWKVGADIAFTNGGGIRASIKPGKITVRDILTVLPFGNTLYVLELTGEQIMKVLEYAATIPEGKGAFLQVSGLTWKSKDGKVVEVLVNGEPLDPEKKYKVVTNNYMAGGGDGYVMFKEWDGYDTGYLMSDAVIEYIQNVLNGKIEEYDDSQRYVRE

SEQ ID NO: 3073 - protein, 1046 aa, Neurospora crassa
  unsure (1)..(1046): unsure at all Xaa locations
MEAAFAKPVDEVLSTFGVDPTTGLSDEQVAQSRAKYGRNGMRFLYRILXIQLRYSINGLCXPFCLPQAIPEEPPTPIWELILEQFKDQLVLILLGSAAISFVLALFEDEGGWSAFVDPAVIITILVLNAVVGVSQESSAEKAIAALQEYSANEANVVRNGQITRIKAEDLVPGDVVDIAVGARVPADCRLISIESNSFAVDQAILTGESESVGKDFQAVVSDDKAVLQDQVNMLFSGTTVVTGHAKAVVVLTGSNTAIGDIHESITAQISEPTPLKQKLNDFGDQLAKVITVICVLVWLINIPNFADPSHGNWTKGAIYYLKIAVSLGVAAIPEGLAVVITTCLALGTRKMAAKNAVVRSLPSVETLGSCSVICSDKTGTLTTNQMSVNKIVHFNQDGTDLEELDVEGTTFEPKGAIMSQGKKVTDLAQNSATILQLTEVAALCNDARLDYHPSTGTFSNVGEATEGALRVLTEKIGPCAPSDCPPKDRVHYASSWYEKQYQRLATYEFSRDRKSMSVLVERDGQQKLLVKGAPESLIERCTHALLGPDGKKVPLDSNMSELLMKEVVEYGNRGLRVIALASLDNVAGNPLLHTAKSTAEYASLEQNLTLIGLVGMLDPPRPEVAASIKKCKDAGIRVVVITGDNRNTAESICRQIGVFGSNEDLTGKSYTGREFDNLTPSEQLEAAKTASLFSRVEPTHKSKLVDLLQSLGEVVAMTGDGVNDAPALKKADIGVAMGSGTDVSKLAADMVLADDNFATIEVAIEEGRAIYNNTQQFIRYLISSNIGEVVSIFLTAALGMPEALIPVQLLWVNLVTDGLPATALSFNPPDHDIMRRNPRKRDEALIGGWLFFRYLVIGTYVGLATVAGYAWWFMFYSEGPQISFYQLSHFHRCSTEFPEIGCAMFSNDMAKAGSTVSLSILVVIEMFNAMNALSSSESLLTLPVWKNMMLVYAIGLSMALHFALLYTPILQTLFSILPMNWAEWKAVIVISAPVVXVPRSVFHVILFEQYANTLSRLLDELLKAVERKYFVQSTPSSTSSDKKKDL

SEQ ID NO: 3074 - protein, 244 aa, Neurospora crassa
  unsure (1)..(244): unsure at all Xaa locations
SSSLSTDGGAAVAMVGKDCVAIACDLRLGLQALTVSNNFPKIFQYGDVFLGLTGLATDVSTVSDLFRYKVNMYRLREERNIAPRTFANLVSSSLYERRFGPYFVSPVVAGLDPKTGEPFICGFDSIGCIDFAKDFIVSGTATEQLFGMCENLWEPNLVCNLCEPQPDLPLKPLVLAVFVCWVVIVRAWYXRXQLPTRDPEDLFETISQALLNAVDRDALSGWGAHVYIIEKDKVTKRLLKGRQD

SEQ ID NO: 3075 - protein, 308 aa, Neurospora crassa
  unsure (1)..(308): unsure at all Xaa locations
EINSKTFLARLCEQAERYDEMVTFMKEVAKLGGELTVDERNLLSVAYKNVVGTRRASWRIISSIEQKEESKGSDKHVAIIKEYRQKIETELETVCKDVLEVLDEALIPHAATGESKVFYHKMYVFQAKPLALAIADRYPKTGKGDYHRYLAEFASGEKRKNAATAAHEAYKVRASENSRDLLPMRFCXLGVSLPCRTATDVAHTELTPTHPIRLGLALNFSVFYYEILNSPDRACHLAKQAFDDAIAELDSLSEESYRDSTLIMQLLRDNLTLWTSSDNGEPEAAAEAPKAEEKAEEKAEAAEEKAPE

SEQ ID NO: 3076 - protein, 370 aa, Neurospora crassa
  unsure (1)..(370): unsure at all Xaa locations
TATRTLRALRTSTRPALTAAPRAAFRQGGRRLYSSEPAKSGGSNIWAWAIGAGALGAGGLWYLNQDGASATPKVFAPKFDDYQAVYNEIASRLEEKDDYDDGSYGPVLVRLAWHASGTYDKETGTGGSNGATMRFAPESDHGANAGLKAARDFLEPVQGXAATILKSWYFNILTSQTAKFPWITYSDLWILGGVCAIQEMLGPQIPYRPGRQDRDAAGCTPDGRLPDASQAQDHLRNIFYRMGFNDQEIVALSGAHALGRCHADRSGFDGPWTFSPTVLTNDYYKLLLDEKWQWKKWNGPKQYEDKKTKSLMMLPADMALIQDKKFKQWVEKYAADNELFFKDFSNVIVKLFELGVPFAENSERWVFKTV

SEQ ID NO: 3077 - protein, 554 aa, Neurospora crassa
  unsure (1)..(554): unsure at all Xaa locations
AKTPIVTLGAIWAGAVVSPANPLYTVEELTFQLKDSGAKAIVTQAPFLKTAVEAAKKAGIPNDRIVLVGQHSDPSGRSSISAVSDALTSPPAQEDQNQPGEGPRVFVYSSGTTGLPKGVCLTHLNVVSNILQMADVDGRYWSATGGLNGEGDKFLGVLPFFHIYVSSLSLSLSVESXSQKTKIGSNPMQQPLLQGLTCALFMCLYLGWEMFVVERFDLEKALQTIQDQRITAFYVSPPIVLAFGKSPLVDKYDLSTLKVMHSGAAPLTSELTEAVWQRLKIPVKQGYGLSESSPVVTCQTVDEWAKFMGSCGKMMPNMEAKLVDEEGREVADGEVCTFCPDVHLTDKMTXDXPGITDNVGXVGELWIKGPNVFKGYYKSPERTKEAFSEDGYFKTGDMFHIDKYGNMYCVDRLKELIKFSKLFLFLTRYVTEQTWTDHXFYLSSRGLPRPTSELEGLILGHSDVTDVCVIGVDDRSQATEVPRAYVVLRPGIEASDSKAQEIMEYVAKQVAPHKKLRGGVRFVAEVPKSPSGKILRRMLRDKVKQEERAAGSKL

SEQ ID NO: 3078 - protein, 1081 aa, Neurospora crassa
MDRLSAWKDNDDVLPFYQKSPGQGTFATPEEIEQSRSGCNTPRHRITSAESRVGCKPHAIVKARDADRRANRGVADDFSYMTPAEAATHLDTSLTHGLTPAEALSRLHDYGPNEIPHDPPEPLWLRFVKQFQEPLILLLLASAGASILVGNVDDAVSISVAVTIVVSVGFIQEYRSEKSIEALNHLVPNHAHLVRKHTGAKPVDGDDSSDIGDVAGSVTPPEDVLDAKSSKVMAAQLVPGDLVLFTTGDRIPADVRVTKATDLTVDASNLTGENEPVRIVAEARTRHGATGPAADKDNSTNVVYMGTLVKSGYGQGVVFATGGNTHFGTIATSVSGTESPRSPLQLSMDDLGSQLSKMSFVIIGLISLVGWLQGKKLLEIFTISISLAVAAIPEGLPIIVTVTLALGVHRMAKHNAIVRKMPKVETLGSVNVVCSDKTGMPQKDFTKDDSKLTVTRNLTTNHMTTVKMWFFGTDDALDVDSDDEATETKPDPAMLRILRIGNIANNARLAMQYTENGAGARAVLSSTQGKNAPSTYTRWVGQPTDIAMLDLLDRFKEHDVRDSIGPRVSETPFSSERKWMGVTIGSEGGKSDKEFAYIKGSIDKVLDACDTYLSKDGREFVMDTNRRQEAIDAAEKMASRGLRVLAFASGPVTKPAKNKSPATNTVEEQYRGLTFAGLVGMSDPPRPGVSRSIRKLMRGSVKVIMITGDAETTAVAIGKQLGMSVTTPAVGTSGVRSVLRGDEIDAMTDEELAAAMDHTTIFARTNPDHKLKIVKALQSRGDIVAMTGDGVNDAPALKKADIGIAMGKHGTDVAKEAADMILTDDDFSTILHAIEEGKAIFNNIQNFLTFQLSTSAAGLSLVLLCTCLGYKSPLNAMQILWISKTPPPSCILSISANCLFPDIIMDGPPAQSLGVESVDKDVMNRPPRRRGDAVLTNPLIARVLTQAFIIMVGTMLVYKHEMLGDGQVTRRDTTMTFTCFVLFDMFNALACRSESKSILRGEIGLFSNTLFNWAVSLSLAGQLLVIYFPWLQEVFQTEALGLLDLVYLVLLCSTVFFADELRKWWKYGARRHMGVNYSQAV

SEQ ID NO: 3079 - protein, 467 aa, Neurospora crassa
  unsure (1)..(467): unsure at all Xaa locations
MVSRHGSRYPTGGSNVESFGARLANATGKFNATGELEFLNNWKYQMGTEILVPRGRQELFDSGVLHAYMYSSLYDPNTKIIARTTVCIWLSVKTSYLVGCXLEKHRPKTACXDLLRTSWLVCSAWNGKFFPLQAPPPCDVANGWSXILILYRPNNVTLEVIIEGSNLNNSLAGYMNCPNEREDGLGSAARDIWSATTCRMVRGFWMINGLSNISCTWLTSSTSATERFSKLVTGYNWTLDDTYAAQTLCAYDTVSQAPPRSYHLFHIKLTFSVGRKRLQPLCSLFTYEEWIGFGYSHDLQFYGNNAFGSETGRAIGIGFQQEVLARLQNHTIPYSETQVNVTLDNNTVTFPLNQSLYLDFSHDTNIVSILAAFGLTQFEEDLPADKYPGEHNFTVSHMTPFGARLDIEIIKTPKPLKADRSGYEDEGEETKYVHFVLNQRTVPLGWSHPECDAERVDGWCEFEAFLK

SEQ ID NO: 3080 - protein, 362 aa, Neurospora crassa
LAFSQRPLPPPSNEALLSSAGYKLPLRTKGRDIVDQNGKRFKLSSVNWYGASDELFIPGGLDVQHRDVIASTIRSLGFNSVRMPYSDEMVISNPEVPLRLLAANQDLVGKRALDVFEATVTALTDAGLAVIVNNHITTATWCCGADPCDAGWANDFLPGSLCRVRQTEAQWIDHWVTVMNRFVDNPLVIGADLRNEVRGLWGTMPWERWAAAAERAGNALLGINSDWLIIVGGTESGNDLTGVKRRPVELDVANRLVYSAHVYSWSGWGSMGGRYSKRTYASFVKAMRQNWGYLVEENLAPVWIGEFGAPDRPGIGDANYWQNLLRYLKAIDADFGYWAINPRKPKDNEKESYSLVEDDWVT

SEQ ID NO: 3081 - protein, 439 aa, Neurospora crassa
YFTVDDTLLYNAFHHDFGPFHIGHLYRFALQFHEILGAKENKDRPVVFWSRADPRSRSSKSASSRQQRLLTNVTLGRANASCLLACYMVLIQSWPPHLALAPVAQVDPPLMPFRDAGYSQADYGITVQDVVYGVWKAKEEGCCVLETFDLDEYEKFERVEHGDFNWITPNFLAFASPQHTPVAPTPEGTEQWSLLPKTLAAVDAHPTLPQPFKNVLRHFSERDIGLVVRLNSQLYNPSYFEALGINHIDMIFEDGTCPTLSTVRKFIRMAHETISRKKGIAVHCKAGLGRTGCLIGAYLIYRHGFTANEVIAYMRFMRPGMVVGPQQHWLHLNQGIFREWWIEERVERRLRKEMAAAAAAAAQANGTAHPSTPVRAVSKTSLGRSSSKNGVSTPSNRGSVRTPLGEIDRESARDNHIGVQEDYLPAPTPGQPRKTQRGA

SEQ ID NO: 3082 - protein, 383 aa, Neurospora crassa
SKSHAEQLRPNYRPRLELSGHTAAISQVRISPDGKWIASASADGSVKIWDATTGNNLDTLIGHMAGVSCLAWAPDSNTLATGSDDKAIRLWDRVTASPAHACGDESNRGQGPREYIRGGSQLARTARGGRTGMGPLLGHHNYVYCLAFSPKGNILASGSYDEAVFLWDVRAGRLMRSLPAHSDPVSGIGFCCDGTLVVSCSTDGLMYAFPCPKKKKKTHELHGVWLLIFVCVHSRIWDTSTGQCLRTLVHEDNPAVTNVCFSPNGRFVLAFNLDNSIRLWDYVSGTVKKTYQGHKNSGFSIGGGFGVVTDNKDTQDDYRHGNIGKPFVVSASEDGDIVMWDVVTKQIVQRIEKAHEGVCFWVDVNGDTMVSSGQDCTIKVYKN

SEQ ID NO: 3083 - protein, 312 aa, Neurospora crassa
  unsure (1)..(312): unsure at all Xaa locations
QDWDVLKILGKGSFGVVRLVREKSQYRDEGPNGRSETWSEASSKQVYAMKVIRKSDMLRTSQEGHLKAERDFLVASEGSKWYVLQVASXNLSRYXLGRRIVPLIASFQDAANLYLVMEYMPGGDFLGLLIRENILHESVARFYVAEMILCVEAAHALKIIHRDIKPDNFLISASGHLKISDFGLAFDGHWSHDASYFNCHRYSLLNKLGIHIEGDDQDKAEGRSLQATMKWASGIMTGIDKHEKKTTDDGEPLLSWRNRCGNRTSAMSVVGTSQYMAPEVIEGKKYDARCDXWSIGIILFECLYGRTPFISD

SEQ ID NO: 3084 - protein, 351 aa, Neurospora crassa
  unsure (1)..(351): unsure at all Xaa locations
SSMRFGLRAQSLTSNPKQSSLRIYVWLILLDAPIIETDTYLSLIHRGASPAYSKIRNDTFRTLTTDPLFRRRVSEASLIRLLNAVAWRLHDARGDRTRDHSIVSLSRRSAPSEPGSRPGTSGHDSITGSPASKSRARALTLTTEGSEASGVASEPGTYVQGMNVLAAPFLYAARSEAEAFVAFHQLLTQELPGYIRGAMDGVHKGLALVDKVLSIVDPKLSLYLMSKNLSAEIYAFPSVLTLCACTPPLPEVLRLWDFLFAYGPHLNILCIVAQLIMIRTKIMESPRYDHPSNRXLVSKVGFQMLTCWSLPSPNKLLRSFPALQADLIKRTTLTVIRMIPDDVYAEIVVHA

SEQ ID NO: 3085 - protein, 436 aa, Neurospora crassa
DVLFNNPVFAGGMGLAGLGAAAAFGRRAAIRGAGLLKRQMLVNVEISKRDPSYNWVLAWLALPRDNTGFIAQRLTRLRNLSVSTTTKSITPGKDEGSSHADFRVQPGFGRHIIRHKPGVYIAVNREKASTTQTATGEPHETLTLTLLWPHRHVLGEIFTEAHQMAHRFHEGKTVVYTAKRMEWMPLGKPRLKRPLGSVILDKGVKESIVDDVKEFLAAQQWYTDRGVPYRRGYLLYGPPGTGKTSFIQALAGELDYSVAMINLSEVGITDDLLAHLLTQQPEKSILVLEDVDAALVNRRPRDSDGYSGGTVTFSGLLNALDGLAAGENRIAFLTTNHIDRLDPALIRPGRVDMMMRIGEATRHQAAEMWDRYYGDIDTDHSGRERFLNRLDELGLFGENNQDPDAPKRHTSTAAIQGLFQFNKNDMEGAIRMAEGL

SEQ ID NO: 3086 - protein, 620 aa, Neurospora crassa
  unsure (1)..(620): unsure at all Xaa locations
YVWPVGHRGLQLRVFLVGCCLMAMNFIHVLIPRQIGIVMDSLGGVNHKDPWTQVLIFAGLKLTASEAGISLLRQWLWIPVESYSTSRISTAAYSHVLNLSSDFHDSKSCSDIEMAIMSGTSISNMLESICFQAIPMLIDMGVAFIYLSVTFGPYEGFITIATATVFCYITAIMLSGLKEVRRSQVSAYFEEHYVRHAGIQGWSTVSSFNQIGHEETRYSDAVNNNVGHYRKVLLGYYLAYAFQSMVLLCGLLAGAFLAVSQITQGQATPGQFVMLLTYWSQLVSPLTFFASLGKSISGDLIRAESLLDIMQMKPTVLSKEGAPPLDFQRGHVQFENVSFSYDKKKPILKSVNFQVDPGTSVAFVGATGAGKSTMLKLLDRFYDVTGGSIKIDGQDIRNVDLFRXVPIADIWWAEELIPTCSLRARIGVVPQNPILFDDTIMNNVRYAKLSATDEEVHEACKAASIHEQILTFTDGKXIIWSAKLDLXSXXCQRYQTRVGERGVKLSGGELQRVAIARAILKRPAIVLLDEATSAVDTETEQNIQEALGKLCKGRTTFIVAYVLIKSQPLCAILTEIXARLSTIMNADKIMVVTGGEIVEEGSHEDLIRANGKYAELWSKQ

SEQ ID NO: 3087 - protein, 432 aa, Neurospora crassa
  unsure (1)..(432): unsure at all Xaa locations
LIHLKTYKYSAVDKSPVSNYILKPYVCLPQHERLPPSRHWKIHQMLRLRRXWNAFVEFLPLWVAPNMVTLIGFSFIVANVGLLLIFMPDLVGPVRPSKLPKASRAVSLLTRXHDLTVXGPSWLYFSFAFGLFAYQTMDNVDGKQARRTGTSSGLGELFDHGIDSLNCTLASLLETAAMGLGTTKAGVFTALCPCLPMWFSTWETYHTHTLYLGYINGPTEGILIACLLMAISGWYGPEIWSERLADNLHLFSFLGLNEENLGDTSFQDIWVYFLIGAMFFHIPFCIINVVNARLSRNEPLLPVFLEWTPIVVFTLSVGTWLYSPYSTLMDENHLVLFCVTMSFVFGRMTTKMILAHLTKQPFPYWTVMLWPLIGGALIGNLPRFGLPAVTAQFEHLYLWAYLVFAFVVYSRWAWLVTTSICDFLGINCLTIP

SEQ ID NO: 3088 - protein, 832 aa, Neurospora crassa
  unsure (1)..(832): unsure at all Xaa locations
MKLSAIATPLGLAALAIASNVLPRDFDSNDYYVLHLDARTSPTEVARSLGLSHEGPLGELQDHHLFVGRKAEHDIVKRELTERRRRKRSLGDEPHVLDSVLFSEKQILRKPWEKRMVPRPVGPSRRGLFSDQEVDWAVKKQNEVIGNLGIRDPIFKEQWHLFNTVQTGHDVNVTGLWLEGVTGKNATVAIVDDGLDMETDDLKDNYYAQGSWDFNDKGPDPKPRLSDDKHGTRCAGEVSAGKNKACGVGVAYDSRIAGLRILSKLISDADEAVAMNYDFQHNQIYSCSWGPPDDGQSMDAPGILIKRAMLNAVQKGRGGLGSIYVFASGNGAGNGDNCNFDGYTNSIYSITVGAVDRNGDHPYYSESCSANLVVTYSSGGGDSIHTTDVGNACSDTHGGTSAAAPLAAGIFALVLQVRPDLSWRDMQYLTVNTAVPINLDSGEWQTTAIGKQFSHMYGYGKLDSYAIVQAAKTWKKVKPQAWFYSPWIHVNKAIPQGDTGVAVSYEVTQAMLDEANVERLEHITVTMNIMHTRRGDLSVDLISPNNLVSHLSVSRKNDEARAGYDDWTFMSVVHWXAHALPQLSEVIFANLYITRGETGVGNWTIIVKDTQINSHEGVFTDWHLKLWGESKDASKAKVLPMPTEEDDNDHAAIPTTTLPATTTTLPPQPIATDTKPSTVSDHPNRPVNSKPTPTDAPNPSPTSDEQTSETTTPANSTWLPSFLPTFGKSAATMVWVYGSAALIGVFCISLAVYFWLARRKRLRNNPRGDYEFELLDEEEAEGLAGGGSSAEKRRAGAGGLAGGKRTRGGELYDAFAGGSDDEDADDGVYRDR

SEQ ID NO: 3089 - protein, 445 aa, Neurospora crassa
  unsure (1)..(445): unsure at all Xaa locations
SSYRNAVYFTNWXVINDXKLQDGHTYXPSQGIYGANFQPQQLPASQITHVLYSFADIKPDGQVXVSQSXRYRLXKGTDSXQSSSDTYADLEKRYPGDSWSEPGENAYGCVKQMYLLKKRNRNMKVLLSIGGWTYSPKFPPVAATEEGRRRFASSAVKLVQGSELQGTSIPRISTKKLXPNPSDWGFDGLDIDWEYPTNAREAQDFVLLLRACRQALDDYARQYAPGYHFLITIAAPAGPQHYGVMDLPGMNPYIDSWHLMAYDYAGSWDSTTGHQANLLPSPKNLLTTRFNTDQAVRDFVRRGIPANKIVLGLPLYGRSFEGTDGLGKPYSGIGAGTLEPGTWVYRDLPRPGAKEEYDNLAKATYSYDALSRELITYDNVLSALVKTKYIFLRGLGGAVFWEASGDKTGAESLIGTLATQMKRLDQTKNLLAYPASRYANIRAGV

SEQ ID NO: 3090 - protein, 554 aa, Neurospora crassa
  unsure (1)..(554): unsure at all Xaa locations
RGKLTIKVGEARGLRRCRDPYVVVVFQRSELISPGPRRAAENDDDAAIAAVQTGGIPIQRQSSDSGRPMAIPMRSRQSSNTSLTDFNTFRRRNSSQSRRSFTNPTWDAEAVLXVTRYVGLCLKYXRVSSDVVDSDMLVDISVYGQGPSGEEFLGHVDFQANKAEPIRGWFPLQGHADTMAENAPTGELYVEAHYQRAEQKHFGPEDFQILRLIGKGTFGQVYQVRKKDTGRIYAMKVLSKKVIVQKKEVAHTVGERNILVRTAMSDSPFIVGLKFSFQTPSDLYLVTDYMSGGELFWHLQKDGKFEEKRAKFYIAELILAIQHLHENDIVYRDLKPENILLDANGHIALCDFGLSKANLTKNDTTNTFCGTTEYLAPEVLLDEAGYTKMVDFWSLGVLVFEMCCGWSPFYAEDTQQMYKNIAFGKVRFPRDTLSLEGRNFVKGLLNRNPKHRLGATDDAEELKRHAFFADIDWDALSKKLITPPFKPQLKSDTDVSYFDPEFTNALNANGSLNERAAALARGYATSTPLSPSVQANFQGFTFVDESALEENMHD

SEQ ID NO: 3091 - protein, 377 aa, Neurospora crassa
ESYEINLEHDFAVDGNLSTTIGSTEAVEIGSDGGVARSQKMTADDFEPLRCLGKGTYGTVLLVKQRTTGRLFAQKQFKKASLVVHKKLVEQTKTERQILESVNRHPFVVKLFYAFQDQEKLYLILEYGQGGELFTHLNTEKMFSESTAAFYMAEMVLALSHLHTTLGVVYRDLKPENCLLDSEGHLLLTDFGLSKVAIESEECNSMLGTVEYMAPEVIQGKKYGRSVDWWSLGALGFDLMTGNPPFRGGNNAKIQENIVKQKLIMPYFLTAEAKDLLTRLLRKDPAKRLGSNMPKDLDTIKKHRFFRKIDWKKLAARELEPPIQPMITDPELAENFAPEFTELSLSPVVSRLEERYAAAAAKDDLFGGFSFVASNSL

SEQ ID NO: 3092 - protein, 359 aa, Neurospora crassa
QWYFTPDEVASTPSIIDGLSVSEERLRRAKGVNFIFQAGIMLDLPQITLWVAGVFFHRFYMRRSMVEEKGGIHHYVCLFMSSNQLLWRPCWKSCSATRMWPFSSEDAQHQLTHFIYAEIAATALFLANKTEENCRKTKDLIIAVAKVAQKNTKLIIDEQSKEYWRWRDSILNYEEVMLEQLTFDLMVGIPYHPLYEFLNMLEQDIPLQQQESSQPQQDLSKQKQHLVRNKAFRNAAWTYCNDLCLTVLPLLLNARDIAISAIFFAASILKEKVDDVDGEAWWKYLKGDEGKVCMAMDVITEFYKENPLRKQDNRMSPSPTFNLESTRRRLGTASSQQEGDGTPMETDRSTQSPRSSSGR

SEQ ID NO: 3093 - protein, 787 aa, Neurospora crassa
LTTTGHGSFGIIRKVRRKADGMILCRKEISYLKMSQKEREQLHAEFSILSTLRHPNIVGYYHREHLKATQDLHLYMEYCGNGDLGRVIRNLIKNNQYAEESFVWSIFSQLVTALYRCHYGVDPPEVGKTVLGLGSTARPKPPSGGMTILHRDLKPENVGDPVIRMWTGLTCCLVVFLGEDNSVKLGDFGLSKVMQSHDFASTYVGTPFYMSPEICAAEKYTLKSDIWSLGCIIYELCAREPPFNAKTHYQLVQKIKEGKIAPLPSVYSGELFATIKDCLRVNPDRRPDTATLLNLPIVRLMRKEKEVVEFSRTLRTKEETLNKRIRELDSKLSALETEKSSIRAEIDASLRREWEVKARLEIDRLVAQEIESLQQKFEQEVQARVEAELQRHGRGPMFNSHGQQGSFSSTAATLVSDYNLSSVGSGDGDFPSTTDITDISIAESTDGSDITKKIPRTPFHRAQTYSSAPAESVLGTPMDIEMASPSPITIASLSLSPRRMALTKAPTTNPRMIFGEEPTSTDKSNWEVPRETEMIDSGDESEAEALVPSPKRITKSSKNPFSTVTTRSRPSLNSQQNSNVLPIHGLRSKQTLATRSKTVSGVSSIGQHPLRSAPSAPSLRDRKPSPTRRLSRIPSVTGVGRRLSANNINNSSNGGSDAPSSTVTSNITVRTRGLKRMSSTCDESSFSQQQNNQPQQSLPQAPPLKKIGLMAAKNIRGSSLVELHQARAGGRPISAIISNEAKLRAFKEHATIAASAVDSSSSSSSSSGQSQLPTRPRSQPQTDNRKL

SEQ ID NO: 3094 - protein, 488 aa, Neurospora crassa
  unsure (1)..(488): unsure at all Xaa locations
FKNEIIRLAHTLRLKGWRRIPLNGGETISVERLSGALTNAVYVVSPPPESILPPQEGKRQPEKVLLRVYGPQVEHLIDREIELGVLKRLARKKIGPRLLGTFLNGRFEQYFNSTTLTPENLREPETSKQIAKRMRELHDGVELLEHEKDEGPGVWRNWDRWLDQAEKTAMYLDSQVAAQLQESTRHKETWKTRGFVCGVEWPVFRKMVQKYRKFLEDYYGSPTKIREKLVFAHNDVGPPHILLFTEKNYXPRIXTQYGNILRIRPDDKKSPLLQPANEHKQLIVIDFEYAGANLAGLEFANHFSEWTYNYHDPVTPHVCDAAKYPTLEQQRRFIKAYVDHQPKFPSVPGVSTPSVTPSSAETPRPGMLQSTNSASSIVEFMLDARVPPGGWKEEDARREAESEKRIKELLEETRLWRVANSAQWVVWGIIQAKIPGLNDGAKDVVTAPAGSVPDEELEAEEEADAFDYLGYSQERAFFFWADCVRLGL

SEQ ID NO: 3095 - protein, 750 aa, Neurospora crassa
  unsure (1)..(750): unsure at all Xaa locations
KVRASVRNYDVEMPVNTIRAWTIGMLLCTIGSAVNMLLSLRNPSISLSTLAIQLIAYPIGLGWDLIFPDRVFTVFGIKFNLKPGPFNFKEHVIIVVMSNVRLGLLLCXASRXLLLPXAAYGGGALYATDVILAQEIWYKQSFGWAWQILFGISTLCTGYGLAGLARRFLVWPAAMIWPADLINCTLFYTLHDHSPSDPARTNGWSISRYRWFLIVMAGSFAWYWFPGYLFQGLSWMCWITWIWPDNVIVNQLFGGQSGYGLFPITLVSGLQLLGEINFMCXLSLGWSIISGYLLSPLASPFHAIANVVGGVTFFFVIVSLGIQYSNIWYSAYLPVQESHSYDNTGKRYVVLRILNENLHFDEAKYHAYSPLYLPTQFALAYGLSFAAVAAVIVHVGLYHGKDIWNQWKLARHQEDDVHMRLMKKYRDAEDWWYIILFAVMLGMSFAVVCAWDTGFPWWAFIICILIPVVWTIPIGIIQAITNIQLGLNVLTEYVIGYMLPGRPLVMMMFKNYGYLVMSQALYFIQDLKLGHYMKVPPRVMFWSQLIASVWSAIVQIAVMNWALGAIPDICTDGQANQFDCPSAKVFFTASVIWGAIGPARMFSGKALYSSLQWFWLVGAVAPVISWFFVRRYPRSLWRYVNFPLVFGGSGWIPPATVYIYYCWGIVGTVFNFFIRRRKTGWWLQYNYLTSAALDVGLLLSTLVIFFSLTLSHTKAPEWFGNTVAKSTMDTTATAVQKLVPPGEIFGPREW

SEQ ID NO: 3096 - protein, 365 aa, Neurospora crassa
AYYAEVTVGTPGQKVSVVLDTGSSDLWVVSYKADLCTDPSIQRQWGDSCDKTYNPTKSSSYKVLEEDSFEIRYLDNSTAAGDYITDDLNIGGATIKSLQMGYATKTVRGAGILGVGYSSNVASQQRYPNLIDQFVAQKLITTKAYSLYLNDRRSDTGSILFGGIDKDKFIGDLSILPIYLAKGQAEPIHFEVEMQSVSLALTKNGKTTKIISTDPSLSQTSTIAILDSGTTLSYLPSKITDQIHTKLSVYVDEIWTGLTFIDCQYLTSNPDLRLSFTFGANATISVPVWELVLDLLGESQSELPFKMPFKNACIFGIQSTAGFQEDNFDEDWALLGETFLRSAYVVYDLTHHQIGIAQANLNSTT

SEQ ID NO: 3097 - protein, 682 aa, Neurospora crassa
  unsure (1)..(682): unsure at all Xaa locations
SVVSTSQQLAVRALPDSPSGGYAPAVVDCPKTKPTLRKAVDLSNEEKNWLSIRRKNTIQPMRDLLKRANITGFDSETFMNEAANNISQLPNVAIAISGGGYRALMNGAGFVAAADNRIQNTTGAGGIGGLLQSSTYLYVKWFFLSRFRVSTAPVQSWAAVDDLAGEHVLDSMPLLRFLKSRSRGPXPXIANATLGAGLSGGGWLVGSLFSNNFSSIETLLSENKVWDFENSIFKGPKEAGLSTVNRIQYWSEVAKEVAKKKDAGFETSITDYWGRALSYQLIGADMGGPAYTFSSIAQTDNFQKAETPFPILVADGRAPGDTIISLNATNYEFNPFETGSWDPTVYGFAPTKYLGANFSNGVIPSGGKCVEGLDQAGFVMGTSSTLFNQFLLANISSYDGVPRRAHRGRDFCPQGNRRQEGRVSQIIPNPFLDWNNRTNPNADTLELDLVDGGEDLQNIPLNPLTQPVRAVDVIFAVDSSADVTNWPNGTALRATYERTFGSISNGTLFPSIPDDWTFINLGLNNRPSFFGCDVKNFTLNANQKVPPLIVYVPNAPYTALSNVSTFDPSYTMSQRNDIIGNGWNSATQGNGTLDSEWPTCVACAVISRSLDRLGRQTPAACKTCFERYCWNGTVNSKDTGVYMPEFKIADAHALDSGAVAIGKMVNVWSSVVVGVVAATLLL

SEQ ID NO: 3098 - protein, 891 aa, Neurospora crassa
METTLPLPFLVGVSVPPGLNDIKEGLSREEVSCLGCVFFEVKPQTLEKILRFLKRHNVEFEPYFDVTALESIDDIITLLDAGARKVFVKTEQLADLSAYGSRVAPIVTGSSAALLSSATESGLLLSGFDQTASEAAQFLEEARDKKITPFFIKPVPGADLEQFIQVAAKANAIPILPSTGLTTKKDEAGKLAISTILSSVWKSDRPDGLLPTVVVDEHDTALGLVYSSAESVNEALRTQTGVYQSRKRGLWYKGATSGDTQELVRISLDCDNDALKFVVKQKGRFCHLDQSGCFGQLKGLPKLEQTLISRKQSAPEGSYTARLFSDEKLVRAKIMEEAEELCTAQTPQEIAFEAADLFYFALTRAVAAGVTLADIERSLDAKSWKVKRRTGDAKGKWAEKEGIKPAASALAATSAPVTKEAAQETTPEKITMRRFDASKVSTEELDAALKRPAQKSSDAIYKIIVPIIEDVRKNGDKAVLSYTHKFEKATSLTSPVLKAPFPKELMQLPEETIAAIDVSFENIRKFHAAQKEEKPLQVETMPGVVCSRFSRPIEAVGCYIPGGTAVLPSTALMLGVPAMVAGCNKIVFASPPRADGTITPEIVYVAHKVGAESIVLAGGAQAVAAMAYGTESITKVDKILGPGNQFVTAAKMFVSNDTNAAVGIDMPAGPSEVLVIADKDANPAFVASDLLSQAEHGVDSQVILIAIDLDEEHLQAIEDEVHRQATELPRVQIVRGSIAHSITVQVKTVEEAMELSNKYAPEHLILQIKEAEKAVDLVMNAGSVFIGAWTPESVGDYSAGVNHSLRKLHIINSPASQILLLTSRHIATYGFAKQYSGVNLASFVKHITSSNLTAEGLKNVGQAVMQLAKVEELEAHRRAVSIRLEHMSKSN

SEQ ID NO: 3099 - protein, 165 aa, Neurospora crassa
STAASAAAAASSAASNPRPRDARTIELLLTAQGVTAFEQRVPLLLLDFAYRHTSAVLSDALHLSADPYTSHAGARPSASSGAAPVNVGDATITSNAVQLAIASRLNFQFRGGSGGGSGGGVSKEWMMEMAREKNKVALPKVSVNEWGVRLPSERFVLNGVSWGLK

SEQ ID NO: 3100 - protein, 602 aa, Neurospora crassa
QDASEPDEEYIPTSFDWASRPMKNPIPESSLVQLPKGPPRELPRIQYAFTADELGKAHNETQWYRRDAVRKAAQKSWKSYRAFAWRHDELTPQSLTGKDSFAGWGATLVDSLDTLWIMGLREEFDEAVRAVGAIDWNKSSSSHCSLFETNIRYLGGLISAYDLSNREILFKKAVELGDMLFAGFDTPNHLPANSYDFRKAKVGELSASSRQSLAVLGSMSMEFTRLSQLTGDPKYYSIVEQLKKGLEKTQEQTNLPGLWPKYIDLIEGTRPRSDTLFTLGAQADSAYEYLSKTYLLLGGLDPSYELMHVKAMDAAVKHLLFRPMLPSGDDDTYEAGSPPPDILFSGNAVSTQRDKSDLQPRVQHLGCFAGGMFALGGKLFDRPDHVQIGEQLARGCAWAYEAFSTGIMPEVSELVPCDKVVEHEAEENDDHLAQCPWNEAKWRQRKKKAAAAAAAAAAMNTRFASDTTNSQTTTLPKPFTKLLDPHYLLRPEAIESLFVLYRITGKKDLLDIAWRMFQSITKATETKFAFSAIEDVHIPNPGQPTTKTDSMESFWMAETLKYFYLIFSPEDGAAEGSGGEEEGVTLDGWVFNTEAHPFRVPR

SEQ ID NO: 3101 - protein, 338 aa, Neurospora crassa
  unsure (1)..(338): unsure at all Xaa locations
GRGKYSEVFEGINVVNYQKCVIKVLKPVKKKKIKREIKILQNLAGGPNIVALLDVVRDSQSKTPSLIFEYVNNTEFRTLYPRFNDFDVRYYIFELLKALDFCHSKGIMHRDVKPHNVMIDHENRKGKFSKSREXSAHQLRANTFSCLSQLRLIDWGLAEFYHPGTEYNVRVASRYFKGPELLVDFQEYDYSLDMWSLGAMFASMIFRKEPFFHGQSNSDQLVKIAKVLGTDELFDYLDKYEIELDAQYDDILGRFQRKPWHSFINAENQRFVSNEAIDFLDKLLRYDHNVRFCTRICLAQYRCNTRNXHDTFPERLTAKEAMAHPYFAPVRDEATRAR

SEQ ID NO: 3102 - protein, 401 aa, Neurospora crassa
VSPEEQPFISPRLIPPVHIAATTATPITTMWEHSEEDDMANAHLSDQMERILKLFEVISARSDIDHPICIECSDMLVEEMQKKLESANREKDAYVNYLKELKASEPTDEEIRAQEEATRKAKQAEKELLEELKALEQEQAALEREKLELEAEIREVDIKEEEFWRARNGFNTTLIDFQNERDSINSKFDHDSRQLEKLQRSNVFNDTFCISHDGTFATINGLRLGRMHNVPVDWPEINAAWGHALLLLVTVAEKLNFRFEGYEPQPMGSTSRIVRIEPASTSMASSFYPSRPVDANAPPPPAKRTVLELYSSGDFPLGFTFIHRKFDTAMVAFLELVRQLGVHVQEQTRREGNPLSLPYQIQGDKISDVSIKLGVQQDDSWAKACKLTLTCCKFLLAHASN

SEQ ID NO: 3103 - protein, 284 aa, Neurospora crassa
EIKKAFVGGDQGWLSLKLEEVELVNHNTKRLRFRLPEDDMVSGLHVASAILTKFKPIDAEKAVLRPYTPISDESKYFRIDSLVSHDSTLTNVRATGAQGYIDLLVKKYEGGPMSTYLHDMAPGQRLDIKGPLPKYPWEANKHKHIALVAGGTGITPMYQLIRAIFNNPDDKTKVTLVFGNVSEEDVLLKHELATIENHYPQRFRAFYVLDNPPKEWAGNKGYINKDLLKTVLPEPKNEDIKIFVCGPPGMMNSISGNKKSPRDQGELTGILKELGYSPDQVYKF

SEQ ID NO: 3104 - protein, 526 aa, Neurospora crassa
  unsure (1)..(526): unsure at all Xaa locations
GQNLILNMADHGFTVCAFNRTVSKVDHFLANEAKGKSIVGAKSTEEFVSKLKSPRRIMLLVQAGKPVDDWIETLLPLLEKGDIIIDGGNSHFPDSNRRTKYLASKGLHFVGSGVSGGEEGARYGPSLMPGGDEAAWPHIKDIFQSIAAKSDGEACCEWVGDEGAGHYVKMVHNGIEYGDMQLICEVSSPNALCHTWFLRRMRTPIXLMTWYRAYDIMKRGLGLSHKEMGDVFAKWNKGVLDSFLIEITRDIMYFTDDDGTPLVEKILDKAGQKGTGKWTAVNALDLGMPVTLIAEAVLARCLSGIKEERVKASTKLEFVGRANKFEGDKEQFLEDLEQALYASKIISYAQGFMLMQEVCGCAEQKQTITEVRLLTLFXSQAAKEYNWKLNKPSIALMWRGGCIIRSVFLKDITAAYRKNPDLENLLFDDFFNKAIHKAQPGWRDVVAKAALLGLPTPAFSTALSWFDGYRTKDLPANLLQAQRDYFGAHTFLVKPEYANEKYPEGKYIHVNWTGRGGNVSASTYQA

SEQ ID NO: 3105 - protein, 410 aa, Neurospora crassa
  unsure (1)..(410): unsure at all Xaa locations
MPATTAETLSLVNRSVSVAPLVLLSVVDHYNRTQANKSKSKRVVGVLLGQNDGKNVRVSNSFRGCVVSAAEACLVAPRPGEYSANSGDAVPFEEDDKDPSVWFLDHNYVESMNDMFKKVNAREKLIGWYHSGPKLRASDLDINELFKRYTPNPLLVIVDVQPKETGVPTDAYFAVDEIKDVCLLETPSRFHLFLLSLVQVTAANYTCVXLPQDGTTTSKTFVHTPSIIEAEEAEEIGVEHLLRDIRDVAVGTLSTRITNQMRSLQGLHHRLRDIQAYLQKVLDGQLPVNHAILGNLQDVFNLLPNLSTPKSGPGATGTNADSELNHAMSIKTNDQLMAIYLSSLIRAITAFHDLIENKIQNRQQQEENDAKKKEGENGEKKEGADKKEGSPAAANGESKEKENSPKEKKK

SEQ ID NO: 3106 - protein, 317 aa, Neurospora crassa
VNDASPMRLRMEKFVKEQQKEIVRALEEADGTPFRVDEWQRKEGGGGITCVLQEGKVFEKAGVGVSVVYGTLPKPAIIKMRANHKNLAQEDDIPDSLEFFAAGLSLIVHPKNPMAPTVHLNYRYFETANPDGSSGAWWFGGGSDLTPSYLFDEDAIQFHKSLKEVCDAHDKEYYPRFKKWCDEYFYNKHRGECRGIGGIFFDDLDETVSDKENTFAFVQDALKSFAPTYISIINKRKDMPYTEEEKRWQQIRRGKYVEFNLVHDRGTAFGLNTPGARVESILMSLPLTARWEYMYEPAPKSREARLVEVLKNPKDWV

SEQ ID NO: 3107 - protein, 359 aa, Neurospora crassa
MVVKVGINGFGRIGRIVFRNAIEHDDIHIVAVNDPFIEPKYAVSWPRSHRSLVSYDNSDSDHHPSYRAYMLRYDTTHGNFKGTIEVDGADLVVNGKKVKFYTERDPAAIPWSETGADYIVESTGVFTTTEKASAHLKGGAKKVIISAPSADAPMYVMGVNNETYDGSADVISNASCTTNCLAPLAKVIHDNFTIVEGLMTTVHSYTATQKTVDGPSAKDWRGGRTAAQNIIPSSTGAAKAVGKVIPDLNGKLTGMAMRVPTANVSVVDLTARIEKGATYDEIKEVIKKASEGPLAGILAYTEDEVVSSDMNGNPASSIFDAKAGISLNKNFVKLVSWYDNEWGYSRRVLDLISYISKVD

SEQ ID NO: 3108 - protein, 254 aa, Neurospora crassa
  unsure (1)..(254): unsure at all Xaa locations
VVLIGDSGVGKSNLLSRFTRNEFNLDSKSTIGVEFATRSIQVDSKTIKAQIWDTAGQERYRAITSAYYRGAVGALLVYDISKGVTFENVNRWLKELRDHADQNIVIMLVGNKSDLRHLRAVPTEDAKKFAGTLRVTAMMTWSLGKAVSPGXLTERTAEENHLSFIETSALDATNVELAFQNILTGNVCPKPTAAALARAYRXHAIIYLEIYKIVSTKNFDNGPSGSNEGHQNLSGQSISLSQTANDPQAKSGCC

SEQ ID NO: 3109 - protein, 647 aa, Neurospora crassa
  unsure (1)..(647): unsure at all Xaa locations
MHLVSSLLVVGAAFQAVLGLPDPLHEKRHSDIIKRSVDSYIQTETPIAQKNLLCNIGASGCRASGAASGVVVASPSKSSPDLXVEIAQCVSSLMAAXLTVSIDWYTWTRDAALVTKLIVDEFTNDYNTTLQNTIQAYAAAQAKLQGVSNPSGSLSNGAGLGEPKFMVDLQQFTGAWGRPQRDGPPLRAIALIGYGKWLVSNGYADTAKSIIWPIVKNDLAYTAQYWNNTGFDLWEEVNSSSFFTIAASHRALVEGSAFAKSVGSSCSACDAIAPQILCFQQSFWSNSGYIISNFVNYRSGKDINSVLTSIHNFDPAAGCDVNTFQPCSDRALANHKVVVDSMRFWGVNSGRTAGKAAAVGRYAEDVYYNGNPWYLATLAAAEQLYDAVYVWKKQGSITVTSTSLAFFKDLVPSVSTGTYSSSSSTYTAIINAVTTYADGFVDIVAQYTPSDGSLAEQFDKDSGAPLSATHLTWSYASFLSAAARRAGIVPPSWGAASANSLPGSCSASTVAGSYATATATSFPANLTPASTTVTPPTQTGCAADHEVLVTFNEKVTTSYGQTVKVVGSIAALGNWAPASGVTLSAKQYSSSNPLWSTTIALPQGTSFKYKYVVVNSDGSVKWENDPDRSYAVGTDCASTATLDDTWR

SEQ ID NO: 3110 - protein, 313 aa, Neurospora crassa
  unsure (1)..(313): unsure at all Xaa locations
MTSDKPVVAATTTKTKKSKQQTIHYPFWFGGSASSMAATVTHPLDLGKFCPLPTXKRICHISHELPKKHHGXHQCETVKVRLQMRTGDAPKTMSGTVLHIIRHNGITGLYNGLSASLLRQITYSTTRFGIYEELKTRFTTKDHPASFPVLIAMATVSGVAGGLVGNVADVLNVRMQHDAALPPAQRRNYAHAIDGLARMTREEGFRSWFRGVWPNSARAAAMTASQLASYDVFKRILIRHTPLEDNLATHFSASFLAGVAAATVTSPIDVVKTRVMSASGKSSIGQVLGSLYAQEGVRWMFKGWVPSFLRLGP

SEQ ID NO: 3111 - protein, 446 aa, Neurospora crassa
SSSRPATIEVNGKTYTTDEWYNVPQTVLALTGRKLHLQKDHPVAITRQIIESKFSTATYKRYNEFDPVVSTIENFDSLGFPPDHVGRARSDTYYINETTLLRTHTSAHEAELFRASASDGYLISADVYRRDEVDRSHYPVFHQMEGARVWDRTKVPNGDVVAAIYADLAKLPTHDVKVEDPNPPHHPERNPLQSKHHSPEEAEAIAAHLKRSLELMVVEIFTRAKQAAARQDPNYVDEPLRVRWVEAYFPFTSPSWELEVYYQGDWLEVLGCGVSKQELFINADQPQQLGWAFGIGLERIAMLLFQIPDIRLFWSKDERFLSQFTGVQDNLDKLKRFVPFSKYPACWKDVSFWLRSTSAAGGNTAVANVHDFHENDLMEVVREVAGDVVEDVQLKDQFTHPKTGRKSMCYRINYRSLEKTLTNEEANDFHERVRQGLVEKLGVELR

SEQ ID NO: 3112 - protein, 448 aa, Neurospora crassa
  unsure (1)..(448): unsure at all Xaa locations
DRFEVLKEIGDGSFGSVVLARVRSAGATVARRGTVVSYLDAFAMTSGSVXHLCAQQIAIKTMKKTFESVGPCMELREVVFLRTLPAHPHLVPALDIFLDPFTKKLHIAMEYMEGNLYQLMKARDHKCLDNSSVKSILFQIMKGLEHIHAHHFFHRDIKPENILVSTSSHMDATNSFRRYSALMNPPPTPPTYTVKIADFGLARETHSKLPYTTYVSTRWYRAPEVLLRAGEYSAPVDIWAIGAMAVEIATLKPLFPGGNEVDQVWRVCEIMGSPGNWYNKAGARVGGGEWREGTRLAGKLGFSFPKMAPHSMDTILQTPQWPASLAHFVTWCLMWDPKNRPTSTQALAHDYFTDAVDPLRPKSSASRILGRKQSDISRGKDSATSTPTSSKPSWFRKSLIGRSESSTEVATVSTTQENAKVNIAPRPSPVQVAPEVPSPKPRPAVSKR

SEQ ID NO: 3113 - protein, 695 aa, Neurospora crassa
  unsure (1)..(695): unsure at all Xaa locations
MASNPTNTAAPTGGLTEKKHDRRSTSSESVSGTGFAEHADRTGTFNQNARLEASKKIANPLAGLSPQRLEAMGEEYAMMAGLTSEEDIRAFRLGARIAGDESNYDLIPELTEREKEVLVRETTHKWSNPPMLYWVVVSMXSPEWSKECSSMMLTTILQVCSLCAAVQGMDETVVNGAQLFYKDKFGIGTDSQRDTWLLGLVNSAPYLCCALIGCWLTEPMNRIFGRRGTIFVSCIISAVACFHQAFTNTWWHMFIARFYLGLGIGPKSATTPIFAAECSPPKLRGALVMQWQMWTAFGIMVGYIADLAFYFVPDHGIGLGLNWRLMMGSAMIPAVIVVCLAFLCPESPRWYLSKGRHQDAFGALCRLRFEKVQAARDLFYTHTLLEAEKQAMSGVKKGNRFKELFTVRRNRNAVIASSGLMFMQQFCGVNIIAYYSSAVFRDAGFSDVSALAASLGFGVVNWLFAIPAMYTIDTFGRRNLLLTTFLLMSLFLFFTGFSFWIPEDSKAHIGCIALGIYLFGMVYSPGEGPVPFTYSAEAYPLYIRPIGMSLATATTWFFNFILSITWPRMVTAFKPQGAFGWYAGWNIIGFLFTLFLVPETKGKTLEELDHVFDVPLKKLVRYGADQSLWFFHRGKNGNGMRPTAPSAEMYHGDAERMNEVVSGQQLGEGEREKRWNKEQEREGGIMGRGDAAGKV

SEQ ID NO: 3114 - protein, 718 aa, Neurospora crassa
  unsure (1)..(718): unsure at all Xaa locations
MSSVLMSKTVTPFLREHIPSIYAPIGKPGNQETARAENPNSKYCYRHHPDSKCRRAADKAKMVMIQSELDKLTSAVGLHTKHKHXLLLVSKVWWTDWYLAXNNRDQQAVTHVWSLFSAAPARHRDLMLQGILSQLCFPQLSFVSREVNEALKIDFISALPVELAQKVLCYLDTVSLTKAAQVSQRWRTLADSDAVWVRMCEQHVNRKCTKCGWGLPLLERKKLRNYTRQRQLAKGGPQGRVTELADSHDSQDRSVNQHGKRPAAEAEEEDPIKKRQCMAAAEASKAVTQPKTRSWKAVYRDRWQVSYNWKNSRYKLSVLKGHENGVTCLQLDDNILATGSYDTTIKICMWSCFFKHWCSLXTNTLLTGNIETEECIRTLVGHTAGIRALQFDDSKLISGSLDRMLRNPPSMIAWQCCXLIRRHIKVWNWHTGECLSTFAAHTDSVISVHFDGHLLASGSSDKTVKIFDFNSKETYCLKGHSDWVNSTHVDIKSRTVFSASDDTTIKLWDLDTRQVIRTYEGHVGHVQQVLILPPEYEPDEEVLNGASQDNQDAMSVSSGGSGSPSMSHAQIERAGSPGSHSSSHNLLPSSLPSGDEDVRHLYGSAFVADESRPLPPRYFMTGGLDSTMRLWDSATGRCLRTLFGHLEGVWSLAGDTIRVISGANDGMVKTWEPRSGKCDATYTGHCGPVTCVGLSDSLMASGSEDGTIRLHSFKPCRQ

SEQ ID NO: 3115 - protein, 890 aa, Neurospora crassa
  unsure (1)..(890): unsure at all Xaa locations
NSLAKCPGYKATNVKTNANGLTAELKLAGKACNTYGTDLDNLVLEVTYETGELTKTITEXRTKQVGGANKDNSCVRQPPHVKIQDATNDVYQIPESIFPRPQAAQGANSKKSALKFTYKTSPFSFAVTRAKTGEVLFDTSAASLVFESQYLRLRTKLPNNPNLYGLGEHSDSFRLNTTNYIRTFWSQDAYSTPNGANLYGNHPVYYEHRKSGSHGVLFLNSNGMDVVIDKDSRSGQYLEYNSLGGVVDFYFVAGPSPIEVAKQYAEITKLPAMMPYWGFGLHQCRYGYQDAFEVAEVVYNYSKASIPLETMWTDIDYMDRRRVFTLDPQRFPLSTMRQLIGHLHENDQKYIVMVDPAVSAAEGPENPALTKGIEENVFLKRNDSSIYKGVVWPGVSVFPDWFSANISRYWDSQFTEFFSASSGINIDGLWIDMNEPSNFPCFFPCNDPEKSAIGYPPEPPAVRTPPRELPGWPCVFQPEGTECKEKKDLTIEAPVKSDILIAKREETVEASITAGKQLGLPGRDLLFPKYSIHNKAAYMDSWNADKGGLSNKTVNTDTIHQNGLAEYDVHNLYGTMMSIQSRGAMLARRPGLRPFIITRSTFAGAGHSVGKWLGDNIADWQHYRESIYGMMAFASIYQIPMVGADVCGFGGNTTESLCARWAMLGAFSPFYRNHNEYLPSISQEFYRWEIVAEAARKAIDIRYRLLDYIYTAQYKQSVDGTPMINPMFYLYPNDANTFGLQHQYFYGPGLLVAPVTEENSTSVDVYLPNDIFYDWYTLDVVHGKGRTVTVKDQSLTDIPLYLRGGVIVPLRAKSAMTTTELRKQDFELIIAVGKDLTAEGELYLDDGVSLEQQGVTNIKFKYALGVLTVNGDFGFKTDVKITNITVVGAL

SEQ ID NO: 3116 - protein, 380 aa, Neurospora crassa
  unsure (1)..(380): unsure at all Xaa locations
LPEPFASIPREPLTFGPSPIQPLPRISQALGGKVNVFAKREDLNSGLAFGGNKTRKLEYIPPPARQSVVLSVHQQLDXQVRPLGPQILVPDAISRGCDTLVSIGGIQSNHTRQVAAAASKLGLHAALVQEHWVPDWTDPGYDKVGNIQLSRLMGADVRLEPLAGFGIEHKQTLAKLKDDLEKEGRKPYYIPAGASDHPLGGLGFARWAFEVVAQEEELGIHFDTVVVCAVTGSTMAGMVAGFKLVEMLERHSERLGKVNKRRVIGIDASAKVEQTRAQVLRIAKQTAAKIGLKEEDITESDIVLDDRYHAGVYGVPDEKTIEAIKFGARTEAFITDPVYEGKSLAGMMDMIKNGEIEAGSNVLYAHLGGQLALNAYSALG

SEQ ID NO: 3117 - protein, 489 aa, Neurospora crassa
  unsure (1)..(489): unsure at all Xaa locations
MLRSNVSRIDPKRRNVLDHRKKQFAEAAYKDTDYPHRLNFYSTPPTADITIEQFEQWAIDRLRSMYHTTLISQXSTILGVPLNANQPLSYHNPVLAELEACSFRNKTPAETASHMKPLLDKYLPLDTNSSSSSQLFAQRQKDHYSHFILRLAFASTEDLRRRFTRVETMLFRMRLNADDGRERAAFINSLNLDWETVSDEEKRELAAELAATASFGGYKKGQQQQQQYEEDQQTWCKVSWLRVPELVEQRRVFLRQGYAYVPAREQQAMVVSEFSSRLERQLELTARALPRLDEDDRLTPILAHLSKNFITPDASYVGTSSAISSADISARNIDTLVNNHHFPACMSHLHRTLRRDAHLKHYGRLQYTLFLKGIGLNLEECLLFWRQSFNKITDDTFNKEYRYNVRHTYGDVGGDSNRRGGGYSPYSCQKILTEHPPGPGEAHGCPYRHFNMENLQTLLQQGMGVTDRGVLNGVKEDKEKQKFHMACNR

SEQ ID NO: 3118 - protein, 388 aa, Neurospora crassa
  unsure (1)..(388): unsure at all Xaa locations
PSIKRRPSRKSVTFTDEKLVVNPDGSVTMDASPADEIKETAQSHSARTPPLHAALGAFTDAPQATEPQDAAAAAAPAADDGLDLSLMKKKKKKVKKEDDADAAADEAAPAEGDGAIDLTMKKKKKKKVVKEDDEFAKKLEALNIEGKEGEEAAPQEDEQEGDMDQGTGIWAHDETKPISYNALLSRFFALLSQKNPDHASTGTRSYKIPPPQCLREGNKKTIFANLPEICKRMKRADEHVTSYLFAELGTSGSVDGSRRLVIKGRFQQKQIENVLRTYIIGMSIXSCRRLDVLRPSRQCHHQHPTFCSDYKCXHAQQEYVTCKTCRSPNTELSKGRTVFSKLASVYDDHSPKMLTCHSFITCNSCGSRRSVQAIKTGFSAQVGKRKKM

SEQ ID NO: 3119 - protein, 452 aa, Neurospora crassa
QAPQQFKQKFNLGEHTKDPVYIDSERRFQELETETKRLHDESKKYFEAINGMLQHQIEFSKAMTEIYKPISGRMSDPDSLVPHGNYEGIAACEEYEAVVKDLQETLAPELEMIEARVIRPANELLDVIKVIRKTAVKREHKKLDYDRHRATLKKLQDKKDRSAKDEKAMWKAENEVEQATQEYNYFNDLLKDELPKLFALERQFIQPLFQSFYYMQLNIFYTLHEKMQHCDIGYFDLTLDIEEAFYAKRGDVQERAEALSIVKFKTTGMKRPPKYQRPGALEGNKPAGLLTAGSSTTTSTGPPEAAPSVTAPRPWEQQQQAPAVTAPRPWETQAETVEAHAPPPYSVKPSTLHATPRLATPLQSASPKPSSLSMAAAAKAKPPPPKPKPKALMAAAPKVETVTALYDYSAQAEGDLSFRAGDVIEIVTRTANENEWWIGKLHGKQGQFPGTY

SEQ ID NO: 3120 - protein, 954 aa, Neurospora crassa
  unsure (1)..(954): unsure at all Xaa locations
AKPVVPEIYPQVMAIPIAKRPLFPGFYKAITIKDPNVAAAITEMIKRGQPYVGAFLFKDENADDDVIRNRDDVYDVGVFAQITSAFPMNNQNGEGASLTAILYPHRRIKLSELIPPGSPEAASIDGAKEGAAPEPVPEPIPKVTDESEQKGDVVASFEESAVTPRPEPSQKPYEPTSFLKKYPVSLVNVENLTEEPYDPKSQVIRAVTNEIVNVFKEVASMNSLFRDQISTFSMSQSTGNVMAEPAKLADFAAAVSAGEPAELQEVLSSLNVEERMHKALLVLKKEHVNAQLQSKITKDVEQKITKRQREYWLMEQMKGIRRELGIESDGKDKLVEKFKELADKLAMPEAVRKVFDDELNKLAHLEPAASEFNVTRNYLDWLTNIPWGQSSAENFDILNAVKVLDEDHYGLKDVKDRILEFIAVGKLRGTVEGKILCFVGPPGVGKTSIGKSIARALGRQYYRFSVGGLTDVAEIKGHRRTYVGALPGRVIQALKKCKTENPLILIDEIDKIGRGYQGDPSSALLELLDPEQNGSFLDHYLDVPVDLSKVLFVCTANLTDTIPRPLLDRMEVIRLSGYVADEKMAIAEKYLAPQAQEMAGLKGVDVQLTKDAIEELNKSYCRESGVRNLKKKIEQVYRKSALKIVQDLGEQALPESEALTEEGKAAQEETEKKKSEEAASGETSSPKAATEASEKETTEKPRVAMKIPEGVHVVINKDNLKDYVGPPIFTSDRLYDVTPPGVTMGLAWTSMGGAAMYVESILQSALTSKSAPSLEITGNLKTVMKESSAIAYSYAKAVMAKDFPKNRFFDKAKIHVHVPEGAVQKDGPSAGITMTTSLLSLALDTPIDPQIAMTGELTLTGKVLRIGGLREKTVAARRAGCKMVVFPEDNMSDWLELPEVDYTSXPINITLIQTSYXRFLFHQNVKEGIEGRPVRWYSEVFDLIFPKLDREKAN

SEQ ID NO: 3121 - protein, 413 aa, Neurospora crassa
  unsure (1)..(413): unsure at all Xaa locations
DRYDHKSIIIHQILTXSIDGHNDLPILLRAAFKNHINDKNFTTGWEDGTLPGHVDLARLRAGMNGGAFWSLFWPCPAQRLRLFXXKLSARWVQPFTQPYCIARQEKKSLTLSLSNHTAVQATLQQIDLVDRLKAAYPKDLGPAVSSKAAYKAWKHHNQLISPMGIEGLHQIGNSAATLRRYHALGVRYATLVHNCGNKYADAALQENPFRKAPSHWGGVSPAGEALVNEMNRIGMIVDLAHTSVDTMKDVLGGSGKDWNGSRAPVIFSHSSAYALCPHPRNVPDDVLRLVKERNSLVMVNFSPDFISCVAAPDRDDGLPDFYPANATLEHVADHIIHIGELIGYDHVGLGSDFDGIPVVPKGLEDVSRYPDLVAELLRRGVSDEDVSKVVGGNILRVWRDVELVAATMQAAGE

SEQ ID NO: 3122 - protein, 677 aa, Neurospora crassa
KITDKVAALPPDSNYFSLEFFPPKTAMGFANLRDRLERMARGLRPLFVNVTWGAGGSTAQKSLELAEICQRELGLTTCLHLTCTNMSRRLLDKTLEDAKVLGIRNILALRGDPPRAAEYHDENDPEPTDDEEFSWAADLVRYIKKTHGDYFCIGVAAYPEGHAEEAHPREQSLEHDLPYLVEKVQAGADFIMTQLFFDIDAYEHFENTLRDHPSGAFKDVIIIPGLMPIQSYQMIKRTTKLSHAKIPPALMARLDAVKGDDEKVKMEGVAIVSEMIERIKEIKSRTPGPRGFHFYTLNLEKAVAFIAERTNLIPPGTPDEDESAILPDIPQLRINGSSVPTRSIQDLSTRKGSIGSDPRDRVIVANQRPSHPDYEASPSEAGLPAEPVNTRANTLAISEGEGVLGREATWDDFPNGRWGDARSPAYGQIDGYGVSLHVTVPQALQLWGSPKTTEDINKIFIRHLKGELSAIPWSEEGFNDETEAIRDNLIELNSRGWWSLASQPAVNGLRSDDGTFGWGPENGFVFQKAFVEFFIPSADWRVLEAKLKQPDMKDTVCFFATNAAGDFVSTDTINFRARMAAEAEGTAEADHRPHEPSTNAVTWGVFPGKEILTPTIIEEVSFRAWSEEAFGIWSEWAKIYGKGSDTQKLLEDLKEDLWLVNVIHHDYLEKDGLWKLL

SEQ ID NO: 3123 - protein, 189 aa, Neurospora crassa
  unsure (1)..(189): unsure at all Xaa locations
HQLRNSWVFWYRPPISKANGFIEYEKTLHPIATCETAEQFFAVYQHLKRPSGLPLVSDYHLFKKGIRPIWEDEENKNGGKWIVRLRKGVADRYWEDILLALIGDQFGDASDDVCGIVLSVRNGEDILSIWARANGQRVLKIRVCFHSLARIAPLEISSXLWLNSETMRRTLSFPSETKVEWKSHDSSIQ

SEQ ID NO: 3124 - protein, 434 aa, Neurospora crassa
DLDTGDNSDKDPNPIATESDPDVLHPEDTTTISPAPDGGPRAWLVAAAAAFTFFCTLGYTNAFGVFEQYYLTSPFSPLHSSSAHSALSSSKIAWIGSLQTFLTFFTGFFAGPLFDRYGAVATVRPGALIFVFAIMMTSLCKQYWQLMLAQGVLGGVAMGLLMFPAMAAVAQWFDKKRAAALGLAVSGSSVGGVVVPIALGRMLNGGSAGGGHLGFGWSVRIIGFMMLPLLVFASLAIKPRLPPRTTDFIVVKALKQKDFVMLVFAIFFLFLGMLTPLFFIPTYAVYRGVDATLASYLLAIVNAASTFGRIIPGVLADRVGKLNMLAVGGVASGISILCFNKAVSTAGLIVYSIFYGFSSGMIISGASAALTVCPRDPRDLGSYIGMGMALGAIAVLIGPPINGKLIDVYGGYLELSIFSGVMCLVGGLVVIATK

SEQ ID NO: 3125 - protein, 277 aa, Neurospora crassa
GLGIALVAATKARVPVTLVDASETSLDKGLAFADKLLSKDVAKQRITQDEADAARALLQPTTILEDLDSVDFVIEAVPEIPKLKFDIFSKLAEICPKHAILATNTSSISITRIAASTTKDPNDTSNSSRVVSTHFMNPVPVQKGVEIISGLQTSQETLDTAVEFCKKLGKIPSISKDSPGFLANRILMPYINEAIICLETGVGDRDSIDAIMKNGTNVPMGPLQLADFIGLDTCLAIMKVLYEETSDSKYRPSVHLRNMVDAGWLGKKSGKGFYDYQ

SEQ ID NO: 3126 - protein, 713 aa, Neurospora crassa
  unsure (1)..(713): unsure at all Xaa locations
FEHVRFRQESADVEEQNKQSEGKEAGQQQSDGQQGKQSGEQQGQQGPKRPGAQGQGGQEPPQGFDGGLMNYVIGTAVLFWTYKVLFPGNDSREITWQELRKNFLEKGLVEKLTVVKDRVIVDLNKEAVRQMYPDSPAASPGFHYYFTIGSIDAFERRLDEAQAELGIPPAERIPVSYANEFSWGNIILAFGPTLVLVGLLAYISRRGPGGAGGPGGMFGIGKSKAKMFNHDTAVKVKFSDVAGMDEAKVEIMEFVQFLKEPERFQKLGAKIPRGAILSGPPGTGKTLLAKATAGESQVPFFSVSGSEFVEMFVGVGASRVRDLFATARKNAPCIIFIDEIDAIGRSRSDGGFRGGGNDEREATLNQILTEMDGFNTTEQVVVLAGTNRPDILDKALMRPGRFDRHINIDRPTMKGRQDIFKVHLAKIVTKEDIEFLTGRLAALTPGFAGADIANVVNEAALVGKFFLDLDCRIPAXCHVLTTCIAARANAETVEMIHFEQAIERVIGGLERKSLVLSPEEKRTVAYHEAGHAICGWFFQWADPLLKVSIIPRGQGALGYAQYLPSGDAYLMNTKQLMDRMAMTLGGRVSEELHFPVVTTGASDDFKKVTRMARAMVTEWGMSEKVGMLHFDDSAERFQKPFAESTAQAIDSEVRRIVDEAYKQCKDLLTAKKKEVGMVAEELLRKEVLSRDDLVRLLGPRQWPDKEEFSKYFH

SEQ ID NO: 3127 - protein, 1970 aa, Neurospora crassa
  unsure (1)..(1970): unsure at all Xaa locations
LTCFLHFLLLQELAKICEDIPERTAAATKLETLFLVSLCSAEIEVCQIVTSCIGSFLEECRIIDAAACSASKPSLALLRNADIFSEISSRTFRFTGLVAFQKRNRGLLRRLQYPSAGILNAWETVFERWLHLSKDVSLTSAESMGERVVAEWRNYSGFLASLGGICTAEQAATLEEPAVSGLRWIDRLSSDNHEEPFLNRYLRLSIQLLACTNVRIRETMREILATEVSPALYQHLFRALESELDVLFTGALEAPSRGQDNEIMFAEQAASLLRSLVERLDTPTELGAASSLHLNSLTHSFAKFLDGVPDSPNSLRVKIKICQLCEAIVKRKEHLNLRDDVRIRNQLLAYVYSWVTRPHSPRIDAGAFGQSRQDEMIRVQKDLDRACLKALAELTYRLPLQLNDSTNDATTSERKMKLFESYFSRFLEVLDPQYEHMFRSEHTGSSSSRDGEPSMSDLSITIMSNLLSANIDVGLKSALNVGYHEHAEIRTAFVRVLYNILVQGAEFNNLSSTAVNEKYDELLSLLTTDTTLAMAMGAVCPSHEVDELTIALLSIYESRGQSFVLLEALIKQEIEETENESELLRRSCVATKMLSIYAKWKGAGYLKATLQKVLDRLMQTSKDLNLELDPTRVSSPEELQKNALQLEIVANVFIDDICASSARIPPSFRKICSIVSAACLRVAAKYXELIRRVXQIAAAVMPRFSEAKYTAVGAFIFLRFFCPAIVAPEVEGLVATAPSKEMRRGLLLIAKVIQNLANNVLFGAKEPFMFPLNDFLTKNIYRVTTFLREISVEPETMERPNSDESFDFGSCVSLHRILYDHWDQVRQRLASIERRDLVRSPCEPTRGKPNLLEPLRSLIMNLGPPPLAVTWNRPHISANLPPVYSRFQDFMLRNAFRGVESSSTPPPAVYDAGESRDGIQMICIMLRYIDTESADVDAYLYYYLKIASRLWDRPFGIFIDATFYNVQSEPAESLLRKIELLTPTELSKQLQRVYIFNMNSACKKGFRKVFKTWIRNENSIYSPANIEYHLLGSYREYDAHFDHKKFSLNKDTREFMDETLDGFNITRLSKTKGKIDVSLSISKSFVRVSTKKRQEIYPASRISVVINDAFRLSEVEEAPTSIQTEDDSAFGLRADNGKIVMYFTSPEKAKILSLLRMRKAQYVKDPKQMQPHERFIKPQDVPGTLLNLALTNLASPDPVLRLSSYNLLGALCKSFKFKAASRLVSTKDIAVPSDASQFIIQISQKLAESEPQLTGDFLNEFFASWPSFSDEQKPLCLAYMAPWVPGLRPSLLANEVDGEKGMEKIAAVLRKLIDIALSDPAVLFQLQQSVWPAIQQDEKLLESFLEEVIKAALNRGFGIAETDTLTSIAGGIGTVTLRGRIISRLRKALNRSSLRPTKYLPDNSVWNEICVLLQFCLALSFDSGEQAEMFMPEIFHIVTMLANTGNPDVRQVVHRLLINTIHAACTSFALDEVRLNKLKVTLDTLSDPRSDLFTNNVTFTRDGASISTNQDGGATLTATENLATLLFETCSIAAPTVDLANKWRSRWMGLVASTAFQNNPAIQPRAFTVMGCLAREEVDDDLLYQVLVALRNSIGRFGDDSNSDMLVAIVTSLSKMMSKLPSASRYGLQLFWLAMSLLRLVPPNLFNCTAMFLESVLTNISTTGDLKGEKMVHYLLQGRAQLEEAALLLDEAYGIHFTAENFHFAACACLVRGLTDTVTKSTALRVLSTFLEMTTFTVTTVNAAVANATPDGILSPTVQPLKTMRELCASPYMALILARTLNLDELRDSLWSAGINVNPNSNGLPPFSSVSASVAAGGLGSGLGAGGDPLVGDVASDAVPSPAAAAADTSAIDIRRGANDLDYIKDKDLLLNTAIELVDFQYLEDAVQNRTLMWLNEIAVGRPSVIMHLCGPIISILDDIVLHCQNPSTLESAHELLQTLTNNPKFSGAMEQAAMLNEILDEMGFGGLWR

SEQ ID NO: 3128 - protein, 298 aa, Neurospora crassa
MSSSLPWDYIAKLVCIGDSGCGKSSLTIRLCEGRFVTHHDVTIGVEFGSRIVPVGPPHSNLDSQQSQQQQPASSTTTFTSDSTTTTIPNTTTSSSGGLPPPPIAAKPSSSSSSASDPPVPQKHMKLSLWDTAGQETYKSVTRSYFRGASGALLVFDLSRKQTFEHVTDWLNDLRAIAEPDIVVILVGNKADLTEANDENEGENNKREVTRKEAEEWARRNGVLEYVETSAKSGENVEKAFMRVAERIYQNIQAGKYDLNDRRSGVKGPSAGLGGGGAGGGGTHVKLTGDKAGGYGGCC

SEQ ID NO: 3129 - protein, 525 aa, Neurospora crassa
  unsure (1)..(525): unsure at all Xaa locations
LQAVSGSLPDRSLTDIHASQEPDPATKSRAVPIYATSVSRQYLAYEAYELKGGKCXPVKSYVFNDSAHGARLFGLKEFGNIYSRIMSEPKQENLKXSRNKCSNAGTSPTVDVFEKRIAALEGGLAAIATASGQAAQFMAISGVACAGDNIVSTSNLYGGTYNQLKVMLPRYGIQTKFVTGDKPEDLAAAIDDKTKAVYLESIGNPRYNIPGFEAITKLAHEKGVPVIVSLTVVYSVQAHRRTFANLRSSXVDNTFGAGGYFVQPLQYGADIVVHSATKWIGGHGTTVAGVIVDSGRFDWGKHADRFPQMVEPSEGYHGLKFWETFGPMAYITRVRVEILRDLGACLNPFAAQQLLLGLETLSLRCERHTQNALALARYLEKSPYVSWVSYPGLESHGSHENAKKYLKRGFGGVLSFGVKGGASAGSQVVDGFKLISNLANVGDCKTLAIHPWSTTHEQLTDEEKISSGVTEDLIRISVGIEHIDDIIADFDQSFANAAATSAKEEGEKGLVVGQGKVEEAAPTVI

SEQ ID NO: 3130 - protein, 756 aa, Neurospora crassa
  unsure (1)..(756): unsure at all Xaa locations
MAPSQDTAAYIKSIAEPPPPGTPYALPVPGTQRPNRTAVYRHWKFVNSPLLETLDPAHQTVHDLFEASVEKVPNKKCLGWRPWNAATKTYEPKYVWITYKEVAERRKNFGAGIVAIHKSIGFTEEKYGVGLWAQNRPEWQITGSTDLDTMRRARAXCTRYANSITELALLSQSLFPISLYETLGPETTEYIINHSGLTAIACSVPHIPTLLKVAPRCPTLKLIISLDPLDAGEPAGHTKRELLNAAASNVGIKIFSIDEVEALGVKSGLSMKPPKREDVLTINYTSGTTGDPKGVLITHAQGVAGITAARSMQSILSSDIHISYLPLAHIYGRMADQTALAEGASIGYFHGDIAGLVEDMKILRPTGLMSVPRLYNRISGAVQAATIDADGFKGTLSRYVVEAKKQSMALPTGKATNKHFLYDRIWTKKVLKGVGLDRARTMVSGSAQLDPEVHQFLRAAFGNDFIQGFGMTESYATGTAQVPGDFSTGNIGPPCPCVELCIESVPDYDYTVDDKPNPRGELLMRGPIMFKEYYKNPEETAKVVEADGWFHTGDIVEVDSMGRFKIIDRKKNVLKLSQGEYISPERIENVYMASTNLIAMAFVHGDPKESSLVAIFGIDPVTFAPYASRILKKNIAPENLEELKQSANDPRVKTAFLKLLDGIGKNHKFNSYEKVKNVYLDIEPFTIENELLTPTXVLILVILLQQQQHAXRSRAGYXHPQTQSKLKRPQAARKFRAEIDRMYEEINAAAQTKAKL

SEQ ID NO: 3131 - protein, 421 aa, Neurospora crassa
  unsure (1)..(421): unsure at all Xaa locations
MMSRATTRTIKSAVGQIQARSVSNSAASSTPRHLLSISQLSPAEFSKLVLNASAYKQATKAAFAAGPGQVPRTLDGKLKGRTVAMMFSKRSTRTRVSTEAAVALMGGHPMFLGKDDIQLGVSVNYRLGSIVPPLAXRRHIHAQRPAPRSLTTLSTGNESLYDTSKVISSMTSCMVARVGPHSDVADLARDSSVPVINALSDDFHPLQAIADFQTIHEAFATKPAHEASLGLEGMKVAWVGDSNNVLFDMATACVMLGVDIAVASPAGYGIPDRMKQIILSVAEGVAKPGKLIETTVPEEAVKDADILVTDTWVSMGQEAETQRRLKAFAGFQITNELAKRGGAKPGWKFMHCLPRHPEEVDDEVFYGPQSLVFPEAENRLWAAVCKXSDLILPRGXSLSXSRLCFYLAALEAFVVNNGRIL

SEQ ID NO: 3132 - protein, 570 aa, Neurospora crassa
  unsure (1)..(570): unsure at all Xaa locations
MAPVMRLGSAALRSSIHLTSRQTAFTAARCYSSKTQVRQSHEPGTHXHHPLTALLWPYXTLKERFAELLPENIEKIKALRKXALPLPRHKPSIASRLVYRVADLSCQPQEHGSKVVDKVTLDQVYGGARGIKCLVWEGSVLDAEEGIRFRGKTIPECQELLPKAPGGKEPLPEGTFTRLRALPGPCTVRYRVXAVLCIDLIRRSFWLLLTGEVPSEQQVRDLSAEWAARSDVPKFIEELIDRCPSDLHPMAQLSLAVTALEHTSSFARAYAKGINKKEYWGYTFEDSMDLIAKLPTIAARIYQNVFKGGKVAAVQKDKDYSFNFANQLGFGDNKDFVELLRLYLTIHTDHEGGNVSAHTTHLVGSALSSPFLSVAAGLNGLAGPLHGLANQEVLNWLTEMKKVIGDDLSDEAITKYLWDTLNAGRVVPGYGHAVLRKTDPRYSAQRKFAQEHLPEDPMFQLVSQVYKIAPKVLTEHGKTKNPYPNVDAHSGVLLQHYGLTEANYYTVLFGVSRAIGVLPQLIIDRAVGAPIERYVLLLYDIVSIQGYGXHFDSRPKSYSTDKWIEICKKL

SEQ ID NO: 3133 - protein, 313 aa, Neurospora crassa
  unsure (1)..(313): unsure at all Xaa locations
MAILLPRNDVLNVHPAPQGQHLSVHGSDWLWAATALFAFNTVSLIXXDLPDHVPGLTYFSKILVLFALKFKASRGERLWHYIWIVTNLVATFAYFAMAANLAWDVVSQRNQVRQHGPTRQIFWAKYVLWVVSFPAAILAMGILSGVSWATIVFNIFLSWIWVIGYLVAAYVPSNYKWGLFAFAALAHIFLAFETLFRARSSANRVGINRDYTMLSGWTNLLWLLYPIAWGVSDGGNVIGVTKSMIFFGILDVLFITTLSYAFVVLSRRWDYSRLNIAFTQYGRVPIAGTYPEKHATTDPHSGVTDPHTAAPAV

SEQ ID NO: 3134 - protein, 1265 aa, Neurospora crassa
SLPRNQVPEWAAFYINYKGLKKLIKAAQGAAKNGEPVDLAEFFFALDRNLEDVDSFYNKKYAEAYRRLKVLQDRYGKTPEIVSNLDDDEVEELMGALLELRSQFRKLQWFGEINRRGFVKITKKLDKKVPNTKSTQHNYISTKVDLLPFAKDTAISLLLTEINKWLSKLGDAQNIDETKSERSTLSLGRASAKAMLNIPSALFDKLDQAIRKDEVAALEKGLKEGNLASSEGSSPLQQPLLLNLLQRSISSRSRDCIVFLLKQVNSLDEPDDINERNCIHRLVIHIGRTKTASLLSSEPEAESYPFPRTGVHYAQPYLTPATSPLSAPRGTTLKESKLLGHDDEAIQLLKYLLENLRPDQRVALVAKDGFGRIPLHYAAQFGFVVVCQIIMRKMQDWGQFNVENGIDAPEWQDKDGNAPLHLSVIGGHPLTTKALLQGENWKGVNDHQAEMRRAISKSSAVLALATKANSKDIVELLVNAGVDINWQDNSGETALHVAARFGHDECARVLLKGTEQQKANLELAEKNFAWTPLHIAAVDGHLGVAQLLVDAGADVDKLDSSGWTAKEHAALRGHLDIARLLSAHSQAPEDEGGSSSDGDDEKSSTTTPYPETDNNTLSASLGDRRSNATSRPAEPVKTFGHRYLKDESLVLVSLGSMDMRKGIEAIKLDKVPLAEAHTTQLDTALSVVVSAQGAKGDPTMIDLPVHENISTEPILFTTRDAAKVRLFFDIVPTYSGNEKNKVGRGVALLSSVRPTVGTKRMNLQGDISVPIMGSNFEVIGTVNFNFLVITPFSHPKMEVTSQQTYWKKLDSTMVIGHRGLGKNVVANKSLQLGENTIPSFIAAANLGAQYVEFDVQLTKDHVPVIYHDFLVSETGFDAPVHTLTLEQFLHINPDSSRSGTHHHHHHHHHGHHGHHGQPGQQAQHRQLKKFRSNSPGPRQRSMSMDFPGDGKDLMEERMKHTRDFKEKGYKGNSRGNFIQAPFATLEDLFRKLPESVGFNVEMKYPMLHETEEHEMDTYAVELNSFCDTVLQKVYDMAGQRHIIFSSFNPDICLCLSFKQPNIPILFLTDAGTCPVGDVRASSLQEAIRFASRWNLLGIVSNAEPLINSPRLVRVVKQSGLVCVSYGSQNNDPSLVQVGFFMMHSNSFCHSNQANQLSSLLIKQVKEGIDAVIVDSVLAIRKGLTRDQGNVNGSGGSNAKELQQRVREVEEAINKEERIEEEGSSAEGSSYGDSNGNGNGTEIRMTTNAGGDPKTEIKETMRALRT

SEQ ID NO: 3135 - protein, 375 aa, Neurospora crassa
MPQFEIPEQQWAQVVEKKGGRKSNTPLSLLVAPVTRILTFLFSVVFKQIPVQKPGPDEVLINVKYSGVCHTDLHAMKGDWPLATKMPLVGGHEGAGVVVAKGELVTEVEVGDHAGIKWLNGSCLACSFCMQADEPLCPHALLSGYTVDGSFQQYAIAKAAHVAKIPKGCDLETTAPVLCAGITVYKGLKESGVRPGQCVAIVGAGGGLGSMAIQYANAMGLHAIAIDGGEEKGKNCRELGAQAYVDFTTTKDLVADVKAATPDGLGPHAVILLAVSEKPFHQAVDYVRSRGTIICIGLPAGAKFQAPVFDTVIRMITIKGSYVGNRQDTQEALDFFARGLIKVPIKTVGLSKLQEVYDLMEEGKIVGRYVVDTSK

SEQ ID NO: 3136 - protein, 351 aa, Neurospora crassa
MNSATSNFEVDATGVSPKQIHNLIPSLKLSDGNEIPMVRPSYPFIPSSFPLLQNHILTKSLTLKNSLGYGLGTANYKSGDSADTISEPIVNATLTALNAGYAHLDGAEVYGNEVELGRAIAQSKLPRSSLYITTKTIVRAGDTVTQSFNRSLEKLGLDYVDLYLLHSPFFAKNPEQLQAAWREMEKIKDSGMAKSIGVSNFLISHLQTLFDIPGGLQYPPVVNQIEYHPYLQHVVEGEDLVAFCREKHIAIAAYSPLTAITKARPGPVDPIYTQLAKKYGVSEAEIAFRWCLDQGIVTLTTSSNEERLKGYLKKLPSFKLTPKEVEDIASAGKEKHYRVWWTEEFAGDDRH

SEQ ID NO: 3137 - protein, 900 aa, Neurospora crassa
  unsure (1)..(900): unsure at all Xaa locations
MLRSTLSRSAWRTGRHQAARNASRAFSATAQRPAEVELTIGMSPSRPPPHDXHTPCMIPVPVGADTDSCLPHLTDGKKVSIEGEHSQCAASQVLATDNGDEGGPKIRTWSSLILEETTAGSALIQACEKAGVTIPRYAGKRTLNLGTARRGSCXLFCRYCYHEYVTCGSPRSPKLIAAPVTPAGVSPTKIDXQMLXLSRKLMIAGNCRMCLVEVEKVPKPVASCAWPVQPGMVVKTNSPLTHKAREGVMEFLLANHPLDCPICDQGGECDLQDQSMRYGGDRGRFHEVGGKRAVEDKNMGPLIKTSMNRCIQCTRCVRFANDIAGAPELGSTGRGNDLQIGTYLEKNLDSELSGNVIDLCPVGALTSKPYAFRARPWELKKTESIDVLDGLGSNIRVDTRGLEVMRILPRLNDEVNEEWINDKTRFACDGLKTQRLTIPLVRREGKFEPASWDQALTEIAHAYQTLNPQGNEFKAIAGQLTEVESLVAMKDLANRLGSENLALDMPSGHKPLAHGVDVRSNYIFNSSIVGIESADVILLVGTNPRHEAAVLNARIRKQWLRSDLEIGVVGQTWDSTFEFEHLGTDHAALQKALEGDFGKKLQSAKNPMIIVGSGVTDHGDANAFYETVGKFVDSNASNFLTEEWNGYNVLQRAASRVGAFEVGFTVPSAEIAQTKPKFVWLLGADEFNEADIPKDAFIVYQGHHGDRGAQIADIVLPGAAYTEKAGTYVNTEGRVQMTRAATGLPGAARTDWKILRAVSEYLGVRLPYDDVAQLRDRMVEISPALSSYDIIEPPSLQQLSKVQLVEQNQGATATNEPLKKVIENFYFTDAISRRFVLFCYADDISTSIRSXRSIHXPSTTHSSPTMARCSAAKKTGDPRTNFMAPGMEEDRPMGQIAYGA

SEQ ID NO: 3138 - protein, 1155 aa, Neurospora crassa
MAALDDGFEALLEPFYNGKKLTDPISTTQDKFHLVPAFLKVKGLVKQHIDSYNYFVNEEIKDIVRANRVVRSDQDPNFWLEFRDIRVGMPTRTEDGEQVQSRNPVTPMECRLRDLTYAAPVEVDIAYTRDKNVIVRKNIPLCRIPVMLKSAKCYLNGATNAQMEVFNECPLDPGGYFVIGGTEKVILIQEQLSKNRIIVEADEKTGGVMASVTSSTHERKSKTYVVLKKDRIVLQHNTLSEPIPIVIVLKAFGGLSDNDIIELVCGGDARYQDDFLINFDEAGRAGVYTQQQALEYVGARVKMGGNRPKFGAAPRRNHAEEGLDALANLVIAHVTVEGLDFYPKAVYIAMMVRRVLMAAQNPKLVDDRDFVGNKRLELAGQLISLLFEDLFKKFISDVKYNIDNFFKKPNRTSTYDPHGAIMANGHYISHGLNRAIQSGNWTVKRFNMNRAGITHVLSRLSYIAALGMMTRISSQFEKTRKVSGPRALQPSQWGMLCTSDTPEGEACGLVKNLALMTHITTNVPEEPVKKMIFAADESVGPIREYTGTEMHSKGSYIIHLNGTPFAVTREPKRFAARFRTLRRRGWVSPFVSIHINEHFSAVHIATDEGRICRPYIIVKNGKSMLKAEHLKMLQLGQATFDTFLTSGVVEYLDVNEENDTLVALQEDQITNSTTHMEIEPFTILGAVAGLIPFPHHNQSPRNTYQCAMGKQAIGAIAYNQFNRIDTLLYTLVYPQRPMVITKTIQLIHYDKLPAGQNATVVVMSYSGYDIEDALVLNKASLDRGFGRCQVFRKYTAELQGYTNGRRDRVGGIMKDEDDKPIVKHAILDADGLAQVGSKVESGQTMIKKETPLDQISTGIAGDRGSDDYRDASTNYRISDPAIIDKVMISVNERENKLIKVQTRQTRRPELGDKFSSRHGQKGVVGIIVNEEDMPFSDKGLRPDIIMNPHGFPSRMTVGKLFECLTGKASVIAGEKDYGFGDAFRSHPVESMGQALIDHGFSWEGKDYFTSGITGEPMEAYIYNGPIFYQRLKHMVQDKMHSRSRGPRAILTRQPTEGRSRDGGLRLGEMERDCLIAYGASQLLLERLMISSDGTELDVCQECGLFGYKGYCNACKSTRNVTQMTMPYACKLLVQELISMNVGVKLKLEDEFPHPR

SEQ ID NO: 3139 - protein, 148 aa, Neurospora crassa
  unsure (1)..(148): unsure at all Xaa locations
FIFDIRARRGDYRLEFYDTSSPESWRLLRPDLVILCYDISQRLSLINLQRVVSAGSNQGEPHPSTNXYIAQWNKEVRTAGVTGDNTPVLMLGLKRDLRSENDPNGTIYPQEAYRMAQEMRLDKYMECSAVTGELLEEVFDDICTTALK

SEQ ID NO: 3140 - protein, 508 aa, Neurospora crassa
  unsure (1)..(508): unsure at all Xaa locations
NIVVLGGNSHPELVESICGILGLPACSRILTKFSSGESRCEIQDSVRGKDVYIIQTGFGGNGSRLNDHFMDLCIMISACKTGSARRVTAVLPLFPYSRQPDLPYNKAGAPLYKAPTPNGENGKNQYTFDSVPPTPGPGVPKTSGLTNSSDIANQMIKNALTNGALRSSILPMTTRISPSSTVSRPSPVTSSGLRRRVPLWPTFXPAPAAIMVRHSNKWPLARTILGPTTSCRDARHEGWLVHRKXLLTHVRTVITMDLHDPQGTCLGXCGKHTNTLARVVAHSLSFRPMTLATAGRLTCSLYSPRIFDIPVDNLYGQPLLKRYIQQHIPNWRDAVIISPDAGGAKRATAIADSLGMEFALIHKVNALLQISPPGLPLNQESQERRPTKITDRQNASMMLVGNVTDRVCILLDDIADTGNTITRAAKLLKKEGATTIYALLTHGVFSGDAISRVKASAIDKLVVTNSVPQDEHKKQLGSKLDVLDISPIFAEAMRRVHHGESISVLFNY

SEQ ID NO: 3141 - protein, 465 aa, Neurospora crassa
  unsure (1)..(465): unsure at all Xaa locations
PRPSTEKSRKPSMRDPSTWTTDVDGCSRQRINQYLIKDEIGHGSYGAVRLATDQFGKEYAIKQFSKAQLRRRAQSNILRHAPRGPRNSPSLAFQSRGLKRPRMPSFLIREEIAIMKKLNHPNLVQLYEVLDDPEDDSLYMVLEMCKKGVVMKMGIHGSVEPLPEEQCRFWFRDLILGIEYRKSSVXYLVTITPWLTFMSIVHSQGVIHRDIKPDNLLLTEDDVLKIVDFGVSEIFQKTDEMKTAKPAGSPAFLPPELCAKHGDVSGRAADIWSMGVTLYCLRYGKLPFAHDNQLEMWEAIKTEEPQFPPDEKPEFLDLMHKILEKDPAKRITMHELRVSDLVNRSIRYSXLTKSQEHPWVTKNGQDPLLSEEENCSEPIEVPNALEVNHAVTRRMSHLFCVVSEILLLTYPLSLTKSRXEQSRNLRASSTATELRPNYRPQPSKSNLAKTSHQQRTSTFPTPTPR

SEQ ID NO: 3142 - protein, 275 aa, Neurospora crassa
DDSMWMKGSLIGQGSFGSVYLALHAITGELLAVKQVETPAPGADSKNDARKKSMIEALKREITLLRDLQHPNIVQYLGCSSSAEYLNIFLEYVPGGSVQTMLNQYGALPESLVRSFVRQILQGLSYLHNRDIIHRDIKGANILVDNKGTIKISDFGISKKLEATNILNGANNNKHRPSLQGSVFWMAPEVVKQTSYTRKADIWSLGCLVVEMMTGTHPFPDCTQLQAIFKIGGSKASPTIPDNASEEAKQFLAQTFEIDHNKRPSADELMLSPFL

SEQ ID NO: 3143 - protein, 604 aa, Neurospora crassa
  unsure (1)..(604): unsure at all Xaa locations
MDSVLRQSKAVCPFMKKATASSLRAMTTAARPAASPCGGAISKLQVLAHRCPVMGKAMAVQSARTGGPRQRCSCFLRSQGQAAHRPSPXSAGCRGCLHRPEGXVAQFLCFAVLQYVDFALLFAAGLPPHPPVKPTTATAANPSPAACTVSGNFGTKFNYEKFYENELEKKHKDKSYRYFNNINRLAKDFPRAHMATKEEKVAVWCANDYLGMGRNKHVLEAMHTTLDEYGAGAGGTRNISGHNKHAVELENSLAKLHATDAALVFSSCYVANDATLATLGSKLPDCVILSDSLNHASMIQGIRHSGAKKIIFKHNDVEDLEKKLAALPLHIPKIIAFESVYSMCGSIGPIEKFCDLAEKYGAITFNDEVHAVGMYGPHGAGVAEHLDWEAHQRGETKGTIADRIDIYSGTLGKAYGCVGGYIAGSAKLVDTIRSLAPGFIFTTTLPPAVMAGARAAIEYQMSYDGDRRLQQLHTRAVKEALADRDIPVIPNPSHIIPILVGNAELAKKASDKLLNDHQIYVQSINYPTVPVGQERLRITPTPGHTKQFRDHLVAALDSIWTELGIKRTSDWAAEGGFIGVGEAEAEPVAPLWTDEQLGIADAVA

SEQ ID NO: 3144 - protein, 357 aa, Neurospora crassa
  unsure (1)..(357): unsure at all Xaa locations
MDVVLEVTDQFMFDYMYAWLLPARPALYDFPDKTNGTAQAFSSWVYEPATKFFSLEPSQAAYQSIWTRDNIYRQALSLFLILWCAQTPFFMSSWAQTRXPWLTHRLFGLVTYYVFASLSYIFVFDKKTMEHPKFLKNQVWLEIKQTNAALPVMAFFTFPFLVAEVRGYSLLYDTTAEGPGRWYDFFQFPLFIMFTDFGIYWIHRGLHHPLVYKHLHKPHHKWIMPTPYASHAFHPIDGFAQSIPYHIFPFIFPLQKMAYVGLFVFINFWTIMIHDGEYYANNPVINGAACHSVHHFAFNYNYGQFTTLWDRLGGSYREPDGDMFAKEKKMSTTTWKKQVNEMEKIVKEVEGEDDRLY

SEQ ID NO: 3145 - protein, 380 aa, Neurospora crassa
  unsure (1)..(380): unsure at all Xaa locations
VPQPLSLLLKLSPLVDELALYDVVNTPGVAADLSHISSPAVSSQHRLCAGCRQGHENTTDPAEPCXHLAHXKTTGYLPPNDGAKAAFKDADIIVIPAGIPRKQQYAPLVMVKQRLTGSSQAKPGMTRDDLFNINAGIVKGLIEVAADVAPNAFILVISNPVNSTVPISAEVLKAKGVFNAQRLFGVTTLDIVRAETFVAEIAGNSNPQELVVPVIGGHSGETIVPLFSKVSPSVTIPDDKYDALVNRVQFGGDEVVKAKEGLGSATLSMAYAGYRFAEKLLKAAKGAKGLVEPTYVYLPGIPGGKEIAEKTGVDFFSVPVELGVSFGLCKIYGVSGXHICSPNGAEKAIDILGDITEKEKTLLEAAIKGLKGNIQKGVDF

SEQ ID NO: 3146 - protein, 643 aa, Neurospora crassa
SKVIVIHPGSQNLRIGFASDALPKTIPMVLATKYPQTESEMYEALPRRQFEARTNEQQYGEDWSKKYQKMCNDLKTDMRANRRKVLPNSKDLVLNFNRRTEAEVISTHNDPLQVDWTDVKTLEDPDSNASVFIGQQALRIPDDSNPKFKLWWPIQHGWMNEDDYPTKAHLFNDIETLLDRALRYDLGLKRSTEWKQYSCVFVIPDLYDKKYVEQILHLCVEWFEFSKISFIQESMAASFGAGYTQACVVDVGAQKTSITCVEDGLCIEDSRINLKFGGYDVTETFIKMMLYDNFPYQEINLRRRYDFLLAEELKIKYCTLSQANISVQNSDFHVRAPNQPTRKYQFKFYDEVILAPMGFYDPSIFDNSTKLRGRRKLIERSYNAYDVEVPDDPTSAAQFAVLSHIAPSLNAHTLAGALNDLATPGKEKPLSFNFLARGDTAAGTPGTSKAPSPAPGEGTGTPVPPPFVFGAGGGSPAPSGRNGTTPVPTSGAAAAPNGTGAGSNTLAVPGMPAEAIQRTPKSMAAERDAVLPVVPLDIAIMTSIQNAAKGDEKKVRELMGSIMVIGGGAKIPHFAPYLEEKLKARRPDLSERILVSRSAREMDEQVVVWKGASVFAKLSTNDSWITNYEYKMLGSRVIYHKAL

SEQ ID NO: 3147 - protein, 406 aa, Neurospora crassa
  unsure (1)..(406): unsure at all Xaa locations
QPQQATLQPPHNHHQQSQAQQQQQQQQQQQPQQQQQQQQQQQQQLQPQPSQPRATKGKYSLADFEILRTLGTGSFGRVHLVQSRHNSRFYAVKVLKKAQVVKMKQVEHTNDERRMLAEVKHPFLITLWGTFQDAKNLYMVMDFVEGGELFSLLRKSGVSXMGLFAHGVCAADTDSQRFPNPVAKFYAAEVTLALEYLHSRDIIYRDLKPENLLLDRHGHLKITDFGFAKRVPDKTWTLCGTPDYLAPEVVSNKGYNKSVDWXVHSFGSLSNGPPIAYMSTAQVSLGILIYEMLCGYTPFWDGSSPMKIYENILKGKVRYPQWVNPDAQDLLERLITADLSKRLGNLYGGPQDVKSHPWFAEVTWDRLARKDIDAPYTPPVKAGAGDASQFDRYPEETERYGQGGPD

SEQ ID NO: 3148 - protein, 624 aa, Neurospora crassa
  unsure (1)..(624): unsure at all Xaa locations
FQYITSSAANSIAPPRSQDLSYPLSSYFISSSHNTYLTGNQLSSDSSVDAYRNVLLRGCRCIEVDVWDGSDSESEDDDGDAESVTSSSSSSSDDAYGSGEEGIASKLKRKAKRKLPSFLGGRKKSKDKKVPEPTTTTPPPPPPAAATTTEAAPVGLSAETNPLERCKSGGSASLFQTLSRKSTKEPRVLHGYTLTKDITFRDVCEAIKDYGFATTDLPLIVSLEVHCSAEQQEMMVDIMRQIWGDLLLPEPEEDAKYLPTPEELRGKILVKVKYAPPNNEGGSTGSTTPEELDNTAAAASGRLSEEAGQPKQRAKKPSKVIWSLSKMGIYTRGVSFKSLMQPEANMPTHIFSLSESGVMDVHKESRSALFEHNKHYLMRAYPSGMRILSSNLDPAVFWRKGIQIVALNWQNWDEGMMLNEGMFAGTGGYVLKPAGTSTXSTPLXARQKRXQDPTXATAAPNSPTLIRPPSPSPLASDTQADAVQHYTMDLTINVLAAQSLPLPPGDDNIDSFRPYLKVELHVEEPGERHGTDELPQDGKEKGGEYKAKTKSIKGGCDPDWEGKFGAQTELKFENIPGVVPELSFVRFLVLDDEIGRDSLAAWACVRLDRLREGYRFVHLLDAKG

SEQ ID NO: 3149 - protein, 787 aa, Neurospora crassa
RPRNHSKTFPFSDLFRTLFNPLIDCKPSTSGGTVRGPKPGRGGHFSKVSYHEQRRHIIERFMSRWRSEVGNDFYPAMRLILPDKDRDRGVYGLKENTIGKLLVKVMKIDRNSEDGYNLMHWKLPGGQSGVSRSVGDFAGRCLEVVSKRAMRAQPGDLTIADVNVLLDRLAAASGEAEQLPIFEEFYRQMNAEEMMWLVRIILKDMRVGATERTFLNLWHPDAEALFSVSSSLRRVCWELFDPEFRLEQQETGIKLMQCFQPQLAQFQMTTTWEKLVKNLGVTEENPEFWIEEKLDGERMQMHMIEDDTVPGGFRFAFWSRKAKDYTYLYGESLGDEQSALTRHLHKAFDDGVRNLILDGEMITWDIDIDKMVPFGTLKTAALEQQKNPSKAGPRPLYRVFDILLLNDKPLTEYTLNDRRRALERAVVGVHRRLEILPFERATSPDAIEPLLRRVVAEASEGLVLKNPRSRYSLNSRNNDWIKVKPEYMSDFGESLDCVVVGGYFGSGRRGGTLSSFLCGVRVSQNFIKSGNASAEKCLSFVKVGGGFKAEDYAEIRHHTEGKWQDWDPSSPPTEYIELGGGEKLQYEKPDVWIRPSDSVVISVKAASITQSDQFAMGWTLRFPRFRKLRLDRAWDSALDMDEFEVLRSKIKDQEQERKKMEMENRKRKPATKRARKDLVIAGMSDPSSSSAATPVIAPKETREASKRLFEGLDFCVLSDSLKPNKMTKPALEKLIKDHGGRIHQQVMDHSGQGKIIIPIADKNVIKVASLRKANPEMDIIRPKWIFD

SEQ ID NO: 3150 - protein, 602 aa, Neurospora crassa
  unsure (1)..(602): unsure at all Xaa locations
MLNRFRPARLVAQSSRCLPLTRARAGPLPVNNARTLATRAAAVNTKVCSKSEEPQKYGHHDAVPXVLTMTPEPTERDNITTLSNGVRVASEDLPDAFSGVGVYIDAGSRYENDYVRGASHIMDRLAFKSTSTRTADEMLETVEKLGGNIQCASSRESMMYQAATFNKAIPTAVELMAETIRDPKLTDEELEGQIMTAQYEVNEIWSKAELILPELVHMAAFKDNTLGNPLLCPKERLDYINRDVIQTYRDAFYRPERLVVAFAGVPHERAVKLAEKYFGDMKASDAPGLSRTGSETSVDSLVSESSEASSESSSSSSDSSESSGGLLSKLFSPKAKKATPNPFLTRVPISTEDLTRPAHYTGGFLTLPSQPPPLNPNLPTFTHIQLAFEGLAISDDDIYALATLQTLLGGGGSFSAGGPGKGMYSRLYTNVLNQHGWVESCVAFNHSYTDSGLFGIAASCYPGRTLPMLQVMCRELHALTTDHGYSALGELEVSRAKNQLRSSLLMNLESRMVELEDLGRQVQVHGRKIPVREMTRRINELTVKDLRRVAKRVVGGMANNAGQGSGAPTVVLQEATVQGLKTTELGWDQIQDTIAQWKLGRR

SEQ ID NO: 3151 - protein, 462 aa, Neurospora crassa
KWYHIKWFADSDTPRERRLIMKLDLLIVPYAFLAYWIKYIDQANLSALFLPAFFQSLLQPIKDSEVQLTPRYFPLTDNAYVAGLKEDLGFHGNELVQLQTLYTVGAVVGQIPFMFLFTYLPMHWTIPFLDIAWGFFTLAQYRANSFGQMAAYRFLIGWFEAAFYAAIHYIFGSWYRGDEISRRGGVFYTGLTLGTLTAGLIQSGASSRLEGVNGLAGWRWMYIICALVTIPVGILGYFILPGTPENPNKWFLKDEDVQIAKERLARVGHSVVHPKFKLGTLKSLANNWKFWALLMLDIFFWNGSLNYSAGGYLLWLKSLGRYSQSKVNELGTISPAIGIFYVLLICFISDLVVGPAWAITIAHVWNIIGLVILVIWNVPESALWFAFMTTYSSVAMSAVLYGWINAIMGKSSAERSFAIVLLNTVAQSTTAWTQLLTFPTKEAPQFKKGYSFVLANAVCLII

SEQ ID NO: 3152 - protein, 397 aa, Neurospora crassa
  unsure (1)..(397): unsure at all Xaa locations
PLVTSGRWIRDASGTNLTYAGVNWPGAADVMIPEGLQYQSIATIVSKIKSLGMNAIRLTFAIQMVDEIYSNGGKDITLQKAFTQALGSTNGPKLLDQVLAKNPQFTASTTRLQVFDAVAAECAKQHIFVHLDNHISKGMWCCSTGDGNSWWGDTYFSAANWTRGLAYMANHVCLPXILPLPCHPASHCXHHRDSQGKQWTSLMSIGLRNEPREPTSGAAKSTYNWQTWYTYMKQGAEAVHSSNPDLLIFLSGLSFDTFLTPVVRGTALTPGTGKFSFNDFPGYADKLVLELHNYETSANNCNNLQNNLYNNGFEALTSSTVNQFPVMLTEFGFQMDASTWKGTYASCLASYLPAQKAGWFIWVLAGSYYIRSGTQDYDEGWGLLTHDWSTWRSPSYV

SEQ ID NO: 3153 - protein, 529 aa, Neurospora crassa
PGPRQFPIVGRIHDLPRFSLWLKFKEWADEFGPIYTTSVPDATFVIISDEKIAEELLVKRGHIYSGRPQIRSLIGHKEGVVYSALMIVMVSSCFFFFSTDLRQCLLMRAYLDTWKSQRKWAHAAMAAAYKHHFYGHVESEMRRFLVVLLFDPDRFLDHTREYCGRVMSRLAWDDATQGRLNGESADKTLHCMSVSGPITNTMTPLWSLPASINPWYKYEVKREAELRQWWLGLFRKAKERMRKGELPSDTWAYRYFEQMVQDTAPSMPATARAPGPDVKNAERSPSTAAQEEAYEKKDALDQPEKDETFASCMIGFLNLVGVVTISGPLKFFQMAMALHPEWQHKAQAEIDEVCGDRMPTMKDFDKLPILRACLKETVRWRSGVPLGVPHQAERDDEFRGVKIKKGTIVLACEWYVFLGSFFPYFRASLTLTLRHTGPSTANPQKYPDPETYNPARYLDPSYPTFQAPLTRYPNFREGSSMHSFGWGRRTCLGQNIVDDEMFVFGAALLWAFEVTPKTCPVTGKEVPID

SEQ ID NO: 3154 - protein, 554 aa, Neurospora crassa
  unsure (1)..(554): unsure at all Xaa locations
GIELTSGFDSQMINALQILESWIQCKWNKSSFLSLLQSSIVLCFCCLPARAVHGCSAVLVPVANHSIADFDNPQGALKGIISAAYSLGAILSLPLVPIINDRFGRRWSIALGSIVMIVGAIIQGFSQHGKHLSVLITMKTPTLTAIINSRMYIVARMILGFGIPTCIVSGSSLIGELAYPKERPVLTSLFNVSYFVGQIVAAAIVFGTNSIASNWGWRIPSLLQICPSLLQLAFVLYVLVMGLVGQRTEFADLRKCSFIPESPRWLITKDRSQEAHDILKKYHGEMERGEEFVAAEFAQMQAVIRLEYETVSKSSWMDLLRTPGMRKRLLISSMLGLFTQWSGNTLISYFLGDLLKMIGFTDSTFIQKINVSIACWSLFCGVTVSLLVTRIRRRIMYMACTISLLLCYIAWTVSMERAMTGKANGTPNNGANIATLFFIYMYSPCYNMGYNAXPTVSXTSCSVQRLISLTQRAAYMVEVWPYAERSRGIAVFQLFGRLAGFFTTFVNPIGLKNVGWKYLISYCCWLAFEVCFVYFMFPETMGRTLEELTFMFEG

SEQ ID NO: 3155 - protein, 517 aa, Neurospora crassa
  unsure (1)..(517): unsure at all Xaa locations
EKDVVLCISSGHFLLPCLFYSTIAAGAIFSASSPASTATELAGQIKQIGAKLVLCNEDTKEVAAAAAKLANIPGSRVLVLGSQPHLELTNLEQSRPIPISTKTLEWQRITDTKALENSIICILFSSGTTGLPKMCRLSHTNMVSQACLVLDPAREYEKARGRDMSADYRTIAHLPAAHIAGVQGYFVNSFYVGGTLYWMPRFNLVKFLEYSKKYQITTLVSVPPIYLAIAKSPLVTDQFDSVEWAVAGAAPMGKELQLAARKNLGKGKAHLTQTWGLSETTGAMTTMPRGIDDETGSVSMLVMNGRARIVDDDGKDVEPGQAGELWVKGPNVTKGYYMNDAANKEAFVDGWFCTGDIGLFKDGKFYIVDRKKVRDDGGFLLXLVGGQRTTWMTNKESQELIKYKGLQVAPAELEALLVSHAKIADAAVIGVDGEETEVPRXVSRQKSQSNMMPDIRSXCSEWNRAYVVAGDATLKAEEIVDWVASKVANHKKLRGGVVFIDAIPKSPSGKILRKELR

SEQ ID NO: 3156 - protein, 587 aa, Neurospora crassa
  unsure (1)..(587): unsure at all Xaa locations
PSIRFPRDPSHSVATTRQPSPGRASTTTTVTKQPAQGHLQAEQLRLDKGRATLPRRAQAQLPTGAPKPQKPVQHDFSHYVHDPVTRNRQKAVRAVFERSWNSYKEHAWLRDELAPVSGVGKTTFGGWGATLVDALDTLWIMELWEDFYLAANAAAQLDWQNTTETAANMFETTIRHLGGLLSAYDLSGEQALLDKATELGNMLYMGFDTPNRMPGFWLNFEDAKRGVQVAGTNDPSASPCSLSLEFTRLTQLTGDQRYFDAITRITEFLERTQNESKIPGMWPKLINFREERVDGESGFTLGALADSLYEYLPKMHALLGGLSPQYEKMHRAAMDVVTKYMLFRPMLPAEEASKHDILFVGDAFAKPDRIDRVAEGQHLTCFTGGMFGLGGKLFDINEHVEIGERLARGCGWAYDAFPTGVMPEIFNMVPCGGSWDAPCPWNEERWKAEGSKNLKKGFASARDTRYILRPEAIESIFLLYRMTGKEDLRDLAWQMFESIVNATETELAYSAISDVTVKGPTTKTDSMEVSGLFPAKDPXXHQLTCFLLQSFWLAETLKYFYLIFSPPSIISLDEYVFNTEAHPFLRP

SEQ ID NO: 3157 - protein, 563 aa, Neurospora crassa
  unsure (1)..(563): unsure at all Xaa locations
LARELKGRHLQMIAIGGSIGTGLFVASGKTLSDGGPASVLIAYLIIGVMLFCTIQALGELAVIFPVAGSFSAFSTRFLDPSWGFAMGWSKSSHLSSSLCKGEEENTDRHFFPCSYALQWIGVLPLEVLAGAMTIGYWNKEINKAIFVTIFLVIIFVINLFGAKGYGEAEFIFAIIKVTAVVGFMXVFIPFFTRTHPFHSLHPRHPHQPNTHPLKKPFRYRHQHRRHPYRRLIGGKYWEDPGAFHNGFKGLCSVFVTAAFAFAGTELVGLAAAETANPRKSLPTAIKQVFWRISLFYIVSMTLVGLLVPYNEPRLLNAQNIADASASPFVIAIESAGATVLPSVMNGVILISVISVGNSAVYGSSRTLAALAELGQAPAILAYVDRRGRPIVAILVTMAVGLLAYLGDVPSQKNIFDWLLAISGLSSILTWASTCLAHIRLRKAWAYNHRSVQDIAFKAQGGVIGSWIGFVLNVLVLVTQIWVSIDPLHQGDTPLTTKERVRSFFVSCLAIPVVLICTIVHKWYYKTKWVRIEDMDVDTGRRDFGRLGIIKAQEKEERMGWPRW

SEQ ID NO: 3158 - protein, 424 aa, Neurospora crassa
  unsure (1)..(424): unsure at all Xaa locations
QNGWVTSLATSLEKYETTEXTAXYSREDHELTNALAISPNMLLSGSRDKSLIIWNLTRDETSYGYPKRRLHGHSHIVSDCVRXILDIGGLCGYFGIAGSLTDWRGRVISSDGAYALSASWDKTLRLWELSTGTTTRRFVGHTNDVLSVSFSADNRQIVSGSRDRSIKLWNTLGDCKFTITEKGHTEWVSCVRFSPNPQNPVIVSSGWDKLVKVCCITCFTPPPKKTRHHDACIFFSKXYLLLQSPRAMRPTSHALIFSEITNSLSETAXDFERICDXQSQLNQVWELSSCKLQTDHIGHTGYINAVTISPDGSLCASGGKDGTTMLWDLNESKHLYSLNANDEIHALVFSPNRYWLCAATSSSIIIFDLEKKSKVDELKPEFQNIGKKSREPECVSLAWSADGQTLFAGYTDNIIRAWGVMSRA

SEQ ID NO: 3159 - protein, 806 aa, Neurospora crassa
  unsure (1)..(806): unsure at all Xaa locations
RFQQMLASRMQLPMWQFRQQVVDTVKREQVVIICGETGCGKSTQVPSFLLEDQLMKGRNCKIYCTEPRRISALSLAKRVSEEIGEGRGDLGTPRSLVGYSIRLEANTSRETRLVYATTGIVMRMLEGSNDLNEITHLVLDEVHERSIDSDFLLIVLKKLLARRKDLKVVLMSATVDAERFSKYLGGAPVLSVPGRTFPVKVAYLEDAVELTGYTLDQRNPVASKLTELDDEADAEVDTSSKPELIQSLRNYSARTRNTLAQMDEYQIDFDLIVQLISTIATHPDYVDFSKAILVFLPGIAEIRTLNDMLLGDKAFADHWLVYPLHSTIATEDQEAAFLVPPPGLRKIVLATNIAETGITIPDVTCVIDTGKHREMRFDERRQLSRLIDTFISRANAKQRRGRAGRVQEGLCFHMFTKHRHDNIMSDQQTPEMLRLSLQDLAIRVKICKIGGIEETLGEALDPPSAKNIRRAIDALVDVRALTASSEELTPLGIQLARLPLDVFLGKLILLGAIFKCLDMAITVAAILSSKSPFVAPFGQRQQANTVRMGFRKGDSDLLTVYNAYQSWKRVCQSSTSGGAEFQYCRKNFLSPQTLANIEDLKGQLLVSVADSGFLQLTTEERQVLNRLRFGGKRRYQAFYEVPQRVNINSDNELIAQSVIAWSFYPKLLVRDVPGSKGLRNVGNNQNISLHPSSVNKGHNELRWLSYYNIMQTKGYVASSSSLLTFLLFRCXLDGXQKRLXCHETTAVDPFAVALLCGDVRADMYSGVLVLDGNRARFAVSDWKTMLVVKMLRTRLKEVMARSFKNP

SEQ ID NO: 3160 - protein, 391 aa, Neurospora crassa
EKRPASDDPSGGQLVKRPNLGSSRALTRTSATGSSGDLIQTAPRTSSLQAPVMELSGHSGEIFAAKFDPTGNLIASGSMDRTISTSQLTSAAGIDNWGPVTNNCLLQVLWRTYGDCENYGVLNGHKGAILDLQWSRDSEILFSASADMHLASWDLTSGTRIRRYVGHEEIVNSLDISRRGEDLLISGSDDGTIGIWDPRTKNAADYIETDFPITAVAMSEAGNEIYSGGIDNDIKVWDVRKKAVVYSMIGHQDTVTTLRVSPDSQQLLSYAMDSTARTWDIRPFAPADRHIRTFDGAPLGMEQNLIKGSWDKDGKKIAVGAGDGTVVIWGSDTGKLLYKLPGHKGTVNVAEFSPGTDPLSKLIAFWLSSAVAYHVVVLSASSDRTMLLGEL

SEQ ID NO: 3161 - protein, 642 aa, Neurospora crassa
  unsure (1)..(642): unsure at all Xaa locations
EAATVPDLLETIVSIVKEVTRFHRVMVYQFDRDYNGTVVAELMDPKASNDVYRGLHFPASDIPPQARKLYMINKVRVLFDRSQRTSRLIGRDVSDMDVPLDLTHAYLRAMSPVHLKYLSNMGVRSSMSMSLESDGKLWGLIVCHSYGPAATRVPFSIRELSFFVGLAASTCLQKLLNSERLQAHRIIETLRGRGRPDECITSSSHELLNLFDCDCGFLVIEGEARTIGRLSSYIEAITLLKYLFFRGSRTILFSHNIGDDFKDLHFPSGFKAIAGVLYIPLSSTTDDCVVFYRKNQIREVHWAGRPSLAGKIGRLEPRNSFKKWTEVVDGTSKAWSIEHSTISLLQPSICQYCXHXFPANLAAMAQLLYGSFIQVWREKETAINDTRLKRLLLHDASHQGRNQAFMCSMSTSXRVVVLVRNPLNAVINCLEIALEKHLDDGTKQVLTTSYTASKSLIYVIDDLLSLTGSITGSVPLLDEPFHLPNCLEEVLCPLRRLGQEKGIQLIMIPSTGPTQYVRGDPTSLQRSLSILVANAIQHTTSGQVVVKWYETAMNPENTVIHISITDTGPGFSERELDDMFQEFEQVPDEDFDEATSKPHAVRDNVLRVGVGLAFVARFVKQRNGQLKVKSTKGRGSTFTLEI

SEQ ID NO: 3162 - protein, 831 aa, Neurospora crassa
  unsure (1)..(831): unsure at all Xaa locations
RKSQTADDMKLWSARPLAVLASLATLVAPSLARDRELHSNSLAACQENSGFTASLFDVIFFPDNGTVNINMLATSSIQGYVVFDIRILAYGYQIMHEVLDPCNIGVGLGGLCPMNAGKMGNPFRLELGPEVKDRIPGIAYTFPDLDATVKVYVNMTDGELAGETVACIEANVSNGMTGRFRGCPHYMQEKCXLGLVFXVDLVGVKWATWAVVFLGILSSALLSGLGYANAASHVASNTLSLYGYFQAQAMIGLCGVHLPPAVRAWTQDFVWSMGIIRVQFIQDILTWYQRATGGTASTVLNSLETVSVQVEKVKRALPAEYVDPAINLFKRATAMLPRAAAHVGSRIAKRANVQTSFGSYIVYGIQRVAFRGKIESTNLFMTSLTFFYIFVVFTAILVILFKIGLELFAKLGWVKGDAFSEFRAGWITVLKGXVTLIIQVDFRLVLTIPLGILYRVGLVGFPQVTVMCMWEFTQNDSPAEMALAVFFFFGLLATLLWAAWRVIRIARRSISLHRNPAYILFSDPQALNKWGFLYVPFRASGYYFIVPILFYIVIKGMFIAFAQANGTLQAIALLIIEAAALITASVMRPWMDKSTNTFNIAICAMNFLNAILLFLLTDVFDFPPLVIGVVGVVLWIANAIVCLILLLMLIITTTMTLLHNNPDTRYQSMNDDRTSFMKSNPQLHTQSELEALGVTARGESKLYTKSPLSFEDDDSALSSPSNPLNRPETADSNAGNPHFHSNRHSGRWSNDPSLMRDEPFVRHRPSGSIQTPSPMTDSASSLPGGQASTHSMVSEKKPHNTARYVXWGNGLCAMFSXLTYDSPWQRGAGYE

SEQ ID NO: 3163 - protein, 574 aa, Neurospora crassa
  unsure (1)..(574): unsure at all Xaa locations
EPVADKKEKKEKKDKKEKKDKKEKKAKKSDESTTEESTSASKATTNGTTTPAASTNGAYTYKQADALSALPESEIETFLKEKEIVIKDPSSSNLRPIMNFSQLPQSNLISKNPFAAYTNPTPIQSASWPFSLSGRDVIGIAETGSGKTMAFSLPCVESLASRPKPKFNSRDRTAHPRAVIVSPTRELAMQTHAALSGLASLVGLSAVCIFGGSDKNEQRNLLYKNNGVDIITATPGRLKDFLSEGSISLANVSFAVLDEADRMLDRGFSEDIKLILSGCPPKEQRQTLMFTATWPLDIQKLAESYMINPAQVTIGHRTRAGGDGEGNGNIELQANSRIEQKVEVVDPRGKEFRLYELLKEAQKGSQKDDRILVFCLYKKEAVRVEQFLSRKGIKVASIHGDLRQDQRTRSLEAFKSGTTTVLVATDVAARGLDIPEVKLVINVTVSSTAHILLIVNGQVLTDSQFPLTIEDYVHRIGRTGRAGKLGKAITLFTEHDKAHSGSXVSILSFCLXYFPMLTTSFLFQLVNILRAAKQPVPEELLKFGTTVKKKAHDAYGSFYKDIDPNKKATKITFD

SEQ ID NO: 3164 - protein, 221 aa, Neurospora crassa
  unsure (1)..(221): unsure at all Xaa locations
FQRGVYPAEDFTTVKKYGLNMLVSADDQVRAYIKRIMSQLHKWMVGSKISKLVIVITDKDTGEHVERWQFDVSNFLVPLLXTDSKLIRGLXVQIFSKAAQSKTKSQPASATTDDNQNQSPNENAAASTAASTPTPPLDKTEAEIQAEIAAIFRQITASVTFLPQLSGDCTFNVLVYADADSDVPVEWGDSDAKEIVNGERVQLRGFSTTNHRVDTLVSYRL

SEQ ID NO: 3165 - protein, 216 aa, Neurospora crassa
VYGHTGPNPPKVIMVLAELGIPYDLDNIQISQAKSPEFVKNVNPNGRLPAIQDPNTDLTLWESGAILEYLTEKYDKELKLSFTPGTNDFYLARQWLYFQTTGQGPYYGQVAWFKRYHPEPVPSAVERYVKELNRVSSVMEDHLQTQKEKYGTEEPWFVGNKFSYVDIAFAPWQHIVGVMLTKEEYDEDKYPLIHAWLERLRARKPIKDALDNMIPA

SEQ ID NO: 3166 - protein, 828 aa, Neurospora crassa
  unsure (1)..(828): unsure at all Xaa locations
TDLAKPSPTDNVYREDCTQCFDSIVRTLSWPFLSSSSPIYHVQPSNXPPRCKXDDPAGLDVCLKCFNGGCAGDRNHAKLHATSRNHPLVLNIRRTRKIIERNEPPLKMSKLAIAAETESDRYDTTLTVKCLDCGIDNLNKEDATIAPVIEAVMKANTFSRKEEVKAWEQELTTCEHILTMQQGEPRKIESQDLGHCSKCDLNENLWLCLECGNLGCGRAQFGGVSGNSHGLAHATETKHGVAVKLGSITPEGTADVYCYNCDEERIDDNLGAHLANWGIILAEREKTEKSLTEMQIEQNLKWEFSMTTEDGKELTPVFGPGLTGLKNLGNSCYLASILQCLYDLPSFQQRYYSDKLGPLPSVSDPAEDLETQLRKLGDGLLSGRYSKSDADVFASEHTPNVPYQKGLQPSMFKHLMGRGHEEFSTMRQQDAFELLQHLIKLITRSKHPVELGDPTQPMRFVMEQRLQCLNCKKVRYSSNEQDSVFIDVPMEKLPPEEEGQEPKYKPVTLKQCLDSLTASEVVELTCAGCGSKDGFTKRQAFKTFPDVLVVNARKMAVVNWVPVKIDVPVIVDDEPLNLDEYLSKGQQPDEEALPEDESAKSSAPAFVPNAEALAMLEAMGFPRVRGEKALHATGNSDANAAMEWLFAHMDDPDIDVPLDLSASSGGAASGGAGAADPEKLAMLESMGLSGPRAVKALNETGGDVERAIEWLFSHPDDDGADAVEEEAPAGNEGPKKEAGSSELPAKFQLQSIVCHKGTSIHAGXVSIHVFSHRITRXPXQPDHYVAFIRKKLSEDETSWVLFNDEKVVKVVDVEEMKKTAYVYFFKRV

SEQ ID NO: 3167 - protein, 748 aa, Neurospora crassa
TNMSECPVRKSNVGGGGTRNHDWWPAQLRLNILRQHTPVSNPLDKDFDYAAAFKSLDYEGLKKDLTKLMTDSQDWWPADFGHYGGLFIRMAWHSAGTYRVTDGRGGGGEGQQRFAPLNSWPDNVSLDKARRLLWPIKQKYGNKISWSDLLLLTGNVALESMGFKTFGFAGGRPDTWEADESVYWGAETTWLGNEDRYSEGQEGHEGHGVVQGDESKKQHTDIHNRDLQSPLASSHMGLIYVNPEGPDGIPDPVASAKDIRVTFGRMAMNDEETVALIAGGHSFGKTHGAGPTHHVGKEPEAAPIEHQGLGWANSFGQGKGPDTITSGLEVTWTPTPTKWGMGYLEYLYKFDWEPTKSPAGANQWVAKNAEPTIPDAYDPNKKKLPTMLTTDIALRMDPAYDKICRDYLANPDKFADAFARAWFKLLHRDMGPRTRWIGPEVPSEILPWEDYIPPVDYQIIDDNDIAALKKEILATGVAPKKLIFVAWSSASSFRGSDKRGGANGARIRLAPQNEWKVNDPSTLREVLAALESVQQKFNDSSSGKKVSLADLIVLGGVAALEQASGLVVPFTPGRNDATQEHTDVHSFTHLEPHADGFRSYGKGTKRVRTEQFLIDRASLLTLSAPELTALIGGLRVLEANYDGSSYGVLTKTPGKLTNDYFVNLLDTNTAWKAADNEGEVFIGYDRKTHDKKWTATRADLIFGAHAELRALAEVYAAVDGEEKFKRDFVAAWHKVMNLDRFDLKQEGR

SEQ ID NO: 3168 - protein, 711 aa, Neurospora crassa
  unsure (1)..(711): unsure at all Xaa locations
PLLTIRFWILSTLWVIVGCSVSSVYYFKPYSVRLSGYVVQLLSWGMGALMARYFPQKQYTLTLPILRKEISFNLNPGPWNPKEHALVIVAYWGSTYTAYGLGPLSAMELYYHKRMSGPWAVLFLMTTQLMGYGFAGVYRDVLVRPPGMYYPGVLPNVTLFNAMHRHPSVTKKSLGFFGVVAAAAFVYQWLPGFVMPLLASLPVVCWMGLGTKTAFVLGSGTYGFGLLDFSLDWNYASFLTPLYTPLWATVNRFVGAAVVIWVVYPLAYFLNVNGAQQFAPMSSGTWDAEGNRYNISRILTPTYELNRTALEEYSPPYWSFSYAMHFFWGFAASTAVLTYAVMFHGRQSWEALRSSLQTISNPFAKKDHKQKKKNSQQHRAEFDDPYLKLTAHLPRVPHWWYLALLFSCLVIAIAQVSGGGMQLPWWGLLLITAISALFTFPSGILFGFTNVQIGMDYLSELLAGFLFPGKPIAVLTCTVYGRQILEQCLNLVSDIKFGFYMKIPERELFVAQVYGTLLGPFVNWACMRLIIDTQGPKLTGEVVSGTTWNALKTKNFFSLSVIWGVLGPQVFFGDESPYRWVYWGFVVGPLAVTLLWLVQHRLARPKWGKVASVVNPVVMLNGATLFPIYPTTNLATSALVAVVFMGYVYRYHPVWFRKYNYLLGAGLDCGAQLVQMAMILVVDLPNVTMPHWWGNDAVAVDKCYPIXLCEL

SEQ ID NO: 3169 - protein, 442 aa, Neurospora crassa
  unsure (1)..(442): unsure at all Xaa locations
NKVMLPPIPVLADYGISPTHGFLPDVLPLTRLPDPYYNKWEAIAANLQALILSKRLRGVVDRLPVLDTIGLEHDAEWRRAYSLLSFMAHGYIWSGDSPSDRLPPSIAVPLLKISEHLEVPPVATYAAVCLWNFKPLFMDEDIDNLENLATLSTFTGAIDESWFYLVSVAMEARGAPIIPLMLTAIAAARVGDGATVTRCLHTFAERLDDLTTLLQRMHESCDPKIFYDRIRPFLAGSKNMADAGLPHGVIYEDGSGKEEYRQYSGGSNAQSSLIQFFDIVLGIEHRPTGEKRGRPQEQGEVHAPAPKHNFLLEMRKYMPGPHARFLDHVQSVANIREFVEKHRGYRSLGIAYDACLAMLRALRDKHIAIVTRYIVLPSQGSAHSQPQPQSRGCPPQDQPGDRVAPATSWNCLGHQGXWKKDNLKGTGGTALISFLKQARDET

SEQ ID NO: 3170 - protein, 275 aa, Neurospora crassa
  unsure (1)..(275): unsure at all Xaa locations
FYGVAVGRTPGVYTDWSIAQQEVVGWKNPKYKKFETRAEAEEFVRQWSGKPSSPSRQGTTSGRDRXPASHCSGRASKSSRKARKTGATQSAHQAQEALDDASKPVIIYTDGSARGNGKVGAMAGVGVYFCGGFREXVCSLTRKNSMCDSFSXHISTTNRNISERLQGPVQTNQRAELTAVLRALEAIPDTQNCELRTDSQYTINCVTSWYKKWMKNEWRNTKGEEVSNQDLIVAIRKKIDTRDRKAAETKFVWVKGHGTDEGNIAADMLAVKGAT

SEQ ID NO: 3171 - protein, 492 aa, Neurospora crassa
  unsure (1)..(492): unsure at all Xaa locations
PLEVLPGEYYTPWEDLIRRLSESLDAGTFRAEVDRLPVLQTDRLMREEEWRRAYVVLCFFAHGYIWGGRRPSEVSSLCMVAXSRRXRXRXRRXECTDNDKKKQILPAPISVPLLSVSKHLDLPPIATYASLNLWNFRCVPPPSSSLPPSPPATPASSSSPSPSLTTCKTAAAKTPKVFDPTDLSRLQTLHTFTGTPSESCFYLVSVAMEAQGAYIIPIMLRALQAIGLRAEAWKESTTKALRELVRCVQAVGELLERMYEGCESMVFYHRIRPYLAGSKGMNSTSMGLGRGVFYDLGPLSPAGSERKTGEKGEEGVEGEEVQGQKRKGKWMAYRGGSNGQSSLIQFWDLVLGVEHVSAGHSSPHGQASHPSQSDTMKEKEKPFHEEVREYMPLKHRQFLTLVSKMGLGKGGIRKAVMEMVEAAEHEGRELDDKEKELQGAFTDATRALAGFRNKHLQIVARYIVIPSRQAVPEGSKRPGASLGDGKVGGGKD

SEQ ID NO: 3172 - protein, 290 aa, Neurospora crassa
ATELLAGAAALLASGVSAEAYLGFNSGNTLPSREAKFKKDWVQEFTTAQNLKNSPGVFNAVRLYTNIQAYSQTSEPIEAFEAAIETNTKILLGVWASGTNTIEPEIKALQNGIAKYGKKLTDLIIGASIGSEDLYRVSVTGIQNKSGVGAGPAELVKFIADWKKAFQGTAIANVPIGHVDTWDAWTNGTNKPVIDAVDWVGVDEYPYYENGKGNNIENSGYLFDRAYDAIEGAVGGKPIWVTETGWPYVGQTWDQAAATIKNQQYYWQEVGCRKLFGKVPTFWYNLRDSN

SEQ ID NO: 3173 - protein, 327 aa, Neurospora crassa
FFVPFPSPLLTPVAVEIGTPPQTVYTQLDTGSFELWVNPDCTTVSPSDSSFCDHIGFYNASLSSTSKSLGTSKTLRYGIGAANISYVTDTISLSGSSTSLKDIQFGVATSSKDAFSGILGIGYGQGLATKYPNFIDQLYAQKITKVKAYTLALGSKTAQQGSIVFGGVDTSKFAGPLGRLPIIPAEDSPDGVPRFWVQMNGISLTPPSGQSMGVYEGSKIPAFLDSGSTMTILPPALANKIAEDFGSPEMDANGFYRVGCGYVEMNGTMDFEFVGAGQKVTVRVPYKEMIREVGQGESKMCFLGIMGSESFTLLGDTFLRSAYGEFN

SEQ ID NO: 3174 - protein, 545 aa, Neurospora crassa
  unsure (1)..(545): unsure at all Xaa locations
LSGVLTQRHAPAVADAVRTSLGPRGMDKMIMTGKGETIITNDGSTMLKSMSVMHPTAKMLVQLSHAQDVEAGDGTTSVVVLCGSLLGAADRLLGKGIHPSVISEAFQRAAAAAVDVLHDMSQPISLTDTASLLQAANTSLSSKIVSQYSNLLGPMAVNAVTKTIDLKTAENVDLKNIRIIKKVGGTIEDSELVDGLVLTQPVIKSAGGPVRMEKARIGLIQFQLSPPKPDVRIPFWRPXPTHLACWPXIAQTLPFSCFYXQLTLTMENTISVNDYRQMDKIVKEERTYLLNMVKKIKKAKCNVLFIQKSILRDAVNDLSLHFLQRLGILAVKDIERDEVEFICKSTGCKPIADIDSFTEDKLGSADLVEEVNSSGSRMVKVTGTKSAGKTVSVVVRGANSLILDEAERSLHDALCVIRCLVKKKALIAGGGAAEIEIASQLAKQSRALSGTEAICWKAFADAMEVIPTTLAENAGLNSIKVVTDLRHRHENGEKNAGVSIKSGGVNPNIAKENVLQPLLVSTSAIELAAETVKMILRIDDIALSR

SEQ ID NO: 3175 - protein, 453 aa, Neurospora crassa
  unsure (1)..(453): unsure at all Xaa locations
PREPAHHYHRNGQVVXPPSRDIQVLKTYGAAPYGAAIKKLEQQIKEKQQSVDEKIGVKVCXSCGGYPTNREAHLADQXYFLVYRESDTGLAPPHLWDVAADRQRMSEEQPLQVARCTKIIPDEKDESKSKYVINVKQIAKFVVQLGERVSPTDIEEGMRVGVDRNKYQILLPLPPKIDASVTMMTVEEKPDVTYGDVGGCKEQVEKLREVVEMPLLSPERFVNLGIDPPKGALLYGPPGTGKTLCARAVANRTDATFIRVIGSELVQKYVGEGARMVRELFEMARTKKACIIFFDEIDAIGGARFDDGAGGDNEVQRTMLELITQLDGFDARGNIKVMFATNRPSTLDPALMRPGRIDRKIEFSLPDLEGRANILRIHAKSMSVERDIRWELISRLCPNATGAELRSVCTEAGMFAIRARRKVASEKDFLSAVDKVIKGNLKFNSTAAYAQYN

SEQ ID NO: 3176 - protein, 710 aa, Neurospora crassa
  unsure (1)..(710): unsure at all Xaa locations
PKRHALVTRFPVHSSHFRGCTAVSRRQAHQFRNMSHSQNPQDEQAQKGSKFSHLPLSTSGPLECALKGTVLLNHPYFNKGSAFTKEERRDFALHGLLPPQIQSLEQQVQRAYEQYCSQPNDLAKNTFMTSMKEQNEVLFYRVRLLFCSVPXSIAIGLGCALFXLERLFSLLHDHLDEMFSVVYTPTEGEAIQNYSRLFRRPEGVFLNINDMDSVKRDLAQWGKPEDIDYIVVTGKTQPFDIKRFHGXGRWLTKCRGEEILGIGDQGCGGILISIAKLVLMTICGGIHPNRVLPVVLDCGTNNEELLKDDLYLGLRQKRARGDKYDDFVETFIKAARELYPRAYIHFEDFGLDNGMLQNVYSPAWLLTXSLARRLLERYRPQMPCFNDDVQGTGCVTLAAIMAGLHISKQKLSDVRMVVFGAGTAGVGIADHVRDAIAADADISPEEAGKQIWYWRRIPGLGQVSSRNNTLTLRRLIDKPGLLTTKSESLSDAQKKYAKSHDDWANEKTDLLAVIKEVKPHILVGTSTKPKSFTEEVVREMAKHVERPIILPLSNPTKLHEAVPEDLLNWTDGKALVATGSPFDPVKGPWGKDGKEIEIDVAECNNSVVFPGIGLGSVLSRANRVTDKMLMAASKGVAEMGPALRDDTAPLLPGVDVVRDVSVRVARRVILAAMEEGVVEEKDVPTNEEDLDEWIREQMWDPVYRPLKYVE

SEQ ID NO: 3177 - protein, 716 aa, Neurospora crassa
  unsure (1)..(716): unsure at all Xaa locations
LLHPCLNRNSIXTEXIYRSFVNRISDSHQKEQPENFQGGIIADPMGLGKTLTMIALTASDLMWVSLARRGNNEFASVGQTLVIVPPPRMFTKIGAVVIGSANQPPNSVRYMGRAVDRVSLLLIMTTSGNPSSLIHAQXAVEPGAFSWCRHHGNDRLITTNDAHQPTIILTTYHTVSAEWRNAGESARSGIFSRRWRRIILDEGMFSEPCCLWKVSLNKNSLTKILCLKLIIIRNHNSQMAHAICSLDGDSRWAVTGTPIQNKLSDLATLLKFLRIYPYSDKRCFDADFTNLWKNGQANEALKRLKRLAGCLILRRPSTTIQLPERRDLLCPVEFYPAERELYQDIRTRTIERLDEFLYANNADTVRLPSYVNVLQQIEGMRMVCNLGLYYRSRHDFTAQDPSADTTWNNAMAQRALDLQLEMNPVRCKDCKASLDVAFSLLGDTPEVQGLQQALLSQCMKFVCPECVFRRWRRTARLRSHSSMPVRPSVHQCHHCQGSAGACRYRIRRKRLDVTAXDALKDQVADFAAQKPSLRHQKVYQXAADSKKMRLTAPISVVFSTWRTTLDVIEAGLKTEDIPCLRFDGKIPQKERPNVINRFRHDPTCRVLLLTLSCGAVGXDHNTECALSMSWSYCXLPNPSTRLTLTVASYAFLMEPHWXVPNPXLTLTIXXVQKTLSXPXDIRNPTLEDQALARIHRMGQTREVTTARFFIRDSFEE

SEQ ID NO: 3178 - protein, 311 aa, Neurospora crassa
  unsure (1)..(311): unsure at all Xaa locations
ASGIGKACALAFARYGVRGIVIADLTLEAASAVAAECKSQATHPHFLAEAVAIDVTKEESVYQAIAYAHQVLGRIDYAVNSAGVSLPXPPNHQHTLIDIPCLVQVGVQLANEIAEASVSEFEKMFKVNVTGTFIVTRALSALMKTQDPVPVDEAVPARGVSRGSIVNVGSASGFVATPGMVQYTAAKHAVVGITKNAGKLGCWVTQSTVPALAIGXQKGSVPAFTDGSLPIALDNAKHGIRVNSVCPSWVDTPMIRKAMDDIPELGEMIQKAVPLGRIALAEEVADAVMFLSSPKASYATGCNMILDGGTT

SEQ ID NO: 3179 - protein, 305 aa, Neurospora crassa
LGFCTKNPPTPKEQAFKAMRAALESGANFWNAGEFYGSPDWNTQKLLAAYFKQYPEDAEKVVLSVKGAFLFPQMIPDCSPAGLKRSIDACLADLDGTHKIDIFEPARIDPKVPLEETLKYLEDEYVSKGIIGGIGLSEVSAATIRKAVKITKIAAVEVEISLWATHTLENGVAEACAEFGIPLIAYSPIGQGMLTGQIKTLDDLAADDFRRHYPRFYPENFHLNIQLVSELNELAKKKGYTPAQLAINWVKSLSKKPGYPTVIPIPGATTAERVKENNVDIDLTSEDLKKIDETLKKFEIAGRRY

SEQ ID NO: 3180 - protein, 472 aa, Neurospora crassa
TINNASSLPATGGSQSSEMPKTPGPSPLAVLPLTNVLRSWMTTTVSSSPFLLPPSLAVMSVLAHTTNPVLNPDRNPLLRAFLKKTFYAQFCAGENPAEVRQTIDSLKQIGFSGVILGYAREVVLTDSETKDLASCAAEGGAAAEECIRTEINPWAEGTMETVRLASPGDFVALKFTGAGRQALYSLSKQLPPSEALGSAIDGICNLAAERGVRLLFDAEQNALQPGIDDWTLDYMRRYNKSNAVVYGTYQAYLKSTPATLSKHLAIAASEGFTLGVKLVRGAYLGADPRYLICDTKADTDGQYDGIAEALLRKTWSGPLQPPVPQSGSAEKETTNFPDVGVVLATHNRESVLKGKALLDSGVAKLGYEQVAFAQLQGMADEVSCELVAGPHETPKEMEMAAEKESEKGSEKGSEMVNKPQVYKYLVWGSTGECMKYLLRRAYENRDAVQRTRSGREAMGREVRRRVKGLFGV

SEQ ID NO: 3181 - protein, 351 aa, Neurospora crassa
RFLPTGLIPGDGIGKEVIPAGRRILEALPASLGLKFEFIDLKAGWETFEQTGNALPEETVSILKSECDGALFGAVSSPTKAVKGYSSPIVALRKKLDLYANVRPVKSVRGPGVKPIDMVIVRENTEDLYVKEEKTYDTPEGKVAEAIKRISQRASSRIATIAGEIALRRQKIREGGSPSIHKGPLVTVTHKSNVLSQTDGLFRSTAREALAAGRFTSVAVEEQIVDSMVYKLFRQPEAYDVIVAPNLYGDILSDGAAALVGSLGLVPSANVGEGFAIGEPCHGSAPDIQGQNIANPIATLRSAALMLEFLNEEEAAAKIYAAVDANLEEGKLLSPDLGGKAKTEEVVQDIL

SEQ ID NO: 3182 - protein, 403 aa, Neurospora crassa
  unsure (1)..(403): unsure at all Xaa locations
RAGPTHQAILQNEQARGGYFATCAMGTPGQKVTLQLDTGSSDVWVPDSTASICNKGACDLGSCMXPAAPLYLRRRXCQLTNVLVDPSKSETYTVVGQGEFDISYVDGSSSKGDYFTDVFNIGGTTVTNLTMGLGAQTDIAYGLVGIGYAINEAIVGNSHSLSSQYPNLPVAMVDDGLINTIAYSLWLNDLGMYSACSRXHGRKADNVASHDAGEGSILFGGIDTKKYKGDLTRIRIYPSSNGYYFSFIVALTSLQAISPSGNDTLTSQEFPIPVVLDSGTTLSYLPQDIVDQIWQEVGAEYSDRLELAVIPCSKKSSNGYFSFGFAGPDGPRITVRMDELVLDLTSGDPPKYTSGPNKGQDVCEFGIQNSTSAPYLLGDTFLRSAYVVYDLVNNEIGLAETDF

SEQ ID NO: 3183 - protein, 637 aa, Neurospora crassa
KKLKKIPGQESKRYPGIHFSTQARLFSKINVSSLRDLILYIFADGPAPQWVSVKHRPEFRKIVAIMVPGLDEAMFKNGLDFSAYTGPTLDQAISGGGAPDPDEYYPRELKKELLPEVLQPFADMFPHLWPVKAPGDDKYGKLHSPMPAMLTAPLPKSKGTGIQPVSEPHGWKNQRTRITEFLATNEELMEHGFPVHPAMLNPGEKKDKFKDPEGWVHTRVENLEDGKVPEGEVQQGSVTAGREVYALDCEMCMTGEAEYSLTRISLVSWDGSVVLDELVKPDKPIIDYVTRFSGITKEMIDPINTTLKDIQARLLDILGPRSILLGHSLDSDLKALKLAHPFIVDTSLLFPHPRGLPLKQSLKYLAQKFLNREVQKGGGTNAGHDSIEDAKTCLDLVKRKCEKGKAWGAGESQGENLFKRLARAGTAYRSTAGPEATGGAPVGKSSAAVDWGDVSRSAGNAATVTISCKSDAEVEAGILRAVKGDPDGLEVPGGGVDFVWARMRELEALRGWWNRNKLVPEDAGGPPALTDGDKKEEEEEQEDAASPLETCLKTLGERLKRIYDNLPPCTAFIVYTGTGDPREMSRLQAMQAQFKKEYNTPGSKWDQLSVQWTDREDQALRRALKVARSGIGFIGVK

SEQ ID NO: 3184 - protein, 735 aa, Neurospora crassa
  unsure (1)..(735): unsure at all Xaa locations
MPSTFTDPAGVARDEPLYTVVHNDKKRVAYFYDSDIGNYAYVTGHPMKPHRIRLAHSLVMNYNVYKFLEVYVSLLCWGYWPWSTTNXPSLCXRAKPAVTAEMTQFHTDEYIEFLQKVTPDNMDGFMREQGKYNVGDDCPVFDGLFEFCGISAGGSMEGAARLNRDKCDIAINWAGGLHHAKKSEASGFCYVNGMWPSQFPGTRTTPPMLTYYTEQDIVLAILELLRFKKRVLYIDIDVHHGDGVEEAFYTTDRVMTVSFHKYGEYFPGTGELRDIGIGSGKNYAVNFPLRDGIDDTTYSSIFQPVISAVMQYFQPEAVVLQCGGDSLSGDRLGCFNLSMRGHANCVNYVRSFGLPTLVLGGGGYTMRNVARTWAYETGRLVGVEMNPVLPYNEYYDVSGLVPLWLAALLTNSXYYGPDYELDVRSSNMENANSPEYLEKIKISVIENLKKTAPVPSVQMQDVPRQGFGMSDDQEDELDDMDEDENKDVRRTQRQWEKERARQDEFEESDDEDMAQANGVFKPNGPQRRSILDFKNPKAVEDMDLDIGEPAPPSIAATAAAAAAKPAEPTAVDNDETMIDNDEAQPAAAEPEAEAPATTAAQPAVSSAAKVDEDGDVDMGEADEKPAEPEAEIKTEEIETAPAPEPEAERRPSPAAATAEPATEAAAAAAASPKAASPVPDANTEKPVAEEPSKVAEEASDKAPAATTDDKEKEADKPQEXDATPRTNTQYVXXLG

SEQ ID NO: 3185 - protein, 314 aa, Neurospora crassa
  unsure (1)..(314): unsure at all Xaa locations
LGSGQDNTNLIDNSETVYISSLALLKMLRHGRAGVPMEVMGLMLGEFVDDFTVRVVDVFAMPQSGTGVSVEAVDPVFQMNMMDMLRQTGRXEDTQLNLTFHHPLMYFPSQPEAVVGWYHSHPGFGCWLSSVDINTQQSFEQLNSRAVAVVIDPIQSVKGKVVIDAFRLINPQSLMLGQEPRQTTSNLGHLNKPSIQALIHGLNRHYYSIGINYRKTALEENMLMNLHKHVWTEALEMEDFRCEGSRTKERLDRLVSLADGYEKRVKEETELTKDQLKTRYVGKVDPKKHLEDVGQQLIEDNIVAVTRQMIDKEA

SEQ ID NO: 3186 - protein, 583 aa, Neurospora crassa
  unsure (1)..(583): unsure at all Xaa locations
GLSGRPLSLAVSTVATTGFLLFGYDQGVSAQSTPXVALDEAECXHTPNSVMSGIITAPAFNNFFTPTKDNSTMQGLITAIYEIGCLIGAMFVLWTGDLLGRRRNIMVGAFIMALGVIIQVTCQAGSNPFAQLFVGRVVMGIGNGMNTSTIPTYQGAFRLCQPLTDKKFXQILXPECSKTSNRGLLICIEGGVIAFGTLIAYWIDYGASYGPDDLVWRFPIAFQLLFAIFICVPMFYLPESPRWLLSHGRTQEADKVIAALRGYEIDGPETIQERNLIVDSLRASGGFGQKSTPFKALFTGGKTQHFRRLLLGSSSQFMQQVGGCNAVIYYFPILFQDSIGESHNMSMLLGGINMIVYSIFATVSWFAIERVGRRRLFLIGTVGQMLSMVIVFACLIPDDPMKARGAAVGLFTYIAFFGATWLPLPWLYPAEVNPIRTRGKANAVSTCSNWMFNFLIVMVTPIMVDKIGWGTYLFFAVMNGCFLPIIYFFYPETANRSLEEIDIIFAKGFVENMSYVTAAKELPHLTAEEIESYANKYGLVDRDSNGEGGNRHDEEKTRDRPDQSDSDSPAHVEIDVVDEHGVE

SEQ ID NO: 3187 - protein, 1068 aa, Neurospora crassa
  unsure (1)..(1068): unsure at all Xaa locations
NESVFRRNTLPPRTYHIPTENSLLLNGQWDFHYASSPLAAPDPTAENGHNSADKHNAKYQWTTIQVPGHWQLQGHGIPHYTNVQYPFPVCPPFVPSENPTGTYRRSFFVPDTCETDQLRLRFDGVDSAYHIWINGVLIGYAQGSRNPSEFDVTEYVDRAGPNELVVRVYQWSDGSYIEDQDQWWLSGIFRDVHLLAFPQTRIEHWFLRTDLDVEYKNGILIAEIDVKTNSRSVIEVEVLDHNQDIVGCAEDWGFGSRKVMLRIPINNVDQWTAESPNLYTVRIEHVVDETLFHVVKQRVGFRKVELKDGLICVNGKPIRFRGVNRHDHHPSFGRAVPLDFIRKDLLLMKRHNINALRCSHYPSHPKLLDLADELGLWVIDEADLECHGFYDAIARPLNIPEEVDYEERKKLTFGHAAKFTSDNPSWKAAYLDRMAQLIHRDKNHASVIIWSLGNEAFYGQNHKAMYELAKDIDPTRLVHYEGDPHAESADMFSYMYPSVERLVSLAKTEGVRSDGTFEKPIVLCEYAHAMGNGPGWLEDYEEAFRAYPRLQGGFIWEWANHGLWKEDPDGKSYYAYGGDFGDVPNDGTFVMDGLLYSTHQPTPGLLELQKVYQPIKAELIDYSDVACKLRITNSYDFVSVNHLTATWKVESFMNTTRXSPVNFPLTNLTPRHXQICIPXYHLAXRWRHGTATYTPTIIKEHRAESKATIAVTSTYVVSVSFRLKSSTAWAEEGHEVAWAQFELGSDDGFSHGSTFFYLPSLTNLPLRSESSGTLTTITGHNFTINFDNAKGYMTSWTTGGTPLLEPNPRTGAAIIPSFWRPPTDNDNPISLPYWKRFGVHAMTSQLRFFDVTATAKMVVITTRTLHSPPILSWGYLVHTVYEITKIGDIHISVTLKPQSSDYVNTLPAHVPRVGLDLRLSRRLDAVKWFGLGPGESYPDKRTAQRLGIWSVDHVADLQTPYEVPQENGNRMGTRWVAIHEPQGTGLRAIAGDDGEWSDKCERNFSFVATRHSAKALEEAKHPCDLVEEDATLLRLDAKVAGVGTAACGPGVREDLLVKVEEMKFSFVL

SEQ ID NO: 3188 - protein, 581 aa, Neurospora crassa
TSTCSLSITPYQPVNMAHSINEKEAMGAHDDAFPESDITVQLAHDVDNTKYSPWSKSMFRLYLVLACAYLCGCLNGYDGSLMGGLNGMKAYQNYFHMYVSSAKTPISDTSANLLGSSRSTAGSGTGLVFAMYNIGSVAAVFFTAPVNDWFGRRWGMFTGALVIIIGTCVQATTHTKSQFLGGRFVLGFGVSFCCVSAPCYVSEMAHPKWRGTLTGLYNTTWYIGSIIASWVVYGCSYIENNKDAWRIPIWCQMITSGIVCLGVFWLPESPRWLVAQDRYEEAAKILATYHGEGRLDHPLVQLQLKEMANQISSEASDKKWYDYHELWNTHSARRRLICVLGMACFGQVSGNSLSSYYMVNMLKSAGITDEHKVLALNGINPALSLIGAVMGARMTDVVGRRPLLLYTIVFSSTCFAIMTGTSKLAMPGHVGNLDDADTQALTPSQRAAANTTIAFIFIFGIVFSFGWTALQSMYIAETLPTATRAKGTAVGNFVSAASSVVLQYSSGPAFEKIGYYFYLVFVFWDLIEGVLIFFYFPETKDRTLEELEEVFSAPNPVKKSLEKRSAQTVLNTMGAPDDEKV

SEQ ID NO: 3189 - protein, 542 aa, Neurospora crassa
  unsure (1)..(542): unsure at all Xaa locations
SKESIHLYFAIFVAFCCACANGYDGSLMTGIIAMDKFQNQFHTGXHWSXSLCHLFSLYRVSDXGFSKSLLFGLGLFXHLESSSGAMVGAPFAAILSDRFGRKKGMFIGGIFIIVGSIIVASSSKLAQFVVGRFVLGLGIAIMTVAAPAYSIEIAPPHWRGRCTGFYNCGWFGGSIPAACITYGCYFIKSNWSWRIPLILQAFTCLIVMSSVFFLPESPRFLFANGRDAEAVAFLVKYHGNGDPNSKLVLLETEEMRDGIRTDGVDKVWWDYRPLFMTHSGRWRMAQVLMISIFGQFSGNGLGYFNTVIFKNIGVTSTSQQLAYNILNSVISAIGALTAVSMTDRMPRRAVLIIGTFMCAAALATNSGLSATLDKQTQRGTQINLNQGMNEQDAKDNAYLHVDSNYAKGALAAYFLFNVIFSFTYTPLQGVIPTEALETTIRGKGLALSGFIVNAMGFINQFAGPIALHNIGYKYIFVFVGWDLIETVAWYFFGYVLGLLLCRHRVNSTQIANSFHYSVESQGRTLEQLEWVYDQPNPVKASL

SEQ ID NO: 3190 - protein, 579 aa, Neurospora crassa
  unsure (1)..(579): unsure at all Xaa locations
MATVLPPPSKRQKREEIERTTTQLDVAPILAPELGSFKANFVDSDGNQMTDVIEINFADATEKNISVLLNTLLERDREEFTPYRFRIHIPGKDIIVDQYPSDLLGLLKQHGVENPFEYARPGHRKPSTXLLRXPPHRTTITLSAEPQAVFRVQAVSRLAHRIPGHGQPILAAQFSPISSGRLATGSGDNTARIWDTNTGTPKHTLKGHTGWVLGVSWRPDGEQLATCSMDGTVRIWDPEAGKPVGQPFKGHAKWVLMTAWQPYHLWRDGTPRIASASKDGTCRIWVVNTGRTEHVLSGHRSSVACVRWGGTDLIYTGSHDKVVRVFDAVKGTLVHSLTSHAHWINHIGLSSDHALRTAYFDHTKDVPSTEEGRREKAKERFERAAKINGKVAERIVSASDDFTMYLWDPTNNGTKPVARLLGHQNKVNQVQFSPDGTLIASVGWDNSVKLWNARDGKFLKSLRGHVATREFLTHIHLLPRGESSNALILQVYQCSWSADSRLLITASKDTTLKAWNVRTGTLAMDLPGHEDEVCEPNHGDIGVPTAGKFXLASRVYAVDWSPDGKMVGSGGKDKAVRTW

SEQ ID NO: 3191 - protein, 798 aa, Neurospora crassa
RSSPTWGGRPDQPMSRANSPPPPSLINSSRALNQKAREMGRQGITQPRSLVRSESHDRVFAHADWKIVSADQGNGGLRNAAEAAARDGKLGEYTWIGTLGMPTDALRGTQQLQDIDDRLATEHDMLAVFCSDKDFDGHYSHFCKQILWPVFHYQIPDNPKSKAYEDHSWKYYVNVNQAFADKIVKNWKKGDTVWIHDYHLLLVPGMIRKKIPEAKIGFFLHVAFPSSEVFRCLAVRKELLEGMLGANLIGFQIREYARHFLQTCSRILSVEATPDGLQLEDRFVDVINLPIGIDPVSLSRHRGESEVKRWLDIMRERYAGKKLIVARDKLDHVRGVRQKLLSYEMFLNMNPEWRDKVVLIQVALSTSEKSELDATVSDIVTRVNSSWANLAYQPVVYLKQDIDYAQYLALLSIADALMITSQREGMNLTSHEYLFCQDGKFSEKKHGSLILSEFTGTSSLFNGNELSVNPWDYRACADAIKKALEMEGEEKERRWKNLYEAVNVHTGSHWFSEFMLRLDKVYEEQHSRDQTAVPRLSMTTLLQQYERTNRRLFIIDFEGTLVSWGPVNQIIPVSPQRTLDVLNDLLLDERNTIYVMSGRRPEELDRIFRRVTNLGLIAESGCYLKDCGSNTWTEMADANKIRSWKSSLRDIMTYYLERTPGAAIEERRCSLVFHYKSADDYETAATQASDLASHINDACEDQRVHAIPMDGCVLVEPIDWTKSTAAQTIFDDLQQRMGPDEKHKSPVDFLMVVGDGRDDEKVFKWANQLGTDGTVQEVVTVSLGNRNTEAKATVTQGV

SEQ ID NO: 3192 - protein, 1085 aa, Neurospora crassa
  unsure (1)..(1085): unsure at all Xaa locations
PSVQNVHPSPLGTTSSSSYHRYRGEEQGNGRGASIPKAKYSSRAPLRDLKECSGTTPSSREMSSPVISQSSWRSSTSKSFSQRDTSETTLRLPRTLLYDRISKTQAMSTRSTLPTPVLSDSDSDSDAEESSLEKRHRLVGSSLIITPQKESAPTVSSEEKDHAICAISESRSAEVVGIAVINITTGQVDLARILNDDKYLYQRLGDTLWKMSSKPEKFLVVNSVTTNSSKSLLISCLEQDFPEVPIVLWGREHWSEAEGLRMIERFALRDHVIALNSDLENNFYTPCAFSAVVIGVIVEIRLLANYIKVMKYVQNELNIHFASNALRIRYIQPLNTMGIDRTTVASLELLQNTRRATAKNSTLFGILNSTKTPQGHRLLRTTLLQPSTNKEEVIERYESVEELSTNEDLFRELRKALEELVRIDFERVIVWVSCFXHSQSLXMLILPKISQEQPNPRQPLEEGVPGCTNQGLLLPTHAELTKAEQELNSILMLKKYLSGIDALHGTLEAAGCKSRLLRWIRDRFAPEHTEPVQRAMEEMIEDDAAYSKKPIELRNNRMWAVRVSHFAWFSFTGLTAIRQAVRNSVLGKARRLFTALTNDLNEYFDVLDNQFNGRSISLHQDYYHXRSSEVLGTRANLHMDSNRRYWLRFDYSDVEREIQPQSDVQKGNSGEVSHWKQVSIAGLEMINGTRDKRHFKCQTTELLQRSRAIQLQADIATMQSDRLVIELKRRLQEHSSLMFDISDAIALLDMLSSFTQAATTQDYVRPMITDSMVIKQARHPIVEARTDQYVANDVYSGDQSGRFQVITGGNMSGKSTFIRSVALIQIMAQMGSFVPAQFASISICDRVFARVSTDDAPENNLGTFGVEMRETNAILRYPFLPYNMSEXLIXWDVXTSHSQSMIIMDELGRGTSPKDGQALAIAIVEKLIKMKPRVFFATHFTRIRRFKGCLSSLIHCXSQSYPAQLLNKIYPRDVLNVHFQGQSQAVGQITQITLPHTLAGGPVQNEDYGIELARCVLPGSIVNTAEEVLKALREGQKPQQSGEKGREARQRKLTLALPVVMKQALDSTMDDAALGSYLRRLQTEF

SEQ ID NO: 3193 - protein, 338 aa, Neurospora crassa
LNLLEKLQYAQLDNVKLPQIVVVGDQSAGKSSVLEALTGIPFPREAGACTRFATEIRLRRSPESSITVSIIPDRNRPSSEQEQLLEFGRLINSSSPFDLTVMGAAELIAPKGVPGRFAARDILVVEKKGPDMPLLTLVDLPGLVRNPNKDQSLEDIHIIEALSDRYMRSPRTIILAVVGGNSDYVQAPILTKARHFDPNGTRTIGVLTKPDLTDSIGLEDKFVELVKNNDRRNHFRLGWYVLLNPGPRTEGETWPSAEQRRSTERDFFSKGKWSSLPASMCGASALKQRLSLQLQQHIGRHVNALRRQIQKALDDCDAELKSLGTAKSTPEEMRLELI

SEQ ID NO: 3194 - protein, 399 aa, Neurospora crassa
  unsure (1)..(399): unsure at all Xaa locations
PLQRLARAVAQPTPRLARGFASVQDTPAQTLQSDIFKPTKYGGKYTVTLIPGDGIGAEVAESVKTVFKADNVPITWEQIEVSGVQDNASRTEEAFQQAVASLRRNKLGLKGILHTPISRSGHQSFNVAMRQELDIYASISLVKNLPGLQTRHKDVDLCIIRENTEGEYSGLEHQSVDGVVESLKIITRAKSERITKFAFQFALANQRKKVTCIHKANIMKLADGLFRGTFNRLAKDFPQLECNDMIVDNASMQCVSKPQQFDVMVMPNLYGGILSNIAAALVGGPGVVPGCNMGRDVAVFEPGCRHVGLDIQGKDQANPTALLLSGTMLLRHLGLDDHANRISNAVYDVIAQGXVLLPLRLYXKHVLTPSQQGRTRDMGGEASTHEFTRAILDSMEKSL

SEQ ID NO: 3195 - protein, 323 aa, Neurospora crassa
  unsure (1)..(323): unsure at all Xaa locations
AYXSLYSKPSVDKRSGQAVAIKVIDIESAEDEVEDIIQEIAILSELQSPYVTKYYGSYAKGAELWIVMEFCSGGSCADLMKPGLIGEDYIAIIVRELLLGLDYLHQDKKLHRDVKGKGQQLANAHVPLNSLCXPLVAANILLAANGQVKLADFGVSGQLSATMTKKNTFVGTPFWMAPEVIKQSGYDHKADIWSLGITALELAKGEPPYADIHPMKVLFLIPKNPPPRLEGNFSKGFKDFIELCLQRDPKERPTARELLKHPFIRRAKKTSYLTELIERYNRWAATHKQDDEEYHEPEENNYVEQRKHINEDMWDFGTVRLVS

SEQ ID NO: 3196 - protein, 385 aa, Neurospora crassa
  unsure (1)..(385): unsure at all Xaa locations
MATPIPVQILDGGMGTTLEDMHDITFSFETPLWSSHLLVSGEEDKLSDCHEAFKQAGANIISTATYQISINGFAATKAPRSGTVDEEREGIEKEEIPRFLSRAVVLAANAAGTEGKVALSLGPYGATMIPSTEYSGRYDPEHQHVQALGKWHKERLDLFKDVDPNQVNYIAFETVPRLDEIVAIRNLLSADNIPTSLRGRPVWISSPYPNDDGKLPDGSTVEEVVKAVLTHREGLETPWGIGINCTKVEKLDSLVKRYEDAIQTCIKNGEQMAWPSLVLYPDGTKGEVYNTATKTWELSPGHKETEVRCDLPLFTGPLVHTPTLTSFKQAPWETVLASVVEAARQRGNWKSIVVGGCCKASPEHIRRLRRTLQDYGHMSTSPAAX

SEQ ID NO: 3197 - protein, 413 aa, Neurospora crassa
  unsure (1)..(413): unsure at all Xaa locations
MKATILASTFAAGALAQSGAWGQCGGNGWSGATSCISGYACNYVNDWYSQCQPGTAAPTTTAAATTLVTSTKTAPPASTTTATASGKFKWFGVNEAGGEFGDGIFPGRWGTEFTFPDTNTIQVCHLPLLSRYVCGSGYXPRLALXTLRSQGYNIFRVGFAMERLVPNTLTSSFDNGYLTNLTQVVNSVTNSGAYIVLDPHNYGRYYGKIITDTDAFKTFWQNVAAKFASNSKVIFDTNNEYNTMDQTLVLNLNQAAIDGIRAAGATSQYIFVEGNQWTGAWSWNVTNTNLAALTDPENKIVYEMHQYLDSDSSGTSTACVSSEIGVQRIVGATAWLRANGKKGVLGEFAGGANSVCKAAVTGLLEHLKANTDVWEGALWWAAGPWWGDYMYSFEPPSGTGYTYYNSLLKTYTP

SEQ ID NO: 3198 - protein, 398 aa, Neurospora crassa
TVNNFIKKHKVTVIGSGNWGTTVAKLVAENCAEHPDTFEKDVQMWVYEENVTLPKDSKHFDASIGEQPQKLTHILNTYHENVKYLPGIPLPHNLVANPSLVDAVKDSSILIFNLPHEFIGNICRQIKDHIAPYARGISCIKGVSVTDDKIELICNYVSDALNIYCGALSGANIASEIANEQWCETTIAYNTPLVDRRDENGRPVGNGESNDHTKQLTPLPLDYPPLDHDEWSLLFSRPYFTVSMVSDIVGVSLAGALKNIVAIACGYVEGHGWNMTAKTAVMRRGMQEIIRFANEFFPGQIEPRTFWEESAGWGDMIVSCTSARNWRCSKLAVERNLPIEEVEKTELNGQKLQGISTTREVSSFLRAKGAEERYPVFMAVERIIDQEIKVEEIPKLFK

SEQ ID NO: 3199 - protein, 510 aa, Neurospora crassa
  unsure (1)..(510): unsure at all Xaa locations
IGTGLFVGSGGILATVGPAPLWLAYLSMMLLVWIVMNCIGEMCTYLPLRGITLPYFTERFVDASLGFAAGWNYWXVSFGSKGTKCSVQLTPWLLGYAYAILVAAEASAGAILLNYWETPVPTWAWITIILVVNLVLNIIAVEVFGEAEFWFASIKFITIMGLIIVGLVIMLGGGPNHKRLGFHYWNDPGAFKEYLAPGATGRFAAYWTAFVRAGFSFITSPELIGLAAGETVAPRRNIPKAARRFLGRLAVFYGISSLIVGCIVPSDNKNLLSGTSDASASPWVIGIQLAGIGGLNHVINAAILTSAWSAGNAFLYSGSRILYSLAQNGQAPAIFTRTTRRGVPYTAVLMTWAFSLLAYLNVSNNGAQVFTWFSNLSTISGYIGWIVLLITYLRFRQALKVQGLLATLPFKTPGQPYAAWFALVMISILTLTNGFQVFVKWNYKDFLAAYITLPAFLVLYFGHKIWHRTPFHKPAVEIDVLTGKKEMDDMCANDVDPVPRNWLEKIWFWI

SEQ ID NO: 3200 - protein, 308 aa, Neurospora crassa
QSIKVAIVGAGSVGVTTAYALLLSHLAAEIVLIDIDKNRALGEVMDLSHAAHFAHAKVSVGEYENCAGATAVIITAGVNQKPGQTRMDLVKTNYGLFEQIVPQIAKHAPNTILIVATNPCDVLTKAAYELSGFPVQRVIGSGTAMDTTRFRHELGKHYGVNPRNVHAVIVGEHGDSQLPVWSLASIAGMRLEDYCKQKGIAYDEDAMDALSKRTREAAYEIIQRKGKTNYGVASVLVSILEPIITNADQLVTVSRVGDYAGVEGVALSMPCKLNSKGAHQDVELLLNEKEKEALRRSATSIKECFDTV

SEQ ID NO: 3201 - protein, 456 aa, Neurospora crassa
HSASKEDVVSAVELAHDTYKSGVWSRAPRHVRAEVLERAASLFETHLAALIDIEVTQTGRAIREMNAQVPSLVKWFRYYAALLRTEERSVLPTVGKLHNFLDRRPLGVVVQITPFNHPLLIAVKKLAPALAAGNSVLLKPSELTPITSLMLGKIMKEAGLPDGVLSVLPGYGATTGKALVEHPLVKKVDVTGGTAAGRAIGEIVGRNLAKYTAELGGKAPLVVFQDADLDAAVNGIAFGAFIASGQTCVAATRIIVHESIYSEVLQKLTTRATSIERRMGSPKNPECMMGPLISERQLKNVEELVDEACLYHERIVQAGGNRLEGRSELDDTDFSKGYYFPPTILAYNKPKDRSILNARIWREEAFGPVVVVVGFSTEEEAIELANDSEFGLGAAIWTRDLAQAFRVSEQIDAGIVWVNTHHRNDPSSPWGGAKSSSGVGSENGIDAYHAYTKTKS

SEQ ID NO: 3202 - protein, 1140 aa, Neurospora crassa
  unsure (1)..(1140): unsure at all Xaa locations
INKKVTPPLQKLSKITSSNPIHTIVLVALLASSSYIGLLQNSLFNVTRSVRKAEWESLQAGSRMLRAGANTEWNWQNHDPEAPVPANANHLALLTLVFPDTAESGPVVAQTNTVPIPSNLSITPLPSTAISFTYSQDSALAFSLPYSQAPEFLANAQEIPNAVSSQETIETERGHEKKMWIMKAARVQTRSSIVKWVQNAWVEFTDLLRNAETLDIIIMALGYISMHLTFVSLFLSMRRMGSNFWLATSVIFSSIFAFLFGLLVTTKLGVPMNMVLLSEGLPFLVVTIGFEKNIVLTRAVLSHAIDHRRPTEKSGKPSKQADSAHSIQSAIQLAIKEKGFDIVKDYAIEAGILVLGAASGVQGGLQQFCFLAAWILFFDCILLFSFYTAILCIKLEINRIKRHVQMRKALEEDGVSRRVAEKVAQSNDWPRADGKDQPGTTIFGRQLKSTHIPKFKVMMVTGFVLINVLNLCTIPFRSANSISSISSWARGLGGVVTPPPVDPFKVASNGLDIILEAARADGRETIVTVLTPIRYELEYPSIHYDLPQKSAEVEGGDYANLGGYGGRMVGSILKSLEDPILSKWIVVALALSVALNGYLFNAARWGIKDPNVPDHPINPKELDEAQKFNDTASATLPLGEYMKPTAPSSPVAPLTPSSTDDENDAQAKENRAVTLAAQRATTIRSQGELDKMLAEKRTHELNDEEIVHLSLKGKIPGYALEKTLKDFTRAVKVRRSIISRTKATTELTNILDRSKLPYQNYNWAQVHGACCENVIGYMPLPVGVAGPLVIDGQSFFVPMATTEGVLVASTSRGCKAINSGGGAVTVLTADGMTRGPCVQFETLERAGAAKLWLDSEKGQSIMKKAFNSTSRFARLETMKTAMAGTNLYIRFKTTTGDAMGMNMISKGVEHALSVMYNEGFEDMNIVSLSGNYCTDKKAAAINWIDGRGKSVVAEAIIPADVVKNVLKTDVDTLVELNVNKNLIGSAMAGSMGGFNAHAANIVAAIFLATGQDPAQVVESANCITLMRKXVSIPLDKLEMHDXHIHSLRGNLQISVSMPSIEVGTLGGGTILEPQSAMLDMLGVRGPHPTNPGENARRLARIVAAAVLAGELSLCSALAAGHLVKAHMAHNRSAPPTRTST

SEQ ID NO: 3203 - protein, 576 aa, Neurospora crassa
RTVIGITFGNSNSSIACTVDDKAEVIANEDGGTCHTLSFPHAAAPNKLSSYDRQIPTILSYVDGDEYYGQQAKNFLVRNPKNTVAYFKDFLGKDFAAVDPTHNHASAHPEDADGTVAFTVQEKEEGEASKLSVSEVSTRYLRRLIEAASEYLGKKVTSAVMTVPTNFSDKQKEALLAAAAAANLEVLQLINEPVAAALAYDARAETEVQDKIVVVADLGGTRSDVAVVASRSGMYTILATVHDYDFHGTALDKVLIDHFSKEFIKKHQVDPRENARSLAKLKAEAESTKKALSLSTNASFSVESLANGIDFTSSINRLRYETIARSVFEGFTRLVDSAVKKAGLDALDIDEVILSGGTSHTPRIAANLGYLFPQTTKILAPSTTPAAINPSELNARGAALQASLIQEYEAEDIDQSTHAAVTTVPHVTNAIGVISLNEAGEEVFVPVIAPETAVPARRTIHVAAPKDGGDVLVKIAEGNTHIKVTKPEPKVKDESKAAKVEDADEEGDDSDFSDDEEEEEEEKREKVWKIGSTLAEAAVRGVKKGGKVEVTILVDANLSVTVTTREVGAKTGVRGT

SEQ ID NO: 3204 - protein, 330 aa, Neurospora crassa
DLRVGNKYRIGRKIGSGSFGDIYLGTNIISGEEIAIKLESVKAKHPQLEYEARVYKSLAGGVGIPFVRWFGTECDYNAMVLDLLGPSLEDLFNFCNRKFSLKTVLLLADQLISRIEYIHAKSFIHRDIKPDNFLMGIGKRGNQVNVIDFGLAKKYRDPKTHFHIPYRENKNLTGTARYASINTHLGVEQSRRDDMESLGYVMLYFCRGSLPWQGLKAATKKQKYDRIMEKKMTTPTEVLCRGFPNEFAIYLNYTRSLRFDDKPDYSYLRKIFRDLFVREGFQYDYVFDWTVYKYQKNAQAIQQAAGNSSQPQPADSKEAAQAAARKDPQQ

SEQ ID NO: 3205 - protein, 342 aa, Neurospora crassa
  unsure (1)..(342): unsure at all Xaa locations
GTFARVVLVRPANGTEIDRQKVYALKILRKTEGXFRLGCFQTRKMPGVRITNRWLQVIRLKQIDHVRHERQILQDVTGHPFITSLQASFSDHDFLYLLLDYIPGGELFTYLRKYRRFDEEMARFYAAEIVLVLEYLHEEQGGIAYRDMKPENLLLDADGHIKLVDFGFAKRLGYNDVERPVETYTLCGTPEYLAPEVIQNKGHTTAVDWWALGILIYEFLTGYPPFYHNNPLEIYRQXVIPNLSCCSRRKSTVTKTQVRIVEKPVLFPSSTEISEEAKDIIRSFCTVDRTMRLGNMSGGAARVKAHPWFKGVDWEAVEQRRHKGPIIPHLSHPGDASCFDVY

SEQ ID NO: 3206 - protein, 588 aa, Neurospora crassa
  unsure (1)..(588): unsure at all Xaa locations
QPDPPDSVTIGEFMKNEVYGRRPIDKSKNPWTCGLTGKTYTVKQAFERTELLAKALHKLMGWEPNADLPWDKVICVFSYNTIDYISVLHSVHRLSGIATPANVAYNASELEHQLRSSGAKCLFTCLPVLETALQAAKAVGIPEDRIFLMELPHHSKKLPYKTVDDLVELGRSVPDLEPLQWTKGQGARQVAFLCFSSGTSGLPKAVMVSHRNVIANTMQISLFEDYGRKKKGVKTQVELGLLPFSHIYGLVVVAHCAPWRGDEVIVLPKFEFNEFLQAIERFKINYLPLVPPIIVRMLSSRDTVKKFDLSSVRHVFTGAAPLGKETQDELRKLLPKWKVGQGYGLTETATVVSATSEHDIVQGTSGSLVPGAKVKLVDQDGREVTEYGKPGELLVQSPSVTLGYLNNERATSETYVFDEDGRWMRTGDEVIVTKSPAGYEHITVVDRLKELIKVKGTYSNFHRTPKLWGPSTDIXCFQGHQVAPAELEAHLLSHPAVDDCAVIAVHDDRDGEVPKAFVVTPASMSSRPDAEIAAEIIKHVQEHKAHYKWLKGGVEFIDAIPKSPSGKILRRLLRDKDREARRAQGAKL

SEQ ID NO: 3207 - protein, 1242 aa, Neurospora crassa
  unsure (1)..(1242): unsure at all Xaa locations
AVVTATDNEMPPSPTSSAPPRPPADRIPXLPPSHPLXCTSTRAEPIPCRPRREPPCRDRRNSAPHRPADPEEEAVDQGKEEAMVTPGRALTRMDTARASAPSPPDSKFPLLSTYNNNKRRDDPLLAAYPPQHAPRGDSVRADSLRGPAPQGFYNNASRSPAQAYYNQPGGRPAPALNSDPYRSQSLASVPRPQMYQGSTPQQSPANAFRQAQYTGSSARTTAQGRIVPERHMEDRAMSMTGYPSYDRDAHQTPSGRVIPNRRAPGSSPDHGPAPSQYPAPGSQSGRTVSITSTTTVDPNGRTMSMASTIAPSIAPTERNEDGTLVHRYSGGASSMTGDRPVTVKIRMPLVYPALLSRVAETFRRKIVVGDRTKNELTYKNAFSGAEAVDVLSYIIRTTDRNLALLLGRALDAQKFFHDVTYEHRLRDSTYEMYQFRETLTDDEKPAVNGVFVLLSECYSPTCTPDQLCYSIACPRRLEQMAKLNLKGGIGLKQEGKAAVNDDDVDQTDEQKLWINSVPKEIADSIGDREKKRQEVISEICYTERDFVKDLEYLRDFWIYPLKGKINGHSPIPLQRRERVVRTIFTNIIDPPSIHGVSSKFAKSLTERQQKTPVVQNIGDIFLEFVPQFEPFILYGAKQLEGKFEFENERSINKDFARFVDEVERRRESRKLELNGYLTKPTTRLARYPLLLENVLKYTEEGNPDKEDLPKVLTMIRDLLSRVNAESGKAENRFNLRRLHEQLKFRPNDKMDLKLTDEGRELVYKAQFKKSPTENADLTAFLFDHAVLLVKIKQVGKTEEIKAYRRPIPLELLSIKEMEEIIPSGAVKRSSSSLLPALRTTTDAKKGDGWPITFRHLGKNGYELTVYASNQAGRQKWLEFIDAAQQQLRARADFLNTTIISYGYFAGPNKVNCATPFGKHFRTAQSSIRALVLTKIQMGGRKIIYGTDQGIFVSDRKTKEIPPKRVIDVQNVTQVDVLEEYSLLLVLSNKSLYSYQLDALNPNEPISSKRGKKIQSHCNFFKIGICLGRHLVCAVKSSALSTTIKVYEPNDAMSGAKKQRGLSKMFNAGQDELRPFKEFYIPTESSSVHFLKSKLCVACARGFEVVSLETLETQSLLDQADTSLDFVQRKEGVKPIHIERLNGEFLLNYSEFSFFVNRNGWRARPEWRLDWEGTPQAFALSYPWILAFEPNFIELRNIDNLAVHIVPHKNIRMLHSSTHEVSLNLNVIYDGHLEANTTARFCS

SEQ ID NO: 3208 - protein, 282 aa, Neurospora crassa
  unsure (1)..(282): unsure at all Xaa locations
MAEIMADSELAPKFAPFIGMVRQQQSRNHPSPVANKVQLGXEGTSPRNRHSTRTMSRPTNNVLSYQAGIAAAMIFGSTLLPNPNLTPYQHHKRXPCRFQLYRAGAAYGTAKSGIGIAGVGTFRPDLIMKVSSPLATWLXYSYAETNMLSYDRXCLIPVVMSGIIAVYALVVAVLIAQDLGPPGSGQHYSLFKTFHDRRRLWVYRLRLWMSHILXRAQLTVGSHHSGFMHLACGLSVGLTGLAAGYCIGIVGDKGVRSFMLQSRIFVGMVLILIFGEVLGLYG

SEQ ID NO: 3209 - protein, 1361 aa, Neurospora crassa
RRNQEVDGGTQRKDQELEHRINDLKAELKQDRAEFDKKKALLEGEVATLQGKVDDKSSKLSSKEAEFNELKKLNEAQIAELRKDVADKSNSLQDKLEELSDLKGQQKTRIEDFNVQINEKMAQLLKAQNELKASQASLNTTTTEYDAKIAQLEKSLKEKKDELKRKEGAATSSTEQNTVQLNKLNDDVKDKQKKLDEQQAELNNLKTKHQAETTDLNQTIKDTKAKLKQKETELIDLKKKHKDRLDTLEKTIAEKQTTLAQKETELENLKAQNRTNMMNTNREIGDKTAELLKKEGELRDLRQKYDDAQKLADGSKEKDLAIAQYKQIIATKTSELEKAKKDVAALTKDVNDQKARIKDLESSVSSKRADLKKKETEISDLKRQYEENIKRLNNDLSSQKATLTAKENEIAALKSGNASRLSRDIQEKASELAQKNQLVANLKVQLDGLQKKQNDLLQKGSDAAKLQADVDSLNKKISEKRQKVTELEGKVNKLDSELAEEKARVSRRDREITDLKKDVSDEKARTTKRDREITDLKKDVSDEKARVSRRDREVTDLKKDVSDEKARTTKHDNEIGGLQSKLDAKQASKEMLEQDIKDLKAKQEKEVASLTSQILAKSKEIVGYERDLSSLKADYQKETTKLKNEISQKEKELAEIQKTNKKLNADIKEKEATLTASQAKVKDLNREVQQKKDQIKDFEAQNAKLQIDIENKKAEIERIKEERRTLNTEADKSIARIEGLERKIKELTGSSAEKEAQMKQYQADLAAKAETEARIKQLERDLATKSNSLAEFEKKYKRANMDANNYRSSLAHTQGEVAKLEEEIKTTKGDVQYWEDQMIMNQEETQKIQDQVDRLKMDVKDKNKILEDHEKEIQTLKDTATRLSQDLIHKKSELEGSNSELQRVKNQVAQLTQDNKDQRVVVDTKDGEIRKLQREVDDLNTHVMDKGDQLMKRGEDIKKLRDEIKNFKKDISDHETTLEETMAEIEKLSADNKQLTAEISSYKDKLKQSQTEADALNNDIKDMKSTKEKLGQDAKAKETVLAEKMKEIQGLKDSINRLNQDISTKNATLDDKREIIDQLKDDIKTANSTIDTLRKDVKDKDAILAHKTKDVVARDAELAKLKAEIASKNAALAKKTEEAKAFEKNVQTLTDQAKGLNQDVATKTTQLAQDRATISKLNKDIFDLKTDVTKLKQELSTKDANLTQKAGEIGSRDAGLAKLREELRAKEAALAKKTEEASSLEKNVKKLTDEATGLKKDVTSRDTQLAQDKDAISKLEKDIAKLNQELSTKDASLTQKTGEVGSKNAELAKLREEIRVKETALAKKTEELKGLNQSVDAKDTQLAQDKIKIERLEKEVKGLTA

SEQ ID NO: 3210 - protein, 1015 aa, Neurospora crassa
NPFTFSPFTSQEGHRADNEAAIEEYDRLRDDNEGKTDPTRPLKYKPYDEGTLRDTRFMVAQLSQYKDHAIAVLDNKVDRHSMLRTYIEKAGEPAIRKAFNTLLEYYDQASKTKMRLLREFRALQIKVDDDKLAKEEVETYLAQAEKRLHDQEKSEFDTYQQLMDEKKKRSMDEHELQKLRDFKQDADRQRLAAVALATHASEAKIKGLEERVDELQFIDQQREADIEHWRQVQTDLKKKEDSLSRLQEEATRKTEQADQMSESLNRTLNDIMDTAAALGVPIKGGADPHDIGATILEVFDNILNLYEDTEQRLVQTEEAKDKAEAAAKESATRSRSETIQKLTSENNKLKEQRDEQKRKADAFYQKLKKKGWLEPTEDPSASLALDQKSLKDQQDRWESEKNALNQKITNLNKSIEEANVALKDMKLMQVERDSLVDLQQRQEGDIKSLNQQVLDLKQKLASKASAGADLKDIQSLRLENKSLEDQRQRVQAEKEVLQQQLSQTKARLEKVETTLKNTASQKMDLETQRNEWSKAKKVLEEEISRLKKEVDLARKNSAAPTIVEIKPEPNIAESITRVEQLMKEQKPQLPLTARDFVQGLVAKLKDAQGHKDLDASEDVIRECIGLLNRVLKEPVFDEKDKEMLQTLQNELNEALRKGKEDREQSAQLQSIIDKYEGEKESLEKEVKVHKDEIKKLKQEITEKKTSLANKQQERDMLKESYEEQIKNLNADHKKAAAELKVKHQNELTQLRKDGDLKETNLLQKLDTLRQQNESERNRLQADYAAEKAKLTKDIEAQKKLVAQKEKDLAELKSKKEKEIKELTQKKDVEIATLKSTKQVDMEQLKNRHLQETEILRKQHQSRVGELESEIATIKEKYKKDLDELSRNNTSQDAIKLKQHENELANFKAKYEQEKKQLAVQHKTEMESLTDRYHEKEKLATQYQERVQALSAELADKKTALAEYKEQLSASKAQLDKLKADHGVKVDELQAKLKSEVAKVTADYEGNLSELRTKHQ

SEQ ID NO: 3211 - protein, 928 aa, Neurospora crassa
  unsure (1)..(928): unsure at all Xaa locations
EPFSFASSDQLNYPVSIRIMSLEGEETPIPFSTLLERPDLRHVGSNQRYTRLFLVVREDGYXITSHSPHSDLYVTVQVWAGSKPLTVPVQTPYKWFRNERKWSEWLTLPIDYSTLPENARLAITLWDLSPTGGEGAHGHAIPFGGTTLPLFDKDNQLYKGRQQCFVYRHKQADGNDDTGTPAFIPRRSGVGSSKKGTPSSIVDNDAEEYDRLMDLLKKHEMGEIPRVDWLDQLAFRVIEKRGYGSAKSSLRLKAIQRQQEALASANPDASKPIPVPSDFLLTVELPRFDFPVVFADHEYPPPPISSLQHLSSSQSGLMVKPTPDIQLGPGISRIDADDETSAGRLIRVYDPEVGARDNPAESKHRRLVRSQHRNGILDKDLKPNAKVRDELNQIMSYPPTHSLSPEEKDLIWKFRYHLTRYKKALTKFVKSVNWLDASEARSAVVVLEKWTDIDVDDALELLGPTFSNSAVRAFAVKRLRKADDNELLLYLLQLVQALKYEHILPQSRQDVSQDSSLASFLITRAVSSLTLGNYFYWYVMVEIDDRSSEQGQDAREIYTKVAYDFMAELDKQPGGQEKRRTYKRQAEWIRILSQVSGEVKEANESIARRTDRVKHFLADSKNELVTLDPPLPLPLDPSVMITGAIPEETIVFKSSLHPIKVAFKTTSGTKYPLIFKTGDDLRQDQLVIQIIMLMDDLLQKENLDLKLSPYKILATSTSAGLSQFVPSMSFQGILNKYGNNAALAYLKQNSPDSNGPLGLRKETLDTFVRSCAGYCVITYILGVGDRHLDNLLLAPDGHFFHADFGYILGRDPKPFAPVMKLSKEMVDCMGGVNSEHYRQFKQYCFLAYSALRKNSNLILNLFSLMVDANIPDIKLEPDKAVFKVRDRFHLELSEEEAIRNLEKIMEDSLNALVPVMIDRLHGVMQAFR

SEQ ID NO: 3212 - protein, 1219 aa, Neurospora crassa
MAGERPSQQQRVPSISSFPETLPSPNPNVERDPLAPTPEPAHPSGIPQRKRSLIRPERNRIGKDHPNYHYRKHAANMNTLPSSTGHDPIYEDLEGATDDVSGTGSRNDDDVSEESPPRRKHSTKMQVIETEKSGDERRRRRKSDTTKHGKIVKASKGKREKSGGLPTPSFWNIYCGFVTFWCPGFVLKCFGMPEMAQQRAWREKMGLISIILLIMGFVGFITFGFTQVVCGKPPLRLRINEVGSGYMIFHGSAYDLTKSHHPPAEGIPRRPDGLGANVIYDLPQHYGGQDGSFLFQNVNGKCKGLITKQENSDVPSDKSGNLAWYFPCNTFNQDGSSKPNTTIPYYLGYACHTTANARDSFYLGLKSSADVYFTWDDIKNSSRNLVVYSGHVLDLDLLHWFNDTQVTYPARFKELRDKNTAGNQAIRGRDITHAFQSSKDKQIAECFEEIIKVGSVDTETVGCIASKVVLYVSLVLILAVVLARFVLALIFQWFISKTYAAAKTSQTSDQRKRNRQIEDWTEDIYRAPPRLPGEVGSSVAGSSDRQSKRSSAFLPTHSRFSTVYGNERGNRKPGLPTTMASQNAAGQLLHPGTIYGQGNESRSSFLKSDAYGSSSSPADGPGPAGFIHEAVVPQPPSDWMPFGFPLAHTICLVTAYSEGEMGVRTTLDSIAMTDYPNSHKVILVICDGIIKGHGEEHSTPDIILGMMKDHTIHPDDVEPFSYVAVATGSKRHNMAKVYTGFYDYGTNSAIPLEKQQRVPMMMVVKCGTPAEASKSKPGNRGKRDSQIILMSFLQKVMFDERMTELEYEMFNGLWKITGISPDFYEIVLMVDADTKVFPDSLTHMISAMVKDPEIMGLCGETKIANKRASWVSAIQVFEYFVSHHLAKAFESVFGGVTCLPGCFCMYRIKAPKGAQNYWVPILANPDVVEHYSENVVDTLHKKNLLLLGEDRYLSTLMLRTFPKRKQVFVPQAVCKTTVPDEFMVLLSQRRRWINSTIHNLMELVLVRDLCGTFCFSMQFIVGIELIGTLVLPAAIAFTFYVVSSHQPQFSLPFLFDQLKTNVRYLVIISIINSPPQIIPLVLLGLILGLPAILVVVTAHSWSYIIWMFIYLLSLPVWNFVLPTYAFWKFDDFSWGDTRKTAGEKSSKGGHGEAEGEFDSSMITMKRWAEFERDRRVRSTYWAGSRDNVISGVGGSNGWGSSQPRGHEQGRHFDDYFSDA

SEQ ID NO: 3213 - protein, 382 aa, Neurospora crassa
  unsure (1)..(382): unsure at all Xaa locations
NASLLSAQKTLEMYRQNVKKTTDFSTQYSFAVFLINTAKEQGLNFDELRNSKNLKPGRSSETLSAEANQSSPYELVREARAILQKLSNNGFPFAQYYLADGYASGLFNKGKEDYNSAFPLFVLAAKHGHAESAYRTALCYEFGWGCRKDPAKAVQFLRTAASKRHPGAMTRLGKACLSGDLGEKRYREGVKWLKLATESADAIYNAAPYQLGCLYETGYGDDIFKDESYAAELFTQAADLGHPEANYRMGDAYEHGKLNCPRDPALSVHFYTGAAERGHPAAMMGLCAWYLVGADPILEKDEEEAYEWAKRSASLVSKLQPHXTXCRGKNKSNPDLTGYVKAQYAVGYFTEMGIGCRRDILEANLWYVKAAEAGDERAKQRL

SEQ ID NO: 3214 - protein, 344 aa, Neurospora crassa
  unsure (1)..(344): unsure at all Xaa locations
LPAEGRLLQACLNLLEGADIQFRRENRLDIALVKNLPIALVFLPAADIPTFVGEGRVDLGITGYDQVQEHDAGVRTVARARRQSGEWSAQDGEKAKPQGCDTVMELGFGACKLQVQVPVKGEYATGKDLIGKNIGTSFVHLAQEYFARLELEQEGLVDADASQLAGRKLKTQIIELSGSVEAACALGVADGIVDLVGEXSSQHCPRLSPTLTQXLTYFAPTESGETMKAAGLMAIDTVVESSAILIKSKAPSNPEMVDLIAARIGGVITAQKYVLCQYNVERTRLADATKITPGKRAPTITSLETEGWVAVSAMVEKKRIATVMDDLTTVGATDIIVLDIHNTR

SEQ ID NO: 3215 - protein, 790 aa, Neurospora crassa
FSSKDFIVRDFVDSLADTAFPANRRSNPTSASTPFDPKPLIRTFENALSQLGTLSEELQEKESELLSQVRRAEIQHDQTLDTLGRKLDQSMAQFEALDLTLNNSSTNSGSMNGHGRPDGGGNIAVQIGEKLEELDRKRRKAQDANFLIQCWTEVSETGQLTSLEEIQRQGGAENKVRCAVIARQLMRISQRLDPFSWVTGGLRANGIANGATRKHNTREALEKFCEHLEQDLLKQFNNSYRRQNFDDMMECAKVLYDFHGGASVIAAFVNQHQFFIDRDQLITDEVTTDGEMWEQLADPDSDPPGVEPSLQSLVDEVKIVMQEESFIIKRAFPYYETVLIKFIQRVFQQSIQQRLEMLLDKATTISSLAYLRSLHASRSYIGALVEDLKTHGLTEHPEPCSAQISQTLDQQLEELFVPYLLQNSYIDRERKSLEELYNSLLFKFTLYHSRRKKAPSGFMAAIAQQGTQLLATAKDAYMERLDSSDLTPTQKRMMLKVAGLQDNSSNKNEIEVSEEHGRLSVQNAKRMIVWLAESVRRTLEMGSGSETPKDINILLNLLLTSMGQVYVETALDAALDTATSQENIKTEPDLSYLPHIKPAVTITNLMSRFITTVLIRLAESNTALRRSMEAQAKQAIEATERKTNAVLKSTMDVAVNWVAKILAGQKKTDYRPRDNDLEGFVDLQTPTCQAICTFLASKVAAQAALAIDGHNLELFSSELALAVHSLLFEHFKKFSVNATGGLMVTKDIAKYVTTMKEWPLTKEVQAIVELLTEVGYLFIIGPEALRERSK

SEQ ID NO: 3216 - protein, 245 aa, Neurospora crassa
  unsure (1)..(245): unsure at all Xaa locations
MTIGXLVYPQQPSSWLRAATDDRANPSCPIKIAHGTTTLAFRFQGGIIVATDSRATAGNWIASQTVKKVIEINSDLLGTMAGGAADCQYWLAWLGMQCRLHELRHKRRISVAAASKILANLVYQYKGMGLSMGTMCAGVTKEEGPALYYIDSDGTRLAGNLFCVGSGQTFAYGVLDAEYRYDLTVEEALELGSRSILAATHRDAYSGGFINLYHVKESGWEKHGFNDTNPIFWRTKLEKGEFSNV

SEQ ID NO: 3217 - protein, 231 aa, Neurospora crassa
FIPLEANPELMTSLLHKLGLSTSLQVHDVYSLTDPDMLAFIPRPALALLMVFPVSAAYESARLAEDSLLEDYSGKGPLEPVLWFRQTIRNACGLMGLLHAAINGPARQLVEEGSTLDKIIKDATPLDPVARARVLETNSELANAHKSAATQGDTEAPAATDEVDLHYVCFVKTEDGGLWELDGRRKGPLKRGELGKDDDVLSQAALTLGPLKFLERGGGDLRFSCVALASS

SEQ ID NO: 3218 - protein, 418 aa, Neurospora crassa
  unsure (1)..(418): unsure at all Xaa locations
FNLETCARPNILALEPYRCAREXAHPQNFSVYDLSXSTSTNTRISVTTRDDGTNILLDANENAYGPPVPQNLATGSGSSGPELDLLGLHRYPDPHQRDLKQLLCSLRTTHAHTSKLLTPENLCVGVGSDEAIDALLRCFCVPGRDRILVCPPTYGMYSVSAQVNDVGLVKVPLLPAPSFAIDVPRVLETLSTEPNIKIIYLCSPGNPTGSLLAKEDIQKVLEHPTWNGVVVVDEAYIDFAPESASLAEWVNEWPNLVVMQTLSKAFGLAGIRLGAAFTSPPIARLLNSLKAPYNISSPTSALASYALGPDGLKVMRANKERLIKQRERLVAELPQIPGVGKLAGGESSNFLLYEMLDKEGKPSNETALKVYQKLAETKGVVVRFRGKEHGCEGCLRITVGTEEEVTRCLGALREALKE

SEQ ID NO: 3219 - protein, 552 aa, Neurospora crassa
  unsure (1)..(552): unsure at all Xaa locations
LVFGYDTGWINGVLGMPYFITLYTGYSYDYDRKQPIGIDPVNFGLPSSTKSLMTSILSCGTFFGALIAGDIADFIGRRLTIIIGCLIFCVGCVLQIASTNQTVLFVFGRLIAGLGVGFISTVIILYMSEIAPRKVRGALVSAYQFCITVGILLANCVVYSTQDRNDTGSYRIPIGVQFLWALILGTGLFILRKLRGALEVLSGSSIYXHSFPFFFFSNXPESPRYHVMKGQLQSAAKSLAYVRGQPIESEYIKDELAEIVANHEYEMQVVPQTSYIGSWVACFHGSLRKGNSNIRRIILGCGLQMWQQLTGKFSFGFSINHSLWPPGIMGDEXFLDVMLTQTNPSFLPRNNFIFYFGTTFFQQLGTISNPFFISLITTLVNVLSTPISFVAVEYLGRRFLLIYGAMGMIIMQYIVAIVGVTAGRIDANDPAAVRGMIACICINIFFFATTWGPTGWVVIGECFPLPIRSRGVGISTACNWFWNCIIAVVAPYMVGNSKGSANLGPRIFFIWGSLCIFSMLFAYFLVPEMKGLTLEQIDKMMEEVSPRKSKKW

SEQ ID NO: 3220 - protein, 847 aa, Neurospora crassa
  unsure (1)..(847): unsure at all Xaa locations
EGRFEAEVPLEGESLLDHIDELNEFDETEEDPADNSPYAQVRASVAPTDNTTLSINTPRMWTLAVLFSIIGSSTNLFFSLRYPSVAITPVIALLSTHPLGLMWDFFLKRADDPPEEYVDGCRTDSANIPVDHPTDEQPRVFVPWEKRSKLDQLRLWLAQGRWNEKEHSCVYVSSNVSFGFAFATDVIVEQTQFYKQDAPILYQILLTLSTQIMGYTFAGLTRGFLVRPSGMIWPGTLMSAAMFTTIHKQENHVANGWKMTRWKFFMVVFLAGFLFYFVPGLLFPALSYFNVITWFAPKNVVVANLFGVVSGLGLFPMTFDWAQIAYIGSPLLTPFWAAMNVVGGLVVVMWIIAPIAYYSNWLYSSYMPILSAAVFDNTGQVYDVSRILTEDFVFDREAYSKYSRVFLPITYVLGYAVQFAGLASLLTHTICWHGRDIWAQWKQTLGEMHGAEPKGSYEPVAVSTEGLSRTWSRLSSRSSFTRSNSSTENIMNREDVHNRLMRRYKDAPMSWYLITCILMLAIGIFVVEXXVGIPRAHGTYRSNPVHSYPVHLPWYGLLLALGICSILFIPIGIIMAVTNQHSSIYLICQLVAGAVFPGRPVANMVFVTYGYISSAQGIKFAADLKLGHYMKIPPRILFSVQMVATIVSSLTQIGVLNWMFKNVPGLCTPEALNGFTCPIARVHFNGSILWGVVGPSEFFGPGATYRPLVWAFAVGAVLPIPLWLYARKRKDSIVRKLNLPVLFGSLGWIPPATGLNFSVWALVCYVFNYVIKNRARAWWAKYTMTLSAALDSGLAFGIVVVFFGFIYPGVVKGFSWWGTEVYKQGCDWQACAYQAVPEGGRFGPDVW

SEQ ID NO: 3221 - protein, 483 aa, Neurospora crassa
CDSPELGYQCNSETTHTWGQYSPFFSVPSEISPSVPEGCRLTFAQVLSRHGARFPTPGKAAAISAVLTKIKTSATWYAPDFEFIKDYNYVLGVDHLTAFGEQEMVNSGIKFYQRYASLIRDYTDPESLPFIRASGQERVIASAENFTTGFYSALLADKNPPPSSLPLPRQEMVIISESPTANNTMHHGLCRAFEDSTTGDAAQATFIAANFPPITARLNAQGFKGVTLSDTDVLSLMDLCPFDTVAYPPSSSLTTSSSPSGGSKLSPFCSLFTAQDFTVYDYLQSLGKFYGYGPGNSLAATQGVGYVNELLARLTVSPVVDNTTTNSTLDGNEDTFPLSRNRTVFADFSHDNDMMGILTALRIFEGVDAEKMMDNTTIPREYGETGDDPANLKEREGLFKVGWVVPFAARVYFEKMICDGDGSGEMVQSEEEQDKELVRILVNDRVVKLNGCEADELGRCKLDKFVESMEFARRGGDWDKCFA

SEQ ID NO: 3222 - protein, 414 aa, Neurospora crassa
  unsure (1)..(414): unsure at all Xaa locations
KIEAQEIETYWNIFSARTNGGKFLTGEQAAPVLKNSGLRDDQLERVWDLADVDNDGNLDFEEFCVAMRVIFDLLNGVRLPPSVLKLRASERASKQAWEQXXQQYQRTNRGRRXQEYADVPTTLPDWLVPESKAHLVQANRALTGKAPKFEQVEDEDDTPGLKDGFDWYMSPADKSKYEQIYQENRDMRGEVSCMFTSLPFPSLPVPNLILIYLPTAVAALQDLYDSLSVPDTDIRSAWNLVNPSASSTINKDACLAFLHILNYRHEGFRIPRTVPASLRASFERNKITYNVNDPSQSRWAQKADDETSTGRKAKFGDQYLTRLGRSSFKTAGTDFSSEQTDDQWEEVRLKKQLAELDEKMAKVEEAANRRRGGKRDTKPALVKRELEQLLDYKRKELRDLEEGKGKAAAGGSLK

SEQ ID NO: 3223 - protein, 1652 aa, Neurospora crassa
  unsure (1)..(1652): unsure at all Xaa locations
SEDEDGSFGSDKDDGMLDNTPPNAKKQKKAPVKKAAGKPLAEIENDSMQIDSVAPAKKTGAAKTATEMYQKLTQLEHILKRPDTYIGSVERSEQKMWVFNKATGLMENRQISFVPGLYKIFDEILVNAADNSQRDSSMTFLKVTINRESGEISVENNGKGIPVEIHGTEKCYVPELIFGHLLAGSNFDDNEKKTVGGRNGYGAKLTNIFSREFTLECQDSVNGKRYKQTWTDNMSKMSPPKITSNKAADFVRITFRPDFSKFGMADGIDDDLEALLYRRVYDMAGTVSGVKVWLNGEHLKLNFKTYCGLYAKAIAKERDEVADGEDVTPATVIFEQQRSEGKLWEVGFTVSDGSFQQVSFVNNIATTSGGSHVNYIADQIIEVLMKELQKKKGKGHGLKTANVKNQFFIFINCLIDNPAFSSQTKEQLTTKPAKFGSKCQLGDLFLKKVRQSEAIDNLLSFADKKRDKDLAKNDGSKRKRISNDKLIEANYAGGRYSQECTLILTEGDSARGLAVAGRAILDPNRIGVFPLRGKMLNVRDASADQILKNKEVENIKKFLGLKHGKVYTDTKDLRYGHLMIMADQDLDGSHIKGLLINFFECQFPSLLRIPNFFQEFITPVVKVWQGPNPKKPQRLQGFFTLPQYEEWKEAHRNELRRWKYKYLKGLGSSTTDDAQLYFTNLNKHLKEFDVMTREESEMFELAFSKKKADARKEWLAKCEPGTYLDHSTEKISYTDFVNRELILFSMADNIRSIPSMVDGLKPGQRKVLFGCFKQNLIHDQKVVELAGYVSKEAAYHHGEQSLQQTIIGLAQNFVGSNNINCLEPSGNFGSRLSGGSDAASARYIHTRLSPLARKIFHPLDEPNLEFQFDDGKLIEPKVYAPIIPMVLVNGADGIGTGWSTSIPNYHPLDIVENLKRRMGRDSSGDGEEKPFEPMTPWFRGWKGTPEPDGPNRFKFNGIVEVNPQNPNEVDVTELPIRMWTDDFKSKLEEIIRGDKSPSWIKDYKEYNDHQTVHFIIALEEKHMSSALRDGLIEKFKLTKTVATTNLVAFDTRGKIHKYENPQEIMEEYYHYRLNLYGERKKHWLKVYHADYRKLQNQYRFISEIIENKLVVSKKKKSVLVQELRERKYEAFPPKSDGRNVKSPDEELGAADNEDEEDAVGEPAIMTISFRFVISSLLIMLPERLTXXXMPIWSLTFERLDKLKQQIAAKKAEHDELDALSEKDLWCRDLDAFTAEWEEQLRLEDEVRKEIRQKGRRVSYKGGAVSRLKKSRGAKDDEDFDPGAKKAKAKAAPKAETIKTQQRFLEKFSGMAKPKPKSTAFTDGADDLSDDDFDLLNKKAPAAAKKKDEDAEPVTTIASVRAKRATVAKPKTYALSDEDSDDEFLDIAKVTTTSEKTTTSASASVSAAEQSEQPVAKPARRAAGAKKPIVDEDSESDLDDFIDDESEEEVIPKPTTKRATAAKKPALEDEDSDVEFQDAPEEPIPPTPKPEAKKATAKKPIVVEDSDEDMMLSEAEKPAHAAKPPTKRAAAVKKSPVLEDDDFESDADDKILSEAEKPAPAKATAKRAAAAKKSPVLEDDDLESDGDDKMVSEAEKPAPANPRKRAAAAKGQVLLHRRRRLRKAKLLMTTTCFLTSAPXSRVXEPLPRRARAR

SEQ ID NO: 3224 - protein, 1166 aa, Neurospora crassa
DDLESLELLSLVSKVTSELQNHLGVSEKTLAEFIIAQRVECGSFDEFKQKLATIGADFPPSLVESIDRLVLTLHPKFKGQNHGQTRADENEKHGQSAEEKTKVFKGLSIPDKEVDVIDDTLALLESLEPKRAEKERPRKRSRTPERDDYADDYGKRKRKERYRSRSRSRSRSISPPRGRRKGRYDDEYDGDFRRPPPREVDDSPILYKVYEGHVTGIKDFGAFVNLHGVKGKVDGLVHVSAFGQRVNHPSDLLSKGQEVKVKVIKLEGGRVGLSMKDVDQETGMDLAPQLRIGSGANMEALAGEEDTIQRMLSPTALVTREHSKRQQMPRQHKKRMTSPERWEIRQMIAAGIAKASDYPELEEDYQATLKGEGQMELEEDVDIEVRDEEPPFLAGQTKQSLELSPIRVVKAPDGSLNRAAMAGTNLAKERKELRQQETEAKKAEEKKVDLSSQWQDPMANPETRKFASDLRKNAQAAPAAPDAVPEWKRAVAPKEVSLGRRTNMSIKEQRESLPVFAFREQLITAVRENQVLIVVGETGSGKTTQLTQYLAEAGFTNNGMIGCTQPRRVAAVSVAKRVSEEVGCQLGQEVGYTIRFEDVTSPATKIKYMTDGMLQREILIDPDLKRYSVIMLDEAHERTIATDVLFALLKKTMKRREDLKVIVTSATLDADKFSEYFNQCPIFTIPGRTFPVEILYSREPESDYLDAALTTVMQIHLSEPMGDILLFLTGQEEIDTACEILYERMKALGPNVPELLILPVYSALPSEMQSRIFDPAPPGSRKVVIATNIAETSITIDHIYYVVDPGFVKQNAYDPKLGMDSLVVTPISQAQANQRAGRAGRTGPGKCFRLYTEAAYQSEMLPTTIPEIQRQNLSNTILMLKAMGINDLLRFDFMDPPPVNTMLTALEELYALAALDDEGLLTRLGRKMADFPMEPALAKVLIASVEKGCSDEMVTIVAMLNLPNVFYRPKEKQAQADQKKAKFHDPHGDHLTLLNVYNSWKNNGYANPWCFENFIQARSMRRAKDVRDQIVKIMDRHRHPVISCGRDTNKVRQALCAGFFRNAARKDPQEGYKTLIEGTPVYLHPSSALFGKQAEWVVYHTLVLTTREYMHYTTSIEPKWLVEAAPTFFKMAPTDKLSKRKKAERIEPLYNKYAGADDWRLSAQRR

SEQ ID NO: 3225 - protein, 380 aa, Neurospora crassa
DLDSLCSSILLAYFCTYRTTPPTLHIPLSNLPQADLALRPELAAVLKPAGLHTNDLITLDGLPKDDNVTPENTQWLLVDHNSLTGPLAARGFGGPERIIGCIDHHDDEGVVPPTVKPRMIEKSGSCMSLVVEYCKPVWEELSRLESAEAGATDSREEWESQLAHLALAPILIDTTNLTSKDKTTEWDTGAVEFLEGRLTQKSQQTSATSGGQEGYDRTAYFNHITSLKEEIAGLSYRDILRKDYKRWEDGGLAVGISTVVRGLEYLLTEIGDQKEFTEALRAWAKEQELDIAAVMTVSNPDGKFTRELLVWAFNERAVKVVKRFVEKHGEEGLQFQTWGGGKLDSDDGKGEWVRCWTQGRVDKSRKQVAPMLRDAMKEAA

SEQ ID NO: 3226 - protein, 305 aa, Neurospora crassa
LVPCSDALGIITAVGPLGPGASESAWKVGDRVLSTFCQSHLTGQITAKDLASALGKPLDGVLQTYRVFPSTGLVRVPEYLTDEEASCLPIAAVTAWMAIFGMEPFGTWATKASDDGKKPLQGKTVLLEGTGGVAIAGLQIAKAAGARTIITSSSDEKLRRAKEELGADHVINYKTTPDWEKKVMEITGENDGADIILETGGAGTLYKALDCIAFGGLISCIGYTAGKEDSGEGSRMNVNVLALRRTVTLKGIINGPRDRFEEMCEFYQRHEIRPVVDKVFEFEEGKEAIKYLRSGSHFGKVVVKV

SEQ ID NO: 3227 - protein, 1324 aa, Neurospora crassa
VLELIFQEKELPPSKHGRHIPLRPHHDKPLIDERRGSAYIPNTIRTSRYTIYDFIPKQLFFQFSRLANFYFLCVGVPQTIPGVSTTGNFTTIIPLLFFVFLTIVKEGYDDWKRHRLDKVENARSATVLRPTGHVDSRQDWRTGFGLRRTKDKDTVAVQEVIPDSEYQWHATQWKDLKVGDVIKLSRDEDVPADIVLLYADGENSMAYIETMALDGETNLKNKQVSKALQRCNTIQGIANCQAEFVVEDPNPDLYRFDGRVTVDGETLPLTLNEVVYRGCTLRNTTCAIGMVINTGEECKLRRNADRHPKAKKPAMEKIANRIVISLVVVVISLSIGCSMGYLLWKNAYEHKAWYLRHLGVDFEDIIIGFFIQFNNIIPLALYVSLEIVRIGQMWWLNSDLEMYDKVSDTPAKCNTNTILENLGQIGYVFSDKTGTLTENVMKFRKMSIAGTTWLHEMDIVKEQEAQGLTQTETKGKGLNVMLEPTFENDNALTKTTTAVSVRSPNPRRSSSQWRSTGRPDHVQPEVTTEDLLEYIRLRPKAPFSRRAVQYLLAMALCHTCLPEIRDGEIEFQAASPDELALVKAAQELGFLVVQRSSQSVTLRISRGDGTELERTYQILDVIEFSSKRKRMSIIVRCPDERIWLITKGADSVILPRLRMAQLAIQKANEVRKSLEVEHEMQRRSEAREPRNSFGGRPSLTIRRSIHLARQNSVAGPSKRPITNRSKSFEVGRMSLSAPENRLRPQVTVRTASYDVPYEDAAAASVSDKFAFLDDPSVCDEGAIFTRCFKHIDDFATEGLRTLLFAQRFLSESEYNTWKKLYRDAETSLVDRQERIETAGELIEQTLDLIGATAIEDKLQKGVPETIERLRRANIKIWMLTGDKRETAINIAHSARLCRPTSDIYILDATKGNLEGQIMDIVDELNIRAETMPTAIPNHTVVVIDGHTLAALDQPETHGNAKELFYSLIPTIDSVICCRASPAQKALLVTAIRNHSHQPSTTKKKGFLAYLITPRRTPPLTLAIGDGANDLAMLSAAHVGVGISGREGLQAARVADYAVSQFRFLARLLLVHGRWNYARTSKFIVATFWKEMFFYLPTELYQRYTGYTGTSLYESWSLTVLNTLFTSLCVIVPGVWEQDLSAETLMAVPELYVWGQRDGGLNLRKYLGWMVAAVAQGVVVWWVCWGLYGGIAVKDNGLFAVGNLVFTVAIVWTNLKLLYVFVPSLILTLFLFSLSFRHDTNLSTNNSIIDTHHKTGIILGAFGITFAGWWIWQIFLASAYAPGVWPYAVRGGFFSSFGPDPAWWVALFAAVGLLTAVELGYKSTK

SEQ ID NO: 3228 - protein, 1103 aa, Neurospora crassa
  unsure (1)..(1103): unsure at all Xaa locations
MRTVSVVAAALLAASYVAGEHVGPTKPKYYFPKHVKRQYANATITSNDAPISTIDTSSDALSQTTKRETTSNDQSESLSDIPFVKSTSSRFLTSSEPQSESESDTSRVTTVVIASTVYVSPSQPTTADLSTAGTAAPSAPAVDTDFVSSTDSTAGSSDSTSQGTTGLSSSATDNSSTDLLGFPTGISSGSTTESSLSDSTTGGTSSGATSSPESTPGTSLGSTTDSSTSSPVTATDRVDSSASASASASASTSASDNTILPSSGANVTSSFASTTDAVSSSSSVTKTASSSSPTTDSASSSASVTGSVTSPGSIANTTSSAISASSSSSVVDILSFLNPGFGGASSSASATDSTTVLGSVANTTSAAISATDVASSSASATDSTTALGSVANTTSAAISATDVARSSASATDVASSSAASTDASGSLTSASALPTVSSGVISNTTSPDSSSSLQVLTPPTTTVEPISTANATTVETASTVTATDGSASTGWLPPIIVLPSIRTSSTSAADVANSTAPALVSGTGRATNSTIGTATASEIIATEDPLITSSSSSGILLAPTGVVNETTSASTNLIESLASNVASLVGSILIPTGNGTATEPTAPVTTSDSVTIPSATEPYASGSGSGVITPSASLTTSQPKPPMMSSGIVSIPIGNSTVSSTKAVESGPTTTGIPGSSVPVIPGNSSIPVTSMSDTTVVLPPVTLINSTTVAANSSTIIPVIVTSASAESSVPVSSLEPVTTTQVLIPPPVPTTTINYPPVTQYTPTATVSNMPPGYNSPTTILVDQPPPAQTHTVSFVQQTTATALPTDLPKAIAPDDTTAPKPEDNVFIQIGFNYGFNYPFVAKNNNAAAQIFRLLPEALAFASSIESHRVRVTKLMPMNTVNTLGYWTTLAVVSYPQAYVESLRLDVKIASSPLYNNPTPLVYNLTMQINPAIDIILGSTLIGDGSGGDSGSNPSNAGNNGNADPFTNNNNGNQTSQQRGTTAGIVGGAVAVAAAYGAAMFVVARRYKRKKQAHRRASSLGGSPSDMQQMGGGSPALMGGALLSRDFTGYGGVAGGAAAAGAVAPGGRDSHGSGRSGMGLSSRTAYISAPVAAENSLGWNX

SEQ ID NO: 3229 - protein, 476 aa, Neurospora crassa
LSLLALSAACVAVLANTFQGDGYPLIASLALGGLAFSATFSMIRWLGPTFMRAGLKGVDMSKHHKKELPECMGAIAAMVYLLAVIVFIPFPFYKDIVAATSGGGNRDVVMHVEHVQEGRFLHRFPHGKVCDNPLPSPLETGTHKDRTDANTLRHQQLASYLSAVMALQSISLLGIGDDLFDIRWRHKFFIPAFASIPLLVVYFVDFGVTSVVIPTPLQPYLGELFNLGALYYVYMASVAIFSPNSINILAGINGIEVTQSIVIALLLAFNDCLYLLTPYPHPATDSHLFSLYFLVPFLGVSFALLWHNWYPARVFVGDTYCYFAGMVFVVVSILGHFSKTLILLLIPQIFNFVYSVPQLFGLVPCPRHRLPRFNARTGLLEPSVTPWTPERQPKPPVAWALKTLDKVKLLRVTLDEEGRFVETSNFTILNLWLVWRGPLREDRLAMEITGMQVVVGLFGLFVRHRLALILFKQDNL

SEQ ID NO: 3230 - protein, 890 aa, Neurospora crassa
MYLPRQLISKLYLHLQNTRHPLSPPVLILVALETDALCACRILTQLLKHDYIPHKIQPVAGYSDLERAGTELVSPMMETRGGAGGVVVCLGVGGMVDLGTVLGLEPEGEENTFGGVEVWVIDSHRPWNLGNVFGGFPLEPETQEARTFSARTPIGVNGGRIERAYKPGKGGIIVMDDGDIEDELSKERDAYLALVDMPEIEDDGRDLGDSDEDESENEEDTGDTSVVAGRKRKSWSDFDEDDDEDDRPRQRRRSNSVSTFRFLHSNTSLMPDTVESNSDSPRRPQHRGLISLRDDALFSSDALEAPPAAQPPRGPSANTLRRRLLRLRRENEGVLREYYRLGTSYSEPISSMMYSLASELGREDNDLLWLAIVGVTSMELYGRSSAGIAVAARRSDARISGWLGMRGARIRQLLRDEVRRLNPPEIGNGRVLPETTGIIPTTARSPEDTSIRLSPEPKFLLIRHWSLYDSMLHSPYLFSRLKTWSEAGMKRLHKLLAKMGVSLVQCKQSYAHMDMMLKRELRTKLLKYASLYNLDELVPTIDTDGKDRGGAKDGWGFVRSWGWRATLSAQDVGVVVGALLEVGKNTTSADDLPAGPSQDLLDVDNNQSQSEEWIPRFWEAYDALEDIEALKAGLPTAQYLHKAIFTTGTTILKKKQISHLRAFRMCVVKDSPDATLFNHPGALTKLALWIGEALAEQEKEATGGRLAHGGRGTPLVVASLDDKRGVYVVVGTGGGGGPDTKFLDRESAKKRAEEKEAKAKAKEMQRRIKEKIKAEKKEAKRKEKEEKKKAKSDAGGDEDEEEDNEEDSDDDSDLSDTDSDDDDESDEDEDELDQELERGYGLNKFGTAFQDVVAETNARVRIDSFEHCVVEVKKEDLSGFLESLSMKVVI

SEQ ID NO: 3231 - protein, 189 aa, Neurospora crassa
  unsure (1)..(189): unsure at all Xaa locations
GFLKDCPSGMLTKAEFQKIYAQFFPFGDPSSFADYVFNVFDTDKSGTIDFKEFICALSVTSRGKMEDKLDWAFQLYDIDGDGKITYDEMLKIVEAIYKMVGLPFLSYLSTPFPVSSQSCTLTFXSLKTGRSMVKLPEDEDTPEKRVSKIFRMMDKDENGSLDMKEFKEGSQRDETIVSALSLTMASSNQ

SEQ ID NO: 3232 - protein, 735 aa, Neurospora crassa
  unsure (1)..(735): unsure at all Xaa locations
LVAKPPYTLDVPGQTPVEGETPVRRIPLAIDGLHAIPPNRRWGENEAIGEEIDTVYKLVKWAALAHGESQCMGSRKLVNTHVETKKVKKMVDGEEREVDKNWTYFELGHYEFITFKDYEQLTLDVGAGLRAIGLNKGDRVHIFAATSQNWLAMSHGSATQSMPIVTAYDTLGAEGLKYSMVATNAKAIFLDPHLLPTLNGVLEHAKGITHVIWNNQNKVKEAHIEALRNERGVTVLSFDELVQLGKQNPVAPVAPAPEDLCCIMYTSGSTGTPKGVPLKHSNVVAAVSGRKLLLSCSXTATNVLVTVAGVCPVVQPFVGPGDRLLTYLPLAHILEFVFENASLYWGSTMGYGNPKTLSDTSVRNCLGDIREFQPSVLVGVPAVWETVKKGILAKVNAGSPLLRNLFWGALALKEKLMGLGLPGSGLLDAIVFKKIKDATGGRMKLCLNGGGPVAKDTQKFISMAICPMIIGYGLTETTAMGTLQNPNEWTAESIGAMPASIEAKLVDFADAGYFATNKPNPQGEIWLRGPSVLSEYYENPEETAAAVTADGWFKTGDIGEWDQNGHLKIIDRKKNLVKTLNGEYIALEKLESIYRSAAVVANICVYADQDRSKPIAIIVPAEPALKKLASSSGVKGDSLEELVHNKKLQAAVLKELQNAGRAGGLSGIEIIEGVVMSDEEWTPQNVSFPLSTSICLPNPSLTKSITGSVTAAQKLNRKGILNKYKKEVDEAYGPK

SEQ ID NO: 3233 - protein, 840 aa, Neurospora crassa
  unsure (1)..(840): unsure at all Xaa locations
RTLYDKVFQAHIVDEKLDGTILLYIDRHLVHEVTSPVRSLNPHAGELRFRSPVPSTDPXSIQAFEGLENAGRQVRRPDCTLATTDHVSSMSLPLFFYFHMAAHAAFSRPXYLAPSQSLCGTASXPRTRCRMVPTTSRKALKDIASFIKEDDSRTQCVTLEENVKKFGITYFGLSDKRQGIVHVIGPEQGFTLPGTTVVCGDSHTSTHGAFGALAFGIGTSEVEHVLATQCLITKRSKNMRVQVDGELAPGVSSKDVILHVIGQIGTAGGTGAVIEFCGSVIRSLSMEARMSICNMSIEAGARAGMVAPDEITFEYLKGRPLAPRYGSEEWNKAVTYWKSLASDPDAKYDIDVFIDGKDIIPTVTWGTSPEDVVPITGVVPDPETFATEGKKAAGRRMIEYMGLVPGTPMEDIEVDKVFIGSCTNSRIEDLRAAAQVVKGKKIAANIKRALIVPGSGLVKDQAEAEGLDKIFQEAGFEWREAGCSMCLGMNPDILSPKERCASTSNRNFEGRQGAQGRTHLMSPVMAAAAAIVGKLADVRKLTDYKSSPHVEAAVIPETTSTAKAHTDERIEEDDVEKDKLADQPQDSSPQVNTSVSKSSAGLPKFTNLKGIAAPMEKANIDTDAIIPKQFLKTIKRTGLGSALFYEMRYNPDGSENPNFVLNREPYRSAKIIVCTGANFGCGSSREHAPWALNDFGVKSVIAPSFADIFFNNSFKNGMLPIAIKDQAALERVHAEAAAGREIEIDLPNQLIKDADGNTLCEFEVEEFRKHCLVNGLDDIGLTMQMEDKIAEYEAKMSQQTPWLDGRAYLKRKGQGGKLVAKAVPVPKTNRGEEKKEPLEW

SEQ ID NO: 3234 - protein, 197 aa, Neurospora crassa
  unsure (1)..(197): unsure at all Xaa locations
MATSQADARDRQFLAVIGDEVSVILQLGLHLSRSXQLSRDSVTGLLLAGIGVGSRMVLGXYAVAEFXYALESXHVTAPPDSQKNFLVVDNKTDNAAIEAAFDRFTTERKDIGIVLINQHVSAGLGSKGGLVGRYFLLTILDKMGNXRGRHRSADRIRHRVDTHTAAFPTVLEIPSKDHPYDPEKDSVLRRVRRLFGE

SEQ ID NO: 3235 - protein, 307 aa, Neurospora crassa
VLIMGAGHIGRRVALVWASALRPVTVYDISKNALRSSTEYITDNLAKYCLEHGTHPGPVHFTSDLREATTAGKRHGLKLDFSAAHDTEPKSTRKKGPWMVIECLPENLSLKIAALAEIERLLPENCIIASNSSSLMTSEMAPHLQHPGRLINTHYYIPPRNVMVEVMSSSHTYEGIFPFLTREMKNMGLTPMVVPPGVQSQGFIFNRIWAACKRETLAVLQEGVGQPAEIDALFRDFFHAEKGPCERMDEVGLDVVANVEEHYIEQRPELARSGEKPLEWLKKTYVGRGDLGEKSGDGLYTWEEREA

SEQ ID NO: 3236 - protein, 426 aa, Neurospora crassa
SNSTWKLTIDDTPSGRKQTIKGFGAAVTDSTVSVFNALPSAQRTALLNTLMTTAGANFAMMRHTIASSDLSANPAYSYDDSNGQTDLSLSNFNLGGRGNAMASLLAEMRRLQPGLTILGSPWSPPGWMKLNRAIQGTTVNNNLDHAYASQFAQYFVKYLQAYQAKGATIDAITIQNEPLNSRAQMPTMYIYADEAGDLIQNNIGPALRNAGLDTKIWAYDHNTDQPSYPSTVLSRAGGYVPAVAWHCYASSLDWSVLTTFHNAHPGVEQYMTECWTSAKQPTPWNWAASFTMGPLQNWASGVTAWVLGTDTNDGPHLTGSDACDKCTGLVTVDAAAGTYNLRGDYYMMAQFSKFMKKGAVVMSGTGSWTYGDGSGLESVAATNADDGSRVVVIENKFGNEIYVTVEAKSGEVWSGLVYRNSVVTWV

SEQ ID NO: 3237 - protein, 594 aa, Neurospora crassa
MSKRHLFPSLDGLVPKALRGIVASNPRLNLDEANKVVYDSEAPRSNVSIVSGGGSGHEPAWAGYVGTNLLAAAVMGDVFASPSTKQILAAVESVPSDKGTLLVITNYTGDCLHFGLAAEKTKAKGNPCKMLICGDDVSIGKKGGSLVGRRGLAGQIGVLKVLGAAAAQGATLDELYDFGSAFANSIVSISATLDHCHVPGRTEHGALAEDELELGTGPHNEPGYWKLSPAPSAEGLVQQILKYCLDETDPERSYVKFNPGDETVLLISNFGGISNLELGGLVDEILQQLLKDWNMEPVRVYSGCLETSLNAPAFSVSVINITAAAANSTYTVDQIKGFFDTRTDTAWEAVAGYQSYPRRRKRSEQVVPPPKEIRRTVDDSTDLKIDPSLLESMIESACNAVSAAEPDLTKWDTVMGDGDCGLTLQTGANALVDALKTKKVASNGSVIEVLNELEDIVEGKMGGTLGGILGIFFVALRTALQENIGLAKEVGVPALWGKALSTAISHLRQYTPAKVGDRTVMDTLIPFAMAMEEGRSFEQSVAAAVKGSEGTKKLKPKLGRATYVGVGADNNKELPPDPGAWGAMVGLQGLLSAF

SEQ ID NO: 3238 - protein, 502 aa, Neurospora crassa
  unsure (1)..(502): unsure at all Xaa locations
MSTLEELDDLDRREREDKKKDQDKDKNNKKEGDGDAEMKDAEPEADDILDEEILSLSTEDILMRKRLLENDARIMKSEYQRLSHERATMKDKIKENQEKIANNRXTFPLHSPKVCLQXPRNLPYXRWPHQQLPYLVGNVVELLDLDPTAESSEEGANIDLDATRVGKSAVIKTSTRQTIFLPLIGLVDPEKLKPGDLIGVNKDSYLILDTLPAEYDSRVKAMEVDEKPQEKYTDVGGLDKQIDELVEAIVWPMKEAERFKKIGIKAPKGMSSPRWSRNSLLWYCCXTSGIGALMYGPPGTGKTLLARACAAQTDATFLKLAGPQLVQMFIGDGAKLVRDCFALAKEKAPSIIFIDELDAVGTKRFDSEKSGDREVQRTMLELLNQLDGFASDDRIKVLAATNRIDVLDPALLRSGRLDRKIEFPLPNEEARAQILKIHSRKMKVNPGVNWGELARSTDEFGGAMLKAVCVEAGMIALRMGKNQIGHEHYVDAISEVQAKKKE

SEQ ID NO: 3239 - protein, 391 aa, Neurospora crassa
  unsure (1)..(391): unsure at all Xaa locations
VAHLDTFELPEKITGSASDRALGKAIIDTWRYEGIIQIAQSDLQKKLWNDAKAASKRFFRKPAAEKAACVDSQSYAGYIASGEEVTDGIADYSEIFTITKDLDLEEPRVRAKWPCHGPCPWPDVEMKEPMMRYVDNLGLEGEKILQLAEFGLGVAPGTLTQYTRDGWHHTRVLRXVVKHDGFYSCHAAPSLHYGRGAGRLLIVSHEKFIRXRFVFTSVFPPRNATNGKGKEGRGIGSHTDYGLLVIAAQDDVGGLFIRRPRDDEKFANWQKSAAGHKEDADGWFYIPPVEGVHTVILGDMMQYLTNNYLTATPHKVGLNTRERFVMAYFHEPSFQAVIKPINEGCGGMRTASEQAEEGVHYGTHFTNMFMRNYPDRITTKRLLAENRYAKL

SEQ ID NO: 3240 - protein, 518 aa, Neurospora crassa
  unsure (1)..(518): unsure at all Xaa locations
MSYPGYPPASPYGRKWKRKQHLHSFVFTTNPRPCEPPPQGGGYYQQPPPQQHHQQPPYGGPPPHAHYNTYQQPQQGYGQPPPGPPPGQYGAPPPQPYGAPAHSPPPGTYGAAPPPSPSYYPLGPPPAGYGAPPPHGYGQPPGPPPQQSYGAVPPTPTAYTPQPYAVQYPPTPPSPGYGPAMNIPWNPDPDADRLRKAMKGWGTDEKELIRVLADKDPFQINMLRDAFQRRHRRDLIADIKSETSSWFEEGLVMLARGPLLNDVHMLFNAMDGAGTNEDILNDILLRRSNADLKAIKAEFSRVCHRPLEEMVRGELSMKTERHFMIVLGATRAEDSAPVVKADIDRDVDDLYNATEGKIGTDEMRVCSILSLRNDNQIRAISYEYRQKYARDLDTVIQKVSXLXRTTATTTKSHLGNNSXQPRQEFSGHMKDALLIQLRHGTDKYMLQARLLEDAMAGMGTKDRLLTSRLVRAHWDRNNMRNVRNAYEQRYKKKLAKRVQGETSGDYQRLLMAICGEPI

SEQ ID NO: 3241 - protein, 619 aa, Neurospora crassa
  unsure (1)..(619): unsure at all Xaa locations
LKTNCGGLIADVMGMGKTLSTLVTILHTLQSAVDFADFTFRQADHKTPTRATLVVVPSRRRFYPNRSPAVLSYSXLRLMKSXSTTGNPRLNGKSQIIRTALLDWQADVKPPLLLSHMSGALHVTIFHGEQKPRGYETLMDTDLVLTTYSTLASDYKRSGLLHRMEWYRVVLDEGRXHSTFFCLSKIADLLKYFNIDIFDSTRNASTHYFRAAATLNTTRRWCLTGTPIQNKLEDLSSLADFLRLPPYLAKNAFRKHVLEPLSGGGRCNSEPLRAYLRSYCLRRTDKCLDVPPSTSKIIYLALSDQEQWTYDAILSRTKWLLDDIVSGKDTGTLKLYNVLFTAILKMRMMCNHGTLNPLWASADYLTPQHGEVDTSCERCSSLENDVDFGDIQFCPNCRRPLQPGSISXMQERVLTQLACWATPSQTQSISIARCRQTCSQRSLKPXESKYLKLERAPSSKYCHSSWKFAGHWQQNXRERPSLIFSQWIPTLYGLVHIFRDAGVAALLVHGKTSISERTRLIRTFQGDPQAFILIMSVGTGAVGXVTNHVFQVSYILDRSANVCQRLNLTAASHVHVVEPHWNPSVEAQAIARAVRMGQTKNVLVTRYIMKRTVEDVSDA

SEQ ID NO: 3242 - protein, 258 aa, Neurospora crassa
PHNPTREAKLLGLLSKPCIPLLDTFRDYEQRLVLVFPYMPLTLESLRERAPLKDSQIRIIFKDVFTALASLHSQGIIHRDVKPSAILLESPTGPAYLSDFGASWHPTLSAATEPADNKILDIGTGPYRAPEVLFGNHSYGPPVDMWGAGVMLAECCRRGANKHLFESRAVHEDGNQLGLILSIFKTIGSPTRESWPEAVSFRTPPFDIYREFERRSWDKILPDVTEDWRELISGLVKYDSGRATAEQVCDLSPVSNRL

SEQ ID NO: 3243 - protein, 676 aa, Neurospora crassa
  unsure (1)..(676): unsure at all Xaa locations
ARRTLPRQMQQSTKPRGGASKSXRPRLATLTYQISNYEQEKELGRLQMENEMRDIRRQAEQDFKAKQAADAEKSKALRHAESLQAELDALRAEKETQKRELNAKTRETQEEARLLREQVEELKAAKEEAARLAEREITELKAKVTVLERTAQETEEENRTLKDTLEKVNAQLAERDDTIGKLDAEVLRLKAHTGDAETVSVIRRELSDQVNHIRMLESKNREQITELKHLRQVYKAVEVVEEEKRTLQRKLEAAQTLETELAEERRQRLRLEDERRSWTAYLESNSEGPVEFDSPEAVARALVEERFRSASLTERLGALQPEIADRDNIIKSLEDEKARLLEQIEKLRASSGPSANDKARARLDRQRALAVKEVEYLRAQLKTFDMEDVTMQPEQLDEQKAKRIQELEDLVDKYKEEVNTLHADLTSLESASTSPVQPVLAGTKRPRDDHDGAESEQLGQLARKNRKLQSEFSDLQTAHRILQKEHEVTTSQLAAAKEQLKTRILSLRDNPTSEYEKIKTDTLKALKLENAELLAHLERQPTLFATVPATQIAALKREISAAQAETASAQKRADRLKQVWAAKSAEFKEAVFSTLGWTVTFIPGGKMRVESVYYPSKTEEHENSIVFDGEKGTMKVGGGPRSEFANRIADNIRFWVREKGEVPCFLAALTLEFYEE

SEQ ID NO: 3244 - protein, 555 aa, Neurospora crassa
  unsure (1)..(555): unsure at all Xaa locations
DDGGDFRAIDPHSGVKRGLKTRHLSMMALAGIIGPGLLVGSGGALHSGGPASLLIGFGVIGLIAFSIMQSLGELTTLYPSGGAFTDLGDRFIDKAFGVAVGWNYLISQFLLSLCELTFLLLTLCGLVWVCVLANEYNVISSVMVDWSDKVPLWGYFLIFWVSFISLSSRHIVKDRVXGGCXHGRQFAFLGFQLLGVETFGEAEFWLALIKLMGLVAYFIFSIVLVCDPPTCLCLRTCTDPKIVYVSGGVKGADAIGFKYWRDPGPFADGFRGVASVFVFCSTFYAGVESVAVAATETKNPGVAVPHSIRQVFIRIVVVYMGCAFFFGLTCPSNAPDLSGGASHALKSPMTIALHNAGWANGTHLINAFIFVTCLSAVNSSIYIGSRTLLYMAQDGKAPRFLGWTDRRGVPVYAIIFTNACGALSMMNVSTGASKAYGYIINLSGVSTFLVWGAISLIHIRFRAAWKAQGHSPEELPYKSLWYPWNAYFGLISNVFLAFVQGWSTLAPFDAGNFVDAYILLPLFPVIYFVYKFTFKTRLWRPHEVDLQAGRRRDLD

SEQ ID NO: 3245 - protein, 748 aa, Neurospora crassa
  unsure (1)..(748): unsure at all Xaa locations
YXDPKSTELNKFSDLPLCEPTASGLRASHFEVLTDVQRAAIPLALKGQDILGAARTGSGKTLAFLVPVLEKLYRARWTEYDGLGALIISPTRELAVQIFEVLRKIGRNHSFSAGLVIGGKSLKEEAERLGRMNILVCTPGRMLQHLDQTAGFDVDNLQMLVLDEADRIMDMGFQQAVDALVEHLPKSRQTLLFSATQSKRVSDLARLSLKDPEYVSVHEAAASATPVGLQQHYIVTPLPEKLDTLWGFLRTNLKSKIIVFMSSGKQVRFVYESFKRMQPGIPLLHLHGRQKQIARLEITNRFTSAKYSCLFATDVVARGVDFPAVDWVIQVDCPEDADTYIHRVGRTARYESKGRAVLFLDPSEEEGFLKRLEHKKVTVQKVNVKENKKKSIKNELQSQCFQSPDLKYLGQKAFVSYVRSIYLQKDKEVFKFDKLDLDGFASSLGLPGTPQIRYQKGEDRQEAQECLARRHVQRVRHRRLGRRDPQEEEGVRTKYDKMAERQNQDVLSTHYRKLLGEDQAEDNEEDDFLSVKRVLDDDAALDDAAGNAKSGTNPDGTAKVVKLGKNAELVIDSHRREKLLKSKKKLLKYMEKGQKLVFDDEGNAHPLYQLQDEEDFQKEGDAKELRQKFVESEATKVKEQDVEDKLLAKQRRKEKRERAKARERGEEVEREKGPLQPALLDAHSDVEEDPLALLRSLPVAGKGGDSGDESEDDREPPKKKAKKWFQKDDSDTEYSDDGRPRRKKAKME

SEQ ID NO: 3246 - protein, 500 aa, Neurospora crassa
  unsure (1)..(500): unsure at all Xaa locations
DVPPDGGYGWVIVAAVFLINVNTWGINSAWGIFMEQYIRENTFPEASHFEYALVGGLSVSLALILGPIISAIQKTLGTRYTMVLGSLMIFGGLFSASAASRVWHLFMSVGLCMGFGFGLLYIPGELPFLYGYFEKKKKKKKKKKKKKKKNWVSGLQXTHKQAMGLLPPWFSRHRSLALGLATAGAGGGIAWNLITGKLLSVSGLKWTWRILALVSIAFNILCAFLCRERPISSSTGSLKRRSFNIRDFGRTQVLLILLWGFITEFGYVSLWYSLPSYATSIGLTPSQGSVVNAMLSLGVGVGRPLVGXVSSLTNTVSLSIAPQRQFPAVCXFSYYFTSALSDRFGRINLALFCCSSCAILCLTLWILARSYAGLIIFALAAGAGGGCFWSTVNPILAETVSLAESSAIFGTICFALVIPTTFGEAIALQLVKGGDGINKFIPSQIFVGCTFLGGTALLMLLRSWQICEIERKSEGMGSGQHEQGHKRSGEESRTEEDLSK

SEQ ID NO: 3247 - protein, 556 aa, Neurospora crassa
  unsure (1)..(556): unsure at all Xaa locations
VIATQAIANVVKSSFGPSGLDKMMVDDIGVSCFSPAPIAESXVNPAMPNTVCADVTVTNDGATILSLLDVEHPAGKILVDLAHQQDKEVGDGTTSVVLIAAELLKRGNDLMKNRIHPTTIITGYRLALREAVKYMKEHISIKVENLGRESLLSIAKTSMSSKIIGADSDFFANMVVDAIQAVKTTNNKNETKYPVKAVNILKAHGKGVTESMLIKGYALNCTVASQAMTTRVTDAKIACLDINLQKERMKLGVQITVDDPQQLEAIRARESGMIIERVEMILKAGANVILTTKGIDDMVLKLFVEKGAMAVRRCKKEDLRRIARATGATLLSTLSDLNGDEKFEPSYLGHAEEVVQERISDDECILIKGTKVHSSASIILRGPNDFTLDEMERSVHDSLCAVKRTLESGSIVPGGGAVETALHIYLEEYAGTVGSREQLAIGEFAQSLLVIPKTLAVNAAKDASELVAQLRSRHALSQRIQEGEANEDEKIVARKKAYKNYGLDLMKGKVVDEIKAGVMEPSMSKITQLKSAVEACISIMRIDTLIKLDPEQRAED

SEQ ID NO: 3248 - protein, 451 aa, Neurospora crassa
  unsure (1)..(451): unsure at all Xaa locations
LDDISHRRYNPLNGSWLLVSPHRTKRPWQXVLDSHTGNKEIQRVSLNXRVAIRGQQEAPALNKLPEYDSPGAXSPSLHDFILLSLTLTATQCYLCPGNKRAQGDSNPHYKNTFAFVNDYSAVKEEQQEYHPRKDAAGDGDDDIASLLLQAQPATGRCYVLTFSAKHDTTLADMSATEIVPVIETWTRIYASHLSASHPLRDAAARSLSEIPPNPDGEVEPAKKQQLRYMQIFENKGAAMGCSNPHPHCQIWTTSTLPEEPGKELAQMTKYHREHKGRHLLEDYVKVEMAKGERVVWQNDGFLVVCPWWAVWPFEVLVIAKRHVRALVELTSEERLQFAEAVQEVTRRYDNLFETNFPYSKFYYPLQLPEGERKGERSXRYEKARVFIQAPLDCTEEEAETSWFHMHFYPPLLRSATVRKFLVGYELMAEPQRDITPEQAAARLRDCGGELY

SEQ ID NO: 3249 - protein, 282 aa, Neurospora crassa
KYGKKGTWAVITGASDGLGKEFAQQLASKGFNLVLVSRTQSKLDVLARELELRWDGFKAKTFAMDFSKDDDSDYERLAELIKGLDIGILINNVGQSHSIPVPFLQTDRDELQNIVTINCLGTLKTTKVVAPILAQRKKGLILTMGSFAGVMPTPYLATYSGSKAFLQHWSSALSAELKDQGVDVHLVVSYLVTTAMSKIRRTSLLIPNPKQFVRAALGKVGLNSSEPFPNTYTPWWSHAVFKWVVENTVGAYSYFTLRLNKNMHIDIRNRALRKAAREAKKQ

SEQ ID NO: 3250 - protein, 579 aa, Neurospora crassa
  unsure (1)..(579): unsure at all Xaa locations
QQQLPHHRREGAEDQEDGHAAAAAADLVTTTESRSLTRGLAQRHLSMLGIAGSIGTGLFLGLGGAVARGGPLGALLGYFVIGLIVCAVQFALGEVASLLPVTGSFVRHAEFLVDPAWGFAIGWNLVYGNVLSIPSEITAICVLFEYWTEGRVSPAVFIVFFVVVTVGVGMALVRVFGEVEFVFAMLKVVLVVFLILLGLVIDLGGIPGTERIGFRYWKSPGPFVEYIATGDWGRFLGFWSVMTGAVFSFAGVESLAMAAAETRNPRKAIPRACKRVFARVVLFYMLAVLVVGMLVASDDPRLDGSGDSVAQSPFVIAASAAGIKAIPSVVNAIVITSAWSASNQSLLAGTRVLYGLALKGQAPKIFLRTTSWGTPYMCVLLFGVFMSLSFMSLSERAINVFWWLVRLTSAGVLVSWSSILVNHIRLRKAMDRQGIAYTRLPWSAGGLVSCCRQSXIPDLRLITFPVIVYSSPVALFMCIVILLTGGFSVFTKGNWDAATFVSSYLXVHQHQSDYSRKDTNEXLGTFPIVLIAYLAWKFYKKTKIVSLDDVPLDIAFEQAEDAIFEDPEEGKTKGWARVV

SEQ ID NO: 3251 - protein, 314 aa, Neurospora crassa
LLTSIAATSTALRAAQDVSLAGSSNSFGDDQLNVDVLAEEAIRLCLAQCPSVVTASSEEDPIEKPVQHTGLPFQVVEAEQDRTHGEVYTVAFDPLDGSSIIAPNWTVGTIFSLWDGTSALGASPRDKQIGAVLGVYGPRTTAVVALRFPGEEKGVCFEVGLSDSSEAGKGQEWDLIRPSVSYAPPPFKTRYFAPANLRSTNTHAAYAKLVAHYMAENYTLRYCGGLVPDVVHALVKGHGVYLSPVTETSKAKLRSLYELFPLALVVECCGGRAVDPVSGENILGDKGVEGCDERGGIVCGTAEEVEYAKEVLCG

SEQ ID NO: 3252 - protein, 314 aa, Neurospora crassa; identical to SEQ ID NO: 3251

SEQ ID NO: 3253 - protein, 440 aa, Neurospora crassa
  unsure (1)..(440): unsure at all Xaa locations
GIVDALCEACERLGYKNPTPIQEQSIPLALQNRDIIGIAETGSGKTAAFALPILQALLDKPAPLFALVLAPTRELAAQIAQAFEALGSLISLRCALILGGMDMVTQAIALGKKPHVIVATPGRLLDHLEKTKGFSLRSMQYLVMDEADRLLDMDFGPILEKILKFLPRERRTFLFSATMSSKVESLQRASLRDPLKVSVSSNKYATVSTLKSNYVFIPHMHKDTYLVYLCNEFAGQTIIIFTRTVLETQRIAILLRTLGMGAIPLHGGLSQSARLGALNKFRAGSREILVATDVAARGLDIPNVDCVINHDLPQDSKTYVHRVGRTARAGKSGHAISIVTQIVSFTPCSALSHRERXAXPXCSDLEIWLRIEAALGHKLDEYPLEKDEVMVFKPRVEEAQRHARNEMKSLMENQGKHGGLLKRKRGNGQGGGRDHMDAEE

SEQ ID NO: 3254 - protein, 319 aa, Neurospora crassa
  unsure (1)..(319): unsure at all Xaa locations
LTTVNSSKTHKLNTGDEIPAVGLGTWQSKPGQVEKAVEAALRAGYTHIDTAYAYGNEKEVGQGIKASGVPREKIWLTTKLDNDWHKHVAEAIDTSLKNLDTPYVDLYLMHWPASLVKGNTKEVYNDWDFVDTWREMQKLVDTGKVKNIGVSNFGVKNLEKLLSAESTKVSKIVLLLLFKFCCELMRTSHIXLQIVPAVNQIELHPGNPSPHLVEYLRSKGIHASAYSPLGSSDSPLYKLNSLTKLAESKGKTVQQVLLRWGVQKGWSVLPKSVTEERIKANIDLEGWSLTDEEIAQIDEVHKENSFKVCGDDWLPVKIF

SEQ ID NO: 3255 - protein, 152 aa, Neurospora crassa
PYFSSPSVQEFADCTTAPPPGISITLPSDADLHTWHVTVTAPPNSVYAPGRFGLILKLPTDYPFKPPTINFTTRIYHPNITNDSLGNICLGLLKSENWKPASKIISVLEAVRNILVEPMPDDALEQRIADEYRRDRPEFEKNARAYVERYAK

SEQ ID NO: 3256 - protein, 295 aa, Neurospora crassa
PKCANPKCPKPNVVDGTCQTCGMVADDSNIVSEITFGESSSGAAVVHGTHVAFDQGGIRGVGGLAFRRVAGGGASEARERSLREVKALMQQYSYQLRIGQSISDIAFRYYKACSHANFVQGRRKQNVAAICLYAACRAENNHKIMLIDLADLLHTDVFALGRGYKDFLNRFPEFLTGPRPIVIEDLIYRFASKLEFLHDTNKVALSAVRIAKRMQHDNITHGRRPAGICGAALIMAARAHNYRRTVREVVYIVKVTMATIQERMDEFASVPAAQMTVQDFDNEDLLKAAPEHDPP

SEQ ID NO: 3257 - protein, 513 aa, Neurospora crassa
  unsure (1)..(513): unsure at all Xaa locations
INKAIQDIGMGRYNWQLFVLCGFGWFADKYEALFKIRXINPLLTPVSHSLWMQGISLTLPSLSAEFDISEKTVRYTTSFLFAGLCVGSFIWGIGSDVLGRRLAFNATLFITAIFGIASAFATSWAGVCFLYAALGFGVGGNLPVDGALFLEFLPDASSSLLTLLSVWWPIGQLCSSLLAWYFIGHLPAEQGWRHFVFSIGIITLIMFLVRFFIFHLYESPKFLLSSGRQAEAVAVVHGIAFRNGRKTWLTEEILDAVVDGLSSLSPATPRRRQHVTRQRLSTANIIKQRFASFSSNRLRPLFSSRKLGLTTVLIWFCWATIGMGYPLFNAFLPQYLSHGGNNGGQQPAPETSTSIDSPETISAETYRNYAITSIAGVPGSLLAAYAVDMKSPFFGRRGTLALSTLVSAIFLYLFIKFGTTSAALLTFSCIEAFAQNIMYGVLYAFTPEIFPAPVRGAGTGVASFLNRVTGLVAPILAATVPGDGRTTPVYLSAALILAAFVGMVLIPIETRGR

SEQ ID NO: 3258 - protein, 352 aa, Neurospora crassa
  unsure (1)..(352): unsure at all Xaa locations
VEKYRPVFLDDVVGNTETIERLKIIAKEGNMPHFIISGMPGIGKTTSVLCLARQLLGDAYKEAVLELNASDERGXKRTRASSSVAMSYAKQHKNPPILTYQPKKTNRIEVVRQRIKGFAQKKVTLPPGRHKIVILDEADSMTSGAQQALRRTMEIYSNTTRFAFACNQSNKIIEPLQSRCAILRFAKLTDAQVVKRLLQIIEAEKVEYSDDGLAALVFSAEGDMRQAINNLQSTHAGFGFVSGDNVFKVVDSPHPIKVQAMLKACYEGNVDAALDGLRELWDLGYSSHDIISTMFKVTKTIPTLSEHAKLEFIKEIGFTHMKILEGVQTLLQLSGCVARLCKLNMDPKKFAV

SEQ ID NO: 3259 - protein, 446 aa, Neurospora crassa
  unsure (1)..(446): unsure at all Xaa locations
GSIPAAKKKYVPTSGTYPLGFSASGINVGVKPKNTTKPDVCLVASDRPCAAAAVFTKNKFQAAPVTFSRSLLQKKGNQGIQGVVVNSGCANAVTGKGGLEDAGKMAQAADECFGQSESTLVMSTGVIGQRLPIEKITSNIPRAHKAMGSTHDHWLTAAKAICTTDTFPKLISRSFKLPSSPSVEYRIAGMTKGAGMIHPNMATLLGIIATDAPVSSTVLPAVLKHAVDRSFNSITIDGDTSTNDTVALLANGAAGGKEVVANTPDYDAFQTVLTDFSTDLAKLIVRDGEGATKFVTIRVVEAASEEAARKIASTIARSPLVKTALYGKDANWXVAENYPMRFGSYXRCHXGRILCATGYSLVSEPGLPVNDVSEVVPEKTNVSFIPTDGTAELKLLVNGEPEQVDEARAAEILELEDLEILVRLGTGDKQATYWTCDYSHEYMXVD

SEQ ID NO: 3260 - protein, 257 aa, Neurospora crassa
  unsure (1)..(257): unsure at all Xaa locations
MSTEQPAPRWAAFARDTNETKIQIALNLDGGAFPPETDARLNVSIADGHATQASKSQTISVNTGIGFLDHMLHALAKHAGWSLALACKGDLHSXXTHLAWAQKSSWNNIQNSELTLSLSXVDDHHTAEDVCIALGYAFAKALGTPTGLARFGSAYCPLDEALSRAVVDLSNRPFAVVDLGLKREKIGDLSTEMIPHCIHSFAGAARITVHVDCLRGDNDHHRAESAFKALAVATRQATSRVAGREGEVPSTKGTLSV

SEQ ID NO: 3261 - protein, 1283 aa, Neurospora crassa
  unsure (1)..(1283): unsure at all Xaa locations
DFKSYKGHHTLLFGDSYFTSIIGPNGSGKSNSXVAPGCGRXGLLSYXRARALLGMDAISFVLGIKSSHLRSTHLRDLVYRGRVMKTSKIQEDGTAAPATNGVNGHEDGEDEDPSQRSSRNDPKTAWVMAVYEDDAGDEQRWKRTITNSGSSEYRINDRVVTAQQYNDALEAENILIKARNFLVFQGDVEAIASQSPQDLTRLIEQISGSLEYKADYEKLQAEVEQAAENQNFQLHRRRGINSEIKQYQEQKKEAENFQRKTEERDEAVITHILWKLYHFQKVMDESSAQIQEHQENLKEFRRNVEAFENKLDAARKEQATVGREVGKVERNIKAKEKDIEDKENSLVPIDEKIAQSTQDMGVLRKRIVEVKKDRDSQASSISKLQKDLATVEKAQQQFEKQWAETLKKQGKELSDEDRKEYTSLQAEAMKKTADNRAKLANLTRQLKSDEVTVNSLKGKIDNFEAAIEKLQTEVQSIKDRKDASEDAVQQLRSDIAAKKKEYNKLQSERVRINQTRTAQEEKLREILRKLEDAESGRRQNEKETRLRNMISDLRRIYPGVRGRVGDLCKPKQKKFDEAVITALGRDFDAVVVDTEKVGMDCVQYLKEQRFPPLTFIPLDNIKVNSSVSAVKGISGARLTIDTIDFDPSLERAISYACGGSVVCDNLHIAKDIVYGRKIQVKAVTLEGFVIHKAGTMTGGRLPNEKGGKRRFEEHDIQNLQRMAQSLKDEVAALAHSGRRTAKEDALLVEFTALEQRLKIQEGELAAFEKNLKSKQKELDHQERQLDDYEPKYEEKHGELERTRATVQKFEKAISDVEDKIFKDFCKRLGYENVRAYEAQQGTLEQEAAQKRQDFDIQKQRIQSNITWEMSQHTATSDRIASLERTLQRHERDLDTYRQEKASIEEELAEDREALEELEQSLEELKVSHAEKTKKVQEAKQDLQRRSRDIEVRLKEISNLEATVQQSSAQKLALLRRCKLEQIQIPLQQGSLDDIPNEDMLLQKDQDAMDVDGEDEDQEAELLEAAMDDYGVEINYDNLDDALLQDPNDEVEEKLQEKISALTAEIEKLNPNMRAIERLESVKSRLESTEKDFEDSRAALKAARDAFNQVKDKRFELFNKAFTHIQEQITHVYKDLTRSDAYPLGGQAYLDIEEDTDTPYLSGIKYHAMPPLKRFRDMEHLSGGEKTMAALALLFAIHSYQPSPFFVLDEVDAALDNANVEKIKKYIREHAGPGMQFIVISLKAGLFQDSESLVGVYRDQDVNSSKTLTLDVSFSPPFLLLLTI

SEQ ID NO: 3262 - protein, 198 aa, Neurospora crassa
  unsure (1)..(198): unsure at all Xaa locations
PFFGAMGCTAAIVFTCLGASYGTAKSGVGIAAMGVLRPDLIVKSMSNFPRVKLSSGVVSYINMLTWLLPQDIVPVIMAGIIGIYGLVVSVLISDALTQDHYALYTGFIQLGAGLAVGLAGLAAGFAIGIVGDAGVRGTAQQPRLFVGMILILIFAEVLGKSSVILASHPHXRLTRCLGLYGLIVALLMNSKATLNTSC

SEQ ID NO: 3263 - protein, 470 aa, Neurospora crassa
PGMDPKIDTSGHFEFGGSLGTGAMMIFFPILMWYMWIGATQYNGGIPSREPGQSWADFAAHLCDLVYTKAFPHAKAWLWYWTFLIFEGAFYCLMPGVTAYGKPLPHEGGKMLKYHCSAYVSFYVTFAIAGVLHFTGIFPLYQIIDEFGPLLSVAIISGFLVSIVAYVSAFVRGATHRMTGHHVYDFFMGAELNPRMFGVLDFKMFFEVRLPWYILLLLSLGAAARQWDRYGYVSGEVGFLVMAHYLYANACSKGEELIVTTWDMYYEKWGFMLIFWNLAGVPLSYCHCTIFLASHHPDEYRWNRFALVGLYVSYLFVYWVWDTCNSQKNRFRAQERGKLLYRKTFPQLPWQTVKNPQKIETETGDSILVDGWYGLARKVHYTCDAYFAICWGLITGFSSPFPWFYPVFFCCMIAHRAWRDITRCREKYGDAWKEYERRVPYLFIPVSFFFFSFFSLFFFFFFPFRHSCWG

SEQ ID NO: 3264 - protein, 412 aa, Neurospora crassa
MIDLGLARIGRLLQHTPQTWKAIHVAGTNGKGSICAYLSAMLSASGVSCARFTSPHLIDRWDCITINEKPVSETIFRQVEGLVKQRDQDEKIGATEFELLAATAFEIFHRLKVEYGVIEVGLGGKLDATNILKHKSVTVIAKIGLDHQSFLGNTVEEIALQKAGIIRSGVPCVVDDSNESSVLKVIQDHAKEVGGVELHYPSSDSALLQILTKEGYEPHQVQNLACALLAFRLACPDVDHSMSRLLPIVKQLQWPGRLQKIDLFPIIRQHQEALLDGAHNSQSAEVLAGYVNKHYRSRSQSITWVLAASKGKDVDSIMSHIIQPSDHVTAVQFGQVDGMPWVKAEDPANLINQATRYGVETQNTHNSGDDVRAALEWASKAAGDKPIVVAGSLYLVSSVLRLMREAESYQKA

SEQ ID NO: 3265 - protein, 597 aa, Neurospora crassa
  unsure (1)..(597): unsure at all Xaa locations
RVASSLSRPSSSIPVVEHPVVPSAIALRPCRGRIERXRKSQRLVPYIKRDIVANSIFAHLDGHPESKHEPPLKPSESTTNAEPAKPLAPPPRPAAQQQSTNSPSDYFSQNPISGSLSLEPNPFEQSFGGAPETPGGTKLPPVAALASPSSILPPGSTPFPWGGSNSLRSGPLSPAMLSGPTTSDYFGDHIRGGFPTPNESSLRTGLTPGGSGSMFPAPSPNSTLFAQLAGPAATPGTIDFHRTAISAAAAKAQAQAQAQQQAAHQHQQQSQPPSITSQPASDLPNGIPPLKPETKPPTGPFDPHDNDAANGLFMLAQGRNASQPPSQSFNVVSAPPPPPSSHPHTVPAPPVQPVNTSPQMNGNVSIAGSSARGVSEVSIGSDDSELARPNTRGKGKRNSTSAATTGSRRKAEETPAKTPANKKTKTNGSVSSLNGMDYSGSEDESKPGKDDGTGSKSKMTEEEKRKNFLERNRYVKLVMLAIGKHLILTVCRVAALKCRQRKKQWLANLQQKVEMFSSENDALTATITQLREEVVNLKTLLLAHKDCPVTQQQGLHGAFMQQAIEPFSHQMNPYGMGAGIPNQPVGMPPNVAPRRFS

SEQ ID NO: 3266 - protein, 255 aa, Neurospora crassa
  unsure (1)..(255): unsure at all Xaa locations
VLLGITGKDFTIIAASKAAMRGATILKASDDKTRSLNKHTLMAFSGEAGDTGTAAISXXWRFXTKPSXPTVCSHRQVQFAEYTQANAQLYSMRNGTDLSPSALANFVRGELATSLRSRKPYNVNLLLGGVDPITHKPSLYWLDYLASLAKVPYAAHGYAQYVISTDISVPSLMRRSHVQNHXPVLSSSDTYCLSILDKHHHPDITLHQGIKLLNLCTDELKRRLPIDFKGMTVKAVTKDGIIDIEFDDDKVVKMA

SEQ ID NO: 3267 - protein, 559 aa, Neurospora crassa
FEGQQGAGWGGPRPQGGFNPNAYRGNAGAGAGAGAGGGGGSFSNRGSGDGQWRDGKHIPGPANPRVERELFGTPDDPSKQHTGINFEKYDDIPVEASGDNVPEPVLTFSNPPLDNHLISNIQLARYNVPTPVQKYSIPIVMGGRDLMACAQTGSGKTGGFLFPILSQSFHTGPSPIPASAAGAYGRQRKAYPTALILAPTRELVSQIYDEARKFAYRSWVRPCVVYGGADIGSQLRQIERGCDLLVATPGRLVDLIERGRISLCNIKYLVLDEADRMLDMGFEPQIRRIVEGEDMPKVNDRQTLMFSATFPRDIQILARDFLKDYIFLSVGRVGSTSENITQKVEYVEDIDKRSVLLDILHTHAGGLTLIFVETKRMADSLSDFLINQNFPATSIHGDRTQRERERALEMFRNGRCPILVATAVAARGLDIPNVTHVINYDLPTDIDDYVHRIGRTGRAGNTGIATAFFNRGNRGVSRELLELLKEANQEVPAFLETIARESSFGGGRGGRGGGRGGGRGRTQTADYRKFGGSGGGGFGGGFGGAPASGGYGGGGYGGG

SEQ ID NO: 3268 - protein, 676 aa, Neurospora crassa
  unsure (1)..(676): unsure at all Xaa locations
MASSQPNMEKFLREWRQDALNKAQYESAIFIGDKLLAMTSKHLYSPSPRXRLXCLTVGLPQDDDNDAFFLAQVHFAAGNYTRAQALLVKQDLLTSSPSCRYLAAHCLIKQNNFVEALAILGEHTPTHLFATNAKRKTTRGLRGTTARASSKTPSRHHDQGDDIPEEDIPSRRYEASMCYLRGLCYAKQNAFDRAKEAYKDALRIDVQCFEAFSQLVKNSLMSPDEEDEFMQSLAFDSIRAPGDDPDMEDEPADYVHMLYQTQLSKYRNPQAFNTAIESLSTHYGLENNADILLAKADLLYTQCRFKDALAITESILMDDKYNFAVYPIHLACLYELRKTNVLFLIAHELADTHPDEPCTWLAVGIYYFTTGKIADARRYFSKASMMDANFGPAWIGFAHTFAAEGEHDQAVTAYSTAARLFTGTHLPQVFLGMQNHAMNNMTAAEEFLKTAYSLCKTDPLLLNEMGIVLYHQDRLKEAVKMFDQALAIAEETDSDPHAWLGARTNLGHALRRLRKHDEALEEFDQVLRDGGKDAQIFCAKGLIYLDQGRPDEAVRVLHEALAIHPQDPIATELLNKALEESAEAGGIGLLGTADADLGGEAGDEAITASFEQLLGGAARMRLARERGRRAVAETPGQGGVKDKGKGVARGGRRGAAGGTRLFRGDQEEVDSMELSD

SEQ ID NO: 3269 - protein, 463 aa, Neurospora crassa
  unsure (1)..(463): unsure at all Xaa locations
MAIARPVRALALAAALVWCFFIWQLLSPSGTAMTKDKYLSFERDPNLDRKWMWRFCFVRSRIAVRCXSALARRTATGEPEGKLIRASEDYAPGAKNSARINATLLALVRNEELEGMLQAMRDLERTWNHKFNYPWTFFNDVPFSDEFKKRTRAVTKAEVRYGTXGGVATHTVXYVEQTGXFYCDGYELIPKEHWEMPSWINQDLYHESVKILEEKKIQYADKISYHQMCRWNSGMFYKHPALANTQYYWRVEPNVHFFCDVDYDVFRYMHDNNKTYGFTINLYDAPASITTLWPETEKFLAEHPEYVHENSAMNWLTDKTRRPDHTKDANGYSTCHFWSNFEIGDMNFWRSKAYEDYFNHLDRAGGFFYERWGDAPVHSIALGLFEDSSKIHWXVSTESLPQPLMLTIPFLGSRDIGYQHIPFFNCPNSPKCKGCVTGRFTDGEAWLNREDCRPNWFKYVGMG

SEQ ID NO: 3270 - protein, 271 aa, Neurospora crassa
LQGKVVLITGGAKGIGRMIAEGFVRNGAKVYISSRDAAACETAALELNALASKTSSGGSAVALPADLSSAEECTRVAQELSKREQKLHVLINNSGATWGAAYDEYPDNAWTKLLTLNLHRVFTLTQALTPLLEKAAKKTSSSSSEGRSDDGVVIDPARVIHIGSIDGIRVPLLPTYAYSASKAGLHHLSRHMAVELGPRGITSNTLACGPFPSKMMAATLRDFGEDIKAANPLGRIGTPEDAAGACLFLASRAGAFVNGATVTLDGGVALV

SEQ ID NO: 3271 - protein, 193 aa, Neurospora crassa
  unsure (1)..(193): unsure at all Xaa locations
LSSLSNLFWTKKEIRILILGLDNAGKTTLLYRLKVGPPVEKLTNGSAHSSESXQHVVIGEVVTTIPTIGFNVESVTYKNLNFNVWDLGGQTSIRPYWRCYYANTAAVIFVVDSTDMERLQTAADELAAMLNEEELKDAALLVFANKQDQPGAKGAADISQALRLGELRDRNWSIMACSAVEGTGITEGMDWLV

SEQ ID NO: 3272 - protein, 190 aa, Neurospora crassa
  unsure (1)..(190): unsure at all Xaa locations
TAADXLASNTDRVVAERSLLIKNLIEDLGDEAVMNEAIPLPNVNEPVLRKVVEWCEHHRKDPPQTTEDENDSRKKSTEIDEWDQKFMQVDQEMLFEIILVGFSLVLPADATXYANITRVLQGQIMLTYSSSRAANYMDIKPLLDVGCKTVANMIKGKSPEEIRKTFNITNDFTPEEEEQIRRENEWAEDR

SEQ ID NO: 3273 - protein, 917 aa, Neurospora crassa
  unsure (1)..(917): unsure at all Xaa locations
RELLPTNVIPKHYHITLEPDFQKLTFDGTVVIDLDVEEDSKSISLHTLEIDIHNAKITSGGQTVRSSELTSPPPVVLFTCCTYFAPALILRLRPSXLXANSSSPKVSYNETTQVSTFDFDNAVNKGAKAQLEIQFTGQLNDKMAGFYRSTYINPDGTQGLLAVSQMEPTDARRAFPCFDEPSLKAEFTVTLIADKKLTCLSNMDVASESEVKDGKKAVTFNKSPLMSTYLVAFVVGELNYIETNDFRVPVRVYAPPGQNIEHGRFSLDLAAKTLAFYEKVFGIEFPLPKMDQIAIPDFAQGAMENWGLVTYRVVDLLLDEKVSGAATKERVAEVVQHELAHQWFGNLVTMDWWDGLWLNEGFATWASWYSCNIFYPEWKVWETYVTDNLQRALALDSLRSSHPIEVPVKRADEINQIFDAISYSKGSCVLRMISTYLGEDVFLEGVRRYLKKHAYGNTQTGDLWAALGDASGKSVEEVMDVWTKHVGYPVVTVTEKDEKTIHVKQNRFLRTGDVKPEEDKVIFPVFLGLRSKDGIDESLTLDKREDSFEVPSTEFFKLNANHTGLYRTSYTPERLEKLGEAARQGLLSVEDRAGMIADAGALASSGYQKTSGVLTLLKRFDSEKEFIVWSEIISRVAAVQAAWIFEDKAVRDGLEAFQRELVSPRAHEMGWEFSESDGHIEQQFKAMLFGNAGLCGDEKIIAAAKEMFKKFIAGDKSAIHPNIRGSVFSIALKYGGTEEVSLVYPVNTXKPGANQSLIFPLXYDAVLNFYRTSTNSDERNTALRCLGRARSPELIKRTLDLLFSGEIKDQDVYMPTAGLRSHPEGIEALFNWMTENWDELVKRFPPQLSMLGTLVTIFTSSFTKREQLAKVEKFFEGKNTNGFEMSLAQSLDAIRSKVAWVERDGEDVAKWVKDNKY

SEQ ID NO: 3274 - protein, 350 aa, Neurospora crassa
  unsure (1)..(350): unsure at all Xaa locations
RANILKEVQIMRQLDHPNIIKLVDFAESRQYYYIILELAPGGELFHQIVRLTYFSEDLSRHVITQVAKALEYLHEEKGVVHRXVDPHHRASSXXISAHSLNSDIKPENILFSPIPFIPSKHPKPKQPGDEDKVDEGEFIKGVGSGGIGQIKIADFGLSKIVWDKQTMTPCGTVGYTAPEIVKDERYSKAVDMWALGCVLYTLLCGFPPFYDESIEVLTEKVAKGQYTFLSPWWDDISKSAQDLISHLLCVDPEKRYTITEFLAHPWIAGSGPTPRDERKNPDGVLRAFDASKIVDGDRRYDFRSPGAVNLREVFDVGYAVHRQEEEGKRRHNLGAKAGVSRLVGLDENSD

SEQ ID NO: 3275 - protein, 528 aa, Neurospora crassa
  unsure (1)..(528): unsure at all Xaa locations
EEDQEDYCKGGYHPVTIGEKFKDGKYTVVRKLGWGHFSTVWLSRDNTTGKHVALKVVRSAAHYTETAIDEIKLLNKIVQANPNHPGRRHVVSLLDSFEHKGPNGTHVCMVFEVLGENLLGLIKRWNHRGIPMALVKQITKQVLLGLDYLHRECGIIHTDLKPENVLIEIGDVEQTVKRVVKDEPNDKENTRNSRRRRRTLITGSQPLLRLSMPASIRDRCSPPQHPSRLARCWRKVSRNDLQKVLSTNLXLTLNRGKSQEGSPFHNKNGEDDQSRREKSADLLSKEVSGISLDKTATPPATSGDKRNLDDMQFDIISVKIADLGNACWVNHHFTNDIQTRQYRSPEVILGAKWGASTDVWSMAAMGTXIXPEXRCSADANTRPQVFELITGDYLFDPQSGTKYGKDDDHIAQIIELLGAFPKSLCLSGKWSQEIFNRKGELRNIHRLRHWALPDVLREKYHFKAEEAQRIADFLMPMLELIPERRANAGGMAGHSWLEDTPGMKGIKIDKVEVGSRGEGIEGWASEVR

SEQ ID NO: 3276 - protein, 473 aa, Neurospora crassa
  unsure (1)..(473): unsure at all Xaa locations
EYAFEMAASSIRFGPGVTQEVGMDIANLNPTGTVAVITDSTVEKLDAMRQVRESLDREGIKYKIFNKVKVEPKDYSVKEAIYWARTTGDYSVYLAVGGGSVIDTAKLMNLYSVYKDADFMDFVNAPLGKGRPVDRKLHPLIAVPTTAGTGSETTGTAIFDLVAKKSKTGIAHRNLKPYLGICDPLNTRTMPSAVKASSGLDVLCHALESYTAIPFNERTPRPTNPILRPAYQGANPISDIFSLNALRQTVKYLPRSVKDPEDVEAQTEMLLAATLAGVGFGNAGVHLCHGASLSFSSSSSSSLSLLSSXVIMLLVXPFPXLIITIANTFRKGMSYPISSQNIASYKHAGYDVPHPIIPHGVSVAVTAPAVFKFTAASNPDRHLAAAEAFGVDISNVKRESAGEVLAEAIAKFLADLGDQPAGLKALGFGREHVEQLVEGTIPQARVLMLAPGLAKELQAEREQLGRLFEDALE

SEQ ID NO: 3277 - protein, 1026 aa, Neurospora crassa
SSISGPTYVNSQLLVQQTAYKLSDKIFSYSPETFDLDVAVKEWAEANEKNVHGETTTVVPLQTRAGAGAFALGYIFSKDFDLAKRHVPQTLLAPSLSLRHLRSSLDQLALLYGVSSPFVAHVAAADYSAEKGLGADYATALQIAEDLGLALVSSSSAYEVQHMSLLATLLASVLPTLHIYDGIRTARESLRVVDALGEAHIADIYAKISKEAAALNKRLDTAGKVVELLKAFNNELGTSYAPFEYHGHEAPETVLVVFGSAEAQLAKQVASALAAEGKKVGTIVVRVYRPFVEEAFLEVLPASVRQIAVLGQVADAAAVEDANVQSALYSDVLTAVSFTDKLSQAPEVVDVRYAVTDAHTPSSIASIFNKLTSKGEAEPVAFSLTAVEEAQQYVFWDVDNSSAAASASAVGKLLETEQSNNVYVHQTYDNLVQGGVVRTDIRVSQKSIEAPYPVESADVVFVGEEKLLKEIAIVKGVKAGGKLIVRLPNFKEDELEKRIPAAAQKEIQEKGIELYVLDSSSSPALEKEAGLLVDVAFLRVARADITKFDSLSADQTALTEAVNALDQSVRKVEVPAKWAEVENTVAPLVDSVKPNSFVAFQKEEEEETSSLENWQSAAKGFAFKEAYGTQNQLRPDLTVKTYTIKVKENRRLTPTDYDRNIFHIEFDLGDSGLTYNIGEALGIHADNDPEQVLQFIQAYGLNADDLVQVPSREDPAVLETRTVYQSLVQNVDILGKPPKRFFEALAQFATDEEEKKKLERLGSKEGADEFKRLTEEDTVTYVDVLDMFKSAHPDFNDLVRIVDPTKRREYSIASAQAVTPNSVTLMIVVVNWVDTKGRTRYGHATRYLSGLAPGSTITASVKPSVMKLPVKDTAPLIMAGLGTGLAPFRAFVQYRAMQKAQGKEIGSILLYLGSRHQREEYLYGEEWEAYLDAGVITLLGAAFSRDQPEKIYIQDRMRQTVTDIVKAYIKEEGSFYLCGPTWPVPDVTAVLEEAIAAEAQESSRKVDPRKEIERLKEDGRYVLEVY

SEQ ID NO: 3278 - protein, 1053 aa, Neurospora crassa
KNMASTSTNQSFSTDTVVDLGGKVPSSQPPPLYRVTVAIGGMTCAACVNTITNELNKKDWIAHVSVNLINNSAAIDIHDESRATELVEAIEDLGYDVKLDKVIALADPSKPPPKPKAGGEILSDAWRATVSIGGMTCASCANSITNEMKKRDWIQDITVNLLTNSATVEFAGRENANKLVGEIEDLGFEATLNEETLVNVAIHEGGPNPEEEQQQRREVEIRIQGMYCEHCPSRVSASLAGFRRQLDVISQPSHKRPIVKIVYVPDAPEFTIRHILKAIEASDPAFKASIYHPPSLEEQSKAIQRHHQMQILWRVLFSLVVAIPTFIIGIVYMNLIKASSGNKSREFLMKPWTSGISRGQIALFILATPVYFFAADIFHKRAYKEIRTLWRRSSRVPLLQRFYRFGSMNTLMSLGTTIAYVSSVCQMIAAGAQKVHMVDNANFYFDSVVFLTFFLLLGRLLESYSKSRTGDAVEMLGKLRPTTAILVEGYGTAKERDEVVQADSLDYGDVVRIPHGASPPADGIVVRGEGSLDESSLTGESRPVKKIVGDEVYTGTVNKDAPLLVRVTGVAGKSMLDEVVKAVREGQTKRAPIEQVADILTAYFVPVVTAIAVATWIIWLAVGYSGHVSNDLLGDTKGGWVVFALQFAISVFVVACPCGLALAAPTAIFVGGGIAAKHGILAKGGGEAFEKASRVDCVVFDKTGTLTMGGEPKITESEVFHDAAADGEAGTVFAALKAVEENSSHPIAKAIVAFCAAKTSAKAQVEDLQEIAGKGMKARCIGVDSQNDFDLIVGNESLMEDFCVTVSNETVQTLQKWKREAKSVALVAIRRHQSNDPNRWLLAVTLAISDPIRPEAPLIVDALQSRGTRVWMLSGDNPVTAAAVAHQLGIPADQVIAGVLPTGKADKIGYLQGTEKARVGKGSESSTRRALVAMVGDGINDSPALATADIGIAIGSGADIAISSADFVLINSDLRGVVTLLDLSSAVFQRIKFNFGWAVIYNCIGVPVAAGAFYPIVSHGHHVTLNPAWASLAMALSSISVVLSSLALRSRVP

SEQ ID NO: 3279 - protein, 1965 aa, Neurospora crassa
LETSNRETLAIVDSKTQANATLAEELQTQHKKILKLNQEVTSLNQAVQTAQTAANSAKYREEALKQELEHAKRTNDWLDNELKTKNAEAIKFRKEKGARIAELQRLNEDANSTIESLTRSEQVLRKRLQEAQDKAEETLTKVQQLQEAAARTEEGFKQELESAKRLVELKDQQSETHRNRLKEVELRLEQIKDDHANEIRRIRRELEQEKEDHAQTEQRAQELQNEVDRIKASSDLRGRSPGTGPQTPKGDGSFAATRAGSPFGTPLSIRGRAGQRATDALEELYNVKGQLAGEKRRCKKLQEELDDAVAMLEAKMPEIDELNAESERLKNETIQMSQLLEQSYEERDLAVKTQRKAEAAAATAQAEVKILRGQLRDLSTQVHVLCFNIHAQEKGLDKLTEEEAAKFERLKRGEVSENALDDMSDTHQYITEKFVAFTNIYELQEKNQELLRVVRDLADKMENEEAMAEKQQAAQDHEEVQQLRLVVTTLQDEVKSITVRMKSYMTERDMFRRMLQQRANPAEIRAALGEDVSQREVLTSIEQNSTEDADLAAAYRELQAQYDSYRNDQTTERKSLKEQIDKLSSEKGSLQAEIAKVSSQLTLATERYSMLESNFKAAQSENQQLQKRNQALSESGVKQDLRVQQIAEDLVEARGLAESLRSENANLKAEKNLWKTIQERLSQDNESLAQEKARLNTLLTNQQSLLNERELSESEAKRRQQTQIDALEAELSTTKRKLSEEMEESKKIQLRKEFDAQQYQKRIDELTTMISQVKEENVAAKTTRDHLQARVSELEVELRNAQERADRLRPLPTARAQPAEQGSAEDDSQARIEELENEVQDLKNNIDLLNAQLENAKQQCDNFKQLSREMEEELTSANETQEQYRQQMDADLAAKESRINELQQRVEGLTVELGNSNSELNMLRDSQADVARKFEDKERMLNSEIARLKDEEERYKETFKFHQQDLRAQAEIATKAQQDYEQELVKHAEAAKSLQQLREEHNQLKTYSAQWRAEAESAKLSLTQSEQSWEERRQQLEQEIAEIKARRDDLTAQNKLLHQQLDGVTSQISALKQSRSAMDESAEGTQISANDTAIEGLRELNNYLRREKEILEVQFDLKVQEANRLQQQLEYSQSQLDEARLKLDQERRSQADSARNSLTHKELMDKLNELNLIRESNVTLRNENLRIQAQLAMKNRKIEDLENRIQPLEARISELELDKSFKEAEVKQLQEARDGLQKRIESILSKYGQADPQEVEQLKASVESLQAEREAFKQTEAALEEKLKEAETNLETERTNWKNMRARLAEDFKTRFGNVKTQRNELAAEKQALQTTLDAANERLSAVEKDLESARQDLANLQAQNTQLQEQHAQAAAAAAAASAEQTVPAAVPAAAPAEQDPQLLQQLDALRQELESVKSQKAALETELESLKAELATAIAERDEARAEVARLQSSTHGTDTEMQDVEAPAQPASAPAPAQEGTGLSDEERKALEERIAAAEAKAAEFEAKAKDLEERADAIVKQRSEKMKTALNKRLAESKEAMEKQTQDERQKLQAEYDLKLQQELAILKAEQQSGVSQNGVPATPAKPPTAQTAQTPGAGTPGLPDLANLTDQQTRELISSNQVIMGIIKSNVKKNIAAESKKVREELEVVVKAEYEQKIASAKEQAAALTEKKSALRLNMLDRQLKTEKAKTAVVETAAKETPQKPVVEVWEVAKVAKPAAPPPAPPAATLPAPLSRSQRARKSMTKHTNDGSDAAAVVVKPAPGEEIKPQIPPTPTNKAAPAPARQGSIVGGQVVGNPFGQPGANQSPVTSQPPANPFGAAPQQQQNAQPQQPPATNPFGAPQAQQPGQQQPGQQQQQGGQFPGAQQQQNQNQQGNRTGLPVTARGGANNARGGRGAYGAQGRGGQGPRGRGGFGGRGGANAAQGGGGMNPHAGEFQPGQQAAGNKRPRGDGEGGNQGGPKRAR

SEQ ID NO: 3280 - protein, 491 aa, Neurospora crassa
  unsure (1)..(491): unsure at all Xaa locations
QTISGEHGLDASGVYVTSCPITISGDGLESSPPTTGYNGTSELQLERMNVYFNEVSNNRSRRSPPPREFARXLASRLTGSGNKYVPRAVLVDLEPGTMDAVRAGPFGQLFRPDNFVFGQSGAGNNWAKGHYTEGAELVDQVLDVVRREAEGCDCLQGFQITHSLGGGTGAGMGTLLISKIREEFPDRMMATFSVVPSPKVSDTVVEPYNATLSVHQLVENSDETFCIDNEALYDICMRTLKLSNPSYGDLNHLVSAVMSGVTVSLRFPGQLNSDLRKLAVNMVPFPRLHFFMVGFAPLTSRGAHHFRAVSVPELTQQMFDPKNMMAASDFRNGRYLTCSAILXVADHGMLLLTTNTDESNSRGKVSMKEVEDQMRNVQNKNSSYFVEWIPNNVQTALCSIPPRGLKMSSTFVGNSTAIQELFKRIGEQFTAMFRRKAFLHWYTGEGMDEMEFTEAESNMNDLVSEYQQYQDAGVDEEEEEYEEEAPLEGEE

SEQ ID NO: 3281 - protein, 648 aa, Neurospora crassa
QQKQQKQQPKKEQPNKAANKKNAEDKKKARKNEKTTVEPKDPELETDLFTKLEELPEPEEEEIDMSEWVPLDLSPRMISSIAKLRFSKPTVIQSKAIPEIMAGHDVIGKASTGSGKTLAFGIPVIESWLSAAETRKQNKEERKGATALILSPTRELAQQIRDHLQALCKGLPTAPYICSVLGGMAVQKQKRQLQVADIVIATPGRMWEVMSSDNSVLASLRNISFLVLDEADRLLKDGHFKEAEEIFKALDRPPVEENNEDQKMGGTDEEGQEEEEEDSEEEEEEEEEHVNKRQTLIFSATFNKNLQQKLAGKSKFKATSTQDMEYLLQKLNFRETPKFVDANPVHQMAENLKEGLIMCGDMEKDLYLYATLMLQPTRRALVFTNSVNSVRRLTPLLENLNLPAFPLHSGMIQQARLRSIDRFKANEGAKKKNGSAAILVATDVAARGLDIPDVDLVIHYHVPRAAEDYVHRSGRTARASNSGTSILLCGPKEAVPTQRLVAKVHAQAEVKAGNSGNNTKKLVSSGLRTIDIDRRIVAKLRERVDLAKKIADAVQAKTMGGKEDDWMKKAAEDLGVDYDSEELEKAGKWGGKGSSKKQKQKEAQQMSKGELASLRAALRDLLSKRINTGVSERYLTGLDVSELLKGEQ

SEQ ID NO: 3282 - protein, 392 aa, Neurospora crassa
  unsure (1)..(392): unsure at all Xaa locations
DEPFYTSCQEPAIDQPREKAAMVMLVRNQELMKALKTVQSIEKHFNQWFHYPIVFLNDEPFSKEFISAMNATVSGEARFELVPKKEWLFPEWMDVADAKASIKAQGEAGILYAGLETYHHMCRFYSGVSLATVLRCFLHPRFFXPPHSVPLHSKFYTLEALKDYAWYWRIEPDVEFYCSITYDPFVEMAKHDKVYGFTIALPEEPRTCPSLFRKMADYKELNNIPTTELWKATIAASWVPWPLRPFMGWFRHRDRSGDGWSLCHYWSNFEIANLDFFRGKDYQRLFEYLDKTGGFYYERVRCFLFSPGQSSDQGTDTFTSFSVGDAAVHSLALHMLLPSHKVHHFEDFGYRHDWYYQCPANAPNGQLFESKLLPDGPYSPEREGGIGCRCEC

SEQ ID NO: 3283 - protein, 1376 aa, Neurospora crassa
  unsure (1)..(1376): unsure at all Xaa locations
FTLLYLPGYIVSSIIMWAAVFRTSSVGILIIYHILAGLSLASFSILGAAFFKKAQLSGISIVILYILLGVIAQIITAPKTATVVVLSLLFMPCNYTYFIAYLARFEAKDMATNLGKSAPDSPSQVAGIVFWIFLIVQIFAYPILGAIIERYLHGTTSSTRNIAYGENSELGPDNAVQLDGFTKIYKPGPFRNMFSFLSKPREPVIAVNGLTLTARRGQILVLLGANGSGKSTTLDIIAGINKLSSGSITVDGTGGLGIAPQKNVLWDELTVEEHLRIFNRLKSPNQLATKEDILELISGVDLAQKVDARSGTLSGGQKRKLQLGMMLTGGSAVCCIDEVSSGIDPLSRRKIWDILLAERGHRTMILTTHFLDEADLLADHIAIMSKGTLRAEGSSVELKNRMGGYRIHLNNAKYISNSPNVSGVQKKVSPEEITYIASTSAAAAQVIKELAVAGISDYRFSGPTIEDVFLSLAEEVSGGRWRETRPVPKHRRCPRRATEYGKTVFDXDGXQCPRXRHNQAQSXPPVWSAYRIFQAGGSSLPQEDDHPQAQLVPDPRCICHSHHRCWFSHSVRHGQGSCWLQPCRSVFSSCCNXPLRLRFXPLHDSWSLGQVFGXXPRPSFCSHLHWLPRTTLPAAATPRVLAXTPWTCSRTSRWLTLWMSSTRLWCSIARTSLPPLSGLGRTTLSPTMTYRSDSVEMFTAWFGQWITDMMLSNTTIASQFVNFDIPFAPDTGKSLQMLVYMSLALCAYPGFFALYPNVERRSFVRGLQYSNGVRPLPLWLAYTTFDFLIVLVASAIMTALLAGLASVWHHVGYLFIIFVLYGLASILLAYVISLWSNNQLSAYAFTAGGQVVMFLIYLIAYMCTITYGPVDRVDDMLVVVHFVVAIFAPIGSLTRALFIALNLFSTACDGDKLASYPGGILQYGGPILYLILQSIILFILLVWVDAGNPCSTLKQLFKRKPRSAPPTVAQEADGISDEEVAHELVRVKSTATGSGVAGTNNTDGLQVVNLTKTFGRNTAVDNVTFGIPHGQVFALLGPNGAGKSTTISIIRGDVKPDYNSGGDVFVEQSSVARSLAAARSHLGVCPQFDAVDTMTVLEHLRFYARVRGIPASGIEYNVEQVIRAVGLTQFRDRMARALSGGNKRKLSLGIALMGNPTVVLLDEPSSGLDAAAKRIMWRTLAETVPGRSILLTTHSMEEADALAGRAGILAKRMLAMGSVDSLRKRFGDTLHVHLVCRGAPRTSDARIAQIHAWVESTFGSAAAMEGKTYHGQMRFSVPAAVVLSLTTGIINQRADKGMAAEEIRETETQQSTTSAIGKLVVLLEEQREELGVEHFSVSPTTLDQVFLEVVGRHNVREEGYAAPEEGKKRGLKRWFK

SEQ ID NO: 3284 - protein, 686 aa, Neurospora crassa
  unsure (1)..(686): unsure at all Xaa locations
DGDTISAEELERYMRVGARDVSILVVDIRSRDEYDEGHVMSQATICVENEVLMRPDISASDIAESMVLAPQAEQQRFERRHDFDLIVFYDQRSKRLVSSPQTPEERAVLTFYNALTAYDYAGGSSSQQRLKLLKGGIEAWTDLVGTGALQTSSTSAAARSQPRPPLTHNLHKSSTQKRNAANTRSRGGTKMGRKRRYCYSGENYGRLFAEIPFRFNDTGVHDSPINPAAARPASPLPRHIVHEQNLYSSLPSPPTRPAPTVPRRSYSGLAETDTSTTATSTRSSLKSGIEKVRKFRTGLVNPGVFCFANSSLQAMFATPGFARELYTGVWKDVYKVPLKADEKNENPQLLTKYLAWPIPLAXXGNAEIVGSEASHGTXXFGYYVAVADDSQTNTAXAYIHFIHSKNADGRKKPETEIFGGPAQQDAQEFYSFIIDNIHDETNVHRDRKPPKEEKPYTPKNGTVIQNAIDYWRDYSNASASIIDKYFRGLEVFISRCQNAECRQEIRMFQPCDVWILNIAAETGGEGNGYGVTDLDRLLASHQATEHFPDLKCETCNQPGRTRRAKFARLPDRLAFCLNRFNSSFGQSRNSFSSILSGGGSNKIHTKVRFPIRDLDLTKYCAEPDPDMATTDDAHYAGRMKYDCYAVTVHVGQGINGGHYYTYVQDEQSKDPTDWFKCNDDLVRGXR

SEQ ID NO: 3285 - protein, 476 aa, Neurospora crassa
LDAIPAVCSTARATFASHKTKNLQWRLVQLRKLYWALDDFKASLMAALQQDLRKGGYESDFTEVDWVKNDCLHMINNLETFAQDGEAQGSARHLLDDELPVKKEPLGTVLIIGPYNFPIQLVLAPLVGAIGAGCTAVIKPSELTPACAMAMKEMIESRLDRDAFAVVNGGVPETNALMEEKWDKIMFTGSAQVGSIIARKAAETLTPVCLELGGRNPAFVTKKANLALAARRLMWGKVLNAGQVCMSHNYVLVDKDVADTFIEFLKIAYKDMFPNGAKASPDLSRIVNARHFNRIKKMLDETKGKIVMGGEMDESELYIEPTAVLVDSLDDPMMQEESFGPIFSIYPVDTLDQALSIANNVHRTPLALMAFGDKSETNRSMLLFFFDSSPFYVNSVCYTNKLPQSLTVLDEMTSGGACINDSYFHGAVHTVPFGGVGDSGWGAYRGKASFDNFTHFRTVSETPTWMDRFLRVRYMP

SEQ ID NO: 3286 - protein, 369 aa, Neurospora crassa
TAMRYTGQGVQRVGMLTPWLEAFPSTTSEIIDEIDSIVGHKLSDVIQNGPGKDLNLSPNAQPAIMATSILIIRILEKHFNFRVQDNAHFTLGHSLGEFAALVAGGYIHFEDSLRMVQKRAEAMSNATRQAEEMYGGEYGMVALVSSKAEHLPPLIAAIHEFVGYDSAGSKVESADEWCPIDQVLIANVNSKTQIVLSGSIERIKTLVEHVRQFLGHDPRAVRLKSDSPFHSPIMKPAVGVLQQMMAGNSMVKGREKEDIITFPGKVTCISNVTARPFESREQLKDLLARQAVETVQWWDSIKYLDQSMKVRRWVGIGPGYVGRNLVGKEVGMRGKDVIKGAGVWAITDPKEIEEVLRGLEETDFYEDDE

SEQ ID NO: 3287 - protein, 505 aa, Neurospora crassa
  unsure (1)..(505): unsure at all Xaa locations
STSSNVVGVHYRVGKKIGEGSFGVIFEGTNLLNNQQVAIKFVCSISWTLARRAFPIRDVGXTGLTSNVIIEPRKSDAPQLRDEYRTYKILVGMPXVXAFPESSWFLANLVSTAGIPNVYYFGQEGLHNILVIDLLGPSLEDLFDHCNRRFSLKTVVMVAKQMVGRPVVFPVSPETRXSNLYVAVRVQTIHEKNLIYRDIKPDNFLIGRQGTKTANVIHVVDFGMAKQYRDPKTKQHIPYRERKSLSGTARYMSINTHLGREQSRRDDLEALGHVFMYFLRGGLPWQGLKAATNKQKYEKIGEKKQTTAIKDLCEGFPEQFAQYLTYVRNLGFEDQPDYDYLRELFSQALKDAGGVEDGEYDWMKVNKSDKKGDWDRPGALHNPNARPGPSAMEIHNSRGPTTHHASDPRAQLTAARLNAPQPSPPAQPGQRAKEQPNANAQNNRAYKSQPTPTQSAGNGAQPYNMQQPPQRTMTHTATSNTNPPPSNQPQQQQGGIKGIWKALCC

SEQ ID NO: 3288 - protein, 560 aa, Neurospora crassa
LREGPGSAPAAPSTPASVIAQRTGGATPSHASKPSVGGSGKIFVQGSNANITHTINEDERTEFTRHINAVLAGDRDIGSRLPFPTDTFEMFDECKDGLVLAKLINDSVPDTIDERVLNMPGKKTKTLNAFQMTENNNIVIESAKGIGCSVVNIGSSDIIEVREHLILGLIWQIIRRGLLSKIDIKLHPELYRLLEEDETLEQFLRLPPEQILLRWFNYHLKAANWPRRVANFSSDVKDAENYTVLLAQIGSDYGCTRAPLQTRDLHQRAEEVLQNADKLGCRKFLSPSSLVAGNPKLNLAFVANLFNTHPALDPITEEEKLEVEDFDAEGEREARVFTLWLNSLDVNPAVQSFFDDLRDGTVLLQAYDKVIKGSVNWRHVNKAPAHGGEMLRFKAVENTNYAIELGKQNGFSLVGIQGADITDGQRTLTLGLVWQLMRKDITLTLHGLAQRLGKREITDAEMVRWANEMSRKGGRNSSIRSFKDPVIGSGIFLLDVLNGMQSNYVDYDLVTPGKTDEDAYLNAKLSISIARKMGATIWLVPEDICQVRSRLVTTFIGKLL

SEQ ID NO: 3289 - protein, 567 aa, Neurospora crassa
  unsure (1)..(567): unsure at all Xaa locations
QQQQQQHRNQPAMLPNDQKEEANSPTWSSPATSSTFDRQNALAASSPFHGFFTLFWLGISLFVIKIGAENWRQHGNPLGRNEIFRIMFHRDLVVLLIADGVMCLSTGVSWVLQRHLVRRGVVDWDEEGWVLQNIWQCLFVAGVVGFPLWRDWPWTHTVFFVMHGMVMLMKMHSYAFYNGYLASVWKKRQLLLGKLKELEHVEVVTKHDPNRSWTEPFPLLPRDLSTEHLSRVPSAQEYKERRKMSIAAQQGADGQEGENDVAKIVAAIDSHEPLNEEQVHVFERALKWEVDAMTDELRGKATDDKRVYPNNLTLANHYEFIVLPTLVYELEYPRSESINWYYAAEKMVACFGVIFVMIMISQAFIYPVVMETVRMKEMGMPLSERFQYFPWMLADLIFPFMMEYLLSWYLIWETILNFVAELTKFADRNFYGAWWNSVSWDQFARDWNRPVHNFLLRHVYHSSISAMKVNKHTATLITFFLSACVHELVMWCIFKKLRGYLLFLQMFQLPVSSDIPXPTRWLTXCXRFWTAVSLSRTKWMRNRKTLGNVFFWLGIFTGPSILCSLYL

SEQ ID NO: 3290 - protein, 342 aa, Neurospora crassa
  unsure (1)..(342): unsure at all Xaa locations
LSAADQFRSAVSQPTVAAFCAGGVAGAVSRTVVSPLERLKILYQVQSSGREAYKLSVGKALAKMWREEGWRGFMAGNGTNCIRIVPYSAVQFGSYNFYKRNIFERHPGDSLTPLSRLTCGGLAGITSVTFTYPLDIVRTRLSIQTASFAELGERPRKMPGMWETLVKMYRTEGGFPALYRGIVPTVAGVAPYVSQTWHVSRXSVCVDRGQXVGLNFMVYEHVRQYLTLDGEQNPSAVRKLLAGAISGAVAQTCTYPLXVQSSPIFYAHDXSGGEQKSDVLRRRFQINTMSGMGYQYKGIFDAVRVIVTEEGIRGLYKGIVPNLLKVAPSMASSWLSYEVCRD

SEQ ID NO: 3291 - protein, 1478 aa, Neurospora crassa
IKEQLADQLPKRFRALQFGVQSHQDIVNQGVLEVSDNLLYDVENGRRTFPHGPLDPRLGTSSKTGTCETCNLPLQSCAGHFGHVRLPLPVFHIGYLKYIQATLQNICKTCSKVLLEEEPKAKFLKALRAPGIDNLKRSAILKKINDECRKQKTCPYCGDTQGVIRKLSVMKLTHDKFSHFNKSTAQKKVPPVAKAAFDSSFIQAKTFTPDLEKHSKKAMDDMDPLKVLKLFKKITAEDCELLGLNPSEGRPEMFLWQYLPAPPICIRPSVQQEAASNEDDITSKLSEIILYAGHLRESLLKGAALNTIMEQWEFIQLQVGMYVNSDVPGLYQPGFGKPIRGFCQRLKGKQGRFRGNLSGKRVDFSGRTVISPDPNLGIDQVAVPERVAKNLTYPERVNRNNIEKLRKCVMNGPKVWPGAQGVIKRDGGMKFNLNFGDESIREERARELKFGDVVERHLEDGDIVLFNRQPSLHKLSIMSHRAKVRPWRTFRLNECVCTPYNADFDGDEMNLHLPQTEEARAEAINLMGVQNNLITPKNGEPIIAATQDFITAAYLLSSKDLFLDRKTFTYICTQMLLGETHLDLPPPTIIKPVELWTGKQIFNVLMRPNKQSPVLVNLEAKNKVYKAKPGELPDMDIDDCYLVVRNSEVMCGRMDKSTVGGGKKNSVFYVILRDWGPEHAAQAMNRLAKLCARTLTLRGFSIGVGDVYPSKDLTEHKAKLVQDAYALCDDLIAQFKSGRLEKAPGCNMEETLENKISGILSKVRSQAGDYCVGHLSRNNSPLIMAKSGSKGSDINVAQMVALVGQQIIGGKRVADGFQDRTLFHFHKNARQPPSKGFVRNSFYTGLVPTEFLFHAISGREGLVDTAVKTAETGYMSRRLMKSLEDLSTQYDDTVRTSEGNIVQFQYGADRLDPADMEGNAKPVDFERSWNHAESLTMNHNDRSLLPAEISAMCKEILDERRKWYVRKHLVTGELLHYEDKTIAESDDHDVFIAIDEHEGARVYLNTIQAEMDKRALKLAKARKLAGLDPCLPQDNADLLKEFAAWEKKQNGGDIKMLDPEEEEIQQAHVDRVAKVSEATLRKFMNLCLSKFDKAKVEPGHAVGAVGAQSIGEPGTQMTLKTFHFAGVAGMSITQGVPRIKEIIGASKLISTPVISCELENNRDIKAARIVKGKIEKTYISDVITYVEDVWLPDVAKIVLKIDMQALSDMQLGIGLREIMVAIVKAKKLKLKVEMDDLKIGPDNTIEVIVSNDWKDLTAQKKAARVRAAAIEKGQLLLTTSDETAADFQLRVNFLKRMLPAVPISGYPEAFRAIIQSSESNEHKVLVEGYGLRACMTTEGVIGTKCISNSIMECRDVLGIEAARTTIAKEIGSVMGDMGIDPRHMDLLADVMTYKGEILGITRHGLAKMRDSVLQLASFERTPDHLFDAAAGMKTDRILGVSECIIMGQTMKIGTGAFQVVRRLGIRDHQVRPKKSMFE

SEQ ID NO: 3292 - protein, 804 aa, Neurospora crassa
  unsure (1)..(804): unsure at all Xaa locations
MEHRTRSWALGLSILGFFALLFSAGFVQQAHANDTEAMGTVIGIVGCPHFPPPPSHPSCWAKHSNNASLTDLGTTYSXVTRARIRCPTRLXARSPCGACGVCYQPLPPIYVPVSTNDTHCLLGTRKLTTSXLVGVMQKGKVEILVNDQGNRITPSYVAFTDEERLVGDAAKNQAAANPHRTIFDIKRLIGRKFSDKDVQNDIKHFPYKXVSGHSXQTTSSXPPLTLVPRVVSKDDKPVVKVEVKGEEKTFTPEEISAMILGKVRRIVFALEQXSETDPHNRXRKTAEGYLGKKVTHAVVTVPAYFNDNQRQATKDAGMIAGLNVLRIVNEPTAAAIAYGLDKTGEERQIIVYDLGGGTFDVSLLSIEQGVFEVLSTAGDTHLGGEDFDQRIINHFAKLFNKKHGVDVTKDAKAMGKLKREAEKAKRTLSSQMSTRIEIEAFYDGKDFSETLTRAKFEELNNDLFKKTLKPVEQVLKDAKVSKSEIDDIVLVGGSTRIPKVQALIEEFFNGKKASKGINPDEAVAFGAAVQAGVLSGEEGTEDIVLMDVNPLTLGIETTGGVMTKLIPRNTPIPTRKSQIFSTAADNQPVVLIQVYEGERSMTKDNNLLGKFELTGIPPAPRGVPQIEVSFELDANGILKVSAHDKGTGKAESITITNDKGRLTQEEIDRMVAEAEKYAEEDKATRERIEARNGLENYAFSLKNQVNDEDGLGGKIDEEDKETILDAVKEAQDWLEENGKLYSDPLXHMKTKCXHAFFFSQPPLLSAEDFDEQKEKLSNVAYPITSKLYSQGGAGDDEPAGHDEL

SEQ ID NO: 3293 - protein, 541 aa, Neurospora crassa
  unsure (1)..(541): unsure at all Xaa locations
QGKKKRQYGNEAVKNHILAARTVANIVKTSLGPRGLDKILISPDGDITVTNDGATILQQMEITNHVAKLLVELSKSQDDEIGDGTTGVVVLAGALLEQAAELIDKGIHPIRIADGYDQACDIAVAELDRISDVIEFSKEETANLVKVARTSLGSKIVSKAHDQFANIAVDAVLSVADLERKDVDFELIKVDGKVGGALEDTILVKGVIIDKDFSHPQMPSEVRDAKIAILTCAFEPPKPKTKHRLDITSVEEFKKLQTYEREKFIEMIQQIKNTGANLAICQWGFDDEANHLLLQNNLPAVRWVGGPEIELIAIATNGRIVPRFEDLKPEKLGRAGVVREMTFGTTREKMLVIEECANTRAVTVFVRGSNKMVSDGVLLHQXGLDXLFSPRIIDEAKRSLHDALCVVRNLVRDNRVVYGGGSAEIACSLAVEDAAVKSPGLEQYAMRAFADALDTIPMTLAENSGLNPIATLAEVKSQQVKDPAGRGRLGVDCMGRGSNNMKEAFVIDPLIGKKQQLMLATQLCRMILKINNVIVSGSGEE

SEQ ID NO: 3294 - protein, 618 aa, Neurospora crassa
VRICVCGDEGTGKSSLIASLVKGVFVANKIQAVLPQVTIPPTTGTPENVTTTIVDTSARPQDRTTLRKEIRKSNVILLVYSDHYSYERVALFWMPYFRSLGVNVPVVLCANKSDLVSDGNAAQVAEEEMLPVMAEFREIDSCIRTSAKEQKNVIEVFYLCQKAVTHPIAPLFDYKEGQLKPACVDALRRIFFLSDKDQDGYLNDQEMQDFQQKSFDKPLSQEDLDNIKLTVSKSVPSSSTDKGLDLRGFLQLNKLYAEKGRHETIWIILRKYHYTDSLSLEDSFLHPRFDVPDYASAELSPAGYRFFMDLFLTFDKDNDGGLNDRELAALFAPTPGLPHSWAETSFPSTTVRNEAGHITLQGWLAQWSMTTFLEPKTTLEYLAYLGFETPNARETTTAALKITKPRKRRRRPGRVDRNVVLCYILGSSGAGKSSLLDVFLNRPFDTLYHPTIKPRQAVNSVELQGGKQCYLILEELGELEPAILENQAKLDACDLICYAYDSSEPDSFSHIVELRKRYPQLDELPAVYTALKADRDKTTQRSELQPDAYTAALNMSAPLHVSVTWNSISELFVALAEAATNPSTAFPRSEEPPADRASLYMALGATACAALAAFMIWR

SEQ ID NO: 3295 - protein, 1260 aa, Neurospora crassa
  unsure (1)..(1260): unsure at all Xaa locations
QKWRQVKSTLRLLRQKRDDQYDYFKSAELMAELTAVTPAVLMFASMIQRDEHGNKRIPVLLEQLRLRIKDSAPLPGKDSERHVLFTIELEYGSGPSQMKWTVKRHIKEIMNLHFKYKINPPKDKLLIHRPEGGVRPKQPNFPISAFPYLRAVRGLEDDEEQESLDPPRIVEDPAGEATAGETAVEGTDVDENGRPQVRKKKSRMGAFGGRRKNSAIGSKGDLNQIALDAAAKKKKYIEQQQRILEKYLQEMVRWLMFRADSNRLCRFLELSALGVRLAAEGSYHGKECYLHIQSSKGLDFRRVLTPGKVIARHSKKWFLVRQSYIVCVESPENMNIYDVYLVDPKFNIVSKKDKNKHLTANGNENEEDLENFDPTTAKKSKSSNHHTLKIVSSERKIKLFSSSQHLIQQFEESILEMLKTTPWHQRNRFGSYAPVRTGVFAQWLVDGRDYMWNVSRAISMAKDVIYIHDWWLSPELYMRRPACISQKWRLDRLLQRKAQEGVKIFVIVYRNVEAAVPIDSEYTKFSLLNLHPNIFVQRSPNQFKKNQFFFAHHEKLVIVDHDIAFVGGIDLCFGRWDTPQHPVTDDKPTGFEPDSYNLPKDAEHCQMFPGKDYSNPRVQDFVRLHEPYEEMYDRSKVPRMPWHDIAMQVVGQPARDLTRHFVQRWNYVRRGRKPTRPTPFLLPPPDCSREELEAAGLNGTCEVQMLRSASTWSIGIDETEHSIQSAYVKMIEESDHFVYMENQFFVTSTETLNVKIVNHIGDALVERAIRAHEKGEDWRAVIIIPLMPGFQNEVNDQDGTSVRLILQCQYRSICRGEHSIFGRLRAAGINPEDYIQFFSLRQWGKLKNNSLTTEQLYIHAKCIIVDDRIALIGSANINERSMLGNRDSECAAVVRDTDMIWSTMGGKPYQVGRFAHTLRLRLMREHLGLDVDEIQEEERQAELDELRQELRWNNARNTTWSTELGTSRLHXRLGRFHGPRKLVQETEVISMSSHILPSTPPPPQLPRHRAHSFNHDVEMQELPRPDSKGKSVAGREDQEHVHAGERHRRDVEGLGPDHWKLAQMQGIDEGRDSVVVNGREVLVHDISAEGKGTLDSPHESHELRTRPHDAASLSESIGNEHMPPMPPFNRRTTEQLGLPRANQLPVLPVVDDTDIGGPPVQITANGTLSHSQIAMNIELANIDKDCMRDPLNPSFYEDVWSRVAENNTKIYRRVFHVMPDSAVTNWAEYKEFKANEREFKKQFXRWQGKRGSQXEERSDR

SEQ ID NO: 3296 - protein, 457 aa, Neurospora crassa
  unsure (1)..(457): unsure at all Xaa locations
SQVGSQFWQQLCLEHGISQDGTIEDFATEGGDRKDVFFYQSDDTRYIPRSILIDLEPRVINTIQTGPYRNIYNPENFYVGKSGLGAGNNWGDGYQTGEQVHEEIMEMIEREADGSDSLEGFMMLHSIAGGTGSGLGSFLLERLNDRFPKKIIQTYSVFPDTTSAGDVVVHPYNSLLAMRRLTQNADSVVVLDNGALSHIAADRLHVQEPSFQQTNQLVSTVMSASTTTLRYPGYMHNDLVSILASLIPTPRCHFLMTSYTPFTGDQVEQAKTVRKTTVLDVMRRLLQPKNRMVSTVPGKKSCYISILNVIQGDVDPTDVHKSLLRIRERRLATFIPWGPASIQVALTKRSPYVTMAHRVSGLMLANHTSIATVCQLLLCWLDRXSNXHFFTQLFKRIVRQYDGMRKRNAFMEAYKKTAPFSENLNEFDEAREVVMDLIADYEAAEDANYLNPELGEN

SEQ ID NO: 3297 - protein, 603 aa, Neurospora crassa
PPAIPSPAKVHSSLPRHILETPQSGKSIFVRTIDEPSKSLQYTGHTTTTTVARFSPSGFWVASGDVSGKVRVWDAVGAENTKGEYSIISGRINDIAWDGDSQRVIAVGDGRERFGHAFTADSGNSVGEVTGHSKVVNAVSIRQQRPLRAATVSDDGSMCFLHGAPFKFADKASEHKGFVTGTAFSPDGATLVTVGADRKIQLYDGKTGAPTKTIGEGVHTGGIYGISWASDSKHFVTSSADQTVRVWDAESGKNTETWRFGPEGSVSIPDQQVGVVWPHGRTDGLIISLNLNGDLSYLVPGNPKPIRVVQGHNKNITALGASPDGQALLTGSFEGRVLSWDLAAGTGTVVDGQSHSNQVTQFALSPSGGTVYSVGWDDTLRSVDVSANTFTGLSTKLSAQPKGIATTSDGKFVVVAAHTGIQVYQGPDFISELPTTFTSTAIAASPTDGSVIAVGGDGNTVRIHSLSSSDGTLSSQPVAVLTNSSAQISTLSFSRDGKFLAAGNSTGKIVVYRTSGSGSWEVETDRWSAHTARVLSIAWNEAGTHAVSGGLDTNVCVWSLAKPGSRTSAPNAHKDGVNGVAWMEEGTVVSTGVDGAVKVWKVS

SEQ ID NO: 3298 - protein, 361 aa, Neurospora crassa
  unsure (1)..(361): unsure at all Xaa locations
GAGGVGKCFLSQLESLAARRQNQKLVLTYIATSKKAVYSDSYSPIALDSVVSTLSSSSQAPLALPKLVDYLAASGTKTVLVDNTSSQDIADAYPSFLRRGISIVTPNKKAFSGSYKLWQDIFAAKEEGGSLLYHEASCGAGLPVISTIKDLVETGDEVTKIEGVFSGTMSFLFNSFAPTSGSGGGKWSAEVAKAKELGYTEPDPRDDLNGLDVARKLTILARYAGLEVESPTSFPVQSLIPKQLESVASGDEFLARLPEFDAEMEEVKAEAQKEGKVVRFVGSIDVASKQVKVGLEKFDLSHPIAALKGSDNIISFYTKRYGSNPLIIQGAGAGGDVTAMGVTSDLLKVLAQLXTGACPQS

SEQ ID NO: 3299 - protein, 772 aa, Neurospora crassa
  unsure (1)..(772): unsure at all Xaa locations
MANTGPGNVPLHFIQKPPFTVEDPNAQPIPGETIPRRHPKAKNGLATRPAPGVNTTLDLLTRTVELYGDERAIGSRKLIKLHKDIKKVPKVVDGETVMVDKEWQCFELTPYSYITYGEYFTIVKQIGAGLRKLGLEPKDKLHIFATTRYAPTFYPRLFASALCXCCLYAHHSPQWLGMSHAASSQSLTIVTAYDTLGESGVQHSLVQSKASAMFTDPHLLKTATNPLKEATSVKVVIYNNHTTQPVSQDKIDAFKAEHPDLTVLSFEELRALGEENPVPLTPPNPDDTYCIMYTSGSTGPPKGVPVSHAGFVAAVAGLYAVMEESVTHRDRVLAYLPLAHIFELVLENLGVFVGGTLGYSNARTLSDTSMRNCPGDMRAFKPTIMVGVPQVWETVKKGIEGKVNSAGALTKALFWGAYNIKSFLVSNNLPGKTIFDDLVFGQVRTMTGGELRFIVNGASGIAASTQHFMSMVVAPMLNGYGXVIFCLSXISIISLCXKRAAHHVKNSLTETCGNGALGSPMQWTSNAIGAMPAAVEMKLVSLPELNYHTDTVPPQGEILFRGACVIKEYYENPEETAKAITPDGWFKSGDIGEIDANGHLRVIDRVKNLVKLQGGEYIALEKLEAVYRGAVFVHNIMVHGDNSAPRPIAVVVPNEKALAEKAEELGLGAEAPGEMHRNRKLRDAVLKELQSVGRRAGLSGMETVAGVVLVDDEWTPANVSPFLSWSLLKEFVAKVMLTDFHDRGFVTATQKINRRAVKERYSKEISDCLDGK

SEQ ID NO: 3300 - protein, 481 aa, Neurospora crassa
  unsure (1)..(481): unsure at all Xaa locations
YVEQSELEKFDGVSTGKYTIGLGQTKMAFCDDREGEFFPSLLFXSTSTRLFRGXLAMCPSDIYSLALTAVSRLLKNYEIDTNTIGRLEVGTETLLDKSKSVKSVLMQLFGENTNIEGVDTINACYGGTNAFFNSVNWIESSAWDGRDAIVVAGDIALYAKGNARPTGGAGCVAMLVGPNAPIAVEPGLRGSYMAHAYDFYKPDLTSEYPYVDGHYSVNCYTEALDGAYRAYNQREKLLTNGVNGHSEDSTKTPLDRFDYLAFHAPTCKLVQKSYARLLYHDYLANPESPVFADVPPEVRDMDYKKSLTDKVVEKTFMTLTKKRFQERVNPAIQVPTLCGNMYCGSVWGGLASIIGHVDSAQLEGKRIGLFSYGSGLAASFCSFRVTGSTEKLAKTLNLPARLAARRAVPPESYDAVSIPDXLNQFNNTSQDANDCTDCDLRKQAHLQKNYTPKGEVSTLEPGTYYLENVDDMFKRTYSIKA

SEQ ID NO: 3301 - protein, 407 aa, Neurospora crassa
MRGSTIRPKAQCLRSLSKGLTKRPSAGLRSVPVAATLAPSLPSQRAYSTHPPHAKLNLPTDYSTTPLLAQTSQSALNNPELSPEVRNGPTKRMNMFQAVNDALSVALAQDESVLIFGEDVAFGGVFRCTGKLADTYGADRVFNTPLCEQGIMGFAIGVAAEGMRPVAEIQFADYVYPAFDQLVNEAAKFRYRDGSCGRSAGGLTVRMPCGGVGHGGLYHTQSPESLFTHIPGLRVIMPRSPIQAKGLLLSAIRSNDPCVFMEPKILYRAAVEQVPTGSYTLPLSKAEVLKEGKDVTIISYGQPLYKCMDALQKAEKDFGVSVELIDLRTVYPWDKETVFQSVRKTGRCIVVHESMVNAGIGAEVAAAIQEDSETFVRLEAPVARVAGWSIHTPLMFEALNIPDVASE

SEQ ID NO: 3302 - protein, 172 aa, Neurospora crassa
  unsure (1)..(172): unsure at all Xaa locations
LSAYVKEHFPNAAYGAYPIENDTKVAVVIVANKYSPNNFWYVALERSRSPCRILPAFCVNTRXQNGRWRSLYIYDPSNNSIEGSIKVDVHYYEDGNVRLLTNKTVTATVSSGTGSGIAKEISVNEKKYQEELNKSFTSLSEGAFKGLRRQLPVTRQKIEWDKVASYRLGQDI

SEQ ID NO: 3303 - protein, 968 aa, Neurospora crassa
  unsure (1)..(968): unsure at all Xaa locations
KRLTKKQRPPSANHRTSSSFNVESLRIDAQSLDSKRSASSLRQGPNCNQSPSLARTVSVPVSVPSNAPAHTKASDLSLPRSHTTRSQSANRPYNPTQTIPTNRFILSPASSSQPQTQSPPYPSAVASTTVTSSRNKDTSKQYDPLDSCIGSFDQNKLSTDELIGAPFDGNAILSRIEATKLSAAPAPTSTTTIAHSNNISPRRVAPPPPPPPPALSRSNTDSKAARSSKPSKSPKSTISNKTMGASSFRHSASFSSAEQLPPSEKPSKSESSSSSNKRHSGDGKESRVPGMLRKKSGFSGFMNSLVGSPKKPLISAPENPVHVTHVGYDSNTGQFTVCCHAMSTSLNVMDGLIRXXGLPKEWQRLISESGITEKDRREHPQILVDVLTFYKETTEKPQEDQQLEKFHDARATDFRSPPVTGTAPLVLQTGVGYAHGPMSPMISPPASPRFPQVGHEGSFENPRAPPPVPKGPGPLPAKDINLIPSRPAPKPPAISTRPLVPPASLPAKDSGIGMPPPGDEAPMPYLPPKDNVQHMYQEEHRNRSRSNSRTNGAAPFSPVQASPLHPIATANQTAAYQQQLLQHQQEQAMAKPRQQXAVNXAELQARDNNQLRPPHNTNTPGSQTSMGAPRMPQTQGAAPQASARPRHRPRQSNAIDVVASLKRICSDGDPREIYRGFTKIGQGASGGVYTGHERGSNRLVAIKQMNLEQQPKKDLIINEILVMKESSHPNIVNFIDSYLCAGELWVVMEYMEGGSLTDVVTFNIMTEGQIASVCRETLRGLQHLHSKGVIHRDIKSDNILLSMEGNIKLSKFSPSGFLGSLRKFKLFEHFPVHFPTIFNPQRPSGAVTRFXPLFFHHSDFGFCATINEAQSKRTTMVGTPYWMAPEVVTRKEYGRKVDIWSLGIMAIEMIEGEPPYLTESPLRALWLIATNGTPHIKDEQSLSPVFRDFLYFALKVDPEKRASAHDLL

SEQ ID NO: 3304 - protein, 245 aa, Neurospora crassa
IISGARGLGNYMARACAEAGAKAIVIFDANQDLGDESAAELHQKTGLPVSFFKVDVRDGSAINAAVQNVVDLYGAPDVLVNSAGIADSNIPAEKYDAAMFRRLIDINLNGSFLMSQAVGRAMMAAGKPGSIILVASMSGTIVNYPQEQSCYNASKAGVIQLGKSLAAEWAKYNIRVNCISPGYMDTALNKVPALDAQKKIWKSLTPQERLGAVDDLNGLCVFLASDASSFMTGSNVIIDGGYTLY

SEQ ID NO: 3305 - protein, 311 aa, Neurospora crassa
  unsure (1)..(311): unsure at all Xaa locations
KLTHPVGYKTNPPPVGRPVRVYADGVFDLFHLGYVPLLFPXWWAICHMKTGERPMPPELGNXRRFGIQCGRGXRKRPFVALVTAFANHKDNRHMRQLEQAKKAFPEVYLLVGVTGDEDTHKRKGLTVLSGKERAETVRHCKWVDEVIEDCPWIVTPEFLEEHKIDYVAHDDIPYGADEGDDIYAPIKAAGKFLVTQRTEGVSTTGIITKXVIPHLSSHALHTSFCTDSYFFHCRIVRDYEKYIARQFKRGASRQELNVSWLKKNELDLKRHIQDLRDNIRSNWATTGQELSKELRQFWPSSRPQSPSPSGF

SEQ ID NO: 3306 - protein, 956 aa, Neurospora crassa
EDDSLRRFRYLLGLTDLFRHFIETNPNPKVREIMAEIDRQNAEDAKSKKGAGRQGGATSDRRRRTEAEEDAELLKDEKVGGSAETVFRESPAFIQGTMRDYQIAGLNWLISLHENGISGILADEMGLGKTLQTISFLGYLRHIMDTPGPHLVIVPKSTLDNWKREFAKWTPEVNVLVLQGAKEERQQLIQDRLVDENFDVCITSYEMILREKAHLKKFAWEYIIIDEAHRIKNEESSLAQVIRVFNSRNRLLITGTPLQNNLHELWALLNFLLPDVFGDSEAFDQWFSGQDRDQDTVVQQLHRVLRPFLLRRVKSDVEKSLLPKKEVNVYIGMSEMQVKWYQKILEKDIDAVNGAGGKRESKTRLLNIVMQLRKCCNHPYLFEGAEPGPPYTTDEHLVYNAGKMLVLDKLLKRLQKQGSRVLIFSQMSRLLDILEDYCVFRQYKYCRIDGGTAHEDRIAAIDEYNKPDSDKFVFLLTTRAGGLGINLTSADIVILYDSDWNPQADLQAMDRAHRIGQTKQVVVYRFVTDNAIEEKVLERAAQKLRLDQLVIQQGRAQIAAKAAANKDELLSMIQHGAEKVFQSKGGFGALPENGAELGDDDIDAILAAGENRTKELNAKYEKLGLDDLQKFTSESAYEWNGEDFAARKKDIGINWINPAKRERKEQIYSIDKYYKQALQTGGRTADTKPKAPRAPKQVPVHDYQFYPLRLRELQDRETAYYRKEIGYKVPLPDGDDETVEEREAERALDQQEIDNATPLTEEEQAEKQKLAEQGFGDWNRRDFQQFINGSGRYGRNDYEGIAQEVDSKTPAEIKAYAKVFWQRYTEIADYNKYLKVIEDGEERMRKIEHQRKMLRKKMSQYRVPLQQLKINYTVSTTNKKVYTEEEDRFLLVMLDKYGVDSEGIYEKIRDEIRESPLFRFDWFFLSRTPIEISRRCNTLLTTIVKEFEDEPSNTTK

SEQ ID NO: 3307 - protein, 422 aa, Neurospora crassa
SIKRNGAVGLINPANDCFINSVLQALAGLGDLRLYLIRETHRRCLDGGWVYAQTIPSDVWGSGGEGEGDETSKWQVRGGVPEWKAEGLQMGIVTKGLKDILDALNERPIYKKTISASPFVRTLEIAFGQRISRQQQDAQEFLQVVAERLCDEYHAGQRARSYAMRGAEQPTTKISLNSKTSDSEALDRPLPLRASEQVSGADQPAATAASAVPNGADEERAEEGFPFEGSFESQIECLTCGFRPRPTQSTFCTLTLNVPHIPTTTLSACFDGMFKTEYIEDFKCEKCRLLHAKAVLEADIQRSTSESSREKARTALASLELAIETDPEKAPKGVELPDPRYAPKRKIARHIRMTGFPRILAIHLSRSIYDMSNFSQKNLAKVTFPELLPLGGLLQQRKYKLLGVVTHKGNHHSGHYESFRRQ

SEQ ID NO: 3308 - protein, 449 aa, Neurospora crassa
  unsure (1)..(449): unsure at all Xaa locations
TTETSTTTTEQQTTPTSPTMGGGPDTTGYRTVAYFVNWAIYGRKHRPQDLPAEKLTHILYAFANVRPDSGEVYLTDQWADTDIHWEGDSWNDSGTNLYGCLKQLNLLKRRNRNLKVLLSIGGWTYSSNFKEPASKEEGRRRFAESAVELVRFGSLXIFIFLTYLFLVHVRDXKLTLPTKXVKNLGFDGLDIDWEYPQNAQEASDFVSLLSACRSALDAYASTVPGNPHFEMSVACPAGPQNYEKMDLPGMDRYLDFWNLMAYDYAGSWDQVAGHQANLFHCNSNPAATPFSTQRAVEYYLSTGVAADKIVLGMPLYGRAFQGTEGLGQPYSGVGEGTWENGVHDYKKLPLEGAEERVDYESGATYCYHPGTKTLVSYDTPGMARMKAEYIRERGLGGAMWWESSADKEGPDSLIGTVVEGLGGLPALRWDGNCIDYPNTKYDNLRAGFP

SEQ ID NO: 3309 - protein, 551 aa, Neurospora crassa
  unsure (1)..(551): unsure at all Xaa locations
AYMMCVFAAFGGIFFGYDSGYISGVMGMKYFIETINGPGATFLPSKEKSLITSILSAGTFFGALMGGDLADWVGRRPTIIFGCLVFIVGVVLQTASQSLGLIVAGRLVAGFGVGFVSAIIILYMSEIAPRKVRGAMVSGYQFCICLGLLLASCVDYGTQNRTDSGSYRIPIGLQMAWALILATGIFFLPESPRFFVKKGKLDKAAGVLSRLRDQPLDSDYVRDELAEIVANHEFEMTVVPYGNYFQQWANCFRGSIWQGGSYLRRTILGTSMQMMQQWTGINFIFYFGTTFFQQLGTIDNPFLMSLVTTLVNVCSTPISFYTMEKLGRRTLLIWGALGMLICEFIVAIVGTCRPDDTMAIKAMLAFICIYIFFFATTWGPASWVVIGEVFPLPIRAKGVALSTASNWLCKSFFFFCPAYLLKVSLKNSLTNLFPSCLGNCIIAVITPYMVDEDKGNLGPKVFYIWGGLCTCCFIYAYLLVPETKGLTLEQVDQMLSESTPRTSTKWKPHTTYAAEMGMTEKTVAGHAENRSDSEXRKNKRTIQNQKKERKM

SEQ ID NO: 3310 - protein, 469 aa, Neurospora crassa
HRALIAYLTAANLPNTAAALREELNLSEEVFDPATAKKYEGLLEKKWTSVVRLQKKVRILSAVRPPNNLFSLFPPYQPLTPLATYRIMDLESRNHILQSELDNATPTSRQNKDPVAWLPRAPPRHTLQSHRDPITCVAFHPVFSSLASGSEDQTIKIWDWELGELERTIKGHTKAVLDVDYGGPRGNTLLASCSSDLTIKLWDPLDSYKNIRTLPGHDHSVSAVRFIPGSGNLLVSASRDKTLRIWDVSTGYCVKTLRGHAEWVRDVCPSLDGKYILSTSDDYTSRLWDVTITNPEPKVTLIGHEHVVLCCAIAPPAAYQNLAAMAGIKKPPATSSAEFMATGSRDKSIRLWDARGTCIKTLVGHDNWVRGLVFHPGGKYLLSVSDDKTLRCWDLTQEGKCVKTIGDAHGHFVQCIKWAPSVIKDASVNGDNGEPNGTPKKGGAAATPEAQIRCVIATGSVDLNVRIFA

SEQ ID NO: 3311 - protein, 423 aa, Neurospora crassa
  unsure (1)..(423): unsure at all Xaa locations
DFPEGGLQGWLVVFGSFCAMISVFGLINSAAVFESYFSTHQLVNHSASEIGWIFSLYLFIVFFVGIQVGPIFDRHGARLLVAVGSLLVVLSLMLLSLSKSKSLQHFRPXLWMAYGANDRHSLLQIMLTYPVLGGLGGALLNCPAYGSITHFFHVRRGLATGVATISGGIGGIMFPIMLRYTLPSIGFPWSCRILGFIMLGLAVPANLFIKTRLKPKISQDKPKMSSLLPDFSGFRDLRYAFSAIGIFFMEWGLFMPLTYIVSYAAAHGQDATESYLLLSYLNAGSVLGRVLPGLFADRIGRFNVVIITISLCVILVLAMWLPAAMSKSVLIGYAVLFGFASGSNLGLVPVCLGQLCDARQFGRYYSTAMMVASFGTLSSVPIGGALLEMGSAETGWRAVIIFSGLSYFVALACYTSARVLAVG

SEQ ID NO: 3312 - protein, 381 aa, Neurospora crassa
  unsure (1)..(381): unsure at all Xaa locations
DQPFATGCLDPSVTAAQPRENATFVMLARNSEIEGAKATVANIERQFNRWFHYPIMFLNDAPWSEEFKDVLSRAVSNGTEVRFEVIEKGKWGFPEEMNEKEKTKARLQMKKQGERGVGYGDMESYHHMCRFYSGYVSRCVWCDRSTCXPXCFRKNSEFYNLEALRPYKWYWRLEPSVRYSCALTYDPFAEMARHDKVYGWTIALWEVGDTCPSLFKTTDDYRIEKGIPRTPTWNALLQVMWFPAPVRWFLGLFRVREHDNSGNKWNMCHYWSNFEIANLDFFRGREYQDYFRYLDSKGGFYSERWGDAPVHTLAVHMLLPPEKIHHFSDIGYEHDTLWQCPGNAPMDQQLLGNKALRDMGRMTLPSEGGTGCRCKCQENKR

SEQ ID NO: 3313 - protein, 468 aa, Neurospora crassa
EDWKKGLNLPARDTRQQTEDVTNTRGLDWEDFIHDRDLLMGIFEAGFEKPSPIQEEAIPVALTGRDILARAKNGTGKTAAFVIPALNKINPKVSKIQCLILVPTRELAMQTSQVCKTLGKHLGINVMVTTGGTGLRDDIVRLQDPVHIVVGTPGRILDLAGKQVADLSECPMFIMDEADKLLSQEFTPVIEQLLQFHPKDRQVMLFSATFPLSVKDFSDKNMTSPYEINLMDELTLRGITQYYAFVEEKQKVHCLNTLFSKLQINQSIIFCNSTNRVELLAKKITELGYSCFYSHAKMAQQARNRVFHDFRNGVCRNLVCSDLLTRGIDIQAVNVVINFDFPKNAETYLHRIGRSGRYGHLGLAINLINWDDRFNLYNIERDLGTEIQPIPQTIDKSLYVYENPESIPRPISTFKPIAQQPQQQLQQSQRPQQSQQQQHFSTQTQPSNQLPPQQGNQQLGFNPQAQQP

SEQ ID NO: 3314 - protein, 431 aa, Neurospora crassa
  unsure (1)..(431): unsure at all Xaa locations
GIRPVIKVVDDRCLXVRCSLPLRQDXXGIQNQRCXQVRRCQVFSILQKITQFRNSLDQSCQRMGKKVKDQVFAFDRIFDENASQVEVYEGTTKGLLDSVLDGYNATVFAYGATGCGKTHTITGTPQSPGIIFLTMQELFEKINERSGEKHTEVTLSYLEIYNETIRDLLVPPGSATNKQGLMLREDSNQGVSVAGLTSHKPKDVQEVMDMIVQGNEYRTVSPTAANAVSSRSHAVLQINVAQKDRNAAVNEPHTMATLSIIDLAGSERASATKNRGERLLEGANINKSLLALGSCINALCDPRKSNHVPYRNSKLTRLLKFSLGGNCKTVMIVCVSPSSEHFDETQNTLRYANRAKNIQTKVTRNVFNVNRHVKDFLVKIDEQMALINELKAQQRDAEKVFFAKFLKQSEKRDAVVREGLARLHAAYEHAE

SEQ ID NO: 3315 - protein, 553 aa, Neurospora crassa
  unsure (1)..(553): unsure at all Xaa locations
NFRVFSIACFACIGGVLYGYNQGMFSGVLAMPAFQKRESLSLNPHVAETVVNLTGEPQTDMGEYDPIDENASQTKKGWLTAILELGAWLGTLLSGFMAEVLSRKYGVLVACLVFMLGVVIQATSISGGHETILAGRFITXGRGXLLLNRLSAPTNTTLLNRGMGVGSLAMIIPIYNSEVAPPEVRGALVALQQLAICFGIMVSFWIDXXVFLFSTLVTPRGRXYQILRSGTNYIGGTKLETQSDAAWLVPVCLQLAPALILFFGMMFMPFSPRWLIHHGREAEARKILSTLRGLPQDHELVELEFLEIKAQSLFEKRSIAELFPELREQTAWNTFKLQFVAIEKLFRTKAMFRRVIVATVTMFFQQWSGINAILYYAPQIFKQLGLSGNTTSLLATGVVGIVMFIATVPAVLWIDRVGRKPVLTIGALGMATCHIIIAVIVAKNVDQWETHKAAGWAAVAMVWLFVIHFGYSWGPCAWIIVAEIWPLSTRPYGVSLGASSNWMNNFIVGQVTPDMLKAIPYGTYIIFGLLTYMGAAFIWFFVPETKRLTLEEM

SEQ ID NO: 3316 - protein, 469 aa, Neurospora crassa
SGEGQGSQGLLETIQSILSYSVNTWDQGFMDKLYASTNAVGVVTELLLSVLNTNLHVYQVSPALSVIEKYTAKQFAALFGFTGPRAGGVTCQGGSASNLTSIVIARNTLFPLSKLHGNGHEQCGAPGPLILLTSAHGHYSIEKAAMTCGFGSSAVWTVPVDEQGRMQPAALREMVLKAKSEGKHPFYVNATAGTTVLGSYDPFDEIADVCDEFGMWLHIDGSWGGPAVFSKKHKHKMQGSHRARSLTVNPHKMLNAPVTCSFLLTNDVKVFHRANTLPAGYLFHGPAAAEEEEDADGEENAPQSQTTPSEEGVTTTNGCGNGNTQDEVWDLADLTLQCGRRGDALKLALSWIYYGAAGFERQIDGAFDMAAYLANLIAERNDFVLVSSNPPPCLQVCFYYAPGGKLADEPQENTRRTRIMVEKLIARGFMVDYAPGDKGSLFRVVVNCQTLRGTVEGLVKGLEAIGKEI

SEQ ID NO: 3317 - protein, 321 aa, Neurospora crassa
  unsure (1)..(321): unsure at all Xaa locations
MGINGLLPLLKSIHRPAELRKYAGETLGIDGYGWLHRGAIACAIDLAQGKPTRKXVPTEATMDCLTPRLIVTPXKKKDYVDYAMHRVKMFKHFGVTPYVVFDGDYLPSKAKTELDRESRREASRKTGLELLKAGKPSQAHIELQKAIDITPEMARHLIDELKKANVPYVVAPYEADAQLIYLERRGIISGIVSEDSDLLVFGAKRLLTKMDQYGQCIEINRSQFCAVREISLTGWSDAEFRQMAIFSGCDYLDSLPSMGLRTAYRMIRKLKTPERIVKKLQFDGKIRVPADYLARFKQAELTFIYQRVFCPEKQAVVCLTE

SEQ ID NO: 3318 - protein, 622 aa, Neurospora crassa
  unsure (1)..(622): unsure at all Xaa locations
MAATALDHLSLGGKIQWLAQLNTEFQPAREFRRTSIICTIGPKTNSVEAINKLRDAGLNVVRMNFSHGSYEYHRTYSPLXHLVVPLKTHRWCKVRQAAARLAFQDHXRLALPKSSCTAYPLTLSHLQESVIDNARQAEKVHPGRPIAIALDTKGPEIRTGNTKNDEDIPISAGTILNITTDEKYKDECTIEHMXVXIDLLLGMRQWGRSLLTSLQVVDYVNITKVIAPGRIIYVDDGVLAFEVLEIVDDKTIKVKARNNGYISSRKGVNLPNTDVDLPALSEKDKADLRFGVKNKVDMVFACEFTLGRPWIRGTSCXQMIIAFIRRGQDIKDIREVLGEDGKQIQIIAKIENRQGLNNFAEILAETDGVMVARGDLGIEIPAAEVFAAQKKIIAMCNIAGKPVICATQMLESMIKNPRPTRAEISDVGNAVTDGADCVMLSGETAKGAYPTEAVREMSEAVLKAENTIPYVSHFEELCSLAKRPVSIVESCAMASVRASLDLNAAAILVLSTSGESARLISKYRPVCPIIMITRNDSASRYAHLYRGVYPFLFPESKPDFSKVNWQEDVDRRIKWGLSHGIGLKVLNEGETVVVVQGWKGGMGNTNTFRIVKADVNHLGLGQ

SEQ ID NO: 3319 - protein, 646 aa, Neurospora crassa
  unsure (1)..(646): unsure at all Xaa locations
SLYQICLSLKQRLAQVPGFEGYLEQLQREQENGHDGPVEALWKLLRTGLPLLTIYNALQPEKPLHVDQRPNETEARRSKRAIMEFVKACLSDLDPPVTECFIVADLTGEDTTGFVKVSESYGAPFLPAHLMEQYMLTRAHVRKTRXLLLSTMCSILPKNGASCSKPCPYPEDDITQPGSKMTHRDYIVRELVDTERKYVQDLENLHDLKRTLEHRSVIPGEFIHDIFLNINAILDHQRKFLIRVETTNSMPQARQEWGSLFVTAEENFGIYQPFIANQRKAAQVATQVFDKIQEAGHPVACDFNTLDGFLLKPMQRLVKYPLLLKVWILRPFDGTNAHTNWLVLKGFAEEERGRAHQGDLAAGIAAAERVLMKANSAVDKNILEEALQDLIHRVDDWKSHKVDNFGSLLLHGVYTVITGRVNKRRTYVSPPWRMRSSFCWYKTSXXWTANLPQQYEIYLFENILLCCKELTTTKAKDKKDKTRSSVPKLRNKFAKLQLKGRIFMTNVTDVVAISKPGKRHSWNSRRNTTVADCAGSYTVQIWWKGDPGVENFMIKFQTEEMMKKWAAGLEEQRKQNTQAAPVAPDQAPPNFAWLASQGNGLENPYKDEEEDEDIYNAAAPTVAMPGTMPRNGSSTSLRQRSATSDS

SEQ ID NO: 3320 - protein, 607 aa, Neurospora crassa
  unsure (1)..(607): unsure at all Xaa locations
SLLHGPTDPPLVDLTLGELLNLQCLHHGTQEALVIPWTGARWTYNELNHQSQLMARALLGLGIRVGDRVGIMAGNCEQYASLFFAATRIGAILVILNNTYTPTEAQYALEFSGMLLRAPAMPGTGPSQAHPFQTARFSSLPRRSVASIQGPLLAELKMKSKAPKVVIIRGDSEGYQTYDQLLSQGFKVSVERLHHMERKVLPHLVCNLQFTSGTTGLPKAAMLTHQYVHHFLHSSRLLLPSXHGTSNIVNNARFIGDRMKLGPDDVLCCPPPLFHCFGLVLGLMSVMTHGGKIVYPAEVFDAPATLKAIVNERCTAVHGVPAMFDSILALPEAKNLKAADLRLRTGIIAGAPVPRYLMELLVSKLGMTEFTSSYGLTEASPTCFNAHTDDPIDVRLTTVGTLMPHAHAKIVDRDGQIVPIGTKGELCIGGYQLQAGYWNNSEKTNEVMMRDESGMLWLHTGDEAVFNEQGYCSITGRFKDIIIRGMFGNDFLFNPTRLLPCXSRRAHRWENIYPLEIEERLVAHPAVSMAVVVGLKDQHYGEVVGAFLGLEKGHQPMSTEEVREWCRRKLGKHKAPTHVFYLGLDGVPSTVPLTGSGKVRKFEMAQL

SEQ ID NO: 3321 - protein, 356 aa, Neurospora crassa
YRKVWHEPVHRRDPSKETETEKACFRHLELTSRSFSAVIQELNPELLMPICLFYLVLRGLDTIEDDMTIDLAKKEPLLREFADLMEIDGWTFTENGPNEKDRELLVHFDDVIAELKKVKKPYYDIIREITVKMGNGMADYALNAEHNTNGVNTIEEYELYCHYVAGLVGEGLTRLFVESNLANPALLERMELTESMGQFLQKTNIIRDIHEDYVDKRRFWPKTIWSKYVNTWDDMFKPENREKALQCSSEMVLNALKHTEDCLFYMAGMRDQSVFNFVAIPQAMAIATLELVFRNPAIFERNVKITKGDACQLMMESTQNLRVVCEVFRRYARRIHKKNDPRDPNYLAISVQCGKV

SEQ ID NO: 3322 - protein, 589 aa, Neurospora crassa
FEDRAYTYAQAYDTVLRYANWLKDRRGVKRGDLVGLDFQNTDTFIFLVLATWAIGASPALLNYNLTGNPLIHCVNKSTARLVLVDPVVAGNVSEDVRSALGGVIFEVVTPALEQEMLAMDSVRPADELRSGFKDKDMAMLIYTSGTTGLPKAAIISWAKAATCCQFHLSMARHQCERRVLYGKSPCKICYITSTHTFLRAMPLYHSTAMLLGFAHTLAAGATFAMSRKFSTSGFWNDVRKHNATIIQYVGETCRYLLSAPPIIDPVTGEDLDRKHRVRAAFGNGLRPDVWNRFKERFGIETIAEFYGATEGTFATWNKSRNDFSMGAVGRSGSLYNVIFTREVAIVEVDHETELPRRDPKTGFCTRAPRGEPGELLFRLPPGDINSRFQGYYGDEESTSKKVMRDVFSKGDAWFRTGDVLRWDNENRVYFSDRIGDTFRWKSENVSTAEVAQVVGLHPAVLECNVYGVQVPSHEGRAGCAAVVLKPSCLVQTSGEAARAPRPTDDTVKSLAEHVKRGLPKYALPLFLRVVPEGGLQATGTNKQQKHNLRSEGVDPARTGEDEVFWLRNGTYVKFGVADWKELNAGNVKL

SEQ ID NO: 3323 - protein, 260 aa, Neurospora crassa
  unsure (1)..(260): unsure at all Xaa locations
QSSFCADERLTRDSQCSLRLGTIAPNFQADTTTGPIDFHEFIGDNWVILFSHPEDYTPVCTTELGEMARLEPEFKKRGVKLIGLSANTLGSHEGWINDIKDVTGSQVQFPIIADKERKVAYLYDMXVYPPHLTDREGGFGESGHRVADTLFYRLDYQDTTNVDEKGIAFTIRSVFVIDPKKTIRTILAYPASTGRNSAEILRIVDSLQTGDKHKVTTPINWVPGDDVIVHPSIKGEEATRLFPNLKAVKPYLRFTPLPKD

SEQ ID NO: 3324 - protein, 495 aa, Neurospora crassa
MTLLALKEDRPTPKAVYNWRVYTCAAIASFASCMIGYDSAFIGTTLALPSFTKEFDFASYTPGALALLQSNIVSVYQAGAFFGCLFAYATSYFLGRRKSLIAFSVVFIIGAAIMLAADGQGRGIDPIIAGRVLAGIGVGGASNMVPIYISELAPPAVRGRLVGIYELGWQIGGLVGFWINYGVNTTMAPTRSQWLIPFAVQLIPAGLLFLGSFWIPESPRWLYANGKREEAMKVLCWIRNLEPTDRYIVQEVSFIDADLERYTRQVGNGFWKPFLSLKQRKVQWRFFLGGMLFFWQNGSGINAINYYSPTVFRSIGITGTDTGFLTTGIFGVVKMVLTIIWLLWLVDLVGRRRILFIGAAGGSLCMWFIGAYIKIADPGSNKAEDAKLTSGGIAAIFFFYLWTAFYTPSWNGTPWVINSEMFDQNTRSLGQASAAANNWFWNFIISRFTPQMFIKMEYGVYFFFASLMLLSIVFIYFFLPETKSIPLEAMDRLFE

SEQ ID NO: 3325 - protein, 321 aa, Neurospora crassa
MSTATTTTSATTTMSVVQPRQQELLHLTSTPDITPYTRHGYLFGQKLAASMSPLLHSIVYSHLSLNWAQLRLDSPSIPLFLQLAQHPDFYGASVTMPHKVAIIPHLDHLTPECRDVGACNTLFLKTDPATGRRLYCGANTDVIGVRESFVQNVSDPARVYESRPALVIGGGGAARSAVYALHKWLGATDIYLVNRDKSEVDAVIAECTERGYGDRLVHVASVEQAEGLEGPGAIVACIPDFPPKTEKEMLVRRIVETFLMKEEKGAMLEMCYNPSPFTELGALAEHEGWQVILGTEALIWQGIEQVCIRPELTLYCGGQLN

SEQ ID NO: 3326 - protein, 173 aa, Neurospora crassa
MASPRHILLINGPNLNLLGTREPQIYGSTTLHDIEQASQTLASSLGLRLTTFQSNHEGAIIDRIHQAAGFVPSPPSPSPSSAATTTEAGLGPGDKVSAIIINPGAYTHTSIGIRDALLGTGIPFVEVHVSNVHAREAFRHHSYLSDKAVAVICGLGPFGYSAALDFLGRHMKF

SEQ ID NO: 3327 - protein, 267 aa, Neurospora crassa
  unsure (1)..(267): unsure at all Xaa locations
RVIPLCASWFLPNDPQKRTGLDVFIEKRIPKARFFDLDKVIDKRSPYPHMLPSSKDFAAAMSELGIRREDTVVIYDSQELGIFSAPRVGWTMKVFGHPKVHILNNFKLWIEEGLPTESGNVWTIECGTYPIPEMNEDKVASFEEVRQVAIDSSKEGSKSVQILDARSPGRWSGTEPEPREGLSSGHMPGSINIPFSAVLDSSTKAFLPADKLKEVFARAGVDPSKPIISSCGTGVTACVLETALNEAQFGSPEKSKVYDGSWTXVLL

SEQ ID NO: 3328 - protein, 610 aa, Neurospora crassa
  unsure (1)..(610): unsure at all Xaa locations
MTAVADFRISPKGTSFTPEERVAKNLTGLIPHVMEDSEKQVERALKMIRTRQTDIDRYLYLSTIKSQNVDLFYRLLMDHAKEMMPLVYTPTIGDVCLQYSTLYTRPEALYISIKQRKSIRTILRNWPYPQPEICVVTDGSRILGLGDLGVNGVGIPVSGNYSISYAGKTLTCTRIGKLALYTAAAGIHPDKTLPIVLDCGTANETNLKDPLYLGLRQKRIPVAEQQEFMDEFMEAAAEVFPDMVVQFEDFESEKAFNYLDRYRDQYKCFNDDIQGTGAVVLAGXVGKPLQPCRRXSCLNGKSHVSKVTCERETNCXQYAVQYSYIGAVNLSNVPIEEQRLVFMGAGSAGVGVAKQLVEYYTKRGLSEQQAKDKFWLVDTKGLVTKDRGDKLAEHKKYFARTDNNGHQFRTLEEVIEYVKPSALVGLTATHGVFTESVVRALKASVDAGGLGRRPILFPLSNPLTKAECTFKEAIDWTDGTVLFASGSPFSSYTTNGVTYHPNQGNNVYVFPGIGLGAILAKATRVTDDMIYTSAAALANSLNADEVKQGLIYPRIDRVREASVIVAREVMKSARREGVSTLPEEQWLEWEEWGDVDLERYIKQHIYDPKF

SEQ ID NO: 3329 - protein, 298 aa, Neurospora crassa
LGEGTYANVYLGHSRLDSSTQVAIKKIKVQKEYQDGIAPDAIREMKYLQKLRGHANIIILHSVFSSKDQNLNLVLEYLPLGDLEMLIRDVDHVRYGAADIKAWMGMLTRAIWWCHDNYVLHRDIKPNNLLIAADGEVKLADFGLARSFADPGVRMTANVITRWYRPPELLFGARHYSGAVDIWSVGLVFAELIIRAPYLPGNSEVEQIALICREIGTPTEENWPGVTQLKEYTVPSDVVPVAGKDKYMGRFGAVGSDGVDLLTKTLVLDPRRRITAREMLEHRWWKADPKPTPKHDLP

SEQ ID NO: 3330 - protein, 951 aa, Neurospora crassa
  unsure (1)..(951): unsure at all Xaa locations
MAWQPSGENLKTLAQCLKDSLSAFNKAAQKQAEIVSXCPSAPSSYPVXWSIATRQRFXLVFINQMLNQAKASPDINNYLALIFSSSEPPQEFPATAADWHVVRCAAALMLKNNIKNNYNKIPEQSLALVKLAVPLGLQDKNSQIRSHAGTLATELINKGGIYGWPEFLPELLKMLTNESGQVTPEAQEGAMAAMAKICEDNAKMLEREHNGQRPINFLLPKLIQATRSAIPKVRAHALTAINVFTPRKSQAMLNSIDDLLQHLFALAEDPSIDVRKQVCRAFVNLVETRPDKLLPHIEGLAKYIIAQQKGDDEDLATEAAEFWLTVGEHDNLWRALEPYITDIIPVLLECMVYSPEDIAILGGASDDEDEEDREEDIKPQFAKKKLTRAANGNTAADMAKNGNAFEKVASMEEDDDDLEDGEIDDSESEGDENPDEKWTLRKCSAAALDVFARDFGGPVFTSILPYLQSNLKHADWSYREAAVLALGAVAEGCMDVVVPHLPELVPYLVSLLDDEEPVVRQITCWTLGRYSAWAVSLVDQAEKERYFLPMMDGILKKMLDKNKNVQEAGASAMANLEEKAGKALEPYCGPIIQQYIRCFGKYKDKNMWVLYDCVQTLAEHIGPVLARPELSNQLMPVLLDRWQKVGDESRELFPLLECLSYVAMALGDAFTPYAEPIFGRCIRIIHQNLEQAMKAKTNTDLDQPDEDFLVTSLDLLSAIIQALDNDKASKLVANVQPTFFELMALCMGDQSDAVQQSAYALLGDCAKYVFEQLKPFLPNIMPVVIKRLDMDTILDEEVDNSFSVVNNACWSVGEIALQYKAGMAPFVPQLIQRCVDILSNPRVPGGVSENAAIALGRLGLDNAELVAPHLGSFAEEFLDTMDDVDPSEEKATALRGFTEMVTRNPQAMESVLLHYFSTIANYQELSLQKPVLLELHEAFQNVSFNPRIPMI

SEQ ID NO: 3331 - protein, 576 aa, Neurospora crassa
  unsure (1)..(576): unsure at all Xaa locations
MASFQLGPVSARVRVSTLSSTAFGRCPTSTRFTRLEIPFSASTRAPPAHQMFGRRFFSNHMPKRPRMQWHPIPIGLGIGLLGVMQFYKVYTRDRDEKRQAAVEGSEPGQAGKPKKRRRIRPDGPWYVDHAGLLNFLRRHELTTRCLGQVQVMSTLPLKAMSRLWGKFNELTIPYYLRAPGFRLYAYFFGVKXVRPGLLPSSLSLSCADTCAPVLDEVEEQDLHKFPNLAAFFYRTLKPGVRPVDPNHNALVSPSDGRILQFGRIEGGDIEQVKGMTYTIDALLGQNSPTPSISGTTLLDESTKAKSVNGDFEGDEELVKKDEEFARVNGISYTLPDLLSGSKKHDKLFKPKDESVTPSKTSETEVSAELALGEKPWYDVLSGGERHTLYYAVIYLAPGDYHRFHSPTEWVVERRRHFAGELFSVSPYLQRTLPGLFTLNERVVLLGRWRWGFFGYVPVGATNVGSIKINFDRELRTNSLTTDTAADRAAELAAAKGEPYLGYAEATYEAASPVLKGHALRRGEEMGGFQLGSTIVLVFEAPVAEHDESGKVTKGWTWDVEKGRKIKMGQTLGHVAL

SEQ ID NO: 3332 - protein, 270 aa, Neurospora crassa
  unsure (1)..(270): unsure at all Xaa locations
QVIILGDSGVGKTSLMNQYVCQRRARCHHALXYKEDVIXPPLFWRKTGNKKFSASYKATIGADFLTREVLVDDRQVTMQVRAPNTLLXAGWTTCXYVRFSTGSCGDTAGQERFQSLGVAFYRGADCCVLVYDVNNSKSFDALDSWRDEFLIQASPRDPDNFPFVVLGNKIDMEESKRVVCFLFDGPCRMLEIIIYXPCGADSTKRAMTFCQSKGNIPYFETSAKEAINVEQAFEVIARNALMQEESEEFSGDFQDPINIHIENDRDGCAC

SEQ ID NO: 3333 - protein, 605 aa, Neurospora crassa
  unsure (1)..(605): unsure at all Xaa locations
MRRTSVSLPTKHVAHDPHEKPDRYRRDQHNQEPASVFIRMQNAWMSQSQKARYLKTGAIVFAVLFLFYLFSPSGVEISGADGGKQASYDEIGLHKSKYLQPDLTRPSQGNQGQVPSDSSYGTDRCTRSFSKEKPIVQYVSMIDAGSTGSRIHVYKFNNCGPAPELEGEVLFKMTAKIEGQSSGLSAYKDDPLAAAKSLDPLMQAALEVIPDKLKACSPVAVKATAGLRLIGPEKSQKILDAVREHLENDYPFPVVSKEEHGVAMMDGADEGVYAWITVNYLLGKIGGPDHSPTAAVFDLGGGSTQIVFEPTFEGLASGGMPQKLADGDHKYELNFGGRKFDLYQHSHLGYGLMSARDAIFATLVNDLFELNKQDKSWMQKPVINPCFSTGMTKTVKVPLGDSHPLGPKVELNMTGPSTPAPALCRSLAERILKKDAECKLAPCSFNGVHQPQIAKTFAREDIFLLSYFTDRTQPLGMPESFTLREMHDLAAQVCGGEQSWDVFTSVPGALEELSDRPEHCMDLNFMLALTHTGYEMPIDREVRIAKKIKDNELGWCLGARXVNAFLVLFLPRSXRCXHGIFFFFATVLPLLSQSSGWKCKIKEIH

SEQ ID NO: 3334 - protein, 244 aa, Neurospora crassa
QITTLLFDCDNTLVLSEEVAFEGCADLINQIAATKNIPLEKPFTGESLIVEFVGQNFRGMLRSLQERYGFPLTDEEMEMYVKKEEDVVIAKIQEKLSPCPNVDGVLERLAAEGKYELAVVSSSALRRVKASIEKVGQDKYFGDRVFSAATSLNPPTSKPDPAIYLHALKELGKKAEECLAIEDSKSGTLSAARAGIKVIGYVGPYKAEERLKMEKVLAQAGASIIMRDWNQFEGYLAAIEKGDF

SEQ ID NO: 3335 - protein, 393 aa, Neurospora crassa
  unsure (1)..(393): unsure at all Xaa locations
AGTGSSDNYAYLVVDDKSKDAVIIDPAHPEEXVLHQRAPRPKYASCNLXGGQVCXXEVPVXRTXRVAPVLKKAIDDGSIKLTAIVNTHQXVAFLRRSQHNTXLTLLSAHWDHAGGNTKLVGSLFRFPPHYPQSTCSLTCIQRTALGLPNLEIIGGKDCEKVNKVPAHGQGFNIGNIAVKALHTPCHTQDSICWFMQDGDDKVVFTGDTLFHGGMFFFCPWSIVDVGWAWVSDMAIIGCGRFFEGNGAEMHKALNETLASLPDETRVFRKSRVPYLNLWITQXYLTYPMKPGHEYTKSNAKFCMSVLQSEAVKALQAFAEKHRETQGKFTIGDEKKHNVFMRPHVSYSLSRRTAMMEGCSXPCRLIGPEIQKATGETDPVAIMTKLREMKNNFK

SEQ ID NO: 3336 - protein, 726 aa, Neurospora crassa
  unsure (1)..(726): unsure at all Xaa locations
MPNPRLHPIFSVQPCSAGVWSVLATPRSPILSELYSGADGSCEGHSAEAPLLCKLYXYRVVPVMYLAXLNPLELRVSKLSSASSSFVPXSQFPSRAAHEXVTNCFCRSHILSHCQYQSYDGHLGRSSRXRFATEALVSSSGSSIFHWRSSANNPTSRRGDAPEALQRQITNYKPLHTFKLEKTRPYQQQYADIYFLRLTKIRPAVEAAASAAWEGTVLGGEKVKRVERVLDVRQGELCWVAGTVYMDMPLKPSILEDVSKDVSFSLSFGGHQAADNDVIRWISAPTSVGHYYSGNGEDSVMLEDDSGRIRLVGNALQNHFMVTGCIVAVMGTENANGEFEVIDLLFAELPPQPERWSLSKGKKEADSSEDVEMMDASFSRQSHKPSSKKIALVSGLEFSNADTSYAMELNLLLEYLLGEALDPSVQRDELSHITRLIIAGNSISTTAAEQAKPAAAFDTTTVTNKFQPQIKKYGYDSSSYNPVPSQLLDSFLSDLLPTMPVTLLPGALDPANASYPQQPIHPAMFPQSRTYMPPPKAGAGKDRDVPGEEEPGWFDNVTNPWEGEIEGWRVLGTGGQNLDDVFKYVESEDRLGMMEAMCRWRCVAPTAPDTLCEFCFSLLQHSFSSPLSLDFDSHFHPPFPVRNXQRTNLSDQTGSYPFQEDEPFVIKECPHLFFVGCQPEFGTKVIHGPDGQAVRLIAVPSFSETREVVLVDTETLDVERVKIVAE

SEQ ID NO: 3337 - protein, 937 aa, Neurospora crassa
  unsure (1)..(937): unsure at all Xaa locations
CRPLRDFCRLWYHVAVKKDQNLLAAQAFASLSLINLLTTPLLMFCQAFPAAMQAVACFGRIEAYLTKQELKQLDLSSVEDRGRSAGASFESGTELRSVVGSRPFARETTPGALASFAAADISWSANTIEPVLQGVNLTIKPGFTAVIGPVGSGKSTLLESLVGETTLQRGSVTTNFSRVAYCPQAAWLMNDTIRHNITGSSEDLEIDQKWYDLCILSCGLRRDLDGMVAGDQTAVGTNGSSLSGGQRQRVALARAVYSRAPVIILDDVMSGLDPATAKDITTRLFSRQGHLRKAGVSVVLATHNSKFLPYTIHITALLTGFQSAFLPYMDEIIVLEGGKIGDIGSYSEIQSRGDLKLMAMTDDDDVIESGEEQQSATDEVSRDSKSPAMTQKPSDTTNRQPIKPNFERRQGSWSVYAYYARSAGALSLSLWAFFTVLGAITSNYMTIWISNWSSASTPSASNPDPHPNLGYYLGIYTLLVVLAQIGTVGECFVFLINIISNTALSLHTDLLNSVLSAPLSFFSQSSSLSLSSSSSSPTDSNGDDNNDTSSEDSGTITNRFSQDMDLIDMTLPIQAIMFTSAGSYALVQLIIICVLGKYLAATVPLLAVTLFLVQKYYLRSSRQLRLLDIEAKAPVYKHFLETVTAGGVATIRAFGWDKRFRDRLARMMDEAQKPFYMLACIQQWLALVLDLVVGGMAVVLVGVAVGVAPDPEKAGSSKSAVSAGALGVSLVLVMTFNELIVQALQAWTRLETSIGAVARVRDFVRTTPKEEDPAADCDNGGCVGDGLAGWPSRGEIKIEKICASYEYVSPTPFPFFSLWYPXISKQNXQPASRVFSNTSSNTNNTTTSGPPALKNLTLTIPSGSKLAVIGPSGSGKTTFLLSLLRMIPLSSGCITIDSLNISTIPRSRHIFNVIPQDPFFIPNTSLAFNLDPFGHLS

SEQ ID NO: 3338 - protein, 668 aa, Neurospora crassa
  unsure (1)..(668): unsure at all Xaa locations
MSNRHFINDPQHLVLTSLQSTTLLNPGIALDAHNKIVYLRPGYGNASSSSSSSNQRQKVSLISGGGSGHEPSFSSMVGRGLLSACVAGTIFASPSAEQVRTAIMGRVENNEPSSSPEHGQQQQRGEDAGGVLVVVMNYTGDVLNFGLAVEKAKAAGVNVEMVVVGDDVGVGRAKAGKVGRRGIAGTVLVQKIAGALAAQGRSLKEVTKVANLAAENIVSVGASLEHVHVPGRRAEAEGAEFKVLKEGEVEIGMGIHNEQGSSREKGIGLPELVGKMLKQLLDRNDEDRAFVNVNSNEVVLLVNNLGGVSPLEMGGIVTEVVTQLAEQPYGIKPVRILSGTYMTSLNGLGFSISLLNVVNTDIGGPGMIDLLDYPSEATGWTAPISKLTWEEQRENKSTRENEVKSEEEVRPCGLTYEPQEVQKQLVAGLKAVIAAEPDVTKYDTMVGDGDCGIGLKRGAEGMSPXQQQPLFPLIANRMPAILSHLDSNPLTGDAAIDLAKIVTVVEQTMDGTSGALYGIFLNALVASLHTVGGGESDKKAADENAWAAALKLSCEALSKYTPARPGDRTLVDALYPFVDALEKTGDVKKAAEAAKQGAEGTKGMKAKLGRTVYIGGSGFEQVPDPGAWGLAKFFLGLAGIEKADDSSAKQAKGSDDGWEEVTREAELP

SEQ ID NO: 3339 - protein, 1285 aa, Neurospora crassa
  unsure (1)..(1285): unsure at all Xaa locations
MDHEHQSRRHKLGVVSGVYIPVCLNILSILMFLRFGSILGQIGLLGMLGMSFPELTVYHFGXNWLTISRLLFIAYSVDFVTTLSLSAIASNGEVKGGGAYYLISRSLGPEFGGSIGILFYLAQVLNTALNVVGLIDCLRLNLGSVMAQGYWWTYLFETGALLVCTLLCLAGSAMFAKASNALLAIMVISILSIPVSAIFLPSFNDPVSGIEFTGVSLTTLRSNLWPHFAGDEFKGAGTFRDLFGILFPATSGIFAGASMSGDLRNPSKDIPRGTLWAMLSTLISYVVVIISLASSTTHGTFLRNTNVIQETNVWPPIIFAGEFATCFFSALMGVIGSAKLMQALARDKLVPGISIFGKGTKKTDEPLLAIFLTYIVAQFAMFANLNQIATFISMGYQMTFFVMNLACFLLKIGSAPNFRPGFKFFSWQTAFAGSVLSAAAMFFIDETYATTAVSLLVTLFLLIHYLSPPKRWGDVSQNLIYHQVRKYLLRLKPEHIKFWRPQIILLINNPRKQTRLIQFCNSMKKGGLYILGHVIVTDDFSAGVTEAKLQQAAWSKYISEFSRIKAFVQLTMSPTITWGVRNLILSAGLGGMRPNIAVIGFYNLDDLRRSRPTLRISHQAPTSHTKSPQTTETKQPVRQRKRGDTSARLMEGFLPTDVIRTEEMMSVIDYLTILEDLALRYRLNVAVGKGFETLETPRKDGSNTKKYIDLWPIQMSAELSADGRNVLTTNFDTCESLSTGHGYHFNCXHITDTLILQLGYILDTVPAWKKVYQVRVLVFVEYESEVEEERGRVKALLEKLRIEAEVLVFWLASGDLGTYEAIIHGRFRDQETEKLVNDCLVGQEWWEELQKIRGTHEETSQPDMSSVLNIVESTSGRPGLYNPHSELPDPRDRRRASWAPLADFPKKPTVSQLVRLGVSMGIHTQNLAANVLDSSDTDVDGESDSDSSSSSGTLDGDFNDAASVANNGGLEALEPSRLPLLGATRRMSHGDLFDRLKKPWKDRRSRKAGGPSAQQSYGAVSQDTGPSRNNGSEGRSSKRDDFLSVGTERSSHTTTPTLSRQNSSILKSSTARKFTSSLVPETRITSDDTGPQIMFAEDQARPGISRRSTPGTTALLSSKQPARNTIGDGNGGGPRTVCFVEPRYDGASSSPDKSRANSPARTGIGSGSGDVLLDIPELLSSYRLQQQQQQDDDAAEAGSSYSTQGLPLSFNDLPSRAQHLILNELMRQNSADTAVLFTTLPVPEENTCQSEEASLTYLFDVEVLCNGLPPMLLVLSNNMTVTVSL

SEQ ID NO: 3340 - protein, 719 aa, Neurospora crassa
LSRTKDKDSKSKKNKDAKDGTASPNSQGSREATQSPVLTPSSSTSTLVNDSRNKPLPPNNAAHGDHGNSMLGPQGGNSNPGAADRFSSIGGQQQGANGGSTPVRHGTLPPTVIISPSAPVRSSLDCRTWTMEILTIGCRSHVPPPGAAETMPHDLAPPKAGQKSLMFDRLHQTPKDVLEGLRTPKRQNSSRFDISAHRELEKLPGFHEVAPNHRQDLFMKKIEQCNVIFDFNDASADMKSKEIKRLALHELLDYVANNRQVITEPMYPRVVEMFAKNLFRPIPPPMNPQGEAFDPEEDEPVLEVAWPHIQVVYEFFLRFIESQDFNTNIAKAYIDHSFVLQLLELFDSEDPRERDFLKTTLHRIYGKFLNLRSFIRRSINNVFFQFTYETERFNGIAELLEILGSIINGFALPLKEEHKLFLTRVLLPLHKVKSLSMYHPQLAYCIVQFLEKDASLTEEACDTPRLLRPHHKLTFVSGCLGLLRYWPKVNSTKEVMFLNEVEDIFEVMDPAEFAKVQEPLFHQLAKSVASPHFQVAERALYFWNNEYFCNLVSDNVEIILPIMFAPLYENSKGHWNRYVLNNITYFEVSRLTENRTIHGMVYNAMKLFMEINPQLFDDCSHEYTENQSNAPAREAHRQSKWARLEELAKQRKVESGTSNGTSSIPARTTVHPLPRLEEVDGTEDNQKRLDSLKLQDGDRRERRPGMHERQSSVGSSRSR

SEQ ID NO: 3341 - protein, 881 aa, Neurospora crassa
MKTDFKFSNLLGTVYCQGNLLFSPDGTHLFSPVGNRVTVFNLVEYVSRFPTHLPGAWLVSWLTRRSNKSYTLPFSHRKNIARIGLTPQGNLLLSIDEDGQAILTNVPRRVVLYHFSFKAPVTALSFSPSGRHFIVGLGRKIEVWHVPSTPDANADGELEFAPFVKHHTHVQHFDDVRHIEWSHDSRFFLTSSKDLTARIWSVDQEEGFTPTVLSGHRQGVVGAWFSKDQETIYTVSKDGAVFDWQYVAKPGQDEDMVDDDDLAWRIVNKHYFMQNSATVRCAAFHPESNLLVAGFSNGIFGLYEMPDFNMIHTLSISQNEIDFVTINKSGEWLAFGASKLGQLLVWEWQSESYILKQQGHFDSMNSLVYSPDGQRIVTVADDGKIKVWDTESGFCIVTFTEHTSGITACEFSKKGNVLFTSSLDGSIRAWDLIRYRNFRTFTAPERLSFSCMAVDPSGEIVAAGSVDSFDIHIWSVQTGQLLDRLSGHEGPVSSLAFAPNGGLLVSGSWDRTARIWSIFNRTQTSEPLQLNSDVLDIAFRPDSLQIAISTLDGNLSFWSVSEAEQQAGLDGRRDVSGGRKIGDRRTAANVAGTKAFNTIRYSTDGSCLLAGGNSKYICLYSVTTMVLLKKYTVSVNLSIQGTQEFLNSKLLTEAGPQGLLDEQGEASDFEDRIDRSLPGSKRGDPSARRKNPEVRVNGVAFSPNGSAFCAASTEGLLIYSLDTTIQFDPFDLNMEITPTSTLAVLEKEKDYLKALVMAFRLNEAGLIQRVFQAIPYTDIPLVVEQFPNVYVARLLRYVAAQTEQSPHVEFCLLWIKALVDKHGAWLSANRGKVDVELRVVARAVSKMRDEIRKLADENVYMVDYLLGQASAAKETNTTKTL

SEQ ID NO: 3342 - protein, 451 aa, Neurospora crassa
  unsure (1)..(451): unsure at all Xaa locations
MAPATTESASPIGIANLPNQRHKIVAKRGAAFTIMVALHCPKLAEPRACKTNADGVGGXVAGESGLGKTTFINTLFSTTIKNYADHKRRHQKQVDKTVEIEITKAELEEKFFKGTTAHHAGGPWCLVGELCLTSLXFRLTVIDTPGFGDYVNNRDSWMPIIEFLDDQHESYMLQEQQPRRQDKIDLRVHACLYFIRPTGHTLKPLDIEVMKRLCSRVNLIPVIAKADTLSPADLARFKSRVGFSLYLKIPPIIANHDFXIRAVIEAQGIKIYQPPIEEDDEAAAQHARSLMAAMPFAVIGSEKDVKTSDGRIVKGRQYSWGVAEVENEEHCDFKKLRSILIRTHMLDLIHTTEELHYEAYRAQQMETRKFGEARPRKLDNPKFKEEEEALRKRFTEQVKIEEQRFRQWEQKLIAERDRLNKDLEQTHAQIKSLEMELESLQGNAVRSHGRR

SEQ ID NO: 3343 - protein, 496 aa, Neurospora crassa
  unsure (1)..(496): unsure at all Xaa locations
MRISCPCLDITCTRSPRLQCDLFTYRWVAKEARPISLRQLMVFGRSLTESRLISSANYVRTELPTRXALNXTLQHRDYQSYSIXLCMRQLGQIAHRIRDMQRLPYVVVTNPHMNEVYDLYYSAFDTFRKVPEIKTLEDNDALCATIRSNLKAHLTVIPKLAMGILESAGLMDAKELDKFMNTILRSRISRRVIAEQHLALTDTFHAPWFSPGAKLSESEFIGEVFLKCVAKDVVERCGQAIRDIAQHAYGPDVAIPEIKIDGHLEANFPYILSHLEYIIGELLRNSVQAVVEKHQRYKEKVAAAGGKTDEIGPPPAIEVTICESQQHVIIRISDQGGGIQQDVLPYLWSFSKGPASQQLLTNLEQVPKMAATMQELKVEGSTSSEAGTTVGKLQQQRQEQQQQQQQQQKQQIKGIHNGNNFPGDPGYCNSLATLTSRPPNLRLGMGLPLSRVYAEYWAGSLALHSLEGYGVDAFLQISKLGNKNEQLTTRATMDAV

SEQ ID NO: 3344 - protein, 1310 aa, Neurospora crassa
  unsure (1)..(1310): unsure at all Xaa locations
MGNPANRALLTPSPSPPSDDQVANLPVRTKDDQNPQAPSPNAMLVDTPEEHVVEPNGVDNDEVAIITPEADEKEAPVLATDCELDNNTTSILLGGSATDAVLDKTMKEHVLPALIDEPPILEDQVYTWEIKGWRNLNKKEHGPIFHAGGFPWSVFLGGFFTSAKETNIVQKANSSFPVWQXCXPVLDIPGTRLRSGRNARKMELLRSFALVLWNPNDPSVFHHHSAHHRFTKEESDWGFTRFLELRRLFSQPYDGSSRPLGENESVNISAYVRIVEDETGVLWHNFNNYDSKQETGYVGLKNQGATCYLNSLLQSLYFTNAFRKVKRSTSCSFLLCFPPACXLACRLIYQIPTEQDESMMNSAYTLQRLFYQLQTSNTAVATSELTKSFGWETRHIFEQQDVQELSRKLMERMEEKMKGTPHEKALAQMFSGKIKTFISCINVPYESSRVEDFWDVQLNVSGNKNLLESFQDYIQVEKLDGENQYYAGDEYKLQDANKGVIFQSFPDVLHLQLKRFEYDIQRDTMMKINARYEFPEEFDAAPFLEKDADRSEPWEYELHGVLVHSGDLNTGHYYAFLKPTKDGNWYKYDDDKVTKARKLEVLEDNFGGPFRLPNGQIRTLPQKKTPIMRPNSAYMLVYIRKSRIDQILTQVTEEDTPPHLRNRFAEELAAREARRKEREEQHLYIGVKVVTEATFQEHGGTDLTYFDTTPDQDPGAPIYYRVLRQDTMEQLVAKIAADLGQDPKRVRLWIMVNRQNKTVRPDVPIMDLALTVEETYSKATAQRDESLRVWAEVAEEVNADGEPIWPSHQAQANGAIVKDNILLFLKWFDVESQTLRGVGHVYVRLDKKVEDLVPVILKKMGWGEKVPSGEKIQLWEEIKPTMVEPLRGKETLKTEELQDGDIICFQRTHVHKSRLGLGESKPSEDAKSSDKLTDAREYYDFLYHRKVVRFCPHPQKADVQQYPQFELVLSSKMSYDKLSEKVGEHIGVEPTHIRFYTINGANGNPRTAVKKLSNQTVERILTPPGYGQMNLNQLSDALYYEVLDISLAELDTKKSLKVTWLSEGITKEVSSLVTLVAAYVTNATVGPYDLLVTKSGVVEDLIETLVKKAKIPGEEEAGQIRVYEVSNNKWYRDLDRNYPVISINEYTTVVAERKPEEEIGVTDPNQYITVFHFQNEPSRAHGMSFRFLIKEVISTFIAFXTLXDLTKWSSQGEPFSETKKRLEKRLGIKGKSFEKIKFAVVRRAQFSRPIYLQDGLWHLPISVFPMAXLTRLLHRRHPYEKAEKEDYLGLDHVDRSRSARNGGGDLFLKG

SEQ ID NO: 3345 - protein, 486 aa, Neurospora crassa
  unsure (1)..(486): unsure at all Xaa locations
DVQAPAMFKPSDEQFFEDETHTKPDIQFLKQHFYREGRLTEEQALWIIREGTKLLRAEPNLLEMDAPITVCGDVHGQYYDLMKLFEVGGDPAETRYLFLGDYVDRGYFSIECVLYLWALKIHYPKTLWLLRGNHECRHLTDYFTFKLECKHKYSEAIYEACMESFCCLPLAAVMNKQFLCIHGGLSPELHTLDDIRNVSLTATXLPRYGMGILTRXLLCRIDRFREPPTQGLMCDILWADPLEDFGQEKTTDFFVHNHVRGCSYFFSYSAACHFLEKNNLLSIIRAHEAQDAGYRMYRKTRTTGFPSVMTIFSAPNYLDVYNNKAAVLKYENNVMNIRQFNCTPHPYWLPNFMDVFTWSLPFVGEKITDMLIAILSTCSEEELREDSATTSPGSASPALPSAANQDPDSIEFKRRAIKNKILAIGRLSRVFQVLREESERVTELKTVSGGRLPAGTLMLGAEGIKNAISSFEDARKVDLQNERLPP

SEQ ID NO: 3346 - protein, 1315 aa, Neurospora crassa
MPSSDTYHLSKPPDSHVVDESDSDLEIDLEELDPQATDPNNHHQSLGQHRSRNSSEQRPPPPTTSIALRNLRMGSLRRGAKRNGYGELGRSRDGNDDDDADALLRHDRHSVGSATHDEDAGLLSEHGGGGRIRTSSGRRRRSFAGDGLRNISMKLPGFMSGDQSNHNDEQEQEEDDPSSSRLVAVGSSQSTRFPPNIISNAKYTAWSFLPVTLYNEFSFFFNMYFLLVALSQAIPALRIGYLSTYVAPLAFVLFITLAKEAYDDIERRRRDNEANSEEYTVLQFDDPGASLGINRPRRKMKSSHTRTGSKRLGIEQENDRLSDIQEEEEQTEGRGLRELPASYLSEVSKKSRDLKVGDVLKLTKGHRVPADVIILKCLAHESAANKETEEQEVPAKEEMLLLDHVDDDDVGEGSSKNAKTSKESNNNGAEGSSSGETFIRTDQLDGETDWKLRLASPLSQNLSTEELVRLRVTAGKPDKRVNEFVGTLELLPSRQDVMSGAAYNPREGDDVKAAPLSIDNTAWANTVIASNATTLAVIVYTGPQTRSALSTSPSRSKTGLLEYEINSLTKILCFLTLFLSIVLVALEGFSTAKGNIWYVKIMRFLVLFSTIVPISLRVNLDLGKSVYSWFIQRDPGIPGAVVRTSTIPEDLGRIEYLLSDKTGTLTQNEMEMKKIHVGTVSYANEAMDEVATYVKQGFNLSSSASSASLALATPSSTYSAANVGATRTRREIGSRVRDVVLALALCHNVTPTSEEDENGHTVNSYQASSPDEIAIVKWTESVGLRLAHRDRKNIVLESAETGRPVVKVRILDIFPFTSEGKRMGIIVQFYEKLQPGNPSLGSSEIWFYQKGADTVMSSIVAANDWLDEETANMAREGLRTLVVGRKRLSLKEYQEFSAKHHEASLAISGREANMQAVVSQYLEHNLELLGVTGVEDKLQKDVKPSLELLRNAGIKIWMLTGDKVETARCVAVSSKLVARGQYIHTIAKLRRKDGAQDNLDLLRSKTDSCLLIDGESLAMYLTHFRREFISVAVLLPTVVACRCSPTQKAEVAKLIKEYTKKRVCCIGDGGNDVSMIQAADVGVGIVGKEGRQASLAADFSIEQFHHLTKLLVWHGRNSYKRSAKLAQFVIHRGLIIAVCQTMYSIALKFEPEGLYKVRLTWRVIPFVAVVVTNLNKTQDWLMVGYATVYTAFPVLSLVLDKDVDEDLANLYPELYKELTSGSSLSYRTFFVWVFVSIYQGCLIQGLSQVLTGIDGPRMLAVSYTVLVLNELLMVAIEITTWHWVMVVSIVGTFLMYIVSIPFLGDYFDLKFVLTL

SEQ ID NO: 3347 - protein, 930 aa, Neurospora crassa
  unsure (1)..(930): unsure at all Xaa locations
TARTRLTKKAAASQPPSPFLSPQPSVDSLPLPVPTRDANNVLLLMKNLCGRMRGEAQYLKDMGGLWYGGICYIDEEKGSLVSDSGEGSSSSSVSLLIPDLRGCRVLPLSRMERGGRPSLEITSPHLNLSIILCPSAVEEYDLWLAALLCWQQLGLPAPRTPXQDQGAALLYHRXGARCSVGPPLPALREATVIKVGRVMLWDKGLATSPRAIVKRPSARDLQIPHMAWKRVSCILSDNGELKLMTEHDVSLLAMIELSQLSRSAIQQLDKTVLNENYCIGIFPIYSPTSTQLSILRPVYISLESRLLFEAWFALLRAFAVPDLYGLDSTSRGRVYEVTNLSSVPKGEVFRVEKTVKVRVTEARLRSRTFAQEGNLMERQNKSVADPDPAVGNYFAEVILDGEVRGRTSIKFNTKNPFWREDCEFTDLPPSLPYLSVVLKRIVGNTESFSHQLQATLGLPKTGQLSEALCGAVDIPLHLLERGKDHEQWLQVYDARQQSIGTMLLKVHHEEVVVLQSREYQPLSELLHRFGSGLTTQIADVMPGNLRKLAEIFVNIFQVSGKATEWLVTLVEEEIDAIGSQTASKQSRFNQRLMSNDSIASTDKMWQTVQDMSRTLPGEASLLFRGNSLLTQAFEIYMRRLGKEYLEETLAAKIREINELDLDCEVDPSRMQNGDDIQQHWAKLIELTSAVWRCIASSAHRLPSEIRHVLKYIRAVAEDRYGHFIRTATAVYTSVSGFLFLRFLCPAILNPKLFGLLRDHPKPRAQRTLTLIAKTIQALANLNISSKKETWMEPMTEFLQKQRQPFKDFADAVCAIPAESTSNSVPAPYSTPLTILGRLSPLAREGFPSLPYLVDHARNFAALAKLWAKVHPESDWDSSNCEGDLLHFHRLCTTLHQRAMHCFSQMETRRSAGETTSRPPDERLRLSDALD

SEQ ID NO: 3348 - protein, 472 aa, Neurospora crassa
  unsure (1)..(472): unsure at all Xaa locations
RTMASEAFQKIKVKNPVVELDGDEMTRIIWQDIKEKFIYPFLDIDLKYYDLGLEYRDQTNDQVTIDAAEAIKKYSVGVKCATITPDESRVEEFKLKRVSFVFHLGDFHAESEALHGAYXRIGXHGLCALVWLSPNGTIRNALGGTVFREPIVIPRVPRLVPGWKKPIIIGRHAFGDQYRAKDLVAPGPGKLQMVYTPEGGEPQVIDVFDYKNGGGVAQTQYNTDESIEGFAHASFKLALDKGLPLYMSTKNTILKKYDGRFKDIFQQIYDTQYKEAFEAKKIWYEHRLIDDMVAQMIKSSGGYIMALKSKSPNSRNNRLEKQTLTENPSPQTYDGDVQSDIVAQGFGSLGLMTSVLITPDGKTFESEAAHGTVTRHYREHQKGNQTSTNPIASIFAWTRGLVQRGKLDNTPELIAFAEALEKACIDTVDIDGIMTKDLALACGKTGREDWVTTSEYMAAVERRLKSTLKEKL

SEQ ID NO: 3349 - protein, 379 aa, Neurospora crassa
DWASKPTSASPLQVLYRRHYMIRQNWTSGKVKPSHVAFAAHPRHVITCLQFDEDKIITGSDDTLIHVYDTKTGKLRTKLEGHEGGVWALQYVGNTLVSGSTDRSVRVWDIQKGICTQTFYGHTSTVRCLQILMPTETGEVKNGEPVMMPEKPLIITGSRDSQLRVWRLPEPGSRRYIMNGPAANEENCPYFVRILSGHAHSVRSISAHGDTLVSGSYDSTVRVWRISTGQQLHVLSGHNQKVYSVVLDHKRNRCISGSMDSFVKIWDLDTGACLYTLEGHSLLVGLLDLRDEKLVSAAADSTLRIWDPENGKCKHTLMAHTGAITCFQHDGRKVISGSEKTVKMWDVQTGECMQDLLTDLSGVWQVKFDERRCVAAVQR

SEQ ID NO: 3350 - protein, 273 aa, Neurospora crassa
  unsure (1)..(273): unsure at all Xaa locations
SXTTIFSPEGRLYQVEYALEAISHAGTAIGILAKDGIVLAAERKVTSKLLEQDTSAEKLYILNEXAHPFLALHIQSLTLLLPSSNMICAVAGMTADANILINYARQAAQRYLLTYNEDIPCEQLVRRLCDLKQGYTQHGGLRPFGVSFIYAGWDPQRQFQLYLSNPSGNYGGWKATSAGANNASAQSLLKQDYKEDCTLKEACAMAVKVLSKTMDSTKLSPEKSESWRYCGHGXNHTNVSTTVEFATVGQTKDGKIYHRLWSADEITALLKEH

SEQ ID NO: 3351 - protein, 1036 aa, Neurospora crassa
  unsure (1)..(1036): unsure at all Xaa locations
NHQVIHRNTLPPRSHFFLYPDSEKALTRDVSLAKAQLLSGEWKFNLSKSPLVGPVGFQHFDSFTDPDWKPIHVPGMWQLQGFGKGPHYTNINYPFPVNTPRVPIDENECGRYVTYFQLAPEDKDHQLRLRFEGVDSAFTVWLNGKNVGYSQGSRNPSEFDITPYVNLKGDNILAVEVYQRCDGTYIEDQDQWWLSGIFRDVWIHKFPQKSHFKDVKILPTLDNEYKDAKLSVTVELSSPEEFTFRLLNISGGEVIQGTISGEQSTVMEFNIKDPLKWTAETPNLYTLVLSMSDCALTERVGFRRVELLDGVFSVNGNPIKLRGVNRHEHHPDFGRAVPYEWLKRDLLLMKQHNINAIRTSHYINDPRLYELADELGLWILDEADLECHGIFVVGGDGNKILSDNPEWKEAYLDRARQMVMRDYNRPSIIIWSLGNESGYGSNHRAMYEYIKSVDTSRPIHYEGDWNAHSADIFSRMYTSVDDMERYAREPSWDKPFVMCEFAHAMGNGPGALKEYIELFYKWPRLMGGFVWEWANHRMYLGGFSSSILCMXLTNDQGLTTKNKEGEEYMAYGGDFGDEPNDGNFVLDGLCFSNHTPTPGLLEYKKAIEPVQTLNLENGNQVRVVNRYDFVTLDHLKCLYYYSDDEPEWIEKREVKIPKGRXCHKSSPTSKPNPLTQSTGVKPHEQALITISDLLDAEALQAAGRHDCYLTLEFSLAEATNWAGTNHILATGQFPLTPPHNPFANFPAATNAHFNLLSPTLLSITVPGSNSTTYEFDLSIGALTSWKRPPSSANILTTPLALCLYRAQTDNDHGCDFGRNWTSSRLNMAKHHVLSTSWAPTASPPTITIKGRFAPPVLNWALETTTVYSFLEGGKVNVKMHGKPVGNWLPRAWARLGLEVGLKDVHSASWQGRGPGESYRDKKESQLVGSWTSTIDELWTEYEFPQEGGNRTDVRSVEFRTEGWDMVLGARFVEPNGENTSFQASRYTVMDVEAARHPFELHRKRREDTIVHLDWMHHGLGTGSCGPETRPEYTLWA

SEQ ID NO: 3352 - protein, 353 aa, Neurospora crassa
  unsure (1)..(353): unsure at all Xaa locations
LLPLLSLLSLSSSALAATRISPPSTACLRVGAGQPYSNIQSAVNALSTTASGSQCIFIYPGTYWEQVLIPARSAQLSIYGYTANSQGYASNTVTIIANKSQADGLSNDQTATVRVKSSNTRLYNLNIENAHGQGSQAVALSVAANGVGVYGCQLKGFQDTLLAEDGAQLYARTLIQGATDFIFGQRAPAWFEKCDIKVMAANLGYITGMFSFPPFHWSSTFNLVQXLTVIQALGRDSSSNPANYVFNSCSIAAAAGNNVPSGAYYLGRPWRQFARVTFQKTSMTNVINPAGWSIWQNGDARTSNVEFGEYANTGAGASGVRAWFGKLLGSPVKIESVLGSRYSRQGYYDASYM

SEQ ID NO: 3353 - protein, 451 aa, Neurospora crassa
TTTTTTVSAADLEFGQPVYETHPHILQPGELTPGITAQEYHERRSKLAFALPENGIAILASSELKYRSGAVFFPFRQDSNFLYLTGFSEPDSLAIIQKTGPKPGDYVFHLFCRPKDPRAEQWSGPWSGLQAAEDVFNADFTGDIAKVETLLPPILRGAGKVYTDITPSTPVTGQLVTTLLSHLHLPPAPLAGLVHSLRAIKSPAEISNMRHAGRVSGRALTSAMRRSWSSEKDLEAYLNYAFTSHGLSGPAYVPVIAGGSRGNMIHYVHNNRLLNQDDMVLVDAGGEYGTYITDITRTWPVNGKFSAPQRDLYEAVLTVQRKMVSLCRENATLSLDQIHRATEAGLREQLTLLGFDLSSGGGGRMDVLFPHHVGHYVGLDVHDTPGYSRSLTLRQGHAVTIEPGVYVPQDDDRFPEHFRGLAVRIEDSVVVDVESPLILTTEAVKEVVDIE

SEQ ID NO: 3354 - protein, 280 aa, Neurospora crassa
LLPACPNDKAVGKEIINIDFTKGADSFFKNMVGTTLQYDNKLGAVYTIKKETDAPTVASSRYIFFGQVDVTVRAAFGKGVVTSFVLQSDDLDEIDWEWIGSDTTQVQTNYFSKGCTETYDRGGFSTVANPQNEFHTYTIKWTPTQLDWIIDGAVVRTLKAADAKGCAGFPQTPMQIKLGTWVAGRKDAAQGTIEWAGGITDFNEGPFMGYYQSIKIQDFMGGDGTTGAKDATEYQYGDKSGTWQSIKVLTGTSTTEDVGTKSGSSTATTLSAVPSASSTS

SEQ ID NO: 3355 - protein, 562 aa, Neurospora crassa
GASPSLSRLLTLSTLAALAPLSEAQFPPYQAVGLKTVTSPSNPNIKISYKEPKDVCTTAFRRQKQYTGWVTVPGEYPTHLFFWFVGAREPTSALTMMLNGGPGSSSMFGLFAENGPCQVVEKGASRLETAAREWGWDRASNMLFVDQPNHVGFSYDTPTNGSLDLTTGMVSPTMQLPDNLPPSLFLNGTFSSNNIQNTANTTQNAAMAVYHLLQGFLSTFPEYVPDKHSPLGVNLFTESYGGHYGPVFADTWQKENDKLSKRAMPLSRRQDDANNIQSRPPKAGSSNREIKLTSLGIMNGCIDDLVQGSRYVEMAINNTYGIKLIDQATADAITSGFNAPDTGCKDLILACRQAQAALDPLDQGTDETVNQVCAYASLTCQQLLGSVLASGANAYDIAHMGPDAFPDYHYLEYLNSRRVQEAIGSVVNYTDISPVVYQAFFQTGDRARGGLIAKLASLLQRGVRIGLVYGDRDYICNWMGGEAVSLALADAMEDLDPKSPYPTKFPQAGYENIQTNNREVGGVVRQFGNLSFSRIYQSGHFVPAYQPETAFRVFERIIGGRS

SEQ ID NO: 3356 - protein, 513 aa, Neurospora crassa
  unsure (1)..(513): unsure at all Xaa locations
DLITATSQLQDQTVEHCLPFLAGEDGPLDLNDYGLPKLNREKHIKFLKQSLGPLPGRFVAVDASRPWYLYWCLSGLTMMGEDVSSYRDSVIETARTMQNESGGFGGGHGQTSHLATTYAVILAIALVGGEEAYDVIDKKAMWKWLCSLKQPDGGFQVCVGGEEDIRCVGPRPHFSXSNMLTDTTRITGKGGIYRGCDHYSARSASGLDARISCIXRSLKPVDWLSGICAXLXVLPXFYILVSKQKRLXRGSQTNMSPGQTFEGGISSQPNNEAHGAYAFCALACLAILDNLAVSFQGKQAXSRSGENMKQTSQISHHLSHKISIPTTITSTLHFICAXPPLSTFSSDIQTANKFSFPPTSYLDVPRLVSWLSYRQYAPEGGFSGRTNKLVDGCYSHWAGGCFPLIEACLSPSGPGAEKNKTATGLAAAPESLYSREGLIRYILCCCQDQTKRGGLRDKPYKXVFLPPFVMLCFALLRIEVSLYSAILPRFTFHYFTLLFTSPVLLYIISSSYL

SEQ ID NO: 3357 - protein, 556 aa, Neurospora crassa
  unsure (1)..(556): unsure at all Xaa locations
FVGSVDQGTTSSRFLIFNGEGDPVASHQIEFENLYPKSGWHEHDPMTLLNSVEECIEGAMRKFQRLGFSKNDIRSIGITNQRETTLVWDHETGEPLYNAVVWSDTRTKSLVRDLKDKDGADAIKDLCGLPLSTYPSSVKLLWLIENVEAVKQAYEEGRLAFGTVDTWLIYKLNGGAQAESPVHVTDSTNASRTMFMNIRTLQYDDKMLGFFGIDRTKVHLPKIVPSSDPECFGRIASGALSGVPIAGCLGDQSSALVGQCGFNPGQAKNTYGTGCFLLYNVGTEPVISQYGLLSTVAYDFGQGRAPVYALEGSIAVAGAGVTFLQNNLNFIENAKQINDLAESVPDNGGVVFVTAFSGLFAPYWIDDAKGTLCKXSPLPTLSTRLLPTHLGASSNRYIHPTPFHMKDRKLTCHVPNSGITQHTQKGHIARATLEATCFQTKAILDAMEKDSGCKLKLLAVDGGLSNSDLTMQTQADISGIPVDRPAMCETTALGAAIAAGLATGVWSDTTELQEVNRTGRKVFEPKISRKCAEKRFKKWNQAVQMSRGWLQDNDNE

SEQ ID NO: 3358 - protein, 366 aa, Neurospora crassa
  unsure (1)..(366): unsure at all Xaa locations
YRQLGKSGLRVSVPIFGCMSFGDRRTLDWAIEEDEALPLLKAAYDRGLNTWDTANVYSNGTSEIIVGKALKKYAIPREKVVILTKCWGAVGETPDLRSFFFPSQIAASKDYVNQHGLSRAAILNAVEASLRRLDTPYIDLLQIHRFDPNTPIEETMKALHDLVQSGRVRYIGASSMWATQFAQMQFCAEKNGWTKFISMQNQYNLLYREEEREMIRFCNDTGVGLIPWAPLCRGHLARRPDQFGRTKRSQGEKEAQPGSHGTVEPDLTIINRVVEIADKHEWPVSFIAKRNPSISVGIFXRGLPCXPYLXISHVALAWIAKRVISPIIGFSSVERLEEAITARGKVLTVEEEKYLEEMYKPKAIHG

SEQ ID NO: 3359 - protein, 742 aa, Neurospora crassa
  unsure (1)..(742): unsure at all Xaa locations
SYHNAVIVRNASFIRLLPKLALKFARIPALFGTMMIGGVAWIQYQAIRKRPTARVCWXLGTPLTKTQRXAIRPKKSSATSEIPSPQTASGLWGSAVDIAEQTKRGWDNTKEEFELPEWLGNLFKSEGGPEGGNNNGSGPGRPEPPKKARMGAAVGASAAAYGYDDAAEEDDRTPEEISKDDQMMYMTKMMIEIRNLLQKVGQSSTVSLPSIVVIGSQSSGKSSVLEAIVGHEFLPKGNNMITRRPIELTLVNDPKVSADYGEFPDLGLHRITDFSLIQKNLTELNQSVPERECVSDDPIRLTIHSPRVPDLSLIDLPGYIQVAGENQPRELKRKISELCDKYIRGPNIILAISAADVDLANSTALQASRRVDPRGERTIGVITKMDLVDPEKGAAILSDKQYPLRLGYVGVISRAPQQTGLFKRDTGALLRQISKNEKSYFSTHPEFGPDSGVNIGTVTLRKKLMHVLEQQMSSKLQDTTAAIQRELEETSYQFKVQYNEEPMTAEAYLAASLDDFKHAFKRFASSFGRPQMQQLLKEALDQRVLDQLAAKYWNKPIEDLSPAPFEPENIADLPKADPDSQFWHMQLDTATSALTRLGVGRLAATVVANAIQANVDKLVNKSTFAKHPSARQVINEAAATVLADRSYTTSDGIEFSLKPYKYEVDIQPQEWSQGRDHVAGVLKMELDQCQRAMGNLENSVGGKRKLKEVMNFVDKARKGEIVVEGETRNGAGGFSAALLQKG

SEQ ID NO: 3360 - protein, 653 aa, Neurospora crassa
  unsure (1)..(653): unsure at all Xaa locations
MADRYIPEHRRTQFKAKSAFKPDELRRRREEQQVEIRKAKREENLAKRRGIGAGDSRPGASLGAAPDSDDENPPTESQVCKPLSYSPYMIGHNFATASVHRLSLLSPTCTPPMMVMLEPQTPRQCRTCIQAARANSNIVQTKTTPHSVTSPIFVIVDLHMLTQLSXLSEDLPKMVEGVFSSEIDKQIQATTKFRKLLSKERNPPIEEVIKTGVVGRFVEFLRSPHTLVQFEAAWALTNIASGSATQTQVVIEAGAVPIFVELLGSPEPDVREQAVWALGNIAGDSPQCRDYVLSCGALRPLLTLLGDSRKLSMLRNATWTLSNFCRGKTPQPDWNTVSSLDHEQSSMSTDPSXIAPALPVLAKLVYSLDDEVLIDACWAISYLSDGSNDKIQAVIEAGIPRRLVELLMHASTSVQTPALRSVGNIVTGDDVQTQVIINCGALPCLLSLLSSNKDGIRKEACWTISNITAGNSAQIQSVIDANIIPPLIHLLSHADLKTRKEACWAISNATSGGLQKPDQIRYLVAQGCIKPLCDLLACPDNKIIQVALDGLENILKVGELDKNAAGDGPDSINRYALFIEECGGMEKIHDCQTNANEEIYMKAYNIIEKYFSDEDEAGDEAMGAQQQFGFGASGGAQQGGFNFGANGTESMDM

SEQ ID NO: 3361 - protein, 447 aa, Neurospora crassa
  unsure (1)..(447): unsure at all Xaa locations
SPTMADGGIDRKADEKIQFSTSKEVTVHPTFESMSLKGKSCRIACISWLLWLSELDXNXLVLKTESLLRGIYAYGYESPSAVQSRAIVQICKGRDTIAQAQSGTGKTATFSISMLQVIDTAVRETQALVLSPTRELATQIQSVVMALGDYMNVQCHACIGGTNVGEDIRKLDYGQHIVSGTPGRVADMIRRRHLRTRHIKMLVLDEADELLNQGFREQIYDVYRYLPPATQVVVVSATLPYDVLDMTTKFMTDPVRILVKRDELTLEGLKQYFIAVEKEDWKFDTLCDLYDTLTITQAVIFCNTRRKVDWLTDKMREANFTVSSMHGDMPQKERDSIMQDFRQGNSRVLISTDVWARGIDVQQVSLVINYDLPSNRENYIHRIGRSGRFGRKGVAINFVTSEDVRILRDIECKFWAIXPRRLRLLTGDTVYYSTQIDEMPMNVADLI

SEQ ID NO: 3362 - protein, 254 aa, Neurospora crassa
MMSGPETTRAVRWALGAGYRGFDSAQWYYNEREAGQAILSFLSSPENTAGLTRKDVHFTSKLRDNSTNYDAVRASISKSVKASGLGYIDLFLLHSPLGGREARLTSWKAVEDAVLAGEVKMAGVSNYGVKHLDEVMSAPFKIKPLVNQIECHPFNTQPEIRAACEKYGIVIEAYAPLARGMRMKHPVLTAVAKKYGVTPAQVLVRWSVQHGFVTLPKSTKKERLVENADVGRFELAEEDMEKLDGLDEKLVTDW

SEQ ID NO: 3363 - protein, 497 aa, Neurospora crassa
  unsure (1)..(497): unsure at all Xaa locations
MQAIARQTRPAGKLVQQLSKRAYSSNSSPYAATINNLKINGDTKVLFQGFTGKQGTXVRATSPARNSPFPVFPIAPCLSXLATPMTRLGRIWGMLHLHQLPMITSFPRPGHHWMXLMLRIXLGXRWLIVQFHAQQAIEYGKPPPSTTHHCHHSPRLSPAYRYRSWVANCRKHGILTHFALCSRHNVVGGTNPKKAGQTHLDRPVFSNVSEAVKETGATATAIFVPXALSEIPAFGGLTNSNIENSPPLAAAGIEEALQAEIPLAVCITEGIPQHGQYNGSQGRRASGXKRILETSDLTGRCRHVRITSMLKTQSKTRLVGPNCPGIIAPGQCKIGIMPGFIHKRGRIGIVSRSGTLTYEAVNQTTQAGLGQSLVVGIGGDPFSGTNFIDCLKVFLEDGDTDGIIMIGEIGGSAEEEAADFLKEYNTKNGGKPVVSFIAGISAPPGRRMGHAGAIVAGGKGGADSKIKALEAAGVVVERSPASLGKALRDEFVRRDLL

SEQ ID NO: 3364 - protein, 314 aa, Neurospora crassa
  unsure (1)..(314): unsure at all Xaa locations
MATTRERRVAKELQDIWNDRETSGVMAEPLDSSNLSHLKGSFSGPPDSPYAGGTYEVDIQIPDKYPFKPPSMYLITKIWHPNVSSVTVRFSRFCPLVLXWMLGSRWSLESSTNPPTSLQGAICLDILGTAWSPVGTIKTALLAVRMLLESPNPKDPQDAQVAKMLMENPKLFARTAHDWAVKYAGAPRVDKIPLKYDETAKEGSRNDASRYVAFLTIPMQXTTLCXAKAIWTMHYWKPGIKVRGDXPXEPAWRTQHRYAGYNKDLVDRFVNMGFDVEKVVDAFKFVGIDRNGGADYELEEAYMGDITARLLGEQ

SEQ ID NO: 3365 - protein, 468 aa, Neurospora crassa
  unsure (1)..(468): unsure at all Xaa locations
GHRXPPSPPKQKDKPKYEPPPKPTTRIGRKKKRQGGASAAAKLPSVYPTSRCKLRLLRMQRIHDHLLLEEEYVENQERLRKAKTAKDSNAPASELESSDRMADERSRVDDMRGSPMGVGVLEELIDDDHAIVSSTSGPEYYVSIMSFVDKDLLEPGASVLLHHKSVSIVGVLTDDTDPAVSVMKLDKAPTESYADIGGLEQQIQEVRESVELPLLHPELYEEMGIKPPKGVILYGAPGTGKTLLAKAVANQTSATFLRIVGSELIQKYLGDGPRLVRQLFQVCKSVSSYTVKYILXHVPQVAAENAPSIVFIDEIDAIGTKRYDSTSGGEREIQRTMLELLNQLDGFDDRGDVKVIMATNKIESLDPALIRPGRIDRKILFENPDQNTKRKIFTLHTSKMSLNEDVDLEEFIAQKDDLSGADIKAICSEAGLMALRERRMRVQMADFRAARERVLRTKQEGEPEGLYL

SEQ ID NO: 3366 - protein, 604 aa, Neurospora crassa
  unsure (1)..(604): unsure at all Xaa locations
PVVVAEDMIGVAMYELVWFYNCPWPLVGCLSXDWNXVKVGHDQLVGEVIRINGDQATIQVYEETGKADNLKSLHPCTRWLTNPSIAGVMVGDPVLRTGKPLSVELGPGLLNNIYDGIQRPLEKIAEASNSIYIPRGIATPALDRKKKWEFTPTMKVGDHIAGGDVWGTVYENSFISVHKILLPPRARGTITRIAEKGEYTVEEKILEVEFDGKKTEYPMMQTWPVRVPRPAAEKHSANQPFLVGQRVLDALFPSVQGGTVAIPGAFGCGKTVISQSVSKFSNSDVIVYVGCGERGNEMAEVLKDFPELSIEVDGRKEPIMKRTTLIANTSNMPVAAREASIYTGITVAEYFRDQGMNVAMMADSSSRWAEALREISGRLGEMPADQGFPAYLGAKLASFYERAGKVQALGSPPREGSVSIVGAVSPPGGDFSDPVTSATLGIVQVFWGLDKKLAQRKHFPSINTSVSYSKYLTILDKWYEREYPDFPRLRDRIRQLLSDSEELDQVVQLVGKSALSDPDKITLDMATLIKEDFLQQNGYSDYDQFCPIWKTEWMMKLMMGFHDEAQKAIAQGQNWNKVREATQDLQAQLKSLKFEVPSEGQEKI

SEQ ID NO: 3367 - protein, 1097 aa, Neurospora crassa
PAPSAGASGSTFGNFQDPTQGHARENSTGGRGGRGGSGGGHQRRHSLALADAKKAAEIAQQKRTTSTFQFPAAPAPGSSEKSEDDAKTTPSTTPAPAEGQIAQGSSFRGGRGGHGRSQSMAVGANGRGGRGGHFSTDSVGQGSDFSRRAPGSGHARTGSRNFDGNWRNQNQNQNQNQAQDQTAALPQSQGFQPGHRSRGSVSQSISSIGSFQYPGQPQLVQFPGQMMMPQVFPGQQLNPMQLNQLQALQLAQMNGQPLTGLAASQHAPQMAAPGQQSQQQQRKTLFTPYLPQATLPALLGNGQLVSGILRVNKKNRSDAYVSTQDGLLPADIFICGSKDRNRALEGDLVAVELLDVGEVWAQKREKEEKKKRKDITDTRSGSISGGQNTGDDNGNAEGGLRRRGSLRQRPTQKKNDDVEVEGQSLLLVEEEEINDEQQPLFAGHIVAVIERVPGQMFSGTLGLLRPSSQATKEKQEAERAARDGGNGRQQDSRSHEKPKIVWFKPTDKRVPLIAIPTEQAPKDFVEKHQDYADQIFVACIKRWPITSLHPFGTLVEKLGKMGDLKVETDALLRDNNFASDEFAEAVLRNVSQQDWSLESEDQAALAARRDFRGENVFTVELDSSVELGNGVHFKQLPDGKIEIGIHVPDVAHFVKPGSLVDREAKKRGTAVHLVNRFCALLPPKLSSELCTLTPEQDRLTFSVVFHVNPQTGAVAEGDTWIGKGIVKSGGKVSLSEIDEAISGSSGFSHPSVKALDIQILNAVAQKFREARLGAGGEPIAPLRLLQQLDDENIPPKHNIFESSQATELVEELMHKANTHVAQRLAQGLPEKALLRRQSAPNSRRLQTIIDRMTALGYDIDATSSGTLQNSLFKIDDSDIRKGMETLLVKSMQRAKYFIAGKTASLLWPHYALNLPLYTHFTYPTRRYADIIVHRQLEAVLSDGKIEYTEDLENLVKTVESCNTKKDSAQNAQEQSVHIESCRTMDKKRQEVNGDLISEGIVICVYESAFDVLIPEWGFEKRVHCDQLPLKKAEFRKEKRVLELYWEKGVPSSAYVPEDERPKAAASQRISNALAAARQAEEAERAKKDREEAARKQI

SEQ ID NO: 3368 - protein, 496 aa, Neurospora crassa
  unsure (1)..(496): unsure at all Xaa locations
MSNLPSEPEFEQAYKGTSERKTNCLAADIELTXFFTTELAYTLENSSLFQKHPEYRTALTVASIPERVIQFRVVWEDDNGNVQVNRGYRVQFNSALGPYKGGLRLHPSVNLSILKFLGFEQIFKNALTGVSDRTDIQNQNIRFADSASLVSMGGGKGGADFDPKGKSDAEIRRFCCAFMAELHKHIGADTDVPAGDIGVGGREIGYMFGAYRKAANRFEGVLTGKGLSWGGSLIRPEATGYGLVYYVGHMLEYSGAGSYAGKRVALSGSGNVAQYAALKLIELGATVVSLSDSKGALVATGESGITVEDINAVMAIKEARQSLTSFQHAGHLKWIEGARPWLHVGKVDIALPCATQNEVSKEEAEGLLAAGCKFVAEGSNMGCTLEAIEVFENNRKEKKGEAVWYAPGKAANCGGVAVSGLEMAQNSQRLNWTQAEVDEKLKDIMKNAFFNGLNTAKTYVEAAEGELPSLVAGSNIAGFVKVAQAMHDQGDWWSKN

SEQ ID NO: 3369 - protein, 1096 aa, Neurospora crassa
  unsure (1)..(1096): unsure at all Xaa locations
DVLPSSRFRTFKNDGKGRIPSTQPKSAFESEVLERMSQDISDLKQNNSEKDQAWERPPLPATYNPATDSLCFQSIEAEEGFLHGGQATIKLFGVTENGNSVLLHVKDFKHYLYVQAPVSFGPDDCPKYRAFLETQLAMPTPAIHSVTLTMRENMYGFQGNTQNPYIKVTVNDPKFLPRVRRLIETNKANWKGMWKSDGSIMTFDDIQYLLRFMVDCSVMSPLHTTPKIPXANKRQIAGMSWVEAPAGSYQLVNDKHSNCQIEAEMSYRDLIAHKPVGEWSKMAPLRILSFDIECAGRKGIFPEPQHDSVIQIANIVTKYGEKKPFVRNVFCLDTTSPIVATQILSFDREEDMLREWRNFLEQVDPDIIIGYNIANFDFPYLLDRAKHLKVKDFDFWSRTRVRSVAKETNFSSKQMGNRDTKATNTNGRLQLDMLQLVQRDYQLRSYTLNSVCSHFLGEQKEDVHHSMITELFEGTPESRRRLALYCLKDAYLPQRLMDKLSCLENYTEMARVTGVPFNFLLARGQQVKFLSQLFRKALEQKLVIPNLRPESSEEQYEGATVIEPTRGYYDVPIATLDFASLYPSIMQAHNLCYTTLIKKRDIERWDLKKDEDYIVTPNGDMFVTTKQRKGLLAQILEELLSARKQAKRELAVEKDPFKKAVLNGRQLALKVSANSVYGLTGATNGKLPCLEIASSVTSFGRQMIERTKKEVEERYTIANGYSHDAQVIYGDTDSVMVKFGTKDLAEAMKLGQDASEYVSGKFIKPIKLEFEKVYFPYLLINKKRYAGLYWTKPEKYDKMDTKGIETVRRDNCLLVQTVIEKVLRMILIDQDVPGAQAXEFAKFIPFAIANIALTYYPQIVKDTIADLLQNKIDMSKLVITKALTKENYDAKQAHVELAQRMKKRDAGSAPGLGDRVAYVMVKGATGSKNFERSEDPIYVLEHNVPIDTKYYLDNQLAKPLGRIFEPILGETKAKSLLHGDHTRVVSVAAPTVGGLMKFAKKTQTCMGCKKPLTGKEESQGAVCADDAPRVGELYKKTLDRVSDLEVRFGRLWTQCQRCQGSMHCEVICSSKDCPIFYMRMKAKKDLEDANKELQRF

SEQ ID NO: 3370 - protein, 214 aa, Neurospora crassa
PSLLWRKQDDSATLNILKWRFGLMVINPDSAFNGGYFRAEMVFSDEYPYQPPKFRFLIPITHPNVYPDGQLCISILHTPGEDLMSGEQASERWSPLQGAESVLRSVLLLLDDPEINSPANVDAGVMYRDRREDYNKKARETVERSKKDIPPGFEMPVSFEEKPPPKAENDDDFWAESDEEFDFGGSDTGDDDEMEDFEDGEEGSEDDDDDSNSK

SEQ ID NO: 3371 - protein, 354 aa, Neurospora crassa
  unsure (1)..(354): unsure at all Xaa locations
KLARLRAQLLEPGPGSGGGPGAGFDVSKSGDARIALVGFPSVGKSTFLSKVTKTKSEVASYAFTTLTAIPGVLEYGGAEIQLLDLPGIIEGASEGKGRGRQVISAAKTSDLILMVLDATKRAEQRALLEAELEAVGIRLNREPPYAPFSLPMLLFYRRXRYNPPLPRNIYLKPKKAGGMKITFQTPPKNGLDEKMVMNILRDYKILNCEVLVRDENVTVDDFIDVIMKDHRKYIKCLYVYNKIDSVSLDFLDKLAREPYTCVMSCELDLGIQDVIDRCWKELKLIRIYTKRKGTDPDFSEALIVRSNSTIEDVCDRIHRTLKETFKYALVWGASARHIPQRVGLGHPVADEDVV

SEQ ID NO: 3372 - protein, 375 aa, Neurospora crassa
YEAQIGVGDARWEAHPQILEDLKAKAKSLGLWNMFLPKGHYKESPGFTNLEYGLMAEWLGKSRVASEAVNCSAPDTGNMEVLAKYGNEEQKAKWLKPLMDGKIRSAFLMTEPQVASSDARNIEMKITKDGDHYVLNGQKWWSSGAGDPRCKVYIVMGKSDPNNKDPYRQQSVIIVPSDTKGITIERMLSVYGYDDAPHGHGHITFYNVRVPAANLVLGEGRGFEIIQGRLGPGRIHHAMRTIGAAERALEWMLMRINDPKKTPFGKQLREHGVILEWVAKSRIDIDAARLVVLNAAIKMDEQGPKAALTEIAQAKVLVPQTALTVIDRAVQSFGGAGVSQDTPLANMWAQIRTLRLADGPDEVHLQQMGRNENKR

SEQ ID NO: 3373 - protein, 376 aa, Neurospora crassa
  unsure (1)..(376): unsure at all Xaa locations
MAKTTTLKEFESVFPKLEEALLEYAKAYKLPEQMLSWYKQVRADQPTYLSGRVAFSELXYXLFCLFSSQSLEVNTLGGKCNRGMSVPDSASILLGRPLTEEEYFQAATLGWMTELLQAFFLVSDDIMDSSITRRGKPCWYRQEGVGMVAINDAFMLESAIYTLLKKYFRSHPRYVDFLELFHEVTFQTEMGQLCDLLTAPEDKVDLDNFSMDKYTFIVIYKTAYYSFYLPVALAMYMLDIATPENLKQAEDILIPLGEYFQVQDDYLDNFGLPEHIGKIGTDIQDNKCSWLVNKALSIVTPEQRKTLEENYGRKDKAKEAVIKQLYDDLKLEDHYKQYEEERVGEIRKMIDAIDESKGLKKQVFEAFLGKIYKRSK

SEQ ID NO: 3374 - protein, 617 aa, Neurospora crassa
  unsure (1)..(617): unsure at all Xaa locations
NPDPVEAELEAKELSKYLLAKSFFDCKEFDRCASVFLPDSLLSGLLSTKATDATTPKGKAKASSAPPYEQALPSLSQKSLFLALYAKVISGEKKKNEESEMIMGPQDLGTIKNSHLVVVSRFLERWFAERKAEDSDLPPSQGFLEYLYVCPGVYRSVYAFGXCXNRYGMVMVKEKNEDAALDYLLNSVHLFPWNWGAWLELTNLISGVEQLNKITPVLPQNIMSFIFYANTAVNLYQQGQDLAASVNDLLKLFPTSSFILTCRALLNYHSKDLYTAEQNFSNLLALHPHRLDSLDHYSNILYVLNMRPKLAFLAHLCSSIDKFRPESCVVIGNYYSLLSLHEKAVQYFRRALTLDRSCLSAWTLMGHEYVELKNTHAAIESYRRAVDVNRRDYRAWYGLGQTYEVLEMNSYALYYYKKAAGLRPWDGKMWQAVGSCLQKMGKDRDGIKALKRALLADSYYDSTLSSFGSAGPADRMAQMDPEVLLQIASMYDRLGEVEEARAYMELCVAQEDGGATDNADASAVCTSNPGESFVVHGDSPGSDGDAEGGYEGRGGAGQGEGTGVTVATSKARMWLARYAMRTEDYVTANRLATELCQDGVEVEEAKALIREVRSRME

SEQ ID NO: 3375 - protein, 697 aa, Neurospora crassa
  unsure (1)..(697): unsure at all Xaa locations
RDQLRENALLKKYYCDVNIGDLIKFNEEIAHRLVTEPAEIIPLFEAALKRCTHRIVFPNEPKIDLPDHQLLLHSNAEDVSIRNLDSLTISRLVRVPGIVIGASVMSSKATELHVQCRNCGHVQHVHVSGGFSGATLPRTCGRIRAPGDPGEKCPMDPYFVQHEKSRFVDQQIIKLQEAPDQVPVGELPRHVLISADRYLTNRVVPGSRCTVMGIFSIYQSGGNKKSTSGAVAIRTPYLRAVGIQTDIDQTAKGLAVFSEEEEQEFLELSRRPDLYNVMAECIAPSIYGNKDIKKAILCLLMGGSKKILPDGMRLRGDINVLMLGDPGTAKSQLLKFVEKVAPIAIYTSGKGSSAAGLTASVQRDASTREFYLEGGAMVLADGGVVCIDEFDKMRDEDRVAIHEAMEQQTISIAKAGITTILNARTSVLAAANPIFGRYDDMKTPGENIDFQTTILSRFDMIFIVKDEHERGRDERIAKHVMGIHMGGRGVEERIEAEIPVEKMRRYISYCRSXVVYAPIYHLRHHKNXHCRSSSRCAPRLSPEAAEKLSSHFVAIRKQVHASELEANARSSIPITVRQLEAIVRITESLAKLTLSPVATEKHVDEAIRLFLCSTMDAVNQGGSTGSNRELNEETSRVEAELKRRLPIGWSTSLATLRREMVEGKGFSEVALNRALMMLQRRDTIMFRNQGAQVYRNG

SEQ ID NO: 3376 - protein, 407 aa, Neurospora crassa
  unsure (1)..(407): unsure at all Xaa locations
MSSTGFTSPFGNANPFGSSGRSESGPMHRLVEEDENDTITSPTTPHFGVKNNAAPAFWNGFGGDAPSDMPVRRQPDDFPAHYNLGRRTSVSAESLKPVTDNSDNWSPPVHPKTAEQLERLKKAISGNFLFNHLEDDQSAQVLGALVEKPVPAKGIKVSTXSHCNSLFXETRFFXRFLAGITQGDAGDYFYVVEKGRFEVYVNSTGALQPGPDGMGQKVGEIAEGGSFGELALMYNAPRAATVVSAEPQCTLWALDRVTFRRILMESTFSRRRMYESFLEEVPILKTLTPYERSKIADALESQKYPAGHEIILEGDPGHSFFLLEAGEAAAFKRGNDSPVKNYKKGDFFGELALLNDAPRAASVISQTEVKVARLGKNAFQRLLGPIESILRRTRYVEAEEVDPLQVS

SEQ ID NO: 3377 - protein, 1124 aa, Neurospora crassa
  unsure (1)..(1124): unsure at all Xaa locations
MADIKIDSKVFQERVSHFYNAWKADKRSGDALFGGVSSIVILMGKVDENPEFHKNNAIHVSFALWRARSACAGCTSGGPFQSNDSCXXLYVKFWLLGYEFPTTLMLFTLDTIYILTTQKKGSPGIPDPRTRTNYLTRLIAKYLDQVKGGRYPVEVLVRGKDAAENEKLFIKITDAIKAAGRKLHPILGAHQHLGAVLTHFRSLXKKVGVLTKDTSKGPFIDEWKKVYADNCKDVEEVDVAQALSAGAFSVKDETELRAMRTSSKACVALLTPYFLDEMSNILDQDKKIKHSALADKVFNKLEDDKFWKTVELPNRQKLPADLDPEQLDWILGPIVQSGGKFDLKWQADSDNDILHPGIIIAAMGLRYKSYCSQIARTFMVDPNKSQESNYKFLLAVHNLILKEIRDGAIVKDVYTKAYNFVRSKKPDLEKHFLKNVGFGIGLENKDPTLILNNKNTRTLKDGMTLVVTTGFSDIQNPNPQDKNSKVYSLILSDTIRVTSSEPVVFTGEAPVDVDATSFFFKDEEEAQPTPKKEKRDSRVGAVATKNITSTRLRSERNTTVDEDADKRRREHQKELAQKKQKEGLAKYAESTADENGVEIKKFKRFESYKRDNQFPPKVKDMGIVIDQKNATIVLPVMGRPVPFHINTIKNASKSDEGEWSFLRINFLSPGQGVGRKDEQPFEDASAHFVRSLTFKSTDGDRYADIANQISNLKRDAVKKEQEKKDMEDVVEQDKLVEIRSKSLPGSIVLQHTNXLSDRRPAVLDNVFIRPAMEGKRVPGKVEIHQNGIRYQSPLSTTQRVDILFSNVRHLFFQPCQHELIVIIHIHLKDPIIIGNKKKTKDVQFYREATDIQFDETGNRKRKYRYGDEDEFEAEQEERRRRAELDRLFKSFAEKIAEAGRNEGIEVDMPLRDLGFNGVPFRSNVYIQPTTECLIQITEPPFMVITLEDIEVAHLERVQFGLKNFDLVFVFKDFTRPPYHINTIPVESLEDVKEFLDSSDIAFSEGPLNLNWGVIMKTVTANTHQFFLDGGWGFLQNDSDDDEVEEEEEESAFEIDESELEDASESSEEDSEYDSNASEEASDEAEDSEEEEGEDWDELERKAKKRDRESGFDDEEERAAPKKRR

SEQ ID NO: 3378 - protein, 487 aa, Neurospora crassa
  unsure (1)..(487): unsure at all Xaa locations
KPDEAPAAAPEAAPVSAPASEEPKAPENETSIEESQSNLVKNEYEVEIKLSDLQNDTESPLYSVSSFDELGLPEAVNRGLLAINFKKPSKVQEKCLPLMLSDPPRNMIAQSQSGTGKTAAFVLTVLSRIDLSKPHQPQALLLAPSRELARQIQTVVQTIGQFCENLIVEAAIPGAISRETGVRGSVVVGTPGTVMDLVKRRQFDISQLKVLVIDEADNMLDQQGLGDQCVRVQEVSSSLGTSVMRPLLTLSSMLPKTIQILLFSATFPDKVLRFAERFAPNANQMKLKHKELTVKGISQMFMDCPTEKDKYDILCKLYGLMTIGSSVIFVRVCFFPSNTVVDICXRAFFQTRETANEIQKRMEADGHKVSALHGAYEGQSRDVLLDEFRSGRSKVLITTNVLARGIDVSSVSMVINYDIPMKGPGEREPDAETYLHRIGRTGRFGRVGVSISFVHDRRSFEALSQIAQFYGIDLIQLNPNDLDDTER

SEQ ID NO: 3379 - protein, 684 aa, Neurospora crassa
  unsure (1)..(684): unsure at all Xaa locations
QQLLEIWNKAKGKERDAMLWGDEVRFWFSCLELLIPWLLTPRLIEYLVVNYSKDEPKVLLSLRQADILKALADSKTLKVTGDCAPGTEANADAGNVTLPVFHPEFGRFMLEATPGKPWGIDFKDLLTVEADMKLRRCIAKDHMLSNEHPITLTTFPRIGSPGVFTEPSYPVSGPKLRSQFVPDEIANPHIRFPTLAANIRSRRGRKVQVNVPVFRDENTPWPWKDPTVNYDLHNWPEDDDVRNGAAPDNFIHMDAMAFGMGSCCLQITFQAKNITEGRKMYDQLSPLGPILLALTAATPVYKGFIADTDVRWNQISRAVDDRTPEELGEKVGTTLYXRSDSMLTFLXPLKNDRWRIPKSRYASNSTYISTDSRLRPEYMDPNLVIDPEIKQQLLDGGMDDRLATHFAHLFIRDPIVIFNEDLQELDLTKTDHFENIQSTNWQHMRFKPPPADNSIGWRVEFRPMEIQITDFENAAFSVFIVLITRAILSFDLNFYIPIVKVDENMETAHARNANLEKKFWFRKNPFPVRTTRRGGSASRSASGTSTPNSGSSRPATPPLGPVEDEYRLMSVNEVINGTAYAKATSKEVTEDAEEGEEFPGLIPLVESYLDSVNMDVATRCGLARYLDLIRKRASGELWTAAKWIREFIAKHPGYKKDSVVSEEITKDLVGAVIEIGEREKRGLG

SEQ ID NO: 3380 - protein, 1377 aa, Neurospora crassa
  unsure (1)..(1377): unsure at all Xaa locations
KAAGPSEGDFIVFSNSDKEPKGKRGGAKAGPSKPAEELDAGPPKPTVKQLIGGHSWTGKLPVNLLSEHCQKQKWERPDYNTIKTKDGFSVFVTLSAKNPKTQEVTTLPPFKLPPSHVHLAYKPTALEAKHFAATYALYRVCSMKNMHMTLPPDYRSLWKEFEALKKQDVKEGKAWMYEADPFQAQREREEAKAAAEKKRAQLQAAKEKAANEPGVSLAFRGSGSGGAGGGGAHNVMRGWANVPKIEMGNKTRSQLEDLLRRETVWNPNGVVMSASQKAAIVKEFKDLGFRQSHIEEAVEECKDREEALEWLLVHIPEDDLPRWALPEKYSAGVTVAATDLKREGAITRLAQSGYSIDLCRKLLALHNGDEAKAAEDLQKLLLASGSESIDDSSQDADGLDTWRDADECWEEEMATLEACFGEKFSKISPEICEIKLEGVKNGSQTNVDACVQFRKSEQYPTQVILAMVAALPSYIKLSVIKQALAYALTLEGEEMKIFYVASWVQENINDIIEKPGRIREVAAVASAASEEPKKAVKRARRAPRCPKPINWSPDPRSTEEWRARTESPSYKKMLYARQNLPAWQVQDYLIQTVSENQVTIISGETGSGKSTQSVQFILDDLYSKGLGKSANIIVTQPRRISALGLADRVSDERCSQVGQEVGYSIRGESKTSPNTRITFVTTGVLLRRLQTSGGRVEDVVASLADVSHVVVDEVHERSLDTDFLLAIIRDVLYKRRDLKLILMSATLDAASFKDYFTVDGKNVSVGLVEISGRTYPVQDYYLDDVIHMTGFSIGNNREYYYDDNAGSKSKEDPNDDPINKIIQRMGSRINYDLLVETVCAIDSELAETQKAGGILIFLPGVAEINRACNALRAVPSLHVLPLHASLETKEQKRVFASAPPGKRKVVIATNVAETSITIDDIVAVIDSGRVKETSFDPQNNMRKLEETWASRAACKQRRGRAGRVQAGKCYKLFTRNLEMQMAERPDPEIRRVPLEQLCLAVRAMGIKDVSHFLSRAPTPPEATAVEASITMLRRMGALDGEELTALGQQLAMIPADLRCGKLMVYGSIFGCLDDCVTIAAILSTKSPFVSPQEKREEAKEARKRFSQGDGDLLTDLRAFQEWNDQMQERMGQSRVRAWCGDNFLNYQTLSDIASTRSQYYSALKEMGIIPHNYSESNNSQQTKSMALLRALTASAFSPQIARIQFPDKKFAASMTGAVELDPEAKTIKFFSQENGRVFIHPSSTLFDSQGFTGNASFMSYFTKIATSKIFIRDLTRKFVLVPVSFSLXYGILTPSLAFNAYTLLLFSGAIDLDTQGRGLVVDGWLRLRGWARIGVLVSRLRGLIDKLITMKVENPSLDVEKNDIIKTVVKLVELDGL

SEQ ID NO: 3381 - protein, 628 aa, Neurospora crassa
  unsure (1)..(628): unsure at all Xaa locations
MISAYPSTYASDRSVVFLHTSRNKTSFTTSSVAMKPFLGLRGQPLNLAVGAVAGCDFLLFGYGMXXDIDESNMAKRTFFXSSMTTDQGVMGGILTLPEFLGYFEQINPDAPGLTPHESSMRSTYQGISVASYNLGCFIGAIITIFIGNPWGRKKIILLGTSIMIVGAILQASATTLGHFIIGRIITGIGNGGNTSTVRYNSTFRXIFRSSSNQSQVPTWQSETSKAHKRGKMVMIEGSLVTAGIMLSYWIDLGLSFAPGSVAWRFPLAFQIIFCILILIFIPFLPESPRWLVFKGRDAEAKEILAALNDVELDDPIVDTEFHFIHDTVVEMSKGSFKDLFTMDKDRNFHRTLLAYLNQVFQQISGINLITYYAAVIYSGLGMSDFLARLLAALNGTEYFIASWPAVFLVERVGRRKLMLFGAIGQAATMAILAGVNSRPDDKPYQIAGIVFLFVFNTVFAVGWLGMSWLYPAEIVPLRIRAPANALSTSANWIFNFMVVMITPVAFNKIKYQTYIIFAVINAFIVPVVYFFYPETACRSLEEMDMIFHKVDGWKGYFTVVHQAKVEPKWYDKDGQRIGGADFEKTAGYQSHSIPESSGFEKPTKAHVESPRADDGITSSSSDGGNRES

SEQ ID NO: 3382 - protein, 791 aa, Neurospora crassa
  unsure (1)..(791): unsure at all Xaa locations
MMARKQATEAPAVSNGSPKKRSSADSDNHNVKRPRLQESTDKARWRLSSEGGRHTWHYLEDDEAAKEWPQSYADKYFLGMPLVKHPAVSSYDTDVTCXSCSPTLQELPELPKATNPLDAVRNGLTFFEKLQLPEGHWGCEYGGPMFLLPGVVIARYVTKNPVPWYYATEIKNYLFARANPVDGGWGLHIEGESTMLGTTLNYTTLRLVGVEADHPVMVKARATMHKMGGAIYAPHWAKFWLTVLGIMKWDIVNPVPPELWLLPDWVPIAPWRWWIHMRQVFLPMSYLWSKKWQAEETDLIRELRNELFVEDWNKIDWAGNRNTIHPNDNYHPKTAFLNTVNWLLVNIWNPVFRTKYLVEKAEAWASELIDMEDENTDYSDLAPVNAAMNTVCCYVRDGPGAYSVRRHVERLDEVLWVNAEGMLCNGTNGVQCWDTAFAIQAIMDAGLTEDPRWRPMLIKSLEFLEDQQIRENVKDQDKCYRHPRKGAWAFSNKDQGYAVSDCVSEALKSVIILQKTPGFPTLIDDQRIFDAVDTMLTYQNPSGACSSYETPRAGQWMEVLNAAEVFGNIMVEYEYPECTTAVLTTLSLFKKHWPNHRTAEIDNFITRAVKWIKSNQKPHGGWYGNWGICFTYATMFALESLASVGETYENSRYAKKGCDFLVAKQREDGGWSESYKVSLFVPGPSXILYEANQRAACETGEYVEHPTGSQVVMTAWALVGLIKAKYPNNDPIKKGIKLIMDRQQPNGEWRQEAIEGVFNKSCMISYPNYKFSFPLKALGLFATRYPDEKVV

SEQ ID NO: 3383 - protein, 328 aa, Neurospora crassa
VQPTDLNGRVAVVTGGAFGIGFEVSRALANAGCRVIMVNRKEEQGDDAKATITAETPGAVVEWRECDMGNLSQVRSVFSELREQLDRLDFLVLSAGINTNQYGLDADGIDRHFGVNYLGQYYVVNQLYPVLKKTSKLPNTPAPRVVFEASEMHRAAPSAVHFASLDEINNPDLGPTELYGRTKLAMILFAKYGLAEKVIKKNGDNIYAASVHPGAVVYSFSRIRNIASVDIGLLTWNTITGQHRHATTMKDAYPGITGKLLTWATLAFGRDVKQGSYSALWALTDPKIEEQNLNGWYFSDPDQPGKETSQASDPVLGQALWDLSERII

SEQ ID NO: 3384 - protein, 465 aa, Neurospora crassa
LKALDAMGYANMTPVQEKVLNMGSFTQDCLVQAKTGTGKTIAFLLPALHTLLNAKDLDPSQVALLILAPTRELAQQIVDECEKLVSQCNPRFECHLAVGGSAKASSLSKFLRGKPTILVATPGRLDDYLSDERVRQKFNNLRCLVLDEADCMLDQGFLPALTKILTSLPKKQQAGWQGMCFSATLPPSIHKVLHHVLAPKHAHISTVDENEAPTINSVPQSYMKVDSVDDVLPTLHNLLSAERYDNPKLKAVVFCSTARQAALLYTLFGHTGGASPAKLPVWQMQSRMNQAQRTRTTEEFKNTDSGILFASDVVGRGLDFPDIHLVIQVGIPLNSEQYVHRVGRTGRAGKGGRAVMIITPEDFWFVERNRQFPMAQSKLDHPKAAAVDSASIISQSLAKVPDQVKAQAYVAYLGFVNTMRSKMKITPAQMVQVANRYAFSLGCEEPPAIEASTIGKMGLKGVPGL

SEQ ID NO: 3385 - protein, 272 aa, Neurospora crassa
KSAIITGAARGIGRAIAHRLAADGYALTLNDLPSSSPSSSSSSDPDDALTSLCHTLHSLGYPNIHPFPADITSPDSVSALISSHVSVHGSLSTMVANAGIVAAQPLLTVTPQDLLRMFTINVIGVFNCYRAAAEQIIKQGTSGKLIGASSVAGLRGLPMLGPYVASKFAVRGLTQTFAAELAGEGITANAYAPGVVDTTMWDTIAEGVIRAGGGNAEEDEGAKAQVSKSFVDTLVPLKRSCTPEEVAALVGFLASEGADYITGQTYAVDGGI

SEQ ID NO: 3386 - protein, 503 aa, Neurospora crassa
MSGLGVPAIPANYTFSPSEGTPYLTINHDVAADLDSTNAFEGPEKLLEVWFAPSAKALPAGVKEGGLKAVNPDSWTPMLDLVHCKVLSIINSENVDSYLLSESSMFVFPHKIILKTCGTTTLLLGLDLMLRIAAVEAGFPFHNVASLEDPKVAATPLRVFYSRKNFLFPQKQRGPHKSWRDEVTFLDNMFENGSAYMVGKMNGDHWYLYITSPTSSLTPPRTPTSSRGVSPSRRSKIPTGIVAPFGGVIENNADETLEILMTDLDPENAKKFYLEEATAIAKEKLFSKSEANGDASFDVFSSSGDCDADGQAILPEALTTEGHALGTVVSEACGLSAVYPTSTYPDARIDAYQFSPCGFSANGVVPPVAGADGTIPKSGHYFTVHVTPEPQCSFASFETNVPGGQNGRQTAEVIEQVVNIFRPGRFSVTLFEAKGALATTPGEDADDSRRSWGAAAKQRMERINGYRRVDRIVHDFEDYDLVFRYYEREDWVGGGGARMGEEF

SEQ ID NO: 3387 - protein, 351 aa, Neurospora crassa
  unsure (1)..(351): unsure at all Xaa locations
GFKKNVNRATTQVMMKTGHVEKTNDRDYEVEERYDCFRFRYDMGRRGTWAKRLXHARRFKTMEAASLRLQKEAKGYLDSLRGMIDTHPSLWQTSHVSXRQCPGTAMTASQMRIAETIDAFYGEAGAKDGVSKSYKQAVEDLDAETIKALDGPYRTTVLDPITRFCAYFPDVNECRSWPSPPLHLPGNQLIALPLPKHIPPFFFVDNALLSVHKLTAMNSKKQASKKRGHKLLDYDALRAKVKKLVEKPDKDVTKLPRAEKEMEMAKAAYEQLNEQLCTELPQLIDLRVPYLDPSFEALVKIQLRFCAEAYSRMAQVQQYLDPDTREQYAQGQLDTRVEQVLQEIRELSISG

SEQ ID NO: 3388 - protein, 237 aa, Neurospora crassa
RCCLTGFRWSGTPTGTALPAGSIPGTTNAVYKTGTNPRVAILIIHDIFGWTFPNVRLLADHYAAEANATVFVPDFFGGFVCPPELVLEERWGEIDIARFMKENAREVREPEIFAFAKALKSAEGGGFEKVGAVGYCYGGWAIFRLAAAEHEEGSGDSEGHGKKLVDAVTTGHPTFVTKEDIERVSKNVPVQVLAPEFDQRYTEELKTHTFVTLQKLGVPFEYSHFPGVHHGCFIRGD

SEQ ID NO: 3389 - protein, 572 aa, Neurospora crassa
FSSSSSSSADAGPDSDWGSTPVSIRDRLQKPPQYPVTKMRQLPTGPPSRLPTVQTTFGPESDNDRKVRLERQAAVKDAFLRCWSSYRTKAWMSDELEPVNGGRKDTFGGWGATLVDSLDTLWIMGLKDQFYEAVAAAANISFETTSRAEINVFETNIRYLGGFLAAYDLSGDKRLLQKAKEVGEVLYLAFDTPNRMPQTRWNFHDASRGERQVAHDAVLLAEIGSFSLEFIRLSMLTGDPKWFDAVQNIMEALQKQQQKTRLPGMWPVVVDARRMDFGRHNHYTLGAMADSLYEYLPKTHALVGGLLPMYADMYNAAMDTAIRYNLFRPMVPDQKNILMAGMVLVGSENGKRVTQLRPEGQHLACFTGGMLALGGKLVQNDTHLQKGEQLMDGCVWAYKSMPLGIMPEVFHVLPCDSTDHCPWDEEKWKLAVVEEAGWGLSDNKENDLHKANRIINHKRLPQGFVSIPDARYILRPEAIESVFLLYRMTGRRDLPDSAWAMFQAIDSNTRTELANSALLDVTVKGGKPPMIHSMESFWLGETLKYFYLMFSEPDLINLDNFVFNTEAHPFKR

SEQ ID NO: 3390 - protein, 350 aa, Neurospora crassa
  unsure (1)..(350): unsure at all Xaa locations
DISSQLHGGYAHPLARSWQAERQLTKVRFPSPLLFVXXLFVANQSPLKQSMLIYPLFVSDNDDEEVLIPSLPNQYRRGINRLVPFLEPLVHKGLRSVILFGVPLKPGTKDALGTAADDPEGPVIRSIRLLRQRFPQLYITVDVCLCEYTSHGHCGILRDDGSLNNQLSVDRISDVALAYAKAGAHCVAPSDMNDGRIRAIKLKLIEEGIVHRVTLMSYAAKFSGCLYGPFRDAAGSCPSFGDRKCYQLPPGGRGLARRAIVRDINEGADIIMVKPASQYLDIISDAKELGKDLPVAAYQVSGEFAMIHAAAKAGVFDLKAMAFEATEGILRAGATIIISYFVPEFLDWLS

SEQ ID NO: 3391 - protein, 273 aa, Neurospora crassa
  unsure (1)..(273): unsure at all Xaa locations
SAWPRDNILRQCASILLITQVGATLLYWVFSAFSYYFIFDRRLEYHPRFLQNQVRQEIISSMTAVPWINIMTLPFFLAEVRGKSLLYTRVDEYGWAWMAISTVLFMIWNDLMIYWIHRLEHHPSVYKYIHKPHHKWIGRRTPPGRNPSVFQLTRHVPTPWAALAFHPLDGYVQSLPYQXVSPVLWAPLWATFXRVDSVFVFICPVQKYLYMVLFVLVQVWTILIHDGDMISGHWLEKYINSPAHHTLHHMYFTVNYGQYFTWADNYFQSHRAP

SEQ ID NO: 3392 - protein, 597 aa, Neurospora crassa
  unsure (1)..(597): unsure at all Xaa locations
IPLYKMGLSLKKPEGVPGKSWPAIVIGLFVAFGGVLLGVFPHSRPSNNDYSCCCNXHPCRYDTGTIGGILAMPYWQDLFSTGYRNPEHHLDVTASQSATIVSILSAGTFFGALGAAPLADWAGRRLGLILSSFVFIFGVILQTAAVSIPLFLAGRFFAGLGVGLISATSKSTRXLCSTVVLEAILPPTAILKECLVHVTLTNTYXKSPLYQSETAPKWIRGVIVGSYQLAITIGLLLASIVNNATHNMQNTGCYRIPIAVQFAWAIILIVGMIILPETPRFHIKRDNLPAATRSLAILRRLEQNHPAIIEELSEIQANHEFEKSLGKATYLDCLKGNLLKRLLTGCFLQSLQQLTGINFIFYYGTQFFKNSGFSDSFLISLITNLVNVVSTLPGLYAIDKWGRRPVLLWGAVGMCVCQFIVAILGTTTTSQDASGMIIVHNLAAQKAAIAFICFYIFFFAASWGPVAWXVDPTLLITPISTSSXLLGSRVVTGEIFPLKVRAKSLSITTASNWLLNWAIAYSTPYLVNYGPGNANLQSKIFFVWGGCCFICIAFVYFMIYETKGLTLEQVDELYEEVSDARKSIGWVPTITFREIRE

SEQ ID NO: 3393 - protein, 564 aa, Neurospora crassa
  unsure (1)..(564): unsure at all Xaa locations
FDKSSDPEAVKTAPVAVSDNDDSVGEVQAAEKFAFGEDRKIGITGAVFLILNKMIGTGIFSTPSAIFAATGSVGVSLFLWIIGKLKVLTSLASAIQLGNSHLAETYHFSPWGLLRSNHMPTXVAFLTCCGLSVWLEFGLAIPRSGGEKNYLEYIYKHPKYLASCVLAAQMIFLGFSSGNSLAFGRYILYANSGDSKDSYAARGIGVACATFACALHAFLPKWGVRLVNVLGIFKVVIVLFIVFAGFAALAGHRHVPDPENFKHAFRIETTESYGGGGAYAYSNALLNIVYSYKGWENANYFMSELKDPRRTLTVAAPIAVAGVTVLYVLANVAYFAAVSKYEIATSEVLVAGIFFRNVFGDSAGVKALPVFVALSNLGNVLAVSFAHARLNQELGKEGLLPLSKFWGSNKPCNAPAASLFLHWLITIIILLAPPPGPAYNFLVNLYTYPGVWINGFVSGGLIYLHFFRRDTWKPTWRCWEPILFIFFLLNVFLAVVPFIPPVGDWNAEGYPYYVFPIVGVAVLLLGASYWFMWTKFWPWVRGHKIVAERFIDEDGNEVIRYKKV

SEQ ID NO: 3394 - protein, 333 aa, Neurospora crassa
TMRAWQYSQTTGGLEQNLVLKDDVPVPTLSPRVGDKELLIEVLSASINPSDYKIAELPLNLGRAVVRTPATPAWDFCGRVVKTTNIVDNFRVGEIVFGRQAPTQHGACGQYIVASANACASLPSGVDVDEAASLPCAGLTAYQTIAPNVKPGDKVFLNGGSGGVGSFGIQIAKALGCHVTVSCSAAKAEQCKALGADDIIDYTAVDVCQALKERGQVFKLSVDNVGLPAELYKAGDDYLLPDGKFVQVGGPVSLAALSSTMSRLLRPSFLGGGKRKFQLYTLMGDQHQDLAILGQMVAEGKIKPVVEHAYDFEDVPTAFRDLRKGKTHGKLVI

SEQ ID NO: 3395 - protein, 504 aa, Neurospora crassa
  unsure (1)..(504): unsure at all Xaa locations
ICCVGAGYVGESCQTVRVTVERSXTNRSSGGPTAAVIAFNNPHIRVTVVDKDEKRIRRWNSVHPPIYEPGLNHILRIARDGSKECTIETRSLSTTNTTSSNTPDVSDASTPASECGSQCGDNVSKPIPARQPNLFFTADVAKSISEADIVLIAVNTPTKSRGAGAGSATDMTAFEAVTNVVAQHARPGAIIVEKSTVPCRTAQFVQDTVRTTDLCMXRDWLANCAPAALHRPGIHFEVLSNPEFLAAGTAIKDLLNADRILIGSSATPSGQRAAAALASVYSAWIPRSRIITTNVFSSELAKLVANSMLAQRISSINSIAAVCEVTGADVSEVAGAIGADPRIGSKFLKAGIGFGGSCFKKDVLSLAYLAESLQLPEVADYWRNVITMNEFARNRFASRVVRCLNNTLIGKKLTMLGYAFKKDTNDTRESPAVEIIRTLVEEGPREIAVYDPCCNPAQMAEDIGRYVGAEVLQRNGGPVIVYADAYEACHSSDALLITTEFDEF

SEQ ID NO: 3396 - protein, 255 aa, Neurospora crassa
PAVGFGTFANEGAKGETYAAVKKALEVGYRHLDCAWFYQNEDEVGQALAEFLENHKDVKREDIFICTKVWNHLHEPEDVKWSLQNSLDKLKVDYVDLFLIHWPIAAEKDEATNMPKIGPDGKYIIKKELTENPEPTWRAMEDLVDAGKTRSIGVSNWTIPGLQKLLKFARIKPTVNQIEIHPFLPNTELVEFCFKNQIIPTAYSPLGSQNQVPSTGERVRDDPTLKAVAERSGHNLAQVLLAWGLRRGYVVLPKS

SEQ ID NO: 3397 - protein, 320 aa, Neurospora crassa
TTTTLQLTKVSVLGAAGGIGQPLSLLLKLNPRVSELALYDIRGAPGVGADLSHINTKSTVKGYEPTASGLADALKGSEIVLIPAGVPRKPGMTRDDLFNTNASIVRDLAKACAESCPEANILVISNPVNSTVPIVSEIFKKAGVYNPKRLFGVTTLDVVRASRFVSEIKGTDPKDENITVVGGHSGVTIVPLFSQSKHPELSKNEQLIHRVQFGGDEVVKAKDGAGSATLSMAMAGARMAESLLRAAQGEKGVIEPTFVDSPLYKDQGIDFFASKVELGPNGVEKIYPVGPVDEVEQKLLDACLVDLKKNIQKGKDFVAA

SEQ ID NO: 3398 - protein, 558 aa, Neurospora crassa
DLGGTARTLDRADGRIPLEPGILSRKAYAVLDDSASMLFEDGWIATRKPGRKDGYLFAYHGDHKAAIKDFYRLSGGQPLLPRWALGNWWSRYHAYSDKEYLAVMRRFATEKIPLSVAVIDMDWHKVNIPAKYGSGWTGYSWNPDLFPMPENFLCNLHDMGLKVTVNDHPADGIRAFEDQYKIVAKALGHDTSKEEPIRFDCTDKKFLDAYFDILKANLEDEGIDFWWIDWQQGNRSRIPGVDPLWVLNHYHYLTSRRNVKATATPITFSRYAGAGSHRYPIGFSGDTLITWASLHFQPEFTATASNIGYGWWSHDIGGHYAGVRSNELTARWVQFGCFSPILRLHSEKSQWNSKEPWLYEPEARKVMTDYLQLRYRLIPFLYTMNVRACYEFEPLVQPMYWNHKDEEAYTVPNQYYFGPDLMVAPITTPNDPATLMGSVRAWLPNTGRRYIDILQPSLVYDGGRYVDIHRPLSEIPVFAKEGTIIPLDTAKSAKYDKHGNSRPQAITIQLVVGADAYFELVEEPSSTVPAAKADRPDPSTLVRTPIRWNQKEGVLSIG

SEQ ID NO: 3399 - protein, 485 aa, Neurospora crassa
  unsure (1)..(485): unsure at all Xaa locations
LAVLSFSSFLVDAAPAPMCPGTNVTSTSADTNVTVPDRADSSGYKNVVYFTNWYVPAXRYPQPSGXTACXLSFPIQGIYGRNYQAADLPADKITHVLYSFANLKEDGTVFSSDTWSDTDKRYPTDCTCFHPQSSFLGRQQHNPPSLLTQQSQPWNDNGTNVYGCVKQLYLLKKANRNVRVLLSIGGWTYSQTSPSRFALTASTAESRTKFATSALALVKDWGFDGIDIDWEYPASETEAQNFLLLLKEIRSQMDKYAAAHADGYHFLLTMAASAGPSKYGVLESSMKEIGETLDFMNLMAYDYAGAWDKKAGHQANLYPDEKNPDTTPFSTDRAVTDYIKFGIPSNKIVLGMPLYGRAFASTDGPGTAYSGVGEGSWEKGIWDYKVLPKSGAKVFLDEKVGASWSYDETNKVMVSYDTPEMVKQKVSYIKEKGLGGAMYWEASGDRTDKDSLMTVVKDGLGTLDSEKNLLEYPDSQYDNMKKGMS

SEQ ID NO: 3400 - protein, 503 aa, Neurospora crassa
  unsure (1)..(503): unsure at all Xaa locations
MSNTDFLGRAIEQVRKAIEADNAAQYDKAYQLYYQSLELFMLALKWEKNPKSKEMIRAKTGEYMDRAEKLKAHLADAEAKRKKPGMVGANGGSTGGTGKGKEAGEDGNGNGEALDEDSKKLRSALAGAILQERPNISWDDVAGLEGAKEALKEAVLLPIKFPHLFQGKRQPWKGILLYGPPGTGKSYLAKAVATEAKSTFFSVSSSDLVSKWMGESERYVLSCCLCPYATIVTEKLTIFQQKTVLVKQLFAMARENKPSIIFIDEIDALCGPRGEGESEASRRIKTELLVQMDGVGKDSKGVLILGATNIPWQLDAAIRRRFQRRVHITLPDLAARTTMFRLAVGDTHTALKAEDFRELARAAEGYSGSDISIVVQDALMQPVRKIQQATHFKKVRSFLFFSFLSHPXPSTPTSTSIHDARIVNFCYYKKQVVHEGKQMLTPCSPGDPDAIEMTWEQVPSDELLEPFVDKKDFIKAIKASRPTVSGEDLKRNEEWTKEFGSEG

SEQ ID NO: 3401 - protein, 878 aa, Neurospora crassa
  unsure (1)..(878): unsure at all Xaa locations
DSSQGFEWDDSQQQLTITGKRTPGLNVWDTACTAENNTLFSTTLYRAAAEIRANQTPVDAAPCWRPGAVPIQIQDYENWQEHGCKDGFLCTLILIPSLTSPLSTTGKPXHAAHRFKQHRQLVATVLYSHHRMPACQTRGHRCKLNGVNIGMGPFEPVICQAGWYCPREEKGMVTLKCPSGHYCQAGAPTPTPCAVGSRCPEGSSFERYLLPIVLLLVIDVLLILGMIHLGIRKRRRNSSASAIRQNHFAAVIGGYKQVAKKRHEEVDHEPALRSQVERQDTFRGLGDQLHEQAPPLSHRKTVRHNPDPEVSPTIRAFVVSMRKATSASEFGLSFGYDQLTFALKNSKRPILQNVTGSINSGSLTAVMGGSGAGKSTFINVLMGKAQYTKGSVTVNGIPGKLKQYKKLIGYVPQDDIVLPELTVYENIMHSAKIRLPRTWKDSDVETHVNVVIDCLELSHVRDSLVGSVGKPVISGGQRKRVSIGMELAAAPMAIFLDEPTSGLDATSASSIMSTLKALGKLGITVIVIIHQPRVEIFEMLDDMILLGNGQLIYEGPQSQAKTFFEQMGFVFPPGANCSDVITDIITGNGRRYKEEGDISKDALIAQWAQGSRVSLLTNESVDTFWQSSHSRNPSDMTLAGSESSDADTSRHNRSSLMSISKLKAGARISMLSISNPQLSRILKHRGAPRWRQTLLCLSRSILQQYRTRSNLWFEIGLSTLAGVLLGLAQKPKNGAFFRGQYNKPYEILSLSADYVAAPQMAMLITLAIGLSSAAPGVKLFSEDMLVYRREAEAGHSRVAYFLAKTISVLPRMALACLHFSAPLFLISMPVIPFWTAFLANLLYVYCIYGLASCMSMVVRREDAPLLATMVSLIVGILS

SEQ ID NO: 3402 - protein, 901 aa, Neurospora crassa
  unsure (1)..(901): unsure at all Xaa locations
SSPLRDNPSSANRGAVPRATRKRARNDHDGASSLPRASSPVMPSSPPAFPVAHGADEDDDIEEDVAAEIEDDIDDLDELAEDDVDLFREGFERDYRERDENDAYKELTSTMTSMRPSTPPQGAVLKPSWPRETVKXGWEWAPRIFLVDDDDGDIDLTNLERRRRIRYNEDPDVDMDGDIMDSELPLEALMDVKAATLSEWISVPAVQKTIRREFKAFLTEYTDESGSSVYGNRIRTLGEINAESLEVSYEHLATAKAILAYFLANAPTEMLKLFDEVAMEVVLLHYPDYERIHAEIHVRIFDLPIHYTLRQLRQSHLNCLVRVSGVVTRRTGVFPQLKYVKFDCTKCGVTLGPFQQESNVEVKISYCQSCQSRGPFTLNSEKTVYRNYQKLTLQESPGTVPAGRLPRHREVILLWDLIDKAKPGEEIEVTGIYRNNYDAQLNNRNGFPVFATILEANNIVKSHDQLAGFRMTEEDEHEIRRLSRDPHIVDKIINSVAPSIYGHTDIKTAVALSLFGGVAKQVGAHHIRGDINVLLLGDPGTAKSQVLKYAEKTAHRAVFATGQGASAVGLTASVRRDPLTSEWTLEGGALVLADKGTCLIDEFDKMNDQDRTSIHEAMEQQTISISKAGIVTTLQARCGIIAAANPIGGRYNSTIPFSANVELTEPILSRFDILCVVRDTVEPEEDERLARFIVGSHSRSHPLMNNNTQDASGGDSMEVEHDTQAAAETQQTGEHGRKKEGEIPQELLRKYILYARERCQPKLYHMDEDKVARLFADMRRESLATGAYPITVSSSLFPFSFFFFFFFFFFFFFFFFFFLPPSQNTTQXQLLTSPTTTLGPSLEAIIRISEAFCRMPLSEYCSAQDIDRAIAVTVESFVGSQKVSCKKALARAFAKYTLNRP

SEQ ID NO: 3403 - protein, 829 aa, Neurospora crassa
RFSHLYTRLLSLPVLNQKWAILYFLYQLSDSPDPNEPLPLSPLARQQPHFDPQFHPQIQAQTPPQPSAWPAEPRIPAYDEVQDEEVMEDAPSPEGSHNLPPERPRHGRDQGHTPVQSHQAGPASRDERDVAHDPSEPALLRDLPFTLQGLSSATLPFLNDTTLKLPPTLPIPIISLLNTLAEPSLLYRGLNEFTKTPANGLLGQSLRAAISKELRSYLTLVATLETQIRRALSELDESAPRGGIGKTGVTLKRCVVWTREATMGLRLMSLIAEESKNKHGGQLVTLIHNFSSSHGDPVVAAFAERLLVDVTRPFYDILRRWIYDGELLDPHMEFFVREQNPLDEERKDAKAKGQMSVWNSKYELVEDMVPSIITRNFADKVFLIGKSLNFIRHSCGDHKWVEDYSKNASRELKYGDTATLEAWIDEAHRETMSHLMRLLNDQFRVFDHLEALKRYILLGQGDFIALLMESLAPNLDRPAGAQYRHTLTAQLEHAIRGSNAQYDDPEITNRLDARMLQLSHGDIGWDCFTLEYKIDAPVDVVVTEWGNRQYLKVFNFLWRIKRVEFALASTWRKCMTGARGVLQTSDETVLQTWKSTRGVLAEMVHFVGQLQYYILFEVIESSWTELQKNIHKENCTLDDLITAHTKYLTSITHKGLLGAKRRPYPQTGDPVSASSTTDEDRNSYMVQLSELLRIMLAYRDSVDGLYSWSVSDFTRRQEKETAGLIYSHRGGSTRTTTRDRADSQAASSMADSMDLDPPYEYFDAAATSDAGSVKSEFPALQDRLKQLGANFKTRLQILLGDLAYQPDVDMRFLGVSMNFNDVYQPVRRK

SEQ ID NO: 3404 - protein, 442 aa, Neurospora crassa
  unsure (1)..(442): unsure at all Xaa locations
HIEVTPDNNGNLFFWHFQNKHIANKQRTVIWLNGGPGCSSEDGALMEIGPYRLKDENTLVYNDGAWNEFANVLFVDNPVGTGFSYVDTNAYIHELTEMAANFVTFLERWFALFPEYEHDDVGATLXTSSIRSVXPISQLYIAGESYAGQHIPYIAQAILERNKNAGPVNRKWNLSGLLIGNGWVSPKEQYDAYLQFAYEKDIVKKGTDLANKLEIQQRICQKEIAVKPDKIDYPECEAILQDMLQLTAGGVGASGKNQCYNMYDVRLKDDYPSCGMAWPPDLKSVTPYLRKKEVIKALNINDNKSTGWTECNGQVGMNFNPKTKPSITLLPDILSAGVPILLFSGAEDLICNHLGTEALISNMEWNGGKGFELTPGTWAPRRDWTFEGEPAGFWQQARNLTYVLFYNSSHMVPFDYPRRTRDMLDRFMGVDISSIGGQPTDS

SEQ ID NO: 3405 - protein, 192 aa, Neurospora crassa
  unsure (1)..(192): unsure at all Xaa locations
RKQWRKDHPFGFYARPQKNQQGVLDLKIWECGIPGKEKTIWEGGLFKLTVTFPDGMRPAPVGVFSQKNTRADLTFPACEYPTKPPKCTRKLALVHPPLLRSHGXHVGVXAGKFVPPLFHPNVYPSGTVCLSILNEEEAWKPAITMKQILLGIQDLLNDPNPESPAQAEAYNLFKKDRQEYERRIKRVVRENA

SEQ ID NO: 3406 - protein, 442 aa, Neurospora crassa
  unsure (1)..(442): unsure at all Xaa locations
MNGYDEKRQLDEDAFGAKGSIVSAFDAFPYVPPSPPSHIQCAFIHLQINXHESPTYYYTAKSKPQYVTRTTAGGKWTVFVGLISFILFWSEASRWWRGSESHTFAVEKGVSHALDINLDIVVKMKCQDIHINVQDAAGDRILAASRLHRDPTVWQHWVDNKGIHKLGRDAQGKVVTGEGYMQGQGHDEGFGEEHVHDIVSLGRRKAKWARTPRLWGATPDSCRVFGSLELNKVQGDFHITAKGHGYMEFGQHLDHSGLFSFLFLLPLPKLQPSNSIFHNNSYXQQQKTAFNFSHIISELSFGPFLPSLVNPLDQTVNIASANFHKFQYFISVVPTVYSSSGKSIVTNQYAVTEQSQEVTERIIPGIFVKYDIEPILLHIDEERDSFLVFIIKVVNVISGALVAGHWGYRISDWCQEVWGKRRRRAGGPSEGMLGGKGHERDD

SEQ ID NO: 3407 - protein, 470 aa, Neurospora crassa
MAPSDPVNPPGTPAPSLLEGRLWVDGCFDFFHHGHAGAVVQARQLGTELYVGVHSDEAILENKGPTVMTLRERLLATDACRWVTKSVAYAPYVTQLDWISHFGCKYVVHGDDITSDSSGEDCYRFVKAANRFKVVKRTPSISTTDLVGRMLLCTRTHFIKDLEKMLEGEEGNGTAEEKKKVGEEMKERIRLYATDETAKNPGANVWFWKGDEKKKKKEDEGKEEEKGVFRELFGGIGPKPGQRVVYVDGGFDLFSSGHIEFLRLVTQKEEELARQEGWYSQQAIDERKGKGADYGPAFVVAGVHDDEVINREKGVNYPIMNVFERGLCVLQCKVCFYQQSRREIDVDIRYSYINAVVFGAPFKPTKGYLTSLPWGTPDAVYHGPTSFMPHTEDVYAVPKEMGIYKEIGQHEYKDVNAGTIVQRIMKSRDLYEARQKAKGMKADIEAAHRERELLEEQQRQKEEAIAAQKE

SEQ ID NO: 3408 - protein, 403 aa, Neurospora crassa
  unsure (1)..(403): unsure at all Xaa locations
MAGLFGSAAASASNTLGDLKQDVELGQPPEDSISDLAFNPNPADQKDFLAVASWDKKTRIYEILSNGQGQGQAMIEHDAPVFSCDFFKVCLRRLAWQVARQNTDMHFSQQDGTKVISAGADKAAKVLDLATGQSMQVAAHDMPIKCVRYFEANGTPMAVTGGWDKQIKYWDFRSANPAATVQAQERVYTMDVRDNLLVVGTADRYINVINLKDPGKFYKTMQSPLKWQTRVVSCFNDSQGFAIGSIEGRCAIQYVEDKDSAYAFTSSPFTIPSAEYADXLTCFPASNFSFKCHRDPAQGNTTAVHAVNDISFHPQHGTFSTAGSDGTFHFWDKDAKHRLKGYPNVGGSITSTTFNKTGSIFAYAISYDWSKGYQGNSPTYPTKVMLHPVQQDECKPRPSVKKR

SEQ ID NO: 3409 - protein, 816 aa, Neurospora crassa
  unsure (1)..(816): unsure at all Xaa locations
RAIQAKQLPSRVACASARSFSSTSSNNTGVLPPRYETLYNKYSEVRRVLGSQRLTLAEKILYSHLDNVEESLLSNTNGGRDVRGKANLKLKPDRVNMQDASAQMALLQFMTCNLPQPVIPASIHCDHLIVGSKGADEDLKAGIATNNEVFDFLESAGKKYGIDFWPPGAGIIHQTVLENYAVPGLMMLGTDSHSPNAGGLTTITIGVGGADAVEALVGAPWELKAPKILGVRLTGKLNDWVSAKDIILHLTGRLTVRGGTGYIVEYFGPGIESLSCSGSSTLCNMGVSSPXAFPLAIXNVLTDHCCYSAEIGATTSIFPFTEASSRYLKATNREQADKDAKNFENFTKGTGQDSFFKFKADEGAQYDELIEIDLSKLEPHINGPFTPDLSIPLSEFKKTVQEQKWPEKLSAGLIGSCTNSSYEDMTRCESIVKAAEQAGIKPASDFYITPGSEGIRATLERDNTLQTFEKAGGIVLSNACGPCIGQWKRQDDIPKGTPNAILTSYNRNFRGRNDGNLETMNFLASPEIVTAMAYAGSTTFNPITDSLTTPDGKEFKFPAPKGLEGPETPFEAGREVFQVQSGSPNPNVEVAISPSSERLALLEPFEPFPESDLSGLRVLVKVTGKCTTDTISAAGPWLKYKGHLPNISENTLNTAVNAATGEVNVAYDLDGSKHTIPELAKQWKQRNQPWLVVAEHNYGEGSAREHAALQPRYLGARIIVTKSFARIHETNLKKQGVVPLTFANEQDYDLIDAGDEVATVGLYEMLKNGGQGEVSLRVTKKDTGKVVEIKTKHAVSKDQAGFILAGSALNLLAKGN

SEQ ID NO: 3410 - protein, 455 aa, Neurospora crassa
  unsure (1)..(455): unsure at all Xaa locations
MGSMYQVQSKLRQDLGLHKVQAVRKPGRELNGTKAYVSAMARYGFNPTEESRFFHLKKTDLTKEFQRRGYIRHWEQLVRTPQERPDDPHTDNEPVPAEDQQYDTQYLCEIGIGTPQQKVKLDFDTGSADLWVSTQHNPTLLSXHXLIAFKVRCTDSSLLHHADKKFDPKKSDTFQESKTDQTWKIQYGDGSTASGTVGTDVITVGGLQIKNQAIELAKKVSSAFSSGEADGLLGLAFSTINTIESDGKPDPQPTPVENMISQEDIPKEAELFTSAFYSARDDKSEEKSFYTFGWVDEDLVKASGKDITWTPIDNSEGFWKFPSESATVDGDNVSVSGNTAIADTGTTLALVSDTVCKALYAKIPGSKYSYRYQGYLIPSTITADQLPQLSVAVGGEQFVIQNEDLLLAPADDDHWYGGVQSRGTMPFDILGDTFLKSIYAVSSRISDRVKLLLTR

SEQ ID NO: 3411 - protein, 490 aa, Neurospora crassa
SNQPTSKNLTALSAASRYAVDPTRPQYHYTPYQGWINDPAGLIQWGGKYHLFNQYNPVAPLWGPMYWSHAESTDAVHWRDLPVALTPPYVNNTQDTSGRYTGSAVKNQDTGALQLIYTDATNVTYHPHAVPEVVSSAVSSDGIHFDLYSGNPIVAEAPPTSSAGFRDPKVFWDPTANNWKMVVGSGDGHTGNVQLYKSTGPSSSELLSWEYVGVLHQGDGSRGIMWECPNFFPIDDKWVLFYGQDKGFKGWYEVGSFNGTTFVSEKLGLFDSGPDSYATQWFVDDAGRNLAVTWINNWNTTKWPSRVNGWAGTQSIMRELFIREDGGLGQKPVEEVSLLASGPAKSLGQTDVFGTYEVGFTDTARLQATVDLAASDAPAFTIELFASGAESTSLVYNFANRSLTIDTMNAGYGQAGTWEATIAKPADNRLSLDILIDRSSIEVFVGDGTAMTVRVFPRYQESKNIRITSDGGKKTVFDDIVLTPMGSAWE

SEQ ID NO: 3412 - protein, 926 aa, Neurospora crassa
MDPRMHTAPPAGHPIQPGYQLEDNPYHHQQGFDIPAGPGRYSPGDALHIQTPVSIAAMSVGNKRLMRRAQPIEGMGGYNAPGQHYTPDYAVNPEEHHDAYYNQPYEPQVGHDPYAAAPTPPVAGYQAHDDQRPMLMHTDSQVGQSDPYHDEPQPPTNNAPIKRWKTVKQVLLYRGNLVLDCPIPPKLLNQLPHGERDEFTHMRYSAATCDPSEFYEENFTLRQKLFSKPRHTELFIVVTMYNEDEILFARTMIGVFKNIEYMCKRTESKTWGKDAWKKIVVCVVSDGRAKINPRTRALLAGMGVYQEGIAKQQVNGKDVTAHIYEYTTQVGMTIKNDVVQLIPKQQPVQMLFCLKEKNQKKINSHRWFFQAFGRVLDPNICVLIDAGTKPGGSSIYHLWKAFDLEPMCAGACGEIKAMLGTGGKNLINPLVATQNFEYKMSNILDKPLESAFGFISVLPGAFSAYRYVALQNDKNGQGPLEKYFAGEKLHGGDAGIFTANMYLAEDRILCFELVTKRNCHWILQYVKSATGETDVPADLTELILQRRRWLNGSFFAAIYAIVHFHQFFRSDHSFLRKIAFFIEFVFQTVNMIFAWFAIGNFFLVFKILTTGLGDEKLLGTVGQILGVVFAWAYGVTLITCFVLSMGNRPAGSPRLYMGMVVFWAIIFMYVCSSPLLFHLEAPLLTVLSQLPMFAAIYIAVVAIQTDVQKGLSFTDLFRNELFYTLIVSVVSTYGIWLIASLLMFDPWHMVTSMVQYMLLSPTYTNVLNVYAFCNTHDISWGTKGDDKPDKLPSVNTKDGQGKTDLPDEGDLNASYERELQVFSRKYVKPVTAPTSAQLEEKQMDYYRGVRSMVVLVWMITNFALCAVVLSTAGLERIDPEEGSQEQQTTKRATIYMSVVLWSVAVLSGFKFVGACWFLVVRMFRGV

SEQ ID NO: 3413 - protein, 468 aa, Neurospora crassa
  unsure (1)..(468): unsure at all Xaa locations
SLHNAPIVLDNGSGTIRAGFAGDDVPKCHFPSFVGRPKHLRVLAGALEGEVFIGQKAASELRGLLKIRYPLEHGIVTDWDDMEKIWAYVYDEGLKTLSEEVRSPIFFWSEQDKKKKKKAVANNGSNCXHPVLLTEPPLNPRANRDTAAQILFETFNVPALYTSIQAVLSLYASGRTTGVVLDSGDGVSHAVPVYQGFTVPNSIRRIDVAGRDVTEYLQTLLRKSGYVFHTSAEKEVVRLIKESVTYVAHDPRKEEKEWAAAKMDPAKIAEYVLPDGNKLKVCXVLFLSCHYQWREVGKEKETSMQILTPTKIGAERFRAPEILFDPEIIGLEYPGVHQIVVDSINRTDLDLRRDLYSNIVLSGGSTLTKGFGDRLLTEVQKLAVKDMRIKIFAPPERKYSTWIGGSILAGLSTFRKVCPHICLCVCAWTRRKLRKMGPXCVLTNVXQXTDWVSIDDWHENPDIIHTKF

SEQ ID NO: 3414 - protein, 828 aa, Neurospora crassa
  unsure (1)..(828): unsure at all Xaa locations
MTSQPSSGKGRGRNLSIDEYNVYDDAKTYYTTEDRHHNHRAGARTRTYSQVSTPPSQDCHAWASIHXFRRLQNSLFKQFERLGLQKEPYRRGSHGTKTITCQRTIPCKTYXSDVXQDESTIPQSRRFLIQVEPTLQSLQSQEDTDGNMQITIEDNGPKVRGNAIKGLEVAVGITQRXHGATPQVLSLRTAASNGYNRFDIRGTYMLSNLLQELYLAKEYGRKQIILDEARLNENPVNRLSRLIKDHFWEGLTRRIDASSIEIAARDPKDWTDDPRPRIYIPRGAPEQHEYYTKVALDRPELRLDVQYLPEKITPEIVRDMNAKPGLLAVDMEEVVDPKTGEKTLRGRPFVVPGGRFNELYGWDSYMESLGLLVNDRVDLAKSMVQNFCFCIKHYGKILNATRSYYLCRSQPPFLTDMTLRVYDKIKHEPGALEFLRQSLLAAIKEYYSVWTAEPRLDPVTGLSRYRPEGLGVPPETEAGHFIHILEPYAKKHNMSFDEFVYAYNHGEIKEPTLDDYFMHDRAVRESGHDTTYRFEGICADLATIDLNSLLFKYETDIARTIRNVFHDKFEVPDDWLATNNPAASKLETSAMWDRRAKRRKLAIDKYLWNEEAGMYFDYNTATRKQCNYESATTFWALWAGVSNPKQAAAMVTKALPKLEAFGGLLSGTKESRGEIGLERPNRQWDYPYGWAPQQILAWTGLYRYGFNEEAERLAYKWLFMITKAFVDFNGVVVEKYDVTRPIDPHRVDAEYGNQGLDFKGVAKEGXVCLLLCFFFFFCFFLFFFPREAQSLTXXTQFRWVNASYVYGLQIVNAHMRRALGTLTPYETF

SEQ ID NO: 3415 - protein, 521 aa, Neurospora crassa
  unsure (1)..(521): unsure at all Xaa locations
QLKDPSLFKKDVCYVNGEWVKAHSGKTFEVNGIXTYLCLHFHAVSSHXCAYHLHTTNSASFLPTKDPATGKLIGTCPEFDAQDTKKAIDAAETAFETFRHKTGRERSKLLRKWYDLMVENHDDLTTLITLENGKPLADAKGEVTYAANFFEWFSEEAPRIYGDTIPSSVPGNRVWTIKEPVGVCGLITPWNFPAAMITRKVGPALAVGCTVVCKAPGETPFTALAIAELAHRAGIPPGVVNVITALENTPEVGSTLTTDPVVRKISFTGSTAVGKLLMKQCSGTLKKLSLELGGNAPFIVFDDADVDAAVTGAIASKFRSSGQTCVCANRIYVQRGIYDEFSQKFAEQVKNNFRVGNGFEEGVTHGPLIHHRAIEKVEQHVRDAEKKGAKVVVGGHRLESLGPNFYEPTVITGMTPDMAMASEETFGPVAGLFPFDTEDEVVKLANATQVGLAGYFFSRDIHRCVRVAEHLEVGMVGINTGLISDPASPFGGVKESGFGREGSLYGIGEYQVTKMVTVGGM

SEQ ID NO: 3416 - protein, 661 aa, Neurospora crassa
ALDRQQLSMQLHLRTQEAVESEYRFARMAELGPVGLFIADSHGRINYCNEMWWRISGHERSASTLDAWMQSIRDEDREGVVNVWHHLVQEKVPVTYEFRFNGTRKIVDGHTVDTWALMSAYPERDETGELKSIFGCITDISQQKWAEDFQKRRRDEAVELKRQQENFIDITSHEMRNPLSAILQCADEIASGLNRFRQENPAFRGPDTLETLVDSCLEAANTISLCASHQKRIVDDILTLSKLDSQLLLVTPVDVQPVQVVEEVLKMFEAELNSNDITGHFQIEQSYRNLEIDWVKLDPSRLKQVLINLMTNAIKFTQGRPTRAITINLGASKDVSSAGLSYFPPRHPDQEDLTDDAEWATGEKINLHLAVSDTGPGLDENEKKILFQRFSQTSPRTHVQYGGSGLGLFICRILTELQGGQIGVYSEKGEGSTFAFYVKSRKAENPQPVPTVVDNSMSIQPLQQRVSPQTQGQISHRSSSSAAFSLLGHGRSHAPPTRTQSAPVLADTTQTRSLDVLIVEDNLVNQRVLQRQLQLSGNNTFVANHGGEALVELRKSRFWNKEIAATDDAASALPRSNKKAVNDGGTDGSPDGEENSNNNISVILMDLEMPVMDGMSCTREIRRLENVGVITRHIPIIAVTAYARPEQVESARAAGVVSSLS

SEQ ID NO: 3417 - protein, 350 aa, Neurospora crassa
FPEKAAVIEERDGEIEFRVVNNDGERESLIILTGLKCIFQKQLPKMPKDYIARLVYDRTHLSIAIVKKPLEVVGGITYRPFKGRQFAEIVFCAISSDQQVKGYGAHLMSHLKDYVKATSDVMHFLTYADNYAIGYFKKQGFTKEITLDKSVWMGYIKDYEGGTIMQCSMLPRVRYLEMGRMLLKQKECVQAKIRAYSKSHIVHQPPKQWKNGVTPIDPLSVEAIRASGWSPDMDELARQPRHGPNYNQLLHLLNDLQNHASSWPFLVPVNKDEVHDYYDVIKEPMDLSTMEDKLEKDQYNTPEDFIKDAKLIFDNCRKYNNENTPYAKCANKLEKYMWQQIKAIPEWSHL

SEQ ID NO: 3418 - protein, 647 aa, Neurospora crassa
  unsure (1)..(647): unsure at all Xaa locations
PCDSPIYCYGELLHQVELARPFSDSKTFVDMXVFGPTSSGVXAWHXPNLPCRPTIKPVDEVLEAFSKLTLPLSNNSELHEFLSTYFGPAGGELEAVPTDQLHVSPTFLDNVSDDVIKQFVDSVINIWPDLTRKYVGAGELCTGCADSFIPVNRTFVVAGGRFREPYYWDSFWILEGLLRTGGAFTEISKNIIENFLDLVEQIGFVPNGARLYYLDRSQPPLLTQMVRIYVEHTNDTSILERAVPVLKKEWEWWTTNRTVEVTADGKTYSLQRXVERAEERSGMTRACLANILSRRYHVDNNQPRPESYREDYITANNNSYYATSGIIYPETTPLNDTQKALLYANLASGAESGWDYSSRWLKNPGDAARDVYFPLRSLNVLEIVPVDLNSILYQNEVTIGKFLAQQGSKDEAEEWAKKAEERSEAMYKLMWNSTLWSYFDYNLTSSSQNIYVPADPQVFPFEQPSGTPEGYQVLFSVNQMFPFWTGAAPDQLKGNPLAVKLAFERIKNLLDNKAGGIPATNFVTGQQWDEPNVWPPLMHVLMDGLLNTPATFGEDDPAYQETQTLALRLAQRYVDSTFCTWYATGGSTSETPKLQGLGSDLKGIMFEKYSDNSTNVAGSGGEYEVVEGFGWTNGVLIWAADKFGDKL

SEQ ID NO: 3419 - protein, 291 aa, Neurospora crassa
QQASSEQSPKLKTFQIYRWNPDTPTEKPRMQSYTLDLNKTGPMVLDALVRIKNELDPTLTFRRSCREGICGSCAMNINGTNTLACLCMSMSQHPPRYMSLGADGMLTFPNHRRIPADNSAEMKIYPLPHTYVVKDLVPDLTLFYKQYKSIKPYLQRDTPSPDVSGYAFIRSCAHRSMLTYVITCRAKEYRQSKADRKKLDGLYECILCACCSTSCPSYWWNSEEYLGPAILLQSYRWLADSRDERTAERKDALNNSMSLYRCHTILNCTRTCPKGLNPGLAIANIKKELAF

SEQ ID NO: 3420 - protein, 399 aa, Neurospora crassa
  unsure (1)..(399): unsure at all Xaa locations
HRPAPPPPPKMSVVETATAAAGASATAGAAKKRQVLLRVNGRTYTRIDCIGRGGSGKVYRVSAESGKMLALKRVSLEHADENTVKGFKGEIDLLKRLNGVERVIQLIDHELNLEKQVLSVVSDSSTSKDSYXILTPPXLMEVGELDFNTLLKSRQSTAEGARLDPTFIRYYWKEMLECVQAVHARDVVHSDLKPANFVLVQGRLKLIDFGIANAIQTEMTVNVHRETQIGTPNYMSPESLMDSNQYAFTSAQNGKFCIPPPLNHRQHGAPKLMKLGKPSDVWSLGCILYQMVYGLPPFGKIANQMSRCQAIINWSYQIDFPEATEDGSRVPPSVIRTMRRCLNREQRERPTCDELLADTDPFLYPQEFDPSVYAAAEHGRVLPVTEELLSRLIQSVVQR

SEQ ID NO: 3421 - protein, 522 aa, Neurospora crassa
  unsure (1)..(522): unsure at all Xaa locations
ITPKDLFLLTFTSPXQACFGAMSFGWDSSVIGGVIELEPFKHDFGFIGNDKAKANLGANIVSTLQAGCFLGALIASPITDRFGRKWCLIAVSLVVIIGIIMQAAASGNLAPMYIGRFVAGVGVGAASCINPVFVSENAPRSIRGLLTGLYQLFIVTGGMIAFWINYSVSLHFKGKSMYIFPLAIQGLPAGLLCVCMLLCHESPRWLARRDRWEECKSVLARIRNLPPDHPYIVDEFREIQDQLEQERRLQGDATYWDLTRDMWTVAGNRKRALISIFLMICQQMTGTNAINTYAPTIFKNLGITGTSTSLFSTGIYGIVKVVSCVIFLLFLADSLGRRRSLLWTSIAQGLAMFYIGLYVRISPPIDGQPVPPAGYVALVAYFCLLRKFFGLFFSFPFLLHLNPFLPFASTSFPPMPIICTLLNVVPLNSFFQFGWGPACWIYASEIPAARLRSLNVSYAAATQWLFNFVVARAVPTMLVTVGPHGYGTYLIFGSFCLSMFVFVWFFVPETKGISLEHMDELF

SEQ ID NO: 3422 - protein, 427 aa, Neurospora crassa
  unsure (1)..(427): unsure at all Xaa locations
TILTAALAATGMAAAIPSRDDTTANKGTASLLQVRNPSFEFRHGPLALAKAYQKFGAPMPEDLRAAIARFRQNQKRTTGTIATDPEKHDVEYLTPISVGTPSQDLVVDFDTGSSDLWVFSTEMSTSDIKGQTVYDPNNSSTSEKVQGSTWKITYGDGSSSSGDVYLDTVTIGNLTVPSQAVEAAKKVSSEFTDDSHNDGLLGLGFSAINAVEPTPQNTFFDNIKGSLDAPLFTVDLKHGTRKLASPAQEQFMRRNXHFXHIAGSFNFGYIDPAAYIGNISWTPVDSSQGYWGFTSPGYAVGTGAFRNHSISGIADTGTTLLLLPKSVVSAYYKEIQGAQYDSDQGGYIFPCSPTPPDFVFGVNKGIVTVPGDMVSYAPADSANQNCFGGIQTDTGIGFSIFGDVALKTSFVVFDAGGLQLGWAAKNL

SEQ ID NO: 3423 - protein, 2081 aa, Neurospora crassa
  unsure (1)..(2081): unsure at all Xaa locations
SLRPLTVSHGSLETSFLIPTGLHFHATQLKERFAAILPAPTDELAQDDEPSSIFELVARYMGFIATEVTQGEDDAQGSYEEVLKIILNEFERAFLRGNDVHALVSTMEGIDDKKLEVIRCYYLARSASNRAIKPYESALFRAAGENAAKIFTIFGGQGNIEEYFEELRELHHTYPAFVGELITTSAELLQTLSSHPDAEKMYPKGLDVLGWLQSPEATPDVDYLISAPVSFPLIGLVQLAHYQVTCKVLGVHPGVLRERISGTTGHSQGVVLSAITAAADSWESFEEHSKAALTILFWIGARSQQTFPRTSLAPSMLQDSADNGEGVPTPMLSIRDLPQAEVQKHIDQTNAYLPEDQHISIALINSPRNMVVAGPPSSLHGLNLQLRKLKAATGLDQTRIPHTERKVRFVNRFLPITAPFHSKYLAKASDLIAEDLKDVQIDSRTLGMPVYNTFTGKDLREEVEGNIVPSLIRMITGETVHWEKATVFQDATHILDFGPGGISGLGILTSRNKEGTGVRVILAGTVNGTVTDVGYKPELFDRDEEQAVKFAVNWVKEYGPRLVKNSVGRTYVDTKMSRLLGLPPLLVAGMTPTTVPWDFIAATMNAGYQIELAGGGYYNAKTMTEAISKIEKAVPAGRGICVNLIYVNPRAMGWQIPLLGRLRAEGYPIEGLTIGAGVPSIEVAQEYIETLGLKHISFKPGSGEAIQAVINIAKANPTFPVILQWTGGRGGGHHSFEDFHHPILNLYGRIRRQENIILVAGSGFGGADDTYPYLTGDWSIKYGYPPMPFDGCMFGSRMMVAKEAHTSLAAKQAIVDAPGLDDSDWEKTYKGPAGGVITVRSEMGEPIHKLATRGVRFWAEMDQKIFSLPKEKRVAALKASRDYIIEKLNKDFQKVWFGQNKEGKAVDLEDMTYAEIVRRLVELLYVKDEARWIDQSYTKLTGDFIHRIEERFTTTPGQPSRLQSYADLKEPYSAVEQILSHYPEAEKQLINAQDVQHFLLLCQRRGQKPVTFVPVLDENFEFFFKKDSLWQSEDLAAVVGKDVGRTCILQGPMAAKHATKVDEPIKDILDGIHNGHIALLTRDMYGGDESKIPTIEYFGGKLIESEIPLDIEGLTVSYDEHKNTYRLSSSPSVQLPSLDAWLSLLAGHQRNWRFALLQSDVLVQGQKYQTNPMRRIFAPARGLFVEILHPNNPEKTVILVKEQPRPNRYAEVIEVKLDGKNEIVVNMIKDTTALGKPVPLTLKFIYNPEAGYAPIHEVMDGRNDRIKEFYWRAWFGDEKLDLDSSVHEVFDGGKTTITSEAINEFVHAVGNTGEAFVDRPDKVMYAPMDFAIVVGWKAITKPIFPRTIDGDLLKLVHLSNQFRMMPGAEPLKKGDVVSTTAQINAVINQESGKMVEVCGTITRDGEKVMEVTSQFLYRGTYTDFENTFQRKVETPMQLHLATSKDVAVLRSKDWFMMDDVENPDIELLGQTLTFRLQTLVRFKNKTVFSHVETQGQVLLELPTKEIIQVATVNYYAGESHGNPVIDYLQRHGSSIEQPINFENPIPLSGKTPLQLKAPSSNETYARVSGDYNPIHVSRVFSSYANLPGTITHGMYSSAAVRSLVETWAAENKVGRVRSFHASLTGMVLPNDDINVKLQHVGMVAGRKIIKVEASNKETEEKVLLGEAEIEQPITAYIFTGQGSQEQGMGMDLYNSSPVAKAVWDRADKYLMDTYGMSLTIVFLLIPMLTGLXGFAITNIVRNNPKELTIHFGGPRGKAIRQNYMSMTFETVAADGSIKSERMFKEIDEKTTSYTYRSPNGLLSATQFTQPALTLMEKASFEDMKAKGLVPRDSTFAGHSLGEYSALAALADVMPIESLVSVVFYRGLTMQVAVERDETGRSNYGMCAVNPSRINKTFTEEALRFVVGSIAETTGWLLEIVNFNVENMQYVCAGDLRALDTLGGVCNAIKMMKIDIEKMRKEYSAETVKEQLVEIIKSCANDTQAKPTPLVLQRGFATIPLPGIDVPFHSTFLRSGVKPFRSFLLKKINKTTIDPSKLIGKYIPNVTAKPFAITKEYFEDVYRLTNSPKIQQILANWDKYQE

SEQ ID NO: 3424 - protein, 1906 aa, Neurospora crassa
  unsure (1)..(1906): unsure at all Xaa locations
MRPELEQELAHTLLVELLAYQFASPVRWIETQDVFLAEKTAERVVEIGPADTLGGMARRTLASKYEAFDAAKSIQRQILCYNKDAKEIYYDVDPVEEEPEPVAASSSSAAPTPAAAAAPAAAAAAPPPPSAGPAASVPDAPVPALDIVRSLIAQKLKKPFAEIPLSKAIKDLVGGEIIPHSVTGRHDNDXQSLRTGKSTLQNEILGDLGKEFGSTPEKPEDTPLDELGAAMQATFDGNLGKTTQGLIARLISSKMPGGFNITSARKYLETRWGLGSGRQDGALLLAITMEPPARLGSEAEAKAYLDDISQKYASHAGISLSTAAAAGPAAGGGGGMMMDPAAIEALTSDQKAMFKQQLELIARYLKIDIRAGDKAFQASQESSKVLQSQLDLWMAEHGDFYAAGIEPVFSSLKARVYDSSWNWARQDALSMYYDIIFGRLKAVDREIVSQCIRIMNRSNPTLLEFMQYHIDNCPTERGETYQLAKELGYQLIENCKEVLNVDPVYKDVAVPTGPRTTIDARGNIKYEEIPRASCRKLEHYVQQMAEGGKISEYSNRTKVENDLARIYKLIKQQHKLSKNSQLEIKSLYGDIIRSLSMNESQIMPKESSKVSSVLSKSSSKSKGKTETIPFLHLRKKSEHGWDYSKKLTGLYLDCLEQAAKNGVTFANKYVLMTGAGAGSIGAEVLQGLISGGAKVIVTTSRFSREVTEYYQSMYARFGSRGSQLVVVPFNQGSVQDINALVDYIYDTKTGLGWDLDYIVPFAAISEQGRQIDGIDSKSELAHRIMLTNLIRLLGSVKAQKASRGFETRPAQVILPLSPNHGTFGSDGLYSESKLGLETLFNRWHAEDWANYLTICGAIIGWTRGTGLMSGNNLVAEGVENFGVRTFSQQEMAFNLLGLMSPTIVDLCQNEPVFADLNGGLQFITNLNETMTSQRKNLMETSDIRKAVTKETAIENKIVNGEDSEALYKKKVIEPRANIKFDFPTLPDWKSEVAPLNDTLKGMVDLEKVVVVTGFAEVGPWGNSRTRWEMEAYGEFSLEGCIEMAWIMGLIKNHNGPIKGKPYSGWVDAKTGEPVDDKDIKPKYEKYILEHAGIRLIEPELFDGYDPNKKQLLHEVVIEEDLDPFEATKDTAEEFKREHGDKVDIFEIPETGQYTVRLKKGASLWIPKALRFDRLVAGQIPTGWDAKRYGIPDDIISQVDPVALFVLVSTVEALLSSGITDPYEFYKYVHVSEVGNCVGSGMGGATALRNMHRDRYLDKPVQNDILQESFINTMAAWVNMLLISSSGPIKTPVGACATAVESIDIGYETIMEGKARVCFVGGFDDFGEEGSYEFANMKATSNAVDEFAHGRTPKEMSRPTTTTRNGFMESQGSGVQVIMTAKLALDMGVPIYGVLALTTTASDKIGRSVPAPGKGVLTTARERQGSLPSPLLDIKYRRRQIERRKKQLENEKEEELEYLADEIEALKAEGRPQKEIDDYARHRTQHIEEEAERQVKEVLRSYGNNFWKGDATIAPLRGALATWGLTIDDLDVASFHGTSTKANDKNESSVICQQLRHLGRKKGNAVLGIFQKYLTGHPKGAAGAWMMNGCLQVLNSGLVPGNRNADNVDAVMEEFDYIVYPSKSIQTDGVKAFSVTSFGFGQKGAQAIGVHPKYLYATLDEEVFNAYRTKVEARQKKTYRFFHNGLINNTLFVAKDKSPYSDDQLQSVLLNPKARVTEDKKTGQLTYPANFMELEPAQKLQKKSEESLESTVARAANRLKNSNTRVGFDLEEISSINIDNETFLERNFTEAELQYCKAPSTGRSPQKSFAGRWSAKEAVFKSLGVTGQGAGASLKDIEILSDSNGGPVVKVRVSFFVFVFCHXNQLLTCXXLHGAALEAANKAGVSKVNVTLSYSDSHAVAIATAHF

SEQ ID NO: 3425 - protein, 304 aa, Neurospora crassa
  unsure (1)..(304): unsure at all Xaa locations
FSFXTXHSFTQVSKTTTFVLPHVATKHNIPKYTRAEFPRKIWQTWKVNPLAFEQRDLDTARSWVGQNPSYRYEVLTDSNDMQYVEWHFGPDGFNRPDIVNFYRSVKAAIVKADLLRYLVMYAEGGLYADIDVEALKPLSKFVPERYDMADIDMVIGVEIDEPDWKDHPILGPKSRSFCQWTFMCKPQLPVMMRLIEQIMTWLNGVAKEQGVPLAEVKLDFDQIISGTGPSAFTNAIIAEMNDASHNPGKPITWDTFHDLGESKLVSRVLVLTVEAFAAGQGHSNSGNHDARAALVKHHYHASNW

SEQ ID NO: 3426 - protein, 228 aa, Neurospora crassa
YTDNGGSTLAIAGADFTIMAGDTRLTSGYSINSRYHPKLFKIGGTTADQKDATIVLSVVGFAADGEALKERLDAICKMYRYRHGKPMSVKACAQRLSTILYQKRFFPYYVYAILGGLDEEGKGAVYSYDPVGSYEREQCRAGGAAASLIMPFLDNQVNFKNQYEPGSGVGHALQERERKPLTRSEGEVLVKDAFDGAVERHIEVGDGLQMMVITKDGIEEVLLPLKKD

SEQ ID NO: 3427 - protein, 414 aa, Neurospora crassa
YYHNKIEAMKLEILKGQAVLRRLEAQRNDYNSRVRLLREELGLLQQPGSYVGEVVKVMSTKKVLVKVHPEGKYVCALRLLLECPVLRMGKQMEVTDLLPRRLPVVDVSDNVDITKLTVGKRVTLLSDSYKLEKMLPSSVDPLVSLMMVEKVPDSTYDMIGGLDQQIKEIKEVIELGLKHPELFESLGIAQPKGVLLYGPPGTGKTLLARAVAHHTDCKFIRVSGSELVQKYIGEGSRMVRELFVMAREHAPSIIFMDEIDSIGSSRVEGSSGGDSEVQRTMLELLNQLDGFEPTKNIKVIMATNRLDILDPALLRPGRIDRKIEFPPPSVEARADILRIHSRKMNLTRGINLTKIAEKMNGCSGAELKGVCTEAGMYALRERRVHVTQEDFELATAKILNKHDDKEVSLAKLWR

SEQ ID NO: 3428 - protein, 401 aa, Neurospora crassa
  unsure (1)..(401): unsure at all Xaa locations
MAPSTPKVDAVVEKAKAAAAPEMSAASLYGRFALAGAICCSVTHGALTPVDVYVVPPSASVYTVMALGALNSQPSASVSXISRIALLTRLHNNSVKTRIQLDPVTYNNGMIGGFKKVVQNEGAGALLTGVGPTFAGYFLQGAFKFGGYEVSFKQQSINYLGLDDRTNNTHCVYLASSAAAEFFADIALCPLEATRIRLVSQPTYASGLISGFGKMLKNEGIGAFYAGFGPILFKQXVAMLPMFRSSXHAPNRAFFLPGSPTPMSKFVVYEKVAEAVYSVYPKKDMSDSAQTAVNLGSGLIAGFAAAIVSQPADTMLSKINKVTMPDNPIPSRTMLTCFTPRPPVLPGESTTSRLVKIAKELGLKGSYTGIGARLFMVGTLTAFQFAIYGKFVLILASEMGL

SEQ ID NO: 3429 - protein, 485 aa, Neurospora crassa
  unsure (1)..(485): unsure at all Xaa locations
MAFRTALRRVAAVNAAPATRLAGAGAGAATAARRSYATASQLTHPDPTEDSPSGKMVREHVPYMVTTYSRPPPVFVKGKGSYLWDLEDRKYLDFTSGIAVNSLGHCDEEFSKIIAEQVRHNQLLLVFKMDNCQLTXRLPRQAQELVHASNLYYNPWTGALSKLLVESTKASGGMHDASSVFVCNSGSEANEAGIKFARKVGKVLDPSGSKVEIVCFQNAFHGRTMGSLSATPNPKYQAPFAPMVPGFKVGTYNDIAAIPSLVTEKTCSVIVEPIQGEGGVMPATEEFLVALGKRCREVGALLHYDEIQCGLARTGTFWAHSSLPKEAHPDILTTAKAIGNGFPIAATIVNEHVASKIKVGDHGTTFGGNPLACRLAHYIVGRLADKQLQEGVKAKSEVFLRGFEKLRNKFPSLVKEVRGKGLILGLQLSEDPTPVIKAARERGLLVITAGTNTLRFVPSLLVTEGEIEEGLKILEESFEAVMVKA

SEQ ID NO: 3430 - protein, 213 aa, Neurospora crassa
  unsure (1)..(213): unsure at all Xaa locations
FRMLFSTFKLLAFTHLFLEHVLSMAPASGPSMLPTFEVVGEWLVVSRFHKYGNGVKVGDLVVYQIPVSTSGELGVKRIMGMPGDYVLVDTPMAGGGTVEGEVLGDRGGLGEGDEVMIQVCFGLYSRXXXAHGANGWTGATTXSGNKYCXRMWXMIXVPEGHCWVVGDNLTASRDSRTFGPVPLALIRGKVFAKVQSNWLPKLIRNPLERVELE

SEQ ID NO: 3431 - protein, 333 aa, Neurospora crassa
ITSWMALMETMFPSIAKMESIGDSYEGRPIHSFRIGDHSGDNANNGTRKTILVTGGLHGREWISTSTVTYLLWSIITAYGKESMVTKLLKHFDIIFIPVVNPDGYDYTWKTDRLWRKTRQQTKVSWCHGFDLDQAFGSVSGQTNFQVDPCSESYGGDKPFQAVEATRLADWGRNQTENGVKFVGFLDLHSYSQQILFPYTSTCDEDPPNRENLEELGVGLAKAIRLSSGNFYTVSSACEGTTTRQDAANEATGGSAIDWVYRKFSFHHSSHHVVGCSEQHILTCNADELYSRYSYQVKLRDTGIYGFLLPRSQIIPTGEEMLNALKYFGDFLL

SEQ ID NO: 3432 - protein, 1234 aa, Neurospora crassa
  unsure (1)..(1234): unsure at all Xaa locations
SYKEQTVIEPFSPGTNVIVGRNGSGKSNFFAAIRFVLSDAYTNMSREERQALLHEGSGSAVMSAYVEIIFDNTDKRFSEPGDEVVIRRTIGLKKDEYSVDKKVQTRADVLKILETAGFAKENPFYIVPQGRVAAITNMKENERLNLLKEIAGTNLYDDRRIQSLKIMAETNSKREKIDELLEYIKERLSELEEEKDELRDFQEKDRERRCLEYAHWHRLQETNNNTLEQIEEVRQGGAGATTKDRVQLQKTEKEIAALDHKFQELKQTLELLAIERRQLDEDRKDTARSQAKAELKLKDLDETRHSREKAQQQQEAELNEVRRRIQAAESELAKITPDYEKWKKEEEEVAAARDLAATGRTRLLTKQTRSSQFRTKAERDAFLKSEIEETTMQLANQRANEMDAKEQVTLVENSIKQLEKEIQNIRDRLEGYGEDRSSIAEKLTKAQEAREHLYEERKRLRREEDKLSSLLANTRADRDNAEADLSHAMDSATARGLAAIRRLKRERDIPGAYGTLAELMNVPVDAYRLPVEQVAGNSLFHYVVDNEKTGTMLSEYLHKNYGGRVTFMPLEQLRPRQVKMPRASDAQPLISKIEFDPIYEKAFQQVFGRTIVCPNLSIASQYARTHGVDAITPEGDTTNKRGAMTGGFVDARRSRLEAVRRLEELRELYEQQLEDLDRIKKEDEILEQKITSANGEERKLDQQLRQFESGFDPLKVDLRTKQLQLERERRHLEDAKMRWAAIEKNLKEFDENLTAYRAEMASEFKKALSAAEERQLEEFGAEEHRLQMQLKEISKKRLELEGRKKSLETELRAHLRPQEDQLRSQAFENSATGGSGSFKDAQKELKKLKKAAAEVDRQLQENEEKTEGIAAEIAELEAHKAQKEQEQQELQKRIDQYQKKLEKNSQTKARLLQQAAEYAKNIRDLGILPEEAFGKYEKMKSEQASYHPWTILAXSAYXLEKKNQIETRLRKVNEALKKYKHINKKAFDQYNNFTTQREQLLKRRKELDTSQKSIEELIQHLDHAKDEAIERTFKQVSREFSTIFEKLVPAGHGRLVIQRKAAGSKNRNPEDSDEDGPSSAKGVESYSGVGISVSFNSKVMDEQQKIQQLSGGQKSMLFFFLILTFPPIPLTNTVXSPGLCALCLIFALQAAESSPFVIFDEVDANLDAQYRTAVAALLDSISKTQKTQFICTTFRPEIVLVADKCYGVTFHNKTSTIDCVPTEDALNFVEGQVS

SEQ ID NO: 3433 - protein, 537 aa, Neurospora crassa
  unsure (1)..(537): unsure at all Xaa locations
DGAVLRNIDACRAISSTVQTSLGPYGRNKIVINHLQKMILTSDAATILRELDVVHPAAKLLVMASQQQESEMGDATNLVIILAGELLKKAEDLLRMGLKTSDIVTGYERAQKIALDTLEELVVDKVEDLRSQAGLSKAIRTVIASKQNGSEDFLADLVAEAILAVLPKNPANFNVDNIRVVKIMGGNLEQSRVVKGMVFPKEPSGTVKKAKKAKVGVYTCPIDTSQTETKGTVLLHNAQEMLDFTKGEENQLETMIKELYNSGLRVVVAGSTVGELAMHYLNRYGILVLKVLSKFELRRVCRVVGATPLARLGAPMPDEMGSIDVVETMEIGGDRVTVFRQEDEVTRTATLVLRGATQNHLDDVERAVDDGVNVVKAITKDARLVPGAGATEIQLVERIQAIGERTQGLAQYSIKKFGEAFEVVPRLLAESAGLDATEVLSRLYAAHQKKDTWSTGVDIEVCFIHLFILIPAVNXQVHRTTDNTGTLDAVKEGILDLLVTKQWAIKLATEAARTVLSVDQIIVARQAGGPKPPGPNP

SEQ ID NO: 3434 - protein, 334 aa, Neurospora crassa
  unsure (1)..(334): unsure at all Xaa locations
MDGRKHPSSFQQLEKLGEGTYATVRDLSLAQNCPSVNREKYLXGANGXHYVLRVFKGRNRQTGELVALKEIHLDSEEGTPSTAIREISLMKELKHENIVALHDVIHTENKLMLVFEYMDGDLKKFMDTNGERGALKPHVIKSFMHQLLKGIDFCHKNRVLHRDLKPQNLLINSKGALKLGDFGLARAFGIPVNTFSNEVVTLWYRAPDVLLGSRTYNTSIDIWSAGCIMAEMFTGRPLFPGTTNEDQIVRIFRIMGTPTERTWPGLTSFPEYKPNWQMYATQSLSSILPQIDRDGIDLLQRMLQLRPELRISAHDALQHHWFNDLVHQQHHHQA

SEQ ID NO: 3435 - protein, 680 aa, Neurospora crassa
GQQHQSSIDDTVTLQRHVPPTHPFAAPDMSLIFDFSPVPLLLLSSSCCITRVSKRFCQDWHVTEEDCIGKFLLPFLESQIRETGASKSRLIAEAVDDAVAARSERTSKAITVKSAFTCRARVIPIFRDAELVSIYLEWHERPSSEVLDNEQVQPGLSTDEAFRILVQATKDYAIFLLDTKGHIATWNTGAQLLKGYTREEIIGKHFSIFYGKEDLDIKKPDMELDICLREGRVEDEGWRYKKDGTRFWANVVITAVYKNGVHVGFGKVTRDLTERKASESRLIAAYEESEKLKSDFLANMSHEIRTPMHGMLSACALLLDSPLTERQRDIVNIMDESGQILLQVINDILDYSKLASGSFSVSSDVVGVASIITSVVRAVQTTLPPAVHFELFLAPNLPKSVQGDPLRYRQIVQNIVGNAAKFTDKGSIRVKASVDSEDNDSYTILTEVIDTGIGIRESASASLFTPFSQFDLTTTKRYKGTGLGLSIAKSLAELMGGRIGYRPNPERHGSVFWFTARFKKIKSLEQIQDWKHQMAAKDGSPISPIQPDVTVLQQRLASVAGTKSILLVEDNVINQKVMLGMLRSLGFRSIDLAADGAAAVKMVTGKPVGYDIVLMDINMPILDGNEASQKIRDAGVKVPIIAMTAYALKGDREKCLEYGMNDYVPKPVDRKFLIKVLATW

SEQ ID NO: 3436 - protein, 432 aa, Neurospora crassa
  unsure (1)..(432): unsure at all Xaa locations
FIPLINDNFGRRWCIMFGSCIMIIGTFIQGFSKNGVPTSCYDFFARSYXRPPAPMYIIARAIIGFGLPYAIVAGSCLIGELAYPKERPILTSLFNACYFIGAIVAAGCTYGTQRITNDWSWRIPSLLQMAPSLLQVIFVFFLPESPRYLMSKHRLEEAKNVLIRYHAEGNADSDFVKAEIAEIKVTLEIELEHSKQSWADMIRTAGMRRRVLIGSLLGLFTQLSGNVVISYFLGDVLKLIGYTDPSFQTKYNLGNQCWSLVCGVSAAMVVMRFRRRTMYLTGIFSILAVYVGWTVCTAVFIAYKNPVAAKFSLFWIYAYSPAYNLCFNALTYSQSSFYHLPCSLSSGVLFRCXQMAAYLVEIFPYAQRARGIAIFQFWGKAAQFFGTNVNPIGTQAIGWKYLLVYCCWIFAEAALIWFLWPETSNRSLEELA

SEQ ID NO: 3437 - protein, 224 aa, Neurospora crassa
FMAKLFGTKEVRVLMLGLDAAGKTTILYKLKLQDHVTTIPTVGFNVETVTLRNIKFNIWDVGGQDKIRPLWRHYYSGTQGLIFVVDSADHNRIDEARVELHRIINDREMKDCLLLVFANKQDLLVVSTPFFFFPWNCIFDEVSAALGSLFLCSLRSNWGFWDKSLRGMDEPMLTRHSTAMTPQEVTEKLQLNKLKDRIYAVQPTIAIDKAGLQEGFNWLSDNMK

SEQ ID NO: 3438 - protein, 482 aa, Neurospora crassa
  unsure (1)..(482): unsure at all Xaa locations
QSDTNRPQSQTSVAMPAPXTTKPRSALPTATKSSASSSSGTYGRVYKATGRQGQTGEFAIKKFKPDKEGEAVVNYTGISQSAVREMALCSELRNHANVIRLIEIILEDKCIFMVFEYAEHDLLQIIHHHTQTPRHPIAPGTIKSIMYQLLQGVQYLHTNWVLHRDLKPANIMVTSSGEVKIGDLGLARVFKQPIHNLYMGDKVVVTIWYRAPELLLGSKHYTTAIDLWAVGCIFAELLSLRPIFKGEEAKMDSKKTVPFQKHQMQKIVDVMGLPTRERWPLLASMPEYSQLSTLQPPLLSTNTSHSHGGGHHPYGHRSQQQPPASQNTHGNLQKWYHQTTVSTPLTSLGAEGYKLLASLLEYDPEKRLTAADALVHPFFTSPTSTPLASLNSNTANSTSQGTGAAAVNWSPTNCFEGLKNETYPCRRVSQDDNDIGFGTGTGNQSGSRVNTAAAGTGTGLVMGQAQSQVQAMGGSLGNIGGH

SEQ ID NO: 3439 - protein, 408 aa, Neurospora crassa
VLDGGTGFLKVGYAAQNFPEFQYPSIVGRPILRAEEAKSLSDSSDIVIKDIMCGDEAAAARTMLQISYPMENGIVKKWDDMQHLWDYTFHEKMKVDTRGRKILLTEPPLNPLKNREQMTEVMFERYDFGGVYVAIQAVLALYAQGYVTAPLHGDLRKQVADRQRAGLSSGVVVDSGDGVTHIVPVYESVVLNHLTRRLDVAGRDVTRNLIALLLRRGYALNRTADFETVRQIKEKLCYVSYDLELDKRLSEDTTVLVESYTLPDGRVIRVGSERFEAPECLFQPHLVDCDQPGIAEFLFNTIQAADVDVRSSLFKAIVLSGGSSMYPGLPSRLEKELKQLWLTRVLGGNPERLSKFKVRIEDPPRRRHMVFLGGAVLANIMADKESMWITKQEWEEQGARVLEKLGPR

SEQ ID NO: 3440 - protein, 522 aa, Neurospora crassa
  unsure (1)..(522): unsure at all Xaa locations
NLRDLTMYLVVLIIVSTLGPLQFGFHLVCAPSFPSPTYLYXQSFQAELNAPEDVITCRKTSISSTISSLLSYVKNSSSDVDCIPMTRPQFATVSAIFTIGGLFGALMAGPFTSSRGRWLSMQLTAAFYIVGSLIETLSHSVPVLSTGRFLTGVGAGASTVIVPLYISEIAPPAQRGLFGAFTQISINLGILISQTMGYFLSHDSAWRWILGSGVVVAAAQGFGLLLAPESPKWTASARGDVAQARRTLQRIRGKNANIDEEVESWGQGSGRPTSEEESLLHSVEDRMEGLSRRDTSSRSNSPSPSTSSRPHPHKASKPHLGFVQVLKDPNTRPAIIAVVGIMFAQQLCGINSIIMYSVSLFRDLLPPSFSSGLLTICISIINLGTTTACSPLPDKFGRKACLLASTIGQGVSSLVLALSIMFGVKILSAIAALFFVAFFAVGLGPVPFILASELVGEEAVGATQSWALGASYIATFLVAFGFPVVNEALNRILGGAGWVYFIFAGLAAFWALFIVRIVPETK

SEQ ID NO: 3441 - protein, 576 aa, Neurospora crassa
  unsure (1)..(576): unsure at all Xaa locations
MPTVHLLDYVAGNVRSLVNAIERVGYSVEWVRSPEEVANADVCANLNSFTETXPLLTRTCSHVXKLILPGVGHFGHCLSQLASAGYMAPIRAHIESGKPFMGICVGLQALFEGSSEDPNCPGLGVLPGKLDRFDDTSKSVPHIGWNDASCPTNPNLFGLNPDSKYYYVHSYKMPYTKGQLESQGWAVATGVYGGETFIGAIAKGNVMATQFHPEKSGVAGLRVIRAFLDGSGAAALASHPPQEVPNAGDDALVSKEGLTRRVIACLDVRTNDQGDLVVTKGDQYDVREKSDDRNVRNLGKPVEMARKYYEQGADEVTFLNITSFRDCPVADLPMLEILRLTSKTVFVPLTVGGGIRDTVDTDGTKVSALEIATMYFQSGADKVSIGSDAVIAAEEYYASGKTLFGNTAIEQISKAYGNQAVVVSVDPKRVYVPKPDATRHHTVKTSYPGPKGEEYCWYACTIKGGRETRDLDVVELTQAVEAMGCGEILLNCIDKDGTNSGFDLELIRQVKAAVRIPVIASSGAGNPGHFEEVFRETTTDAALGAGMFHRGEYTVQQVKEELKARGLVVRQFEGDL

SEQ ID NO: 3442 - protein, 320 aa, Neurospora crassa
MLPSYNHQLPGGHESGQYLAVDIGGSTLRVGVVDLKGRQTTDDDDSTIVHMDSYKIDRNVRLLRGAFFFKWMARKVETSLKKAIDAGHISKAEYELGNPMPMGLAWSFPLEYVKHFILHSSQDQPTNDTTGKHRPMEETSVPWAKSFLACDGLMGQDLGATCNKILQELRVNVEVVSIVNDSNATLLSSAYSSPSARFGLILGTGVNIAAHLPVNLIGKSKFGERPDSWYEQASHVMVNTELGMFGRDILPLTRWDKILKAGHERPDFQPLEHLVSGYYLGEVFRIALLEAIKTTGLLGGKIPPLLLDAYSMDTGTMSLI

SEQ ID NO: 3443 - protein, 641 aa, Neurospora crassa
KHSILDSLNNAQARAVTSDAATVAILAGPGSGKTHTLTSRVVWLVDHVGYQPQDVVVATFTVKAAREMKERIGKALGNGRENKIILGTFHSIARRYLAAYGRHIGLSEKFSIADDNDSRSIITRICKRLQLGLDPPMAKAWISKKKAKGMEPSPSSLPQPPKKQPVQRGQRDLEVCYTEYQTHLERSNLLDYDDLLVRCVELLRKFPSCVSNIQTVLIDEYQDTNGVQYELMRLLAQKHQRITIVGDPDQSIYGWRSAEIKNLWRLLRDYPKTDEISLEENYRSSQAILDLSLLVIQQDKKRYQKVLKPVHDRGSRPVLRKLKNASTEAEWIVAEIRRALLMSGSMLTHNDVAVLLRSASLSRHVESALGKAGIPYRMVGGFKFYERSEIKTILDYLRVIHQPDNNDAFGRIMNVPKRGIGDGTIKNLIEEAEKSSLSLYSLLVKHCRGDRTAKTKITKHAEQKISGELIRMLNGIRKKMEEAAESNPFGLVDLIEHLLTALNFQNYLQVTYPDDHEQRWANVQEFISLANDFVRDLHVSGEDALPEIEGLEQSKEEEVLPQFLANVSLASDAQKGEEGQENKPLVTISTIHAAKGLEWPIVFIPAVYNGSIPHMRSEDGDEERRLLYVAMTRAQSLLYLS

SEQ ID NO: 3444 - protein, 1405 aa, Neurospora crassa
  unsure (1)..(1405): unsure at all Xaa locations
MDPIASHWTPSHQHSNSLGQRSEMRQSTSFDSRDSRPTSPHNVSSPVTYRPMDPQNFLSVPGAAGRSRQNSVNSNDETRSIASSQGETVIGGSSHQGDKIGRPLSSNTSDNAQIMNDPDALKPDQGREADFEVVDNPFAYTPGQLNKMFNPKSLSAFWKLGGLAGLEKGLRTDRKAGLSMDEVEVDGRVTFDEATARPSGNPPAQPKAATETVLAKTDSHAAADHHKKHHGDDHYTSRKRVFSDNRLPEKKGKSLLELMWITYNDKVLILLSIAAVVSLAIGLYQTFGQAHKPGEAKVEWVEGVAIIVAIVIVVMVGSLNDYQKERQFAKLNKKKQDRLVKAIRSGKTVEISVFDVLVGDVLHLEPGDMIPVDGILIEGYNVKCDESQATGESDIIRKRPADEVYAAIENNENVKKMDPFIQSGARVMEGMGTYLVTSTGIYSSYGRTLMALDEDPEMTPLQSKLNVIAEYIAKLGGAAGLLLFIVLFIIFLVKLPKSQHTPAEKGQQFLNIFIVVVTIIVVAVPEGLPLAVTLALAFATTRMLRDNNLVRHLKACEVMGNATTICSDKTGTLTQNKMQIVAGTVGTTHRFGGVGSAGGLNPETPDSPTEADVTAKEVVASLDASVKELLLKSISLNSTAFEGEIDGVKSFVGSKTETALLEFAKEHLAMGPIAEERANAKILHLIPFDSGRKCMGVVVALDNGKARLYVKGASEIMLEKCTQILRDPSNGITAGPLTQENRETVLKLIETYARNSLRTIGIIYRDFAHWPPAKARRTGEDKEEIVFEDICSQMTFVGMVGIKDPLRPGVPEAVQLCQKAGVVVRMVTGDNKITAEAIAKDCGILQPNSLVMEGPEFRNLSKAKQEEIIPRLHVLARSSPEDKRILVKRLKDMGEIVAVTGDGTNDAPALKMADVGFSMGIAGTEVAKEASAIILMDDNFNSIVKALKWGRAVNDAVKRFLQFQLTVNVTAVILTFISAVSNKEQDSVLTAVQLLWVNLIMDTLAALALATDPPADSVLDRKPERRGSGIISTTMWKMIIGQAIYQLAITLLIYFGKQGVLPNYDDNVTDDQIQTLVFNTFVWMQIFNQWKXVIXNMSLPPKTCRXPHSISNRRLDNNFNIFEGLTKNLFFLGISAIMMGGQVLIVFVGGQAFSIAKEKQTGAMWAYALILGFISIPVGMIIRLIPDSLFERMVPEYIKRRANKTPDLTVSDDERFEYYPPAFAEVRDELAFLKQFKGGRINNLKFAMKHPRETFMPKRSASHSRSNSKSNSINVPMTPIRKDSTGGAPSIAPPTPDSRRRSRSTRSRSNSALGASMVMTGIIAGSVAAGWAPSPVERRPDSDFGLFPPKSSPHAESSQSEVQPSQRSLTPSINEEQETPDIVPSIVEQTVPILSVPKPPGQKSA

SEQ ID NO: 3445 - protein, 308 aa, Neurospora crassa
HHVLFTTHRFKIRTGPPVPPSGIWASPITLFNLRDIIDFQSQISYFQYLSSPKIGLAGFFVFGTESEASLLTRKERCDLLRCARDSVPSGFPIMAGVSAPSVRQVREHIIDAIAFGANYVVVSPPVGSEPNKKGTKQENETVDAFFDDIVHYSELRILISDEDGGIDLTSELIIRQALRHKGKIVGAHLRSGNNVVGKITRLAREFPPSQKEFAIFAGQSDYLVGGLAAGSSGCITAFANVLPWALVWQYHEYVNGEKNNDKVKKADALRVSGMLAKVETQLLESGGGIAAIKFAASLYTGWRAGVVK

SEQ ID NO: 3446 - protein, 680 aa, Neurospora crassa
REAAIVSLLNHQYICGLRDNLRTRWHWYMLFEYVNGGQMLDYIISHGKLKEKQARKFARQIASAVDYCHRNSIVHRDLKIENILISKTGDIKIIDFGLSNLFSPEEDRKLKTYCGSLYFAAPELLQARPYTGPEVDVWSFGVVLFVLVCGKVPFDDQYMPALHQKIKKGRLTIPTGFLPVCFNTQFLAPLKVMLTWLSAECKHLISRMLVTDPKQRATMQEVMNHPWMLKGYNGPPDNYLPRREPLTLPLDPEVISQMTGFKFGPPEYITAELTKRIKSPKYQAAVRRLEKERERPEPIAKDAEKKRGFGFDFYKRRNSVTSKDTLTAASSEGLSLGDDPLNAFDPLISIYYLVREKLERERNHVYIDLQQPSKAQQPPPSSSQTVMPVPPSPVIRPKEKHSLADIVPPQPVHNAEPRSRQRTRSHSEDQPREPIQGGLLSPDMVPAKKESTAAGILRRLSTRDRRKEPPATASSTDGKPPLRGSMSMRAKSLGHARRESIQMRRAKREAEAAAAQQAQSQTTEPQRSYQSHHHSVREETDAELVDSDIRGETSGGSNERLEPEDPDLVKPVFLKGIFSVSTTSTKPLSEIRADIKRVLRVLGVEFNEIKGGFSCRHTPSINHAERQPTVMTEGGNEIEFEILIVKVPIVSLHGVQFKRLAGNTWQYKALAEQIVRELRL

SEQ ID NO: 3447 - protein, 1024 aa, Neurospora crassa
  unsure (1)..(1024): unsure at all Xaa locations
HFXILIVQADRTNSVRTIHLRGDWFDTPASVSAYVHIIGQFEDQGKCVLDNNQNMLILHPDQLISSTVVADSFSCMRRAVLQDRVKATSDLTPALVYGTILHEIFQEALVANKWDPAFLTNVINKTLEKHLEDLYILKVSMDDAKSHVQSKMPELRSWAQLFVTSQPKPDAIVQGRNGDKATMCVSKLLDVEEHVWSPMYGLKGNIDATVQVTMRDPPARGSSSKAPTTKTLTVPFEVKTGKNVNSNHQAQTALYNLLLSDRYDIEIVYGILYYMETSQTLRIPAVRHEIRHMIMQRNQLACYIRERSVQLPPMKKNKNACGRCYAQTTCFIYHKLADDGDGETSAMNEKFDEVVHHLSPTHKAFFLKWEELLTKEEKESQKLRRELWTMISTEREKVGRCFANVIIEEGSAYENHQQMGKTNRFAYTFIKEKPAPGFSFLDSQLTVGEPIVISDEQGHFALALGYVTSVRKTRIAVAVDRRLHNARVRQPGFDEADNQTFASIMQVPGSGGNAPEDREAGPVRYRLDKDEFSNGMATVRNNLVQIMADGVLGSRQIRSLVVDLEAPRFKAVPTQYILPSTASGQGLNVDQKAAVEKVMSAQDYALVLGMPGTGKTTTIAHIIRALVAQKKTVLLTSYTHTAVDNILLKLKDDGIPILRLGPPVKVHPEVPSFATLAGVPKTSFSEIHEAWNDTPIVATTCLGINHPVFAERIFDYCIVDEASQITLPICLGPIRMARKFVLVGDHNQLPPLVQNEEARLGGLDVSLFKLLSEKHPQSVVNLEHQYRMCEDIMTLSNTLIYNGRLKCGTEALRTTSLEIPDMDALATKHFDADSFLAHSQQHPLKEGDKLSFCPSPTPTTCWLRDLLDPSARVRFINTDSLLPHSREEKSTRGQRIVNPLESRIVCQLVDSLLTVGVPASEIGVMTHYRSQLALLKHNMKNTLGGSAGAIRAGVKVAAEEIEMHTADRFQGRDKSVVVLSLVRSNEGCSIGELLKDWRRINVAFTRAKTKLLVVGSRETLRGAS

SEQ ID NO: 3448 - protein, 1610 aa, Neurospora crassa
  unsure (1)..(1610): unsure at all Xaa locations
LPRPAGVGTEERRTEYRDGLGPSSVPMIKANLELQYQRSGPGAPKQSTTLQVRTVSAMLQILEEFLPKSPIPELIVVQRQCITAYPRLINYGEGFDDIIDANGRDGNSLPQAANVRMEEHYKKMYSDEVAVRTIVEVLDQYKHSRDPLEQDTFACMIHGLFDEYAHYENYPLEALATTAVLFGGIISHKLVSELPLKIGLGMILEAVRDHQPQEPMYKFGLQALLQLLPRLREWPGFCTQLLLIPGLQNTEARKKAEDVLREHEEETMRARGGALPLGATMGNDNMTNGNLDEAHGSEQHPPPFASVNVDPPPPGVIYEDPTAEAQGKIQFFLNNLTETTLQTMYKDLRDMLETKHQQWFASHLVEERAKMQPNYHQVYLDLVKMFEDKSLWAEVLRETYVSVQRMLNSDVTLQNSTERTHLKNLGGWLGLLTLARNKPIKHRNIAFKQLLMEAHDTKRLLIVIPFVCKVLAQGASSEVFQPPNPWLMDIIHLLIELYHNAELKLNLKFEIEVLCKGLKLDHKSIEPSGEILNRVPVEEVPDLNGQELEPYDNTSINGMGSVAGGLPAHASLPIPDLSASLSIPPTEVIDQAKLHSITSQAVTRALQEIIQPVVDRSVTIAAIATQQMIHKDFATEPDENRVRDAAINMVKSTAGSLALVTSKEPLRSNMANYLRALSAEIGLVLPEGIIMLCINSNLDLASSVIEKSAEDRAVPEIEEMIQPEIEARRRHRAQRPNEPYMDPGLTRWAWTIPHPFKLNPSMTGLNAEQMAIYDDFARQPRAVASTTGPSHAASTSDARSLANEVLGDQFNTISALPTPAETPSLPHLGGQLQHYPQGSGGLANGRQAGLNQVDARTIADRVNKLLESLTAAATGATEEHFNELPRAHQVLDIIDALVQLIIKTQQTSEEFAAYAATQIAQLIFRQPGDTLLLESLVHVLETLRKIAGPATSQQIRSLFHQQPAEYFLNLSLIAALLGTDLLDWRSIDAAMSMALQQRKEGSVEFLEQLVDLTLLSESPLALYADFVRSLEEAWAWISENPDVPGGQSLKSKILAPPPDLPEGLTPAEILAIRQDQMEYVFDEWVHLCNNPAASSSKSSTIFVQQMRSRGVIASTDDFLMFARLAIDKSVDRFEHVVHLNGTITEAYQAIDALGKMILIFFQSHEDNADGQTARAAFIDSILALGVLVLNSHHVKRGDAFNSRVFVRFFSYLLHGIHSLEELPENERDRFMLSFAERLYDLRPSLYPGFVLGWLTLVTHRVFQPAMLQMANNAGWEAYTKILRDLLSYQGELLKPLELSIFAKEMYQAVLKLLIILGHDFPDYVSANHVLLCQSLPPHATQLRNMILLATPASAAKPTDAFQPGLKLDQIADIKEAAISVYDPAEQLRQLGLLDILDQALQNGPSEDAIAQITHAITRTGSGTTDYGFVPIDVNRQVIDAVITHIGNFAVNRAATRNDASVFVPGAPDLKTLQMLITELSPDTRYFVLNSMANWLRFTSAHTHYFIQVFLDFFGHDVASTDPEEMDIRQQIVRILLERLIGYWPYPWGLIITTMELVKNEKYNFFELPFIKATPEVRRVFEDKVRQHXNRSITGGEQMRWGFGRSPIQGS

SEQ ID NO: 3449 - protein, 295 aa, Neurospora crassa
  unsure (1)..(295): unsure at all Xaa locations
MDAIQTHPSNAAQAKAFTAPGSLSFPGAAGELTPPTSTANSDKSAAVNGAIGAQAANGNGVTPATPAATPAANQGPTSGMTPTLQXEDLGFSFFPQGAVGXPKQNIVATVNLDCRLDLKTIALHARNAEVRDGLDCGVPXTCLSWPWLSNSRKQYNPKRFAAVIMRIREPKTTALIFASGKMVVTGAKSEDDSKLASRKYARIIQKLGFNAKFTDFKIQNIVGSCDIKFPIRLEGLASKHHNFSSYEPELFPGLIYRMIKPKIVLLIFVSGKIVLTGAKVREEIYQAFEMIYPVL

SEQ ID NO: 3450 - protein, 893 aa, Neurospora crassa
  unsure (1)..(893): unsure at all Xaa locations
KEESIVSSTGHLPGLAVPLLPHQVEGVRWMINRELGPLKRGRVPKGGLLADDMGYLDSVLACFXLYANFHLGLGKTLQSISLIIGNRKPESSSAPGWKAHFKDISKATLVVAPLALIRQWEAELKDRVMPDLNIKVCVHHGPKRSTVPAELAKYDVVITTYQILVSEHDKSHPDPNKGAQAGCFGVHWFRVILDEAHRXIPKVIYILQSFTKTNIXHHSIKNRNTKAAKACCALRSEYRWCLTGTPMQNNLDELQSLIHFLRIAPYDNLTEWRAQIDTPMKQGKGHIAIQRLHSILRCFMKRRTKEVLTEKGALVAGGKEALAKAEENGEKAPEAAFKVTERKVVTIETEFSPAESAFYKALEERADQSLEKMMKGRTVNYANALVLLLRLRQACNHPRLAQTKLDKDRDALAVDSATAPTAGGKKKKNAYDSQSQTSSVDDLADMMGGMGIQARQCDMCLGEMTKKEIQEGQLRCQGCEDSLSQLMKEQESTQESVESKESKKHKKKKVSVVKEKVKVERKTRGRGRKVVVDSDDEEEGGEWEDEEETPKKDKKSRDNRKRVVDSDDEEDEGTWLVGESQRSALDLGVAGGTDDENAEGTGEDIDSNEEISEDSEDPEEDSFVVKDSDDDDDDDDESVNSDEIVGSGDEDDTFASVSKLSSQVVKQSESEESETAASSSEDSAISDSELEHSSETDSEAEYGTKRSPKGPVQISSKIHELIAILRREAPTHKFIVFSQFTSMLDLVEPFLRHHLPDIKHVRYDGKMSNDAREASLHSLRKDPRTRILLCSLKCGSLGLNLTAATRVIIVEPFWNPFVEEQAIDRVHRLTQTVDVVVYKLTVRGTVEARILELQEKKRLLAQTAVEGSTERGGNKKKKGQGLKLGLQEILDLF

SEQ ID NO: 3451 - protein, 272 aa, Neurospora crassa
PFINGGLSGMVATTVIQPIDMIKVRIQLAGEGKAGGPKPTPLGVTRDIIASGKAMDLYTGLSAGLLRQAVYTTARIGCFDTFMSRLSARAKEKGQSVGFKERASAGLAAGGLAAMIGNPADLALIRMQSDGLKPVAERKNYKSVIDALGGIARNEGVAALWAGAAPTVVRAMALNFGQLAFFSEAKAQLKARTQWSSKVQTLSASAIAGFFASFFSLPFDFVKTRLQKQTRGPDGKLPYNGMVDCFAKVAKQEGVFRFYRGFGTYYVRIAPH

SEQ ID NO: 3452 - protein, 471 aa, Neurospora crassa
  unsure (1)..(471): unsure at all Xaa locations
LSFPSHRKISEKYDKVFVTGCLEPDTSKPRANGAFVVLARNKELDGVIQSIKSIERHFNRWYHYPYVFLNDGDFDDTFKDTVKNYTSAPVEFGKVGPDMWGFPDWVDPKVAKEGIAKQGDAAVMYGGMESYHSMCRFYSGYVLRFKSXASYICXHSTAFFYKHELLQKYEWYWRLEPEIKYFCDITXYVLSLFAFPLCASRXHSTASQXPFLKMIENNKTYGFTIAVKELRETVPNIFRYASAYKRLNNITSQGLWEMFVEPQAREEARSPRARPSXGDPALRPRANKLPDIDPEAMEGEKYNMCHFWSNFEIARLDFFRSKAYEDFFQMMDHSGGFWMERVCFLSFFFTHFFPSSAANNHHSGVMPPIHSLAAGALLGPRDIHYFRDFGYRHTTIQHCPANAPARQLPREPYLEKTTLDEKKRIEEDKYWDEYDTPKENGVGCRCRCDTDIVDVEGKEGSCLAEWVDVAG

SEQ ID NO: 3453 - protein, 432 aa, Neurospora crassa
WTKEPHLRKLYGMTSFLLVASATTGYDSMLLNTSQQIHAWNHFFFPETKLNPDLADPVEDSKLAILNNMFNIGSILSFVITPYVADNYGRKPSIVAGCMFMIFGGFLTGFCNGYGSRYLPFLSPSSGSLLTMTVYMGGRFLLGFGNSLAQMASPLLLTEIVHPQHRGPVTAIYNCLWNAGALLVSCIAWGTSNIASNWSWRSITLLQVLPSAVQLAGIWWLPESPRYLINKERHDEALDILAKWHAGGDRLNRTVQFEFREIKETIRIQKELDEASTYVDFIRTKGNRWRLAIIISLGVISQYSGNALFSNYMNAVYGGAGITEQSHKLAISTGKMILDLIVTIFAALNVDRFGRRPLFLMSTCGMVVSFACWTATGAAYEHDGETNMTIGYTQLVFIWIFGIFYDIGFSGMLVAYALEILPFHLRAKGMML

SEQ ID NO: 3454 - protein, 390 aa, Neurospora crassa
  unsure (1)..(390): unsure at all Xaa locations
ASAQLDKYAKLAGLSYFGTAVDNPRLYNEQYMSVLQGSGEFGSLTPINAQKWKKTEEVQGVFTFAEADAIANTAKAGVGGMKTLRCHTMVWYKGLPSWGMSSYVCRGVERGTNWKLTRENNALVETTYSRDDMEKILAAHIQNLAQYFKGRCYAWDVVNEAIDENGVFRQSPSTSFHAGLHALSIPPIPWLFXADIPQVYKAMGLDFITFSFKTAAKADPGAKLYYNDYALESPSLSPGPKISITLAMLRTVKAQGGTVHGVGFQSHLKVGLVPARAEIVNTMQQFLEVVDEVAITELDIRHSPLKVPSTREMWNAQARDYGEVVGACLDVNKGYGGRKCVGVTLWDFTDKYSWVPSEIPTEGEACMWDNNYVKKPAYWTVLNMFKAYAA

SEQ ID NO: 3455 - protein, 465 aa, Neurospora crassa
NHSLKSRHIQFIALGGTIGTGLFLGIGNAFTHAGPLSILLGYTFTGLAVFGMMQCLGEMATWLPLPGAIPQFCARYVDDALGFAVGWNNWYSAAITLCAEISAASLVIGFWEGAQSVNVAVWISIIWVVIIFLNIFAVSLYGEAEFWFASMKLITIVGLLIMAFIVDLGGNPRHERLGFRYWKNPGAMKEYPPQVHGDLGRFLGLFSTLVNAAFSYGGVEMVAVAAGEAENPRKNIPKAVRRVFWRILFFYVLGSLAIGVLVSSNDKGLLDAQAEGRSDAAASPWVIGIKNAGISVLPSIINAVILTSATSSGNAFLYTGSRYLYALAQNRQAPRIFLTCSKKGVPYYAVAATAIIGGLTYLSVDPNGGAAKAFSWFQNLTTIASLFTWCSICVAYLRFYKALKAQGISRDTLVFKSRFQPYTAWFALIYFAVIIIFSGFAVFIKGNWDVAGKSPLTSSMSPFCL

SEQ ID NO: 3456 - protein, 271 aa, Neurospora crassa
  unsure (1)..(271): unsure at all Xaa locations
CFQGRANRHHDQGRRQVDAYIAQPTGSQKTGKALLFLPDIIGIWQNSKLMADQLAAQGYLTMVLDILNGDPLPLNRPDDFDIMGWLTKGSTGDNPHTKDFVDPIVQAGIKALKEQYGATKIGALGYCFGAKVSSVPFSFLPPHWKRWSFRLSVANSHXHAQKSLVRNMTATAPYTGIDVGFVAHPSFVEEEELAAISGPLAIAAAETDSIFPAELRHKSEEILKETGLPYQVTLYSGVSHGFAMRADLSKKPEKFAREQAFAQAVAWFGEY

SEQ ID NO: 3457 - protein, 263 aa, Neurospora crassa
TQFTREYKLVVVGGGGVGKSCLTIQLIQGHFLDEYDPTIEGALQPGPSQSTFQFSWSWLWPSEPWTNLSSIDSYRKQCTIDNEVALLDILDTAGQEEYSAMREQYMRTGEGFLLVFAINSRESFEEIRIYQQQILRVKDRDSFPMIIVGNKYDLRGERVVSEQGRFSLLHPCEGQDSTLTTLDNEGQALAAEFGTKYIETSAKTQHNVENAFYDLVREIRKEDKKLGEKVGGTSFANNNGAVKQMDVGDEDVQAGCCAKCIMM

SEQ ID NO: 3458 - protein, 981 aa, Neurospora crassa
  unsure (1)..(981): unsure at all Xaa locations
MAEQLRFDGQVVVVTGAGGGLGKAYCLFFGSRGASVVVNDLGASFKGEGNSTKVTISPTQLAIAATGCQSPITCXRVLNRLADVVVNEIKAAGGKAVANYDSVENGDKIIETAIKEFGRIDILINNAGILRDISFKNMKDEDWDLIFKVHVKGSYKTARAAWPYFRKQKFGRVINTASAAGLFGNFGQANYSAAKLGMVGFTETLAKEGLKYNIISNVIAPIAASRMTETVMPPDLLALMKPEWVVPLVAVLVHKNNTSETGSIFEVGGGHVAKLRWERSSGLLLKADESYTPGAIIKKWDQVTDFSNPQYPTGPNDFLALLEESLKLGPNDPGEKVDFKGRVALVTGGGAGIGRAYCLAFARAGASVVVNDLVNPDDVVNEIKKMGGKAVGAKFSAEDGDAVVKAAIDAFGRVDIVVNNAGILRDKAFHNMDDSLWDPVMNVHARGTYKVTKAAWPYFLKQKYGRVLNTTSTSGIYGNFGQANYSAAVSSCPLDAQXILANLCRNCAILGFSRAIALEGAKYNIYVNTIAPNAGTAMTKTILPEELVQAFKPDYVAPLVLALCSDKVPKKPTGGLYEVGSGWCGQTRWQRSGGHGFPVDVPLTPEEVVKHWNDIVTFDSRADHPEKASDSIEKIMANMENRVGEGKVXFPSSCCHERMVMYFPVPPCIIAIHTXCRILGXLLTTHLFLLXSGAAENEHLAAIKKFTGVEGKGTEYTFTERDVCLYNLGIGAKRTDIKYIFEGNEDFEVVPTFGVIPPFNTEMPFSFDDIVPNFSPMMLLHGEQYLEVRKYPIPTSGRLVSKGKLLEVVDKGSAAIVKQGITTFNAETGEELFYNEMTVFLRGCGGFGGQKKPADRGASTAANKPPARSPDAVVEVQTTEEQAAIYRLSGDYNPLHVDPAFAKVGGFKVPILHGLCSFGIAGKAVYEKYGKFKNIKVRFAGTVNPGQTLVTEMWKEGNKVVFQTKVKETGKLAISGAAAEL

SEQ ID NO: 3459 - protein, 367 aa, Neurospora crassa
QKKRQELISQLNEIRQQQAGGKNARTSKLDQIKRLDEQLRSRIAEQKTARSKVNFKSTEELDREIERLEKEVNGGMMKLVDEKKALAEISNLRKQRKSFAGFDDAQKQIDDLKAKIKEIKDSLEDPEAKALSEKYNKLQAELDAIKAEQDEAYKNLSSLRDERTKLQQLQSEKYQAIKKLKDEYYGAKKEFAKWEREQREKARERQQAERERIAKERRMERAQKMLAEASDPAYLEEIRRANSLLKYFDPSHEVAEKAPLLADKGLGAQALRKVDDSGLKGMKLVRKEERDDDYLPAVKKGKKSKKPTGAAPVATGKTFSLPPSVIEDCSFVGVEPPMAATDIPAAVEKIKAKLEQWKADQPEQTRK

SEQ ID NO: 3460 - protein, 205 aa, Neurospora crassa
  unsure (1)..(205): unsure at all Xaa locations
DAANCSCCWSKDMETGQPWLCIAGADAKVKVYDVKQGKLVKFVCIPSLLTLQVPRYXXQKQTLVGHGGGINDLVTSPLTPSLIASCSDDTTVRLWSLLPIHSAQPCMFILGGDAHTWDLLSIAFHDTGRYLLSAGHDQTINLWTIPPCPSEPVTHPLVIHYPHFSTKEIHNSLVDCVSFFGDLILSRACWEETIVLWSISGFSSS

SEQ ID NO: 3461 - protein, 260 aa, Neurospora crassa
  unsure (1)..(260): unsure at all Xaa locations
TRKTNNHAYSTFSPEGRLFQVEYSLEAIKLGSTAIGVATSEGVILGVEKRVTSTLLETSSVEKIVEIDRHIGTAMSGLQADARSMIEHARVECQSHAFNYNEKLRVESCTQAICDLALRFGESADGEESIMSRPFGVALLIAGYDEDGPSLYHAEPSGTFYRYDAKAIGSGSEGAQAELQNEYHKVGYLGCPGLYXGLIANFHLVIXSLTLEDAETLVLKTLKQVMEEKLDAKNVQLASVTKDKGFRIYTDEEMAAVVAR

SEQ ID NO: 3462 - protein, 96 aa, Neurospora crassa
TDPKKDTREPGELHQTGRIPTAINIPITTSPDSFFISEDEFEDRFGFPRPSKDSEVVFYCKAGVRSRGAAGLAREAGWEKVGEYPGSWLDWAARGG

SEQ ID NO: 3463 - protein, 531 aa, Neurospora crassa
  unsure (1)..(531): unsure at all Xaa locations
SGWTIVFTLLAVLVAWDQSMFQSRWAQMSNDXRYXQVLLRAVKYVLNKGTIAGPSWKIPFIGPFLESLDPKFEEYYAKWLSGPLSCVSVFHKXVEPPRMTCAEKSWSENXRHQSQFVVIASTRDMARKVFNSPSYVKPCVVDVAHKLLGADNWVFLDGPAHVEFRKGLNGLFTRRALEIYLPGQEEVYNRYFKSFLEITKNAGGKPVPWMPHFREVITAVSCRSFVGHYISDEAVKKIADDYYLITAALELVNFPIIIPYTKTWYGKKAADMVLAEFAKCAAKSKVRMAAGGEATCIMDAWIKQMIDSKKWREAVASGNTEGLEKPTHLLRDFTDYEISQTIFTFLFASQDATSSAATWLFQIMAQRPDVLDRVREENLKVRNGDIHAPINMEQLESMTYTRAVVRELLRYRPPVLMVPYLVKKAFPITEDYTIPKGSMVVPTTYMALRDPEVYPNPDYFDPERYYSGDAEAKGAKNYLVFGVGPHYCLGQHYAQLNLALFVGKASLLLDWKHHPTPLSEEIKVFATIFPK

SEQ ID NO: 3464 - protein, 1028 aa, Neurospora crassa
  unsure (1)..(1028): unsure at all Xaa locations
NSPXYPGGPQQHHNTMATPMAHSSDAGFMMSDGIASRGGATPRARNGHPSSSSARPRGPPSESLGAASEDEGEEGFADDQVPVRSRPRNIADIPRVQDRIGVMVQRAFEAFIDGYEDPRNQPNMYYLVYLADTGASYVETPTSSGQPTSSAVTTDKYYVAQIHGMRTYSLSTFYVDYKHVASWQDGTLAEAITNSYYRFLPFLTAALHSRIAAHEPQYFNEHRQPTASSAHSTTAASTRGANASQSDFGIKNPNQQTDKLFAIAFYNLPLVSRVRSMRARNVGQLLAISGTVTRTSEVRPELALATFVCQACYAVVPNVEQTFRYTEPTQCPNLTCQNRTSWQLDIRQSTFVDWQKVRVQENSSEIPTGSMPRTMDVILRGELVDRAKAGEKCIFTGALIVVPDVSQLGLPGVRNVSVRDDRGADAGGSGVSGLKALGVRDLTYRLAFLACMVTPDVSAIGASGDALLMDIVGTLNSSAAAETAETIKEAQEALLSSYTSAEMEDLRAMVHSDHIYARLVQSLAPTVYGHEVVKKGILLQLLSGVSKTTAEGMALRGDINICIVGDPSTSKSQFLKYVVNFAPRAVYTSGKASSAAGLTAAVVKDEETGEFTIEAGALMLADNGICCIDEFDKMDIADQVAIHEAMEQQTISIAKAGIQATLNARTSILAAANPVGGRYNRKTTLRANINMSAPIMSRFDLFFVILDECNEQVDRHLAEHIVGLHQNRDQAIEPEFSTEQLQRYIRFARTFRPEFTDEAKEVLVQRYKDLRADDAQGGIGKNSYRITVRQLESMIRLSEAIAKANCVEEITPDFVNEAFHLLRQSIISVEHDDVEVDDEEDAPEPPADSPEALQAAAAAASRVPEADMDGDGDVDMGGEAARQPSAAPSQAHREKQTISYDKYISIVNLIVSKVAEDETQGSGEGIEGEQLVEWYLEQKEEEMATEEEYHEERRLVGKVLKRMVKVCFCPLFLPADXATANEIEKKQDNILMAIRGQGIVGEEGTVGEGTSARAEGNIVYVLHPNCAV

SEQ ID NO: 3465 - protein, 401 aa, Neurospora crassa
FHTTNRLLATPRDPYGVLGVDRSASQSDIKKAYYGLAKKYHPDTNKDPQAKDKFAEIQSAYEILSDPEKRKQFDQFGAAGFEAGGTPGPGGEPFGGGHPFGGFGGRGGFGANINLDDLFSAFTGGGRGPFGGGGGGRGPFQPEIFEGDDIEVQVQVSFMEAAKGTKKTITILPLKQCGTCSGSGLKKGTQRSTCKSCGGSGQKVVTVMGGFQMGTVCNACNGSGTVTPKGSECSTCSGDGVVRERKTLVVDIPGGIEDGMKLRISGEGDAPPLGRQSNPNAQGTQGDLYVHVRVAPDPKFQRHGSDILYTATIPLTTAILGGEVTIPTLEGDAKVRVATGTNTGDKMTMAGKGMPKLKGRRGAKGDLRVEFRVNMPKYLSPNQRTIIEMLADEMGDKTAKR

SEQ ID NO: 3466 - protein, 549 aa, Neurospora crassa
  unsure (1)..(549): unsure at all Xaa locations
THRKLKSRHIQLIGAVYPVLPVLSTDXHKSPKTGIGGTIGTAFYVQIGKGLLNGGPASLFLAFTIWCTFILAIAMCMAEMVTYLPISSPFIRFAGRYVDEAFGFAAGWNFFIFEAAMVPFELTACNLIIHYWSDAVPVGGIIAITLVIYGLVNLLAVEWYGETEFWAALGKFLLIVGLLIFTFVVMVGGNPLGDRFGFRYWKDPGAFTELYYTGSLGRWLGFLQCLIQASFTIAGPDYVAMVCIPLSTXSTQTKQNXHLQAAGEAENPRVVMPRAFNAVFYRLTAFFVLGSLAVGILVPYNDAEMALAFSSGAPGAAASPYVVAMNRLRIRVLPDIVNAMVLTAAFSAGNSYVYCASRSLYGLALEGKAPKALLKCTRSGVPIYCVMIVLCFGLLAFLQVSNSAAVVLSWFISLMTASQLINYSVTCTSYLRWYAALKAQGVSRDKLPYKGLFQPYAGWYGLCGCFVMTFVGGYTVFLPGQWSVATFLFSXVVLGTVLSVVMWLTVSGYTMIGVCPVLFVVWKIVKKTKFHKAEEIDLHKNLDEVEEYQ

SEQ ID NO: 3467 - protein, 714 aa, Neurospora crassa
  unsure (1)..(714): unsure at all Xaa locations
AHLLGEDLYKKLANYLTDHLKHLVSEAEAHKDEALLAFYIREWQRYTNAAKYIHHLFKYLNRHWVKREMDEGKKNIYDVYTLHLVQWRDVLFQAVSKKVMDAVLKLVERQRLGETIEYTQIKQVVDSFVSLGMDEGDNTKTTLEVYRYHFERPFLEATKVFYQNESKQFVAENSVVEYMKKAEARLAEEEERVRMYLHPDIALHLKRTCNQALIAEHSTLLREEFQALLDNNREDDMRRMYSLLSRIPDGLEPLRTRFEAHVRKAGLAAVAKVAADADKLEPKVYVDALLEIHTQYQGLVERAFNKEPDFTRSLDNACKEFVNRNEVCKSGSNKSPELLAKYTDVLLRKSSTGVEEAELENTLTQIMTVFKYIQDKDVFQKFYSRMLARRLVHSNSNSDDAETSMISKLKEACGFEYTNKLQRMFQDMQISKDLNTGFKEHVASLNMDGKPLDSTYSILGTGFWPLVPPNTSFVAPAEISADCDRFTRFYKNKHEGRKLTWLWQLCKGDIKANYMKGAKMPYIFSVSAYQMAILLLFNEKDQYTFEELASITQLNADVLEGALGILVKAKVLTAEGGEGGKIGPGATFSLNYDFKNKKYRINLNVGMKSETKQEEAETNKTIEEDRKLAVAGVXPPTPSKRVDXKANAETTQSAIVRIMKARKKMKHQQLVSETINQIKARFMPKIGDIKKCIEILLDKEYLERLEDDELGYLA

SEQ ID NO: 3468 - protein, 464 aa, Neurospora crassa
  unsure (1)..(464): unsure at all Xaa locations
MGACMSKNDEETEQKKRSQKIDRDLEEDSKKLRKECKILLLGCVPLLSFAKNVFANMRARTGSGESGKSTIVKQMKIIHLKGYSDEELTNYRPTVYKNLLECAKAVVNAMHQFDIQPADPSLRPYVEFLQDYNMEGCPPGQSIDPKVGTAIQALWNDPAKEQLMERQTEFYLMDSAEXCVSGFFSFFFFFFFFSSSPXELTFADLHSFFTEVMRIVAEDYRPNEMDVLRARTKTTGIYETRFKMGQLSIQXVCLIDICYPRAPQLTQXSSMFDVGGQRSERKKWIHCFENVTSIIFCVALSEYDQVLLEESSQVCPPTTSPPGTEMVLTCNRNRMMESLLLFDSVVNSRWFMRTSIILFLNKVDIFKQKLGRSPLGNYFPDYSGGNDVNKAAKYLLWRFNQVNRAHLNLYPQYVRSICPVLVYAPSCXHCHSLTQATDTSNIRLVFAAVKETILNNALKDSGIL

SEQ ID NO: 3469 - protein, 477 aa, Neurospora crassa
CIAMVMKEGQLRRAEILSIKDTKSGRQFYCNFDNFNKRLDEWVPAARIDFEQDVEWPNPDKDKQKDAKTKKNNSTVSKKQPSKKNNQKKASKREQSVASDGQTPHPWTEFVESQPGKNNRQRGKTEDGTDVNASLEVGGDKGVKRKADEIDMDEDEIPAAKKQRQPSFSREQEIEKLRTSGSMTQNPTEISRIRNISKVEFGRYVLFPWYFSPYPQIFDQEDCIYICEFCLSYYGELKSFVRHRQKCTLHHPPGNEIYRDDYVSFFEIDGRRQRTWCRNLCLLSKMFLDHKTLYYDVDPFLFYVMTTRDDRGCHIIGYFSKEKESTDGYNVACILTLPQYQRKGYGRLLIQFSYELSKIEGKLGSPEKPLSDLGLLSYRQYWSENIIDILLGYNERKEACTIENIAVALAMTTQDVEHTLQALKMQVYHKGEHKIVVPEKLIKQREKSKAKQKRLIDPERIQWKPPVFTALNRTWGW

SEQ ID NO: 3470 - protein, 123 aa, Neurospora crassa
QTVGKTSLITRFMYDSFDNMYQATIGIDFLSKACSTPVSHSILYRPSFPDRQCATVAKTQELVEQDESLWLTLRGGKKTMYLEDRTVRLQLWDTAGQERFRSLIPSYIRDSSVAVVVYDISSM

SEQ ID NO: 3471 - protein, 1522 aa, Neurospora crassa
TQPIVARIAYLASDVVVSVQPSLAAESDFSATLKSLASSRTQSLVAKAADAVTEIIPVRHNNDPLLSVFTPIRSGRLVSVTTTSEVLLPSIAHLYKLAQLPVVLHVALGPKSLPDYTAITSIRNSGWTFLQSNSLQEAQDLALTAHALAVQSGKGVIHFFDPSSSASEQPIAAEDLSLVQEILNLDNVRRFQSASISGSSIYANDGRVAVVSEQSEPVASQTVLDARQVEAATATATDSLAPAQDGSDESAQTSQEQSEASEASATPSASVATTIDEQAPVVTSEHIYKYVTAIWAKLNDLAGRQYSAFEYSGPSNAENALFVFGSGSPLFAQAIAQAQSDDSFAKAGVLTARLYRPWLGAKLLEAIPKSVKRVAVLEQVSRKTTKWGPLLIDVLTSVKSGPGGVQTIVGHQLGYISQETVVQALRGIFQNLTSEKPVQNLEVGEREAPKEASEYGLEKPKLETAYTKILDQLFGERAYIANSIEKDNAGISNTISATPEYGFGALLARKERKQKFVSEVKEAASNGQFSSDAPKQALAKWVANAEDSKKVEEVASEAVSKLSEDGSDLSKSLLEYKQFFRKQSLWLVGSDAWSYDLGNSGVHHVLASGENVNLLIIDSTPYSERAAADANRRKKDIGLYAMNFGNAYVASTAVYSSYTQVLQAMDEADKFNGPSVVLAYLPYFGEHDSALTVLQETKKAVDIGYWPLYRWNPENEKKGEPSFSLDSERIKKELKEFLDRDNHLTQLMKKEPSFGAVLSEDFGTEIRAQQKRKAKDAYNQLLEGLFGAPLTILYASDNGNAISLSKRLGNRGRARGLKTTVMSMEDYPVEDLATEENIVFITSTAGQGEFPQNGLSFWHAVKDNTSLDLANVRYSVFGLGDSHYWPRKEDKIYYNKPAKDLDRVLANFGAKPLAPIGLGDDQDPDGFQTGYSEWEPKLWEALGVANVDGLPEEPAPRTNEDIKIESNYLRGTIVQGLNDTSTLAISPDDCQLTKFHGTYMQDDRDIRDERKAQGLEPAYSFMIRCRLPGGVSTAKQWVQMDDIANELGNETMKLTTRQTFQFHGVVKSKLKPAMQAINRALMTTIAACGDVNRNVMCSPLPAHSKYHRAVHACAKRISDHLLPNTTAYHEIWLTDDDGAKTQVGGNAVQDFEPLYGPTYLPRKFKVSIAIPPHNDVDVYAHDIGLIAIKNEDGSLAGFNLLAGGGMGATHNNKKTYPQTGRMLGFVTAADVHLACEKVMLVQRDNGDRKNRKHARLKYTIDDMGVDVFKAKVEEYWGQKFEEPRAFHFDSNVDTFGWTKDETGLNHFTMFIENGRIEDTAEFQMKTGLREIAKVHKGEFRLTPNQHLILSNVADEDKPELEKLLAQYKLDNLHHSGLRLSSSACVAFPTCGLAMAESERYLPVLITKLEGVLEEVGLKQDSIVMRMTGCPNGCARPWLAEVAFVGKAYGAYNMYLGGGYHGQRLNKLYRSSIKEEEILTIMKGLLRRYAKEREEGERFGDWTIRAGIIKATTDGRNFHEGVS

SEQ ID NO: 3472 - protein, 961 aa, Neurospora crassa
  unsure (1)..(961): unsure at all Xaa locations
MESRISNRLSSSATRTVRAFRNRGHARPGTPGSSYGNARRPLPSAPAPLHYNSPSRAASHYPRYHGGYADDVTVSMGPDDDRTDIFGPETDLSETRHLNDAYGFRSSQITLSEDPHGTHARSRYDDEDDVSTTYSSNTGTSASGVDKFEHYGPIPEEGKHERRGVRPPQMSRKEVQLINGELVLECKIPTILYSFLPRRDEVEFTHMRYTAVTCDPDDFVARGYKLRQNIGRTARETELFICVTMYNEDEFGFTRTMHAVMKNISHFCSRNKSRTWGADGWQKIVVCVVSDGREIIHPRTLDALAAMGVYQHGIAKNFVNQKAVQAHVYEYTTQVSLDSDLKFKGAEKGIVPCQMIFCLKEKNQKKLNSHRWFFNAFGKALNPNVCILLDVGTRPGGTSLYHLWKAFDTDSNVAGACGEIKAMKGRFGGNLLNPLVASQNFEYKMSNILDKPLESVFGYITVLPGALSAYRYHALQNDETGHGPLSQYFKGETLHGQHADVFTANMYLAEDRILCWELVAKRGERWVLKYVKGCTGETDVPGELPPFFAVXXVILTSCRTVPEFVSQRRRWLNGAFFAAVYSLVHFRQIWKTDHTFMRKALLHVEFLYHLLQLLFTYFSLANFYLAFYFIAGGLADPHVDPFNSDGHVARIIFNILRYVCVLLICTQFILSLGNRPQGAKRMYLASMIIYAVIMVYTTFATIFIVVRQIQPSQKSDDKPDLELGNNVFTNLIVSVASTLGLYFVMSFLYLDPWHMFTSAIQYFVLLPSYICTLQIYAFCNTHDVTWGTKGDNVMRTDLGGAIGKGSTVELEMPSDQLDIDSGYDECLRNLRDRVMVPAVPVSEDQLQQDYYKSVRTYMVVSWMVANATLAMAVSEAYGDSEIGDNFYLRFILWAVAALALFRALGSTTFAAINLVSALVEGRVRLRLNMKGFRWIKEKWGDADVKGKFEGLGDRARGLARR

SEQ ID NO: 3473 - protein, 401 aa, Neurospora crassa
TDVVILSSLRTPITRSYKGHLKDAYPEELLSVVLRATLDKVPELNPSKIEDVAVGVVLSELGGSKAARMALNHVGFDSSSTSLYTVNRACSSSLQAIASIAASIRTEAIDVGIGAGMESMTRNYGSRAIPTSYWPALKESPVKDARDCVMPMGLTSENVASRYGVSREDQDAFAVKSHQLAAQARAEGRFKEEIVPVTTQYQEVDKAGNKVGEPQTVTVTEDDGIRPTASLEGMAKLKPAFKPDGASTAGNSSQVSDGAAATLLMRRSTATALGLGDRIIGKFVAANTVGCKPDEMGIGPAVAIPKLLGQLGLENKDVDRWEINEAFASQAIYCLRELGLEEAWKDGKVNPDGGAIALGHPLGATGARMVSTLLHGLGRTGGEVGVVSMCVGTGMGMAGVF

SEQ ID NO: 3474 - protein, 372 aa, Neurospora crassa
  unsure (1)..(372): unsure at all Xaa locations
VEGQDPLIPPALLISEIPMTDAALETVVKGRKEAVGVIMGKDDRLLVVVGPCSLHDPATALEYCSRLKALSEKLKDDLVIVMRAYLEKPRTTVGWKGLINDPDIDSSFKINKGLRISRQLFCDLTSAGMPIASEMLDTISPQFLADFISVGAIGARTTESQLHRELASGLSFPVGFKNGTDGNLGVAIDAIGAAAAKHHFMGVTKQGLAAITRTKGNEHGFVILRGGTKGPNYDKENVQAAKETLIKKGQKLAIMVDCSHGKSTTLTFAHSNSDXQMTRNSNKDHRNQPKVAKVVADQIREGEKAIIGVMIESNINEGNQKVPAEGPSALKKGVSITDACIDWESTVSTLEELAEAVRERREVNGGLASGVA

SEQ ID NO: 3475 - protein, 522 aa, Neurospora crassa
  unsure (1)..(522): unsure at all Xaa locations
QQLLEYLEKLPGTAFRRLYQSPATALAIFRRMLSYHGMQLFLESDTEVLDAESIACSXLLCPSIAKVIVRGLLYMPDPFPLTSLDIWFPPEGGGKIHRDRTIAALRSLHILQVSPPSKDRTQEIQITASFKKGLQLAFEGGGEDGSFGVPSSLPVDPSIDIAYLDRYARKKWDDILHYVVNSLGVHGSSEGVSGPKASVKELLLAGRLVERRPDTRTGIGITQAGFTFLLQESNAQVWTLLLLWLEAADHTADSGMDSIDMLSFLFMLSSLELGTAYDTSALTETRRNMLPSLVDFGLIYFPRDTRQFFPTRLATTLTSTASALRTVSSAFTAATANPSGEPGTTTSTSGGPAATPDKTQTAAKGIIIETNYRIYAYTTSPLQIAVLALFCQLNMRFPNMVSGRLTRDSIRQAIGFGITADQIISYLHAHAHQQMVREATVTGKPVLPPTVVDQIRLWQLENERMQTTAGFLFKDFESTEEYAALSRYAEEIGVLVWKNDKRQLFFASKHEQLRDYLKSRKK

SEQ ID NO: 3476 - protein, 473 aa, Neurospora crassa
  unsure (1)..(473): unsure at all Xaa locations
MPFTNFDFKERYRYQNGFDSYLEXVSYSLPLLNLTSAYPNFQSEAVSGALPIGHNSPQKPPLGLYAEKLSGTAFTAPRHENKQSWLYRILPSCSHPPFVQATPRNGQEPVLERSPARLHYIPNQLRWDPFDHESDTDFVSGLRLVAGAGDPTLKQGLGMYIYAAGKSMSAQSAFYSADGDLLIVAQDGVLDIRTEFGWLLVRPMEIAVIPRGVRYQVFLPSGPVRGYALELYQGHFQLPELGPIGSNGLANVRDFQAPVACFSEDHGSIALDGPNSYTITAKFNNTLFETKQPHTPFDVVAWHGNYYPYKYDLGRFNTIGSISFDHPDPSIFTVLSAPSDHAGTAIADFVIFPPRWLVGEDTFRPPWYHRNTMSEFMGLITGAYDAKKGGKGGFVPGGASLHNVMSGHGPDAASYEGARNADLKPQKVGEGSCAFMFESCLMVGVTDWGLETCHKVQEDYNEHSWGGVKVHWK

SEQ ID NO: 3477 - protein, 318 aa, Neurospora crassa
  unsure (1)..(318): unsure at all Xaa locations
SSSGVPESWIASFCSLLGHEYFAEVSEEFIEDDFNLTGLQTQVAMYKEALEVCLFWNLFVRYVSSXSLWFXPDXMILDVEPEDDDDEEEEDEEDEEDMSGGDGINKPHGERRHHSRIASDLSVIESSAEMLYGLIHQRFICSRAGIQQMSEKYELGHFGICPRTNCNQTRTLPVGLSDTPGEDTVKLFCPSCLDVYVPPNSRFQTVDGAFFGRTFGALFLMTFPEYDLTKTGAESVSNLTRSGSDDTTVINGMYARNIAPGLGRGKIYQPKIYGFKVSEIARSGPRMQWLRSKPDDLSVLDEARRYAEQQGSDDEDES

SEQ ID NO: 3478 - protein, 265 aa, Neurospora crassa
  unsure (1)..(265): unsure at all Xaa locations
LRLHSTELINHNTKKLRFELPDRSQPSGMGLTSALLTISFPKGRWLPVIRPYTPTNDLSELPTLNNLXSHXRHPPPRRTGFVELMVKLYPGGKQSTHLHSLQPGDTLTVAPIPELKWTLNKHPHVAMIAGGAGITPMYQLVRGILTNPADKTRITLVWGVNTDEDIFLRDQLAELEQNYPGRLKTVYVVAQPAAQSPHQKGFVTRQVLEQAGLNGATEKSKGTKVLLCGPPAMEKALKGTKGWVGGGKKGVLQELGYTQDQIYNF

SEQ ID NO: 3479 - protein, 786 aa, Neurospora crassa
MADDGDMFLNFEIGDAPIKQTVKYTGGRWRDRVKAQKGEKGGQDQSKQASTARRDTGADYYTNRAAKRQRTEDGDSGRFSKTPRTGNAAERGPPPPPTHAMKTGLVSSRLFTSNPVPVTDFEELPQAEEAEPAQPSNAPLSAEAENFLSLGLSRRVSQHLATKLEMKAPTAIQKNTIPQLVKEDSDAFLQAETGSGKTLAYLLPIVHRILALSHNEDGTPKTTKVHRNSGLFAIILAPTRELCKQIAVVLEKVLRCAPWLVCTTVIGGESKKSEKARIRKGVNILIATPGRLTDHLDNTKVLDVGTVRWLVLDEGDRMMEMGFEDDIKTIVGKIRAGTLQKKNAEGVVLDGVLPSRRVTVLCSATMKMNVQKLGEISLEDAVHITASKSDMEKDAETGAVETAFSAPAQLKQAAIVTPAKLRLVTLIALLKSTFARKGSVMKAIIFISCADSVDYHFELLKSTTPRAEPEPKPEGEAPTKPNIHIESTVAPATYITSPANPTVMLHKLHGSLAQPVRSATLKAFSECKDPAVLITTDISSRGLDVPAVELVIEYDPAFAVPDHVHRIGRTARAGRAGKAVLFLLPGSEEGYISILPKSTPIAPQLYDSILQKGFATNINVPGTESGVLETDRQSWASRAEALQLHFEQRLLAPLPGATPVFESKSEKFAASKQGKKGKKDAKKDENKTPDNPLLVSARQAFRSHIRAYATHVREERVYFDITALHLGHMAKAFGLREAPGGIGGGVSRRTHRPVQPGDKTNKTSKSVGDGTARRPKKDDDDERDFG

SEQ ID NO: 3480 - protein, 600 aa, Neurospora crassa
FGRGQHSFTTAMADQKPLTSSPEEATEAGTTTTTTIPQAQIQDDVVLVEAKHAADTEHEMTLLRAIQLYPKAIGWSVLLSSTLIMEGYDLALLGSLYASPVFNKKFGELNPATGKYAVSAAWQSGLSNGARAGEIFGLIFAGWAADRIGYKKTTIASLVLMITFIFVLFFAPNVKVLVVGEVLCGKFTCKPVFMDVPTVPSQGSIDTRRLRDVVYLMEGQRCMLANHLRSVRTKTGIPWGAFQSVTPAYASEVAPMVLRPYLTTFINMCWVIGQFFAAAVNKGSVGRTDQWAYRIPFGVQWVWPIPILAGLVFAPESPWWYVRHDRREEAKQSLLRLTSRNQPGFNVDETLAMIEHTNELEKQMKEGVTFRDCFRGVDLRRTEIVVGIWLVQTLGGQNLMGYFSYFLTQAGMDPSNSFSLSMGQYALGMVGTAGSWFLMSRVGRRRIHFSGLCAQFCLLAIVGCLSFGGNKASVWAIGGVLVAFTFVYDFAVGPVTYCLISELSSTRLKAKTIVLARAAYNASNIFVNVMTNYQLSSTAWNWGARTAFFWAGSCLLSAIWVFFRLPEPKGRTYAELDILFEKKVTARKFRKTKVDPFDLR

SEQ ID NO: 3481 - protein, 591 aa, Neurospora crassa
WWKEAVFYQVYPASFKDSNNDGWGDIPGLIAKIDYLHDLGVDCVWLSPMFESPQKDMGYDISDYQAVYSRYGTLSDVDNLIAACHVRGMKLILDLVVNHTSDQHPWFQESRSSKTNPKRDWYMWKPARYDANGNRIPPTNWRSYFAGPTWTWDELTQEYYLHLYDNSQPDLNWENEECRKAIYNEAMRFWLDRGVDGFRIDTVNKYSKRTDFPDAPVTMPGETDQPAAEMWCNGPRIHEFIREMNEQVLAPYNAVSVGELSNTPLPSQVLPYVSAAAKELDMVFEFSTIRLGTGGPFHGKYLYREFPLSELKAYVATWQQWLEGTDGWHTVFCENHDNGRAVSRFGDDSTVESWEASAKTIALWQATLTGTIFLYQGQEIGMVNMPKEWRIEQEYKDVESLNFYREAKAFGDAERIRKTEEGLRILARDHSRIPMQWDASPNAGFTSAGVTPWMRVHDGFKDLNVEKQEGDDESILGFYKKILKLRKEYSGLFVHGAFRPSLQEDETLFVYVKDDQGSEESGVQADKRRKALVVMNFSGQPAILREHNLNVAATLGCKQGEERLLVTTLKKKDTPRMEAGVLEPWESRMYL

SEQ ID NO: 3482 - protein, 452 aa, Neurospora crassa
TTTTTATTTTTATPTEPTKAAVVDPSSLSRRLKLSAYATALAAVLGVGYYYATDTRASVHQYLVPPLLRTIFPDAEEAHHVGTAALKGLYETGLHIRERVPESPNGPLSVNVFGKQLLNPIGISAGLDKDAEIPDPLFALGAGVVEVGGCTPFPQEGNPKPRVFRIPSVDGLINRYGLNSRGADAMATRLRERLRKFARSVGLTDNEVLNEEGTDGIPPGSLHPGRLLCVQIAKNKKTDEKDVNAVIRDYVYCVDKLAPYADVLVVNVSSPNTPGLRDLQATEPLTKLLSAVVDAAQQTKRKTKPRVMVKVSPDEDDDTQMEGVVEAVWNSGVDGVIVGNTTKRRTGIVPKGVKLIDDEPKILHEEGGFSGPALFDRTVNLIGRYRKMLDGYALKSESDKSPAQKVLFASGGITNGEQALRVLNAGASVAMVYTAMVYGGSGTITRIKSEMK

SEQ ID NO: 3483 - protein, 421 aa, Neurospora crassa
  unsure (1)..(421): unsure at all Xaa locations
VIAVLYFISTPSSVVTPLKDNFGKFQQSTGNSKPSTGSTTGSTAGSTTGGTTEVAHDEKTPAKSNGADYDPAQYPLAMTPNDPGWNDLSGVKGGPRMNATFVTLARNGDVWEIAKSIRSVEDRFNRRYNYDWVFLNDKPFDETFKKVTSSLVSGKTYYGEIPTEHWSFPPHIDQEKAKKVREDMRQRKIIYGDSISYRHMCRFESGFFFRQPLMMNYDYYWRVEPSVEFHCDIHYDPFRFMHENNKKYSFVLSLYEYFETIPTLWDSVTKFIKNHPEHIAEGNSMAFLSDDGGKTYNKCHFVSIFREDSQLATSLVXQCYYSWSNFEIGSLNWLRSKAYTDYFESLDQDGGFFYERWGDAPVHSIAAGLMLKKEEIHFFNDIAYYHVPFTHCPTGEQFRLDRKCHCNPKENFDWKGYSCKS

SEQ ID NO: 3484 - protein, 381 aa, Neurospora crassa
PITHFSEVETAMAETVQKFANDVILPKVRDMDEAEAMDPAIVEQLFEQGIMGVEIPEEYGGAGMNFTAAIVCIEELARIDPSVSVMVDVHNTLVNTAVIRWGSEALKKKYLPKLATNTVGSFCLSEPVSGSDAFALATRAVETENGYKINGSKMWITNSMEADFFIVFANVDPSKGYRGITAFIVEKGMKGFSIAKKEKKLGIKASSTCVLNFDDVEVPKENILGKVGEGYKYAIGILNEGRIGIGAQMTGLALGAWENAVKYVWNDRKQFGQLVGEFQGMQHQIAQSYTEIAAARALVYNAARKKEAGEDFVMDAAMAKLYASQVAGRVSGLAVEWMGGMGFVREGLAEKFFRDSKIGAIYEGTSNIQLNTIAKTLQKQY

SEQ ID NO: 3485 - protein, 1245 aa, Neurospora crassa
  unsure (1)..(1245): unsure at all Xaa locations
NDEDKVHDISKKIEREKALINAAQAMRQQTNNEQVRSKLDTQMREGRRNLEFFEEKLRELQMRRLGHGVDNMSLGASPMSGSHRQSVDDFEGYGAPSPPPKEDVRGHSSHQSQGSGPLMPASAPYPGGPPDSNVPRARPNYTRLGKLDIFLGPVPLXTYSVXLTLRELQDLIKFDTPHLGPRIQLMLSQIQFKLNVEEQYLKGIEKMVQLYQMEGDKKSKLDAAAKRVESKQKIVLLKQALKRYEELHIDIDVDGPDGRIPSPTCCFHQHSFYXLXMXLXTDSINLPALRKPLSGTLSIRILAVKDVDHAPLGRFARSPETFIAVKAEDIVVARTKPSRNDKWEAEFHTFPVDKTNEIEFTVYDKPAEHPVPIAMLWVRISDIVEELRRKKIEAEMTSAGWVSADRVGSRAPPPQFPMGAQSPQFAAPPTSPGSQEQNTMIPPQAPPPSQVVSQPVDGWFNLEPYGQIHLSFNFIKGARPQGMDRLGRKGAVRQRKEEVHEMYGHKFVQKQFYNIMRCALCGDFLKYSAGMQCEDCKYTCHTKCYTSVVTKCISKSNAETDPDEEKINHRIPHRFIPFSNLTANWCCHCGYMLPIGSKKNSRKCSGMSSSPLFWSPICXQLXQNVALTAHAQCVHLVPDFCGMSMAVANQILEGMRTQKKTHKDKASSMSERTLRPGSKTSISSGSIAQASTYSGSTAYTSIASPEATEAAKLMYSQTTPRPGGPDRTSTSSTTASAAAAAAMAPKHSSQPSQAGSIPDFGGSPGYGRPDSRDDEYSAQQQQGYGSPQQRKYNPADYANIDAYSSPQARPQQQQQQQQQTPQQVSPMYQQNPQTPISKPQPVAPSYDNQVVPSASGVPVPTKKPLPSATDPGTGMRIGLDHFNFLAVLGKGNFGKVMLAETKKSRKLYAIKVLKKEFIIENDEVESIRSEKRVFLIANRERHPFLTNLHACFQTETRVYFVMEYISGGDLMLHIQRGMFGTKRAQXVLLCVFXSYCSDXLVPDSTPAEVCLALKYFHENGVIYRDLKLDNILLTLDGHIKIADYGLCKEDMWYGSTTSTFCGTPEFMAPEILLDKKYGRAVDWWAFGVLIYQMLLQQSPFRGEDEDEIYDAILADEPLYPIHMPRDSVSILQKLLTREPDQRLGSGPTDAQEIMSQPFFRNINWDDIYHKRVQPPFLPQIKSATDTSNFDSEFTSVTPVLTPVQSGKSYTSEPNXATFSXLTPSVCIVLSQAMQEEFRGFSYTAD

SEQ ID NO: 3486 - protein, 490 aa, Neurospora crassa
  unsure (1)..(490): unsure at all Xaa locations
MAAPSSRPESNPPLYKQALDFALDVANGRHALSKLIPPALFLVDALLCGLIIWKVPCTXQVPWNGVRLPVCSRSXTTDTEIDWAAYMEQVSQILSGERDYTKVRGGTGPLVYPAAHVYIYTGLYHLTDEGRNILLAQQLFAGLYMVTLAVVMGCYWQAKVSFYKWLCDNAGXERSXQSETPPPKKQAPPYLFPLLTLSKRLHSIFVLRCFNDCFAVLFLWLAIFFFQRRNWQAGALLYTLGLGVKMTLLLSLPAVGIVLFLGSGSFVTTLQLVATMGLVQILIGVPFLAHYPTEYLSRAFELSRQFFFKWTVNWRFVGEEIFLSKGFALTLLALHVLVLGIFITTRWIKPARKSLVQLISPVLLAGKPPLTVPEHRAAARDVTPRYIMTTILSANAVGLLFARSLHYQFYAYVAWSTPFLLWRAGLHPVLVYLLWAVHEWAWNVFPSTPASSAVVVGVLGVTVAGVWFGAREEWEPGMKSSSKKEEAAMR

SEQ ID NO: 3487 - protein, 341 aa, Neurospora crassa
  unsure (1)..(341): unsure at all Xaa locations
MRESNVVHVRAPVTVVGDIHGQFYDLIEIFRIGGYCPDTNYLFLGGWXSWWWXWKQDAGGACPPCGCCAKMTTFDXPWEKNNRDYVDRGMFSVETISLLVCLKLRYPNRVHLIRGNHESRGVTQSYGFYTECSRKYGNANVWHYFTDMFDFLTLSVVINDQIFCVHGGKIPPFWAPGVQASCXTSSSAPGLSPSIHSIDQIKVIDRFREIPHEGPMADLVWSDPDPDRDEFSLSPRGAGYTFGAQVVKKFLAVNNMNHILRAHQLCQEGYQVLYDDRLSTVWSAPNYCYRCGNMASVLEVSDTGERFFNVFAAAPENDAVKDQQMNQDKSAEGGALPDYFL

SEQ ID NO: 3488 - protein, 158 aa, Neurospora crassa
  unsure (1)..(158): unsure at all Xaa locations
YKEAFSLFDKRGNGRVALDSLGDLLRACGQNPTLAEIRELEKNVGGDCEXYPSGNKXFIXDXLLTDALLIRQVDFETFQRVLNRPGGFRDPGEPEEYCRGFQVFDKDMTGFIGVGQLKYILTNLGEKMTDEEVDELLKAVDTSSGQVNYTGMSASALA

SEQ ID NO: 3489 - protein, 753 aa, Neurospora crassa
  unsure (1)..(753): unsure at all Xaa locations
PPQPPGLRNHTPESVTAAFEAWADKHRAALDAIVADVNLSDPQTVTFENVMRPQLEFENQKFSHNLRFYQHVSENSDLRETTRKMAKWYDNIWTDMNMRGDVFRAREVLYHKSGLAASRKQNSARYITEDIAKNAGFEDAESAIALEEEWKEAIRLGLGLPSKPQRDRFNQIQKRVEAIKSEFKNHHASDKGCNWFTPAELDGMDNDIIDQLAKGTGENEGRLKVTFDPSHYDIFLRDVKNSEARKRMWTAMENKVRCTWXVVTDAYKSLLTMPRXCPENVPLFKEAMLLRDEAARLLGYPDHATLRIESRMAKTPRAVNNLLNDLRTRLAPLATKELNQLLQTKKKDCETRNLPFDGSFYHWDWAFYASQISKQEHDLDNKKVAEYFPIDSAITGMLRLFGVLFGIVFVRLTAEDLERISPTGVADDVMYHRDTIMFSVWNDESEGNDFLGYLYIDAHPREGKYRHVANFPLELGHQRTDGTRFYPSTAIVCNFPAPTKDKPSLLDHEHIVDLFHELGHGIHSLVSRTRFSRHHGTAGKRDFVEAPSQMLEHWTWRAEYIKRISKHYLTGEQMSDDMAERIAASRHFLQALRNLWQLSSAIFDMEVHSPKSRAALENMDFTKRYNELRNELTGMKGPEAIGEPMXALMLSTSLLPSYLGRYLTVHGRTHGHGNLQHLFYAYDAGLYSYHWSNTYSYDMFYFAFAKDPMDKSQGHRFRHTVLEKGASQDEMLILEQFLGRKPTTDAFCMELGL

SEQ ID NO: 3490 - protein, 490 aa, Neurospora crassa
MDSQYETKKNDPNAIMPYPESNDEHVGEVRGLGGGIMDKEPEAQEGHAKFHRLGWKRLTVVLIVEAIALGSLSLPGAFATLGMVPGVILSVGMGLICIYTAHVIGQTKLKHPEIAHYADVGRVMFGRWGYEIISFMFVLQLIFIVGSHVLTGTIMWGTITDNGNGTCSLVFGIVSAIILFLLAIPPSFAEVAILGYIDFVSICAAILITMIATGIRSSHQEGGLAAVPWSCWPKEDLSLAEGFIAVSNIVFAYSFAMCQFSFMDEMHTPSDYKKSIVALGLIEIFIYTVTGGVVYAFVGPEVQSPALLSAGPLLAKVAFGIALPVIFISGSINTVVVSRYLIERIWPNNVIRYVNTPAGWMVWLGFDFGITLIAWVIAEAIPFFSDLLAICSALFISGFSFYFPALMYFKITRNDAKSQGKKYFLDALNMLCFVIGMGILGIGTYAAIQDIVSLARFSVYSLHTNANLLLRMDRYDHGKVSKPYSCAPLA

SEQ ID NO: 3491 - protein, 475 aa, Neurospora crassa
  unsure (1)..(475): unsure at all Xaa locations
MDTNMEDVGRVPAELTSSNFEPTTIPTLDGWIESLMNCKQLAESDVQRLCEKVGSAIISPAVXYRDRARAGKLPAHQTPLPLSPPLLLPWGRTVLPRVVGRVRTVVWGLMLTXQIDFRAREVLQDESNVQPVVCVLFLPHVLPKLARRADRCQKCPVTVCGDIHGQFHDLMELFKIGGSCPDTNYLFMGKSPISAASAMPWLPSLMRSVPVYRRYVDRGYYSVETVTLLVALKIRYPNRITILRGNHESRQITQVYGFYDECLRKYGNANVWKYFTDLFDYLPLTALIDNQIFCLHGGLSPSIDTLDNIRALDRIQEVPHEGPMCDLLWSDPDDRCGWGISPRGAGYTFGQDISEAFNHNNGLTLIARAHQLVMEGYNWSQDRNVVTIFSGKWTPXTPIYFLPKTFLTWSYSANYCYRCGNQAAIMEIDEHLKYTLYVLFPPXSLFDVLPSDANQNASLQFDPCPRAGEPMVSRR

SEQ ID NO: 3492 - protein, 255 aa, Neurospora crassa
LAAMQKENNNNICCDCGAPSPQWCSPKFGIFICLSCAGVHRGLGVHISFVRSVSMDAFKQAEIERMRLGGNDTWRTFFENHSDTKLRGISWDDATIAERYSGDVGEEYKERLSAKVEGREYVPGEKKPLAQQQETSQSPSSVAGGVPLSGTSSRTASPKPGTTIKVDDKYFAKLGAANASRPDNLPPSQGGKYQGFGNTVSSQPKNDGGASLPGLDELQKDPVAALSKGFGWFTKTVTQTAKTVNEGYIQPTAKQ

SEQ ID NO: 3493 - protein, 472 aa, Neurospora crassa
  unsure (1)..(472): unsure at all Xaa locations
MFSRLAARLPKASALNGVAARQVRNLSQPAITGSKGRNMPAREPRTTAAATGAEATFTIRVRTYNXSSLVAKPNIFSLRDGPVFQGTAFGANTNISGEAVFTTSLVGYPESMTDPSYRGQILVFTQPLIGNYGVPSNERDEFNLLKTSSLPTSSAPVSLSPMSLPSTATGLLFRAWASGAPARAFPPSPGVDTRAIVTYLREQGSSLARISIGDEYDADEDEGFIDPGQINLVKRVSTKAPFVVTNPNAKFHVALIDCGVKENILRSLVSRGASVTVFPYNYPIHKVAENFDGVFISNGPGDPTHCQETVYNLAKLMETSPIPIMGICLGHQLLALAVGAKTIKLKYGNRAHNIPALDLTTGQCHITSQNHGYAVDISTLPSDFKEYFVNLNDGSNEGMMHKTRPIFSTQFHPEAKGGPMDSSYLFDKYMENVELFKSNSQVYRDNRPTQFMIDILSKERVGVEPTPLSNAA

SEQ ID NO: 3494 - protein, 256 aa, Neurospora crassa
DMDIINVDFELFNYDKDIDFHGVKTLLRQLFDADAQLFDLSGLSDMIIEQNTIGSTCKVDDKANDAYAFLTVLNAWEHREKKPVAQLIEYLSDKAVKAGDSSLSVLPELFTSGKAQVGIVLSERLINMPAEVIPPMWNMMIEEIQDAVDDKEPYEFTHYLVVSRAYVEVESSLDQEEQKRKRLRDEKGLQYFHPEDEEMRKHAVGAGTYTFTKEGDSADSKRAFQELGVKSQGFMMLIEAGRFKQAVKAIGDCIGA

SEQ ID NO: 3495 - protein, 919 aa, Neurospora crassa
  unsure (1)..(919): unsure at all Xaa locations
QDVDGKTPANGKKEEEQNGGFLGHSDRLEVSAPGFCXQRFALASEELSEEDQQLKSELEMLVERLTVGASQXRDTGXRPASLTVQCLQESDATLYKPALEAMKNSIKTSTSSMTAVPKPLKFLRPHYETMTKLYDEWPAGDDKSSLADVLSVIGMTYSDEDRQDTLKYRLLSPTQDIGSWGHEYVRHLALEIGEVYAKRIANDEPTQELVDLALVLVPLFLKSNAEADAVDLMSELEIIEELPKFLDENTYSRVCLYMVSMVNLLTYPDNETFLRVAHSIYKKYNQHTQAMVLAIRLNDLGLIEKDFEAADEDPALRKQLAFLIARQGIPLEFERSNDDDEKIYECLSNQKLSEYFKSLGKELNILEPKTTEDIYKSHLESSRVAGMTNFDSARHNLAAGFVNAFVNAGFGSDKMMLVGKDKDSWVWKTKDEGMMSTVASLGTLLLWDVENGLDHVDKYTYLEEEQIQAGAYLAIGIMNTNVRTDSEPAMALLADPDKLAHKNPLIRVATIMGLGLAYAGSCKEELLSFLVNIISDPEESMQVSAMAALACGMIFVGSSNSEVSEAIVTTLLDEESGSRLNDKWSRFLALGLGLLYFGRQEQVDVILETLKAVEHPMAKPTAVLAEICAWAGTGAVLKIQELLHICNEHIEDGEEKKGEELLQAYAVLGIGLIAMGEDVGQEMVLRHFGHLMHYGEANIRRAVPLAMGLISPSNPQMKVYDTLSRYSHDNDNEVAINAIFAMGLLGAGTNNARLAQLLRQLASYYHRDQESLFMVRIAQGLLHMGKGTLSVSPFHTDRQVLSNVATAGLLAVLVAMIDAKQFITSKSHYLLYWIVTAMHPRMLVTLDEDLKPLTVNVRVGQAVDVVGQAGRPKTITGWQTQSTPVLLGYGERAELEDDQYISLSSTLEGLVILRKVRAD

SEQ ID NO: 3496 - protein, 257 aa, Neurospora crassa
  unsure (1)..(257): unsure at all Xaa locations
HDEEQIRLMDEVCIVTDQNDLPIGTASKKLCKCLPEEEQEIPSTLSADRHYYSYRHLMTNIDKGLLHRAFSVFLFNDKNELLLQQRATEKITFPDMWTNTCCSHPLNLANETGSTLPDAIAGVKNAARRKLDHELGIKQEQVPFEDFRFLTRIHYKAPSDGKWGEHESKYCTTARLGEXXFADRYTLVDYILFIKANPEVNANLNEVQATQWVSAEKLKEMFKDPSLKFTPWFKLICESMLFEWWASLDNGLEKYTD

SEQ ID NO: 3497 - protein, 252 aa, Neurospora crassa
SLVQQQYADESLRPVTIKQLLDWEETFPGAELAIDGHPVTQVTIVGQVRSVKPQPTNITYRIDDGTGAIDVKKWVDSEAQGGEDGGSGAGTIAPDAFVRVWGRLKSLGGKKHVSANFIRQIEDFNEVNYHLLEATYVHLFFTKGAPGSGGGAKQEGGGGDNMFVDQGYGAGGGDVAMGGAGPGGGNSAMQARLATCSRNAQIMCNFINNSPGGTEGVNLHVIAQGTRMSVRDITNAADELLGQGIIYTTQDD

SEQ ID NO: 3498 - protein, 890 aa, Neurospora crassa
  unsure (1)..(890): unsure at all Xaa locations
NGEGDDDEAFIASLTRSSQRKSSNIQGKSVKKGGGFQAMGAXSSVPWHKLMMLGAAADTLLGLNAHLLRAITRKGFSVPTPIQRKAIPLILERKDVVGMARTGSGKTAAFVIPMIERLKGHSPRVGSRALIMSPSRELALQTLKVVKELGRGTDLKTVLLVGGDSLEEQFGMMASNPDIIIATPGRFLHLKVEMNLSLASIKYVVFDEADRLFEMGFATELTEILHALPPSRQTLLFSATLPSSLVEFARAGLQEPSLVRLDAETKVSPDLESAFFAVKGGEKEGALLHLLHDVIKVPLGPPEGTKEESDELQARKRKREYRPNPKEKPTEYSTIIFTATKHHVEYIANLLKLAGFAVSYVYGSLDQTARLIQVDNFRRGRTHILVVTDVAARGIDMPALANVINYDFPSQPKIFVHRVGRTARAGQRGWAYGLVRQSDVPYLLDLQLFLGRKLIIGHDQKNPSFAADVVVGTLKRDGVDVNIEWVEKALKESADLKALKGVAAKAEKLYMKTRNSASSQSAKRAREVTQSRGWTQLHPLFGEEAAEAQAARDDLLSRINRFKPQETIFELGPKGKSSRNKAAEVVRNMRSRFKERKTTNDEDDEDVDMEDAEGKPDGEETNAFEDFEDEEEEGEAEEAEEAEAKEDPYADDSDSEMEVTVSSSMHTKKKGGPVNFQDPEIFMSYTPRTTSLAEEKAYGVHSGGYSGNSFVEAARDATMDLTNDESAKNFGLPTKSKMRWDKRHSKYVAVANDEDGSKGAKMIRGESGVKIAASFKSGRFDRWRKDNRLGKLPTIGETEKSQLIRNFGAQPGQPRYKHKMEKAPKDADKFRDDYHVRKKRVAEAKEKRIGKYKDGEGSKRELKTATDIRKARAVAEKKREKNARPAKRQK

SEQ ID NO: 3499 - protein, 932 aa, Neurospora crassa
  unsure (1)..(932): unsure at all Xaa locations
FLLSSTTFSPALFLSQVHATDSTEALLNGLEVLNQSIDQKSASLKVLVESNFERFVRAKATIDNVYKEMKYRGAEPAAPRARAHSRHASRNSFQSTSAAGGLANSLGPTIDPRKKNALIRESEYGVMGVKAPLLDVSAKAEDFWGPALGGREKEEHLKTVGSSLDTYKDYVEISAALAESIKRKDHESLVEEYNRARRFADEAKQIAQNIGSGEPTEAQLYKILLAARMWHDVDEQIQLFRREVWRRLVSPQAMAKSDATPGQAHDQHMDLITLLLELGVEENPIWAWLQSRVAYLKSEFNRQPRSQRSKSKCCDGVXQMLRSLALSQXRQIXEDSARQSIESKTPTFDSAEVLDVWETIVAFMNNLMSPQGILGEVVEFWQTVQGFMDGNTQRTLPLGYKGESQGHHRLTQQSSQELQRATVELVDMIREHVLSFFTGPPPEDLSALVSPLPSTPNTPNPSTTPGSAIQTTTLRVPINLDPNNLPPPSPKRGEAWEKFAFWPPWSNSISGAHYLAKMLTLVGSGASDMASLAPVGKGDPSELEQLRSLVNATRERCVTALCAAWNRDSENIKYVEDWNRSPTRKDVTKMPASFAAFERALLSGMQKILYVSEAMTKPGAEDIVLPPATKLLQMVRSQYVTTLYKALHGMVENAELPIKKPDDDWTTDANDFVLVNNPSRLRVSTIGGATIDAGDSVSGSNPLLDTPSSAQIANDHPXNVRMLLTLSNLQALRSEVVPNLNTQFENAFSVKLTDETKTIRDVLGQIDARLFQSYTRPSIESLRRIIRAGVTASDWPPPSGQKPREVKPYIYEALLDLVLVHTQVSTTAASLTSQVLSFLLEQTSRELLEAFKTRARYDLGMLMQATLDVEFVAQTLNHYTTDRASELQSAVYQELDSRTDNDARTRLQAELPEMRAVLKRLREASKSEFACF

SEQ ID NO: 3500 - protein, 377 aa, Neurospora crassa
  unsure (1)..(377): unsure at all Xaa locations
GKYTVSLIEGDGIGPEIAVAVKDIFAAAQVRSTPPPACLLYGHRRVVCXHLKLDPINWEPINVDPILKDGKTAIPDAAIESIRRNKIALKGPLAVCWPPGFRIAKTTAVLNSVXTPIGKGHVSLNLTLRRTFNLFANLRPCRSVAGFKTPYDGVDTVLIRENTEGEYSGIEHVVVDGVVQSIKLITREASERVLRYAFEQARAINRKKVRVVHKATIMKMSDGLFLNTAREVAQDFPDIEFDAELLDNTCLKMTTDPTPYNDKVLVMPNLYGDILSDMCAGLIGGLGLTPSGNIGDECSIFEAVHGSAPDIAGKGLANPTALLLSSMMMLRHMGLNEYADKIEKAAFDTLAEGKVLTGDLGGKASTKDFTSAIIDRL

SEQ ID NO: 3501 - protein, 563 aa, Neurospora crassa
MHIREMLADAERTKAPSFSFEYFPPKTAQGVQNLYDRMDRMYNFGPKFIDITWGAGGRIAELTCEMVAQAQAYLGLETCMHLTCTDMGEEKVNNALQRAYKAGCTNILALRGDPPREKERWEAAEGGFQYARDLVAHIRKLYGDHFDIGVAGYPEGCDDNKDEESLLDHLKEKVDMGASFIVTQMFYDVDNFLRWVKRVRERGITIPIIPGIMPIATYASFIRRANHMNCKIPEEWMAKLEPVKNDDVAVREIGKTLVAEMCRKIVDAGIRHLHFYTMNLAQATRMVLEELDWLPSPNRPLKRALPWKQSLGSGRRDEDVRPIFWRNRNKSYITRTQDWDEFPNGRWGDSRSPAFGELDAYGIGLTGSNELNRKKWGEPQTVKDIANLFVRYLNQELEYLPWSEAPISSEAELIKDDLIALNNRGLITINSQPAVNGVKSTHPVHGWGPANGYVYQKAYLELLVSPELFPEIKRRIEDHPDITYYAVTKSGNLHTNAPSEGPNAVTWGVFPGKEIVQPTIVESISFLAWKDEAFQLGLEWARCYDADTPSRLLIEEIMDKWYL

SEQ ID NO: 3502 - protein, 1192 aa, Neurospora crassa
  unsure (1)..(1192): unsure at all Xaa locations
GNRWHLDCFRCNTCNTLLDSDANLLLLGDGSLICNNCTYSCSACGNKIEDLAILTGDQAFCATCFRCRNCKRKIENLRYARTAHGIFCMNCHESLMARRRKKAKAAAQAKARDTDKSLPALPPNAVPPSSTGFAAEKLAADSDTPTELSPRPRNAYGRQDSSSRSSSRPDRSPERLAETNKETVLAPPAPNYRHNRNSTMFSADLSGGDAEDFFIPVALDQSPAPSITPQSTADTISDTSRKNKDYFGSARSNAVQPDKKNRRRQHPTLHXWRRWPKRGSRRLTMKVLNRSGSHPGSSLERPMXLVTQNRPISLASWPKSTISSPTTRTSSCRMYPKARGLWVNRSESQASNSIENGTTPRNKESPEPPLTMSPDRIMTPRSSQDSRPRDPMSDEIRPSSDSVTSRSEVSNAGRSIPRKEVPPPVSRNCTSPFQSCVIVSALFTDVLQVADGKPLPVPGSNSSEGPALPIRPPPPEAKLSNTYMQPRAPPLPPTQAQTPKNQSTTSGEVQELKPSPKLPRWSSGVEFSMDEDMARILGTDEGSSSILRRVSNAVRHGRNSSGETGATPGRISHSRSVSETTRGTTSPRWPRTPIVEDYSAGNINDITSPLSLASTTQDDPAYLKRQLRSSEQRVAELERQFNTEKDLKSLNKKLIEKRKTVSVLDTQTEIMIRQLEVLAGYVERAKKTNESFDARELEESAIKEFVQKLERLKHNMTSAIEQLIAERDDLVEEKNQAIADRDRALLEFEQLSSKNAQLADMNNDLTHQIQERFKQQINNGELKSPNGLGIYGHTKGASLNMDAASLQTATTMVGPDMEDQLVEGPTVVNIRKGQVKKFNWKKGSSKVAHISRRVSVVQQAHSKDRKEPRGSSSSSSSSSSRAPXTETTLVFLMPXQLPRLRLRSLSFPHQPTPSNLXWLITRGKVEEVVVEGLVSSVAKSRTRSKSRCRXPISLPLRLAEAPTTLFGSDLIERTEHERRQIPSVVTRCIEEVELRGMDVEGIYRKTGGNSQIKMIQEGFEKQQDFDISDPEIDITAVTSVLKQYFRKLPNPLLTFEVYERVLESNSKSHPQLTGVDGCSPAFSTDIQDVEEKCAHLKKTVNMLPPKHRDCLEFLMFHLARVASRERENLVSLPFQWVSFPCTREIRLTGSHQMSPKNLAVVFAPTIMRDHSLEKEMTDMHAKNNAVQFLIEN

SEQ ID NO: 3503 - protein, 1231 aa, Neurospora crassa
  unsure (1)..(1231): unsure at all Xaa locations
GFKSYAVRTVISGWXGHKSIRAMEGILPTAXLTGRHRDESFNSITGLNGSGKSNILDAICFVLGITNMSTVRAQNLQDLIYKRGQAGVTKASVTIVFDNRDKKKSPIGFEEYATISVTRQIVLGGTSKYLINGHRAQQQTVQNLFQSVQLNINNPNFLIMQGRITKVLNMKAVEILAMIEEAAGTRMFEDRRDKALKTMAKKEMKLQEIKELLRDEIEPKLEKLRTEKRAFLDFQQTQNDLERLTRLVVAHDYVRCQEKLQQSASDLEAKKQRQKELEESAIRLKNEISHLEEDLQRVKAQRDKELRKGGKAQALEEAVKKHANELVRLATVVDLKKSSMKEEQERRKAGEKNVADLEAALKEKTKTYEKIKAKYDAAKETLEKQRQEADTKEELLQTLQTGVASKEGQENGYQGQLQDARNRATAAATEQEQAKIKIAHLEKRIKGEEPRARKAKEQNAGLLKDLDGLKAQAQRLEKELGRLGFQPGTEEEMYKQESSLQQTIRNLRQEADALKRKVANIDFNYADPVPNFDRSKVKGLVAQLFSLPKEYMEAGTALEICAGGRLYNVVVDTEVTGTQLLQGGRLRKRVTIIPLNKISAFKASAQTIANAQRIAPGKVHLALSLVGYDDEVSAAMDYVFGNTLICADADTAKRVTFDPNVRMRSITVEGDSYDPSGTLSGGSAPNSSGVLVTLQKLNEINRQLKEAETALNELRGQIYREKTKLDQAKRIKQELDLKAHEIKLAEEQIGGNSSSSIIQEIANMKETIVQLKQSIMEAKQRQAEATAEAKRIEKDMKDFDNNKDAKLVELQASVDKLRASLDKMSVTNKALQKELQEAQLDSEQVAADLAAAREQVQDIDVALKAQQEEIDDIVKQGTVLQETHDAVLAQLEDERTKLHVYDDELRALEDATRSKNARIAEEGLEMQKLGHQIEKFHKEQQQAAQTASHMEREHDWIAETKDQFGRPGTLYDFKGQNIAECKSTLRNLTERSQGLRKKINPKVMNMIDSVEKKEVSLKHMMRTVIRDKRKIEETILSLDDYKKKALQETWEKVNADFGQIFAELLPGSFAKLDPPEGKTISEGLEVKVQLGKVWKQSLTELSGGQRXIFVFQNLFFFFFFFLPPPPIQLTSARPFIQKSPIKPTNFVVVQSLIALSLIMALLQFKPAPMYILDEVDAALDLSHTQNIGRLIKTRFKGSQFIVVSLKDGMFQNANRIFRTRFSEGTSMVQAL

SEQ ID NO: 3504 - protein, 499 aa, Neurospora crassa
  unsure (1)..(499): unsure at all Xaa locations
GYENMTEVQSMTISPALKGKDMYAXIRHLHFRALNSCXREASSVAQAKTGTGKTLGFLVPVIQKIITQDPDLAHRFGGKRARSDDIRAIIISPTRELAEQIGEEARKLVKGTGIIVQTAVGGTQKNAMLYKTRQQGCHILVGTPGRLNDLLSDSHSGIDAPRLSTLVLDEADRMLEVGFNEELRQIINYLPDRKVLPRQTLLYSATIPKDVVGLARSYIDKNNFEFVQTVKADEVLTHDRIPQYIVPCKGFENIYPAMLELIEKALNESRTNPEALPFKAIVFLPTTAEVIMANAIFKRLQWKFKHIPKTWDIHSKLTQNARTRAADEFKNARTGILFSSDVTARGMDFPNVSHVIQTHIPPNREQYIHRLGRTGRANKPGQGWLIVPDIELHAARSRLPGLPIKRNDELECASVNAADSGADKHANFQHILDAASRLPEDLFKDCYSSYLGGALQGIDRQALVYALNDLAKFGWGLEEPPAVRQSIMKHMGRVQGLRV

SEQ ID NO: 3505 - protein, 627 aa, Neurospora crassa
  unsure (1)..(627): unsure at all Xaa locations
MQRALTRASVGKAATRLPAQQLRFAHKVRSGSRPCRHGYPMTIGAYXQLSPTTQELKFGVEGRAALLAGVETLAKAVATTLGPKGRNVLIESSFGSPKITKGXYTMSRGVMGKHGMCVRVTNPSTQQDGVTVAKSISLKDKFENLGARLIQEVAGKTNEVAGDGTTSATVLARAIFSETVKNVAAGCNPMDLRRGIQAAVEAVVEYLQANKRDVTTSEEVAQVATISANGDKHIGELIASAMEKVGKEGVITCKEGKTLYDELEVTEGMRFDRGYVSPYFITDPKSQKVEFEKPLILLSEKKISQASDIIPALEISSQTRRPLVIIAEDIDGEALAVCILNKLRGQLQVAAVKAPGFGDNRKSILGDIAVLTNGTVFTDELDVKLEKATPDMLGSTGSITITKDDTIILNGEGSKDAIAQRCEQIRGVMADPSTSEYEKEKLQERLAKLSGGVAVIKVGGASEVEVGEKKDRFVDALNATRAAVEEGILPGGGTALIKASVHALKNVKPANFDQQLGVTIVRNAITRPAKTIIENAGLEGSVVVGKLTDEFANDFNKGFDSAKAEYVDMIQAGILDPLKVVRTGLVDASGVASLLGTTEVAIVEAPEEKGPAPMGGMGGMGGMGGMM

SEQ ID NO: 3506 - protein, 407 aa, Neurospora crassa
  unsure (1)..(407): unsure at all Xaa locations
MLSRQALLRPARVLNTQVRTYAAAAAASSKVKPPVTLFGLDGTYATALVRPRAPDPDVTSNXSTLELPCSXGYVDWSSPTSAKPTTERNGPIDRISESXHSSLRHLHMIXYTAAVKTSALEPTAKAISSLGNLLAKDPKLASILETPTLSPADKSAIVAELQKSVGVSNETVKNFLATLAENNRLGLLPSVVAKFSELMSAARGEVEMVVTSAQVRSLCSVTLFDGGQKKNQKEEGNYEGDDGRGAELMGGFYTTRKRRTTMKLGLDIGGSSGWNWDPGXTETQGDGKQKRXRNAELPPYSPLDNKTLNRLESAVAKSPYVGSGKKLKVTNKVRLSHTIPTRQNWSYTRPGCLVKLGKTTTYLLSFNLNRSNADIIGGLVVEIGERTIDLSVSSKIAKMNKLLSEAL

SEQ ID NO: 3507 - protein, 890 aa, Neurospora crassa
MTLTEVRTFTPPRAFGDAISQPVVTPVITTSTTPRSIPELQITLKPAISPSPKARQNSMASTPEEKSKGGVTFAHQDKLPKLPIPELESTCQRYLASLKPLQTHREHAETRRAVQEFLQTDGPELHEKLKKYAEDQTKLYRAVLYVSSDTKALYSPCLANTSSGYDSYLNYDNPVVLNLNPFFLLEDDPTPARNNQVTRAASLIASALEFVRAVRREELPPDTVRGTPLDMYQYSRLFGTARVPTDSGCQIQQDDKTKHIVVMCHGQFYWFDVLDDNSDAIMTEKDIAINLQTIVDDARQTPIQEAAKSALGVLSTENRKVWSGLRDVLTSDPGSNNADCLSIVDSALFVVCLDYTEPTTAAALSQNMLCGTSEIEKGVQIGTCTNRWYDKLQIIVCKNGSAGINFEHTGVDGHTVLRFASDIYTDTILRFARSINGKAPSMWASTSPDPSKRDPESFGDVSTTPHKLEWDMGPELSVAVRFAETRLADLIEQNEFQCLDFHGYGKNFITSMGFSPDAFVQMAFQAAYYGLYGRVECTYEPAMTKMFLHGRTEAIRTVSDDSVNFVQTFWADAPGDAKIDALRKACQAHVNKTRDCAKAQGCDRHLYAMLCLWQRMQDDDAASTTTDNSMNGYSFEDGSIIGSPSKDSVFSQSMESQSVNGGGRERGDSINSHISATPSQRGGVPQPLPAIFADAGWDKLNTTILSTSNCGNPSLRHFGFGPVSGEGFGIGYIIKDECISICVSSRHRQTRRFVDTLESYLLEIRRILRIAARNAASAGGVGATGTTGNKGMSRAREIDAAAINQNGQEKLARPKIGNRIKSRGRLITGQSSGLMGHGGPTSMYTNGGGSSVGNIKGAGGGSVSSAMEESVVMSEDDEIGGCKFFFSPYT

SEQ ID NO: 3508 - protein, 796 aa, Neurospora crassa
  unsure (1)..(796): unsure at all Xaa locations
MASHDDKGVKRSNMDGNDQDSKRIKRAENGDAAPEKYNPYLAHLNEDGNGNGTNGDFESPLDAFERHKTTAAQAAQAEDSELNPWTGQPHSQRYFDILKVRRDLPVHKQRQEFLDMYHNTQILVFVGETGSGKTTQIPQYVLYDELPHTNGKLIACTQPRRVAAMSVAQRVANELDVELGQEVGYSIRFENRTGPKTMLKYMTDGQLLRESMHDHDMSRYSCIILDEAHERTLATDILMALLKQIAARRSDLKIIVMSATLDAQKFQSYFYNAPLLAVPGRTHPVEIFYTPEPERDYLEAAVRTVLQIHATEPEGDILLFLTGEEEIEDACRRISLEVDDMIRESDAGPMKVYPLYGTLPPAHQQRIFEKAPEPLRKGGRPGRKVIVSTNIAETSLTIDGIVYVVDPGFSKQKIYNPRSRVESLLVSPISKASAQQRAGRAGRTRPGKCFRLYTEKAFKKELIEQTYPEILRSNLANTVLELKKLGVEDLVHFDLMDPPAPETMMRALEELNYLACLDDDGELTRLGGLASEFPLDPALAVMLISSPEFYCSNEILSIVSLLSVPSIWVRPNNARKRADEMKMQFAHPDGDHLTLLNAYHAFKGAETNGDDMKRWCHEHFLSYRHLSSADNVRAQLKRIMETHDISLVSTPFQDKNYYTNIRRALLAGFFMQVAMRESSNSKVYKTVKDDQLVMIHPSTSVTSPYDWVVYNEFVLTTKQYVRTVTNIRPEWLLVRIPLLXIPFVNGILKLTYVNQEIAPVYYDLDTFEKGEIKSALTRITDKVKRRQAIKGSGSAR

SEQ ID NO: 3509 - protein, 861 aa, Neurospora crassa
  unsure (1)..(861): unsure at all Xaa locations
MSSNRGFNPESESFEQRPPFYIGQHDVQRHESPTDNQYGQILDSGVSLSLHXSRKRKKNEQQHKFXHTXDENSSTLSPPPSPTSTFTSAXSTCTRSHLQEREQWVTERGLTDAQKANPSLPLPTVPTLTDDDTSLFPSSYVGSLIAYASPWIDLCSADPIISDISRQVLNLELAYANFCGSRTIIIPGPRQDDGRAVAQYARAIQEAQEVGGRVNLVIHLPMYREPGLEEEAETLSSLLAGDGSSSSNSKETVKTDAAKGTEIDLFSTWDSWHTIRTVCKYSGRLFVALRIPKRVPEKDLQERWFSEPLHYLTLDKKIFSLNKAGHPSLTRHHQDLINRYMRLKNHPWLILINVGPSTESLVEAPSKMEVDFPPLSEASKAVKENRKPYAPPYNEYVDYMKYLERHQPPYSAMETPSLVSFQDWLQSPLQPLSDNLESATYEVFEGDPVKYDQYEKAVAEAMLEWKKYNRPVSSVTPETPDGKDLIVAVAGAGRGPLVARVLRAAASTNTPIQLWALEKNQNAYVYLLRRNKREWNNSVTVIKTDMREWEGPRLAANPNIITKLDILVTELLGSFGDNELSPECLDGIQRHIARPHGISIPYSYTAHLSPIAHPRIFADLSNRVVSDPNAFDIPWVTRLFQLAYVAQKVPKHGRFQQAWEFVHPVEVSRADDFSAQNGRARKYVTHGSGSMYGSSGINEHNARHCHLTFVCPTRGVIHGLAGYFESVLYKHQEEGKTPVEISILPDQIDRKSKDMISWFPIFFPLRVSFYLFFLHFLFFLTFRSSLLLWXRLLTLFLRRYIAPLYFPQDTELEVSMWRQTDDTRVWYEWMVEVYAWVGPKTRIKVGASEMHSSRKVACIFG

SEQ ID NO: 3510 - protein, 887 aa, Neurospora crassa
  unsure (1)..(887): unsure at all Xaa locations
MTRSRSWSVKNQITNLPANNSDLPVLFPYPRIYPGMXAHPHWYTITSADRPTTQEQYAYMVDLKSEHSTNSSHSSHVHXPPPLPTETLDAGGNCVLEMPSGTGKTVTLLSLIVAYQQYYPEHRKLIYCSRTMSEIEKALVELRALMKFRAERLGHEEEFRGLGLTSRKNLCLHPSVKREKSGAIVDARCRSLTAGFVKEKREKGENVETCVYHDNLDLLEPHNLIPNGIWTLDGLMRYGEEKKQCPYFTARRMVGLFSTPQDADVIARDAIHTNSSYVDQHCNVIIYSYHYLLDPKIAERVSKDLSKDCIVVFDEAHNIDNVCIESLSTDITQDSLMRATRGAQNLEAKISEMKDSDQEKLQSEYEKLVEGLKGLDEGRQEDAFMANPTLPDDLLKEAVPGNIRRAEHFVAFLRRFIEYLKTRMKVRQVISETPPSFLAHLKEYTFIEKKPLRFCAERLTSLVRTLELTNIEDYRPLQEVATFATLVATYEKGFLLILEPYESDTAKTPNPVLHFTCLDAAIAIKPVFDRFSSVIITSGTISPLEMYPKMLNFETVVQESYAMTLARRSFLPMIVTRGSDQASISTSFQVRNEPSVVRNYGNLLTEFARITPDGMVVFFPSYLYMESIISMWQGMGILDEVWKHKLILVETPDAQETSLALETYRTACCNGRGAILLCVARGKVSEGIDFDHQYGRTVLCIGVPFQYTESRILKARLEFLRETYRIRENDFLSFDAMRHAAQCLGRVLRGKDDYGVMVLADRRFMKKRAQLPKWINQAFLEANTNLSTDMAVGNARAFLKQMAQPFSAKDQEGVSIWGMEDLKRHQEKMAEDMIVELKTAREEEERERKRREEEERRRFEEERDRVSDYEMDEDDEAEMMALDARIG

SEQ ID NO: 3511 - protein, 301 aa, Neurospora crassa
YFNDSHRSLQKAIRKFTDEVIAPEALEKERTGELISQDLIDKMSKAGILHMRMGPGKHLHGVNLLDGAVKGEEFDYFHDMIMAQEQVRVACRGFQDGNMAGMAIGLTCILNYGDKNPALKKRITEEVFAGKKKICLAITEAFAGSDVAGLRTTATKTPDGKHYIVNGTKKWITNGVFCDYFVTGVKTDKGLSVLLIERGEGVETKPIKTSYSPAAGTTYITFDNVKVPVENLLGEENKGIYVILSNFNHERWMMACATIRYMRLVVEESLKWSHQRLVFGKRLIDQPVIRQKLAKMIALCE

SEQ ID NO: 3512 - protein, 903 aa, Neurospora crassa
RSPPIPGRASPTKSGQQTQSHCRSWSNRYTTPMASKRYAFVPMDDEPAAPSKSDRKDRDRDSKRDRKRDRSRSPRRHKSRRPDDSDSTRRQSRSRSPRKDDSRSDSRRDREDPKMSDLRLKSRYDYLKKREAEKLALLRKQVAEETAELRSGVRLSEKEKAEFARNREILRLAEERARIDDYQDGYRLPDQYGTDTKKKEEALYQRHVERDEYGNEKMVTEYDEWEREQTVKAKAQIASRGEREDGGEYDFLLDEDAINFVRDAAAKFIQPTDGLTPEQRILKEKIEAAERAAKSIQEVRKSLPVYAYRDAFLDAIKEYQVLILVGETGSGKTTQIPQYLHEAGYTEGGMKVACTQPRRVAAMSVAARVADEMGVKVGREVGYSIRFEDCTSDKTILKYMTDGMLLREMVTSPTLEGYSAIMIDEAHERTVHTDILLALIKDLTRARPDLKLIISSATLNAEKFSTYFDDAPIFNVPGRVHPVDVYYTSAPESNYLEASLVTVFQIHATQPEGGILVFLTGQEEIDKACERVEEIKKKLGGRVPEIIPLPIYANMPSELQAKIFEPTPPGARKVVFSTNIAETSLTIDGIVYVIDCGYVKENTFSPVGTTGQSTLAVVPCSRAAANQRMGRAGRVRPGKCFRLYTKFAYLSEMDESPTPEIQRTSLSSVVLQLKALGIEDLLGFDFLDPPPTELLIKSLNMLYALGALNSAGQLTRVGRQMGEFPAEPMLAKALIAATAEGCVDEMLTIVSMLGEVATLFFRPKDKKVHADSARARFTVKDGGDHLTLLNVYNQWVDADYSPIWAKENFLTQRSLTRARDVRDQLAKLCDRVLEGSTSTCGGVSNMQPILRALTAAFFLNAARLNRGGDGYRTLKNNMTVYVHPSSVVKGMDPPPKVIIYHEL

SEQ ID NO: 3513 - protein, 504 aa, Neurospora crassa
LQAAIQGADNDVAVIIPSKPQALTVTYADLKRETASFQKKLADIGITKGSPVSIATVNSYEFIVSFLAASWQRGIAAPLNPAYKQDEFEFYIEDVKSAIVIVPKGAYAAGAPVVKAAQKFNAAIAESYWDAAKNEVALDVKELGQLTGKGAQPVLKPDADDIALVLHTSGTTSRPKVVPLTHRNLTRTMKNIRNTYQLTSADRTMLVMPLFHVHGLLCGLLAPLLTGGSMIVPAKFSATDFWSDFIQFQANWYTAVPTIHQILLKHPVPNPLPKIRFIRSCSSPLSPTVFHNLEKTFQAPVLEAYAMTEAAHQMTSNPLPSVGKRKPGTVGLGQGVEVVILDDKDNILPDGQEGEISIRGENVTKGYLNNPEANASSFTRKGGYFRTGDQGKKDEDGYIVITGRIKELINKGGEKISPIELDNVLTRHPAVSEAVSFAIPDEMYGQEVAVAIVLKPGQQKVDAEEFKQWVGSKLAKFKVPKKIYFTDVMPKTATGKIQRRIVAE

SEQ ID NO: 3514 - protein, 391 aa, Neurospora crassa
EELEETAAAGQDITEEIIDSASADPMQEDPNRITGLERWAMNASDSQFNALAGAVGGFMSGVVTCPLDVIKTKLQAQGAGQHVGQPRMYNGLVGTAKVIWRHEGIRGMYRGLGPIIMGYLPTWAVWFTVYNKSKIWLRQYHGYVFLLVLVRNGTFKANIDVTDKPIAINFGASIIAGASSTIATNPIWVIKTRLMSQSAFQDARPSMHSHWHYKSTFDAARKMYTTEGLLSFYSGLTPALLGLSHVAVQFPTYEFLKTKFTGQGMGGAAGDQNAKPSFMGTFAASVLSKIIASSATYPHEVIRTRLQTQRRPIPGQEHLQGLGVVAKNGAESKQLATSGPKYRGVVSTFKIMLKEEGWRAFYAGMGTNMMRAVPAATVTMLTYEYVMNNLK

SEQ ID NO: 3515 - protein, 297 aa, Neurospora crassa
  unsure (1)..(297): unsure at all Xaa locations
MSQPLKGKLAIVSGSSRGXXLLCFLNSHSRHXESPGIGAAIAENLASKGCNLILNYTTPSSASLASELSDRLNKTYSISSVPVQADIGTPEGPQAIITAATSAFSKADGSLQIDIIINNAGIARNDLIPNVKVDDFTETYRVNVLGPLLLVQTAQPYLPKDRSGRIVNISSVSSSTGFIGQSVYGGSKAAIEAMTRTWSRELAENCTVNAVNPGPVEGPMYASNSEEFLEGIEGWIKHTPLMKAREDLHGKEAVEEAKQWHGRLAKTGEIAGVVGMLCGEEAGWCTGQVVCANGGML

SEQ ID NO: 3516 - protein, 252 aa, Neurospora crassa
  unsure (1)..(252): unsure at all Xaa locations
MDIRVLRPSDIPLIQHANIENLPENYFLKYYLYHALSWPQLSYVAVDVSRPAKSAYDYPKIVGYVLAKMEEEPTDGVQHGHITSLSVMRTHRRLGIAEKLMRQSSYVVSPPSPPFLSLSSFLSLSSFPFFLSSFFFSLLAPLDLYPPHKSTTNXPIISLTRCEKTEQAMVETFGAHYVSLHVRVSNAAAIHLYRDTLGFKTEKTEAKYYADGEDAYCMKLDLAPIREALLAEAAGREGRQTKNRGRKGIGRG

SEQ ID NO: 3517 - protein, 287 aa, Neurospora crassa
  unsure (1)..(287): unsure at all Xaa locations
SLEAKIVVLGSQGVGKTSLVTRFCKGAFNPAQITSTVGASMMTKRVIDTDTDTVVRLQIWDTGMSWWXFTLVDINHMHMFHHCLHIYLPMSSSPSLPHPFTIYIXMXYPSPSLPTXETATITRAXGXLIPETXNYLKKINAGQERFRSISRLYYRGANACILCYSITDAASFAEMGMWLTELRRNLPQDIVLHVVGTKADMVARDPSKREVPFERCIAYVAENLNPGVGSTPPPTATPLGMPGVGGSLNSNVVVAXEGGQVQEQEQGRRRRQRRQVLGLHQQQQPQK

SEQ ID NO: 3518 - protein, 522 aa, Neurospora crassa
GHFTNTNTVASYYDNLDDRNVVSTVEPGYLRKLLPSEAPVEGEAWTDIHKDIEGKILPGITHWYGDLTMFIFNFLSFLFLTQNQRLTIQPGQHPGFHAFFPCATSFPSILGELYSAALSGACFNWICSPAVTELETIVLDWLAKILGLPECYLSTGPTRGGGVIQGSASEAVLTAMVAARDKYLRETVPLEQFPEGSEAREDAIAHKRSKMVALATTATHSSTKKASIILGVRFHTIAVHADTGYSLTGPVLAKTLAELRARGLEPFFMTATMGTTDTCAVDDFAGIVSTLKSDPVHPAGTPGELWVHIDAAYAGSALVLPSVREQVSISLIENFHSFDMNMHKWLLTNFDASCLFVRDRNWFIQALTINQAVYGNKASEGGLVTDYREWQIPLGRRFRSLKIWFVLRNYGVKGLQSYISRTLKLGEEFADSLKSRPDLFEILTGPNFALTVFRVAGKEQGKSDEELNALTKAVCEKINASGRMWVTSTVLDGRFAIRMVTSVSTTEKEHVDRAWKILVEAA

SEQ ID NO: 3519 - protein, 375 aa, Neurospora crassa
  unsure (1)..(375): unsure at all Xaa locations
MSLSNCRFYEEKYPEIDSFVMVNVKQVRYTGVPVVRMRMWMRQSXPPDXIADMGAYVKLLEYDNIDGMILLSELSRRRIRSIQKLIRVGRNEVVVVLRVDKEKGYIDLSKRRVSPEDIVRCEERYNKSKIVHSIMRHVAEKTLVPIEQLYETIGWPLNKKYGHSLDAFKLSITYVIPGNRRTAVGQNGGIDKMLTWMXSNPDVWNDIQFPTEAVAEELKTYISKRLTPQPTKVRADVEVTCFGYEGIDAIKTALRTAEARNTEETQVKCRLVSPPLYVXVFARNSLAMLKTEWKLITIHSLTNTCLDKNAGIARLQEAIQDMRTSIEAAGGHLVVKMEPKAVTESDDAELQALMEKRERENAEVSGDESVSESDD

SEQ ID NO: 3520 - protein, 185 aa, Neurospora crassa
  unsure (1)..(185): unsure at all Xaa locations
IRNGFLGQFSHYLIRYATWIPPLVVFNGWVAEITQIKGPSMYPFFNPHYNESTRRDIVLVSKWYPDRNLKRGMIVTLGEIQNLILQHLACRIRGIGWEPDDXLXPRNPLNPKGKVVKRVVGIAGDVIRTKAPYPHEYVQVPEGHIWVEGDGDKTKDSNYYGPISACLVTGRVTHILSPWDRFGRV

SEQ ID NO: 3521 - protein, 504 aa, Neurospora crassa
DVVVVGAGVFGCAAAYALANQGRSVILLERWMHEPDRIVGELLQPGGLQALQKLGLGHCVEGIDAITCYGYHVVFHGEEVAIPYPVVDDQGKVYSGEAAARVESTATTTTSNGTAGKANSGPKLRRPEGRSFHHGRFISQLRKACAGHPNITIFETTVTSVIRGSHSNQVLGVETLTTTDRDTGEKQPDFFFGQLTLIADGYDSKFRKQLLPSGPDTTPVVRSKFYALELIDCPFPPSGYGHVVIGKTSPILLYQIGTHETRALIDVPLDLPAASAANGGVRGYIENTVVPTLPSSVRPSVLAALKDGKIPRSMPNSYLPASGKANTARTPGVLLLGDAYNMRHPLTGGGMTVAFSDVVLLASLLHPDRVPNLADSAAIETAMKEFHWRRKAWTSIINTLAQALYSLFAANDWQLDALRKGCFRYFQMGGAKTDEPVALMGGLLQRPVVLARHFFTVAFVAIWLHMCERVGSVWGLWRAPLVLVEAVLILWKACVVFLPTIWKE

SEQ ID NO: 3522 - protein, 1878 aa, Neurospora crassa
  unsure (1)..(1878): unsure at all Xaa locations
PVSIMAATVYRPATAPIADAPCEGLVCLELEDGSAYQGYSFGAPKSIAGELVFQTGMVGYPESVTDPSYRGQILVITFPLVGNYGVPSRETVDDLLKDLPAHFESNQIHIAGLVTASYAGEDFSHFLATSSLGTWLKEQGIPAMYGVDTRALTKRIREKGSMLGRMLLQKEDLAVSAPSLGVPGDWKPHFETIEWVNPNEKNLVAEGKQHLPSAKMDRPFLTRYFQVSIKEPKLYKPDEATALKHPSGRNLRILCLDVGMKYNQLRCFIKRGVEVLVCPWDYDFSKEEYDGLFISNGPGDPKVMDTTVEHISAALQKNNTPIFGICLGHQLLARAAGAKTVKLKFGNRGHNIPCTSMVTGKCHITSQNHGYAVDATTLPTGWQELFINANDGSNEGIMHVDRPHFSVQFHPESTPGPRDTEFLFDVFIQTVAKCTTDNTLLQKGVEFPGGTTEENERLHPRVDVKKVLVLGSGGLSIGQAGEFDYSGSQAIKALKEEGIYTVLINPNIATIQTSKGLADKVYFLPVNAEFVRKVIKYEQPDAIYCTFGGQTALSVGIQLKDEFEALGVKVLGTPIDTIITTEDRELFARSMESIGEKCAKSASASSVEEALNAVKDIGYPVIVRAAYALGGLGSGFANNEAELVDLCNKALAASPQVLVERSMKGWKEIEYEVVRDAQDNCITVCNMENFDPLGIHTGDSIVVAPSQTLSDEDYNMLRTTAVNVIRHLGVVGECNIQYALNPFSREYCIIEVNARLSRSSALASKATGYPLAFIAAKLGLGIPLKEIKNTVTKVTCACFEPSLDYVVVKMPRWDLKKFTRVSTQLGSSMKSVGEVMSIGRTFEEAIQKAIRAIDFHNLGFSESKGALMSVDDELQTPSDQRLFAIANAMHAGYTVDRIWELTKIDKWFLSKLKGLSNFAKDMTKLTANDVVGRPDLLLRAKQLGFCDRQLANFWDSNELAIRRMRLEAGITPFVKQIDTVAAEFPAFTNYLYLTYNASEHDVSFEDRGVMVLGSGVYRIGSSVEFDWCSVRAIRTLRESGFKTIMVNYNPETVSTDYDEADKLYFENINLETVLDVYQMEDATGVLGAMGGQTPNNIALPLLRAGVRVLGTSPEMIDTAENRYKFSRMLDRIGVDQPTWKELTSFDEAKAFCQKVSYPVLVRPSYVLSGAAMNTVYSEADLESYLQQAADVSPEHPVVITKYIENAKEIEMDAVAKDGKVVGHFISEHVENAGVHSGDATLILPPQDLEQTTIQRIEEATRKIGAALNVTGPFNIQFIAKDNDIKVIECNVRASRSFPFVSKVMGVDLIEMATKAIMGLPFVEYPAIDRPSGGVGVKVPQFSFSRLSGADPVLGVEMASTGEVASFGVDKYEAYLKALMSTGFKVPKKNILLSIGSYKDKKEMLPSVAKLSQMGYKLFATAGTADFLQEHDIPVQFLEVLAKEDDQKSEYSLTQHLANNMIDLYINLPSNNRYRRPANYISKGYQTRRMAVDYQIPLVTNVKNAKILVEAIARYRDMEIGERDYQTSHTPLQLSGQVNFTLQDSLSRPHSFKKAHVLSVEQYTRADLHLLFTVAEEMRLSVQRGNVMDILKGRMLATLFYEPSTRTSASFEAAMKRLGGEVISIATQHSSVQKGETLQDTLRTLACYADAIVLRHPDETCVDVAKKYSPVPVVNAGNGSREHPTQAFLDLFTVREELGTVQGLTFTFVGDLRYGRPVHSLVYLLRHYSGVKVQLVSPKGLELPTDVRQQLVKAGQLLCESETLTPEILGKTDVLYCTRVQKERFPSEAEYEKVKGSYRIDNQTLKHAKSKMAIMHPLPRNEEIAEEVDFDQRAAYFRQVRSSFDIVSATMRLSSSFADRLXMRYGLYCRMALLALVMS

SEQ ID NO: 3523 - protein, 638 aa, Neurospora crassa
  unsure (1)..(638): unsure at all Xaa locations
QDYKTQKDAVLFAIDVSKSMLKPPQNTGDKKADKDSALTAALTCAYQIMQQRIISQPKDMMGVLLFGTEKSKFRDDSGNGTGYPHCYLLSDLDIPGAEDVKKLKALIEDGDDEDEIMVPSKEPVIMSNMLFCANQVFTTNAANFGSRRLFIVTDNDDPHAGDKQAKSSAAVRAKDLYDLGVVIELFPISREDKKFDLSKFYDVRKRACQVTELYADVVXDIIYRNPAAEAGQSESPKTSKSGDGLTLLNSLISNINSKQTPKRSYFSNLPFELAPGLTISIKGYMPLNRQTPTRSCYVYEGEEQAQVVQSETAQVDFAARTVEKSELRKGYKFGGEHICFKPEELAELKQMGKKTLRIIGFKKRSKIPSWASVKKSIFIFPSEEQYVGSTRVFSALWQKLLKDDKVGIAWFVARENAHPVMVAIFPSGNPDDEEANTPYLPAGLWLYPLPFADDVRSVDHVTAPPRPADELTDQMRQVIQNLQLPKAMYDPRKYPNPSLQWHYKILQAKALDEETPDAMDDVTLPKYRQIDKRVGGYLAEWKEMLAKKANDLQNTRAFKREFEEDDERPAKRAKPSKKAASGGGGPANSNADLKKAFEQGTLGKMTVAELKDIMASKGISTAGRKAELVERLEQWVEE

SEQ ID NO: 3524 - protein, 455 aa, Neurospora crassa
  unsure (1)..(455): unsure at all Xaa locations
CARPRGLRASGRRSDALSSRRGGSATPTTHPVTQKNVGTAMVFLNMGGPSTLDEVGDFLSRLFVCFXIMMMAIPCVWLAIFILRLFVLTNPCRLMADLIPLGRLQNYLGPLISKRRTPKIQKQYGAIGGGSPIRKWSEYQCEEMCKILDQISPETAPHKPYVAFRYANPLTEEMYKKLLADGFGNGRGGRAVAFTQYPQYSCSTTGSSLNELWKWRQRLEGKAGPSEDGKDGTIRWSVIDRWPTHPGLVEAFARNIEEKLAEYPEERRKDVVLLFSAHSLPMSVVNRGMPISSLLTLQWDILITPTLGDPYPQEIGATVQAVMQRLNFSNPYRLCYQSQVGPQPWLGPQTQTSVEEYIHKGQKDLVLIPIAFTSDHIETLYELDQEVIGESGHPDTVKRVESLNGNPVFIKALADLAKEHLDSGLACSHQNSLRCPGCKSERCAASKKFFAGQEI

SEQ ID NO: 3525 - protein, 441 aa, Neurospora crassa
  unsure (1)..(441): unsure at all Xaa locations
RNIVRRKLTGYVGFANLPNQWHRKSVRKGFNFNVMVVGMXRFLCPLKEIYXFXTCRESGLGKSTLVNTLFNTSLYPPKERKGPSLDIVPKTVTIQSISADIEEAGVRLRLTVVDTPGFGDFVNNDESWRPIVDNIEQRFDAYLDAENKVNRMNIVDNRIHACVFFIQPTGHSLKPLDIEVMKRLHTKVNLIPVIAKSDTLTDDEIAAFKARVCLRALLVLRSILTVYHRFLADIKYHKVQIFEGPRYELDDEETIAENNEIMSKVPFAVVGATNEITNADGRKVRGRRYPWGVIEVDNEEHCDFVKLRQMLIRTHMEELKEHTNNVLYENYRTDKLIAMGVSQDPSVFKEVNPAVKQEEERALHEQKLAKMEAEMKMVFQQKVAEKESKLKQSEEELYARHREMKEQLERQRLELEEKKSRIESGRPIEKEPTKRKGFSLR

SEQ ID NO: 3526 - protein, 469 aa, Neurospora crassa
  unsure (1)..(469): unsure at all Xaa locations
SLVDRAIAQLRACRPIPESDVRELCHKAREILIEEGNVVTVNAPVTVRLELSRSKYTHVESNPTATRYCGDIHGQFHDLMELFRVGGDPPDTNYLFMGXGCPWSVNHVVKIMLSXLLYCRMLIGDFVDRGFYSLETFLLLLCLKVRYPDRMTLIRGNHESRQITTVYGFYDECYRKYGSANVWRYCCDVFDYLALGAIVLGASNTISPSAGESSIPTTPEGGEVEIEVCNAQGEVMSRFPRPNNGADSDVQSRTNGIPPPSNTGPPGSGASGLSRGSVGNPAGAVLCVHGGLSPLIDKVDKIRLLDRKQEVPHEGAMCDLLWSDPDEIDGWGLSPRGAGFLFGADIVKVFNHRNDLSLIARAHQLVMEGFKEMFDASIVTVWSAPNYCYRCGNVAALLELSEDDSGLGVLARSNGDVNRSNGGAGSSGGLGEGELQPMKGPARRYRVFQAAPQDSRGMPAKKPVADYFL

SEQ ID NO: 3527 - protein, 892 aa, Neurospora crassa
  unsure (1)..(892): unsure at all Xaa locations
ADDVDPAKATKADLFPYGVAAKITGVEGRGTGEFTLLVEGVTRIHVEKVISDKAYLEGKVSSYADPALITDAALEELFMSLKLLSRQFVTILRLSSLLPQSSGTPGLSPLLARRLDFYIAKQKYPGALADFMANIVESSYEEKLEILTLIDVKERVAKVIELLDRQITNIKNSMRVTTITATTLPFPMDPDAAKHGKIKPPVKAPGHGAGMPFSPQGGFMGRGGNADEDQEPNEIEELQKRLDAARLSPEAAKVADREIKRLKKIHPAQAEYAVTRTYLETLAEIPWTTTTDDRLGPDTLNRARKQLDEDHYGLDKVKKRLLEYLAVLRLKQAINDDVDSQIKQLEQELGVASESSKEDAAQSTPIDLGVDEKAKAGGDKLEALKSRRMVDKSPILLLVGPPGVGKTSLARSVATALGRKFHRISLGGVRDEAEIRGHRRTYVAAMPGLIVQGLKKVGVANPVFLLDEIDKVGGSSIHGDPSAAMLEVLDPEQNHNFTDHYVNVPIDLSKVLFIATANSLDTIPAPLLDRMETIYIPGYTTLEKRHIAMRHLVPKQLRVNGLDESQVSFTPEVVSRIIESYTREAGVRNLEREISSVARGKAVEFADAKDSGHPENYNPQLTVDDLEKFLGIEKFEEEIAEKTSRPGIVTGLVAYSSGGNGSILFIEVADMPGNGSVQLTGKLGDVLKESVEVALTWVKAHAYQLGLTQSPSENIMKDRSIHVHCPSGAVPKDGPSSGISQAIALISLFSGKAVPPTMAMTVSISQSHYFGPLTPFXFHYLSFDFSFSWDSKHNESRARQSGSYVRLTFPIWIRGRNTVPPCYVCKANTAFVSVSQGEISLRGRITAVGGIKEKLIGALRAGVKTVLLPAQNRKDAKDLPQEVKDGLEIIHV

SEQ ID NO: 3528 - protein, 590 aa, Neurospora crassa
  unsure (1)..(590): unsure at all Xaa locations
MSTPQKTAGGNNAYHNFYNDFLHIKDPNERRRLALAEVDRAPFGWYHVRAVAVAGVGFFTDSYDIFTVSLLTLMLGIVYFQAKARCLQPPTQPSSSQHRPARSLGRSASAPLLMSLVVRACTDWNCCSSSLPLSLRPWPRVTFHQHHRYHYLLACSYGKQLFRRTPLTRNVXLTSITTGGRYRWRLSSFQYYHSEFATTKWRGAMMGAVFAMQGLGQLAAAFVMLFVTLGFKKSLEAAPTLASCTGDCAVAVDKMWRTVIGVGAVPGCIALYYRLTIPETPRYTFDVKRDVEQASDDIEAFKTGKPKGQPDEATRIVAKQEAEKEMEIPKASWGDFFRHYSKRKNAMLLAGTALSWCFLDIAYYGVSLNNATILNVIGYSTTGAKNTYEILYNTAVGNLIIVLAGAVPGYWVTVFTVDTVGRKPIQFMGFGILTILFVVMGFAYKHLSPHALLAIFVLAQFFFNFGPNATTFIVPGEVFPTRYRSTSHGLSAAMGKIGSIIGQGAIAPLRTRGAVKGGNPNPWMNHVLEIYALFMLLGVGTTFLIPETKRKTLEELSGEFDMSGEEEAQRDTTLTEHKTEAPTSSAAVNA

SEQ ID NO: 3529 - protein, 308 aa, Neurospora crassa
AKTVVAPLDRVKILFQAHNPHFVKYAGSWWGFGEAIKEIYRQDGVKGLFRGHSATLLRIFPYAGIKFLAYEQIRALVITRKDHETPLRRLVSGSLAGVTSVFFTYPLELIRVRLAFETKREGRSSLRSIIRQIYSENALTVPKNAPASAHAPALIPRTGLANFYRGFSPTLLGMLPYAGMSFLTHDTVGDIFRHPSLAKWTTLPQPENAPAGKAAPLRSWAELTAGGIAGLVSQTVSYPLEVIRRRMQVGGAVGDGHRLTIGETAKLIMRERGVRGFFVGLTIGYAKVVPMVATSFYTYERLKTFFGI

SEQ ID NO: 3530 - protein, 990 aa, Neurospora crassa
  unsure (1)..(990): unsure at all Xaa locations
SSSAADPFAARLNSDVRQRHPTASATSKNVEGTSQQKQQQQQQQSEANAAASRVKKTYGKTPDGTGKEILRRLVFNVYSRVRLGMNXHNPSQCLVFVVPTTHDMVTQLLDPREPKNLSDVAVLAIIALHFLAAYYLPWGVKRPLFAAIFMFWRLAYNVGIGYLLTIQSKYKLLVTWAKRWKLFENPATGKNPRPWLYNLLKKELETKIPQDYKFEEAPIEYNTWLTFRRVVDLILMCDFISYCLFAIVCAHKPDGEGLFMCFARWAAGITLVGFNLWVKLDAHRVVKDYAWYWGGKSNYFRQLSQDTGTDHIDFFYLIEQELTFDGVFELAPHPMYSIGYAGYYGISMMAASYDVLFISIIAHAAQFAFLVIVENPHIEKTYNPPQPRVRCESEAGSQLQEFASEYSVPSTTGRHDNTPLPVHNLIGLKNLDFFRITDVAIVLLCAYLAVVTMVTPNTRFYQALFVLHALAWRLWYSAGLGVILTMQSEEKMFTRHFLKYGESVGEAWRQWKGIYHLSNCLCHASFIAASYKMYEFPADWTYGWALLKHVVGLSLIALQVWTATSIYESLGEFGWFYGDFFFDSKRQLTYTSIYRFLNNPERVFGTAGLWGAALITWSRAIFLMALAGHFLTLAFLAYVEKPHMQKVYGRNLRDDAGVTKFIKRSLPPPVTEWQQSIDKVLDETKHFIDEFVDAARSRLATGSSTIVKDTSALFNKYPARLTLSKISPDLAGYDPKHYGLSLAGTRVVGTNEKATGKESPNARVLKDVKTQAFEYGAPIRVKWTAPANHSKKDWVGLYMVTDNRSREVTEVPSLGRWVPTNPGEYDTTTDQGILVWDQPVEKKSEDTDLVEGEMVFEGDKLWWTQGVFEFRYHHGGGHHVMSISEPFEIQIPKFDDEHMGVDISGEVGERAVEAALLPVIRNCLDRDPDIAPSNAEERFGGHVERDGKYARRVVYAIRHMFGIDFAPAVVLADGNVRRLAWRICHAKEVL

SEQ ID NO: 3531 - protein, 328 aa, Neurospora crassa
  unsure (1)..(328): unsure at all Xaa locations
RLAGKTIVITGASSGIGRSTAFEFARTAPNHGLKLILTARRVDALEQIAKEIRQEVGEGVQVLPVKLDVSQPEEVRGFVGNLPEEWRDIHVLVNNAXVSVTPSDDNDQGEXEEGKPKYDLKKXKXKETKMANEKXYMYSGLVKGGLAAPXPNXPPKPHLKSYCTNPPKQLKTKKVAQAPSIAEEDINVMFATNVTGLINMTQAILPIFKARGSEGGSGDIVNIGSIAGREPYAGGSIYCATKAAVRSFTDALRKELIATRIRVMEIDPGQVETEFSVVRFYGDKNKADAVYAGVDPLTPDDIAEIVVFVVTRRENVVVADTLVFPSHQ

SEQ ID NO: 3532 - protein, 354 aa, Neurospora crassa
  unsure (1)..(354): unsure at all Xaa locations
DREAVFPTRQSLGIMKAKLKGAETGHSLLKRKSEALTKFVVPLPAHVHPYLYTELDTDILISLNRRFRGTSHSRTHQISAKCRHSNTPVSSQEITRRIDEAKRKMGRVMQIASLSLAEVTYAVGGNIGYQIQESAKSARFRIRAKQENVSGVLLPAFEAYQAEGNDDFAMTGLGKGGQQVQRCRETYARAVEALVELASLQTAFVILDEVIKVVNRRVNAMXGEPNLSSLQDRMGDTNTEFLVSHVIIPRTENTIKCKXMXTPRFRHXGRLLTAIIDINSELDELDREEFYRLKKVAAKKQRDNAETDAQMKAKKAEQQRLALADSENAEGEQTENTPADILACRGGRRRHLLV

SEQ ID NO: 3533 - protein, 518 aa, Neurospora crassa
EAMTGRWGVILDAGSSGTRLHIYRWKDPEKALVDATPEELRSLPKITTKKKWTKKIRPGISTFGEKAGVVGQDYLKELIDHALDIIPADKIHDTPIFLMATAGMRLLPQVQQNAITGAVCTYLRKNTNFSLPDCDLHIQVIPGETEGLYGWIASNYLLGGFDHPEQHAHGQDHHTYGFLDMGGASAQIAFAPNSTEAQKHANDLKLLRLRTLDGSPAEYKVFTTTWLGFGVNRAREAYVQSLSDLYTTSDAGELPDPCLPKGLRLSLDGTPVSKPKKGETTLIGTGAFDECLRKTYPLLGKDKPCADDPCLINGQHVPAIDFDVNHFVGVSEYWHTTHGVFGGKENEAYDFTTYQKRVKDFCGRDWNSIEPSLDAHKKFAVKDAQEACFKASWLINILHEGIGVPRIGVEELPAPGLNASKGAIETAKQKGFLDPFHPVDKIDGIEVSWTLGKMVLYAAGQVPPKTGDDRFPVGFGTNIPSAGATELPPDFQYAGSTVDTTQRRSQPQRLALPSGRQW

SEQ ID NO: 3534 - protein, 1111 aa, Neurospora crassa
  unsure (1)..(1111): unsure at all Xaa locations
AVDPVSLVISECIAITSAIQKHARSPHSSVSAILGGSPNLIQLVPPSGPALRRDQKKMAGSSAADDSSDLATNRWGLRGKKGKSILDNPLISGFGRLRQELTGVKGSYTDDAVARVMSMERQKGLQXSNFWANRILTDIHQFDALVLLYPFLQIIQAKGTAAPITILALRAIQKFLSYGFIAPQSPRFALAMQSLSAAITHCQFDISDSAQEEVVLLMILHLMENMLAGPGGDILSDESVCDMMGRGLTICSRSRFSAVLRQTAEASMVRMCQIIFEDLKHLEVEAGEESEALDRQTSGDMDSVKLDPVANGTDVPVTPVATELLVAQGNERPGTATSSADPRPSTAVETENGDRSSTASAADARRSSTSSGTGSTASIDLRPYSLPSVRELFRVLVSFLNPHDRKHPDQMRVMALRIIHVALEVAGPSIARHPALATIAEDQLCSYLFQLVRSDNMAVLQEALVVAGTLLSTCRGVLKLQQELYLSYLVACLHPAVEIPREPGIDPSLYSGIPQAPKLVKPPPSQAGSGRSTPVPVKDRQKLGLEGGARKPDARQAMVENIGVLVRMPSFMVELFVNYDCDEDRVDLCEDLIGLLARNALPDSATWSTTSVPPLCLDALLRFIQYIAERLDQAPETEGLPDPEELRERRARKKVIIKGTNKFNENPKGGLAYLKEKGIIASDTDPVCVATFLKGTSRVNKKMLGEFISKRGNEAILDHFIGMMDFTGKRVDEALRVLLETFRLPGEAQLIERIVTSFAEKYCAGSTPEDVADKDAVYILTYAIIMLNTDQHNPNFRGHARMTYTDFARNLRGQNGGKDFAPEYLQDIYDAIKSNEIILPEEHDNQHGFDYAWKELLLKTESAGPLVLCDTNIYDADIFNTTWNAIISCLFFVFMSATDDTVYARVITGFDECARIATKYGNSEALDELVYRLSLISTLSSESLSNTQLNTEVQVGENSVMVSELAVKFGRDVRPQLATLVLFRVVTGSEHIIRNSWKMXVFLAEXGKCFDANRKQIVRIWLNLFVNSLIPPFFSTEPDRLALPAIPLQSPSNVIDRQKQNETSFFSAFTSYISSYAADDPPEPSDEELESTLCTVDCVNQCHIGDVFANI

SEQ ID NO: 3535 - protein, 551 aa, Neurospora crassa
  unsure (1)..(551): unsure at all Xaa locations
QAVMADSAVFTDQSIPLNAVEAQLKGLLIDVAKYINESQEAAEGEKEGKNVNEPVILRWAGGWVRDKLLGTESNDIDVAINNMTGEAFALRLRDYCDADPAHRERHSIGPADVGNLHKIARNPDKSKHLETTTIKLFGLDVDLVNLRKETYTEDSRHPQVEFGTAEEDALRRDATVNALFYNLHTGKVEDFTGGMKDMERKLIRTPLEPLQTFMDDPLRVLRLIRFACRLGFTIDEETKAVMGDERVLEALKLKISRERVGVELEKMLKGKSFLFLSSNYNLSTKCXHHLLPGPDPFSSLTYINNLSLYHTLFTDSARSDFPRPPLTSWPIAYQTLHSLSTTLATPGSIYSLLVTSPESAYFAWNLAALVPFASLPDDPPLKGGKPAPPLATQAAREGYRAPNKLTDVITASHRNRTAILAMRDLVVRPAAGDEGKKMERDRLGLAIREWDSRPGAGANWRLQVLYAVLVDVAERTTSEGKETVEDVLKEWQAFLDHLVEMDLMDAPSVKRIIDGKQLAKALGVKPGKWMGQALEVVMAWQLRNPTVSDPE

SEQ ID NO: 3536 - protein, 1100 aa, Neurospora crassa
  unsure (1)..(1100): unsure at all Xaa locations
LQIHQIQSGQVIVDLCSVAKELVENALDAGATTIGTSQDICPCEVXTDTKEITDVRFKNQGLDSIEVQDNGSGISSSNYESIALKHYTSKLSNYDDLSTLQTFGFRGEALSSLCALSHFTIVTCTQKEAPKATKLEFETSGKLKSTSVVSGQRGTTVSVENLFKSLPVRRRELERNIKREWGKVVNLLNQYACIQTSVKFTVSQQPTKGKRMVLFSTKGNPTTRENIINVFGIKTMTALIAMDLRLQLKPTNTGLLAKMTAQDDDAMTEVRICGHISRPAHGEGRQTPDRQMFYVNGRPCGLPQFAKVFNEVYRSYNSTQSPFIFADIQLDTHLYDVNVSPDKRTILLHDQGQMLDNLRESLIELFELQDVTIPVSHTQLLKGSTFRGPSTVPLGSLTPAREKDSRDASEEPGSSLPSNRPENGPQGNRATRHAVNEDSDEAVSDEDNAPNTLSTGPKTRAGPCESTPANTQASNLLARWLERKSEARKQPVSAAINANDSRREKSPVEKEPQSPKRARRYDTKDAESDAEQDTAEDNEHVENNSMTQDVVDDKEMDRQELTMPSIPPPTQPPIPKGSLLSISRPPKRSAQEEVATITIGGHSITSVIGSSNKRSRLSEGMRSVSLGSSPTKGIRTVPVPSFGGRLTQLFSASGGASRGVSKDLEMTTEDVEMVDEEGKGEENEEGNETEKGVDSDDEALFVSQTKDVPAVEYDDVDEQAEHSTRENSPADEEGNGPISGQTNQSVAEGDDNGEVELSEDAPSECCHHGDDDEEYIDEDEKKAKEEKKVQEMIKAAEKKANEPTEEGEKRSQSFVKGRLKRKDLTFNLIQRLKTSEGDIRSRMEIWAKHLPRAGTASSSTQESSDGKPTIGLDAADAEEKLSLKISKSDFAKMKIVGQFNLGFIIAVREASSSHSLEHSPSQQSPAATTQEDDELFIIDQHASDEKYNFERLQSTTTVQSQRLVQPKPLTLTAVEEEIILEHLPALAANGFQVRVDTSGESAVGSRCQLLSLPLSRETTFGVADLEELIFLLGDNPTSSATTAIPRPSKVRKMFAMRACRSSIMIGRALSRPQMEKVVRHMGEMEKPWNCPHGRPTMRHL

SEQ ID NO: 3537 - protein, 647 aa, Neurospora crassa
  unsure (1)..(647): unsure at all Xaa locations
AEVDVLNSRLEKTSQLTKKIQACLARLDATGKSVRDVAGPLSGETRKLQVLGNSKSSGPSSPYLVHRXLRLTVELLYVDIDAVIAAIEKLRSPADSKNDEEQIIRMGPEKAGLPNYLASIKRLNKALNDMKASNLRSTQQTVADLQRLVKTGNSQLESSFDKLLRSETPRAIEPLHYLTKNMPFPVLSQEKITRLGLMNSYLTGVHQQNTGAGSSQESPVIKIYAEVRAQYLLSTLGNLATASTNTAKKKTPEAVYKAGTNGMGTYAQAMEGLFLAEYDNICSIFMREDWGPVFQATCQPALVELGRTLRELNSHIKSHITTDCYLAYEIVEIISSLSSNLENRTGELKSSLAAALKPIRETAKSSLVDLLEETKRQVNSLQTLPADGAPTPLATQTMQRLQSMVNFLRPISSIMISIGDGGWKSAAASKGGATDTIPSLVSFDVGADGQEIFAHYCADTIETLLSSLDARARVLYQQKKAVIGVFLANNVTVIERMINESGLVTLLQSRLQVLDVWRKKATALYTETCKEISIHLFDTVHTNRTARPGSGQGMVSSASIMKGLSSKDKEKIKGMFTAFNSGFEDMVARHKQFTMEKEVRQMLAQDVQHMLEPLYNRFWDRYHEIDKGKGKYVKYDKGSIAAVFRSL

SEQ ID NO: 3538 - protein, 515 aa, Neurospora crassa
  unsure (1)..(515): unsure at all Xaa locations
LNPTVGATDAVASSKHSAVLHRHLDTTFLNMTRSEGNFLILEDDRKIFDASGGAAVGCLGWGDQRVAQAVTNQVLAAPYCATIFYTTRVQEELCRDLVQSTNGAMARAYIVNSGKTITSQLSPTATDTCQGSEAMEAAVKLARQYFLEIDQPQRTRFISRKQSYHGITLGALSVGGHEVRRAKFEPLLIKNVSRVSPCNAFRGKAPGESDEEYAERLAKELDDEFQQVGPENVCAFVAEPIVGAVKLLHVIGVERARILTVAFQALGCVPAVKGYFKAVRDVCDKYGALLILDEVMCGMGRSGTLHAWEQEGIVPDIQTIGKALGGGYQPVAGLLAGHRVVNALEKGSSXVVSPTVQQXRYTNXSQPVVFVHGHTYQGHPAACAAALEVQRIVREENLLSNVRAMGDLLSSRLREILASHPNVGDIRGRGLFWGIEFVADKENMAPFPSEDHVCMEICQLGLTDKYGINVYPGGGSVDGITGDHIIISPAFNISREDVEWIAATVGRLVSDYFAA

SEQ ID NO: 3539 - protein, 772 aa, Neurospora crassa
TDDQHQRSYRPDIVLMLQKNQRRLVVNIDHVRDHSSEVAEGLLTDPFNWTLAFNHALKTIVSTVPQARPDQIDPDVLYYCAWAGSFGLHTCNPRTLSSQHLNNMVSIEGIVTRTSLIRPKVVKSVHYSEAKKTFHYREYRDQTMTNGIVTNSVYPREDEEGNPLETEYGFSTYRDHQTISIQEMPERAPAGQLPRGVDVILDDDLVDRVKPGDRIQLVGIFRTLGNRNTNHNSALFKTVILANNIVLLSSKSGGGVATATITDTDIRNINKISKKPKVFELLSQSLAPSIYGHDYIKKAILLMLLGGMEKNLENGTHLRGDINILMVGDPSTAKSQLLRFVLNTAPLAIATTGRGSSGVGLTAAVTSDKETGERRLEAGAMVMADRGVVCIDEFDKMSDIDRVAIHEVMEQQTVTIAKAGIHTSLNARCSVIAAANPIFGQYDTHKDPHKNIALPDSLLSRFDLLFVVTDDIEDTRDRQVSEHVLRMHRYRQPGTEEGAPVRENAGQALNVALNGQSESQKPTEMWEKYDAMLHAGIKVPSGRGSANKKPEILSIPFMKKYIQYAKTRIKPVLTQEASDRIADIYVGLRNDDMEGNQRKTSPMTVRTLETLIRLATAHAKARLSNRVEERDAAAAESILRFALFKEVVQDESRKKRRKTRPAEGEDGMSSDSDDSDDDDDDVATQTTTARSSAARASRASRASQRASRRTPANGASSSSAANANGTPREEEETQGAEEEEEDIYDATPRRSTRSARTTGDSQPSFASSLPAS

SEQ ID NO: 3540 - protein, 550 aa, Neurospora crassa
  unsure (1)..(550): unsure at all Xaa locations
LRRLEAATLRLEDMASSTIPPIGSQAVIEPASSAPSAPASTAVSTPAPAAAVPIPESVEKFDDFLNQTVQKYVKTSNLIGGLVAEQGTYPAQFWIYFVGREREADHFYQAASVLKGFAETRKFLLAASQSKKLDMNSVDFQEAIKPISEAIQATQEIKDKNRGSPFFNHLGMVADGIMLLAWITVQSRPDKLIDESLSSAEYLGNRVMQANKNTDPQHTEWVKTFYQIFKDLSEYAKDYYNNGIVWNPNGKPYKEVVQCLESGSAPSAPAASPAPSGGAPPPPPPPPGPPPVLKINEQKAEPAQPGGFSSVMSELNKGEAVTKGLKKVDKSQMTHKNPSLRAGSTVPDGPAARSKSPAPPGTKPPKPESMRAKKPAKKALEGNKWIIVSSPAGHCGVNSRFLTVLXENYDAAAGNVEIEASISQSILISRCNEVVIVVKGKANAVNIDNCDKVSLIVDTLVSTVDVVRSKNFQLQVNETIPTVLLDQVEQATIWLSKESISTRVFQSKTDNVNIMVVDENDDSKELPLPSQICSYYDPEKKELISEIVSH

SEQ ID NO: 3541 - protein, 605 aa, Neurospora crassa
  unsure (1)..(605): unsure at all Xaa locations
AMAQTRKNSSLPAGYVEDKSKGPMLRFQESLPRLPVPTLEETAARYYQSLKPLLSPQELENSKKAIDAFIAPNGPGRKLQEKLVARREDPKHKNWLYEWWNDAAYLSYRDPVVPYVSYFYSHRDDRRRRDPAKRAAAITTAALEFKKMVDQGTLEPEYMKKLPICMDSYKWMFNASRVAAKPADYPVKFSADEHKYILAIRKNQFYKIYHEVGGKQLNTAELEQAFKRVYELAASRAPAVGALTSENRDVWTDARATLLSADPKNAKALEAIEASSFVVCLDDAAPVTLEERAHQYWHGDGQNRWYDKPLQFIVNDNGTSGFMGEHSMMDGTPTHRLNDFVNDVIFNNKLDFSDPSVRSNLPEPEAVKFTVTKEVQAEIDRAITDFSNVIGQHQLAVQAFQGYGKGLIKKFKCSPDAYVQMIIQLAYYKMYGKNRPTYESAATRRFQQGRTETCRSVSEASVAFCKAANDASVDDKTKVELFRKAIDSHLEYISAASDGKGVDRHLFGLKRLLEPNQEVPALYQDPAYGYSSSWYLSTSQLSSEFFNGYGWSQVIDQGFGIAYMINENRSVAPPLSFPAYMTIRXKCXHVRLSQPQLXHCLQGPR

SEQ ID NO: 3542 - protein, 295 aa, Neurospora crassa
  unsure (1)..(295): unsure at all Xaa locations
NEYESQVALEVVAPEDIPVGFDDIGGLDEIIEEVREAIIYPLTMPQLYSHGGTLLSAPSGVLLYGPPGCGKTMLAKAVAHESGASFINLHISTLTEKWYGDSNKLVRAVFSLALKLQPAIIFIDEIDAVLGTRRSGEHEASGMVKAEXVTLCSTSKCALCNLGLPELTLKLQQQFMTLWDGLTSTNSLGQPARIMVLGATNRINDIDDAILRRMPKKFPVPLPGKDQRRRILELVLADTKRDPEFDLEYIAMVTEGMSGSELKEACRDAAMVPMREAIRNQKAAGKSIKKLDPNT

SEQ ID NO: 3543 - protein, 476 aa, Neurospora crassa
  unsure (1)..(476): unsure at all Xaa locations
MSTPNSDSPAAQAAKKVFSRLDLDGHNLPPSPAPSSPHNGRRYALATELVYTETKDQYGASSIPIYQSATFKQSSSNGGSEYDYTRSGNPTRTHLERHLAKIMNANRCLSVSSGMGALDVITRLLKPGDEVITGDDLYGGTNRLLTYLKNNQGVIVHHVDTTNVESVRQIISPKTTMVLLETPTNPLIKICDIPTIARITHEANEKAVVVVDNTMLSPMLFNPLDVGADIVYESGTKYLSGHHDIMAGVIAVNDTELGDKLYFTINATGCGLSPNDSFLLMRGVKTLAIRMEKQQANAQRIAEFLESHGFKVRYPGLKSHPQYDLHWSMARGAGAVLSFETGDVALSERIVEAARLWGISVSFGCVNSLISMPCRMSHASIDAKTRAERQMPEDIIRLCVGIEDADDLIDDLSRAVSLPTXMVFLSELKLTQYVIQLVQAGAVTLTVDGFHANTAEGAAAAAAGSEAAETTTTAAP

SEQ ID NO: 3544 - protein, 606 aa, Neurospora crassa
SFIGKTGGEIFHEMMLRHGVKHIFGYPGGAILPVFDAIYNSPHFDFVLPRHEQGAGHMAEGYARASGKPGVVLVTSGPGATNVVTPMADALADGTPMVVFSGQVPTTAIGSDAFQEADVIGISRACTKWNVMVKSVAELPRRINEAFEIATSGRPGPVLVDLPKDITAGILRRAIPTDTAIPTSPSAASRAAIELSRKQLDASIQRVAKLVNIAKKPVIYAGHGVVQSKGGPALLRALSEKASIPVTTTLHGLGAFDELDEKSLHMLGMHGAAYANMAVQEADLIICLGGRFDDRVTLNLNKFAPAAKAAAAEGRGGIVHFEILPKNINKVVQATEAVEGDVATNIELLIPQVDAKTMADRKEWFGKINEWKSKWPLSDYERAERTGLIKPQTLIEELSKLTEGRKENTYIATGVGQHQMWTAQHFRWRHPRTMITSGGLGTMGFGLPAAIGAKVAKPDALVIDIDGDASFGMTLTELSTAAQFNIGVKVIVLNNEEQGMVTQWQNLFYDDRYSHTHQKNPDFVKLADAMGVQSKRIIKPEEVVEGLKWLIDSEGPALLEVVTDKKVPVLPMVPAGCGLDEFITFDQERDRKRRELMVKRTGGVHG

SEQ ID NO: 3545 - protein, 920 aa, Neurospora crassa
  unsure (1)..(920): unsure at all Xaa locations
FYGHFGSXSIPPTAAYFPRXFKTDGKIVGVRYYNGVASPGEVVVCKREPQNQYDPNAIRVDNVLGTQIGHIPRTVAAKLAPYMVSIPLDSLRPFPFLIQIQDNGDLVVEGMLTGEKEFYDCPVRLYFYGTSASLQRARLEERLKKDKLVKATQLNQTRKANEEQRKKQTLELRGNGTYGFPSQTQEPEPQVTMEQLAKMSEVISFRSGGDMIKSLAMSEEDLANLPMASQPEKLRAKLLPYQLQGLAWMISKENPTMPAKGSTDSVQLWQHTADGRYHNMATGFYNKSPPQLLSGAICADDMGLGKTIQIISLIMTEGLGTGPTLIVAPVGVMSNWKQQIRRHVHEEHQPKIVIYHGSKRKEFAKALQDQDVVITSYGTLSDDALVKTRWRRVVLDEGHRWVKQCMVWVPYVQCXQNXSSIRNAKAQVAQNACKLEAKSRWVLTGTPMXVALDNQQSGDSTCSTDKTLHVAXTSIRDLHSLLKFLRITGGIEQSEIFNTVLTRPLANGEPKGEALLKSLMKDLCIRRKKDMKFVDLKLPEKTEHMSRITFWPDEQKKYDALLXAPPHLLIFTMLASXHMDQSEAQGVLENYRTQSKRSQGQFQGVLERLLRLRQTXVIQGVEHSEDANQTLVAIIGCCAKSASQKFSSFSQTKMWVDLTDENRAILQQALQLYIESQEECPICIDPLSNPIITHCKHVFCRGCIDKVIEVQQKCPMCRAPLSEDKLLEPAPEHSATQDEEELESETKSSKTEAVLALVKGTLDKEGSKIIIFSQWTSFLTIIQHQLDEAGYTYTRIDGSMNAAQRDAAIRALDYDPNTRILLASLGVCSVGLNLVSADTVILADSWWAPAIEDQAVDRVHRLGQTRPTTVWRLVMDNSIEERVLDIQKEKRELVGKAFQEKQDGKKKVKETRMADIMKLL

SEQ ID NO: 3546 - protein, 271 aa, Neurospora crassa
  unsure (1)..(271): unsure at all Xaa locations
LQRKIKVVTEQHNINKPAAQEGYPMKEWTVELYILDQDGKERPARCFTKVTYNLHPSFANPSRVSRHRSGRRSPLPISVVSREPEVGXRVANSAFNDPPFKCTNEGWGEFEMIIDMYTTEKGGKISIAHDLNFQQSEYENIHTVTFRNPSQALQQLLRETGPLPSDEERKQKKAVDGGSKKKRPYDIERMADGLTKLGEDDLLQVIQMIHDHKDDNTYIQNNLDGKFARXGVWPLEATRADGXLDMSIAGEFSVDLYTLPDNLMKMLWEFL

SEQ ID NO: 3547 - protein, 418 aa, Neurospora crassa
  unsure (1)..(418): unsure at all Xaa locations
MDSRSSDVSPEAMQARIQQARREAENLKDRIRLKKEGLADTSVSPLVGRSRTAPLSAHACRRQRRIDRCIVLLTXCVVYEVAQQAHEPLPKNNMMKTKKTLKGHLAKIYAMHWSTDRRHLVSASQDGKLIIWDAYTTNKVHAIPLRSSWVMTCAYAPSGNFVACGGLDNICSIYNLNSNRDGPTRVYRELSGHAGYLSCCRFINDRSILTSSGDMTCMKWDIETGTKVVEFADHLGDVMSISLNPTNQNTFVSGACDSFAKLWDIRAGKAVQTFAGHESDINAIQFFPDGHSFVTGSDDATCRLFDIRADRELNCYRREXPVDYSPLGSXFFFLLVALELTFGXSESILCGITSVATSVSGRLLFAGYDDFECKVWDLTRAEKVGSLVGHENRVSCLGVSNDGISLCTGSWDSLVSFY

SEQ ID NO: 3548 - protein, 707 aa, Neurospora crassa
  unsure (1)..(707): unsure at all Xaa locations
PQIAQEFSVLKLDLNLGSLHQADLVHSLQKESVASLLDGKIRSSIKHLYSLRERIEDTSSKVLVTGDLNAGKSTFCNALLRRKVLPEDQQPCTSIFCEVLDARENGGIEEVHAVHRDAIYDRHDEATYDVYSLKELERIVTDNETYQQCKIYIRDARTIDESLLNNGVVDIALIDAPGLNMDTTKTTAIFARQEEIDVVVFVVSATNHFTQTATEFIRAAAAEKAYLFIVVNGFDTIRDKERCQKLILNQVRGLSPATHKEADELVHFVSSTAIPMAPSPPGGSYGGGSGSASGGGGGDDGDDDDPKGKGKKKEMARDFSNLEQSLRRFVLEKRARSKLAPAKTYLTNILNDVHVLATVNQEVAQSEFDRMNQELQKLEPELERSKQAKQEINEKVDQTIEETCQEIYEFSRNTISSSIEHAGDGNFGIPYPGLFSAFEYAEELKEAMLSQIAGSVTQCEEHARARTVDGVNMIKQLGIMHLGNEYTDLAFRPDVMFRRKKDALARQVDIPTELWDFVDWSTVLQKEEKAGMALTVAGVVGTSVLSGYSQMNLALRAAQILGTDNVRRLIIPVXLRPVSLDSLEQFPSEHCADFDSSTAVAATYYVLNQIPHSLPHRLKEKISTQLAAIDYVHSNSIRISGSVRKVLRFPADSLRVGLQRSVEKLDGRRNETLRVKAESDVALKYFANLVRESAHQRRVVEAVDLDG

SEQ ID NO: 3549 - protein, 381 aa, Neurospora crassa
  unsure (1)..(381): unsure at all Xaa locations
GESLPGPRSTFKVGVWEDRNKKCRRTMEDTHAFLYNFLHTPAPVLGAEGSAQKQSKSANESHEKRSSSSASQNADMIETDNGYFAIFDGHAGTFAADWCGKKLHIILEDIIKKNPNAPIPELLDQTFTTVDTELEALPLKNSGCTAAVAVLRWEDRVPSNQSATGSQAIAPAVVKATEDALKVEDGQSEKSLNSSIPEATHAKLKNSATRQRVLYTANVGDARIVLCRSGKALRLSYDHKGSDENEGKRIANAGGLILNNRVNGVLAVTRALGDTYIKDLVTGHPYTTETVIQPDWDEFMIIACDGVSNTNSSAVHFPHCAXRYINXQIFYSLWDVCSDQEAVDLVRDIQEPVIAAKKLVDHALSRFSTDNLSCMIVRFDK

SEQ ID NO: 3550 - protein, 767 aa, Neurospora crassa
  unsure (1)..(767): unsure at all Xaa locations
FGGTSSGAISASSRPSATTDPLTTRPANSAPRPPPNYGSSGSGRAFASLYNASDSFNDTPDVIEVSMQSTRRPQHDLTSSVYIEDDDFSDDENLDLDFEAPSALPVLPTGRISLEQHRELQKQQEEEVKESRFREPPSGTHTSVLSWPESSPSHLQPPKRELNPPPNTNTKHARLQDDDFDFEPPAAVKKPKRELPWTMEAESKEEDWKHAEKYPLEKSGYAPTPESKPKGSMLWNTTASAVKEQKKQLKDRQKSSSVAPKTEIPMDEIKKVVSSHLSKASAITLSGEQLHVKSLVVEKGQSVFFTGPAGTGKSVLMRAIISELKKKFAREPERVAVTASTGLAACNIGGMTLHSFAGIGLGKEDIQTLVKKIRRNQKAKTRWLKTKVLIIDEISMVDGELFDKLSQIGRIIRNNGRPWGGIQLVITGDFFQLPPVLDKDLNKQRDVKFAFDAATWNMSIDHTIGLTEVFRQRDPGKQFNSGISSPTCGXQPLEFAEMLNEMRLGRISDRTVKNFQQLSRPLAFDDGLEVTELFPTRNEVENSNRQRLAALKGKIYRYEAYDTGEPAVREKLLANMMAPPVIELKKDAQVMLIKNMDETLVNGSLGTVVGFMNEATFELKAGSDFDDDEDLDKKRRIKAFTSALSNAAIEKGDNTEYPLVRFHAVDGTRRDILCQPEDWKVELPTGEVQASRKQLPLILAWALSIHKAQGQTLERVKVDLGRVFEKGQAYVALSRATTQQGLQVLRFQKDKVMAHPRVVSFYNKLYS

SEQ ID NO: 3551 - protein, 326 aa, Neurospora crassa
  unsure (1)..(326): unsure at all Xaa locations
NRISDIQAFGDEALLEKYGLKANDAILAEEKHQGLFEDLLQNYDAKLIAGGAAQNTARGAQYLLPPNSVVYLGGVGDDKYAAILHDAVKQAGLRVEYRVDPKISTGRCGVVITGHNRSMCTELGAANHYDLEHLKKPEVWSLVENAEVYYVGGYHFTVCPPAIMELAKQAASGNKPFILSLSAPFICQFFKEPLDASAPYWDYVIGNEGEAAAYAESHGLNTTDVKEIAKALANLPKENTQRKRVAIITQGTEPTIVAIQGEDEVKEYPVHSIDPAKINDTNGAGDAFAGGFAAGVVEGKSIEESIHMGQWLAKLSIQELGPSXVL

SEQ ID NO: 3552 - protein, 770 aa, Neurospora crassa
  unsure (1)..(770): unsure at all Xaa locations
VIKQGWASVKESKNFINPWKNKYLILRKESLDFHKAESSKVAYTLYLKDVINVGRVEAAGTIFEIKRQSSGASTSPGEEENGIRTLQIRVKADDDLYEWIDFIYARCPGMGGVSNPTNFSHAVHVGFDPQTGEFVGLPPEWSKLLNSSAITQEDYERNPQAVFEVLDFYSDFNKNGGQAPTPNFPTPPSNSHRASSSDTRAVETPSRRRALRSRCNNATQAPTTHPRRSSKVAPVLAHHPPSSASRRRRATTLSARERSKGANWSASRERWRSGIAGIRKLIMRPFPRRRLLWLSRRLEVVVMVVPIASTQHAPLHQHPRACSKHRVSKLRDLRLPHQVPSSSRPPVAQQSSSSSQRDLAQAQAQRRAEQQAQAQRSQNGQAPPRPPHPSANQPSKIPTTVKPLNVGPKQPQDGVKAAEAALTSKPAASERSKDVRMSTMSEKEVMQKLREVVSHEDPEAKYSKQKKIGQGASGSVYVAKIRERPGQDPNVSRRRGQVAIKQMDLAHQPRKELIVNEIMVMKDSSHPNIVNFVEAFLKNKDSELWVVMEYMEGGALTDVIENNPRYHGGANFYNLLGGELPCRPNIESDTILYXLKLVQTCRGLQHLHERNIIHRDIKSDNVLLDARGNVKISKFLHNMSLFTLNXLCNQPISVFCAKLTEAKSKRATMVGTPYWMAPEVVKQKEYGPKVDIWSLGIMAIELIESEPPYLNEEPLKALYLIATNGTPRLKKPEKLSKELKAFLSVCLCVDVKSRASADELIEHDFLKHGC

SEQ ID NO: 3553 - protein, 418 aa, Neurospora crassa
  unsure (1)..(418): unsure at all Xaa locations
MARTQKNKATSYHIGQLKAKLAKLKRELLTPSGGGGGGGGAGFDVARTGVASIGFIGFPSVGKSTLMSRLTGQHSEAAAYEFTTLTSVPGQVTYQRWAALFLHLLILRSVTNKVQVELTFCIHTGAPLQIIDLPGIIEGAKDGRGRGRQVIAVAKTCHLIFIVLDVNKPLTDKRVIEAELEGFGIRINKEPPNITFKKKDKGGLNITSTVPLTHIDNDEIRAVMSEYKISSADIAIRCDATIDDLIDVLEAKSRSYIPVIYVLNKIDAISIEELDLLYRIPNSVPISSEHGWNIDELMEAMWEKLKLVRVYTKPKGKMPDYSAPVVLRSNRCTVEDFRKFFFSFVFVFFSFSFVLMHLIEQKKHLGXEXGELTADEPQCNTIHKTIVDQFKVAIVYGKSVKHQPQRVGLSHELADEDI

SEQ ID NO: 3554 - protein, 287 aa, Neurospora crassa
  unsure (1)..(287): unsure at all Xaa locations
YDILSNLGLLNKHGKLLFLGLDNAGKTTLLHMLKNDRVAILQPTLHPSSSTTCSCHLPLFLRQRRDLDTRAPSAFSPFASTLPVPTPVPGSIHRIRYARTCEGEMFREXLWLTXFVVASEELSVGNVKFTTFDLGGHQQGEWIIISYLGLMSNPLGTLTSRSTAAVSTNKXRIYSRRLWKDYFPEVNGIVFLVDAKDHERLPEAKAEIDALLSMEELAKVPFVVLGNKIDHPEAVSEDELRQRLGLWQTTGKGRVPLEGIRPIEVFMCSVVMRQGYGEAIRWLSQYV

SEQ ID NO: 3555 - protein, 516 aa, Neurospora crassa
  unsure (1)..(516): unsure at all Xaa locations
IKPNMEVELTAPNGKKWMQPLGLFINNEFVKSANEQKLISINPTYVSNPISLTXLRVLTIIPSTEEEICSVYAATAEDVDAAVSAARKAFRHESWKSLSGTERGALMRKLADLVAENAEILATIECLDNGKPYQTALNENVPEVINVLRYYAGYADKNFGQVIDVGPAKFAYTVKEPLGVCGQIIPWNYPLDMAAWKLGPALCCGNTVVLKLAEQTPLSVLYLAKLIKEAGFPPGVINIINGHGREAGAALVQHPQVDKIAFTGSTTTGKEIMKMASYTMKNITLETGGKSPLIVFEDADLELAATWSHIGIMSNQGQICTATSRILVHEKIYDEFVEKFKAKVQEVSVLGDPFEESTFHGPQVTKAQYERVLGYINVGKEEGATVMMGGEPAPQNGKGFFVAPTVFTNVKPTMKIFREEIFGPCVAITTFKTEEEALTLANDSMYGLGAALFTKDLTRAHRVAREIEAGMVWVNSSNDSDFRIPFGGVKQSGIGRELGEAGLAPYCNVKSIHVNL

SEQ ID NO: 3556 - protein, 752 aa, Neurospora crassa
  unsure (1)..(752): unsure at all Xaa locations
LLPLSGLIGTALAACPFADPSALGRRAEGGEVDARQRLKEVEVDDNGQFMTTDFGGNIEEQFSLKAGGRGSTLLEDFIFRQKLQHFDHERVCLPCHGPISIKNPSXRKFDTRIPERVVHARGAGAHGIFTSYGDWSNITAASFLGAKDKQTPVFVRFSTVAGSRGSADTARDVHGFATRLYVDHVTTLPFTSSAGRXLDSSYTDEGNFDIVGNNIPVFFIQDAIRFPDLIHSVKPSPDNEVPQAATAHDSAWDFFSSQPSALHTLFWAMSGNGIPRSYRHMDGFGIHTFRLVTEDGKSKLVKWHWKTKQGKAALVWEEAQVLAGKNADFHRQDLWDAIESGNAPSWELAVQLIDEDKAQAYGFDLLDPTKFLPEEFAPLQVLGEMTLNRNPMNYFAETEQISFQPGHIVRGVDFTEDPLLQGRLYSYLDTQLNRHRGPNFEQLPINRPVSGVHNNHRDGQGQAWIHKNIHHYSPSYLNKGYPAQANQTVGRGFFTTPGRTASGVLNRELSATFDDHYTQPRLFFNSLTPVEQQFVINAIRFEASHVTNEQVKKNVLEQLNKISNDVAKRVAVALGLEAPQPDPTYYHNNVTRGVSIFNESLPTIATLRVGVLSTTKGGSLDKAKALKEQLEKDGLKVTVIAEYLASGVDQTYSAADATAFDAVVVAEGAERVFSGKGAMSPLFPAGRPSQILTDGYRWGKPVAAVGSAKKALQSIGVEEKEAGVYAGAQDEVIKGVEEGLKVFKFLERFAVD

SEQ ID NO: 3557 - protein, 1299 aa, Neurospora crassa
  unsure (1)..(1299): unsure at all Xaa locations
FSQTSDLGNYQRYAEDSDDYPDESTTSYYQHGGAIPPDSAAARDSARARNSVLSMGGGLIGRAKNMLGMGPEGYSEMDLPLTDPRATARVDHSHEPPPPQKPAKKFDFKFGFGGGKPDPATLGPRIIHLNNPPANSLNKYVDNHVSTAKYNFATFLPKFLFEQFSKFANIFFLFTAGLQQIPGLSPTNRYTTIGPLAVVLLVSAGKEMVEDYRRKQADKALNMSKARILRGSTFEETKWINVSVGDIIRVESEESFPADLVLLASSEPEGLCYIETANLDGETNLKIKQALPETSSMVSSSELSRLGGRIRSEQPNSSLYTYEATLTMQAGGGEKELPLNPEQLLLRGATLRNTPWVHGVVVFTGHETKLMRNATAAPIKRTKVERQLNTLVLFLVGILLIFSVVSTVGDLIQRKVEGEEGLAYLFLDPMNGASAVARIFIKDMVTYWVLFSALVPISLFVTIEMVKYWHGILINDDLDMYYDVNDTPANCRTSSLVEELGMVEFVFSDKTGTLTCNMMEYRQCSIAGIMYADKVPEDRIPSGEDGEDGIHDFKQLQKNLESHQSAQVIDQFLTLLAICHTVIPEQAEDGSIKYQAASPDEGALVDGAVQMGYRFVARKPRAVIIEANGQQLEYELLAVCEFNSTRKRMSTIYRCPDGKVRCYCKGADTVILERLNDQNPHVDATLRHLEEYASEGLRTLCLAMREIPEHEFQEWMKVYETAQTTIGGNRADELDKAAELIEHDFYLLGATAIEDRLQDGVPETIHTLQEAGIKVWVLTGDRQETAINIGMSCKLLSEDMMLLIVNEESAEATRDNLQKKLDAIRNQGDATIEMETLALVIDGKSLTYALEKDMEKLFLDLAIMCKAVICCRVSPLQKALVVKLVKKYQKESILLAIGDGANDVSMIQAAHIGVGISGMEGLQAARSADVSIAQFRYLRKLLLVHGAWSYHRVSKTILFSFYKNICLYLTQFWYVFHAGNHFXFKNTDLKQYTFQNVFSGEVIYESWTLSFYNVFFTVLPPLALGILDQFVSARLLDRYPQLYNLGQRNTFFKIRVFGEWIINAVYHSIILYVGGCLFWLNDGPQGDGFPGGKWVWGTAMYGAVLLTVLGKAALVTNNWTKYHVIAIPGSMAFWILFVAVYGEVAPKLNISVEYFGVIPRLFTSPIFWIQMPTLAILCLLRDFAWKFSKRLWRPEAYHHVQEIQKYNIQDYRPRYFLPXFVVPPSSPYFFTLPLFDCXRKDNSMEQFQKAIRKVRQVQRMRKQRGYAFSQADESQTRVLQAYDTTQHRGRYGEMASSRP

SEQ ID NO: 3558 - protein, 346 aa, Neurospora crassa
LDTGSSDTWVNSPSSILCQDEDKPCEYSGTYLANDSSTYEYISNHFDIKYVDGSGARGDYASDTFTIGNTKLNRLQFGIGYSSTNAQGLLGIGYTLSEVQTRAGLPAYNNLPAQMVADGLINSNAYSIWLNDLDALTGTILFGGVDAAKYEGDLLTLPVQTPEKGTYKNLMVTMTGLSLSQSQSSSSDKGNGDDTTQISKDNLALAVLLDTGSTLSYLPSELVKPLYDAIGIEYITDPDGKVDGYAPCHLMSSSQSVMFSFSSPLQIAVPMNELIVNRTFHGKLPRMPDGVTDACIFGIQERNGTGANTLGDTFLRSAYVVFDLDNNEISMAQTRFNATATDLKEI

SEQ ID NO: 3559 - protein, 197 aa, Neurospora crassa
EYSVILLGLDNAGKTTFHEQVKALFHPDQPEPKLRTVPTVGQNVSTITLPDMYLKLWDVGGQLSLRALWHSYYSSCHAIIFIIDSTDIGDGQIERDQNNGRLDECRAVLEDVLQHSETEGVPLLILANKQDREDCVEVVRIKEGLVKKVFEGEKSASIRDSRVLPVSALTGTGVREAVEWVRSRVKWNKESRPPVMR

SEQ ID NO: 3560 - protein, 318 aa, Neurospora crassa
  unsure (1)..(318): unsure at all Xaa locations
ATAGAAGAAFANVLVYPLDLCVHPSSLRSLXQSLTLXELQHKTKLQVQVKKSADVEKQEATASNEVHYKGTWDALTKIKNAEGIAGLYAGMNGALLGVTSSNFAYFYWYSIVRTLYLQYQKSDAHPSTAAELSLGAVAGALGQLFTIPVAVVTTRQQTQSKEDRKGIIDTAREVVEGEDGITGLWRGLKASLVLVVNPAITYGAYERLKDILFPGKNTLKPWEAFRKFESSEDYAICLANNCSVVLGALSKSIATIVTQPLIVAKVGLQSKPPAARNGKPFKSFVEVMEFIVKNEGALSLFKGIGPQLLKGFLVQGIL

SEQ ID NO: 3561 - protein, 408 aa, Neurospora crassa
SEDCLFLNVWTPYLPAAGHGGKKGKGKDGDEKKRKDLRPVAVWIHGGAFTSGTSSDSTFDGGNMASRGDVVVVAINYRLSTLGFLALADGKTNGNYGLGDQVTALQWVRENIAKFGGDPDHVTIFGQSAGAGSVRALLASPKTKGLFKGAIPLSNLGGINYGTTYSRYYTIAEETAVVGNAILAATNCTDVACLRQVPAEKLTSGTVARYLVVDGTYLVSPELDLSRTAGPSGIDLMMGITHDDGAPFISYPSTTNQTAYLLSQGFSPSLASPSLFPIPPNPNGTLALFNSSSRLATDSMFRCIDQATVQAGLANNRFSRVFYYEFDRTYQTGGWPNLDVCEPPKTASHPFGDPSKPYLRCHSGELYYVFGNLARQGLPVRDEKDLPFEQFVLDSFASFIRTGDPNPE

SEQ ID NO: 3562 - protein, 551 aa, Neurospora crassa
  unsure (1)..(551): unsure at all Xaa locations
PGEILACMGPSGSGKTTLLNFLASRPLPSASGGGTTTSGSVLINGQPTSTSTFREITRFVEQEDTLIGSLTVRETLDFSFRLASSSKVLPKRERIARIEGLLDAFGLRGQKDALIGTPIRKGISGGQKRRVSVASQLITSPRILFLDEPTSGLDSKAGWEVVKYLKEVAREEXCEAPSLCXCLLGTRGXQEQKQLIVIASIHQPSTATFNLFDKLMLLSAGKMHYFGPVTGVTEHYEALGHEVPLHVNPAEFLLDLVNIDFASEREEAVKALDDMQTAWQGSERSRQLTAAVAEAEARGGDQVDISTAGLGGKPGLIGSTATLLHRSFVKSYRDVVAYGIRAAMYFGLAIMVGTVWVRLDAAQESIIPFINALFLXVLLSLTISSRPPCXSWFMTISGSAFMSFMAVAYCPAWLEDYFQYVKERRNGLYGPTALIISNFLIGIPYLFGFSLLFSVISYWLVNFQPTATAFFIWVFWLFCDLLAAESLVVFMSSLFPSFVISLALVAFANGLWMSVDGFMVQPTILNVFYKYVFHYWDYQKYVFENMMINEF

SEQ ID NO: 3563 - protein, 176 aa, Neurospora crassa
  unsure (1)..(176): unsure at all Xaa locations
ASVTSLDKDLRKLRAEKYTPQAAGEAKSWIESVIGEKLPQPDLLDALKDGVALCKXVLTFLKYPSLSNRLTPRPVQAVNKVLPPPGVKFKQSAMPFVQMENISIFLRSCKAPPLNLLEHDVFLTVDLYERKDPAQVLQCIGAFSRAANAANPEAIPTVIGPKVNAHNTAKVISPQP

SEQ ID NO: 3564 - protein, 752 aa, Neurospora crassa
AGNNTTTGGQPMEKLYRGVEDICRRGKKESGELYEWLKDRCKGWLNSDEVLKSLLAAASVHSFRHGREEDVILLRAVLAAWKRWIAQLLVIRWIFSYLDRSYLLPGGSGTSAEGKGKSASGKREGPTSVNDMGISAFRSAMYSSRSRNGANMLTIGARVVNAVCVLVMFDRLDDSRFDSQLLRESVAMLRLWGVYGKELEPKFINESREYVRRFAEERSESCGLKDYIVACERLLNKESERCDVYNFDSTTKRQLKDDAHDILIFNYAEKLLDSGSVAKLLDANDLDSIKALYELLKLSGIQKRLKGPWEQYIRKAGAAIVSDTARGDEMIIRILQLRRALDVMVRDAFGRDEDFTYGLRDAFGFFINDKSVSSSWNTGTSKVGEMIAKHIDMLLRGGLKTLPKALLSDVKDRQDAERSGIASTADEDAELDRQLDHSLELFRFIQGKDIFEAFYKKDLARRLLMGRSASRDAERNMLAKLKNECGSSFTHNLEIMFKDQELAKDEIASYKTWLAGRGEDSPVANSELDLSVNVLSAAAWPTYPDVRVLLPQNVLDHITTFDTYYKSKHTGRRLTWKHNLAHCVVKARFDRGPKELLVSAFQAIVLVLFNEAEEKSPDGILSYEQLASATGMPDPELQRTLQSLACGKTRVLNKHPKGRDVNKTDTFSINKSFTDPKFRVKINQIQLKETKEENKETHERVAQDRQFETQAAIVRIMKSRKKMAHAQLVAEVINQTKQRGAVDAADIKANIE

SEQ ID NO: 3565 - protein, 69 aa, Neurospora crassa
EAQVWDILIREFAPTNLVVRDISGGCGSMYGVDICSEKFRGLNMLKQQRLVNAALGDLVKQWHGIQIKT

SEQ ID NO: 3566 - protein, 428 aa, Neurospora crassa
  unsure (1)..(428): unsure at all Xaa locations
MSVPEKFTGFQVNGPETWTEFHKNEFQPKPFGDYDVDIKIECCGVCGSDVHTISGGWGEQKFPLAVGHGTVLALHMMPAILSYLSVNQLVNSKTDXLTDXKPIEIIGTALRVGPKVTLIKPGQRVGVGAQSYSCLDCRQCKNDNETYCRKQLDTYGAVWPDTGIVSQGGYSSHVRTHEHWFVFLFFSLSFFSPSVPSLLLKPQLTHSCPPXYDRVFPIPDALPSTVAAPMLCAGLTAYSPLVRNGCGPGKKVGIVGLGGIGHLGLLFAKALGATVYVISRTHSKEADARKMGADGFLATADPNWNEEHIMTFDLIINTANSFEGFDLDAYLSLLDVHGKWVSVGLPEDEEGIRVRNQTFLKNGCFFGSSHLGSRRETLEMLQLAADKGVRTWVEEVKINEENLKGVMQKMKGAGGRYRFCLTGYEEAF

SEQ ID NO: 3567 - protein, 284 aa, Neurospora crassa
  unsure (1)..(284): unsure at all Xaa locations
QELLQWINSLLQLNLTKVEQCGTGLVCHAPPSPSAPPRARPLNESPFCXSPPARNSAALCQVYDSIFGDVPMSRVKFNVNSEYAYIQNFKILQSEXPVPLPSRTVSXVTDDGFPPDTFTKHQIEKSIPIEALVKCKMQDNLDFLQWTKRFWDQYYPGGDYDAAARRKGGALPATMSGASRASAGSAAARRPGGATPTGGPRVAARAPAANSAATQALQQEVATLKEAVGGLERERDFYFHKLRDIEVLVQSAVEEDPELEKQEDGLIKAIQAILYSTEEGFEIP

SEQ ID NO: 3568 - protein, 702 aa, Neurospora crassa
  unsure (1)..(702): unsure at all Xaa locations
EIIRRRRERKAAKEGKTTATKEEEDKMEVDEEEDDIEEIDVDLDDDEDGVLADDAFGMGVGSDWKRRRRSRMRRWGVLMGRMRIVRVKMGRRRERDEDEGDASDDDSVATAVEHPDDVQSSDDEEGIDEEEEAKMKEFFAPEEENQPKKKGEMSSFQEMSLSRPILRGLTSVGFTKPTPIQAKTIPISLMGKDVVGGAVTGSGKTAAFVVPILERLLYRPKKVPTTRVVILTPTRELAIQCHAVAVKLASHTDIKFCLAVGGLSLKVQEAELRLRPDVVIATPGRFIDHMRNSASFAVDTIEILVLDEADRMLEDGFADELNEILTTLPKSRQTMLFSATMTSSVDRLIRAGLNKPVRIMADSQKKTAGTLVQEFVRLRPGRESKREGYLLHICKTIYTERVIIFFRQKKIAHKMRIIFGLFGLSCAELHGSMNQAQVCLRFTMLQMDEXYXQDPXRIQSVEDFRDGKVNFLLATDLASRGLDIKGVDTVINYEAPQTPEIYVHRVGRTARAGRSGTAITLAAEPDRKVVKAAVKAGKSQGAKISSRIIDPADADKWQAEIDELEDEIEEIMQEEKEEKQLQNMEMQVKKGENMIKYEDEISSRPKRTWFETQEDKKKAKAAGRAELNGVRDKLKSKNEGKLSNKDRKKLDTMQERKQERTYKKGSAERAGKGAVLNLKKVVKKVGRSAGPKKKGGNAGKGG

SEQ ID NO: 3569 - protein, 441 aa, Neurospora crassa
  unsure (1)..(441): unsure at all Xaa locations
RVDDDDGHMIVIPGNDLTERCKSSDYGHLPRVIDKLTIVADEILKLLGQGTFGKVVQAKDKKRNKLVAIKIIRSVQKYRDASKIELRVLATLKANDEENRNRCIHLRDCFDFRGHICIVMDLLGQSVFDFLKDNNFVPFPNSQILAFARQLFTSVAVSISFFCLHCITEEGTNEKLVLHDLNLIHTDLKPENILLCNQEYQTFTYSRTIPSSSTLTNRRAVHRKVLLDTEIRLIDFGSATFQDEYHSSVVSTRHYRAPEIILGLGWSFPCDIWSIGCILVEFYTGDALFQTHDNLEHLAMMEAVVNHKIDPSLVQQVNRMTRNGGTRPRSMCLPLFFSEVSLGXSRLSNLFRFFKRSKLDYPAPDTTRASKRFVKGMKPLDVSITEGSHFKWTLRXHNAQEIIPARNSRFLALFLDLLKKIFMYDPNKRITARQALEHEWF

SEQ ID NO: 3570 - protein, 282 aa, Neurospora crassa
  unsure (1)..(282): unsure at all Xaa locations
MLSILRKAKLKDKELRILMLXAITCLLPVRLHYAQFADRYQRRGLDNAGKTTIVKKIMNEDVNTVSPTLGFIIKTIDYEGYKLNICKWXIPVTWAQVWKNSLXPILITTIRIGDVGGQKTLRSYWRNYFEKTDALIWVVDATDRLRIQDCKDELHGLLQEEVSNPRSNMICTPVCQFRPCNXPKFTHPRLSGASLLVFANKTDVRGCMSEDELREVSTYTXXSFLXIFTLRKXXCXCVSPQALRLDEIRTHKWNILRCSAMTGENLKEGLAWVVEDAKARLF

SEQ ID NO: 3571 - protein, 356 aa, Neurospora crassa
  unsure (1)..(356): unsure at all Xaa locations
MSEESLLERKYFDGIYIPAGLLVFGTVIVKKEWTLYAALAALILGAIKYFRMRTFSPLSRDAEKFTRXRPLAAVPKKVLKPAVFQEFELKEKTIISHNVAMYVFLLTPYHVXKPKTKTNGSPFCNSYRFKLPTPDSVLGLPIGQHISIGAAIEQPDGSTKEIVRSYTPISGDHQPGYFDLLIKSYPTGNISKHMASLQVGQTIRVKGPKGAFVYTPNMVRHFGMVAGGTGITPMLQVIRAIVRGRAAGDRTEVDLIFANVTAQDILLKEDLDALVAQDKGIRVHYVLDRPPEGWTGGVGFVTQEMVEKLLPKPASDVKILLCGPPPMISGLKKATEALGFQKARPVSKLEDQVFAF

SEQ ID NO: 3572 - protein, 800 aa, Neurospora crassa
MTPNNVTVSLLLRQAIYYHLDNCAYESALFFAERLYAHDQSFCDSAYLLAYTHLRLGDARTAYHVSRGSGYRGSHLGSCYVFAQACLELERYRDGITGLENGRKQWSKADNLGKHTSFTRMPYPDAAAFSCLLGRLYRAYDDKKKAIPCFEEALRRNPFMWEAFTNLYDMGVSVRVPNVFRASDGLAQTLEHGLNATPILAWIAGPSPQPPEPLQLKKTGQQQNRQPSDPFGPYGTSQESASYPDSENGFISKMYLSQSGITSSQPGKPLEETDTQSAPAPTAHNPQVTRAVHQAEPPQAPPRRTRAAQATDSTVTDAPPRTGHRLGTRRKDKAQESAKDHAESGTKTSTVSSSITERKRTAAGHPVQTRSMNNEEPRRSARLNVVPRPTATKTTSAGATRELRKARPPISRFARPGSSGANVGRVISGSRKPPQEDIGMDIDHAEAVPRTKEPPVLQAAPPPPPAPKPAESEFVKAVEEALKTIFDLLKKLASGYALSSQFQCQEAVAAYMSLPRSHQDTPWVLAQMGRTQYEQANYAEAEKYFKRLRVIAPTRLEDMEVYSTVLWHLKKETELSFLAHEMIDSVWDSPEAWCALGNAWSLAYDHEQALRCFKRATQLDPKFAYAYTLQGHEHVENEEYDKALTAYRHAIAADKRHYNAYYGIGRVYEKLGNYDKALSHYHAASVIHPAHAVLICCIGSVLHRQKQFKQALPYFTKATELAPRAPDVRLKKARALLQMGQLKAAQTELMILKDLAPDRAQVHFLLGKLSKTLHDKKSAVRHFTIALSLDPKVSLVLKEA

SEQ ID NO: 3573 - protein, 905 aa, Neurospora crassa
  unsure (1)..(905): unsure at all Xaa locations
PKHKRTLTGFGPGEIKNVEGMVGPLTPTLPPGTNTNIICXYHSASIPEPQRKAWLAHQTSGFKDKDGFETEVVRHVETTLARSMYNCDEQAAYSACSLAFRDRLILEWNRTQQRQTFADSKRVYYLSLEFLMGRALDNAMLNIGQKDVAKAGLAELGFRIEDVIEQEHDAALGNGGLGRLAACFLDSLASLNYSAWGYGLRYRYGIFKQEIIDGYQVEVPDYWLDFNPWEFPRHDVTVDIQFYGHVTKRTDDNGKTIATWEGGEIVKAVAYDVPIPGYATPSTNNLRLWSSKAASGEFDFQKFNSGDYENSVADQQRAETISAVLYPNDNLDRGKELRLKQQYFWVAASLYDIVRRFKKSRRPWKEFPDQVAIQLNDTHPTLAVVELQRILVDLEGLDWEEAWNIVTNTFGYTNHTVLPEALEKWSVPLFQHLLPRHLQLIYDINLFFLQSVERKFPKDREMLARVSIIEESQPKMVRMAHLAIVGSHKVNGVAELHSDLIKTTIFKDFVEVFGPDKFTNVTNGITPRRWLHQANPRLSELISSKTGSQNFLKDLTELAKIEHYKDDKAFRKEWAEIKYANKVRLAKHIKKTTGVDVNPSALFDVQVKRIHEYKRQQMNIFGVIHRYLTLKSLSPEERKKFQPRVSIFGGKAAPGYWMAKQIIHLINAVGAVVNNDKDIGDLLKVIFLEDYNVSKAEMIIPASDLSEHISTAGTEXVFRCEGCESXKLTLNRASGTSNMKFVLNGGLIIGTCDGANVSNNPLFYAMSSLANPLQIEITREIGEQNIFLFGNLAEDVEDIRHNHTYGSYTVDPDLVKVFEAIEKGTFGEPNDFMGMISAVRDHGDFYLVSDDFHSYIETQELVDKAYRDQEGWITKSIESVARMGFFSSDRCINEYAEGIWNIEPL

SEQ ID NO: 3574 - protein, 528 aa, Neurospora crassa
  unsure (1)..(528): unsure at all Xaa locations
TMAEFIRAQIFGTTFEITSRLASPRRTLLSLCALVXSRDRYSDLQPVGMGAFGLVWYVFRFAIWSHPPDAPSXXXXPLRSSAKDQLTNQNVAIKKIMKPFSTPVLAKRTYRELKLLKHLRHENVGLPDSIAQAIGNHATNMLAQQVISLSDIFISPLEDIYFVTELLGTDLHRLLTSRPLEKQFIQYFLYQIMVSHPLSMSHENDGSHXLQDXRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVINTIASENVCTPTLLKALRHRHXLSVRTLRFVKSLPKRERQPLKNKFKNADSSGTSQPLAIAGYTRCXPVLAVDLLERMLVFDPKKRITATEALSHEYLAPYHDPTDEPVAEEKFDWSFNDADLPVDTWKIMMXVSPHQYDELRTTHHXLNHRYSEILDYHNVEASGQMMFQEDVPPQXNTATAGSETGAESSTQGWSRSPLAS

SEQ ID NO: 3575 - protein, 402 aa, Neurospora crassa
  unsure (1)..(402): unsure at all Xaa locations
ERRTIEEPELGELQVAVKTTGICGSDVSYYKKFANGDLCACMPLSLGHESSGVVVAIGPQVSGFSLGDRVALEVGVACGQCTICRKGRYNLCKKMRFRSSAKSVPHYQGTLQERINHPAIWCHMXAHPGFIGINTMLTTLRLPDHISFDAAALLEPLSVGIHAVNRASPAPGSTALVLGAGTVGLLTAAMARQAGCTQVTITDVDQGRVDHAIFKGFATHGYLVPRSHHISSSSSSMFPNSNSNSSSGSSTPSDGIATPPSTLSFRSSLDSAKALAADVLTQTQNPVLDRDDEDIGVDVTFECTGKEVCMHTALYATRPGGKVIMVGMGTPIQTLPLSVAHLREIDILGVFRYANTYATGIRMLCNQKGSGAGFTLPSLDDMVTHRFKGLENAKGAFELASR

SEQ ID NO: 3576 - protein, 440 aa, Neurospora crassa
  unsure (1)..(440): unsure at all Xaa locations
SAETIVILNDACYGHRYSRPRTSKASLSTIVERPERIKASVLGVSAAYVRLGERHQDGSFPIHPDQHPSNLPSVPFLIQKTTRRLAITSPTVTNVHGTKWMEELKIMCDTAEAKLATNGKELQRPDMDRGPDAEEPPKFHEGDLYLCAESLDAMEGALGGVCEAVDAVFKPEGPKRAFVAIRPPGHHCSASYPSGFCWVNNVHVGIMHAILSHGLTHAAIIDFDLHHGDGSQQIAWQHNSRGVKAAKNAAMWKKTSIGYFSLHDINSYPCETGDDEKVMNASVCIDNAHGQNVWNVHLQPWETEEDFWALYESKYTVLLEKARSYLVTQAERLRAAGQNAKAAIFLSAGFDASEWEGAGMQRHEVNVPTEFYARLTRDVVRIAAEVDTAVEGRIVSVLEGGYSDRALCSGIMSHVCGLAGAGFYWKWQSSXSVQPFVVVC

SEQ ID NO: 3577 - protein, 4413 aa, Neurospora crassa
  unsure (1)..(4413): unsure at all Xaa locations
MMDSVPSPPPQPSPDANGVATTPFAAVDPVKVVDHLVLLLEATLGAKRDELEAPGSLLSKVRYSDTVQRCSRFALDTQVALYIQKDLAPTTTLDGDNGAEAEERTFGASTLHALRNVANTRFTATAEPTHVYTISSDLTSSPTTVAYLVLLKRPQPLDPIVPLTSQIQMLNLPGPAYLSTSGSEQGPTSSPYEILQLYLHNGLAPYFDASTKSQQLLNGARGRPDVDAKTGIPVTKKRWTELELSLSHLQQNVEIPEVSLPFHPLVQSTLEEAATKNVKPSIDLLPATVLADSTFLNNLQATVNNWIKSIQVITKMTRDPTTGTANQEINFWLSMEAALEGIENQLRSEGVMLTLDILKHAKRFQATVSFTADTGLKEAMEKVQKYNQLMRDFPLDELLSATTLTKVQESIGQIFGHLNKKLRICPYPIRRALPLVEAISGDLDEVLHRLLPGTELVKLDYEEFKGVMKQAGSIFRAWDESIKEFTNVAREVTRRRNEKFIPIKINPRHAELQSRLDYVHNFRDNHEQLQRTIINVLGPKATVNGIVTASGANGVAVVEEIGDVDAVDEVKQAWEALKDVDLLDCTREGTEKWVRAENIYNERTARVENSIIARLRDRLATAKNANEMFRVFSKFNALFVRPKIRGAIAEYQTQLIDNVKQAISSLHERFKQQYGHSEAHAMAQLHDLPPVSGAIIWARQIERQLDQYMKKVEQVLGSDWALHTEGQKLQNESDLFRKKLDTRPIFEAWLHDVQRKQISISGLLFTINRIRSAGNILELAVNFDAQVIALFKETRNLLWLNYPVPHSVNNVAKEAKRVYPFAVSLMESVRTFAQTNRQISDMSEVAVLLSGHRNDVYTLISKGIPLRWETFVNTYEVHFKPTFNPNTPLGQTGSKVSETKHVMFIREFAASVSLLQSKTLLLANIYVTVQKALNELKTCPYEASAFQSRLETIQHAVDQLNLEQYVNLGYWVERMNRQIKDVLYTRLQVAIQAWIQAFEDEDVERPSERKRLLEIASPDAAKSIGPVIKSLVHEITMRNQVIYLDPPLEYARASWFAQLQDWIGVICNLKKIKATRYTMSLSTEVVDEPRFNDLPGDCTEELLRVQTSVEKKIREIGAYVDKWLQFQSLWDLQSEHVYDVLGDQLSRWLQLLQEIRKTRQTFDTTEVSRSFGHITIDYDQVQTKVNAKYDQWQQDILIKFASRLGNRMREVYAELEKARKDLEGQAMTANSTAEAVRFITIVQSCTRQVKLWAPEIETFRQGESTLVRQRYHFQNDWLHAEQVDGMWDMLNELLARKSKIVTDQSDALRAKITAEDKVVNDKIAEIAHQWNEEKPVSGTIAPDVASATLTHFEQRITKLQEESAMVAKAKEALDLAPTPDTSLGVILEEVQDFKSVWASLSTIWKNLNELRETLWNSVQPRKIRASIDNLIKMTKEMPSRMRQYAAFEHIQNVLRQLMKVNSILGELKSEAVRDRHWTKIYKQIKPGKRYSPVSMTLGDVWDLNLVATEVIVKDIIIQAQGEMALEEFLKQVRETWTNYGLELVQYQQKCRLIRGWDDLFAKCSENLNSLQAMKHSPYYKEFEEEASSWEEKLNRVHVLFDIWIDVQRQWVYLEGVFHGNADIKHLLPIESSRFQNINSEFLAVMKKVYKQPNVLDVLNIPNVQKSLERLAELLNKIQKALGEYLEKERVSFPRFYFVGDEDLLEMIGNSNDTMRIAKHFKKMFAGLNGLVMDDEGVISGFTSKEGETVRLKKEINLVKTPRINDWLALLENGMKVTLAELLAEAVDEFTPIFSSENVDRDALIKFMNTYPSQIVVLATQVVWTTAVDQALADGGKDLQLLFDREVQVLRMLADTVLGDLEVLLRKKCEQLITECVHQRDVIEKLVKLNANSNTHYMWLLQMRYVYNPEGDFLQRLHIKMANAKLNYGFEYLGVPDRLVRTPLTDRCFLTLTQALCQRLGGSPYGPAGTGKTESVKALGLQLGRFTLVFCCDDTFDNQAMGRIFLGICQVGAWGCFDEFNRLEEKILSAVSQQIQDIQLGLKMGAEDEKAQIELDGRQIHVNANAGIFITMNPGYAGRSNLPDNLKKLFRSVAMSKPDKELIAEVMLYSQGFNQAKQLSKHTVPFFDQCSEKLSKQAHYDFGLRALKSVLVSSGGLKRARLLETGDAESLGPEDVVEPEIIVQSIRETIAPKLIKSDVEIMMEIESVCFPGVKYVPASLEKLQEAIRRLAAERQLVVNDIWMTKVLQLYQIQKIHHGVMMVGNSGSGKSAAWRLLLDALQQTENVEGVSHVIDSKVMSKEALYGNLDSTTREWTDGLFTSILRKIVDNLRGEDAKRHWIVFDGDVDPEWVENLNSVLDDNKLLTLPNGERLNLPPNVRIMFEVENLKYATLATVSRCGMVWFSEDTVTPDMMVSNYIETLRTVAFEDLDEDAVATGQSSAKALAVQSQAADLLQEFLTRDNLINEVLKEAANYEHIMEFTVARVLSTLFSLLNKAVRDIIEYNSAHVDFPMDPEQVEGYIAKKVLLALVWALTGDCPLKDRKAFGDKVAGLASFGSPPLDGTSSLIDFTVTMPQGEWQTWQQHVPTIEVNTHSVTQTDVVIPTLDTIRHEDVLYSWLAEHKPLLLCGPPGSGKTMTLFSALRKLPNMEVVGLNFSSATTPDLLIKTFEQYCEYKKTLNGVMLSPTQIGRWLVIFCDEINLPAPDKYGTQRAISFLRQLVEHNGFWRTSDKAWVTLDRIQFVGACNPPTDAGRTPMGARFLRHAPLIMVDYPGELSLMQIYGSFNAAVLKVIPSLRGYAEALTQAMVRFYLESQERFTPKIQPHYVYSPRELTRWVRGVYEAIRPLETLSVEGLIRIWAHEALRLFQDRLVDEEERKWTDDAVRRIAMEYFPTIDEHKALGGPILFSNWLSKNYVPVDREQLRDFVKARLKTFCEEEVDVPLILFNDVLEHVLRIDRVFRQPQGHLILIGVSGSGKTTLSRFVAWMNGLKVFQIKVHGKYSAEDFDEDLREVLRRCGCKGEKICFIMDESNVLDSGFLERMNTLLANAEVPGLFEGDDLAALMTACKEGAQRQGLLLDSQEELYKWFTGQIVKNLHVVFTMNPPGEDGLSSKAATSPALFNRCVLNWFGDWSDQALFQVAHELTHSVDLDRPNWTAPDTIPVAYRGLNLPPSHREAVVNAMVYIHYSLQRFNAKLLKQQGKITFLTPRHFLDFVAQYVKLYNEKREDLEEQQRHLNVGLEKLRDTVDKVRDLRVTLSEKKAQLEQKDAEANEKLQRMVADQREAEQRKNISLEIQAALEKQEAEVASRKKVVLEDLARAEPAVEEAKASVSSIKRQHLTEVRSMPTPPSGVKLALESVCTLIGHKANDWKTIQGIVRRDDFIASIVNFNNEKQMTKSLRVKMRNEFLANPEFTFEKVNRASKACGPLVQWVEAQVNYAEILDRVGPLREEVMLLEEQALQTKAEAKAVEQTISTLENSIARYKTEYAALISETQAIKAEMSRVQFKVDRSVKLLDSLSSERTRWEEGSRSFETQISTLVGDVLVAAAFLAYSGLYDQTFRKSMMEDWLHQLHLSGVQFKQHNPMTEYLSTADERLSWQENTLPVDDLCTENAIILKRFNRYPLIIDPSGRATEFLNRESKDRKLTVTSFLDDSFTKVLESSLRFGNPILIQDAEHLDPVLNHVLNKEYQKTGGRVLIQLGKQQIDFSPAFKLYLSTRDPSATFAPDICSRTTFVNFTVTQSSLQTQSLNEVLKSERPDVDERRSNLIKLQGEFKVHLRQLEKKLLQALNESRGNILDDDHVIETLETLKTEAAEISAKMSNTEGVMAEVEQITLQYNIIARSCSAVFAVLEQLHYLNHFYRFSLQYFLDIFHSVLRGNPHLANETNHNVRRDIIVKDLFVATFKRTALGLLQKDRITLAMLLAQASPYKMDKGLLDIILDERIEGKDVSIDQNTREEAFARAKKIPALKNKIDAVPEADWEKFFTEELAEDFVPKIWNDETEPNDRALMSLLLVKLFRLDRFVPAAERFVTLVFGSDLFDIVEDLKQTVDQVSAILPIALVSSPGFDASYKVDGLVERMRVRCTNIAMGSAEAEGSADKAIANAAQTGSWVLIKNVHLAPGWLQGVEKKMETLNPNPEFRLFLSMESSPKIPVNLLRASRVLMYEQPAGVRANMKDSMSSISTRSLKSPVERTRLYLLLSFLHAVVQERLRYAPNLGWKGFWEFNDADVSSSSTISLLLTFNGXWRXPNQTQYECSAHVIDTWIDTAAHGRTNIAPSNIPWEMIRYLIVETYGGKIDDENDFKMLNQLVHTFLTPSAFDIGHKLVEVSHDAEDEQKDAATGGDLVVPSGTSLQEFMSWIQKLPEREPPTYLGLPANAEKLLLVGLGKSLIGNLKKVTDLLDEGEAIMAEASEAA

SEQ ID NO: 3578 - protein, 343 aa, Neurospora crassa
  unsure (1)..(343): unsure at all Xaa locations
MAFTMHSHSGQFCPGHAKDQLEEVIRHAISVGYRTIGLTEHMPRTQLSDLYPEEVQPAAHAHAYPQSQSTHHNXPNYLTKLQLDPDQGQTTLAQLVPRHASYLAEAQRLQAKYASQIHILIGFEGEWIRGAEYGPLISSLLSSAPCVDYFIGSIHHTAGIPIDFDKTMFLQAQDACGGLEEKLWERYYDEQFEMLNATRPKVVGHFDLIRLLSEEPDKRVKGWRDGVWERMKRNLEVCKGLGAWLEVNTSALRKGLEEPYPGRRLLRXACGFXFLLLFSSQFERXXTLTNNLVGLQEWIKMGGKFTFSDDSHGIAQVATNYTRGLDYLESLGVTELWTLERVP

SEQ ID NO: 3579 - protein, 507 aa, Neurospora crassa
  unsure (1)..(507): unsure at all Xaa locations
RRLGIEVARTISLNYSNQETSFTVGESVRDEDVFIIQSTTTGDVNEGLMELLIAISACRTASARRITAVMXGSDPXAXTPSRALFAPAIGASVVAXLCWRKRCHSAFALETGQTELTISVPTFPYARQDKKDKSRAPISARLVANMLQTAGANRKPFSNCSRGPGRRXLXLRHVTVDLHASQVRSVFAIHRLCEVICXQCRLQIQGMPSSLPIERLNDSLDILDMENACXRISKTKGFFSVPGKLPLPHIRPPDSNRXTVDNLYAEPSFLRYIRENYKPEDCVIVSPDAGGAKRLVLCVSSKTDRSGXLTLLQVLPPIADHLNTGFALIHKERPRPNVVGRMVRKSEMVFWXGRKLTVXQQVLVGNVEDKIAILVDDMADTCGTLVKAASVLKENGAKAVLALVTHGILSGNAIENLNGSVLEALICTNTVPLGDKIERVSFDCTFRLLWMWKIDLPIKLGKITDQRLPYIIQCPKIRVIDISPTIAEAIRRTHNGESVSYLFNHAP

SEQ ID NO: 3580 - protein, 232 aa, Neurospora crassa
  unsure (1)..(232): unsure at all Xaa locations
CNARTKKKKKKKTGWNXQYTAQMLIRTXTEVVIAPPALYLDFVKQNLQKPNVEVAAQNVFNKPNGAFTGEISATQLLDLGVKWVILGHSERRNELGESDEFIASKTKYALDNGISVIWCCGESKDTRQAGETIKFVENQLAALAKEINDWKNVVIAYEPIWAIGTGLVATKEQAQEVHAAIRSWLKQNVSDKVAEETRILYGGSVNAKNCKDLAKEQDIDGFLVGGASLKPE

SEQ ID NO: 3581 - protein, 1300 aa, Neurospora crassa
  unsure (1)..(1300): unsure at all Xaa locations
DPYKHLPEREAKILKEQVFTPDVKVGIATLYRYATRNDLLIIAVSAICAIAAGAALPLMTVIFGNLQGTFQNYFAGVTTYDDFTDELARLVLYFVYLAIGEFVTMYITTVGFIYSGEHISGKIREHYLESCMRQNIGFFDKLGAGEVTTRITADTNLIQEGISEKVGLTLQALATFIAAFVIGFVSFWKLTLILLSTVVALTLVMGGGSQFIIKFSKQNIAAYAEGGSVADEVISSVRNAIAFGTQDRLARRYDAHLTRAEHFGFRLKGSIGVMVAGMMTVLYLNYGLAFWQGSRFLLSGDTELRKILTVMMSVMIGAFNLGNIAPNLQAFVTALGAAAKIYNTIDRESPIDSSSEEGGKLENVVGTIRLENIKHIYPSRPDVVVMEDVSLVIPAGKTTALVGASGSGKSTIVGLVERFYKPIEGKVYLDDVDISTLNVRWLRQQIALVSQEPTLFACTIYDNIRHGLIGTKWESESEEQQRERIYEAARKANAHDFITSLPEGYETNVGERGFLLSGGQKQRIAIARAIVSDPKILLLDEATSALDTKSEGVVQAALEVAAEGRTTITIAHRLSTIKDAHNIVVMAQGRIVEQGTHAELLAKRGAYYKLVTAQAIAAVNEMTAEEEAALDQQEEAALIRKATRNSQKEGGAAGYVEDPEDNIAEKLDRSKSQQSVSSVAIAARKKEEPKEYGLWTLIKLIASFNKKEWHMMLVGIFFSAICGAGNPTQAVFFAKLISSLXVAVPQTVLLGKILTDHRSRPIVNEEIRASIKSDASFWCLMYLMLALVQCLAFSVQGWLFAKCSERLIHRVRDMAFRSFLRQDVEFFDRDENSAGALTSFLSTETTHVAGLSGVTLGTIIMVLTTLIAACTVALALGWKLALVCIATIPILLGCGFYRFWMIAHYQRRAKSAYAGSASYASEAITAMRTVASLTREQDVLQHYKDSLAKQQHASLISVLKSSLLFAASNSLMFLAFALGFWYGGTLIAKHEYDMFTFFIVFSSVIFGAQSAGSVFSFAPDMGKATEAARDLKELFDRKPTVDTWSNEGDLIKQVDGTIEFRDVHFRYPTRPEQPVLRGLNLSIQPGQYVALVGASGCGKSTTIALLERFYDPLSGGIFIDGREISSLNVNEYRSFIALVSQEPTLYQGTVRENIILGANNDVTDEQIKFACQEANIYDFIMSLPDGMNTLVGSKGALLSGGQKQRIAIARALIRDPKILLLDEATSALDSESEHVVQAALDKAAKGRTTIAVAHRLSTIQKADIIYVFDQGRIVEQGTHSELMKKNGRYAELVNLQSLEK

SEQ ID NO: 3582 - protein, 420 aa, Neurospora crassa
  unsure (1)..(420): unsure at all Xaa locations
QISKVKQKISEERGWAPELQKLIYSGKHRLLLKRWIPLPNTDFTPTGKILKDEETVESYKIEEKGFVVCVVNKVLFPPLLLTSLYKDEADTLRSPRPLPPSQPSRRRLPLPPATPAAAAPASTPAPPAAPAASSAAAAAPSTPTPARTAAAPEAAPAAGARDANALAMGEQRAEAIANMEAMGFERSQIDAAMRAAFFNPERAVEYLLNVRFTTHSTFRSMSGLLTQLXGIPANLQQQTASRQPSAAPAAAPAAAAQAASPAAAGGDDDDQVNLFDLAAQLGNSAGGRGARGAEGAGAEAAGLGNLDFLRNNAQFQQMRQLVQEQPQMLEPILQQLGAGNPQLAQMIAQNSDQFLNLLGEGGEGGSVGIAVTEEERDAIERLTRLGFPQDQAIQAYFACDKDEELAANFLFDQGPEEDDD

SEQ ID NO: 3583 - protein, 458 aa, Neurospora crassa
  unsure (1)..(458): unsure at all Xaa locations
LTALLGLASATAIRSEARPKRTAYDGYKVLRVAAGDDADKLNKIIADLELETWKGVAKVGGHADVVIPPSKLAAFNAQAEGFETLTMHEDLGVSIANESGFQAYAGTADQTWFNTYHAYADHLTFLRDLVAAHPNQSEIVTSGTSVNGNAITGIRFWGSAGKGVKPAIVFHGTVHAREWITTMVMSNLSRRSLDKINXQNLQVAEYQAYYLLTNYGSDATVKSFVDKYEFYIFPVVNPDGFIYTQTSNRLWRKNRQSNSGSSCVGRDINRNWPAHWSTSGGASTNPCDEAYKGAKQGDAPETTALAAFLNKVKAAQGLKLFIDWHSYSQLFMSRMFFPFFLLFFYFLSPTNTNTPHAYGYTCSSVPAKNSEYQSLARGAVAAIKSVYGTTFNYGPICTTVYKATGNSVDYAFDVSGAEYAFTLELRDTGANGFILPASQILPSGVEAWAGVKYLLANM

SEQ ID NO: 3584 - protein, 460 aa, Neurospora crassa
  unsure (1)..(460): unsure at all Xaa locations
IIKVDFISQLPLELGIHILGQLDASSLASASLVSRSWNHAAMNQHIWRESFLREKTTTYATSGAVKPGTGLGVPAIRPGNDWKEIYRVREELDKRWKEGKARPIYLHGHTDSIYCLQFDEYVPDLLLRNRMITNFTXHKIITGSRDKTIRVWDMKTYSCKLVLGPPEIINDSDLSLLHDEAGNPIHYATLPELDPHPSASGQIQTPARSHFSSPALFSPPIFHRASILCLQYDDEILVTGSSDATCIVYDIASGYQPVRQLRHHSAAVLDLVFDDKHIVTCSKDVSICVWDRATGALLKQLRGHTGPVNAVQMRGNTIVSCSGDFRVKLWNIETGKQIREFLGHTKGLACSQFSEDGRYVASAGNDRVIRIWDANTGECVREMKAHGDLVRSLHVDSVSGRLISGSYDTDIKVWDMETGAQLLDFPQWHNSWVLSAKSDYRRIVSSGQDPKILIMDFGAD

SEQ ID NO: 3585 - protein, 566 aa, Neurospora crassa
GTDTSQGKPQIISNINACLAVQATIKSTLGPYGGDLLMVDANGKQTITNDGATVMKLLDIVHPAARILVDIARSQDAEVGDGTTSVVVLAGEILKEVKEHVEQGVSSQIIIKGLRRASTMAVNKIKEIAINTAESNRRETLSKLAATAMTSKLIKRNTDFFTESKRFAMMHLSHKYATSSTDRPACAQVVVDAVLSLDQEDLNEKLIGIKKIPGGSLTDSLFVNGVAFKKTFSYAGFEQQPKSFKNPKICCLNVELELKAEKDNAEVRVEQVSEYQAIVDAEWQIIYKKLEAVYATGAKVVLSKLPIGDLATQYFADRDIFCAGRVTSEDMERVVQATGATVQSTCSDILPEHLGTCGTFEERQIGGERFNFFEDCPSAKTCTLVLRGGAEQFIAEVERSLHDAIMIVKRAIRNKTIVGGGGAVEMEVSAYLHRFADRDVAHKQQAIIKSFAKALEIIPRQLCDNAGFDATDILNKLRVEHRKGNTWAGVDFTNEGVCDMMERFVWEPALIKINALQAATEAACLILGVDETIRNEESQAPQAPGQKLPPGAAQRALRGRGRGMPR

SEQ ID NO: 3586 - protein, 895 aa, Neurospora crassa
  unsure (1)..(895): unsure at all Xaa locations
PAKKRKLNSGTKQSFSVPSRGLEYFFAKQKQNGASKEPSPLPKESDSQPAQQGSSEEHLNDEELARKLQAEWDAEARASSTPRENDVRSQDVAVSTTEPVDTDGVEPTNESNPQTVTAPPKADRPKGKNTLSLSSAAATEDQASASIPLDESPLTFNPSKYIPQLQESWATDGGDASYALLIRCFVLVSSTTSRIKIVDTLVNCVRLLIEGDPSSLLPAVWLATNAISPPYVSMELGLGGSAISKALKQVCGLDNRSLKALNDKLGDPGDVAFEAKKKQSFTLRKPKPLTIKGVFQSLVKISKTQGQGSGDAKQRIVDKLLQDARGGEESRYVVRTIMSTCELGLSEPYHLANMDXLRIGAVKTTMLIALARAFLLSKPPGANIPTKDPNQLAKLKKEELAEVYAKAEEIVKASYARHPDYNDLVPVLLETGVSEELLVRCGLTLHIPLRPMLGGITRDLSEMLSRLQGRDFACEYKYDGQRAQIHCDDRGVVSIFSRHLELMTDKYPDLVALVPKIRGEDVQSFIMEGEVVAVDRATGELKNFQTLTNRARKDVAIGAITIDVCLFAFDLMYLNGQPLLNRSFRERRDMLRSLFMEIPHHFTWVKSIDATSQESEIVLEFFKSAVDSKCEGIMVKILDNLPELEAPGPDDSTDPIIPTELVATSSDAVAVSVSAKKSLKGMGKGNHAETKAPSDTPNPNSNEKKQSRRKPLLATYEPDKRLDSWLKVKKDYIGTSAGVDTLDLIPIAAWHGTGRKAKWWSPILLAVRNEETGSLEAVCKCMSGFTDSFYKANREVYDKDGSFSSDGEPKNVHVAKPGFVEYAGGNPDVWFEPQEVWEVAFADITISPTYTAAIGLVREDKGLSLRFPRFLRKREDKGIEEASTSDFLAGLWRKQ

SEQ ID NO: 3587 - protein, 608 aa, Neurospora crassa
  unsure (1)..(608): unsure at all Xaa locations
RRGEALKVNITAGEGLQDVLKSNLGPSGTIKMYASSDGNLLVLLLANNKCNAGLVDGAGQVRIPXRGWKAGMDAIITAYXPPCDAQQIKLTKDGNVLLREMQIQNPTAVMIARAATAQDDICGDGTTSVVLLVGELLKQADRYISEGLHPRIITDGFEIAKTEALKVSIPRRFCLFPSVEHSXHCRSSLDQFKLPREVDRELLLSVARTSLATKLSASLAQSLTADIVDAVLAIYQPPAKPDLHMIEIMTMQHRTASDTQLIRGLALDHGARHPDMPKRVENAYILTLNVSLEYEKSEINSGFFYSSAEQRDKLVESERRFVDAKLKKIVELKKEVCGNDPTKNFVIINQKGIDPLSLDVLAKNGILALRRAKRRNMERLQLVCGGVAQNSVDDLSPEVLGWAGLVYEQQLGEEKYTFIEEVKDPKSVTLLIKGPNAHTITQLKDAVRDGLRSVYNMIVDKSVVPGGGAFQVACAAHLKSDAFTKTVKGKAKWGVEAFADALLVIPKTLAANAGLDVQDSRKSCFSSTSFAHANCSSSVAALQDEQAEGNVVGLDLATGEPMDPTLEGVYDSFRVLRNCVASSAGIASNLLLCDELLKARQMGRAGGP

SEQ ID NO: 3588 - protein, 527 aa, Neurospora crassa
  unsure (1)..(527): unsure at all Xaa locations
MPGVIEPTGSGRLLLISNRLPITIKRADDGQYTFSMSSGGLVTGLSGLAKSTKFQWYGWPGLEVPEAETAGMKQRLKEEYDAIPVFVDDELADRHYNGFASKCSSSSSFATFCYPLLCLTSVPLTDSILWPLFHYHPGEITFDESAWAAYREVNRLFAKEVAKDVQDGDMVWVHDYHMMLLPQMLREEIGDTKKNVKIGFFLHTPFPSSEIYRILPVREALLLGILDCDLIGFHTYDYARHFLSSCSRILXVGTAISLRCVXSLSLDXQFHSQTPTTPNGVDYNGKFVTVGAFPIGIDPEKFVEGLKKQNVQQRIAALTRKFEGVKLIVGVDRLDYIKGVPQKLHALEVFLTEHPEWIGKIVLVQVAVPSRQDVEEYQNLRAVVNELVGRINGKFGTVEFMPIHFLHQSVSFDELTALYAVSDVCLVSSTRDGMNLVSYEYIATQRERHGVMILSEFTGAAQSLNGSLIVNPWNTEELANAIHDAVTMSPEQREANYRKLERYVFKYTSAWWGQSFVAELTRISAEA

SEQ ID NO: 3589 - protein, 502 aa, Neurospora crassa
YNISFYHINDVHAHLDQFSSSGTDCTNPAKGCYGGYSRVKTIINETRPSHKDSLVLNCGDEFQGTMFFSYYGGEKIAETLNQIGFDGMTLGNHEWDKGDEVLGQFLENLTFPIISANVFSDNARLNRTIKPYHIYEEYDLAIIGVTTETVPSISSPGPGTKFTDAIQAVQDTIDHIRSTTSIKRIAAITHIGYDEDQRLAKETTGLYLIMGGHSHTPLGDFPGAVGPYPTIVKNKDGDEVFIVTAYRWGEYLGYIDVTYDADGKILEYHGGPIHLTNTTKQDEGLQKQIDAWRVPFEEYSKQVVGTSNVVLEQSTCQSKECTFGDFICDAMLDYRLNASTDGLAPSFALTNSGGIRASIDVGPITRGEVLTAFPFGNAVVEITLSGQQLWDVLAGIVARVNKANGKAVTSFLQVSRGIKIEYQPTNSPDNGVGTLAAVTIGGEKLDMTKQYKVVTIDFVAGGGDNFFAEAISNLVVLDTLDEVLVNYIKEKTPVDVELDGRI

SEQ ID NO: 3590 - protein, 441 aa, Neurospora crassa
VNPSTLAPLPAVPVSTKADVDAAVSAAKAAFPSWRDTPIEKRAALLNTFADAIMANFMDFASLLALEGKPPTAAQFEVDFAVKHLKGTAQLRLDDEVIEDNEEKLTKIRYTPLGVGVGIVPFNYPFFLGLGKMGPAVLAGNAFIWKPSPYTPNTALKLVELAAKIFPPGVVQALSGEEDLGPWLTAHPDIRKISFTGSTPTGKKVMAACASTLKRVTLELGGNDAAIVCDDVNLDEVVPKVALGCFNNAGQVCVDIKRLFVHEKIYDQFLAKMVEVVKTFKFGGSEDTEGAFFPPVQNAMQFEKVKELFSSIEKEGLKPVIGGEVEAEAGAKKGYYFKPTIIDNPPENSRIVQEEPFGPIVPVVKWVGGEDEVVRMANNTDMGLGASVWSKDLEKAERIARRLEAGSLWINTHQDLAPNVPFGGFKQSGMGHDWGVIGLKG

SEQ ID NO: 3591 - protein, 436 aa, Neurospora crassa
  unsure (1)..(436): unsure at all Xaa locations
ERLGSILKHLTPGTALSNITAKNPDDIVITLAIRTPLTKAKKGGFKDTSLEYLAYATLKEVKERCNMDPALVEDIAMGNVRNLVCHXQRHMDSLQRLIMAVWLQVSDGKAAYKLRAAALAAGFPNTAGAYSLNRFCSSGLKAVADIAHAISCGSIEVGIAMGAESMSVGGDALEQPFDEAVTSQSQESADCMQPMGWTSENVSRDFGITREEMDKYAAESFQRAERAQKAGLFDDEIVPIKTRVKDANGEWKDVTLTKDEGIRPGTTAESLSKIRVAFPQWGPTTTGGNASQVTDGAAAILLMKRSTAVKLGQPILGKYVGSTVAGLAPRIMGIGPSIAIPKLLNQYGLTLNDVDVVEINEAFASMAVYCRDKLQLDWNKMNPRGGAIALGHPLGATGARQIVTGLAECRKSGKKVLLTSMCIGTGMGMAGLFVNE

SEQ ID NO: 3592 - protein, 396 aa, Neurospora crassa
  unsure (1)..(396): unsure at all Xaa locations
KKKANFIERTLWTFVMIAGFFAALFMGHIYIVVIITAVQIISFKEVIAISSGASRARDIQSTKSLNWYWLAVAMYFLHGETVIYYFKHIVMVDRVLLPLATHHRFICFTLYVVGMRSSFSPXRQRPSXQNSAPGFVFFVSTLKGGHLKFQFTQFVWAHMALFLIVGQSHFIMNNVFDGLIWFFLPAALVITNDIFAYVCGITFGRTQLIKLSPKKTVEGFLGAWVMTVLFGILLTHILMRSRFFICPANDLGANIFTGLDCEPNPVFIPQTWTMPELLFFPTKTRFSITMAPMQIHTFFWATFASLIAPFGGFFASGLKRTFKIKDFGHSIPGHGGITDRMDCQFIMGFFAYIYYHTFIAQSKVDFDEVLEIVATRLTIDDHKKLLLFIAKYLVNH

SEQ ID NO: 3593 - protein, 997 aa, Neurospora crassa
  unsure (1)..(997): unsure at all Xaa locations
RYADHIGIHYVLCSKLRQFPYEDIEFFLPQLCHLIISIDNESMALEEFLLDLCEESVTAALVGAQPSIHHLTLCTTPNCXYLARSQTFWLFQTYLHDLSANPQANAFKICQRVYNKVQHIVFGVSDSARNEKITENALPVTVLGSFVLASIAAPFLPHWAGPLAVAQARKPRPQVIEPVLDATPVNAAPPARAHTVTAGTTKSRRAKEARLTSSSDHQLQSNNSSPVAHRPKPKIKEPQPDSRPTSSGSSIKTPVETKRPTPFDSNVLEARLSSSSLPLPTSNANSPGLVHRPTTPALRPTTGVNRRHSHHVKTLLNQADMSRTQKMRLLKQNYFHCQTAFLTALEDISNRLVIVPKAARLSALRAELALIAQELPAEVDIPVICPPTLVNGSPSQSRHHRIVRLNPAEATVLNSAEKVPFLLMVEILREDLTFDPDSQDNQRLLTQLLVEQGTRRRIFDLSESSRIPATPRSQEPVIDSVFEPSSGDLGHSPLIKPFNDEPFAIQHNPVPGGLRHAATTGTSSTQFVDLTSTPRSSGTSGSSTPPFRRMTLQSPRNNAAADQPDFSALAIHMRTASQMLAQLDATSGKRPRHEVAAIRAKIIASMQSLEEESFEVHDSQGPTFDMIMAKASAENVINGNVATDEEIEAPLEKVESNVNPNAGLARMENDIKTGGLQRKGDRDDPSAAVFGEAWEMKKERIRKSSPYGWMKNWDLVSVIVKTGADLRQEAFACQLIRVCHKIWVEHNVPVWVKLMRILVTGESCGLIETIANGVSLHSIKRSLTLATVESGQNPRRRIATLKDHFVKAFGLPESQAYRSAVDAFKRSLAAYSIISYVLQLKDRHNGNVLIDNEGHIIHIDFGFMLSNSPGSVGFEAAPFKFTYEYLDVLGGVDSQDFADFKQLCKQAFQGRFSLSHHSYQAXITNDCYSPRRSADNIIDLVAMMGRESKMPCFGAGISQVTTSLRARFQLQLSKDEAEQFVETDLIAKSLGSYYTRL

SEQ ID NO: 3594 - protein, 234 aa, Neurospora crassa
  unsure (1)..(234): unsure at all Xaa locations
VPQSSLVLRFVNNDFQENKEPTIGGXFLKSXRLSLHQFSXHFFAAAFLTQKCNLPTRTIKFEIWDTAGQERFASLAPMYYRNAQAALVVYDLTKPTSLIKAKHWVAELQRQASPGIVIALVGNKLDLTSDSAGSAEASGGGDDNAEDSGDARKISTDEAKAYAEEEGLLFFETSAKTGHNVTEVFTAIANAIPETSLKSARGPGASHAGVSRTEEQRVNLNGPRDLDAKEGCAC

SEQ ID NO: 3595 - protein, 450 aa, Neurospora crassa
  unsure (1)..(450): unsure at all Xaa locations
FDALNVRPWLVQSLANMAIKRPTGIQKGCIPEILKGRDCIGGSRTGSGKTVAFAVPILQQWAANPSAIFGVILTPTRXVHSEYPLTPTNNQTIGRGXPLPQELALQIMEQVIALSQPHVLKAVLITGGADMRKQAIDLAKRPHLVIATPGRLADHIRTSGEDTICGLRRVKFIVLDEADRLLANSGHGSMLPDVEECFSVLPPPSERQTLLFTATMTPEVKALSERPPIPGRAPVFVCEVDTQRLAIPATLRQMHLQVPVTHREHYLHMFLLTPQNVDKSVIIFCNRTSTADFLHHLLRLLDHRVTSLHSKLPQSQRIDNLGRFRASAARILVATDVAARGLDIPEVKIVINYDIPRDPDDYIHRVGRTARAGRKGDAVTFVGQRDVDLVLAIEQRVGRQMEAWTEEGVNLETRVIRDALKVVGEKKREALLEIEEQKEVGGKRKRGKEK

SEQ ID NO: 3596 - protein, 549 aa, Neurospora crassa
  unsure (1)..(549): unsure at all Xaa locations
LHTKQANPGLQAPQLQQGPSPVPTMAPAPAPLLRPAIPGARPGGRGPPRLGLAIPPSLSVKPVGNPGAPPARAAPPQLKLATPMGSTTIPHEQPAGRPGAQGYSASGASDSSAAHSRSGSFGPESNPTSADTRYSNVSFIGAQRPHGTPDPVSAVGSLYSNASEGGVGMERENSLHGLEAFDKLTLEKARTLDVEELDDDGWRIAMMEKRVEELGPLGEGAGGAVTKAKLKGGKTVFALKVWHSSLRSDPIILLESLLTTLRLDITANPDKDVAKQIVRELGFNKQCASEHICRYFGAVVDTQSATISIAMEYCEGGSLDSVYKEVKKLGGRTGERVLGKIAEGVLHGLTYLHSKKIIHRDIKPSNILLCRNGEVKLCDFGVSGDYGTNGAANTFIGTSYYMAPERITGQSYTITSDVWSLGVTLLEVAQHRFPFPADGTDSQPRAGLIDLLTYIVRQPVPKLKDEPDANIFWTDKFKYFIDCGMCTHSLFFFFCPASXPGELCSLEKDPNRRASPWRMLDHPWMLEIRSRRVNVARFLATVWGWEDGK

SEQ ID NO: 3597 - protein, 678 aa, Neurospora crassa
EQQQWITVQQKTFTKWLNTKIEVRGLEVKDLVKDLSDAVRYGSPLPHSLIQCFFLFQIWQLTPFPRQQVMLIHLLECLSGDSLGRYAAKPKLRVQRFENANLALNFIKSRGIQMTNIGAEDIVDGNRKIILGLIWTLILRFTINDINEEGMTAKEGLLLWCQRKTACYDEVDVRDFSGSWNDGLAFCALLDIHRPDLIDYDALDKSDHRGNMQLAFDIAHAEIGIPKLLDVEDVCDVAKPDERSLMTYIAYWFHAFSQMEKVENAGRRVEKFFNNMQGAWEMQSAYERRMAALLKAIREQVVSWKGSTFDGTYADAKAQAFQFASYKKGKKREWVAEKSDLATLLGNIKTKLATYRLRPYDPPAHLRMEVLDDEWGNLSKAEMSRGQLINETIREYVSFVSLCFRAESLLELPLTPLQIKDALRKSFADKANDFALALNTMQLAISGLEGDVEDQLHHVRKLSENLPPLDAYLKTIEAVDLKCQEANIEENDFTTYSYDELCYELSLVKSSVSKKLAFLENQMVARNMTNLTPIQLEEFESVFRHFDRDDTNSLSELEFSAALASLGLVFSEDEMHEYFLSTSNGRDRVTFEQFIRFMVDVTEDQNTAEQVFQSFREVADGKPYVTEMDLRHSLVPDEVIEKLIEIIPKHTGPDMQSDRGMEQYDYIAFMEKLISEQE

SEQ ID NO: 3598 - protein, 741 aa, Neurospora crassa
DGATQFFGSGKRDFSYLNLKPDHDQKPLWIDPEKGTIILEKFSPDADRVTDFLVTIAEPKSRPHFLHEYQLTAHSLYAGVSIGLQSKDIIDTLDRFLKTPLPESIRLFIESCTKSYGKVKLVLNNNKYFVESSDAELLQKLLRDEVIGKWRVQGSGDITTSYAPTMGGLVIPGTKDAAGVNQAGLNKSGNKKTAEDGAADAAATNEADLYAAINEEDDEDDKDAVHAFEIPETAVEIVQRRCLDLGFPILEEYDFRNDSNNADLEIDLRPNTQIRPYQEQSLSKMFGNGRAKSGIIVLPCGAGKTLVGITAACTIKKGVIVLCTSSMSVVQWRQEFLKWSNINPDDIAVFTAESKNKFSGNTGIIVTTYSMVTNNRERSHDSKKMMDFLKSREWGLMLLDEVHVVPADVFRRVISSIKSHSKLGLTATLLREDDKISHLNFLIGPKLYEANWMELSEKGHIAKVQCAEVWCPMPTEFYDEYLRANSRMKRTLYAMNPRKFQACQYLINYHEARGDKIIVFSDELYSLKQYALKLNKVFIYGGTGQAERMQVLENFQHNPQVNTLFLSKIGDTSLDLPEATCLIQISSHFGSRRQEAQRLGRILRAKRRNDVGFNAFFYSLVSKDTQEMYYSSKRQAFLVDQGYAFKVITQLANIENTPDLAFATAQERRELLQRTLVDNEKGAEDDVETDDLFGKVGRGRGGAKGRAAAVRRMAGTLGELSGGQDMAYIEQNKAANKGLKK

SEQ ID NO: 3599 - protein, 287 aa, Neurospora crassa
  unsure (1)..(287): unsure at all Xaa locations
SPDGHVFQVEYAGEAVKRGMRCRLDPDPTLSQLGWRSYRCLTRRYTXGTCAVGVKGKDVVVLGCEKRSAMKLQDTRITPSKIGLVDKHVCLAFAGLNADARILVDKARLEAQSHRLNLEDPVTIEYITKYVAGVQQRYTQSGGVRPFGISTLIVGFDNGSDVPRLYQTEPSGIYSAWSVHTNLPPQHRRSXAWMELTPPQESQRIGRSSKTVREFLERNYKDDMDREATIRLTIKSLLEVVQTGAKNIEIAIMAPGKELEMLPVEDIENYVKNIEQEKQEEADKKKK

SEQ ID NO: 3600 - protein, 482 aa, Neurospora crassa
FTSETYPELKRDPRYGQVTKEHVDYFKGLLGTESAVIDGVTNENATDDIEPFNSDWMRKYRGHCRLVLKPSSTEEVSKILKYCNDNKLAVVPQGGNTGLVGGSVPVFDEIVLNMGRMNNIIEFDEVSGILTVEAGAILEVVDQFLASKGYIFPLDLGAKGSCHIGGNLSTNAGGLRLLRYGSLHGTTLGIEAVLPDGTVVDDLCKLRKNNTGYDLKQLFIGSEGTIGVITKAVIQCPQRPKAQNVALFGLESYEAAQQAFREAKGHLSEILSAFELMDAGSQALVRQVTKKNSPLEGEYPFYCLIETSGSNSDHDGEKLQTFLEDVMEKGIVVDGTLAQDETQVKALWSWREGITEALGHLGGVYKYDVSIPLPEMYQLVEDTKARVEEAGLLGDTDEHPVRAVVGYGHMGDSNLHLNVSTRRFDERVEKVLEPFVYEWISKRQGSISAEHGLGLAKKKYIGYSRTPTMVGLMKQLKDLYDP

SEQ ID NO: 3601 - protein, 243 aa, Neurospora crassa
VTLNRPKALNALSTPLITELNAALLSFQQSPTIRAIVLTGSERAFAAGADIKEMAPLTFSKAFLDSFIESWSNLTFTVKKPIIGAVSGHALGGGCELALMTDIIYCTKTANFGQPEIKLGTIPGAGGSQRLTRAVGKSKAMELILTGKSFSGEEAERWGVAARAFDSYEELMEGALKTAETIAGYSKVAVQAAKEVVNKSQEVGLRDGVEYERRMFHALFGSQDQKIGMKAFAEKGKAKWVDE

SEQ ID NO: 3602 - protein, 259 aa, Neurospora crassa
  unsure (1)..(259): unsure at all Xaa locations
RCVVVGDGAVGKTCLLISYTTNKFPSEYVPTVFDNYAVTVMYVAHSSNYPIPSMRACTPCSTSQRPPVSLLHHLSGLXLICATSLQIGDEPYTLGLFDTAGQEDYDRLRPLSYPQTDVFLICFSVASPASFENVSQKWAPEVNHHCPGVPFLIVGTQKDLRSDKELRDKLAQRKQSMIEFKQGEKLAQDLDAVKYVECSALTQEGLKNVFDEVGHSQDGYCRXVVKLPKADTHFFXAIVAALEPPQKKTSKRDKKCLIL

SEQ ID NO: 3603 - protein, 371 aa, Neurospora crassa
PAYETRPLPDLLPWISDFWLSLILPHIAYWVVSMFFHIIDVYDLFPQYRLHTPEEISQRNLASRYEVARDVLLEQAIQIGTSAVLNLLDDQQLTGHENYEVAVWATRIRLAQRGLPTILGFVGLNAGALSKNIAGSYPLLAGALAGGFYPSLFELDDMAGTAVPAFASWEILLAKAIYWIIIPCIKFWFAAFVLDSWQYLWHRAMHMNKWMYSKSSKTHRLKFPRSWTTPTNICFPSNSKWHARHHRLYVPYAYGALYNHPVEGFVLDTLGAAIAYKCSFMTSREGMFFFVGSMMKTVDDHCGYALPWDPLQNITSNNAAYHDIHHQSWGIKTNFSQPFFTTWDRILGTMWKGDTSIKYERTRAAAANKKK

SEQ ID NO: 3604 - protein, 813 aa, Neurospora crassa
  unsure (1)..(813): unsure at all Xaa locations
SPTTKSPKSKKAKTEEDSEDVAPASKRSRRSRKVVEDDEDETMEDVPASSAPVKEEKSKKAASPKPALKKKSSSPAPVEKANDAEASSASASEIEAEEEDEDEKTEAVAKEARKVIQTTLATKVKDPYPDWKAGEPVPYAALCTTFSLIEQTRKRLLIMEYCSLFLRQVLRLTPDDLLPTVLLMINKLAPDYAGIELGIGESLIMKAIGETTGRSIAVVKNDQKEIGDLGLVAVKSRSKQPTMFKPKPLTIRGVHKGLMDIATTMTGTGAQQKKVDGIKKLLSAADANSTGKVDITKDKGGPSEAKFIVRFLEGKLRLGLAEKSVIVSLAQAMIAHEFAQKGKIPSESDFSKAESILKTVYSELPSYDVIIPAMLQHGIMNLREHCKLRPGVPLKPMLANPTKAITEVLDRFEGQTFTCEYKYDGERAQIHYVAKDVPKSEGDLSQVASKDTGKGVAAIFSRNSEDLSQKYPDVLAKLPTWVKEGTKSFVLDCESVAWDTVDKKVLPFQQLMTRKKKDVKLEDVKVKVCVFAFDLLYLNGQAVVEKSLRERRELLREAFKPVEGEFAFATSMDGQELDEIQSFLDESVKAGCEGLMVKMLDGAESGYEPSKRSRNWLKVCFLPXFXRLFGMMNXHKENRSKKDYLAGIGDSLDLVVLGAYHGKGKRTSVFGAFLLACYNPSTDTYETVCNIGTGFSDEVLQELHSSLSPIIIDRPKPFYAHSSGGQHQPDVWFEPKYVWEVKTADLTLSPRYKAGMKEGVDPSGEKGISLRFPRFIKVRDDKKPDEATTSRMVAEMYRKQESVGKNKGPAVDD

SEQ ID NO: 3605 - protein, 491 aa, Neurospora crassa
  unsure (1)..(491): unsure at all Xaa locations
SSLGAGLCRFLRAIQRLLLVATTTTPGNVDKLTMQFCFNLVGTEPFQVTLSDESFETYELDPPPYTLNVTKKELKQMYYDMVVVRYAKTTIPLVLTGGLXASPLLSLPISAWRINMASPHSIXLTHCSLCIXQMEMAADRLYKEKKIRGFCHLSVGQEAVAVGIEHAIERADDVITSYRCHGFAYMRGGTVRSIIGELLGRRGGIAYGKGGSMHMFTKGFYGGNGIVGAQVAVGAGLAFAHKYTGRKNASIILYGKPFLGGNNVGGSEGXYIVIGDGASNQGQVFESFNMAKLWNLPALFGCESKXPRFHGLRYSYXHVXWCRQKYGMGTSAARSSALTDYYKRGQYIPGLKVNGMDVLAVKAAVAYGKQWTNNDNGPLVLEYVTYRYGGHSMSDPGTTYRTREEIQRMRSTNDPIAGLKQHILEWGVASEEELKNLDKEARAYVNEEVAAAEAMPPPEANQQILFEDIYVKGTEPDFIRGRTPDELFYFK

SEQ ID NO: 3606 - protein, 542 aa, Neurospora crassa
  unsure (1)..(542): unsure at all Xaa locations
FLKATTPEKKRILEDIVNMCNSQQLSFILQLVSPRLKKDPMMSLPDELCLRVSAASVDIISGVXPRLLTPXLGLSFIDDPKDLARASQVSRRWRDLVSDDMTWKNLCLKHDYQRRLSEVQTSMQYSNFLRPDPTSSFYQPYSAPAASVTFDDASSLRRPRSYKSHFKQRYLVDAAWRTGGRNITKNITQEGGVVTSLHLTKKYIIVALDNTKIHVFDTEGNELRTLRGHMMGVWAMVPWDDVLVSGGCDRDVRVWDLTTGYVTPFFLLHCSFSQPVSGPPADTCAQCLMHTLRGHTSTVRCLKMSDANTAISGSRDTTLRVWDIKNGVCRNVLVGHQASVRCLEIHGDIVVSGSYDTTAKVWSISEGRCLHTLSGHYSQIYAIAFDGYRVATGSLDTSVRIWNAATGXVYKPHTYXPFCYLSTCSCADIESSECQAVLQGHTSLVGQLQMRGGTLVTGGSDGSVRVWSLERFCPIHRLAAHDNSVTSLQFDDTRIVSGGSDGRVKVWDLKTGQLVRELISQGEAVWRVAFEAEKCVAMALRN

SEQ ID NO: 3607 - protein, 492 aa, Neurospora crassa
  unsure (1)..(492): unsure at all Xaa locations
QTVRIGRDTDRDNNDVVFVDSTVSRNHFELYSITVDEEGRHTSLVFVRDRQSSNGTLLNKKCVGKKPDITPGRLLQNGDVISIYPYITFKFVQLEQGTSFLRLTARQREELKVLLLSWRATKIKHAMIXLSNIQLLENRYLVEDRTLGNGAHAVVYLATDVLTGQQVACKVHNLDRRPRSHQILRRIKQEAMLLSYLDHVSHXKGTGRWIKLTKVVSPNILSIKAAFESEHSVXDLHHEQLAGLGNXCISRYIFTELATGGDLFSLLSREGALPELEIRWIIRQTLNAVDYIHNKGVAHRDIKPENILCAIAPNVSYRLVLSDFGDSAVTNRGRLRSEVGTTFYRAPXVSHFPSWVDICHWIVESNANAXFSECYNSERGHSLSVDIWSIGMLCLQLFSGFQELPNLRHLDFTSQDRIDRYLNIILNDLGCDIAVQDGDEDYGNDNEPIDPQTSRLRPDENISSHAKDFIRGCLTYNSKHRLTARQALTHPW

SEQ ID NO: 3608 - protein, 1400 aa, Neurospora crassa
  unsure (1)..(1400): unsure at all Xaa locations
PRXRLYFPTPTMAGVQMPAAVAQHPQMVMAANMSGQQIQEVYAVCFPLGRIRVSHCDSVMVSSXLPTALPAIEEAGRPSKRSRVYEAPQHHPGRIRRQQQQQQQQQMQRQQQQQQQQQQQQMAGGAVNGGQPGRAPGPQQTDGVSGAQIPKTPAAKPVGMPTGQPQGGVPYTKAQIQLLKDQIKAFQALSRNQGVPAALQKQLYEFRARRNSAQVAQAVSNASAAQTNSSTPTQDTPKTGSSNGQEEADSTPKARELKTVKLPLEAGLVKNSINYLEHGRRKNRLIIPGIFPTGVDFEQLRADREKIVFNRMSARYAELKSLPGNLAHWDTSKDEVVADDTAKRKAIIEMKKLALYSKQRALRDKVGKQMLHYDNLAMTTNRTMYRRMKKQSVREARVTEKLEKQQRDARENRERKKHVEFLQAVQNHKVEIQNVASIQRNKLQKMGRLMYAHHFNIEKEEQKRVERTAKQRLQALKANDEEAYLKLLDQAKDTRITHLLRQTDGFLHQLASSVRAQQREAAERYGDDLQNIPEEESDVDEDEESSRKIDYYAVAHRIKEEVTEQASILVGGTLKEYQLKGLQWMLSLYNNNLNGILADEMGLGKTIQTISLVTYLIEKKQQNGPYLVIVPLSTLTNWNLEFDKWAPSVAKIVYKGPPNTRKLQQEKIRRGEFQVLLTTYEYIIKDRPLLSKIKWFHMIIDEGHRMKNANSKLSATIQQFYSTRFRLILTGTPLQNNLAELWSMLNFVLPNIFKSAKTFDEWFNTPFANTGGQDKMELTEEEQILVIRRLHKVLRPFLLRRLKKDVEKDLPDKTEKVIKCKFSALQQRLYKQMVTHQKILVSDGKGGKTGARGLSNMIMQLRKLCNHPFVFDEVENQMNPTNTSNDLLWRTAGKFELLDRVLPKYKATGHRVLMFFQMTAIMDIMEDFLRFRGIQYLRLDGTTKAEDRSELLRLFNAPDSPYFMFLLSTRAGGLGLNLQTADTVIIYDSDWNPHQDLQAQDRAHRIGQKNEVRILRLISSASVEEKILERARFKLDMDGKVIQAGRFDNKSSETDRDAMLRTLLETADMAEVGEQEEMDDEELNMILARNEDELVTFQQLDDERARDPLYGTAPGCKGIPRLMAEKELPDIYLQEGNPIEEEEAVSLGRGARERTKVKYDDGLTEEQWLMAVDDDDDSPEAAAARKAARKERREQNRLKKMAILNNASGSVDASPSVSRASTEEVEVAPPTPKKRGRKPGSKNLEKRPREDGDDEPPVTKKRRGPGGRPKAVSNGDSRMSAEMRTKLQQSMRRIFDGLMNLEVEDDEPAEQLDGDKDEDEGPPTRLIIGPFVKLPPKREWPDYYLMITNPICMKDIEKKMKKEDYHSLSDMRKDLELLVRNCRTFNEETSMICIDANRIE

SEQ ID NO: 3609 - protein, 425 aa, Neurospora crassa
  unsure (1)..(425): unsure at all Xaa locations
MGCGMSTEEKEGKARNEEIENQLKRDRMQQRNEIKMLLLGYVMPPDKPIAGAALVRTLGSPMKFHRSXQYVAGAGESGKSTILKQMKLIHEGGYSRDERESFKEIIFSNTVQSMRVILEAMESLELPLADQRVEYHVQTIFMQPAQIEGDVLPPEVGNAIEALWRDAGVQSCFKRSREYQLNDSARXXVSAXXGRLWSPTANMLSQLFDNIARIAAPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGDDYAAACDYILNRFVSLNQHETKQIYTHFTCATDTTQIRFVMAAVNGMLFVYFEILRGQEANRPKQISIIQENLRLCGLI

SEQ ID NO: 3610 - protein, 407 aa, Neurospora crassa
AKTNQTTPETLTISLENNTPSSTVYAYITGQTLDGGLFVLSASGNAAYTYASVNKTLTPIPPSDIAIPLNAPGSSSPRTVTIPRLAGARIWFSVDSQLEFFLNPVDGVPQDGKGAGLALVEPSVTNDKDVNYEKEWGFVEFTFNEFQLFANVSMVDLVGKCPASLGVIRTTGKPEDNQEVEGMGYETGLNKVVDELKQAGGDWEKLVVRRKSDGQVTRVMSPNSAVVMAEARKESLFSGYYDGYVKQVWDKYAKEDLMVDTQNKWGVVKGRVDAGTGLLTFKSNNSETITFDKPSAADIYSCSTGPFAFPPLPANATEAELDIQAFRGNVGARLAAALNRSTLLINNNQPAGEEISTFYKSNNITNHYSRVVHQNSPKGKGYAFPYDDVSRTEKENVAGTVAAGDPK

SEQ ID NO: 3611 - protein, 787 aa, Neurospora crassa
  unsure (1)..(787): unsure at all Xaa locations
FSRMGVLRDLKKANEAYWADKISQEALLAEGKRLRLAHWKIQKDAGVDIIPSNDFAHYDHVLDHIQLFNVRXPPPISSPTPISTSWDCVNXLAPLSTRLVPERYTSQKLSPLDEYFAMGRGHQKGGVDVPALEMVKWFDSNYHYVKPTLQDNQTFSLAKDPKPVREFLEAKEAGFQTRPVLVGPVSFLALGKADRGSSVDPITLLDKLVPVYVELLKQLKAAGAESVQIDEPVLVFDLRPEVKAAFKPAYEAIAAAGDAVPKVVVATYFGDIVHNFDVLPAFSGAAGLHVDLVRNPEQLEPVLKQLGPNQILSAGVVDGRNIWKNDFAKSLEILQTAVKALGSERVIVATSSSLIHTPHTLASEKKLPSDVYEWFSFAVEKVKEVATLAKAVTEPEAVKAELEANAAAIKARTDSKRTNDPAVKERQAQVTPEQHNRKAPFNTRYAEQKKHLSLPLFPTTTIGSFPQTSEIRVQRNKFTKGEISAEEYERFIEKEIELAVKIQDELDLDVYVHGEPERNDMVQYFGERLNGYVFTTHAWVQSYGSRCVRPPIIVGDISRPAPMTVKESKYAASISKKPMKGMLTGPVTCLRWSFPRVDVHQSVQCQQLALALRDEVVDLEKNGIYVIQVDEPALREGLPLRKGQEREAYLKWAVDSFKLATAGVENSTQIHSHFCYSEFQDFFHAIAALDADVLSIENSKSDAKLLKVFIDEEYPRHIGPGVYDIHSPRVPTLEEFKQRIEEMLAYLKPEQLWINPDCGLKTRKWDEVKGALSHMVEAAKYFREKYA

SEQ ID NO: 3612 - protein, 225 aa, Neurospora crassa
LMAALRSFPDFPIPGINFIDILPLFQDVKTHEALLVALQLQIELSHQKPDVIVGLDARGFLFGPSLALRMGASFVPVRKQGKMPGPCVTAAYEKEYGTDFFQMQDGAIKPGQKVLIVDDIIATGKHYVPTFSFLAIASSCPIFLLYHANPISALRWILASPHWQPCSSIWLTSIFTGGSAAAAGELVKKLGGETIGYLFILEIAFLKGREKLGGVPVTTLLETDE

SEQ ID NO: 3613 - protein, 140 aa, Neurospora crassa
  unsure (1)..(140): unsure at all Xaa locations
PRPLSDNERARLEEFIDSIHYSTRYAVAHFGKRSTVRLLTLPLVPIAIPDSEYEYRHVQLPKAMLKAIPSDYHDKSKGTLKLLWEEEWRAMGITQVRANMISCDGNAXGTGRLTQRLRQQSLGWEHYEVHEPEPHILLFK

SEQ ID NO: 3614 - protein, 286 aa, Neurospora crassa
  unsure (1)..(286): unsure at all Xaa locations
PEGGNTNGDAAAAKDDKTVTVFHDKEHFNVKHPLSNRWTLWFTQALKRKGWFPPLPPPSLRPPPAPPYDAVSXHHRDQGDNWNDLLKEVITFETVEEFWGVYVCLXALSHPTLCATCMLTKTRAENIAPVSELALKSDYHLFKEGVRPEWEDPQNKHGGKWSYQFKEKRNVNIDEIWLHTMLAAIGETLEDEEDGEVMGVVVNVRKAFFRVGVWTRTIGKHIPGRGDGDISGGKGRSPEKGKEILMAIGRRFKEVLQLPPNEALEFSGHTESAHSGSSRARAKMTV

SEQ ID NO: 3615 - protein, 701 aa, Neurospora crassa
  unsure (1)..(701): unsure at all Xaa locations
IGTTYSCVAIYEGTNVEIIANEQGSFTTPSFVSFTPEERLIGEAAKNQAAMNPKNTVFDVKYALSSIPVSKEAASLTHLQRLIGRRIDDPTVKKDQESWPFKVVDDGAGNPKVEVDYLNGVHTFSPQEISAMVLTKVSHSHIRASGSVRIRTALXHVLPQHRXKEIAEVKLGKKVEKAVITVPAYFNDNQRQATKDAGAIAGLNVLRIINEPTAAAIAYGLGANKSNKERNVLIYDLGGGTFDVSLLNIQGGVFTVKATAGDTHLGGQDFDTNLLDYCKKEFTRKECRTRNRSLFPFPSFRNFSRFFSSFFSISFDFSSIFFVRGKINELHAKDLDXLFFTDQEGLSGDARALRRLRTACERAKRTLSSGAQTTIEIDSLFDGEDFNINVTRARFEDLNAKAFSGTLEPVAQVLKDAGIEKSAVDEIVLVGGSTRIPKVQKLLSEFFDGKKLEKSINPDEAVAYGAAVQAGILSGKATSAETSDLLLLDVVPLSLGVAMEGNIFAPVVPRGQTVPTIKKRTFTTVADNQQTVQFPVYQGERVNCEDNTSLGEFTLAPIPPMKAGEPVLEVVFEVDVNGILKVTATEKTSGRSANITISNSVGKLSSSEIEKMVEEAEKFKSNDEAFSKRFEAKQQLESYISRVEEIVSDPTLSLKLKRGQKEKIEQSLSEAMSQLEIEDSSAEDLKKKELALKRLVTKAMS

SEQ ID NO: 3616 - protein, 272 aa, Neurospora crassa
RSVGILGAGVLGRRIGACWASAGYQVHIRDPDPRQTNAALQYITSELWRYKPIVDPNTISVRGFQNMEHAVEDSWLVIECVPEKLNMKIDLFAELENITRPDAILASNSSSYKSREMTAMVKPETAQRMLNTHYMVPPTIRIVELMTSGSTRPEIFPFLLNHFRASGMMPVIAHKESTGFILNRVWAAIKRECLMVLAEGVASPQELDAVWTEMFIENGSPPCTLMDSVGLDTVSLIEKHYIQERGLQDRGVLPFLQKYIDEGRLGAKSSKG

SEQ ID NO: 3617 - protein, 1022 aa, Neurospora crassa
  unsure (1)..(1022): unsure at all Xaa locations
HPTIXTVFLDKSINNSVRFLAVILLKNGIDKYWRHTAKHAIQPAEKQFIRSRLLQGSVGEEDKTLALHNALVIAKIVRIDYPNDWPDVIPSIINVTRSARTESALALSGALQVLLRVVKELATARLRRSQTALQAVTPELVQLLGEIYTERTAAWQQFFARGGSGDEDEADYYMQNSLTALKILRRLVTVGYEHPHTDPMVQGFWSLSQSQFDQFLTGVSSESHIPAPFQDSVGKHLIQFTKLHIDMCDSHPASFPLLPNSIPLVKAYWNLVKQFSNEFEKSGGIRQTGSENHDGSAKHEGPLSEKLALKGLLLLRSCVSIAHRPMQTFKYKSPEVKNQEREAMELVKDQLLTNSFLLDIVQVTISRLFIFRQSDLEAWEEDPEGWEAAERNEGQAYEWAVRPCAERLLIDLLTHYKELGQPLLTYCEFATKVDMDIVTKEAAYCALGCAAAVIHEAFDFDRFLKTTLVKDAQIQDSMSKLLRRRIAILLNQWISIKITEESRPAVYEIFRHLMNPDDPHNDQVVRTTAAREFKGIVDDFGFQGEQFLPFAPDVFNQLMGLLQEVESDETKLTVLDTIRAIVQRMETHITQFGDAIMLTLPKLWESAEKEEYMIKQSILAIMSALVDSMRGDSQRYQPAIIPLLREAMEPESALHLHLIEESVALWKSVTTQSYPPLHPDLVQMVELALPLLEYDSEVANQCLEVVKNYILLAPREILDDRLRRPTLAALVKTLDARSREQSQTGARSIELILRIAENIGGVQGLQVVVQDMLEIGLLNTIFEGLHSAWEASTTHGPNKKVSQINTIKQTDYFMLLARIALGDPTVFLTMLAGIATTAGSTAEQVWEWLGTLWFNNFDCMAEVERQKLSMLALTRLWELPDPMVQEKIVLARLQDFLAMWTSVVTELAASEDDQSLTEQQDFRQSINSTSKEQLAGGSTNPRDYLVWDPNNLPSYEWDTPLDVTERQFALKDPVHRVEAYEFARERLQGLVQRMGGEQQFEAEWAVNVDKDVLEGFRRLGEG

SEQ ID NO: 3618 - protein, 724 aa, Neurospora crassa
LRSIFDSPETWKQFSGDKHGRNVGLFRNAYLTSPHGFLDFAHVSLGKARALVDKVLNAQSLDEYRAIVRHLDRLSDILCRVLDMADFVRVTHPDQQIQRTASMAWDMMYEYMNQLNTMTGLYDQLVQAMDNPQVSTTWSEEERMVAEVLKLDFAKSAVHLPKDARDKFVHLSSAISQTGTNFIQHMEPKIPYTTVEKSRMMGMDPVEVKRMASMGKVYVQTLSPQASIALRTVRDDHARHQLFMASRTASRRTVHTLEELMLLRGESAKLSGFESYGHLVLHDRMMASTPESVRQFLQALSENTRPQAQQEVADLTAAKRAHKGGDATLEPWDKDFYAESIRQAIKSRQKREDLSSYFSLGTVMQGLSRIFTRLYGIRFVPREPMPGETWHPDVRRLDVVSDVEGHVAVLYCDLFYRPLKSPNPAHFTLRCSRELSPHEIAETAHTQAENPHVLIPSFESAEFAANDGMAYSRSQDGAIKQLPTIALVCDFPQQSHNRPALLSFFQLETLFHEMGHAIHSILARTSFQNVSGTRCATDLAELPSTLMEYFAADPSVLALFARHYETDNPLPYEWVDNKIREARRFEALDTENQIILAMLDQELHSSKAVQGHIDSTEIFHSLQRQFSTAPPDPQGTAWQGFFGHLVGYGSTYYSYLFDRVLAQRVWNVVFNSGQGGAALQRENGERLKENLLKWGGSKDPWKCLAGALKDERLEGGGEKAMKLV

SEQ ID NO: 3619 - protein, 350 aa, Neurospora crassa
TGEVDATPVQFDVQYLAPVQIGSPPQTVMMNFDTGSSDLWVFSSETPAKQRNGQKIYNMTQSTTAELVDGHVWRISYGDGSSSSGNVYTDKVSIGGVEVDKQAVEIATHVSDSFTNDAASSGLVGLAFDSINQVKPRKQKTFFGNAIDDLAMPLFSANLNKAEPGNYNFGFLDHEEFVGPISFVDVNASRGFWEFEASGYTLPASNFTESNNKTGVFQSLTHTAIADTGTTLLMLPQPIVEDYYGQVAKARSDNAFGGYVFPCNADLPDLIIHIGSYKARLTGDLIKYAPADTDDFATAKWCYGGLQSAQGFPFSIYGDIFFKAQFVVFQGGVIDKDDWSKGAKLGFAAK

SEQ ID NO: 3620 - protein, 519 aa, Neurospora crassa
  unsure (1)..(519): unsure at all Xaa locations
EGVMGFIMDVTELKDRERDIEAQALEKRQLLANEAAAKEASRLKSQFLANVSXSAHFPHCFRTNRSRMSHEIRTPITGVIGMAELLLDVELDAEQRELTENIFRSANALLTVINDILDFSKIESGRLDIEEVQFSLAVVIQEVGKMLSFTAERKSLAFNYEICSDIGIDLVVMGDPGRVRQIITNLATNSIKFTHEGHVKLHVSVEQETDDTIEVKFVIQDTGIGIEEEVLKRLFQPFSQGDPSTARKFGGTGLGLTISKNLLELMKGRMALASKKDEGTTATFWIPFKKPQKAQSITGPLSDRLQSETSVSCNCPAPADQESGALSGEQRSAWRQSSTSLSPTTSQEELSMPDRSKIFILVVEDNEINQQIAIRTIRKLGFQVAAAWNGKEALEYLSKASTGKTRKPDIILMDVQMPLIDGYLCTHLLRHHAPYRSYVRDVPIVAMTASAIQGDKEKCKRAGMDDYLSKPVKRTTLERMLLRWCTTKREELSPITSQCTESGEHCQSAGIPAVGLNEE

SEQ ID NO: 3621 - protein, 492 aa, Neurospora crassa
  unsure (1)..(492): unsure at all Xaa locations
YTVPFFINGEEVRTSRTFDVTSPATQKVVHKCSSATDTEVQAAVNAAAEAFKTWRKSHPNQRRDLFHKAAEILEKRKEELGQYVMDETGAPRQWADFNIQVAKDLLMDVAGRCNTLEGSFPVVNDPESGALVLQEPYGVILAVAPWXVQLXAAAKRNGMYSTNTLQGNAPYILGIRSILYPIAAGNTAIFKATELCPRTMWGLCSVFHEAGLPKGVLNMLVHEPANAPAITSSLISNPQVKKVNFTGSTAVGRIIGRLAGENLKPVLLELGGKASAIVWEDAELDNAATQCALGAFLNSGQICMSTERILVHKSVRAEFEKKLVRAVENIFGPPTPAPILINSLAVDKNKKLLSDALSKGAKLLYGNPDAQEETTTRMRPVIVSGITTDMDIYKTESFGPTVAVYEIETEEEALRIANDTEYGLTSAVFTEDLRRGLRMAKEIETGAVHINSMTVHDEATLPHGGAKASGYGRFNTSRGLQEWVKSKTVTFK

SEQ ID NO: 3622 - protein, 1094 aa, Neurospora crassa
DPNEELTVVVPFRSKRIRDGLHFVGVEEGDLRYPHVYTRHSLEPGTASCIFPCLDDPGSRHSWTIKITCPRTLEDAFAPPLATQSALLTALDGGRKRKASDISAHQPGSSFTEEDKLREITVVCSGNLIGEQMHPKDERKKTMIFECVNTAARHIGFAVGPFEHVDLGAEFRTEEADEKLGANAARIHGYCLPGRVDEVRWTCQAVVAAADYFAPEFGRYPYEAYKMCFVEDLVHDTAVANSLSLCSTRLLYPETIIDTDIEVTRKLVHALASQYVGVHIVPNERSDTWLIIGLQWFMTDLFMRTICGNNWYRFHIKSLSDKLVEADVRRPSLHALGDYLHLGDFELEFMALKAPLVLYILDQRMSKIPGSTGVVRVLSQMVSAANISNTDPKATTLSFQDFRRWCEKRSQYVPDELWNQYVFGAGCPRLDIHQKFNKKNLNVDIQILQYQGPTKKSISKDEFWRELQEEIHQVYAGDVPKLFTGPFTVRIHEADGTPYEHYQLITEKDKGGTNLQIAYNTKYKRLKRTKKAMAAAANSNSDKHEIQEDDVVYFNMLGDVLTSQKDMEDWGLQDWASEVQTKMDQESYEWIRLDANMEWLCFMKTDMQEYMYLAQLQQDRDVVAHQDAMLAFKREKRHAVHSTIETRTVMDRRYYHGVRVMALEDLAKQAHPDLNYIGMVHLILCFRKFFCKKVPIPGREGGYHYPIAPNDFTDKGQYAIQCAIPAVLARTTDLQEKGRCSKRARQFIMEMLLFNDNSENEFSDQFYIAKLLDALTTSVIPQKEITEGYLIKNLDPFDEDDAEFKSFIEKTIEEIDKFRRMDEWTLTYQNIWTTTALHCKMRLMKARVIPESALDFVQYLQDDNIDLVRIKAFECLVELGMISKPPILKLLLSYMSTDSSPFIRDRLFKVFCRGIAAIAFGENKASTQELEALNDGGLVIDQGDAEIQQRKLDAVRREDIAHALNALKEELRGNTEMQISIWKAFNSPVIGLQEKRQLLELCSAMFEPEDSLLVTIKYPIVWKATRDPTIVATAPQILGTPPKKRCVVKFKSEYRTLPKSKDMVAIEAPPPPAPLPAPTPSTNLSASRVEIKPP

SEQ ID NO: 3623 - protein, 297 aa, Neurospora crassa
  unsure (1)..(297): unsure at all Xaa locations
MASLARRPPLLVPAVARHTATVIFIHGLGDTGHGWASAVEQWRRRQRLDEVKFILPHAPSIPITANWGMKMPGWYDIVSLPTYSVXYLAPSPPKLKVXHHSYKSSPSMAAAEALRRNEDEAGILTSQAYFHDLIQKEIDSGIPADRIVIGGFSQGGAMGLFSGLTAKCKLAGIIALSSYLLLSLKFAELVPKPEFNKETPIFMAHGDADPVVNYKLGTMTRDLLKEMGYNVKFTTYPXVPPSVSQCRSISRMFPCXLPGIARGMGHSACLEELDAIEDFLTERLPKVADKSEQKSEL

SEQ ID NO: 3624 - protein, 287 aa, Neurospora crassa
  unsure (1)..(287): unsure at all Xaa locations
AMSEPKVIIVTGGSKGIGLAVVQDLLKASHKVVLVARTPVSELAKDYPGQVTFLAADYDSIXCELRSQPYWDIAECNMMENQMDINVSKTAHRAVELALISYGKLDAVVVNHGVLTPITRLADASIEDWKSHYDVNVFSALSIVSFTPLDQCDQITGLTQWSGKEAIPHLRATKGKIIFVSSGAAIKAYAAWGAYGSSKAALNSICRHVAVEEPDITAVAVSPGRVDTDMQKELREKGQGVMSDKEYADFVSAFEEGQLNKPEWPAQVIAKLSLDAKSDLSGKYVAW

SEQ ID NO: 3625 - protein, 936 aa, Neurospora crassa
  unsure (1)..(936): unsure at all Xaa locations
ADSLSLDATLRHAAEQQLSQAAQTNFVWPPPLVAPVSRPHSKAFINANLAVSXSQYLVTLVQELANESAQSHIRAAAGIALKNAFSAREFARQAELQAKWLQQTDQDTKTRVKQLTLETLASSSTQASQASAQVIAAIATIELPRNEWPDLMHALVKNVSEGSEHQKQASLTTIGFICESQDVDLRNSLVQHSNAILTAVVQGARKEEPNREVRLAAITALGDSLEFVGNNFKHEGERNYIMQVICEATQAEDSRIQQGAYGCLNRIMALYYENMRFYMEKALFGLTILGMKSDDEDVAKLAVEFWSTVCEEEIAIEDDNAQVRFTATLVEQESHXQQLQVESSEQMRPFYNFARVATLEVVPVLLQLLTKQDEDAADDEYNISRAAYQCLQLYSQAVGAAIIQPVIQFVEANLRADDWHLRDAAVSAFGAMMDGPEEKLLEPIVKSGMQPLIGMMEDPSLHVRDSTAYALGRITETCSEVIDPAVHLDPLITSLFNGLMSSPRMAASCCWALMNLAERFGGEYGAAQNPITPHFNQCVTNLLAVTAKLDGDATVRTAAYEVLNVFVQNAANDSLPAVASLSDVILQRLEETLPLQSQVVSVEDKITLEDMQTSLCTVLQAIIQRLDKEITPQGDRIMQVLLQLLNTINGKSAVPEGVFAAISGLANAMEEDFAKYMDAFAPFLYNALANQEEPSLCSMAIGLVSDITRSMGERSQPYCDQFMNYLLNNLRSTALANQFKPAILQCFGDIAGAIGGHFEAYLSVVAVVLQQAATVTASAEGSYEMFDYVISLREGIMDAWGGIIGAMKGSDKSKFPRSXARFAETDKCRTANVLEPYVQSIFELLNTIAQDPNRSEALMRAAMGVIGXVGMMLRQHIIETLTIIXDLADAYPNGQLAEVFRQDWITAMIKETRSNREFQQRTIETARWAREQVKRQ

SEQ ID NO: 3626 - protein, 77 aa, Neurospora crassa
  unsure (1)..(77): unsure at all Xaa locations
YRQLLRQGNQFSSYNFREYAKRRTRDAFRENKNVEDPRQVQELVQKGLQNLQMLKVCRALELRRDLENTEKLTLEXR

SEQ ID NO: 3627 - protein, 289 aa, Neurospora crassa
SPKLDGKFDDNASVDSGFASANSSTANLPLISLTKPHLDHLNKQLENMEALDILRFCKILFPNLFQTTAFGLTGLVTLDMLSKLAKESPDAAPVDLIFLDTLYHFKETYALVDRVQERYPNIRLHVFKPADVSNVDEFEALYGEKLYETSEELYDWIAKVEPQNRAYQELKVAAVFTGRRRSQGGARGSIPVIELDEERGIVKINPLVNWSFQQVKAYIDEHQVPYNELLDKGYKSIGDWHSTSPVAAGEDERAGRWKGKNKTECGIHNKQSRYAQFLAENARKQAKGA

SEQ ID NO: 3628 - protein, 557 aa, Neurospora crassa
  unsure (1)..(557): unsure at all Xaa locations
EDKTHINVVVIGHVDSGKSTTTGHLIYKCGGIDKRTIEKFEKVSHYLLSSPFTSPFPSALPFCCLXAFPRRFGFVATPHPLMVGLGLKDFRLAAHRPTYPAFKHHDATPTHIHSTXCXLSTTEAAELGKGSFKYAWVLDKLKAERERGITIDIALWKFETPKYYVTVIGMSHHSPAFIPTHANSLPRQMAPGHRDFIKNMITGTSQADCAILIIAAGTGEFEAGISKDGQTREHALLAYTLGVKQLIVAINKMDTTQWSQTRFEEIIKETKNFIKKVGYNPAGVAFVPISGFNGDNMLEPSTNCPWYKGWEKETKAGKATGKTLLEAIDAIEPPKRPTDKPLRLPLQDVYKIGGIGTVPVGRIETGVLKPGMVVTFAPSNVTTEVKSVEMHHEQLAQGVPGDNVGFNVKNVSVKDIRRGNVAGDSKNDPPAGAASFTAQVIVLNHPGQVGAGYAPVLDCHTAHIACKFAELLEKIDRRTGKAVEASPKFIKSGDAAIVKMIPSKPMCVEAFTDYPPLGRFAVRDMRQTVAVGVIKAVDKSTAAAGKVTKSAAKAAKK

SEQ ID NO: 3629 - protein, 426 aa, Neurospora crassa
  unsure (1)..(426): unsure at all Xaa locations
QEKLPNLREYKYSAVDHSLTSKYILKPFYTNVVIKLFPMSMAPNLITLTGFMFVVGNFLTLLWYNPTLDQDCPPWVYYSWAAGLFLYQTFDAVDGTQAXVISVPSCVKLTETRXTDDEPQHSRRTRQSGPLGELFDHGVDALNTSLECLIFAASQNMGQSWYTVATVFASLLTFYVQTWDEYHTKTLTLGIVNGPVEGILILVGVYTLTGYLGGASFWQQGMLSTLGVPQTLTFGTTALTLPSFLYNFSFTEWYMVQGTVVLVYNTVESARNVIRARRARGDRSRYALVGLLPFFATWALVVAYLFLQPNILHGHLVPFVLFAGIVNAYSVGKMITAHLVKLDFPYWNVMVIPLGLGVFDSLGPVIHKYAPDGLKNLGWPSALGDGVYQVAYMFCMLGMAVGVYGSFVVDVIVTICDYLDIWCLTI

SEQ ID NO: 3630 - protein, 793 aa, Neurospora crassa
  unsure (1)..(793): unsure at all Xaa locations
MSNPPHGGVLKDLIARDLPRHAELEAEAETLPALLLSERQLCDLELILNGGFSPLEGMLSLSSSEPVLGFTFHYLVRPLVLDSDDGGVMDLGRVNPAMLDHPLRFACTLEHDKSAGYDHGRXCTTCXQLNSSRRIIGFMNQEDYNEVRVSLFFSCCPSRASLCRMWSSPLTRDFTPNSVVKENRLASGLLFSMPITLDVSEETISELGLKAGARITLRDFRDDRNLAILTVDDVYKPDKYRNKDMNCSGVNFHHEDIPDARAHCALGRRGIKEISGMKCVPSGCVIAWRMADLXYSSHLRGWKWDRTEELTLRHFRALEAKEVFGGDEEHPAVKFLYETAKEYYVGGKLEAVNKLQHYDFVDLRCEAAKSPFFSASSSPFHPHCNVATILTRDGIIDSPAEIRTHFDKLGWSRVVAFQTRNPMHRAHRELTVRAARSHHANVLIHPVVGLTKPGDIDHFTRVRVYKALLPRYPNGMAVLGLLPLAMRMGGPREAIWHAIIRKNHGATHFIVGRDHAGPGKNSKGVDFYGPYDAQYAVEKYRDELGIEVVPFQMMTYLPDSDEYAPVDQIPKGVRTLNISGTELRARLRSGREIPEWFSYPEVVKVLRESHPPRSQQGFTVLFTGYPNSGKDQIARALQVTLNQQGGRSVSLFLGENIRHELSSELGYNREDRDKNIARIAFVASELTRSGAAVIAAPIAPFEKARQNARELVEKYGDFYLVHVATPLEYCEKTDKRGIYAKARAGEIENFTGVNDPYETPAKPDLVVDCEKQSVRSIVHQIILLLESQGLLDR

SEQ ID NO: 3631 - protein, 297 aa, Neurospora crassa
NTVKAMFDTLDADIVVIQETKIQRKDLRDDMVLVPGWDVYFNLPTYKKGYSGVAIYTRSSKCCPIRAEEGITGVLCPPNSSTKFRDLPADQQIGGYPTPGQLSSDIDEAQLDSEGRCVILEFPAFVLIGVYSPATRDETRIEFRQAFIDAMDARVRNLVSLGKEVFLCGDLNIIRNEMDTAGLPEQLKKEAMTLDQFISTPSRRFLNQIVFGGRVIGEPDEGREKPVLWDLCREFHPKRPGMYTCWETRKNARPGNFGSRIDYVLCSSGIKDWFVDANIQEGLLGSDHCPVYATISD

SEQ ID NO: 3632 - protein, 1077 aa, Neurospora crassa
RSEAELAINIRKATSAEESAPKRKHVRSCIVYTWDHKSSQSFWAGMKVQPIMADEVQTFKALITIHKVLQEGHPATLREAMANRGWIDSLNRGMGGEGMRGYGPLIKEYVYYLLAKLSFHQQHPEFNGTFEYEEYISLKAINDPNEGYETITDLMTLQDKIDQFQKLIFSHFRNVGNNECRISALVPLVTESYGIYKFITSMLRAMHSSTGDAEALEPLRGRYDAQHYRLVKFYYECSNLRYLTSLITIPKLPQDPPNLLAEDENAPALPARPKHEIEKRPTPPPPAPKSEEPDDMAEFWKNELDRQNREYEEQQRVLEAQQQQALLAQQQAQLQAQRDFEEQQRRLMEQQQREQEALMAQQTQWQTQGRLAELEQENLNARAQYERDQLMLQQYDQRVKALESELQQIQGNYGQQINSRDDQIRALQEQLNTWRTKYEALAKLYSQLRHEHLDLLQKFKTVQLKAASAQEAIEKREKLEREIKTKNLELADMIRERDRALHEKDRLQGSNKDEVEKLKRELRMALDRADNLERSKGNELSTMLSKYNREMADLEEALRIKSRALEEAQAKLRDGSSDLEALLREKEEELEVYKAGMDQTLIELNELRNNQGVSDSALDGQLDALILSQLEKVNEIIDSVLQASVQRVDDAMYELDSDMQAGNQNASPSYVLSQIEKASASATEFATAFNVFIADGPSSSPAELIKNANVFAGAIADVCSNTKGLVRLATDEKKGDSLINGARSSAHSTVKFFRGLLSFRLEGMDPLQKTDVVINSNNDVQINLQKLNKLVETFAPGFGQLANKGDLGDIVDQELSRAADAIAAAVARLQKLKNKPRDGYTTYELKVHDSILDAAMAITTAIAQLIKAATATQQEIVQAGRGSSSRTAFYKKNNRWTEGLISAAKAVANSTSTLIETADGVLSNRNSPEQLIVASNNVAASTAQLVAASRVKAGFMSKNQESLEEASKAVGAACRALVRQVQSMIKDRSAEDEQVDYSKLGSHEFKVREMEQQVRDSFEISFLFHFRYPWSCLLWFIADQFILSPSQVEILQLENALNAARHRLGEMRKISYQQDED

SEQ ID NO: 3633 - protein, 1678 aa, Neurospora crassa
  unsure (1)..(1678): unsure at all Xaa locations
AASIMEFLRLRLNCIDHYQATPTRYDPQFDQDVRFSRSRKAAKVPVIRVFGSTDKGQKVCAHIHGAFPYLYVEYDGNLEPNKGECFPVSTHMVRAYVPFLTXVLAYEYIAKLHASIDHALAISYRKDPIRDRPKYVARISLTKGIPFYGFHVGYRFYLKIYLFNPVVMSRLVDLLQQGVIMSRKFQPYEAHLQYLLQFMADYNLYGCNYLDAAMATFRAPVPKHDSNIEGREAEHHWDDTTIPSELITDNYSLPRASHCSLEVDICVEDILNRKQVKERRLHHDFIEKEQPVSSQEKLVHSMAGLWTDETNRRKKRMGITDPEVNPFPPEVLVSMSADPRQSQVMGWVHEAEYRAGIQQLVAQEQNNTDGRQETFSRFVQPVPFEETIKTTLESVEDLYPDNLSQALQIEAQFFHMNAHHLISIDVDERSIFQLTREPYAKHTRHEYAGRISPEEPLNGVGEGFGVGDSMIYPMDGRIRVYQPRASIRHKLLKIAQTYSSNIPANTGRQAGILGPGERQRRSLKHPRPPGEVDHGAPAKRQVLQAEYSRESLHIKADPPQRALRKAPRNAHEQTQGAGQPGPQRKLQSNPPERVYEEPNKRVHEEAQPKVHRKAQQRSREHDQKQGQQIIQEQTQDHDQGGCQKEVPEDSAFTTPALTVQPMKPNNQDPAGEELSVNSLRVEPPKPKTSQPMKSAMKQSFTQEFQNRTINFPVVKDPQDPNTRARLSQKSGSQKNEGNVTRKQLAFDPQPTILGPSAQAKPGQTKSNLKSSSRPLDSAPVALAPALLWSGSKKMFVLNNKPPSLSEVRCTMQVHGLPDVIYQDAYYSKDEDVPSRPREYAGREYRLDGSSVPWLSDFDPTGTSSATYGEKPTSGADWPMLEAIYEAQQEECAMRGWEIADPPPSFKEVSNWWTDEQNDRNPKRCHSTPLRIKTYRSQIAGVTPKNKHGFEHPEKTKSESKQDQAQYMSAMSLEVHVNTRGKLVPDPEEDEVQCVFWYLRSEVNALRGTQTPDDTARGIIVFSEDSLLADRIRKHTSVPVVQETTELDMMVRMVEIVRNHDPDIFTGYEVHGSSWGYLIERARIKYELDLCDEFSRMKSQSNGRIGKDADRWGFNTTSSIRITGRHMINIWRAMRGELNLLQYTMENVVWHLLHRRIPHYSWKTLSDWYLSDRPKDLDKVLRYYLTRTRLDIEILEKNELIPRTSEQARLLGVDFFSVFSRGSQFKVESIMFRIAKPENFLLPSPSRKQVGAQNALECLPLVMEPQSAFYSSPLLVLDFQSLYPSVMIAYNYCYSTFLGRIVSWRGRNKMGFMDYKRQEGLLSLLKDYINIAPNGMMYTKPHIRKSLLAKMLTEILETRIMVKSGMKQDKDDRAIQQLLNNRQLALKLLANVTYGYTSASFSGRMPCSEIADSIVQTGRETLERAIAFIHSVQKWDADVVYGDTDSLFVSLKGRTREQAFEIGQEIADAVTKLNPRPVKLKFEKVYHPCVLLAKKRYVGYKYESRDQTVPVFDAKGIETVRRDGTPAEQRIEEKALKILFETADLSQVKSYFQEQCHKIMRGAVSVQDFCFAREVKLGTYSTSGRGGPAPAGALIATKKMKEDARAEPQYGERVPYVVMAGAPGMRLVDRCVEPEELLNNAHATLDADYYINKNIIPPLERIFNLVGANVRTWYEEMPK

SEQ ID NO: 3634 - protein, 533 aa, Neurospora crassa
VVVKHQGKKYDVDVDTSATGEVFKYQLYSLTGVEPDRQKVLLKGSQLKDDTDMSKVGLKPGQMIMMMGTPGEGGGAIVRPTEKVKFVEDMTEAEAAQQAGATPAGLQNFGNTCYLNSTLQVLRSIPELNDALKSYKGEQSMLDPTSQLRNLYDMMSKTQEGIPPLAFLNALRVAFPQFAERERDGHGYAQQDAEEAWSQILTQLKQKLKISEGDAARDASFIDKYMGLELTSVLECDEPGAKEAGEEPKTSKERLLKLNCHIDGQTNHLRDGIVNGLVEKLEKKSEVLDREATYTKRSQISRLPKYLTVHFMRFFWKREVQKKAKIMRKVTFPHELDVVEFCTDELRKALIPVRDKVREVRKEEHDIERARKRRKMNPIDGENAQGSQPSTSKDKKKDEKKPAGGDVEMTTEETFKTDAEFEAEKEAEVLAAKKELYTLINQDLLKDEGANQSGLYELRGVITHQGASADSGHYTAYVKKTGIKDPVTGKVGEEDGKWWWFNDDKVSEVEAEKITALAGGGESHSALILLYRA

SEQ ID NO: 3635 - protein, 395 aa, Neurospora crassa
  unsure (1)..(395): unsure at all Xaa locations
DHIPLVVSRETGDIVPESHQADPLVRPDKIEATPFAKSWAHFVAGGXARTIPPTDGKPLAPPSAKKSAELXHFRALAHITEIGGMTAAALTAPLDVLKTRLQSDFYQAQLRASRQSHVGVPLNPIRAAWYHFSETGQILSAVYRQEGPRALFKGLGPNLVGVVPARSINFFTYGNGKRLIAKYFNNGQEGTWVHLSAGVLAGIVTSTATNPIWMVKTRLQLDKNVAAESGGVTRRQYQNSYDCIRQILRNEGLRGLYKGMSASYLGVAESTLQWVLYERMKTALALREEKIVQSGRQKTWWDHAVNWTGNAGAAGGAKLVAAVLTYPHEVARTRLRQAPMDGGKPKYTGLIQCFKLVFKEEGMAGLYGGMTPHMLRTVPSAAIMFGMYEAILRLL

SEQ ID NO: 3636 - protein, 459 aa, Neurospora crassa
  unsure (1)..(459): unsure at all Xaa locations
PSPLKHTTPPFHPSHAANPSPPPPSIGTWQGESTQVKDAVVAALKSGYRLIDTAYCYGNEEHVGAGLKEAFDQGIVKREDVFVVTKLWATYTSRAEEGLEKSLRNLGLEYVDLFLVVCCLSLQFFLSLLXAALLGGVRGLCQSGGGIXRERCXGRCXRMATWAITALAAFDESXRXVRXVGIRKKKKRENKKKKERKKDQGRCLVDXRTDYNTXGNDDRFPKLPNGERDILRDYSHVQIWKNMEKLVGSGRTKAIGVSNVCVSILMTFLAQPCSAFSHPVPSSLPLTSXWRPLTXAPYNTNSIASAISKSSSPHAKIVPAVNQIENHPQLPQQEIVDFCKEKGIHIMAYSPFGSTGSPVTSAEPVIKIAEKHGVKPTTVLLSYHRGLFPVIILGSERVALLGELHTKGTEVLTRLYCKSTVYRGSTVLPKSTNPERIEANAKLIELDAEDQKLLNDYSE

SEQ ID NO: 3637 - protein, 318 aa, Neurospora crassa
  unsure (1)..(318): unsure at all Xaa locations
VQNMFSLEGHTALITGATRGIGQAVAIALAEAGADILLVQVCPSVAFXLPQDRYLSVPKERPVSKNHPSQRDETSTTTLQAIQSLGRHAQIYKADLSSPTDVSSLVPRILSDGHTIRILVNCAGIQRRHPSHLFPDSDFAEVMQVNLNAVFTLCRDVGAHMLGLDPHPVTRRKGSVINFASLLTFQGGLTVPAYAASKGAVGQLTKSFANEWTSKGVTVNAIAPGYIETEMNEALLKDEERLKSISARIPAGRVSHSVFYFLVCQFADVHGXRDGSGQFGIVWGSPEDFKGTAVYLASKASGYVSGHVLVVDGGWMGR

SEQ ID NO: 3638 - protein, 508 aa, Neurospora crassa
  unsure (1)..(508): unsure at all Xaa locations
QLLENSRAWKDAWASIVHHQLQFVVELEGLYDPIVGASDGHGRESVPTPRLQLERTYRLKQAFGELKSELAEEIGTIEDRVIRPAVEARDCIAPIRKTIKKRENKRLDYERAQDKVSKLHKKHTRTPKEEASLAKAEVEMAQAGDVSLLXPQAVHLIDYQPYXLCTXEFAIADEHLQSTLPPIINASFSLVPSLVAALVLIQNRLLGLYYTTIHGYCMESGFPSPPPPMSDVVAAWEAAFVPARDDFESVSIVARGKAAHSPMALQAPEGPGRRISAIIPGRNDMRRVTSPMPSTSGAASTYSSGASQPGRNNLRIPSAGGYPSRAPSPAASDRSSYASSPPASSYSGYSGSQNQQRRPDYLAPTDFTAATALGDRGSVDRGTIENNRPFPRSPSTTAPSINRVHSPQATRNAGSANGNGNGNGNDYFALAVAKKRPPPPPPPKRITSQQQLVEYVVAQYTFAGQGAGDLAFNEGDKIKIIKKTNTDQDWWVGELNGKRGNFPANYCK

SEQ ID NO: 3639 - protein, 549 aa, Neurospora crassa
  unsure (1)..(549): unsure at all Xaa locations
VKASQRLDSRGNPTIQVEVRTAHGAFPTYNSLSDKFLLDKVGCLTNISLGIFRALVPSGASTGVHEAVELRDNDKRKYGGKGVLTAVNNVNEIIGPALVKEGYSSRRDLKQIDGFMRELDGTPNKAKLGANAILGVSMACARAGAAAAVSFRPXLPIVLFRAPPPPPQVRLVDKRETPKFXNIPLYEFLRREGGEEAPYMVPVPFFNVLNGGRHSGNGMAFQEFMIAPTGAKTIEEGIQMASETYFVLKQMISDKFGAICKSCPEPNQWIILXCENXXAAKTDTGVGDEGGFAPPITQPEEALDLLTEAVAKAGYTDKIKFGIDAASSEFFNPENGTYDLGFKRIKEGESHSDDVRTPAEMMALYKSLIEKYPIPLLEDPFAEDDWESWTKFCKDFYFEELVGDDLLVTNVERVRMAESRVACNAMLLKINQIGTVTEALDAXVLAPPLVSLXLPLGWXSDGLADXFLVXRAKLAKSLGWGVFVSHRSGETTDDFIADLSVGLCTGHIKSGAPCRGERVAKYNRLLDIETELKESWKPWSYAGEKFRKP

SEQ ID NO: 3640 - protein, 509 aa, Neurospora crassa
  unsure (1)..(509): unsure at all Xaa locations
IHFERSLTFLQACALYPSAILWSAFVSMGVIMLAFDPQLLGNLYAMPQFRKDFGYLYKNDYIISAPWQTGLSMGNPVGQVVGALIAGYPMERFGRKWTFGACVALTACLIFIQFFARSLQVLLVGELLGGLVLGCYAVIAPAYSSEVCPMALRGVLTSYVNLCFVIGQLLGNAVCAGTSKLSNHWAYSIPFALQWFWCLVILLGLAWVPESPWWLVRKGKLDEAEMVLRRLASDKVDVGKTLTVIVETDRLEQELEMGSTYWDCFRGVNLRRTEISMGVYCTQVLSGIYLINYGTYFFQLAGLDNDEAFDMGIWIFRXGAWLLVSLHCFMLKTHFSTAVGFLGTIISWPLLIRYGRRKIFNTGLLVLVFLQIIIGILDCIPGRPSGVIWTESSLMLVWNFFYDISVGPVCFVIISEASATRVRSKSIALATAAQGALGCVMTVAIPYMINPDQANMQGKLGFFFGGLAAMCLVWSYLRVPETSGRTYEELDILFERKIGARQFQEYVIE

SEQ ID NO: 3641 - protein, 276 aa, Neurospora crassa
FNLAGRVALVTGGGTGIGLMATQALAVNGAKVYIAGRNKEKLDKVVEIYNKDVEGEIIALQADVTKKEDIAALVKEIESREKCLCILVNNAGISSSSVTTEASDPKELKHNLFDNENATFDDWTETYRTNVASIYFMTSAFLPLLQASTERHPGWSGTVVNISSISGQVKSAQHHFSYNASKAAAVHLNRMLAAEIANAGLKIRINSIAPGVFPSEMTAEESDEFQKSHIPKEKYQDKFPSARPGRDIDMAQAVLALVSNQFINGETLAVDGGYKL

SEQ ID NO: 3642 - protein, 1233 aa, Neurospora crassa
YLTPSTTFSTEWLNRLQQRWDTPVDHSLLFRIAPTQTRTVTRFQRHGLEGRVTGYRNVTVPASHATAKTSTSMMRKPASKSEFVRGGAGFFPFAPGGLDGIESAAALEDQLRKDAASDEGESKKKLERVITLAEGGLLEVAPGMSRGIDMSKRKKTADAESEKQAKEVEDVLGQEPEDAPDGEGERDEVNGVKREESEDNQDDLEDIDAILPVEFPALEPRGTLAASSARKAGREWAHMVDIRREIPNFRELVPDMAREWPFELDTFQKEAVYHLENGDSVFVAAHTSAGKTVVAEYAIALAAKHMTKAIYTSPIKALSNQKFRDFRQTFDEVGILTGDVQINPEASCLIMTTEILRSMLYRGADLIRDVEFVIFDEVHYVNDYERGVVWEEVIIMLPEHVSLILLSATVPNTYEFASWVGRTKQKDIYVISTPKRPVPLEHYLWAGKKIHKIVDSEKKFIETGWKEANLAIQGKDKPPKAIEASTGPARGGGNQRGRGGAQRGANQPRGGARGGGQQRGRGGPPRASHTPGHMGRTGRPGGFTSAAQDKNLWVHLVQFLKKDNLLPACIFVFSKKRCEENADALSNQDFCTAQEKSHIHMIIERSIARLKPEDRVLPQIIRLRELLSRGIAVHHGGLLPIVKEMVEILFAETLVKVLFATETFAMGLNLPTRTVVFSGYRKHDGHQFRNLLPGEYTQMAGRAGRRGLDTVGSVIIVPPGGDEAPPVTDLRQMILGEPSKLRSQFRLTYNMILNLLRVEALKIEEMIKRSFSEHATQQLLPEHEKAVKLSEADLAKIKRDSCPICDVHMDECHQAGEDFKVATEELYRALLAIPVGRKLFTPGRLIVYMKEGVRTPGILLAEGPSKAGTAANPTLHVLEIKTGRDLRNDTDLLPFTPTLAKWFTPLPAHKKNIYTKTVHIPLSDVVCLTKHITKSIVPELFDGGDGYTKAKEALHQICKSWSAPIWDEMDLSRIKSLSIHEIITRRRDAEIKCTKSSAVDCDLFLKHYAMCHDQWLIKTKIDELRQSLSNQNLQLLPDYEQRIQVLKDLSFIDDASRIQLKGKVACEIHSGDELVLTELILENVLADYEPAEIAALLSAFVFQEKTDMVPNLTSNLERGQKTIIELSEKVNAVQTLHQVILSSDEGSDFASKPRFGLMEVVYEWARGMSFKNITNLTDVLEGTIVRTISRLDETCREVKNAARIIGDPELYQKMATTQELIKRDITAVASLYM

SEQ ID NO: 3643 - protein, 572 aa, Neurospora crassa
  unsure (1)..(572): unsure at all Xaa locations
KSLPSHPTHKSRRLVSLDXCKSXXYQAIAEIRREIEGEDIISTDPDDLHAHGYSEWSSSNPEGLPVAVAYPRSTEHVSTIARICHKYRVPIIPYSGGSSLEGNFSAPYGGISVDFAFMDKIVQFNKDDMDIVVQPSIGWQDLNEQLAKMASGLFFPIDPGMYCARKSMKAGEXCSRHXRITQGPSAKIGGMIGTNCSGTNAVKYGTMKDWVINLTVVLADGSVIKTRRRPRKSSAGYNLNSLFVGSEGTLGLVTEATLKLAVVPEELSVAVVTFPTIRDAAAAAAEVMQRGIPVAAMEIMDEVQMKVVNIGGATAPRVWKEMPTLFFKFAGTKAGVQENIDLVQRITKTNKGSNFEFAKDAREQKLLWSARKESLWSMLALRKEGEEVCKFSFLFTCACSMKSXHXGEQTNITGRLFTQKTAILTLLVLLGSTDVAVPFSRLADIIEVSKKEMDDLGLFASILGHIGDGNFHESIIYNRQKKEERDKVEVCVKNMVKRALEMEGTCTGEHSIGWGKKESLLWEVGPDTLGVMVSLXTPGELAKGLGCVLTKCTEIIKLALDPKWIMNPGKIF

SEQ ID NO: 3644 - protein, 292 aa, Neurospora crassa
  unsure (1)..(292): unsure at all Xaa locations
TAQFVHNEWIESYDPTIEDSYRTQVAVDVSLNFSILLIECLCSRLANEDLQGRQVILEMXDLPHLHFTLTDTSLFDRVMLTCSSSASTRPVQNSSVSNRTALGQLTPSNLKLASLTLWAKVAMRDLYMKAGQGFLLVFSITSQASLDELATLREEIIRIKDDENIPIVMVGNKADLLDQRAVDRAKAFTISQQWNAPYYEASARTRSMLFMSLFKKRKIRYXHFQKANVDEVFIDLCRQMLRRDDSGQLDDDDGARNGSGYGYGQGKQEDGHGPMKKKRRRKRKGDHKCIIM

SEQ ID NO: 3645 - protein, 224 aa, Neurospora crassa
  unsure (1)..(224): unsure at all Xaa locations
QTCLLISYTTNAFPGEYIPTVCVQPIRHSYLRXLGHHYPGNXHARCDSFDNYSASVMVDGKPVSLGLWDTAGQEDYDRLRPLSYPQTDVFLICFSLVSPPSFDNVKSKVSNSAMRGGRGDATHMDLHADFSGSWHPEIQHHAPGIPIILVGTKLDLREDPDTIQSLSQKRMAPITFEMGVNCAKEIGARKYLECSALTQRNLKSVFDEAIRXVHSTPGPSQSDK

SEQ ID NO: 3646 - protein, 353 aa, Neurospora crassa
  unsure (1)..(353): unsure at all Xaa locations
TGDFATMAKYKPQDATTNPSLILAASKKPEYGALLDAAIADAKKGPGSPEEKVDAALDYLLVQFGKKILEIVPGKVSTEVDAALSFDTKASVDKALHIIKVRVSEYVAYWAPXFRLAMTDXPCHQQLYEAEGISKDRILIKIASTWEGIKAAEILQRDHGINCNLTLMFSLTQAIAAAEAGAFLISPFVGRILDWFKAHTGKNYSKEEDPGVASVKTIFNYYKKFGYKTIVMGASFRNIGEITELAGCDYLTISVCLHLHLMLQYFAEICANRTXKXPNLLEELLNSDAPVPQKLNAADAASLSIEKKTYINSEPTFRFDFNEDQMAVEKLREGISKFAADAVTLKEIIKQKL

SEQ ID NO: 3647 - protein, 376 aa, Neurospora crassa
LRERVQEFVRRSLPETLAAETDKSNAFPPHMWQALGDAGLLGITADEAYGGLSMGYQAHCVVMEELSRASGSIALSYAAHSQLCVNQLSLNGNAEQKEKYLPGLISGEKVGALAMSESGSGSDVVSMRTTAKKVEGGGYKLNGSKMWITNGPDADVIVVYAKTEPDAGSKGITAFIVETKKDGVKAEGFECLRKLDKMGMRGSNTGELVFENVFVPEENVLGKVNGGVRVLMEGLDLERLVLSAGPLGLMQAALDVALPYAHSRKQFGTPIAHFQLLQGKLADMYTKLQASRAYTYATAKTVDEQGVIKTQDCAGAILYAAERATEVALDAIQILGGMGYMEEMPVSRIMRDAKLYEIGAGTSEVRRMVIGRVFNK

SEQ ID NO: 3648 - protein, 245 aa, Neurospora crassa
  unsure (1)..(245): unsure at all Xaa locations
YSPKGSFTEYDGLKTYVTGPDDATKGIVVIYDIFGYFDQTIQGADILATSDDTKYKVFMPDWFKGEPCPIEWYPPDTDEKKKNLGAFFSKNPPHGVAEKLPAFVKTLSAKHPNIKSWAIIGVSVVSLGIQGNLSDXSLQQYCWGGKVVSLITKSENNPFSIGAECHPAMVDPEEAKGIKVPLILLASKEEPEDKVKEFEQNLSVPKHVETFKDQVHGWMAARGDLKDERVKSEYVRGYKTVLEFF

SEQ ID NO: 3649 - protein, 1196 aa, Neurospora crassa
  unsure (1)..(1196): unsure at all Xaa locations
KFGKQIQKRQLEVPEYAASFVNYKALKKGMHPGCCYCCCCSRVSSXCYQAWTXGHHISILGPLRLXKLHRSITTYGXLRRKCXHFHIQLIKKLSATPILPPQTDLRRAPGEPLDTQSALQANKATFFFQIVRKVFLSVPCIINNCLGRELDKVNACYVQKEAELKIRLKTLLDKKKALRSRSGGTSRRSTKFTTLQEGFQQFVNDLNKLQQFVEINGTAFSKILKKWDKTAKSKTKELYLSRVVEKRPAFNPTVISELSDQATTSLQELGAWADGDNVSFETRPDHDHVVSTQHLLGTDEGDADTLLLDTVLSGNIDSLKDMLDRMKATAAPDGSADVSLAERVTRTFLASINEGSLEALKVLLDTGLVDIQSWDDINERNCLHQAAIYGNSFVLEYGLSKGVDAERTDAYGRVPLHYASMHGRLDMIDALLNGMLTLIXMLFSGARLTSRSVASPKTINLIDHDNFTPLVHSIVRNHLECVGRLLERSARIDPVSDTDHVPLNLACQHGSVAIVELLLKHGAKILADAEGLYPQHLVARSGQTPEILVLLKQYGADLDQIDKLYGWTPLVHAASEGNVPCLQALLETGADPNILDEKDLPAMYYAAWEGHLECMKLLTPAKKEKAASELPPIHIGGALPPMASSTAPMPMSLDAIDPIPALELPPPIIPLRRYGHNFLDTKTVVQISFEEDSEQPLLFFQDGKYPAARLTISSKSSDLIPKNIILPFQEDTRVASFQIDNLESFTLDFEVFPTYGAKVIAKTVALPNIFRALLSSSGKCCLPLFDPRLRAIGQISFHVQIIKPFSGTPLEITDFETYWKATSQFDTNTSTFVTGSSLSGDFVQIYVQHTKDGVPVLWPRWTINCGGIDVPVSTLTLAQFQTVTAAARNRINLSELSTYTLDQIADVHRILANIGITLHEALFLLPKGMHVNIQVLYPTADEKAEAKSSTAADDVNEFADAILSVVFDHARAQRAERPDSVRSVVFSSYNPTLCTALNWKQPNFPVFLCNDMGREDRKQQQQGSCSKGDGDEDMGGTTAASRREAADERTLQSDGRRTSSIKDVVRTATSNNLMGLICCSRLLVSFLSLSLSFPPPPPPTPTLSSXSECFHXRLXMTTGHVPALVDAIKSHGLALVVDKSGEPEAANSKDSGDKQLGISGALGGLAGSDPFPKLPKGVDGLLKSNGVLRFNEYIDV

SEQ ID NO: 3650 - protein, 533 aa, Neurospora crassa
  unsure (1)..(533): unsure at all Xaa locations
SARSVADIIRSCLGPKAMLKMLLDPMGGIVLTNDGHAILREIEVSHPAAKSMIELSRTQDEEVGDGTTTVIILGREIFGYSCAAYRSLTGGIHKQAGEILAQSLPQLERNIHPVVIISAFKRALKDALQIIEDISLPIDINDDQAMYKLISSSIGTKYVSRWSELMCGLALKAVRTVTWEQGNGKKEVDIKRYARVEKVPGGEIEDSRVLDGVMLNKDITHPKMRRRIENPRIILLDCPLEYKKGESQTNIEITKEEDWNRILEIEEEQVKQMCEHILAFNPDLVITEKGVSGEFDSINGKRVSRRWQESXRXFHSQILAQHYLMKANVTALRRVRKTDNNRIARATGATIVNRVEDLQESDVGTNCGLFEVEKIGDEYFTFLTKCKDPKACTVLLRGPSKDVLNEIERNLQDAMGVARNVMFHPRLSPGGGATEMAVSVRLTQLAKSIEGVQQWPYKAVAEALEVIPRTLVQNAGKSPVRVLTDLRAKHAEGKNSWGINGDTGAIVDMKDYGVWEPEAIKVQSMKTAIEVCL

SEQ ID NO: 3651 - protein, 463 aa, Neurospora crassa
  unsure (1)..(463): unsure at all Xaa locations
SDGEYASDDELKRHGKRTADGRSKQTKASWEDVKRSWDTVLETADSGLSIAEIREAEKRRRLLRDTTPLQRGIIRHLMLVLDMSFAMADKDLLPNRYRVVLNNAIGFVREYFEQNPISQLGIVGMRDGIAVRISDLSGNPAEHIEKLMQWSEQQDPQGNPSLQNALQMCRGALXSALRPTPSVTEVIRXPLHVFVQSNAVTCTREILIIYGALVSIDPGDIHDTINDLVADRIRVSVVGLAGQVAICSELCKRTNNHDGNYSVAVDEVHLKELFFAATTPPVTRTPEQNTASLLMMGFPSRTLAPKDHVSFCACHAKPTREGYTCPRCGIKVCRLPIDCPICKLTLIQSTHLARSYHHLFPLKVFVEVPWSQAYKSTACYSCLTPFPARPRDSVAAAPAVLGGRAGAKGSGKQQDGEQKNPKPELKGVSESGRYACQVCGNHFCIDCDVFAHETIHNCPGCQS

SEQ ID NO: 3652 - protein, 385 aa, Neurospora crassa
NFNGYDHVTWWVGNAKQAASYYNTVFGFKTLAYRGLETGSRYFASYVVGNADVRFVFTSPIRSQKCLPEEEPISDADRKLLQECHEHLEKHGDAVKDVAFEVDNVDGVFHKAVAAGADVVQEPTTLTDKMHGSVRTAVIRTYGDTTHTLISRADYNGPFLPGFRTAAPSSATVQLPSVPLARIDHCVGNQDWNEMVSACAFYEQCLSFHRFWSVDDSQICTEFSALNSIVMASENNLVKMPINEPAPGKKKSQIEEYVVFNSGAGVQHIALLTPDIISTVSAMRARGVEFINVPSTYYDTIRQRLKTEKRGWELKEDLDTIQKLNILIDYDEGGYLLQLFTKPLMDRPTVFIEIIQRNNFEGFGAGNFKSLFEAIEREQAERGNL

SEQ ID NO: 3653 - protein, 1035 aa, Neurospora crassa
  unsure (1)..(1035): unsure at all Xaa locations
GIRNFVVQYILQCSSSEELLKAHRVLLNKLNLVLVSVLKQEWPHNWPTFINEIISASRSSLSICENNMIILRLLSEEVFDYSAEQMTSTKTRNLKTTMCAEFSQIFQLCQEVLNSANQPSLIKATLETLLRFCNWIPLGYIFETPLIETLRTRFLEVPEFRNITLQCLTEIGGLQIGGPTGQQPNYGEALIKMFTEVLTTISNIIPLSMDLKATYPASNSRDQEFIQNLALFLCNFFGMHLPVSSXDLXAHDRSTNMVSSSIENLPNRDFLTHGHYYLIRISQIEDREIFKICLDYWLKLVQELYEEMQALPLSDMNPLLSGGLQTSGAPNPALLNNYPLRKHKYNEILSNLRVVMIEKMVRPEEVLIVENDEGEIVREFVKETDTVQLYKTIRECLVYLTHLDVVDTEQIMTDKLARQVDGSEWSWHNCNVLCWAIGSISLAMNEETEKRFLVTVIKDLLGLTEMKRGKDNKAVVASNIMYIVGQYPRFLKAHWKFLKTVVNKLFEFMHESHEGVQDMACDTFIKIAKSCRRHFVALQPSESQPFIEEIIRDLGKITCDLTPQQVHTFYEACGYMVAAQGNRHQQERLLSELMQIPNMAWQEIIRQASLNPNILQDADTIKVIGNIMKTNVSACSSIGTYFFPQIGNLYSDMLQMYAATSQLISEAVAREGEIATKMPKVRGLRTIKKEILKLIETYVDKAEDLQAVREQMVPPLLDSVLVDYNRNVPGARDAEVLRAMTAMITKLSALMEDQVPIIMENVFECTLDMINKNFSEYPEHRVEFFNLLRAINLHCFPALLKLDNRQFKFVIDSCMWASKHDNRDVETAGLNMCLELVNNIAEKTDVQTSNAFFNQFFVSILQDVFFVLTDQDHKAGFKTQSMLLMRMFYFVHPADGSPSRIQGPIYQPDQAQPGTSNKEFLTMFVGNLLQTAFANLTPXVFFPTFGPCKVPSXPKVQNSAQITSFVEGLFTLNTQYDKFRLALRDFLISLREFAGDNAELYLLEKEQQETAAKAADIERRSKVSGLLKPSELEDD

SEQ ID NO: 3654 - protein, 461 aa, Neurospora crassa
  unsure (1)..(461): unsure at all Xaa locations
FKDYFNQPTSAQIGTMVAILEIGALISSLLVGRIGDIIGRRKTILYGSCIFFVGGALQTMATDMAMMMTGRIIAGLGVGMLSTIVPVYQSEISPPHNRGKLACIEFSGNIIGYTTSVWVDYFCGFLEGNISWRLPLLMQCIMGALLGLGSLIIVESPRXVQPFFQCSASLIANHDVRWLLDNDHDEEGIVVIANLYGGGDIHNPRARDEFREIKMGVLLARQEGERTYSEMFKRYSRRVFIAMSAQALAQLNGINVISYYAPLVFESAGWVGHDAVLMTGFNGITYLLSTIPPWYIVDRWGRRHILLTGAVAMVLSLSAISYFLYLDTHWTPSAVVVMVMIYNAAFGYSWGPIPWLYPPEILPLKIRSKGASLSTATNWAFNFLVGEMTPILQELIHWRLYLIHAFFCAVSFVIGEYLLTATPQGIQLTEFPVYFLYPETCGVRLEDMDALFGDSTNAFGT

SEQ ID NO: 3655 - protein, 863 aa, Neurospora crassa
  unsure (1)..(863): unsure at all Xaa locations
TSSSXNWRLRRKTGERPSSRRKARQQKPIEQARLSVSSVYDSIKRSNSSLARQKKKLLEDSIERVLDLRREEAKKDAVEDSDDAIEAADEAEAAKRNKSAEATATGFLNKQIAKAWGLAAPKLPATTAVSGEGVAVVENGGGEAGAAGEGGSGSVPQTPGLGAAAVAPGSSERQANGEPRGKKRKAEKISKEKEVDRSPPTGISIKDIAGVDDTLDKLLHEVWFPLCAGEACAKMGYRYDNGVLLHGPSGCGKTTLAHAVAGSVGAAFIPVSAPSIVGGTSGESEKNIRDVFDEAIRLAPCLIFIDEIDAIAGKRESANKGMEGRIVAEIMNGMDRIKQQTPLGKNVVVLAATNRPDFLDPAIRRRFSAEIDMGMPNERAREHILKSLSRDLNVADDVNFAELAKLTPGYVGSDLQYVVKAAVSESFRGSLDALLEKARQLRAAAAEAATAAITSDSPEGHEEQQKQIQKELDDTLTGISQKQRDWLLLEDHRQASWSDSCITMAQFRLAVSRVQPASKREGFSTIPDTTWAHVGALDEVRKKLEMSIIGPIKRPELFTKVGIKPAAGILLWGPPGCGKTLVAKAVANESKANFISIKGPELLNKYVGESERAVRQLFARAKSSAPCILFFDEMDALVPKRDDSLSDASARVVNTLLTELDGVGDRSGIYVIGATNRPDIIDEAIRRPGRLGTSIYVGLPSAEDRVDILRTLYRNSIARAKASQTAAAAPPRPTPTTTPAVEGDVMDIDGGSGAVLPGQQTPSATAAAMDETMQEAEKQLERVALDLRCTGFSGADLGNLMQAAAQACLERAYLSQMYQSSKESGTPTEEEKVTDMVANPVITPEDWEKALNEVKPSVKDPEK

SEQ ID NO: 3656 - protein, 655 aa, Neurospora crassa
  unsure (1)..(655): unsure at all Xaa locations
SRIKQFFRINSGSKDHKDRDAHTTSSSHGGAPRADAKTPSGFRQSRFFSVGRLRSTTVVSEGNPLDESMSPTAHANPYFAHQGQPGLRHHNDGSVPPSPPDTPSLKVDGPEGSQQPTAATKEELARKLRRVASAPNAQGLFSKGQGNGDRPATAELSKSRSRRARIPTPSFRRAKAQQRFLHKSGCARCRGLGALPPPIRQSPLAFRRTYSSNSIKVRNVEVGPQSFDKIKLIGKGDVGKVYLVKEKKSGRLYAMKGTSRVCSVQCLTPYXQSNTVLSKKEMIKRNKIKRALAEQEILATSNHPFIVTLYHSFQSEDYLYLCMEYCSGGEFFRALQTRPGKCIPEDDARFYAAEVTAALEYLHLMGFIYRDLKPESTFPLFPPFIMPIISHNXLSIITDILLHQSGHIMLSDFDLSKQSDPGGKPTMIIGKNGTSTSSLPTIDTKSCIANFRTNSFVGTEEYIAPEVIKGSGHTSAVDWWTLGILIYEMLYGTTPFKGKNRNATFANILREDIPFPDHAGAPQISKXVSHTCQRFLLXLLANLESSAFANSLIRKLLIKDENRRLGARAGASDIKTHPFFRTTQWALIRHMKPPIVPNQGRGIDTLNFRNVKESESVDISGSRQMGLKGEPLESGMVTPGENAVDPFEEFNSVTL

SEQ ID NO: 3657 - protein, 284 aa, Neurospora crassa
  unsure (1)..(284): unsure at all Xaa locations
PTASKLSDLFSLKGKVVVITGASGPRGMGIEAARGCAEMGASVAITYASRADGAQKNVAELEKEYGIKAKAYKLNVADYAECEKLVKDVIADFGQIDAFIAKYVDALFPSLCTLFFLXERMLTQRKTAPAPQAKSGVLDGSKEEWDRVIETDLNGTAYCAKAVGPHFKERGRGSFVITSSISGHIANYPQEQTSYNVAKAGCIHMARSLANEWRDFARVNSISPGYIDTGLSDFVDQKTQDLWKSMIPLGRNGDAKELKGAYVYLVSDASSYTTGADILIDGGY

SEQ ID NO: 3658 - protein, 622 aa, Neurospora crassa
  unsure (1)..(622): unsure at all Xaa locations
LLALLLLFSIAYFLHSSSSSSSSPPSAAHAVSEFAWLQHHMNSPFPSQRRNLVSNTSFDWSSIPYKYPPPFPLRVLPLPSGFPISLPPIQHHFGPESRTARHIRESRRQQVKQVFIKNWKSYRERAWKKDALLPISGGYKDQFSGWAATLVDALDTLWIMGLRSEFDEAVAAVAEIDFGVVQEGSGNRVNTFETNIRYLGGLLGAYDLSHRDILLIKAREVGDLLFAGFNTAKRMPVDFIDFERAKEGKEGVGSEETVVSASPGTLTLEMTRLAQVMGDMQYYDAAARVMDVFERGQNRTKIPGLWPVYVSMARQDVVPTSGNQFGVAGGADSLYEYLPKMYALTGGLETRYEDMSRAFLERRIRSLLFRPMVPGNEDVLMIGTADVMINKNGKEEVVLNPESEHLGCFVGGVYGLGGRLFGRPEWVENQGIKITKGCVYAYRAMPTGMMPERYNMVPCPSRDDVSCWWNEDVWKREKKKRLEWKQHLPKGFTTAKDPRYILRPEAIESVFVMWRITGRQEFQEAAWDMFTAVSNATETEFANAAVLDVTKAEYPLPKEDYMEVRVLTLTRYDAVFKRCNSXQWFAELWLAETLKYFYLVFSPPDVISLDDFVLNTEAHPFR

SEQ ID NO: 3659 - protein, 513 aa, Neurospora crassa
  unsure (1)..(513): unsure at all Xaa locations
YVGLDPPEGAKLLGIQYPRAAVLGGCAMHNAGVASLPEDDDWNRIVNLTGDASWEAGKMREYLKKIERNEYADADDPSHGHDGEFSLXQSFVXXDGNXQRTTVGWLAISNSDPSWAKNDSSPAVKIMKRLAELIGQDPSRVADFANTDILGDFPNRDTMSSFFNLATHADKTGKRFSPNNYIRATVADPAKYPLTVKLNTLATKVLFNTTGPKPRAIGVEAMSGPSLYRADPKHIPGTTAPKTQYFARREVILSGGVFNTPQLLKLSGIGPATELSKFGIPVLVDLPGVGERLTDNYEGSLLGLGKVPIASGLITILFRTPNAPTPKRNIFAWCGAFSFEGFWPGFPTYYGPNQYSCAMVHIKPRSQDGSVRLLSADPQDKPEINFRFFEHGGDEDLAELVSAANMLRESWQAAGEPVLPFEELHPCPSSAEKKSNGTTCSDGKQAEYFKTQAYSHHATSSCQIGAEGDKMAVLDSKFRVRGAEGLRVVDASAFPNVPGFFPSVPTMMISVKA

SEQ ID NO: 3660 - protein, 1161 aa, Neurospora crassa
QPKREGFHLNVNDALTPDPGKEGLFKVENNPFAFTPGHLAKLLNPKSLDAFYALGGLEGLEKGLHTNRNTGLSADEKHVDGPIAFKDVAPPGTPQYGQHGDNEPFASGKHDASVPEPLPLDHKAGSNYADRRRVYRENRLPEKKSKTLLQLAWTTYNDKVLILLTIAAVVSLALGLYQTFGGKHEPGEAKVEWVEGVAIMVAIIIVVLVGTINDWQMERQFNQLNKKHNDRTVKVIRSGKSVEISVFDVMVGDVMHLFAGDLIPVDGIFISGHGVKCDESSATGESDLLKKTPADEVFAALKDIADGKPPREDIHKLDPFIISGSKVNEGTGTFLVTAVGVYSSYGQISMAMQTEQEDTPLQQKLNVLADWIAKFGGGAALILFIVLFIKFCVQLPHNHDSPDQKGQTFLRLFITSVTVVVVAVPEGLPLAVTLALAFATTRMMKDNNLVRVLKACETMGNATTVCSDKTGTLTQNKMTVVATTLGKSLSFGGTDKPLEEPDSDKEKINNGANGSEAPNTVPNVPVANFIRELSKTTKKILNQANAVNSTAFEGDEDGEKTFIGSKTEVALLTFCRDHLGAAPVEEERKNADVVQVVPFDSKYKLMATVVRLPNGKYRAYVKGASELLLERCNTVIANPSEDELRTAELTDADRKMFLHTISSYAGQTLRTIGSSYRDFDNWPPPELSGHGELTADEFAKVHHDMTLVAIFGIKDPLRPQVIDAIQDCRRAGVYVRMVTGDNLLTGKAIAKECGIYKPEEGGMAMEGPAFRRLSEDKLKEVVPHLQVLARSSPEDKRILVRTLKELGETVAVTGDGTNDAPALKMADIGFAMGIAGTEVAKEAASIILMDDNFASIVKGISWGRAVNDAVKKFLQVSDVLCVRSEVVANKRRTFQLTVNITAVALTFISAVSNDEEQSVLNAVQLLWVNLIMDTFAALALATDPPSHTVLDRKPDRKSAPLITIRMWKTIIGQAIAQLAITLCLYFGGRSLLGYNMSDPTESKRHSTFVFNTFVWLQIFNELNNRRLDNKLNIFEGITRNYFFWAINAIMIGGQVLIIFVGGEAFKITRLNGKEWGMSIGLGAISIPWGALIRKFPDRWAEAMMPHVHIPIPKILKRKKKEGEDQEKQPVDRPPLPPGRVHTGLRGQRARVHSSRLGRSWS

SEQ ID NO: 3661 - protein, 673 aa, Neurospora crassa
  unsure (1)..(673): unsure at all Xaa locations
NGGLSHNLLAAREAAANQFPTSAGAQYAFYQALLKANMPAIIIERYQSGRFATNEQVDQIYQQALAMSTGQPYTPANNTVDNNGYHPSGFTASQIHAAGTAAAAQHTGGNMAMVKPIAAGAKTGPLHIVVDESFGSSALRWVKFLMWFTLFTYLSMVVITMVFEGLSSIKRPGGKLEASEVKPENQKARFADVHGCDEAKEELQELIDFLRNPEKYSTLGGKLPKGVLLVGPPGTGKTLLARAVAGEAGVPFFNMSGSEFEEVYVGVGAKRVRDLFAAAKAKAPSIVFIDELDAIGGRRNSRDATYVRQTLNQLLTELDGFEQNSGVIIIGATNFPESLDKALTRPGRFDRNVVVSLPDVRGRMAILQHHAKRIKAAADVNLEAIASRTSGLSGAELENIVNQAAIHASKLKAQAVTQKDFEWAKDKVIMGAEKRSMVITAKEKEMTAYHEAGHALVGYYAKDSASSLYKVTILPRGQTLGHTAYLPEMDKHSFTVRDYLGMIDRAMGGKVAEEIVYGNELVTSGVSAVRSPLPLFHLIRRVNXHGIQDLDMATRTAWQMVAQLGMSEKLGPVEYLRKYNQLSSETRAMVESEVKRVLDESYERARNLLTSKRNELDYLAKALVEYETLDKKEVERVIRGEKLKDRISVPPGPMAIPKPSDTLEPGLPLPPLP

SEQ ID NO: 3662 - protein, 505 aa, Neurospora crassa
  unsure (1)..(505): unsure at all Xaa locations
PSNKMEELEFHNIINDTLRSSPTTHTVTDPRTESPLWPCPIASPADFEDAVASAQTAFKTWMLTPLSERQALLTKLATNLEDHLPLLSQILARESGKSLLLSELDVRTSIAQCLHYAQPANALSDHIQYEDETVKIIATHVPLGVVAAICPWNFPLILSNIKVVSSLVTGNCVIVKPSPFTPYAVMKWIELARGILPPGVLQVLNGGADLGQMMTLHPGIAKVSFTGTIAVGKAVMAACAKTLKKVTLELAGNNACIVCADADLPKAVKNVASGAFFNAGQVCVATKRVYVHESVYEEFVRRLVEEVKGTYTVVEDASVPSVFGPVSNKVQFETVKRIVEDCRGKGYEIVAGGEVRESGNAEGNKGFWLEPTIVKGPPDDSVLVKEEQFGKSHLFSCRVXCVVVXTLTSYALLQGPILPVMSWSDEDDVISRSNLANAGLGASVYSSDLAQAERIARRLEAGGVWINKSERPHMGAYFSGFKDSGFGGEMGKQGLLSYSYTQSIH

SEQ ID NO: 3663 - protein, 159 aa, Neurospora crassa
  unsure (1)..(159): unsure at all Xaa locations
DGKLVTIELWDFPGNIANERTTQLASNFFQAAIICYSVEDVKNIPSICDRYVCTMVFGMKPLRXLTQCLLQWKPKLDRSLIDCPRFLLGLKKDLRPAFPPLGLSFLPRKEPVMADMGRSAAYHSRVAGYGECSAKTGENVDDAFRGIVNFTLSHMRKKE

SEQ ID NO: 3664 - protein, 746 aa, Neurospora crassa
LAELLRHPDDLDKITTLKAEFMRKKAAVDSQLRSGLREQLETTQAGMNGLADGQRTVQQIKEEMMKIDKICSESQDMITDFATINLVSQAHRNFGAVETMRRNLETFSERLDAIDRMLNEDDEDPENMPNLLAIHYELTQLRNIRDDAIEQIQRGDDPGLQSTLEDYFSRLDKYIEWFDVNITLVAMSLINLVIADNNSLVVRFALIIEAEEKSDQRVLALQEALKDHKEMATRFQSITDGAKTVRGYKDKFLKAIKTFAEDQFKESKEKFLGDPDMLDKSLKWYFNDLNAVKIGMTPLMPKKWKIFKTWATIYHGLMHDYLIGLIDDPETSSAHTLAIISWPEAYYRKMTKLGMKQDELTPHVIDNREAELVRDFRALIIKFLDEWIDRIYKQECKDFVDRNVEGGNLDQDEYGYFRTKNLVDLWRMLREQVDAAGNSKRADVVEGVIDTMFQRLRTRQQSWQKMLEDEAARYEVQPPQGQPELDGFQPLQDWLVATANDQIACIDDNEDEGRMAYLSDFRRKFSTLVSPQYMDRAETEITALRDGYVDLSTWCMTKFAQLVFAVDFRTVMPDFFTPRWYTTNAMARMIATFEEYVSDYKMVLHHSLVDIFIEIFAEELLIRYLSSVRNKGAKFRRQDNFQDKIFDDLSTAFDFFNNLPNPDVGDAIKETWRVSEPFLQLLTVDKEAVPDAFAEFKSQYWDLQISWVEAVLRSRDDFERSMLNAVKARAAQMDVVRGPETIMSKV

SEQ ID NO: 3665 - protein, 493 aa, Neurospora crassa
  unsure (1)..(493): unsure at all Xaa locations
MAPISRETDFLVIGGGSGGIATARAAAGKYGIKSMVVEGKRLGGTCVNVGXVAFQFCLCVCLARKVKLXLPLFLLXCVPKKVTFYAALVAETIHQAKDYGFSVEQTAPFDWPTFKQKRDAYVARLNGIYERNLANDKVEYVHGWAKLLSPNSVEVTLDDGTKSVVNAKKILIAVGGNPTIPPHIPGSEYGTNSDGFFDIDTLPKKVALVGAGYIAVEFAGMLNALGVETHLFIRHDTFLRSFDPMIQQVSVKEYERIGVKVHKKSQLTSVQKDAAGKLAINFKEGEGEQSISDVDHLIWAVGRTPAVEGLGLDKAGVKTNEKGYIEVDEYQNTSTENIYAVGDVCGQVELTPVAIAAGRKLAARLFGPEEFRTLKLNYDNVPSVVFAHPEIGSIGLTEPEAVAKYGAENLKIYKSSFTAMYYAMMKPEDKAPTAYKLICAGPEEKVVGLHIIGLGSGEILQGFGVAVNMGATKADFDNCVAIHPTSAEELVTL

SEQ ID NO: 3666 - protein, 253 aa, Neurospora crassa
KTSVTSRLNLPGRIGWLTMEAPGFMTLVYMMRTLPAQHGFTLSDLPWQNKVLAGLFVFHYSYRALAFPFLQPSMAPIHIAIWLSALSFQIINGTLIGAWLAAYGPTSHAAWDRQLFSSFPTLQFTCGIALFYVGLMANFYHDDELREIRRRENRRQERLAKQNGQKGQPGKKVGKHYEIPKAGLFKVMLYPHYFCEWVEWLGFYMAAGWGCLPARCFLLNEVAAMLPRAVKGKQWYMEKFGEEKISKKWAVIP

SEQ ID NO: 3667 - protein, 279 aa, Neurospora crassa
  unsure (1)..(279): unsure at all Xaa locations
GIGRASAHQFAQNGAKAVYICDYDDSNLEEHKREIETLYSSANVHTRQFDAADEKAISEVVKDALDRYGRLDVFFANAGILGPHTKFSDVEADEFMETMRVNALGXDALVFFPSELPFLVWLISXSIANHAYHQSPFLAAKYAAPAMQKTSAEKQKSSGSIIMTASVAGLRSNAGGTPYSASKAAVVSMAQTIAYQLVGTNIRVNALCPGLIETAMTAPVFDSARARGTEGKIGQLNPLRRGGHADEIARVALFLGSDESSYVNAQAWAVDGGLSSGHP

SEQ ID NO: 3668 - protein, 1071 aa, Neurospora crassa
  unsure (1)..(1071): unsure at all Xaa locations
MLAGYNCTIFAYGQTGTGKTYTMSGDMNQTFGMLPDTAGIIPRVLHALFNKLEVDDKEHCVRCSFIELYNEELRDLLSAEDNTKLKIFDDNSKKGHATTIVQGMEERHILSAADGLRWLQEGSVRRQVAATKCNDLSSRSHTVFTITVHVKQQTENGEDYLMGGKLNLVDLAGSENIQRSGAENKRAAEAGLINKSLLTLGRVINALVDRSPHIPYRESKLTRLLQDSLGGRTKTCIIATISPARSNMEETISTLDYAFRAKNIRNKPQINALLNKKTLLREFATEIEKLKSELIATRQRNGVYLSNDAYEELTVQNESRRILTEEQAARIETLETNLRNKLQELYTMTSTFMGLRKEHEATKAQLDETKDVLDQTELVLAATRKSLAEEAHLRRAHQTTEQKLAKVGDELISTVKRTVQDVEGLHAKNRRRSDLHALNRSTWAMSQSQVTGITELVESRIAEFRKGQEEHISSVSERMQSFVQEELDKLSTTQAFLDQNLEHFAESRTQLLEQKQKSKEEMDNVLEEIKVVRDTVKQRVGESLQAIASAAERIAGDVLGELTTFHSQLHASYSSLGKECKSIFGDLLQTISAQKAEAERLRQELEGASQTIVESNATVSARIQEVLEEERRQAAEERQNLLLQIGSLINSQAEMQESRLAGKTALIRQAVMDSNATFEGSMSEYMDGMNAWNEKDSRLMEDVVKSRDVLKNKMKDDWAVSYLSCFSIGRLIYXXKPQTADEHSNSIQNTTKSVHAETVRVVDAQLKDLDTQMQDLDQFVSRARSENSVHHEQHVVSMENLTSTVEKSFINIADHFGERFDRIRDLSGEMDNDAKILRESLEPLDESLRQPLAALREDIQSTKIREYEPTGDTPEKKRYEYPTDLPRTAGHETLIAGMQDKPSTTPTTSPAKRATMTAVYSDIVVSPSRSPSKVPLSVPVSPRNNPFGTPGPATSTRNKSHPMDPSLREVNPNLGGGTSVFGELSSSTMSMAPPSTSVIGFHANNTDHTEESATQVPLFRRSNRRQSPRVLAKKKITGHAGGIITEGLENMPVTTDASVGIAGNRRKTPRL

SEQ ID NO: 3669 - protein, 600 aa, Neurospora crassa
EAATEEKPPKKQKKQKEDRKKQEEEEKKKKKKDEDKKQIYPQPLNSFGELKYTYGIHPVLADNITRQGFRVPTEVQMGSLPLQLRPEMALEKATDVEDVKVEKGIDFLGVAPTGSGKTISFLIPAIDAIIKRRAEDYTPETDEHVLQAIVVAPTRELASQIVNEGRKLAIGTGVRVVLMKRTLRLVAESNEQEETEQEAKEEVQDSDSDSEAESEPEEVMKIDEEEEEEEESDSDAEKKTESRAKGDQKFKKERPITRVDILVTTPKILLNFLCGGEKEKGKPRIIKKTLPTVQSLILDEADVLLDPIFRKQTMGIWRACTHPNLGMTCWSATMASNIEALLTKHIDKRAKRTPEQTPKPLIRLVVGLKDTAVPNITHKLIYTATEPGKLLALRQLLHPVSSADSGPPLRPPFLVFTQTIERAQALHDELKYDIPLEAGGSARVAVLHSSLPDSVRSKIMARFRSGEVWVLITTDVLARGVDFAGVNGVVNYDVPVSAAAYVHRAGRTGRAGREGGVAVTFYTKDDIPFVKSVANVIAMSEKQAGKDIDEKDTVKAAQGSVQKWLLDALPKVAKEDKRKLKVRGVESRRTGGKATITTKS

SEQ ID NO: 3670 - protein, 793 aa, Neurospora crassa
  unsure (1)..(793): unsure at all Xaa locations
HSKREKHTKFGEYILGNTIGEGEFGKVKLGWKQEGGVQVRRTNVLPAHKYAAYXLTYDQVAIKLIKKDTVGNNPSRMAKIMREVAILKQLTHPNIVRLHKMEESDRHYGIVLEYASGGELFDYILNHRYLKDNAARRLFAQLVSGVGYLHKKGIVHRDLKLENLLLDRNRNIIITDFGFANTFDPNQELSEEEELNLSDREFVKRMGLDKVNDAGWRKGDLMQTSCGSPCYAAPELVVSDSLYTGRKVDVWSCGVILVSXPPRPAAXTIANVSSVAMLAGYLPFDDDPANPEGDNINLLYKYIVNTPLTFPEYVTPHARDLLRRILVPNPRKRADLFEVARHSWLSEYSHVVEFITSSTTTPSEIQNTTVPAEDEGESPHLARSASVREAPKKSTASPAIGGLVSKQGTVDPEAEAAYAKQQRDNKRRTVQVEYVAPNTTTQRGDIAGQQQPSSNANRNRNESQAPVESSDSRPTTSAKDKQLSQGPSAPKDAYNNKPPVSSRRPPSSQRNGGNAPTTGNAVAPPRPSRDGRPTADNQYLSGAAGAPTQRPTTGGSMQSGRPSYAQPAPPEVADANVHGRIQQPSKGSGSSHFGVPTTTPAEQQPSESADYGRPSISTGSRFDKVREDGVVKGHKRSSTMGEIGGKLFGRSGSLFGGRKSKRQQELQQAGEKTKRYPPVSMNNSMPGGENGSRPSLDSKRSRRSFSMGMGKKSSGGSITGSNGSQEKSNKRFSFIPPSLSRAFGYNKEDEPPALDSQQDLPIQEPSSVDQFLGREQNVSATTVDGMYTQLQDS

SEQ ID NO: 3671 - protein, 480 aa, Neurospora crassa
LGWLVGTQYPRGEISPDSTLPLAKTTPPRHDTGKANLEAAWADFVKIVGQENVSTADYDLEEHSNSDWSSHQSDASTRPFCIVYPSSTEEVSEIMKVCHSRAIPVVGYSGGTSLEGHFTPTRGGICVDFRRMNKVLALHKEDLDVVVQPAVGWQDLNEDLAKDNLFFPPDPGPGAQIGGMIGTGCSGTNAYRYGTMREWVLSLTVVLADGTVIKTRQRPRKSSAGYDLTKLFIGSEGTLGLVTEATLKLTVKPASESVAVASFKSIREAASCVASVVANGVPVAAVEILDDDQMRIINQAGVTTRRWKEAPTIFFKFSGTPSGVKEQVAIVQGLSKQTGGQSFEFARNNDEQAELWSARKEALWSTFSIKKPGDHLWTGDVAVPMSRLPDIIDLTKDDLKKSGLKSSIVGHVGDGNFHILLLYSDAERKLAEDCVHRMVKRAVEMEGTVTGEHGVGLVKRDYLPHELGESTVDTMRKVSL

SEQ ID NO: 3672 - protein, 1336 aa, Neurospora crassa
  unsure (1)..(1336): unsure at all Xaa locations
MSKLEKMSILGVRSFGPRHPEAIAFNTPLTLIVGYNGSGKTTIIECLKYATTGELPPNSKSGAFIHDPNVSATVDCPWLYEDSGXTVTCCSLVGEKDVQAQIKLSFRSTVGESFVVTRNVQLAVTKTSSKQKTLEGSLLLRANGDRQVLSTRVVDLNKLVPEKLGVSPAVLDAVIFCHQDESLWPMSPGADLKKRFDEIFEAKKYAKVIDNIKLLRKTKGEELRLLRMQEAQDKENKERADKVDRELSKLIRELQEDRDKCNELQKQIEDEDVRIKQKWEQANSFLKIVNELQTKQEKLEYKKDAIAELRERIEESTESDEYLRDVLSQYEQTVKRMNSDRDQKVAQFGTLQTELKTARAKHTAKVEEQGKHQSDKEKYDRQLVSQRQMIQEAAEKHEIRGYDGDLDDQEINAFYERIQKMLQDTKRDLERLQRDNAAELDAKSATITELESHKASRIRDRKISSQRVATLQRDITKLQGELNNLDVDEGAEAVLQTEMEGLESKIKAAKADNRVSELDSQITKLNNEVLTLEAQGAQLSRELVECTNLASERAQLELRKKQLTERKRELDILKNTFNQQLTDVVGRNWTPETIESDFQKALRQLSDRLSELRKTKDSTQQELKQVEYKLTTAREQQIKSVKERDSCKKDVLEALKKVPRQNKPVTESVDDYPDAVKEIEKLLKDTDTDLELNMYLKEYFLKAKVKAEEKHKCYLCEQSLGDEKTMKRLMKRIQDKIDDKDRDELLEDQALYGRHLGTLRSVRTKHETYGRLCKELPSMVEEINSLTLQKERLVRQLEDQDGAFKIAEEKRNAADVLSKSVLKIAQTVKDIADSERHIERAQQNSSNQVRSADEINDDQTTCAEQLRIAQAKLSKSTAERQRLKDLAAQLEVEKLELKHKITEAVQKLEHKKRLQDTIKNHRDEQSELRKNMQDIDKEVEGIDPEIASARAALEESRKQGRAREQRIAEERDGIATTVSELKIINREIQDYLDRGGPANLASNQRTIASLESTIAALEKEMKDVTIQINKLNKEIDNSDAKRRNIADNLTYRKNLRERDALEEEIEELESRNAQEDYDRLVEEAHSFELYRGKLNAERQRLMGSMSTKDEQFRRLEEEYEIELKGARARYKESHIKVETTKAAIEDLAQGNMALDHAIMQYHSLKMEEINRTIADLWQSTYQGTDIDTIQIRSYMESTASGATNTRRVYNYRVSMIKGDTEMDMRGRCSAGQKVLACIIIRLALAESFGANCGMIALDEPTTNLDSDNIRSLAESLHAIIKARRSQNNFQLIVITHDEEFLKHMQCSDFCDSFFRVKRDENQNSVITRESITRISE

SEQ ID NO: 3673 - protein, 232 aa, Neurospora crassa
  unsure (1)..(232): unsure at all Xaa locations
GESAVGKSSIVLRFVKVRPAPTRRLMGLKRATDLHPGQFDSYRESTIGAAFLTQTIALDENTTVKFEIWDTAGQERYKSLAPMYYRNANCAVVVYDITQAVCGLSRGPCLCPRDMSXRNPLLGILDKAKSWVKELQRQANENIIIALAGNKLDLVQEQPDKRAIQTADAQAYAKEAGLLFFETSAKTAENVQNLFTEIAKKLPLDQVGPRHARPGQRPGVSLAPEGANPRSE

SEQ ID NO: 3674 - protein, 571 aa, Neurospora crassa
HSPLSGLTTRAKLFSAKPTTNIHHFIFRPPLRTCHTTPCKMASSQRTYDDALSRLAQLQSNRTIVNLFGSDDSNNDSQSKKPAAKKDLNSLAIPEMLSWLARAGYTPSSLAATGLKCVHVAGTKGKGSVSALVSSIISQYPPPPSFHDDGGGGGAHIIQKPVVVGTYTSPHVLSVRERIQLDNVPVSREKFALYFFEVWDRLSAAARAARDPVQSEAEYDGPGTKPFYFRFLTILAFHIFVREGVKQAVIECGIGGEYDSTNFLSPQCVTASVVTQLGIDHVAMLGNTLEKIAWNKSGIFRKGVKGFTRRLDGETQKGVMEVLRNRAQEKEVERLVEVEDEQVEKWKGVEGAKLEGPFQKFNMALAVAAAREHLTRVGHKFAGAFGEEGWKLDDIPAEFEKGLKEASLKGRCESFRDPKGTEWFVDGAHTEDSLAGVGQWFSGKVKEGDVNVLVFNQQDRDPEVLLRALLAAAQKQSGTTTPVFTYAVLTRNEEKAPVEGEPERDLAVQLQGQKIIQEASAETETSVYNAVEPAMEQVQKIAEQARKDGKTCNVLVTGSFHLLGGVLKTVE

SEQ ID NO: 3675 - protein, 565 aa, Neurospora crassa
  unsure (1)..(565): unsure at all Xaa locations
MHHVLRPIAFRLALVSPLRSLTITHHHLFFTKRTMASSARTYNVSQPTFYRSTEPQTLTHHIVDAIDALNSLQTPFAVIEARRKAGIRPDAHSVKEMRAYLARIGYSSQDLDRLNIVHVAGTKGKGGTCAFVDSILTRHQRTHGIPRRIGLFTSPHLIAVRERIRIDSKPISEELFARYFFEVWDRLETSQLAKDEVELGSKPIYARYLTLMSYHVYLSEGVDVAIYETGIGGEYDATNVVDRPVVSGISTLGIDHVFVLGDTVDKIAWHKAGIMKTGSPAFTIEQVPSATQVLKDRAVEKGVDLKILDVDPRLNGVKIRPDAVFQKKNATLAIALAETALKKLDPSFKPGTDSLSPEFVQGLEQVVWRGRCEVKEEDQAVWHLDGAHTVDSLKVAGRWFVEECVKKAKGGPKVLIFNQQGRSEAVDFLDGLCNTVKSADPEGTGFSHVIFCTNVTYATTGYKKRYVVLGLSMICSSXPSIDFVNHQYNPKDIENMTQQRVFAERWSTLDPSANVMLIPTIEEAINKARSLVDTTEGEQKVQALITGSLHLVGGALGILEKADAL

SEQ ID NO: 3676 - protein, 344 aa, Neurospora crassa
NLSFVLNKPLDVCFQDKPVPKINSPHDVLVAVNYTGICGSDVHYWLHGAIGHFVVKDPMVLGHESAGTIVAVGDAVKTLSVGDRVALEPGYPCRRCVHCLSGHYNLCPEMRFAATPPYDGTLTGFWTAPADFCYKLPETVSLQEGALIEPLAVAVHITKQAKIQPGQTVVVMGAGPVGLLCAAVAKAYGASKVVSVDIVPSKLEFAKSFAATHTYLSQRVSPEENARNIIAAADLGEGADAVIDASGAEPSIQAALHVVRQGGHYVQGGMGKDNITFPIMALCIKEVTASGSFRYGSGDYRLAIQLVEQGKVDVKKLVNGVVPFKNAEEAFKKVKEGEVIKILI

SEQ ID NO: 3677 - protein, 270 aa, Neurospora crassa
  unsure (1)..(270): unsure at all Xaa locations
LCTFSASGLGRACVRDIVKSGGNAAVLDMNEETGAALAKELGSSIRFFQCDVTDTESIASVVESTLEWIKETGKPLGGIIPAAGVGSPGLVSIPANVSALDXSNTHQMLDKSLNPLSLSSIDFVLSINLRGVLDLVRQFLPALASSPAYGPDGEHGVVIMVASSAAFDGQMGQVSYAASKGAVAAMTLPMARDLSRFGIRVVTIAPSMFDSAMTAMMSDKVRTGLKKAMEFPSRAGQPEEFASLARQAIENVMLNGVVIRLDGATRMPSK

SEQ ID NO: 3678 - protein, 806 aa, Neurospora crassa
  unsure (1)..(806): unsure at all Xaa locations
VRAVSFPAANVVLSASRDHTVRLWRKATSQSPFDDTIVSQGHGYINSLTFIPPTGEYPDGLVVSGGAEPIIEVKKPNATPDINAERLLVGHGHNVCTLDVSPDGKWLVSGSWDGKAIVWNTATWEMAHVLVHNMDNRGVWTVLAYDADTIITGSADNNVRVFRLKGATGLEIEASRTLSTGDVVRALCKLPSGLKGHPSGADFASAGNDNVIRLWKLSGKEVGKLQGHDSFIYSLAALPTGEIVSSGEDRTLRIWRGSECIQTITHPAISVWTVAVCPENGDIVSGASDNMVRVFTRSADRTADTQTIAQFEESVRSSAIPQQQVGSNINKEKLDTKDWMQTNSGTKDGQIKMIREEDGTIGAYQWSMGECNXPALSLXIKLTCYAGQQQWIHVGTVVDSAGSSGKKVSYNGQEYDYVFDVDIEDGKPPLKLPYNLSQNPYDAATKFLGDNELPISYLDNVANFITQNTQGATLGQANEAPSSDPYGTDSRYIPGQDSQPAKPKYLPHTEFLSLTSGKLEPALARLKTLNTKHIQAGNKHIAMNPDNVEILEELVKQLLQPASAAGKLANLDASKPILLTLVTQWPYADRLPALDILRCLAAWPAAASITDDRYGDIIDIAVRGALDVEDTVTADGSLSDFIANKLDATKANANSVMMALRTILNLFKLDDGRKLVASKAGVILSFMGHIVGLDGDKGVIGAENNNFQIALTSAAFNFACLFYRDRKLDANLDEIALLIMIVEATVRKQKDPEVLFRALMALGMVLSIGPQPVAEAKKQGVDAWLTPVIGQTREQRLKDVIQECLS

SEQ ID NO: 3679 - protein, 247 aa, Neurospora crassa
  unsure (1)..(247): unsure at all Xaa locations
CGITTCPTGQTCCNASCGLCVSPGMACTQQLCEPAGVQCGPNVCSGDTPVCCNKSCGICTAPRGFCTQQFCERGFTPSESKRNEEADKIKLGNQKCGKATCPEGTSCCNSSCGICVKPGGACTQQFCEHGFISGESKRNEEADEIKLGNQKCGKATCPEGMSCCNSSCGICVKPGGVCTQQFCEHGFISGESKREEETEEIKSGNETCGKVTCPEGTSCCNASCGICVKPGDGCTKQFCTXCGCSDC

SEQ ID NO: 3680 - protein, 488 aa, Neurospora crassa
GMIGTGSMGGMMSLLFAEYGIHTHYYDPSKKNIEALQSHAKESKHEDKITYHDDHKSLCEALEDGDKPKVFMFSIPHGGPADDSIDALEPYLKPGDIIMDASNEHWKATERRQARLEPKGIHYIGMGVSGGYQSARHGPSISPGGSKEALDKVFPFLQKIAAKDNRGRPCVAKLGPGGCGHYVKMIHNGIEHGMMTALCEAWAIMNIGLGMDYEEIGTIFEKWNGDKQRPLRDNFLIDIGADICRTKDEKGNYVLANVRDKVVQDVDNSEGTGTWSVQEGTRLHVPDPTIAVSHLFRVASADAARRETVNKALDGKGVKPAQIEGVDKAKFLEDLYNAVYASFLMCFIQGLHVLSKANEENDWKLDFADVLQLWRNGCIIQSDGVADLLETVYRSREHDNDDLLGHQTIAGELAKTYPSLKRVVLKAIEFDLHAGALGTSLEYYKYSGSTELPTQFQEAELDYFGAHMFDLKTAEPGKPVTGKHHFEW

SEQ ID NO: 3681 - protein, 880 aa, Neurospora crassa
  unsure (1)..(880): unsure at all Xaa locations
QSNSPYAEVRAVVDNTDDPSTPCSTIRSWTIGILFSVILAFVNQVGANFLFRDPACFSWLTIIALFSVRQPSISIESNVAQLLAFPLGKAWEMWMPYYEFTLFGTKHNLNPGRFSKKEHMLIAIMANTAKSLPYTQYIVWTQVLPQYFNQPYANSFAYQILIALSTNFIGYGLAGEXXSSLCEMPKGSGDXQYKIGITRRFIVYPSYCVWPASLVTIALNSALHHEENHIVPGPFKKLYRMSRFKFFMWAFGAMFVYFWFPNYLFEALTFFSWMQWIAPNVRQTHLLLWREVNLTLAEFESEHSHWIPKRHWRECSLPISAMNTVAVSXYXLCVDVQPLPHIXLERFAFRLRRSSRESSCFHSSELYYTNQCQMVPAFTTFNKTFGMAFFGFIILGIWYTNVWNTGHLPINSNRVFDHYGSLYNVSRAIDEKGMFDEAKYMDYSAAYLSAANAIVYFAFFAIYAATISHIILFHRAEIAIGFRNIWKTVKPKRWTKRNAAGESVEEEDVGYKDVHNRLMAVYPEGENPFLKRGREKVTDENPKQFRNCWYLGCLVIAMALGFAGVAAWPTYTTAGVVPYGLFLAIIFVIPIGIIKAMTGIEVTLNVLAEFIGGAWVEGNALAMNFFKSFGKSCPSIPSLSGLKLTHHRYVTCAHAISFANDLKLAHYIKIPPRHTFTAQMVATLISTFICTGVLNFQVNIENICQTNAPMRFFCPGINTFFTAAVLWGTIGPVKVFGIHGQYKWLLLGFPIGLCIPVIFWLIIRKFPRNKFIRQFHPVALFYGALNWAPYSMSYCWPAVPIAWLSWIYVRNRYLAFWSKYNFVLSAAFSAGIALSGIVMLFSVQWARVSVEWWGNTQPYKGCEDTACTIKTLSEGERFFP

SEQ ID NO: 3682 - protein, 474 aa, Neurospora crassa
  unsure (1)..(474): unsure at all Xaa locations
MSLSNKLSIEDVDLKGKRVLIRVSFFXRXLAPDVAVXFIXVDGWVTRQKFXHATLLXVDFNVPLDAEKKVTNPQRIAGAIPTIKYALDHGAKAVVLMSHLGRPDGKPNPKYSLKPVVPELEKLLGKKVTFAPDCVGPEVEEIVNKADNGEVILLENLRFHIEEEGKGTDAEGNKVKADKAKVEEFRKNLTKLGDVYISEFSSPLGFKIGHSSXHHIPQDDAFGTAHRAHSSMVGIDLPVKAAGFLMKKELQYFAKVLESPQRPFLSILGGAKVSDKIQLIDNLLDKVNTLIVCGGMAFTFKKTLQNMPIGNSLFDEAGAKIVPDLVKKAEKNNVKLVLPVDFTIADKFDKDANTGYATDKDGIPDGWMGLDCGEESVKLFTQAINESQTILWNGPAGVFEFDKFAKGTKATLDACVKAAEEGRTVIIGGGDTATVAAKYGVEDKLSHVSTGGGASLELLEGKALPGVVALSERQ

SEQ ID NO: 3683 - protein, 447 aa, Neurospora crassa
MSAPAHKFKVADLSLAAFGRKEIELAENEMPGLMATRKKYAADQPLKGARIAGCLHMTIQTAVLIETLTALGAEVTWSSCNIFSTQDHAAAAIAAAGVPVFAWKGETEEEYQWCLEQQLIAFKDNKKLNLILDDGGDLTHLVHTKYPEMLEDCFGVSEETTTGVHHLYRMLKEGKLLVPAINVNDSVTKSKFDNLYGCRESLVDGIKRATDVMIAGKIAVVAGFGDVGKGCAMALSGMGARVIVTEVDPINALQAAMAGYQVTTMEKAAPLGQIFVTTTGCRDILVGKHFEVMPNDAIVCNIGHFDVEIDVAWLKANAASVQNIKPQVDRFLMKNGRHIILLAEGRLVNLGCATGHSSFVMSCSFTNQVLAQIMLYKANDEAFSNKYVEFGKSGKLEKKVYVLPKILDEEVARLHLDHCNVELTQLSDVQAEYLGLATEGPYKSDQY

SEQ ID NO: 3684 - protein, 685 aa, Neurospora crassa
  unsure (1)..(685): unsure at all Xaa locations
LSTREANLFRTVIRHYEDKQYKRGLKAAEQILKKNPRHGDTMSMKALIMNSQGKTEEAFALAKEALTVDMKSHICWHVYGILYRQHKNFDEAIKAYKFALKLEPESQQIQRDLAVLQVQIRDYQGYVQSRFAMLKAKPHLRQNWTALAIAYQLEGSLEQAENILTTYEKSMTNVPLKTDQEHSEALLYKNTIIAERGDIKRALEHLESDCKNCLDRLAVMEMRARYLGQLNRKEEAAKAWRALLDRNPEHPEYYKGLIEALEIDEKDEAALKAIYDEYAAKYPRSDAAKRLPLNFLTGDSFKAAAKSYLTNMLDRGVPSVFANLKHLYSEVAKKEAILALAEEYLKEHKGSEQANGDSSKGVGAALYFLAQHYNYHLSRDLAKAMEYVEQAIELDPKNVDFHMTKARIFKHQGDTAKASETMDRARSLDTKDRYINSKAAKYQLRNNENEKALETMGLFTRAETVGGPLADLTDMQCMWFLTEDGEAWQRRGNTGLALKRFTTIHNIFDIWQEDQFDFHSFSLRKGQIRAYVDMIRWEDSIREHPFYFRAALDAVKLYLDMFEKQQASANGTNGTGEATNGEDAAEKKKAAKKARKEAQKAEREAAEKAAKQDPNKATAKKDEEPKKKDDDPNGLKLAATTDPLGDAMKFLTNILQFSPKNIEGQVAGFDVYIRRSRFXMQPLYL

SEQ ID NO: 3685 - protein, 364 aa, Neurospora crassa
  unsure (1)..(364): unsure at all Xaa locations
KXADEIIRNDPEANHEYLPIAGLASLTSKAAELVVGASAPAITEGRVASIQTISGTGACHLGGLFLSRFYNPYGDASKKPTVYLSNPTWANHNQIFSNVGLPIAQYPYFDQKTKGLDIDGMKKALSDAPERSIILLHACAHNPTGVDPTLAQWREIAEIMAAKGHFPFFDTAYQGFASGDLDRDASAIRLFVELGFELVVAQSFAKNFGLYGQRAGCFHFISAPSPDAASITTRVASQLTLLQRSEISNPPIYGAKVASIVLNDPALFAEWKENLRTMSGRIIDMRKALRAKLEELGTPGPWNHITDQIGMFSFTGLNEKQVAKLREEFHIYMTKNGRISMAGLNKKNVDYVARAVDKVVREVQ

SEQ ID NO: 3686 - protein, 287 aa, Neurospora crassa
  unsure (1)..(287): unsure at all Xaa locations
LAGQVVIITGAAQGIGAECARLFANEGAKVVVSDIDAAKAQATVNRIDASGGKAISVPGDLLKDDYIEKLVKKAAEFGNGKIHIIVNNAGFTWDAVVHKVVQYLXSGKRCCXCXHRNRMTDKQWETIIALHGTAAFKLIREAAPFFRVKDGEPRNIINISSTSGLHGNAGQLNYAMAKAGVVGLSKTIAKEWGPAFGVRANTIAFGHIETRLTANKEAGAFVEVDGQKVALGIPQKQNAQKAGGPVPFADIPLRRPGSATEAASAVLAIASPLSSYISGQTISVTGG

SEQ ID NO: 3687 - protein, 1065 aa, Neurospora crassa
  unsure (1)..(1065): unsure at all Xaa locations
NGLSTNQVPKLQEQYGENELDVGNTIAWYTIFIRQLCNAMVLVRTPFPKPPMTGELNADIWTXILGLIFAMALSFGVKDWVEAGVLAAVIILNVGIGFWQEYRAEKKMDALRALSSPSASVLRDGKTSVIPKXVAKISADRRTERPADSXPYHSAQVVPGDIILLKMGDTVPADLRIFEAMNLTCDESSLTGEAEPVEKITTNDIVVPGTEKPALSEGDLGIGDRINIAYATTIVRKGRGRGIVIATGMKTEVGKIAASTNKKQRKAGRSMSTKHGHLQPVKGAGLRTWDFIGKFLGLTEGTPLQIKLSKLAYILFFCAIFLAIIVFAVNKFNIPTEVILYAISTGIAIIPESLVAVLTMTMVVATAVMRKANVVVRDLSALEALGGVTNICSDKTGTLTQGAMIVKKAWLPPSSVYTVRDSTNPNNPTEGKVTFSPDDTKAKKEEKERDYDQERTTQAIKFDVPEGEKEKPMQPKASEMDAEVTPDLRLFLHATALCNLATVRYDEEAEGWKTTGEPTEIAIQVFAHRFDHGKKSIEGKGWKQVAEFPFDSSIKRMSVVYNAPKDNELGYSPENSIVFTKGAVERVLDLCSHIGTGDAQQPMSEEVRDRILDQMTDFASQGQRVLAVAYKPWDGEYSAPDEAHKGDDSVRAQVEDNLVLLGLVGIYDPPRRETTGSISTCAEAGIKVHMLTGDHPETAKAIAREIGIIPRNLGVLPAGVAESAVMKATDFDKLSDEEIDNLQELPLVIARCAPETKTKMIEALRRRGAFMAMTGDGVNDAPSLSRADVGIAMGSGSDVAKSAAKIVLTDDKFNSIVAAIQEGRRMFENIQKFILHLLSSNVGEVILLIAGLGFRDQDGFSVFPISPLAILWINMVTSSFPAFGLSKEPASREVMRKPPHDRKRGVFSNQILWDMIVYGILMGTCTLMTFIIVVYGKYGGDLGKDCNRGYNDTCIPVFRARAAVFALLTWLILLSAWEFKSIRRSMFRLDPDNHKKFAVFHDLWSNKFLFWAVLIGLVSVFPTVYIPGLNRNVFKHTDISWEWGVIIGMSIVYVVGIECWKAVKR

SEQ ID NO: 3688 - protein, 638 aa, Neurospora crassa
  unsure (1)..(638): unsure at all Xaa locations
DHEYDAIVVGAGGAGLRAAFGLAEAGFNTACISKLFPTRSHTVAAQGGINAALGNMHEDDWRWHMYDTVKGSDWLGDQDAIHYMTREAPASIVELENYGCPFSRTEDGKMXVSNPGNRAVRSARGXLLTVYTLYSYQRAFGGQSKEFGKGGQAYRCCAAADRTGHALLHTLYGQSLRHNTNYFIEYFAVDLIMQDGECRGVLAYNQEDGTLHRFLANNTVLATGGYGRAYFSCTSAHTCTGDGSAMVARAGLPNQDLEFVQFHPTGIYGAGCLITEGARGEGGYLLNSEGERFMERYAPTAKDLASRDVVSRSMTMEIREGRGVGPEKDHIYLQLSHLPAEILAERLPGISETAGIFAGVDVRKQPIPVLPTVHYNMGGIPTRYTGEVLTVDEQGNDKVVPGLFACGEAASVSVHGANRLGANSLLDLVVFGRAVSHTIRDKFTPGSKLKPIEADAGSESIEVLDKIRTSDGPKSTAEIRLAMQKTMQRDVSVFRTQESLDEGVEKITQVDQMFDQVGIKDRSMIWNSDLVETLELRNLLTCAXVALAMILRKRIGEYILTKLRIQTQTAVSAANRKESRGAHAREDYPERDDKNWMKHTLSWQKQPHGKIELGYRRVIDTTLDEKECPPVPPFKRVY

SEQ ID NO: 3689 - protein, 261 aa, Neurospora crassa
  unsure (1)..(261): unsure at all Xaa locations
FGKLFDGLFGKKEMRILMVGLDAAGKTTILYKLKLGEVVTTIPTIGTPLAMLPPLVHIDGTDPLLARARSLTCLSRFNVETVEYKNIQFTVWDVGGQDKIRPLWRHYFQNTQGIIFVVDSNDRDRVVEAREELQRMLNEDELRDALLLVFANKQDLPVSATPIYPMPAMFSSNSSSNSQLTLRVFRMAMNAAEITDKLGLSSLRQRSWVCFEFPLSHMMHAFVPXHXFFPSRSTSQATCATTGDGLFEGLDWLSTELKKKS

SEQ ID NO: 3690 - protein, 1094 aa, Neurospora crassa
CGACTSAVEAGFKGVNGVGSVSVSLVMERAVVMHDPDQITADKIKQIIEDRGFDAEVLATDLPTPMIARHPEQDLEASDDSPLMITTVAIEGMTCGACTSAVENAFKDVSGVRHFSISLLSERAVIEHDPTLLSADGICEAIEDRGFGATVVESVHKQPERESVPGAATSSQPSNATTTVAIEGMTCGACTSAVEQGFKDVNGVLKFNISLLAERAVILHDPTLLPADKIVEIIEDRGFDAKILTSTFDQPSQSGGTSTAQFKIYGNIDAAAANKLEDAVLALPGVASAKLAIATSRLTVTHLPNVTGLRAIVETVEGAGFNALVADNDDNNAQLESLAKTREINEWKQAFRISAAFAIPVFFISMILPMFLKFLDFGKVRLIPGLYLGDVVCLVLTIPVQFGIGKRFYVSAWKSIKHKSPTMDVLVVLGTSCAFFFSIVAMVVSILFPPHTRPSTIFDTSTMLITFITFGRFLENRAKGQTSKALSRLMSLAPSMATIYADPIAAQKAAEGWDRNADSSDSQEPREGNAADEKVIPTELIQVGDIVLVRPGDKIPADGVIVMGETYVDESMVTGEAMPVQKKKGSLLIGGTVNGAGRVDFRVTRAGRDTQLSQIVKLVQDAQTTRAPIQRLADTLAGYFVPMILFLGMMTFFTWMILSHVLSTPPKIFLEDASGGKIMVCIKLCISVIVFACPCALGLATPTAVMVGTGVGAENGILVKGGAALETITKITQVVLDKTGTITYGKMSVAKTNIVPVWLDNDWRRRLWWTLVGLAEMGSEHPVGKAVLNAAKTELGLEAEETIDGTIGNFTVAVGQGITAEVEPATSLERTRYRVHVGNIRFLRDNDIEVPESAINAAEEINEAAASSRYKSTPSNTPAGTTTIFIGIDGKYAGHLCLSDTIKDGAAAAIAVLHRMGVKTAIVTGDQRSTAIAVASAVGIDPEDVYASASPDQKQAIIQQLQSRGAVVAMVGDGINDSPALATADVGIAMSSGTDVAMEAADVVLMRPNDLMDIPAALHLARTIFRRIKMNLAWACMYNLIGLPFAMGIFLPFGYHLHPMGAGAAMAASSVSVVVSSLFLKFWARPKWMDKTLN

SEQ ID NO: 3691 - protein, 165 aa, Neurospora crassa
  unsure (1)..(165): unsure at all Xaa locations
RLQTELMQLMTSPAPGVSAFPSADGNLLSWRATIEGPEDTPYAGLTFKLSFEFPANYPYAPPTVLFRTPIYHPNVDFSGRICLDILKDKWTAAYNTQTVLLSLQSLLGEPNKXGLHMLSHSISTRSELTPITSASPLNGEAAELWDKDPTLFKTKVMDRHRDIDD

SEQ ID NO: 3692 - protein, 218 aa, Neurospora crassa
HPNVIEWFATGEDRIWRWIAMEYAEGGDLFDKIEADVGLEEDIAHLYFQQLISGVSFMHSKGVAHRDLKPENILLSESGILKIADFGMATMFEYKGARKQSSTMCGSPPYIAPEVLHCARQRERRAPSSEQTKYSADLVDIWSCGVILFVLLVGNTPWDEPTPGNWEFKEYVRTSGRSTDPLWQRVPSDALSLLRGMMNIEANKRFSFTQIRQHPWYT

SEQ ID NO: 3693 - protein, 2630 aa, Neurospora crassa
  unsure (1)..(2630): unsure at all Xaa locations
MTRNDGGSRYSSIDSAQSSITAKPFPLTPTSSLGSSMTRPLSPSLQAGSSSSNGGHNVSRSASQGARRPAPTRLKTDDGTQFARXVEASDAVCCFLGASWFSSGSVIRIPTQSCLHSPVLSPQLSGNPVLLCRPFSYKSSLFLPYFPAVQTNGCMRRPPIYSRSSRDFESSQSQSQPSHTQTRSHSLSQATLQSCSQPQLSLNSQQSQSPSQYHSQQTPTQQQPQQQVSPTGGSRLTQSPTTPSNASIREHRMSELGGYRREMAAMLDTTGGALSRTSSHSQQQPQQPQQQQQQQQQQQGHAAGSVSGTFSNLSQYAPYLGGNNGGGMSMGSFLNDSTDNLSVISQLSPGIRPMTARPSQASAGSMEFPDSAYYDDERRPSIASITTTASSQGSRTSKTRGGLQKLQQFFGDRDDWPGRDSSEISLPQPSHSGPMSTGKEHRSHSYSLPGSGRSHRDRNYSNATDHHPSTFGSVSTVGGRDRDASPVPSRPRTPVPAPEVVPFLYQEADVRIASLSLSLFLYFCFLLXFTVFDLPFPLFALPLPPSSLPSLVKCCGGSLVRDTGAVVSLKVPYATYTYXLLPSLRPHFHTSPNLISGLLFPISTPSYPFWESRIGXVAVGSTLAMAAGRLILCSKRNPRLTLPATCRRXDDPSCHLPSSSSQQPHXQGAQGNGCGIFYTTMTTTACQXGVVVALLQSRETRSLLLSSSLDSSCLPCLPIRIIQIARVISVAVTDHCMKHRDIARYGEAPVRTSLTGPDRDRYIDSSQNPPKTSSSARSGHSIVHLPGHHKHNKSNEDPRALKPSLSREDSAASFARDFRNGSSSMMGTRSRAQSPAPSWTGTSRGLKANSISDGTSSPAPSHKKGILGRFRRHNKDKEDGSSLRSGSNHTLVHRPSRQDLTRAAESTYPASVYVSDPSEQREVPVRPGYVRQTTAPGFTTKLFTSKKSSSAKQPQDDMDEDIGPTDMHMGGGTVYHLDTNLNDMEGILTKPQPMTPLDNSISMRRESEKMIVPITTDPEGAWAAPDSWAVRDNKKSLAPQVNEDLCSRQPSEEKEKKSNYYIRVFRSDSTWTTLTLPLTATAEDVIMGVAKKTYLPPGAQDSYSLLIKKHDLFRVLNSAEQPLRIQKRLFQQIGYQEKDGIDEIGREDNSYICRWVFLKEKEADMHLLSPDINFRNQKLNHVDLSGRNLITIPVPLYRKAAEIVSLNLSRNLSLDVPRDFIQACTALRDIKYNNNEAQALPKSFATASKLTYLDVSNNRLQDLDHSELSKLTGLLKLNLANNCLRSLPPTLGAYKSLRTLNISSNFLDVFPSFICELETIVDLDLSFNSINNLPDNLMKLRNLEKFVITNNRLSGPISESVRDLVSLRELDIRYNQISTIDVLSDLPRLEILSADHNQISKFSGSFERLRSLKLNSNPIVKFEVKAPVPTLKILNLSNAQLASIDESIDNLMNLERLILDSNYFVSLPNQIGNLKKLDHLSMANNHLGELPPEIGCLTELRTLDVHGNNMRKLPNEIWWANKLEHLNASSNILTEFPKPASRAPQAPGEASPSPGAYPFPNANKNGLLSRTPSMDDLNGDASRRPSQASSTLLGVAVSPVPSGPDNRKSSMVSLYGKGGRKTSVVSRSTTQSSTGVITPSNGPRKDSSLSYRFTHTFSGSLKNLYLADNQLDDDVFEELKHLPELRVLNLSCNDLSDMPQGTIRSWPQLVELYLSGNELTSLPAEDFLEEHCLLQTLHINGNKFINLPAEISRAKKLQVLDCSSNNLKYNVTNVPYDWNWNFNRDLRYLNLSGNKRLEIKNNYRQPQSYRDDDFADTDFSKLTNLRVLGLMEVTHTLPNIPDQTEDRRVRTSEMKAGAYLPYGMADTLGKNEHLSLFDLVVPRLGSVETDTLVALFDGKELSTGGSKIAKFLYEEFSRLFILELEKVKGKPNENPADALRRTFLSVNKLLMSLSNSADERGLDSHPSRNYAHTVLTKEDLNSGCVATVAYLSELKLYVANVGDVQGMLIQANGSFKMLTKKHDPADPVERSRIRNAGGWVSRNGRLNDVLNVSRAFGYTELLPAVQAAPDITEHTIDDKDETVLIASKELWEHLRPELIVDVARECRSDLMKASQKLRDLAIAYGSTNKLLIMMIGVANLKQRQAQQFKGQLNATFSMPQDDPSHVPPSGNKRRKVRAEGPLDSNLMRLNAEVPPPTGQLSIVFTDIKNSTQLWENYPEAMRLAIKLHNEVMRRQLRMIGGFEVKTEGDAFMVSFPTATSALLWCFAVQMKLLTVDWPPEVLSNSSCQPIYDRNNNLITRGLSVRMGAHWGEPLAERDPVTRRMDYYGPMVNKASRISAVADGGQITASSDFITEIHRCLETYKESVDVDEDSLEDDATAKAIRAELRALSSQGFEVKDMGEKKLKGLENPELVYSVYPHALVGRTEQHHAHTESTQNQAALQPYGALATPKPATMDPDSEIQFEPETIWALWRVALRLEMLCSTLEEPNARGLQAPETELLERMKQRAGEVTDHFLLNFMEHQISRIEVCXAQTKTFVRRIKRLKFLFTDCITSLAVRHIAIGSGPITKLNDLRAPMNDVLSTLKEQMDELARYKAKYGSLDQAETDDATDNNSSGDVDTLDGSDTEQE

SEQ ID NO: 3694 - protein, 590 aa, Neurospora crassa
  unsure (1)..(590): unsure at all Xaa locations
GNSYCNSILQALYYSEPFRENVVNYPPSNNTSEGNTSKVKVSIRPPVQVNGNAATPGKQLPKPRQGFTPGPIPMPITQPIRPEDRPDAPEYKKKQAMIKGPVLELTQENPDAYGMEECTFTGLKDIFTALIQSNSRTGVISPQRFLDIFKRDNEMFRNSMHQDAHEFYGLVLNDVISNVEAYARRMQESRKEIGTTSSPLNQQSSSPSLTRSLMASNLRTPETSWVHDIFEGVLVSETRCLTCETVSQRDETFLDLSIDLEEHSSVTSCLRKFSAEEMLCERNKFHCDRCGGLQEAEKRMKIKKLPKVLALHLKRFKYTEDYSRLQKLFHRVVYPYYLRMFNTTDDAEDPDRIYELYAVIVHIGGNAYHGHYVSIIKTKDRGWVLFDDEMVEPVDKNFVANFFGDKPGMACAYVLFYQEVTFEKMREELDAEGLEEMRLATQAADLAAGAEQTNGTGNDSLTKVNSQPTVPVEDLDPSVALLTPKQLQAELPVSYNLQRRPRPPDPSLSPILXLRHHLRPLPSXRRRTRRPRFRPNPRMNLPRRKRNRKPKRKHRKRPEKPPRKRQQGSQKRSVSRRSQRSAEYSKKSRS

SEQ ID NO: 3695 - protein, 270 aa, Neurospora crassa
DYGNEVECGQGVARAIKEGIVKREELFIVSKLWNTFHDGDRVEPIVRKQLADWGLEYFDLYLIHFPVALEYVDPSVRYPPGWHFDGKSEIRPSKATIQETWTAMESLVEKGLSKSIGVSNFQAQLLYDLLRYAKVRPATLQIEHHPYLVQQNLLNLAKAEGIAVTAYSSFGPASFREFNMEHAQKLQPLLEDPTIKAIGDKYNKDPAQVLLRWATQRGLAIIPKSSREATMKSNLNSLDFDLSEEDIKTISGFDRGIRFNQPTNVSLILP

SEQ ID NO: 3696 - protein, 295 aa, Neurospora crassa
DLLDNEPLDTDEIICTHSRIQSISALRLERFKQVARICLRQNLIQDIEGLAAVAETLQDLDLYDNLISHIGRGLTDLTNLTSLDLSFNKIKHIKHINHLTNLTDLFFVSNKISRIEGLEGLDKLRNLELGSNRIRELQNLDSLKNLEELWVAKNKITELTGLGGLPKLRLLSIQSNRIRDLSPLREVPQLEELYISHNALESLEGLENNTKLRVLDISNNKIASLKGIGPLEELEELWASYNMVGDFAEVERELKDKKNLTTVYFEGNPLQLRAPALYRNKVRLALPQVQQIDAS

SEQ ID NO: 3697 - protein, 307 aa, Neurospora crassa
  unsure (1)..(307): unsure at all Xaa locations
PADTIKVRMQLSKRGRVPGQAKRGFIRTGVEIVKKETALGLYKGLGAVLTGIVPKMAIRFTSFEWYKQLLADKQTGVVSGQATFFAGLAAGVTEAVAVVTPMEVIKIRLQAQHHSMADPLDVPKYRNAAHALYTVVKEEGFGALYRGVSLTALRQGSNQAVNFTAYSYFKKWLYDYQPEYVGQNLPSYQTTLIGLVSGAMGPLSNAPIDTIKTRLQKSVAQPGETAFQRITKISAEMFKXVTFHSLSLSASQLPXRGRLLMQMRQTGQEGFHAFYKGITPRIMRVAPGQAVTFTVYEFLKQKLERSG

SEQ ID NO: 3698 - protein, 2301 aa, Neurospora crassa
  unsure (1)..(2301): unsure at all Xaa locations
SYAAKHNLAPHFIGGNRLENAPPSKVKDFVASHDGHTVITNVRFLALPAVQRTFRXHLLVFQVLIANNGIAAVKEIRSVRKWAYETFGDERAIKFTVMATPEDLQANADYIRMADHYVEVPGGTNNHNYANVELIVDIAERMDVHAVWAGWCVDKSPASGVDGMKILTVRIGGHASENPKLPESLAASPKKIVFIGPPGSAMRSLGDKISSTIVAQHADVPCIPWSGTGVSEVKVDDNGIVTVPDDVYLKGCVSSWQEGLEKAREIGFPVMIKASEGGGGKGIRKVLNEDNFESLYNAAASEIPGSPIFIMKLADSARHLEVQLLADQYGNNISLFGRDCSVQRRHQKIIEEAPVTIAKPMTFKAMEEAAVRLGRLVGYVSAGTVEYLYSHADDKFYFLELNPRLQVEHPTTEMVSGVNLPAAQLQVAMGIPLHRIRDIRLLYGVDPRTASEIDFEFKNPESEKTQRRPTPKGHTTACRITSEDPGEGFKPSNGVLHDLNFRSSSNVWGYFSVGSAGGIHSFSDSQFGHIFAYGENRAASRKHMVVALKELSIRGDFRTTVEYLIKLLETEAFEENTITTGWLDELISKKLTAERPDPILAVVCGAVTKAHIASEGCMTEYRAGLEKGQVPSKDILKTVFPVDFIYEGYRYKFTVTRSSADSYHLFINGSKCTVGVRALSDGGLLILLNGRSHNVYWKEEVAATRMSVDSKTCLLEQENDPTQLRTPSPGKLVKYTVENGEHVSAGQTFAEVEVMKMYMPLIAQEDGIVQLIKQPGATLEAGDILGILALDDPSRVKQAQPFLGQLPEFGAPVVVGSKPAQRFRLLYDTLQNILMGYDNQIIMQQTLKDLIEVLRDPKLPYSEFTAQFSALHARMPQKLDAQLTQVLEKASSRSAEFPARNLGKVFQKFLDENVASKVDAELLKTTLAPLTTVIDQYSEGQKVHELNVIRDLLTSYVEVERLFSGRRLQDEEVILKLRDENKEDIKKVTQTVLSHSRVAAKNSLILAILDEYRPNKPNVGNVSKYLRPVLRKLAELESRQTAKVSLKAREILIQCALPSLEERTAQMEHILRSSVVESRYGETGWDHREPSLDIIKEVVDSKYTVFDVLTLFFAHEDPWVSLAALEVYVRRAYRAYVLKKIEYHTDETETPSFLSWDFSLRKLGHSEFGLPIQSAAPSTPGTPVDSTFKRISSISDMSYLSHKTQDEPTRKGVIIPCKFLDDADELLSRALEKLPVLGARKRNSVIPDLNEKRRPPLQRLETFDELSAVVNVAVRDAEGRSDEEILKEILPLVHQHREDLFARRVRRITFVCGRNDGSYPGYFTFRGPEYVEDDSIRHSEPALAFQLELGRLSKFKIKPVFTENKNIHVYEAIGKGVETDKRYFTRAVIRPGRLRDEIPTAEYLISEADRVINDIFDALEIIGNNNSDLNHMFLNFTPVFQLQPEEVEHSLQGFLDRFGPRGWRLRVAQVEIRIICTDPATGMPYPLRVIITNTSGYVIQVELYAERKSEKGEWVFHSIGGTTKIGSMHLLPVNTPYPTKNWLQPKRYKAHLMGTQYVYDFPELFRQAIQNSWVKAVRMDSSLADKQPPVGECIEFSELVLDDHDNLIEVSREPGTNTCGMVGWLIRARTPEYPNGRKFVVVANDITFNIGSFGPKEDNFFFKCTELARKLGIPRIYLSANSGARLGLATELMPHFSVAWNDPSKPEAGFKYLYLDDAGKKRFENTVITEEITEGDEKRHKIVTIVGAEDGLGVECLRGSGLIAGATSRAYNDIFTCTLVTCRSVGIGAYLVRLGQRAVQIEGQPIILTGAPALNNVLGRQVYTSNLQLGGTQIMYRNGVSHLTANDDFAGVSKIVEWMSFVPDKRNNPVPISVSVDTWDRDVVYTPPQKQPYDVRWMIGGKEDENGYQPGLFDKDSFVETLGGWARTVVVGRARLGGIPMGVIAVETRSVENITPADPANPDSIEQVANEAGGVWYPNSAFKTAQAINDFNNGEQLPLMILANWRGFSGGQRDMYNEVLKYGSFIVDALVKFEQPVFIYIPPFGELRGGSWVVVDPTINPVAMEMYADVDARGGVLEPEGIIGIKYRKDKQLETMARLDPVYADLKRQSADASLPKEESDAIKQKMTEREQQLLPVYAQISVQFADLHDRAGRMKAKGVIREVLEWQNARRFFYWRVRRRLNEEYILRRIISATTPGGAPSKALTASSTKERARHLQLLQAWSGIEKFDTADREVAVWYEENRHLVQTKIDALKAEAITTEMRDLIRAASKGSDDAAWKGVRDILSVMPVEEREKVVKYL

SEQ ID NO: 3699 - protein, 318 aa, Neurospora crassa
GGPNHVRTGFRFWRDPGAFAQYSASAGDDKVVIPGATGRFLGVWACMVQATFAYLGTELVGVAFGETPNPRKNVPRAVSQTLMRIVFFYLGGILVLGMAVKYTDPLLGAVKKTSGLASPFVIAAKNAGINKLDDAVNGLLLIFTVSAANSDIYLASRTLWALAKDGQAPGIMNKTNKRGVPVPAVILSSLFILLGYMNASKGSSTVFGYFVSLVTVFGALNWVAILVSYLFMIRAMKVQGVPREVMPYRNILLPWGAPIALFLTILIIIFNGFGAFFPHFQVDKFLTSYIGIPVFLINIGWWKVFKKTKRVRPEDADL

SEQ ID NO: 3700 - protein, 740 aa, Neurospora crassa
VHVPASFKVVSGEVENPASSPSSPKIAAEEMDIPRSPSPVDNLDVTELQHQHSTQIIPPHTQRSVLPTAQTQAVPEEIQLPASPLEQFTPEEVELPRSSSPVEAKLDIVEMQHEHSAQILPLYVQRADSTWGEVDPEDVDLPTGPLKEIMPAEAELPGSPSPVEDELDGAKLQAAHEEVELQASEPTSPKITPEEIEVPRSPSPFDESKITELQHLHSAQIIPRNIHYATSSSGSPKIIPEEVELPASPVEEVDVDELQRFHSSQIISPHIERSASPTIEEVVPEEVELPVSPVEQVDIEQLQHLHSRQIIPPHIQHPASPSPNAELLASPKVTPEEVELPASPELVPQDIELPASPIDEAEQAELPILTKESEASVDQQIDDLEEEEDARSAALELPSSPEVKHEVQPEEMELPLSPVLKPEEVDLPASPEVVPEEVELPVSPVDDLADVQHLPQPDDVPEEAVQENVNLEIPSSPVIAPEEVELPLSPKTAPEEVDVPASPVVEVEEQPATVSEPSERSINLEADIAPQEEIEPPFSPVAKPEDIQLPASPEVIPEDVELPLSPIVELEHQLPIEPVNFELPSSPKLKPEDLELPSSPEIIPEDVELPASPVVELADEQLPVEPEQSAQAIEVSEEDTKLPSTPIVKPEDLELPASPEVLAQDVELPPSPVTLSEDVELPPSPMVDLEHEQLSVEPVDLSDVQEQQVEEQLDKHTAPESSPVLLPKEVELPTSPATKS

SEQ ID NO: 3701 - protein, 458 aa, Neurospora crassa
WAPDSWRSKPIKQCPEYPDKAALEKATNELKTLPPIVLPNEIIRLREHLRDVAQGKAFLLQGGDCAELFSYCQQDVIESKIKLLLQMSLVLLWGADKPVVRIGRMAGQYAKPRSSPVETINGKEVPSFRGDILNGFHPDERELDPNRLVRAYQYSSATLNYIRGAIGSGIADLHGPLDWGLGHVRDPALKSKYQETVDRIQEMLRFMHTIGADQNEKLSTVELFTSHEGLLLEYEEPLTRLLNHPSVRSYPPDSTTPPKKEYYNTSAHFLWIGDRTRQIDHAHVEYFRGIANPIGVKIGPSTPTSDLLPMLRTLNPNREPGKVTLITRYGADKVASLLPAHIRTVESSEYARTVVWQCDPMHGNTQSVSGGIKTRKFSDIFSELQQTLRIHKEEKSYLGGMHLELTGDAVTECLGGGAGLDEDDLSTNYTSFCDPRLNEKQALELAFLVADHYRQERK

SEQ ID NO: 3702 - protein, 586 aa, Neurospora crassa
  unsure (1)..(586): unsure at all Xaa locations
TANTGLARELKGRHLQMIAIGGSVGMSCTTPYLKTXLTNIGSGLFVASGKCLYLGGPASLIIAYGFVGVMLWCTIQALGELAVAFPVAGSFSSYSTRFLDPAWGFAMGVEVRHXPLNFDDISNPTNLTPSYALQWLTVLPLELIAASITIGYWNDQLNKAIFITIFLATVIIINLFGVKGYGEAEFVFSIVKIAAVTGFMYVHPLPLSSPKLSLTIPASSAAVINIGGFDDPQGNTGYIGGRYWTNPGAFHHGFKGLCSVFVSAAFAFTGTELVGLAAAETANPRKSLPTAIKQVFWRITLFYIVSLTLVGLIVPYNHERLLGNIQHYSVSDASYSPFVIAIESASIQVLPGIMNAVILIAVLSVGNSAVFGSSRTLAALADQRQAPQILAYVDRKGRPLFAILFAALVGLIGYLADLKFQSDVLNWLLAVSGLSSIFTWGSICLCHIRFRRAWARRGRSLTQLSFTAQAGITGSYVGLFLNVFVLIAQFWIAAFPIVTFTDNQSAATASPSKVAQSFFLQYLCVPIVVAFYLVYKLWFRTKIVRSDEMDLDTGRRRDVNLPVLVMREKEEVEGWPGWKRVYRFFC

SEQ ID NO: 3703 - protein, 540 aa, Neurospora crassa
SSDTKARSKADWLKRRERVVEAMELSWDAYERYAWGMFLKKGWCCDYRLRLTCVLGYDEFHPVSKTGRNMAPKGLGWIIIDSLDTLMIMNLTSRVTHAREWISKSLTWDQDQDVNTFETTIRMMGGLLSAYYLSTEYPNLAPISDDDVGAPGEDLYLEKARDLADRLMSAFDTPSGIPYASVNLGKFQGLPSHADMGASSTAEATTLQLEFKYLANLTGEKDFWDRSEKVMKVIDDNQAPDGLVPIFIQPSTGHFHTQNIRLGSRGDSYYEYLIKQYLQTHKAEPIYQDMWNDALQGIRKHLVTYTENSGFTIVGERPSGLEGNLSPKMDHLVCFLPGTIALAATEGLSEREARKKPGFWNKQREADMKLARELMQTCWGMYRYMATGLAAEITYFKIPSDPLPESSSHTSPPDSIFDDPAGPDATWRKDYEVHQMDAHNLQRPETVESLFYMYRITGDVKYREWGWDMFKSFVNYTAVEDGGGFTSLSNANVIPPVIKDNMESFWMAETLKYFYLLFSPEDLLPLDKVVFNTEAHPLPV

SEQ ID NO: 3704 - protein, 582 aa, Neurospora crassa
  unsure (1)..(582): unsure at all Xaa locations
ALLPXSEQDALSESTQRSTMSPTTSKQRRRRPPHHPSQLPTRTLRTTRKTASPQETRTRTERRPKHQPSHFSEGANQSSPARQRQLPSHLPHHDTTMSLQEYQSPLRAIASCPLASSPRRMTPSTPMTPAASQTVYHQARQLFSRSADPGELIGRDDEREKLNTFLDCCTTAHPSGCLYVSGPPGTGKSAIVNKVTDKFASETSTVRKAYINCMSIKSSKDLYVTLLDQLVSKDEDKEELSTESDVVAALQKLILPRKKTQDVFLVVLDEIDHILTLDPESLYSLFEWSLEKKNSRLALIGIANALDLTDRFLPRLKSRNLKPELLPILPYTAPQVKNIIITRLKSLLPGGTPKDPNYIPFFHPAAIELCSRKVSSQTGDLRRAFEICRRAIDLVESETRLKHENEVKEQMLQMSPSKKRVLGENTNLSSAPAPSSLFRSISTGPSASVSASLLKSLQALTPATAPRVSIADLSKVTAAAFSNGTTQRLKTLNLQQKAALCALVAIEKRNRAAQSEALNSASASFASTTGTPSRKQEAPIAPTVKTLFEAYTKLCKQDSLLHPLSSSEFREVVSSLETLSLI

SEQ ID NO: 3705 - protein, 387 aa, Neurospora crassa
  unsure (1)..(387): unsure at all Xaa locations
GETVERPPIWVMRQGEMSSLTHFYSHIXRSTSHPHAGRYLPEYHEAKGGRDFFEVCRNPEIASTLTLQPIERYAGLIDAAIIFSDILVIPQAMGMTVEMVDKKGPHFPNPLRSPSDGQYAELMKRDVDVAKELDYVYKAITLTRKKLDGRVPLFGFTGAPWTLLCYMVEGGGTKLFKEVKTWIYKYPEETKALLQKISELCVEYLALQVKAGAQVMTLLLSGYITLAIQYXRHPDRPVFDSWAGELSPSSFKTFSQPYLTYIAKHLPLRLKEMGLEPVPMVVFPKGAWYALDAACDMGYNVVGLDWLHDPAEAVKVVGDRPMVLQGNADPGVLYGSHEAITKVVEEMVQGFDWHGRHKGWIVNLGHGITPFVNPDDLKFFFEEIHRL

SEQ ID NO: 3706 - protein, 227 aa, Neurospora crassa
RNHVVIKVGMVGDAQIGKTSLMVKYVEGSWDEDYIQTLGVNFMEKTISIRNTEITFSIWDLGGQREFVNMLPLVCNDAVAILFMFDLTRKSTLNSIKEWYRQGRGFNKTAIPVLVGTKYDHFVNLSREEQEEISNQVGSVICAYTAKFLLADVTFPARRFAKAMRAALIFSSTSHSINVQKVRHTLFAATGAWSDCFADFKIVLSKAFDLKCTIPEISNVGEPLLLY

SEQ ID NO: 3707 - protein, 131 aa, Neurospora crassa
ELRKYTREHEWIELSDDKKTGYVGISSYAAKALGDVVFVELPEEGKEVHAGDALGAVESVKSAADINAPVSCKVIASNLTLEESPSTINKVPEDHSASGGWVAKVQVTDQGIADLEKLMDEEAYKEFTAAE

SEQ ID NO: 3708 - protein, 321 aa, Neurospora crassa
ETVHIGTRRSALALRQVDLVIAALQPHHPNVHFQVHALATLGDKNQTASLPSLGKGLWTNELEAKLFNKEVDFIVHCLKDMPTTLPEGGKIGVVTEREDPRDVVVMKKKWAEQGKYKSLADLPEGAIVGTSSVRRAAQLRRRYPGLVFKDVRGNIETRMRKCDEEDYDCIILAAAGLLRMGYDERIAQWLDSTTEGGGMLHAVGQGALAMEIREGDEKTLEIIKPLCHEKTMVATFAERAVMRTLEGGCSVPIGVETKWVGEDQLQLKVTVVSLDGKESVDGQSVEVIKTIEEAEAMGQKLAEDLAKRGAQKILDFVNQGR

SEQ ID NO: 3709 - protein, 473 aa, Neurospora crassa
  unsure (1)..(473): unsure at all Xaa locations
GELIGLLINGYVSERFGYRYTVIGCLMLICAWTSLFFTAQNVQTLLAAEILCGIVSFTHLPQSNAHDWFTDELPPWGVFQTLTITYASEVCPVAMRGYLTTYVNFCWGVGQEIAIGVIMSMLKRDDEWAYRIPYALQWMWPVPLALGIFFAPESPWWLVRKGRLDDAKKSLLRLTSVNRETDFNADETVAMMVHTTALEEKTTQGATFWDCFKGHDLRRTEIVCMVWAIQNLSGNSFSNYSTYFLKQAGLDDDDAYAFALGQYAINMAGVFGAWFLMSRGIGRRALYLYGLCGLFCMLFVLGFLGLVPEAHNREASIATGSIMLGWALVYQLTVGTVCYSLVSEISTRRLQIKTIALGRVLXXVPQTQEPFXAHAXVLTMHSIIVGIVTAVLTPYMLNPGAWDWSNFTGFFWVSHLAPFPWLQSXRIPGRICFLCIIYVYFRVPEPTGRTFAELDLLFSKGISARKFAETKVD

SEQ ID NO: 3710 - protein, 240 aa, Neurospora crassa
  unsure (1)..(240): unsure at all Xaa locations
LDRYFRHIGYSPKDAEDDLGRLAMLQLRHMARVPFESLTLHYSQHHRLSLDLEDLFEKIVDKGRGGYCMEVNTFFGAVLRSLGYTLINVGGRVKAGDGEYKGWFVVPDRRPMPIXSQHRALTGFPGIHMVNIVTINNTRYLVDVGFGSHGSVNPVPLEHNNVFTTVSPARGVLEYKSLSQHTDPTNQRIWVYSTQENPSAPWKEMYCFAADTEFFPADFEVMNLSTMTSPQSFFVQTVMC

SEQ ID NO: 3711 - protein, 710 aa, Neurospora crassa
  unsure (1)..(710): unsure at all Xaa locations
MSAKSILEADGKAILNYHLTRAPVIKPSTLPNPTKHNPPPRLASLHFAEDADVNGVLSQAEVTYPWLLQEGARFVAKPDQLIKRRGKSGLLALNKTWAEAKAWIAERAGKPQKVEHTEGVLRQFLVEPFVPHPQETEYYINVSRPIAGLAKVIHKXTARXRETDQLRSXCKCCRLFQSSWQFVESSERSHMQVHPNEGVAKPKRSDVRIPIQVETNSXGSGPQFSYTLEKEKKKIXGGGXENWGXEAHFESCAXLVLPLPVYGRTEAKPNSCGAGHTHRPLCDPHHHNPPSTPTQTPSQHVVPQKNCQTXNKVAEANCTSCRGDWILFYHEGGVDVGDVDAKAEKILIPVDLSQYPSNEELASTLLKHVPKGIHNVLVDFSSFTCQIKLNRPVLAVPCQASRTHTLHPDNHPGLADAXLDHXYXQPLTVARLYAVYVDCQFTYLEINPLVVIPNEDATSAEVHFLDLAAKLDQTADFECGNKWAIARSPAALGIVAQSSNTGVNIDAGPPIEFPAPFGRELSKEEAYIAELDAKTGASLKLTVLNPNGRIWTLVAGGGASVVYADAIASAGFADELANYGEYSGAPTESQTYHYARTVLDLMLRAPVSEKGKVLFIGGGIANFTNVASTFKGVIKALREYGKALIEHNTQIWVRRAGPNYQEGLKNLKAATQELGLNAKIFGPEMHVSGIVPLALVPGKWEESGAVEFQA

SEQ ID NO: 3712 - protein, 543 aa, Neurospora crassa
  unsure (1)..(543): unsure at all Xaa locations
PQRFQRSMVQVQGETGVAIDSPQGRKLFVFDRVFGPEVDQEGVWEYLSDCVNAFTQGYNVSLLAYGQSGAGKSYTMGTAGPDVQEDLEAMGKCTWHRPLRHAGALPTKKLACXLHMQEXSPGPLSPCSKSWTAQVQSPKARLRNGVPCPSCVPLRELPCFSPPTSTRDWKLTATYVEIYNETLRDLLIPEHIPQHERGTVTIREDVKGNIILTGLQQVEVNSVDDLMNVLAQGSALRQTDATAINARSSRSHAVFSLNLVRKGAKGPTAPTDRRMSMPLEAMSGTEAMVTTDSKMHFVDLAGSERLKNTGAQGERAKEGISINAGLAALGKVISQLSSRQPGAHVSYRDSKLTRLLQDSLGGNAITYMIACVTQAEFHLSETLNTVQYAQRARAIQSKPRIQQVDEGDKQAIIERLKAEVAFLREQIRSSERGGGDRRSMLLAPGERSERQNEREAELQNQLLDARENYTTLSQRHAKLISEMAKARENEFAENQHLEESLGESATERLNRSNSFAQAVEQVVLEYEKTIQSLEQSLASTRAT

SEQ ID NO: 3713 - protein, 650 aa, Neurospora crassa
  unsure (1)..(650): unsure at all Xaa locations
LRQTLRSTRSCTSSPSPSPTVFWAERARELLSWSKDFQTVHSGSLANGDNAWFVEGELNASYNCVDRHAHKDPNRVAIIYEADEPGQGRNVTYGELLREVSKLAHSSPTWVFAKGDTVAIYLPMIPEAIVAMLACTRIGAIHSVVFAGFSSDSLRDRVVDAQSKVVITTDEGKRGGKLIGTKKIVDEALQQCPDVRNVLVYKRTGADISMTPGRDLWWHEEVEKYPAYYTPVAMASEDPLFLLYTSGSTGKPKGVAHSTGGYLLGAAMTGKYVFDIHDGDRYFCGGDVGWITGHTYVLYAPLLLGVSTVVFEGTPAYPNFSRYWDIIEEHKVTQFYVAPTALRLLKRAGDHHVRNEMKHLRVLGSVGEPIAAEVWKWYYDVVGKGRAQICDTYWQTETGSNVITPLAGVTPTKPGSASFPFFGIEPALVDPVTGEEIHGNDVEGVLAFKQPWPSMARTVWGAHKRYMETYLHVYKGYYFTGDGAARDHEGFYWIRGRVDDVVNVSGHRLSTAEIEAALIEHHSIAEAAVVGVADELTGQAVNAFVAVKEGTQINDALRKEFVLQVRRSIGPFAAPKAIYIVPDLPKTRSGKIMRRILRKIVAGEEDQLGDITTVSSSLPTEQLHARYXQLEIAQRPSVVAKIIDVVHAQR

SEQ ID NO: 3714 - protein, 508 aa, Neurospora crassa
  unsure (1)..(508): unsure at all Xaa locations
DTGVISATLVSIGTSLSHRPLTSLDKSVITSCTSLFALLALPFASALADDRGRKRVVLFADTLFIIGALCQAASRTVEVMVIGRSVVGIAIGAASFVTPLYIAELAPATHRGRLVTMNIVFITLGQVVAYVVGWIFGTYGSPETTGWRWMVGLGAVPAVCQVVILLWMPESPRWLVKDGRSQEARAVIAKIAAGDDAQDPSTRREVDAVLKSIEIEVREEATAMRLGGAGAGYANGNAVNAWMEAMRELIRVRRNRRALAIACLLQGLQQLCGFVSNPGCDRDTVPPYXWATCANNFFFFFFFSLNSLMYFSATIFTMVGFSEPTLTSLVVAVTNFAFTLVALVLIDRVGRRRILLWSLPFMIAGLVLAGYGFSFIELPNSETSSPSTTGGQGGAVIILASIMIYVAGYAIGLGNVPWMQSELFSLSVRSVGSGVATATNWSANFVIGLTFLPLMEALSPSWTFVLYAVICAVGYGLIWTVYPETAGLSLEDAATLLEADDWGVRXGL

SEQ ID NO: 3715 - protein, 1613 aa, Neurospora crassa
RSRNPRNNPLKGKSLGIFSPDNPLRLWLCDLLVNPWAEPLILILIVLQAVLLAVEAAPDVLADGNGRPERWGSTRIDWAIFVLFVIFTIELIARIIVSGFIINAPEYEEAKNKRRFRERLAEQYRVIFRPQRQRSVRQTRQEPFEPAPFTRSFTMAHSQIQTLEDQQRRHLARRAFLRHGFNRLDFVAVVSFWISFVLGVTGLESKHHMYVFRMLSCLRIIRLLALTKGNLIILRSLKKAAPLLVRVSFLMGFFWLLFAIIGVQSFKSSLSRQCLWIDPDDPTNFQAAYTPDMTFCGGHIDNVTGETMPWVYSHEKESLIDLKNGTSRAKGFICPRGSICIRQENPFNGTVNFDDIGHSLELVFVIMSANTWSDLMYHTIRSDFLPSALFYGAGILIMLLWMTNLLIAVITSSFQVIREESKASAFTADEPPGMTSSRVDDTMRRPTLLQRIYNRTKPLWILIIAFGLLAQSLRSARMKSDRERFVNIAEPVVTLLLDVEIIIRLAADIRGFHRRKRNLVDLGLAVATSIILVPPIRNSGQVYNWLTAFQILRVYRLVMVIPMTRKLIRLVLGNVTGIGNLMSFVFLITFLMAIFAAQLFRGELPREDDGGEEIRIPFNTIYNSFLGMYQVMSTENWTDILYSVTASTHHLHTAWIGAIFLVGWFILAYFILINMFIAVIQENFDVGEDVKRLEQVKAFLQRKELGHSSSSNLALSKVFNFGRSRKQRDPLDYGPAMMEMLLKEAVVHDFLDDDMDPLQQSSPDGQPTSHLGSSAAMQHDGVTPGVLSSFWGKLVSVFTSREPNPFYSNVNLHGLGENLDPRTMAAQAMNATRRRQRQQREYLMRHPNYNNSLFIFKPRNPIRRLCQSLVGPGRGTERFEGAQPNKYAWYTFSTLIYAAIVIMVVLACITTPLYQKEYFEKYGENAFDWFRWVDTGFAIVFTLEALIKVIADGFLWTPNAYFRSTWGVIDAIVLITLWINVITLFTRNGAVSRAVGAFKALRALRLLNISESAMDTFHSLLIVGGWKILSAAFVSISLLIPFAIYGVNLFHGKLLACNDSSEGIVSLDDCFGEWNSTPYNNNWPVLAPRSVANPYFSFDDFGSSLFILFQIVSQEGWVDVSFALQAITGRGLQPQSGAPYSGQGNALFLVVFNLLATVFVLTLFISVFMRNYTEQTGVAFLTAEQRSWLELRKLLRQISPSKSSYDESKNKWKIWCHKRAIEKRGKWYMAITSVLVLHLILLLSEFYSEPDWWTNTRDALFLLFTLIYIANIVIRIVGLGWSRFRKSSWDMFSLITVTGAFATTILFMTNTKLDTYIQLHKFFLVAIVLMLIPRNDALDQLFKTAAASLTTIGSLLATWLVFFLVFAIALTQTFSLTRFGNSTDYYVNLRTVPNALILLFRFSCGEGWNQVMEDFAKIKPPLCVESTNFSDSDCGSTAWARALFIAWNIISMYIFVNLFVSLIYESFSYVYQRTSGLAMVDRDELRRFKEAWRSVDPSGTGFISKEAFPRLLGELSGVFEMRIYESHDSVRQILEDVRGEDTSSIRHASIISTTQFQTSLDLKKLNERISQIDVAKVRERRRRFNIFFEEVMVSADPERGISFTTVLMILAHY

SEQ ID NO: 3716 - protein, 513 aa, Neurospora crassa
  unsure (1)..(513): unsure at all Xaa locations
TLQRTRNPRSLANENDENSTATTTRMTRAKAATLHVDELSMPAKTMQTKKTTISTTTAATAARTVGKRNALGDVSNVTKVEVAGTKKAIAKPGLVSKAAQPSGIQKKTTTATSRTATTARRALSNKEPNKTVGPSAGAGTIPAKRKPPPSTSKLAPIKESAPVENEPARKKIHVEEPEKKKVSRTEAKENDAPSKAVKPMAEPPAPVVRDVVPVQSVYPPGVKDLDTEDLEDPLMVAEYATEIFEYLRDLECKSVPNPQYMSHQDDLEWKTRGILIDWLIEVHTRFHLLPETLFLAVNIIDRFLSEKVVQLDRLQLVGITAMFVASKYEEVLSPHIANFRHVADDGFTEAEILSAERFILSTLNYDLSYPNPMNFLRRISKADNYDIQSRTLGKYLMEISLLDHRFMPYRPSHVAAAAMYLARLILGRGEWVSYTDGFIILAISSCGXYSXXQDKTIAYYAGYTEEEIEPVFHLMVDYLARPVIHEAFFKKYGSKKFLKGMSNNRPCLSRNLI

SEQ ID NO: 3717 - protein, 350 aa, Neurospora crassa
  unsure (1)..(350): unsure at all Xaa locations
MRTYKPHTPGIRHLKRPINDHLWKGRPYLPLTFPKKGQSKGGRNHSGRVTVRHRGGGHKRRIRMVDFERWIPGPHTVLRIEYDPGRSAHIALVKEEATGRKSYIVAADGMRAGDVVQSYRSGLPQDLLDSMGGVVDPGILAARTCWRGNCLPVSMIPVGTQIYCVGSRPDGKAVFCRSAGTYATIISKEEETREDGTKVMTGKFVNVRLQSGEIRRVSKDACATVGIASNIMHHYRQLGKAGRSRWLNIRPTVRGLAMNASEXTPRTIRLSSEQNQLTAWXMDHPHGGGRGKSKGNRHPVSPWGTPXVMPLYFLPSSEQTPYPLFLXAKGGYKTRRKSNVNKWVVTPRVR

SEQ ID NO: 3718 - protein, 237 aa, Neurospora crassa
  unsure (1)..(237): unsure at all Xaa locations
FISSRGNEYFCEIDEDYITDRFNLTGLNTEVQYYQYALDLITDVFDLDCDDDMRETIEKSARHLYGLVHARYIVTTRGLQKMVSNQLSAFHLHPASPRLHPXLTHFPPTVEKYKKADFGKCPRVMCSSHPLLPMGLSDVPNSKPVKLYCARCEDIYNPKSSRHAAIDGAYFGTSFHNIFFQVYPTLVPAKSVERYIPRCYGFKVHAAAALVRWQNSQRDEMRRRLRKLEVESGFKDA

SEQ ID NO: 3719 - protein, 344 aa, Neurospora crassa
SDKYNFKGKIGQGAFATVYMVTDKMNGRPYAAKELEKRRFMKNGVLDLKVENEMKIMQRVSHVSHYIIQRPELIHYLHQPDSTRLTCYLQPNIVQFKEHLDPDDKHLYIIMEFVGVGDGDLGKYIGTNGPFSEPDTKTIARQLVDALAYLHDMNITHRDVKPDNILIQSRFPLVVKLSDFGLSKMIDHDATFLRTFCGTLLYCAPEVYAEFEEYDELCERKTRRSYPRQPRRSQRYDHNVDIWSLGGVLYFALTTQPPFPARNGVGHTEFLHQIMTTFPDFDQLIKADPPVSLECRDFLKQMLSRRPEHRPTAKMLLSHEWIRTPHYSPNVAPSCSQNGGVDEL

SEQ ID NO: 3720 - protein, 397 aa, Neurospora crassa
  unsure (1)..(397): unsure at all Xaa locations
MSNNEEYDESANMEDDSGIPNPGAPTPLSALEVRITFFDGSIRIANNQLTCLGVAGLTKRDIQLIVDGGFNTVESVAYTPRRVLEQIKGISEQKAGKILAEGQXPAFDIPRGSILGVHDYXHYHQASKLVPMGFTTATEMHQRRSELISITTGSKNLDTLLAGGIETGSVTEIFGEFRTGKSQICHTLAVTCQLPFDMGGGEGKCLYIDTEGTFRPVRLLAVANRYGLSGEEVLDNVAYARAYNSDHQLQLLNQAAAMMCETRFSLLIVDSATSLYRTDFLGRGELSSRQTHLAKFMRTLQRLADEFGIAVVITNQVVAQVDGGPSAMFNPDPKKPIGGNIIAHASTTRISLKKGRGETRIAKIYDSPCLPESDCLFAINEDGIGDPSPKDMEKMNQ

SEQ ID NO: 3721 - protein, 397 aa, Neurospora crassa; identical to SEQ ID NO: 3720
  unsure (1)..(397): unsure at all Xaa locations

SEQ ID NO: 3722 - protein, 149 aa, Neurospora crassa
TGQLSERELSAALVNGDWTAFDPHTVRMMIRMFDSDRSGTIGFEEFCGLWSFLASWRTLFDRFDMDKSGNISLDEFNNALVAFRYRLSPRFVELLFRTYDKRGDGVMSFDLFVQACISLKRMTDVFKKYDDDRDGYITLSFEDFLTEIL

SEQ ID NO: 3723 - protein, 914 aa, Neurospora crassa
LDRDWYGGDDDLGGHTFGDDSHNPFGDEGAWAAQEREAALAEKKIGQMARGMSVRQIQKQKDADAWETNRMLTSGVAQRRDLGQDFEDDQEGTRVHLLVHDLRPPFLDGRTIFTKQLDPVPAVRDSQSDMAIFARKGSKVVRERRTQRERQRQAQEATKVAGTALGNLMGVKEEDTDSALPIAVEEEAGKSKNMNKFSEHMKENEGASNFSQSKSLKEQREFLPAFAVREDLLRVIRDNQVVIVIGETGSGKTTQLTQFLYEDGYGKTGMIGCTQPRRVAAMSVAKRVAEEMEVKLGSTVGYAIRFEDCTSKDTVIKYMTDGVLLRESLNEPDLDRYSCVIMDEAHERALNTDVLMGLFKKILQRRRDLKLIVTSATMNAKRFSDFYGGAPEFTIPGRTFPVDIMFHRSPVEDYVDQAVQQVLAIHVGKPAGDILVFMTGQEDIEVTCELIRERLDALNDPPKLSILPIYSQMPADLQAKIFDRAAPGVRKVIVATNIAETSLTVDGIMYVVDAGYSKLKVYNPRMGMDTLQITPISQANAMQRAGRAGRTGPGQAYHLFTEKAFKEEMYMQTIPEIQRTNLSNTVLLLKSLGVKDLLDFDFMDPPPQDTISTSLFDLWALGALDNLGELTDLGRKMNAFPMDPPLAKLLITSEEYGCSEEMVTIVSMLSVPNVFYRPKERQEESDAAREKFFVPESDHLTYLHVYTQWKANGYNDGWCVRHFLHSKSLRRAKEVREQLLDIMKMQNMKMTSCGTDWDVIRKCICSGYYHQAAKVKGIGEYINLRTSVTVQLHPTSALYGLGFLPDYVVYHELILTSKEYMSTVTSVDPHWLADLGGVFYSVKEKGYSAREKRITETEFNRRMEIEARMAADKKRQEDQLHEEELQLEKKAAPSKDKKVVKAGAVVKPVRKRAG

SEQ ID NO: 3724 - protein, 354 aa, Neurospora crassa
ILLRAYGNGTDLIIDRHRETQNHELLMRYGLAPELLARFENGMMYRFVQGSMTHPEDLRKPVIYKAVAKRLAQWHAVVPCITARTGHSRRNSKNTDFIVPSEALGDAEFQQIIDSVAPGKPPPNVWTVMQKWIFALPTDTEAQRERQAQLQKELTRTVCRAEPAARLGYQWGEYCLLSVSRVFGMTGDNFADHLTQQLVFAHCDLLSGNVIVLPKPQQTPADDSNGVTAKDTTIDVTFIDYEYATPSPAAFDIANHFAEWGGFDCDFSVLPTRVQRREFITAYIRAYYAYQGKKNGTTADYNEAAEVDRLLNEVDVFRGLPGFYWGIWALIQATISQIDFDYASYAETRLGEYW

SEQ ID NO: 3725 - protein, 518 aa, Neurospora crassa
  unsure (1)..(518): unsure at all Xaa locations
RAFHATRDLKVIKPVLLADIGEGTSRASGPRSIFSIASRXRLLLGIVECEVIQWFVEPGARVEEFSQLCEVQSDKASVEITSRFAGVVKKLYYEAGEMAKVGKPFVDIDIEAGPESKEVEAWTPPGPVSTLEGQQAIKGEAISTSTPQAVAPELKQSFIEAPWARQTPTTSSHAPVTKQTGKHASLATPAVRHLARELSVDITQIPGTGKDGRVLKEDVYKFLQARDSAPTLYPSAATPTSPGGTAAAAAAAATAASAFSSPDATIPGPQKETPVPLTRTQEMMFKSMTRSLTIPHFLYADEVDFTPLVELRTRLNRVLSKSGLPEGQVSKLSYLPFIIKAVSMALYKYPVLNARVELDSNSNGKPSLVMRSQHNIGVAMDTPSGLLVPVIKNVGSLNILSIAAELARLQSLAVAGKLSPQDMSGGTITVSNIGSIGGTYLSPVIVDREVAILGIGRMRTVPAFSTVPGEEDKILRRQICNFSWSADHRVIDGATMARAADVVRTIVEEPDVMVMHLR

SEQ ID NO: 3726 - protein, 194 aa, Neurospora crassa
QHIWLVTGPAGCGKSTVARYLAESLHWPYIEGDEVRDDALPSMVLSQLTKSKSFHPPANIEKMSAGIPLTDADRWDWLTALREASIRALDQGNSGVVLTCSALKRKYRDVIRVAPYFTPNLHLHFIYLDASEEILLQRVLARQNHYMGANMVHSQFEALEPPTPAETDVIRIDVSRPADMVMADALNQVLHTID

SEQ ID NO: 3727 - protein, 866 aa, Neurospora crassa
KTTAKRKIDMGDEEIIKRKLVKLPDLALENADDTPYADDDVAEDAEKDFDVLLAGTEEDRAEAQRLLRERREEQIQKESMAMEIDSAPSNIEVATEPVAQNPTAMDVDDEVDPLDAFMAGLEQTASGEESHSKADTLTEKKNGNIPPEAYFSDDDYGYEADGTDPTSILAMASKKKKKDIPTIDYSKLDLNPIRKNFWVEPYELSHMSEEELAELRLELDGIKVSGKNIPKPVQKWSQCGLTRPILDTIESLGFEKPTPIQMQALPVIMSGRDVIGVAKTGSGKTMAFALPMLRHVKDQDPVTGDDGAIALIMTPTRELCTQIYSDLQPFAKALKLRVVAAYGGNAIKDQIAELKRGAEIIVATPGRLIDLLAANGGRVTNLKRATYLVLDEADRMFDMGFEPQVMKIFNNVRPDRQTILFSATMPRIIDALTKKVLRDPVEITVGGRSVVAPEITQIVEVMDEGKKFNRLLELLGELYADDDDVRSLIFVERQEKADDLLRELLRRGYGCMSIHGGKDQEDRNSTISDFKKGVCPILIATSIAARGLDVKQLKLVINYDAPNHLEDYVHRAGRTGRAGNTGTAVTFITEEQENCASGIAKALEQSGQPVPDRLNEMRKAWKEKVKAGKAKDASGFGGKGLEKLDKDREAARMRERKTHKAEGEEDDVKEDAPAEDGEKKDKTKVAIQSAVSAIVSRDASKAETEDKHAIPAGAVKAGHHASSGKSGGALDKAASAISEINARLARAGQLRPGQPIDNKGPDAGAFHATLEINDFPQKARWAVTNRTNVAKILEATGTSITTKGNYYAPGKEPGPGQEPKLYILIEGDTEVVVGNALSELTRLLREGTMAAADAESRAPASGRYTI

SEQ ID NO: 3728 - protein, 384 aa, Neurospora crassa
LGSVMVIGGCGFLGHHVVRVLLRDYICSVSVIDLRCTRNRRPESDGVQYFEADITDPARLETIFNQVKPQVVIHTASPAAQSNDSVSHALFKKVNVDGTAAIIKACQQTGVTALVYTSSASVMSDNKSDLINADERWPVIRGAQQSEYYSETKVPSYFPSLPYPPRVMHPKTNLPLPPAAAEELVLQANRSAAAPSLLTCSIRPSGIMGEGDTMTLYHLIKLYQNGKTSVQVGDNDNLFDFTYVENVAHGHLLAAVALLQTSKLKIAPLDHERVDGEAFIITNDSPVYFWDFCRAVWNAAGSPHGTEHVWVLPRDVGIVLGFLSEVFFGIIRKPPTFNRQRIIYSCMTRYYDISKAKKRLGYKPLVPLDEAVKRSVKWTLEQQK

SEQ ID NO: 3729 - protein, 128 aa, Neurospora crassa
  unsure (1)..(128): unsure at all Xaa locations
EDGNPFVWLVTYFGKPMTNLDGGLFRIRLCFSARFPEEQPRARFETKIFHHRIAADGTPCYFAPQNRREDVRTHLEAIIDALEEESPPYDPRTLVNPEAFKLFWGSADDRKMYNRRLRRSVQQSMEXD

SEQ ID NO: 3730 - protein, 371 aa, Neurospora crassa
  unsure (1)..(371): unsure at all Xaa locations
RPKTLSDVTAQDHTITVLQRTLQASNVCQTCLFPLRVSLKSNLDSHXPVSSTLQLPHMLFYGPPGTGKTSTILALAKELYGPELIKSRVLELNASDERGISIVREKVKDFARMQLTNPSAAYKARYPCPPFKLIILDEADSMTQDAQSALRRTMETYSKITRFCLICNYVTRIIDPLASRCSKFRFKSLDQGNAKKRLEEIAQLEGVGLEEGAVDALIKCSEGDLRKAITYLQSAARLVGAVAATAKDGEQKETEGDDEMEVDAKLVTVKVVEDIAGVIPDDTIQRLLEAMRPRAGVDTYPAVAKVVEEMVADGWSAGQTMTQLYQAVVFDEMIPDVQKNKIVMVFSEVDKRLVDGADEHLSVLDLALRIS

SEQ ID NO: 3731 - protein, 1168 aa, Neurospora crassa
  unsure (1)..(1168): unsure at all Xaa locations
RWLSASAAAAAASQPAPDAKAYIQSGVVKPRDHVDVKKVLVIGSGGLAIGQAGEFDYSGTSNVLSTQXNQTQNKQTNKQTNSSADSTLPIQGSQALKALKEAGVASVLINPNIATIQTNHSLADEVYYLPVTPEYVEYVIQREKPDGIFLSFGGQTALNLGVQMQKLGLFEKYGVKVLGTSVRTLELSEDRDLFAKALEEINIPIAKSFAVNTVDEALDAANKIGYPIIVRAAYALGGLGSGFANNEEELRNMAARSLTLSPQILVEKSLKGWKEVEYEVVRDANNNCITVCNMENFDPLGIHTGDSIVVAPSQTLSDEEYHMLRSAAIKIVRHLGVVGECNVQYALQPDGLDYRVIEVNARLSRSSALASKATGYPLAYTAAKIGLGHSLPELPNAVTKTTTANFEPSLDYIVTKIPRWDLSKFQHVKRDIGSAMKSVGEVMAIGRTFEESFQKAIRQVDPRFVGFQGDKFEDLDFELQNPTDRRWLAVGQAMLHENYSVDRVHELSKIDKWFLYKLQNIVDCQKEMQQLGSLEALKKEHILKAKKLGFSDKQIAMAVNSTEDLVRAARKGFGIRPWVKKIDTLAAEFPADTNYLYTTYNASSHDVTFEDKGTVILGSGVYRIGSSVEFDWCAVSATQALRAMGEKTVMINYNPETYSTDFDTADKLYFEELSYERVMDIYELESASGVVVSVGGQLPQNIALRLQETGKARVLGTDPRDIDRAEDRQKFSEILDSIGVDQPAWKELTSVEEAEKFAEEVGYPVLVRPSYVLSGAAMTVIRSKEDLKDKLEAAANVSPEHPVVITKFIEGAQEIDVDGVASEGNLILHAVSEHVEQAGVHSGDATLVLPPANLDQTTMDRVKEIAQKVAKAWRITGPFNMQIIKAEDPEGGLPALKVIECNLRASRSFPFVSKVLGVNFIDAATKALVGKNVPEPTDLMAVKRDYLATKVPQFSWTRLAGADPFLGVEMASTGEMACFGKDLVDAYWASLQSAMNFRVPEPGEGLLFGGDLSKSWLTTIVDYLSPLGYKLYAADNEVKQFLESSAKTKIDVEVIAFPTNDKRALREVFAKNNIRGVFNLAQARGKTVFDVDYVMRRNAVDFGVPLFHGAPGKLHHXPFHPRXPKTNVSFFPXTAMLFAQCMAEKLPRPEGIPSEVRRWSEFIGGKPL

SEQ ID NO: 3732 - protein, 425 aa, Neurospora crassa
  unsure (1)..(425): unsure at all Xaa locations
LLDSPSRPPFPVSSPSLTTTTVTTTPRSTLTPVLISAPMVLSWSLRSFRAPLSSSMSXTARRSMPMRRRRASRRVIMSSLASSKPSFVAPPPVVSTSKASIPGGALFLELTSSMSTSTSTSTSTSSSTTSSIPTTSSSPIPSSTSSEPPAATSSAASENLSGGGLDSEFPSGKIRCDHFPSDYGALGVDWLNLSGWTTLAKVGKLMKGVAINNYEQPISGPCQPGMLCSYACPPGYQKTQWPEDSQGATGQSIGGLYCNNDGFLELTRASHPTLCEQGAGGVYVKNMLPKSAAICRTDYPGNEAMVIPLETNPGGQYPLTNPVSSSYYKWKGQSTTAQYYVNNMGIPVDDACTWNSKSCPDCAGNWAPVNVGVGKSDDGVTYISIFPNAPTTNAILNFDMEIQGDISGECWLKNGKYSGSNGCTV

SEQ ID NO: 3733 - protein, 439 aa, Neurospora crassa
  unsure (1)..(439): unsure at all Xaa locations
MATNGVNGAKHYNEGTFLFTVSLRRHSVYAHGRTIRXSDLYSSESVGEGHPDKIADQVSDAILDACLAEDPLSKVACETATKTGMIMVFGEITTKAKLDYQKVVRNAIKDIGYDDSSKGFDYKTCNLLVAIEEQSPDIAQGLHLDDRLENLGAGDQGIMFGYATDETPELFPLTLLFAHKLNAAMSAARRDGSLPWLRPDTKTQVTIEYKHDNGAVVPLRVDTVVVSAQHAPEITTEELRKEILEKIIKTTIPAKYLDEKTVYHVSTKPVNLTYFGGITDTLIPTTDQPSGLFVIGGPQGDAGLTGRKIIVDTYGGWGAHGGGAFSGKDFSKVDRSAAYVGRWIAKSLVAAGLARRALVQLSYAIGVAEPLSIYVDTYGTSDKTSEELVQIIRNNFDLRPGVIVKELDLAKPIYLQTAKNGHFGTNQSFSWEKPKALKF

SEQ ID NO: 3734 - protein, 564 aa, Neurospora crassa
  unsure (1)..(564): unsure at all Xaa locations
DSPCGPLPDRRAYIDPEQPDTNYLDLSSYRLLAKRVALGLQQAGLKEGDRVLLFSGNNIFFPSIFLGILMAGGIFTGANPSFVARELAYQLRDSEASFLVTAQGSLETAFQAAKEAGLPRDRIFVLGGDTPAAQEVVLSSNPGPGLKGRVAGARHWTELLQGNAKEAESWSWKEPKDPQTTTCCLNYSSGTTGVPKGVEISHYCYVANGVQVIHLNNLNPDWEERQKRARALCFLPLYHAYGQTYFVANMPRAGIPIYIMPSFDFVKMLEYVQRYRITSLTCVPPIVVALAKSPLTKKYDLSSVEGLGSGAAPLAKEVSDEAEKLFNGKFRLRQGWGMTETTCTCMSWDPLNKEPSSGVGEMMPNCSGKLMSLDGKVEITKAGERGEFWVTGPNLMRGYWRKPEATAETVVVDADGTRWLKTGDIAYFDAYKPGGIVHIVDRLKELIKVKGNQVAPAELEGLLLEHPEVADAAVIGVTINGEEVPRAYIVRQNPKSKITGQEIAGWMAGKVTRYKQLKGGVVFTDNIPKNPVSSDYIFXCCTYLGANAXLVQSGKILRRQLRDR

SEQ ID NO: 3735 - protein, 274 aa, Neurospora crassa
VGHPFDTIKVRLQTSDATRFSGPLQCLTQTIRNEGILGLYKGASPPLVGWMFMDSVMLGSLTVYRRLLRDNLFNPPWHPLHDPAKPLPSHGHGLAGILAGMTVSFIAAPVEHVKARLQIQYAARKEERMYKGPIDCLKKVYTHHGIRGVYHGLGATILFRSFFFFWWGTYDVFSRWMKQYTQMSTPAINFWAGGLSAQVFWLTSYPSDVVKQRFMTDNLGGGLGDGVRRFPRWRDAAVAVYRENGAKGYWRGFLPCFLRAFPANAMALLVFEGV

SEQ ID NO: 3736 - protein, 432 aa, Neurospora crassa
  unsure (1)..(432): unsure at all Xaa locations
QTITCKAAIAWGAGQELSYEDVEVAPPKAHEVRIQIKHTGVCHTGEFARTPRTLMARSVGLPCSSQSHXPKTWCDMQDAYTLSGKDPEGAFPVILGHEGAGIVESVGEGVTNVKPGDHVIALYTPECKECKFCKSGKTNLCGKIRATQGRGVMPDGTSRFRARGQDILHFMGTSTFSQYTVVADISVVAVNPEAPMDRTCLLGCGITTGYGAATITANVEKGSTVAIFGAGCVGLSVIQGAVANGASKIIAVDVNPSKEEWSRKFGATDFVNPSTLPEGQSVVDKLIELTDGGCDYTFDCTGNVKVMRAALEACHKGWGQSIIIGVAAAGQEISTRRKFFYPSTRSPASHYMLNNANVRSSYSVMLVTGRVWRGSAFGGVKGRSQLPGLVEDYLNGKIKVDELITHRKKLAEINNAFEVMHQGDCVRAVVDM

SEQ ID NO: 3737 - protein, 932 aa, Neurospora crassa
  unsure (1)..(932): unsure at all Xaa locations
RXTRGXPAYVTDDFQARSSDELSLTKGDRVELIERDDEFGDGWFLGKHLANGNSGLFPEGIHTPSYVXATEELHGKQLFRARLXLTSPYSLYASCTQAPFQQPVSPKTCSRAAGRNRXRANGKFHLFLRQLQQDWEIGRXNLTVKLLQASFSTRRPCTFVSQQXFANRGYWTPRRXQPRPHETLNVIDEHITDLNSPQSNGALRNTGDSGSEYSSHIGNRVSYIQGEETDEEEEGNHTRSEVESWSADQVAEYLFTVGVEKHHCEVFRDQEITGEVILGMDQTSLFIKAFDLGSVGRRLKTWQKIKNLQDEVNGEGPGSRVLSQSYGSEVGSDAQGKMRSRTNTLTGSTPRYSSNTSQSLSVQTKRSSETPKMDPVQPVSPVSPLMESPNRMFHERRPSAADIRDLHHSRRHSSTDFRLAGASPATPKVSGGTLHGTEVPHKKQPSFDRNWTLGSASNSNHPESSAGQQDNVAVQEPEIQDSAVDLDRGYLSGTDADPRQRNVLKKRESKAPALAESPKTSYTEEQRVRSATTLSRQSRLGSIDSSREAVGILPAAQKYYGLVRRTASTATMESARLSIERNHPTVTKLEGSPEQSRSSPRSALKRLSQSTTRTLIWPACXRTASAGYEPPQTRSRVPNEQKWRHQWTRRPKTSSIYSPTRTGSTTPSAGRSLDLDQETAKSLSTVATAASAAKQAANRKKTKKETSAYTRGLQKIGPRESIKDADYSGWMKKRSANLMTTWKPRLFVLKGRRLAYYYSEDDQEEKGLIDISFHRVLPADNERLTGFHATLMGASTSPAIPAGSHVQTLADADAERDPTEEGDQMFIFKLVPPRAGLSRAVNFTKPTVHYFAVPNIKQGRLWMAALMKATIDRDDTQAVTTTYQQKTISLTKARQMLHRPPALMNLVEASEDNAGDDKRGPAKEQNGLGISY

SEQ ID NO: 3738 - protein, 467 aa, Neurospora crassa
  unsure (1)..(467): unsure at all Xaa locations
LNIYERGEIVDYKDVYFCGTQNAAKVVGNVQSDLPNFGYDDERGDYSIIIGDHLAYRYEIIDVLGKGSFGQVVRCIDHKTGVLVAVKIIRNKKRFHQQALVEVNILQKLRRMGKFLVEDSSXPYFFVRXQVNFQDPKNKHSMVNFTHSFYFRGHLCISTELLDMNLYEFIKSNAFRGFSLKLIRRFTKQMLSSLLLLKQHKVIHCDLKPENILLRHPLHSEIKVIDFGSSCFENEKVYTYIQSRFYRSPEVILGMTYGLPIDMWSLGCILAELFTGVPIFPGENEQEQLACIMEVFGPPEKHLIEKSTRKKLFFDSSGKPRLTVSSKGRRRRPSSKTLQQVLKCDDQPFLDFIARCLRWDPDRRMKPEEAVRHEFITGQKTPPSSSMPVPRLASTRESSPSKRVQNLNGGPRPLPEPPAAAVTTRTSLRSGVVSSGMPQGPLKPTLASGMLPSSRKVSGVTASASGA

SEQ ID NO: 3739 - protein, 435 aa, Neurospora crassa
ITTISPTTGEPIITRNGISEEELVQLPETAFKAFQGWRTTKLEDRQIIVKKALKLLAEKQDELAEELTVQMGRPIAYTAKEVATAIKRSEYLLKISNDALKDTDGEEEKGFKRFIRKVPVGPVLIIFAWNVSGVHHVVLTLHPSPLTLRSYPYLILVNALIPALLSGNSVILKPSPQTPTIVEQVAKVFSEAGLPDGVIQYFHSGSPTVIETIVRNPKIANICFTGSVAGGLAVQKAASDRIVNVGLELGGKDPAYVRGDVDIAWAAEEIVDGAVFNSGQSCCSIERVYVDEKIHDEFIAAVQNVLKGYKLGDPLDKGTHLGPVISARSKETIQAHIKDALDKGAKNATPENETFSILPDKGNFVAPTLLTGVDHTMTVMKDETFGPVIPVMKVKSDAEAIQLMNDSEFGLTASIWTKDTAKGYELAEEVEAGTV

SEQ ID NO: 3740 - protein, 402 aa, Neurospora crassa
AVSAPGKVLLAGGYLVLDRNYTGLVFGLSARINVISRDIQASPGVHINEIIVRSPQFLKAEWRYGYHLADEDGGIKTIQLQGGASASAKGNPFVETTLNYALTYITRRAAYGTTQTLKPVTLTILADNDYYSSPTNNSNAAAGKGSGGSRFAAYSTTLEDAHKTGLGSSAALVTALTASLLSHYLDPSLFDLATDEGKRILHNLAQAAHCAAQGKVGSGFDVAAAVYGSSHYRRFSPSILSSLPEAGKPGFSAKLFSVVNGKDAESQWDTEVVKDAVSLPKGVAVRMCDVDCGSQTVGMVKQVLAWRAAQPKEAKELWDELQRRNEKLASVLKEGKTEEIRPAVHAIRELVRKMGTESGVPIEPDSQKELLDALEEGVEGVYGGVVPGAGGYDALALLVRDD

SEQ ID NO: 3741 - protein, 184 aa, Neurospora crassa
  unsure (1)..(184): unsure at all Xaa locations
QXIPTVFENYVTDCRVDGKSVQLALWDTAGQEDYERLRPLAYSKAHVILIGFSVDTPDSLDNVNTRWVVRATHRLSKSSNQTTNXDISQWVTEANERCPNVPIILVGLKKDLRGDPVAIEEMRKRSQRFVMEDEGQRIAKEIGARKYLECSSLTGEGVDDVFEAATRAALLTFEKKEGSGCCVI

SEQ ID NO: 3742 - protein, 1264 aa, Neurospora crassa
  unsure (1)..(1264): unsure at all Xaa locations
MLTTYNSHALHNAVRRSXVDQDELSSLRLSXLSKQIDSDEEDEPSESDATPVSRKPAKRRRVERSLPVSFHPSYSSAFCFTADLSXFPASKRGTPARQPSIDDSDSDTYGGAKARSFQRKVRRQQEQDPALAFSEKRWSSRRAAQVSAGAYQESDAEEDEEDDSELTPNYWSANVEDNSPYIEKILGHRPKEGVEVTVDSTRHDFEYFIKWQGQSYPHNTWETTETVAGFRGFRRLENYYKKVVEYELEMQFGGDDISPEQKEQWYLDREREQEALEDYTKVERVVAVRDGDEGTEYYIKWKGLQYDECTWEAESLVAELAQDKINQFLDRCNRSWQSDRKQTNPDTRSRMTKLEKQPDYIKGGELREFQMKGLNFLALNWVRGNNVILADEMGLGKTVQSVSFLSWLRNERGQEGPFLVVAPLSVIPAWCDTFNHWAPDLNYVVYLGPEAARSNIRDYELFVDGNPKKTKFNVLVTSYDYILADADHLKNIKWQVLAVDEAHRLKNRESQLYIKLNNFGVPCKVLITGTPIQNNLAELSALLDFLNPGKVVIDEELEALSTADNKGPTDEEQDEARRIRTQEKLRELHQSIAPFILRRTKETVESDLPPKTEKIIRVELSDVQLDYYKNILTRNYAALSDASNGHKQSLLNIMMELKKVSNHPYMFQGAEERVLNGSTRREDQIKGLITSSGKMMLLDQLLAKLRKDGHRVLIFSQMVKMLDILGDYLRVRGYQFQRLDGTIPAGPRRMAINHFNAEGSDDFCFLLSTRAGGLGINLMTADTVIIYDSDWNPQADLQAMARAHRIGQKRPVNVYRLVAKQTIEEEVVKRARNKLFLEYLTIQAGVTDEGKALKEQFKERGLKMDEAKTAEDISMILKMRSQNLFEQSSNQQKLEQLDIDAILENAEVTKTDVDDKINLSSGGIDWDNWMQVTDVKVDDLALDWDQIIPAEQLAAIKAEENRKKEEEYLAKTIEENAPRKAALKGSKKSAENDRAERLAKKRQREREEQEELEEQRALLSDPKRPLNEKETRNLIRAFFRYGSLDDREEEVVQDARLSDRDRDFLKSIIEDLVVISRRAVDANNERLREEEARAGKPLAKKDKKAVLVDFGEVRKVNAETVVERPPQLKLLRRVLREHADILSFRLPEASKAAAYTCDWGAREDAMLLIGIDRYGFGAWTQIRDDPELQMHDKFFLEEHRVDKREERKKTEAVGIQSPGAVHLVRRSEYLLSVLLAKHSNDAALRRQWRTTIGARSFSRTTAID

SEQ ID NO: 3743 - protein, 983 aa, Neurospora crassa
ATMASLKRSFESDPFAQNISSKVYVRSTKSGKVQKIVREVYLRQDIPCSSKLCNACLKIAPRDAANRPIPFVLSEKPAGTSVFTQGHYIVPDTNAFLSAMDLFEQSSAFYDVIVLQVVLEEVRARSLPLYNRLVSLTKSEDKRFYVFFNEFRLETYVTREENESVNDRNDRAVRKAVKWYNEHLSKTSKKAPAVVMLSNDRDNLRKAKEDDIPAYSLANYVSQLKDGEQLLDMIPELEERDALIEKKPGQFLYPEHYTLSKMNTGVKNGLLHQGIFNVSPYNYLEGSIRVPAFPKALLILGRENINRAVDGDLVVVEVLPKDQWKQPSTQVIEEEAVTMNENPTEEGSDLISEKERKVLQEEAKRTLAKTTEGHALPTAKVVGVIKRNWRQYVGHIDQSSVSSSAAQGRKQDSVFVIPMDKKIPKIRLRTRQVAELLGKRILVTIDAWDRTSRHPTGHFVRSLGELETKAAETEALLLEYDVQYRPFPKTVLDCLPKEGHDWKVPASMDDPGWRDRQDLRDLLICSIDPIGCQDIDDALHARALPNGNFEVGVHIADVSHFVKPNNAMDTEASIRGTTVYLVDKRIDMLPMLLGTDLCSLKPYVERYAFSVIWEMNSNADIVGSRFTKSVIKSREAFSYEQAQLRIDDASQQDELTNSIRTLLELSKKLKQKRLDAGALSLSSPEIKVHMESETSDPIDVKTKEHLPTMSLVEEFMLLANTSVAAKIYEAFPQTAILRRHAAPPKTNFDELANQLRVKKGLDLSVESSRALADSLDLCVDPKEPFFNTLIRIMATRCMMSAEYFCSGTQSYPEFRHYGLASEIYTHFTSPIRRYADLVAHRQLAAAIEYEAVHPAVRSRGRLEAVCKNINVRHRNAQLAGRASIAYYVGQALRGKATEEDGFVMKIFSNGFVVLVPKFGIESLIRLRDLAEPEPAATYDAETYTLTTSGSREVKVELFQKVRVRVTDQKDETTGKRGVKMELV

SEQ ID NO: 3744 - protein, 986 aa, Neurospora crassa
SRYVESHSGSVPSLVPGSLTSSLPLANGSSSRRGASSETYANGTPSRPQRPTAPARTPSNTYQPYNQRRPPQGQPSSYMANNPHARDGSRPRPLAGTSTFRAQEREYVRRLRQQDYNNDYFDAYGSGEQYDSDSEGETPSSEGAFDSYDDAHIMFASNEDIQITEEDLRDPESRERLEWHGMLEAVLTGDVVRQEKKRLIGSNDEAFGKSAHNVELWLGIRARLCGRHLPVQKRVVEDARAALDRSINDIINFAIAGESEAGKPPFEQVRDVVNKIERIESLYPSSRELMTALKPGVYSAYQETCDAVISWYNVNEMINTELSILKKWVGNDALDFSRTKEKSPSGNGLSDESSFLDRLMKEEGLKSLHEDKGSEPKSLKKKSRLDGISRVITKAKDTLIQNAEGFQKRHLPPYIEELLTLISFPSRLIEEIIKMRLAYAKKMKDSAQQNPMMQDQMISQFQVLLKLAIKIKREYMEIARPEPGWDLPPCIDEDFDRVILEALKYYFKLLNWKLSGNKNTFKEAELLFQEWGFGNEIGRYLAHGDVEVAEQFSSLTYKAWNRLSQTFEKEVQRRPKESVPEMTKRYKQILDSVRVRQRMLQRFSRMLNDNYENACDYTIAFEQPQMLHQLYDRLIETGHFQVYSASPEHKDILIIASPTLHNRDDEIQVLMGTFTYEAAIEDPSDPYLLIIKAEDPPQWLGPVHTLRVRNEPLDIKLGHMRLIAGGCQPRLLNARKAFVDRIDMQVDPVVEQRSNLQKVNFRLMEIRKVAFKLSNAFMDSVEAIRRQTRGLNCQELIQTCFIFATEFGQRSLLYMDNNRRTMNNLKLTKLALDWVSFICDDCISSDRKTFRWAVQALEFAMGMTRGRHILGLGEDEYARLRAKVAGCMALLISHFDIMGARSSVAAQAEKKRLEGLVNQIKRLNKGQMLDDNEAAKYYQEHRLEELAKVDNYRKEILLQQSAMGRVLEASNEVDRSLAWLSSTATN

SEQ ID NO: 3745 - protein, 552 aa, Neurospora crassa
  unsure (1)..(552): unsure at all Xaa locations
QHYAKGSESRHKLTEAYTALSKNLPVDVPINIRGRTVSVCPKMSIHPKPSANHRPXTQLSKADTKYQVNPADHQQKIANYAVATPEMVNLAINAALNAKPAWESLPFADRAAVFLKAADLISTKYRYELMAATMLGQGKNAWQAEIDAAAELCDFLRFNVQYAEQLYAQQPAHNSPGVWNRVEYRPLEGFVYAVTPFNFTAIAGNLPGVAALLGNVVVWKPSDSAILSNYLLYKVLLEAGLPPDVIQFIPGDPELVTKEVLAHKDFAALHYTGSTAVFRKLYGQIGAGVAEGRYRSYPRIVGETGGKNFHLVHKSADLRNAVVQTVRGAFEYQGQKCSATSRLYVAKSIWPDFQELLVQETEKLKVGPPHDHGNFMGPVIHAASFKKLSTAIDEGKKDPDLQLIAGGEYDSSVGYYVKPTIFVSKTPDHKLFSTELFGPVLTVYVYDDYVDSTTSIYDIIDGATEYGLTGSIFASDRSVIRFAEEKLRNSAGNFYINCKSTGAVVGQQPFGGSRASGTNDKAGSINLLSRFVSMRSIKEEFNSTTTVTYPSN

SEQ ID NO: 3746 - protein, 481 aa, Neurospora crassa
  unsure (1)..(481): unsure at all Xaa locations
HVRTYADQVIKVPQMAESISEGTLKQWNKKVGDYVEQDEEIATIETDKVCTTLPXSRAGVGAXTAWSTCCLPPCPASFYGHSSPAAHIFAFXLLLPLGSRIDVAVNAPEAGTIKEFLVNEEDTVTVGQDIVRLELGGAPKEGGAEKPAASESKEAAPKDSAPAPEKAPEPKKETKPAAAPAPTPAKKETPAPKQESTPAKEAPAALGNREERRVSXTAPEQTEWXIGQTNTLQVKMNRMRLRIAERLKQSQNTAASLTTFNEVDMSGLMDFRKQYKDEILKKTGVKLGFMSAFSRACVLAMRDIPAVNASIEGPNGGDTIVYRDYVDISVAVATEKGLVTPVVRNVEAMDLVGIEKSIADMGKKVTASRAYGVLILPYXLLSQARDGKLTIEDMAGGTFTISNGGVFGSLMGTPIINLPQSAVLGLHAIKERPVAVNGKVEIRPMMYLALTYDHRLLDGREAVQFLVKVKEYIEDPRKMLL

SEQ ID NO: 3747 - protein, 571 aa, Neurospora crassa
  unsure (1)..(571): unsure at all Xaa locations
QKWRCSAVELKDNTVIVVLGASGDLAKKKTVSSCLPLGYFIWQSADVQLYPALFGLVCMPSSRSPPIEELMLLLXYRNQFLPKDIRIVGYARTKMDHDEYIRRIKSYIKTPTKESEQQLEEFCSICTYVSGQYDRDDSFLQLNKHLEELEQGRKENNRLFYMALPPSVFTIVSQHLKKCCYPSRGVARVIVSHXSYPLLLSPCLTLQQXVEKPFGKDLASSRELQKSLEPDWKEEEIFRIDHYLGKEMVKNILILRFGNSFLGATWNRHHIDNVQITFKEPFGTEGRGGYFDEFGIIRDVMQNHLLQVLTLLAMERPISFSAEDIRDEKVRVLRAIPAIEPKNVIIGQYGKSLDGSKPAYKEDDTVPKDSRCPTFCALVAYIKNERWDGVPFIMKAGKALNEQKTEIRVQFKDVTSGIFKDIPRNELVMRIQPNESVYIKMNSKLPGLSMQTVVTELDLTYRRRFSDLKIPEAYESLILDCLKGDHSNFVRDDELDASWRIFTPLLHYLDDNKEIIPMEYPYGMXSPRCSMEXYSVLTSSRFRGPAVLDDFTASYGYKFSDAAGYQWPTTS

SEQ ID NO: 3748 - protein, 477 aa, Neurospora crassa
LLAVSLVALLEPVSAIWPAPQSFTKGNSSLYLHPKINVTYNGEPVRRPTSSSSSSSFFLSSSNNVGGSAGPGYEGLFTKTPAQQQLVYKEDYFASSLSSKEIVHAGVSRALGSIFSRNIVPWMLQPRGKLSEFEPDLYKGQNWIKSLEIDQTAKDAKTAFKPALAGEVSEAYSLTLSVEGDVKLTADSYIGVLHGLETFTQLFYQHSTGTSWYTPYAPVEIKDEPKYPHRGILLDVARTFMPVKNILRTIDGMATSKLNRLHVHVTDSQSWPLQIISMPEVAEKGAYHSSQTYSPADIDLIQKYGALRGVQVYFEIDMPGHIGSLSLSHPDLIVAYDQWPYQWYCVEPPCGAFKLNDTKVDDFLGKLWDDLLPRVAPYSAYFHTGGDELNRNDSMLDDGIKSNDTEVLRPLLQRFVDKQHERIRKEGLTPLTWEEIPIEWNVNLGKDVVVQTWLGQSSVKNLTSRGHKVIDSNYNFW

SEQ ID NO: 3749 - protein, 492 aa, Neurospora crassa
  unsure (1)..(492): unsure at all Xaa locations
WQQMFRSIGGYTGEVRLVGHRIIFTSEPENMKAILATQFEDYGKGEGFHQEWKDFLGDSIFTTDGDLWHASRQLIRPQFIKNRVSDLQCFENHMQMLFRTIANGGALNGEDQMVDMEAGNGKPVDISDLFFRYTLDAATDFLLGKDIKSLRFVLPNASFPICXNATENSTPVQPFADAFQEVQRVQIVIARAGPLNRFVPKKTFWEGLKVIDETINFYIDRALRLDEEELASKSKGDEGYTFLHALAGFTKNRQVLHDQLMAVLLAGRDTTACTLSWAIYELARHPEAVAKLRAEILSVVGPDRAPTYDDLKSMKYLQNVMNETLRLYPVVPFKQVPETSFSTRSCFLTFFIVYSVRMALKDTTLPRGGGPDGSQPIVILKDTPVGYSPLAMQRRPDLYPPVSEKFPDVEMFSPDRWFHWQPKPWQYIPFNGGPRICIGQQFALTEMGYVLTRLFQRYDRVVSYMDEIDGGKPRMKTDIVLMPGDGVKVAFF

SEQ ID NO: 3750 - protein, 957 aa, Neurospora crassa
  unsure (1)..(957): unsure at all Xaa locations
KADDRAMDAADSKVHMAPVGVSIRNGPVDQDRMDVDSSVSGQAKRKSRTSIDQSINYKDDSSDDEAPLVSFPVFAAWYPCLVCGXPGQAKRSKTQHKQPDSDSDDEPIAKKNGARLPPSAKNTDMDVDSDDDEPLGKIAAKKANIEKEAAKEAKSIRAGTKAKKPAAKKAVKDESSDDEPLAKPTKRQVNGTAAKKTNGVKKEESDSDVPIAKRAKKAPAAKPAAKPAAKPAAKAATKAAPKGKVAAVKKSVKEESKDITDEDDEEEEYKWWEESAKKEDDSIKWTTLEHNGVIFPEDYQRLPKDVKLLYDGTPVELDIEAEEAATFFGFMLNSTVNVENPTFQKNFFRDFKEILDRTGGAKDKNGKKVDIKEFEKLDFSQLWAYKDAQTKAKNARSSAEKKAEKAERDKRDAPYLYCKWDGRKEKVGNPRVEIPGLFRGRGDHPKTGCIKKRVLPEQITINIGKEAKVPEPPAGHKWKAVQHDNKATWLAMWQENINGHYKYVMLAANSTVKGKADFKKFEKARELKKYIDRIRADYTKDLKSEVMADRQRATAMYLIDKFALRAGNEKDTENEAETVGCCSLKYEHVTLREPNTVIFDFLGKDSIRFYNEFTVDRQVFKNLKMFKKPPKEDGDDIFDRLTVGLILPTLQYLEVCXRAVQTTQLNKHLSSYMPGLTAKVFRTYNASYTMSKLLQELKVTNATVHEKVKLYNDCNRQVAILCNHKRTVGASHEQQMKKLVEQIKGLRYQKWRTKMMMLDLDPKLKKKKGAAYFELDEDLTEEWVKSHQEFLVEDQKAKINKKFEKDNEKRIADGEKPLPASELKERLKAASELEAKFKKENKTKKVEAEGKGPSVEKLEAALEKLDQRIKNLELQSADREGNKEVALGTSKIVSWMGFPSTCIVGCXLSTTNYIDPRLTVVFSAKFNVPIEKFFSKTLREKFKWAIESVGNDSTWEF

SEQ ID NO: 3751 - protein, 317 aa, Neurospora crassa
  unsure (1)..(317): unsure at all Xaa locations
FATLREIETRLKSIRNIEKITNTMKIVASTKLNRAQRAMTESRGYGATSNEVFTSAETKPLEAEGKKKLVVVCSSDKGLCGGVHSGLARFIRRRAATEPEFDIVIIGEKAKAQLSRTNAKDIVLNFSGVGKDIPTFVEASAIADQITQLKGDYSSVEIVYNKFINATSYEPTVIEAFSEDAILASRTSCRPPXCPSRFSQLTKLYPANFSAFEVDEEVLGNLREYALANSLYWALCEGHACEISARRNAMDVSSPPVPCHLFEVDSGQAADVNSLTPYPNASKNAGEMISKYQILFNRTRQAVITGELVEIITGATA

SEQ ID NO: 3752 - protein, 454 aa, Neurospora crassa
  unsure (1)..(454): unsure at all Xaa locations
RSKYSFGRTLGAGTYGIVREASGPTGRVAVKIILKKNVKGNEQMVLDELEMLQRLKHPHIVKFVDWFESRVCRIATGLGWLRRDXLRFLXDKYYIVTQLATGGELFDRICEQGKFTEKDASQTIKQVLGAVNYLHENNVVHRGXWRPYLSISXTPDLTLTSQDLKPENLLYLTRDADSDLVLADFGIAKMLDNKDEVLTTMAGSFGYAAPEVMLKQGHGKPVDMWSMGVITYTLLCGYSPFRSENLQDLIDECSSGSVVFHERYWKDVSNDAKDFILRLLQPKPENRWTSQVRLSHVMLCXSDVLKYGYXHLAPINXQALAHPWLRGDSATNHNLLPEIKAYLTKARLRRGIEMVKLANRIEALKMQEDDPENTDMPGDATLAADQAQSRHRALSLASTKGGSSDAENATAPAEKRTLSKTIKTAIFREVVLAKVREMKEAEEANKLKEEAETK

SEQ ID NO: 3753 - protein, 593 aa, Neurospora crassa
  unsure (1)..(593): unsure at all Xaa locations
SGLDVNLAMIPPNHKFLDPRLLEAEAIGLLDRMLGGLQDNSRYVRAAFPRLITSXPLVPLSCTVMLXLXMPLSTLCPFSSRTRPATSSRITNAVLNFNPLKLANSPMTPKNKVLVKSMTKTTQMLLKHLFVRXEMSSYRLCFSCXLGQGILIIRXRHASINNTRDFSVLVWTFLMRRTASGLFLSRLLQVMVMXRGRRLKESHRSLHFAFNHLHQGPHTLAEVFSLTNNTGLQGFDVTVVPTSLTARINVRTLASLDQGQLDMAINVRLRQFLDRGNYANTAIGSSXPIDCFVCCSTCRSTSPGTGHRNSDGATSFGXAETVALGVEEDDDAYEPDFYAAEDTEQILNKLDNAPPEESPEQNAKPDSALALGPFRLPPPPVLNPDTAVKVSQITAMRIFGPLSGLEDPLVRKPKAGLNRLAANSHDRDSWLTLITRLATRSTIGLGDGVKSEADATSSALGRPQMSLGNLIREMLFNYVLEDWRRRIEVAVAWCCEEWYNDRLTILNKLDGPLNYERCALRLMDGFLSYITAQDKVLTRFLSEIPQLSKELLGRLKGLCSDPTTVQLAMTSLLYLVMMKPPARELALDTVYEI

SEQ ID NO: 3754 - protein, 607 aa, Neurospora crassa
  unsure (1)..(607): unsure at all Xaa locations
QVVHIHLGQAGTQLGNSAWELXVLNTPLCFFFSFFFFGVTFSNTSALLAYLLEHGLTQDGRKDPDSTVAGEGGSYDTFFTESSNGKYVPRSLFVDLDPSPIDEIRTGPYRQLFHPELLISGKEDAANNYARGHYTVGKEMAENVLDRIRKITGRLSSVRLGRVICFXPGMDRNCHSLQGFLVFHSFGGGTGSGFGALVLERLAQDYAKKCKLELVLSSLPPMVPIGHLYGXLGLVQNVGILTFKPCWVFRRWCLNSLNVRPSRRKKENLLGDSAAFGTRPICPSAFGRSLLLTVSSVRFSVYPAPRVATAVVEPYNAVLATHSTLEHSDVTFLVDNEAVYDICRRNLDIPRPSYEHLNRLIAQVVSSITSSLRFDGALNVDLNEFQTNLVPFPRVHYPLISYAPVISATKSAHESFKTSELTLQCKWNLSVLISRSIAIPDTDIFCEXASSPNNQMVVCDPRNGKYMAVALLYRGDVVPRDTSAAVAALKAKSSFNLVEWCPTGFKIGINHQKPMSVPTASPADGGLASVDRSVSMLSNTTAIAEAWSRLDHKFDLMYSKRAFVHWYVGEGMEEGEFSEAREDLASLEKDYEEVAGDYNDVDVDAEY

SEQ ID NO: 3755 - protein, 264 aa, Neurospora crassa
  unsure (1)..(264): unsure at all Xaa locations
YDYLFKLLLIGDSGVGKSCLLLRFADDTYTESYISTIGVDFVRPAILPAQHMRSTPINMLTVWLKIRTIELDGKTVKLQIVSNPPALLDTLEIQIRXPSRLFSGDTAGQERFRTITSSYYRGAHGICVVYDVTDMDSFNNVKQWLQEIDRYATEGVNKLLVGNKSDMTDKKVVEYTVAKVHSHPXPSCLSHILTHQPTGVADSLGIPFLETSAKNASNVEQAFLTMARQIKERMGSSIATNNTKASVNVSPGHGVSNNSSGGCC

SEQ ID NO: 3756 - protein, 900 aa, Neurospora crassa
MTTLIASRPRSRPAHPPGATYCAYTPDGTRLVTVGSNNTTRLYKTGYEGEPTNIDDCQEQNLALATSNNYFVAGSEDGTVSLYSLDTNAFDRFLLRTSLPVRDVAISPDHQWCAVASDELTVRLVGVHDNTQLRTLKEHGKPTKHLTFDPKGSLLALSCTDGVIYIYSLTAEHPELIRKVDGVIGRLETESEASSRAVWHPDGRAFAAPTPTRDIQVISKNDWEKQRVFKSGHDGDITALSWSPNGALLASAGKDKKLLIWSTKDQSVIARYEYPNVTDICWHPTKNLASFTTSDGELYISPDFVPEQFASLLRLPKQPAPFIHDPLTELSNNTRRLEVSGPKPDARPRRDSVDADLDDLLDENYGDDDDFVVDDDGAGYTLNAGRKRPAEDDAIYESHTAKRGNFVQPQHHPSFQPGSTPWRGNRKYLCLNLIGFVWTVDQDSHNTVTVEFYDHEFHRDFHFTDTFLYDKACLNDKGSLFSCPPKEDGSPAVVFYRPHETWTQRNDWRIQLPKGEAVLAMSLSDSYITVTTTGNYVRIYTLFGIPVRVYRPKSTPMVTCASWRDYVLTMGNGPVGADGMSRLLYTIENIKRDEVCQNEDTVALPEGATVKSVFFSDNGVRLRPSLPLPLYLTHPLTSGPDPCIYDSTGTLLTLLHWRRPSRAVWVPLLDTRLLPRLASGRKKESYFPIAVADHKFHCIILKGGDQYPYFPRPLLSEFDFAVPLTSAKPKKQSKKKKTRSGDDSMDVDGEDEEDNDFSASEADDSDSENNADPLTTKESLPLTQSFLLSSLRAAQLSDMLESSRSTASQRAALARLELDIDKTLLQLLAIECREGEDRGMRALEVVKLMKDRTGRMIEAAGKVAERYGRRILGEKIREVGERRVAGEDESEGEEEEDPFA

SEQ ID NO: 3757 - protein, 572 aa, Neurospora crassa
  unsure (1)..(572): unsure at all Xaa locations
PRIRYNTVGGVNGPLVILDQCWSTTTSLRRHGHVXQRPQVKFPRYNEIVTLTLPDGTQRSGQVLEARGVFPSRHISCASLXSTADSHDALQETAPSSRXITATQVGRHANNALISXTVFEGTSGIDVKKVRQISTRDXRTRNXPGTTDQVEFTGESLKLGVSEDMLGRIFDGSGRAIDKGPKVLAEEYLDINGSPINPYARVSTLVAELPRPGTLCXQDIGIPSEMISTGISAIDTMNSIARGQKIPIFSAAGLPHNEIAAQICRQAGLVQRQGITNKGVHDGHEENFSIVFGAMGVNLETARFFTRDFEENGSLGRTTLFLNLANDPTIERIITPRLALTTAEYYAYQLEKHVLVILTDLSSYCDALREVSAAREEVPGRRGFPGYMYTDLSTIYERAGRVAGRNGSITQIPILTMPNDDITHPIPDLTGYITEGQIFVDRGLHNRGIYPPINVLPSLSRLMKSAIGEGMTRKDHGDVSNQLYAKYAIGRDAAAMKAVVGEEALSNEDKLSLEFLDKFERSFIAQGPYESRTIFESLDLAWSLLRIYRKDMLNRIPKKIIDEFYSRSAADR

SEQ ID NO: 3758 - protein, 243 aa, Neurospora crassa
QVDSASAYRNEAGCGAAILRSTIPRSEIFFTSKVGPKHISYNAAKRIISESLAKTGLGYIDLMLLHAPYGGSVHRKGAWLALVEAVEEGKIRSIGVSNYGVHHLDELEQHIKELEQERGGSGKGGVLSVGQWEVHPWCPRQDIVEWCRKRNVVVEAYAPIVRGERFGEPRLKSLAEKYGKTEAQVLVRWSLQKGYVPLPKSVKAERIKENADVYDFDLSEEEVKALETDEYSPVCWDPTTSEL

SEQ ID NO: 3759 - protein, 978 aa, Neurospora crassa
  unsure (1)..(978): unsure at all Xaa locations
RYVGAFGVEGWATRSGTGLLRHGDSVKIERQKIQPPTVARKGQTKPGTPQSIPRVSAAAAKRVDVIVRFNDASGRELGRLAKDTANWVSTLIDQNICRFEGICVYAPERLRTNETVFLQLKCYMLRSAFLGRTLQLADNRAAGFHEKDETTEEKDLRLRQVALVRLFQEINIVPSRGNAAAAKDARKDLLEAADSAEKKAMDKAKAGDHNTNGLASPPEEAEEGQELEQDQLDALYKKAQSFDFSTPEAEPANTFAMTLRPYQKQSLYWMLAKEKNQRTEDRETSMHPLWEEYVWPTKDHDDKDLPVVPDQPCFYVNPYSGDLSLDFPKQEQHCLGGILADEMGLGGFAFYIFLFSLTXYPAHSHVSQGKTIQMLSLIHSHRSEVAIKAREAGPTSVNNLPRLPTVSGQKTTIDAPCTTLVVAPMSLLAQWQSEAENASKEGTFKTMMYYGAEKNVDLVTMCCEANAANAPDVIITSYGVVLSEFTQLATKNGDRLSSRGLFSLNFFRVILDEAHNIKNRQAKTSRACYEIAAEHRWVLTGTPIVNRLEDLFSLVRFLRVEPWNNFSFWRTFITVPFESKNFVRALDVVQTVLEPLVMRRTKDMKTPDGQFLVPLPPKHIEIVDIELSEPERAVYDYVFNRAKRTLFDNMQAGTVMKAFTSIFAQILRLRQSCCHPVLVRNQEILADEEEANMAADVAAGLADDMDLQTLIERFTATTDDASKTNNNFGAHVLRQIRDEAVNECPICAEEPMIDQAVTGCWHSACKKCLLDYIKHQTDRNEVPRCFQCREHINIRDIFEVIRHDDDLETSSTPGASPEPRISLQRVGANDSSAKIVALISHLRTLRQEHPKMKSLVISQFTSFLSLISSALTRHKISFLRLDGSMSQKARAAVLTEFQSTNKFCVLLLSLKAGGVGLNLTSAKRVYMMDPWWSFAVEAQAIDRVHRMGQEDEVRVYRFIVKQSVEMRMLRVQERKKFM

SEQ ID NO: 3760 - protein, 573 aa, Neurospora crassa
  unsure (1)..(573): unsure at all Xaa locations
LDEGHGESVFDIGFENHGESLKLTKEDWEVAYKRLSQAAAQIDADCQLLLTKNLGGDLDGTPTRDGDVSGKVMIRRRPSAAEEVIETRIAVVGNVDAGKSSMLGVLVKGDLDDGRGRARVNLFRHKHEIETGRTSSVGMEIMGFDSHGQTILSDTPGRKLSWEEIGKRSAKVITFTDLAGHERYLRTTVFGLLSSSPNYCLLMVAANNGLIGMSKEHLGIALALNVPIMVVITKIDICPPNILEQTITQITRILKSPGARKIPIFIKNHEECINTATQFVSQRICPIFQVSNVTGENLSLVRSFLNILPHHGRYDADAPFEFHVNDTFSVPHVGTVVSGIVKSGVIHAGDEVYLGPDGLGKFTTTAIRSIERKRIGVPAASAGQSASFALKRVKRKDVRKGMVVLSKTESGPPKVYREFIAEVSKHSASFCLYFPLPLGAIQKILYVSXRALVLILSHATTIKTKYQAMLHVGPVSQTCAIIDVDRPFIRTGDRATVAFRFVQRPEYLVPGDRLLFREGRTKGLGIVKSVGYDPERPLGGVNVGEGGDKVAAGVEDVKHEGGGNEVKVGAXXP

SEQ ID NO: 3761 - protein, 302 aa, Neurospora crassa
ICLLIAHPDDEAMFFAPTVLALTRPETGNHIKILCLSSGKCSYSVHPTFAHLFLPSHQQLLTSPEQQGDAEGLGPTRKRELATSGTYLGLRSPSDVFVIDSPFFPDSMTTSWDPERISHLLASAFAPELKETTNIASASASRSSKNKGGAGKAEVKATIDTIITFDKHGISGHPNHISLYHGARLFVSQLLAATAGKNKEKGQGQVDLYTLPTLSLPRKYSGILDALPTLLEWAWSAGITKKDKHERPGGLVFMNNLIPGEGWASVDKAWAAMTKAHVSQMRWFRYGWIGLSRYMYVNSLFR

SEQ ID NO: 3762 - protein, 429 aa, Neurospora crassa
  unsure (1)..(429): unsure at all Xaa locations
PDIKTIRDAIPDHCFRPRVWISMAYFIRDFAMAFGLGYLAWQYIPLIASTPLRYGAWALYGYLQGLVCTGIWILAHECGHGAFSRHTWFNNVMGWIGHSFLLVPYFSWKFSHHRHHRFTGHMEKDMAFVPATEADRNQRKLANLYMDKETAEMFEDVPIVQLVKLIAHQLAGWQMYLLFNVSAGKGSKQWETGKGGMGWLRVSHFEPSSAVFRNSEAIYIALSDLGLMIMGYILYQAAQVVGWQMVGLLYFQQYFWVHHWLGKLSLAHFASVWWFLXSLWNXRTNSRSLSKQVAITYLHHTHEEVHHFDADSWTFVKGALATVDRDFGFIGKHLFHNIIDHHVVHHLFPXVFRSDIPAIFSFKTIPSMSLANAPNPAQRIPFYYAEEATNSIRPMLGPLYHRDDRSFMGQLWYNFTHCKWVVPDPQVPG

SEQ ID NO: 3763 - protein, 593 aa, Neurospora crassa
  unsure (1)..(593): unsure at all Xaa locations
VMRRRHDDWVNATHILKAAGFDKPARTRILEREVQKDTHEKIQGGYGRYQGAKLMSRSLXTSRPLLIIPLARTWIPLEQAEALARRNNIYERLKPIFEFQPGNESPPPAPRHASKPKAPKVKPAVPTWGSKSAKNANPPQPGTFLPPGRKGLPAQAPDYNDADTHMHDDDTPDNLTVASASYMAEDDRYDHSHFSTGHRKRKRDELIEDMTEQQHAVYGDELLDYFLLSRNEQPAVRPDPPPNFKPDWPIDNERHTCLHWASAMGDVDVMRQLKKFGASLDAQNVRGETPFMRAVNFTNCFEKQTFPQVMKELFSTIDCRDLSGCTVIHHAAVMKIGRVNSQSCSRYYLDIILNRLQETHHPEFVQQLLDAQDNDGNTAVHLAAMRDARKCIRALLGRGASTDIPNKQGIRAEELIKELNASISKSRSNLPQRSSSPFAPDTQRHDAFHEAISESMVTSRKNSQPNYSSDAANTVQNRITPLVLQKLKDLTATYDSEFKEKDDAEKEARRILNKTQSELKALTASIDDYNSRLDTDDVAAKTAAEMATARHKVLAFVTHQNRISVQEAVKQELAALDRANAVTNGTSTKSKSS

SEQ ID NO: 3764 - protein, 225 aa, Neurospora crassa
MPFPYKTVLITGATSGIGLALAERMINSGVFVIAVGRRKDRLDALVKQHGSDKVAAEPFDISDLSALPNWVKQYVPIPIPSLPSYPPTNIYQITTTYPTLDSILLNAGLQKTLLFTNPTAIDLAAHTTELTTNYLSPLNMIALFMPHLISLAPNPTSIIVVTSGLSVIPLPRCANYSASKAAAHSLVWSLRAQLTGPEAEHTKHIKVVEIMPPAVKTELHTIQPD

SEQ ID NO: 3765 - protein, 270 aa, Neurospora crassa
  unsure (1)..(270): unsure at all Xaa locations
ARLRPSVVPRVLPALSTVASPRYSSGVPSEDPKTKAQSIIDSLPGSNLMSKTAILSSAAGLSIYALSNEYYVVNEETVVAFCLLSVWGGLIKFGGPLYKKWADEQSDKIKNILNSARADHTQAVKTRIGDVKQMSGVIDITKTLFAVSKVGATRMGIGIHGMQMVQQVEGXHDWEEXCXGNKGKDRGXHGFXETAKLEAEAYELEQRTALAAEAKTVLDSWVRYESQVKQRQQKELAQTVIAKVQKELENPKVLKQILEQSVADVESMFS

SEQ ID NO: 3766 - protein, 420 aa, Neurospora crassa
LSMASLSVHADDYINNHQAVAPPMHVSTTFRYAENPDDLKPWENLNVCLLLSLLTFSSNIEKDPQSQNLTNTQQKHSPMPPMTPTIYSRDSAPNSTRLEAILTSLLGAPALTYASGLSAFHAMIVFLNPKRVAIGGGYHGCHGILKLMKKLNGLEKLELESDADLAKLQPGDVIHVETPLNPTGEARDLAYYRRKADELGCYLTVDATFAPPPLQDPFQLGVDIVMHSGTKYFGGHSDMLCGVLAFRPDKAQEWLPALLEERLYLGAVLGSLEGWLGVRSLRTFELRIKRQAESAQKLVDWLVEEKAKEGSLVSEFVTRIQHASQQPEAKEEGSWLRKQMPGGFGPVFSIYLKSEQQAKRLPSKLHLFHHATSLGGVESLIEWRAMSDLDIDKRLLRISVGVESWDDLRDDLIQGLEALK

SEQ ID NO: 3767 - protein, 1500 aa, Neurospora crassa
  unsure (1)..(1500): unsure at all Xaa locations
EDFSGKKYVWLKDPQAAFVKGWVVEELPENKLLVQCDDGSVSIASLXYVLRRNVQPTDXLAXXQREVDAETVDKVNPAKFDKANDMAELTHLNEASVVHNLHTRYQSDLIYTYSGLFLVAVNPYCPLPIYTNEYINMYKGRNREDNKPHIFAMADEAFRNLVDEHENQSILVTGESGAGKTENTKKVIQYLAAVAHPDPSGRTRGSQHSNLSAQILRANPILEAFGNAQTVRNNNSSRFGKFIRIEFSSNGSIAGAFIDWYLLEKSRVVHVNANERNYHIFYQLLKGADRKLKQELLLDSMDVKDFTYTRDGHDTITGVSDKEEWDSLIEAFLVMGFSDEEQVAILRTIAAVLHLGNITVVKESRSADQARLNPDAKAIAGRACKLLGVPLEPFLQGLLHPRVKAGREWVEKVQTPEQVRLAIDALAKGIYERGFGDLVARINRQLDRTSMGLDDTRFIGVLDIAGFEIFETNSFEQLCINYTNEKLQQFFNHHMFVLEQEEYAREQIEWKFIDFGRDLQPTIDLIELPNPIGIFSCLDEDCVMPKATDKTFTEKLNSLWDKKSQKYRPSRLGQGFILTHYAAEVEYSTEGWLEKNKDPLNDNITRLLAASTDKYMANLFSDCADQDDEAGAMRSRVKKGLFRTVAQRHKEQLSSLMTQLYSTHPHFVRCIIPNHKKKPKQFQSLLVLDQLRCNGVLEGIRIARTGFPNRLPFAEFRQRYEVLCPNMPKGYVEGQAAARIMLDRFGLDKSLYRVGLTKVFFRAGVLAELEEKRDAIITEIMAKFQSLARGYIKRRIAYKRLYRAEATRVIQRNFQVYLELSENPWWQLMVRMKPLLGATRTATEVKKRDEMIRQLSDRMKQEAMDRQRLEEERRNVHAEMLRIQQTLESERALALDKEEIFKRLQLREAELEDKLAGALDDQERMEEQMDGLLEAKKRAEVDVEKYRTQLEQAATIIGRLEDEKSELANRIADLERQIVEISQKQSERSEQETALENELKMLQSQLSLKDRKVKDLESKLLKIDQDSDVKLLATEKELQIAKSKNEQLTTENTQFQQQLTQLSKTSTSYEDLIRKKESELAILRSENKQLATERRSIDDQTKMLASEREKAAERLREVQAELTAMKSQQAQLMREAEDAKKLLQARLSEDAQADQNRQVLEAQIKDLKDELYNAQMELSRERQSRDDVQLLGEHKYQTLKDEYNHLNESKITIEKELYAQQDTLRRAVETRTTLEQERDDAREEIRRLRSAMTQAEEARREAEVLGERAATKIAREREESLLKDLDAANDKLKWYESECAKLNYQVETSTRXLSSRASLVSKTIRQRNRLERELNTVRSRLAASENDNRALLNKLQQKGLEIARSASRAGEASRAQLVQVQREKTRVEEQNTKLNKQLGDSQVTVAGLEKKVEKLQLTIEDLNHELARETQASRNAEKLSSNVTVQLAEANRTIESERQLRTQAQGTVRTLQSTLDARDKELIELRAQLLSALKTVDPDT

SEQ ID NO: 3768 - protein, 631 aa, Neurospora crassa
ERTASGEEDAYLDESPQLRRVQKLEKANNRLHELLDDSSKKVSALEKALRTGELSLRDIQTRSHEEILDLLNSQEDSRRSLLHSHKDAVAELTELKEHYDKVRHERAKLEVDLRDPGRISKRCRSPGIRRLQAGANYSKSLRTSRIRLDAEASKLADVTASLNLYKGRADEYFSKLEQAEIAVLKANRAEAFARAQAKEAEDSCAEMMSERKRLDTMIEDLQHSNQRLEEKIEDMSTDLAAVTQAKKRLQHELEDYRNQRANDIEDKESSMEQMRKKYQAEFATLANELDRAREEKLRKQSEITRLREELDELRSKWDDEVLNSSTWSKEKARLEATLSDVVASRDEAVSAHNEAQSKIVTLLGQVRSLRSSLDEITAERDALFREKRSIEARLEEAKAGLDELANSESPSLRNAAHMDREILELKSSLAQQEDIAAAAVEKMRRAEALAAEVQKDIAAERENNADLQKQKVTLEKNFNELQMKLIDLETKGYSTASHDIKFLHSRIKEVSLYGVVLAFLASTANSSSPAESQLEEQENERSKSQRSVRNVDRIVKDLQSQIDRKDKQNTQLQEDVTRMRDKVDKLLKTIDELQSSESANELSARRAERELREEKEKALRLERELEGWKNL

SEQ ID NO: 3769 - protein, 618 aa, Neurospora crassa
  unsure (1)..(618): unsure at all Xaa locations
GAGAGGIAVAARLAKAGVDVTVLEKNDFTGGRCSLIHTKAGYRFDQGPSLLLLPGLFRETFEDLGTTLEQEDVELLQCFPNYNIWFSDGKRFSPTTDNATMKVEIEKWEGPDGFRRYLSWLAEGHQHYETSLRHVLHRNFKSILELADPRLVVTLLMALHPFESIWHRAGRYFKTDRMQRVFTFATMYMGMSPFDAPATYSLLQYSELAEGIWYPRGGFHKVLDALVKIGERMGVKYRLNTGVSQVLTDGGKNGKKPKATGVQLENGEVLNADLVVVNADLVYTYNNLLPKEIGGIKKYANKLNNRKASCSSISFYWSLSGMAKELETHNIFLAEEYKESFDAIFERQALPDDPSFVSFTLILVFFLSLSLSLSLXXSSDHPPTNFTSPLEQYIHVPSRVDPSAAPPDRDAVIALVPVGHLLQNGQPELDWPTLVSKARAGVLATIQARTGLSLSPLITEEIVNTPYTWETKFNLSKGAILGLAHDFFNVLAFRPRTKAQGMDNAYFVGASTHPGTGVPIVLAGAKITAEQILEETFPKNTKVPWTTNEERNSERMRKEMDEKITEEGIIMRSNSSKPGRRGSDAFEGAMEVVNLLSQRAFPLLVALMGVLYFLLFVR

SEQ ID NO: 3770 - protein, 372 aa, Neurospora crassa
  unsure (1)..(372): unsure at all Xaa locations
GVLGCTGSVGQRFILLLQNHPVLKLVAVGASSRSAGKKYRDAVRWKQSTPISAEFGDLVVRDCKASEFADCDIVFSGLDSDVAGDVEKEFQHANIAVFSNAKNYRRDPLVPLVVPTVNLNHLDLIPHQRKTLGLEKGFLVCNSNCAVIGLVAPFAALQARFGKIDTVSVVTMQAVSGAGYPGVSSMDIIDNVVPFISGEEDKLETEAQKILGSLNADATAFEDQKQLRVSAACNRVPVLDGHTACVSLRFAQRPPPSAEEVKEAMRSYVSDAQKLGCPSAPEPPIKVFDEADRPQPRLDRDLCKGYTVSVGRVREDESGIFDIKFVALSHNSKSPYASNASSCSRXHLSVAVIGAAGSSILNAEAAIFKGLI

SEQ ID NO: 3771 - protein, 890 aa, Neurospora crassa
  unsure (1)..(890): unsure at all Xaa locations
MYSACAVALRAGARRVVRRVPKSARALPRAAAARRQISTTAARSTDLTTRGMIVQTLSSVGSKREVQQYLSLFTSVSSQRFAVIKVGGAILTDYLDELCAALKFLYTVGLYPVIVHGAGPQLNRLLEDAGVEPQFEEGIRVTDAKTLRVARDLFLQENLKLVNKLEEMGVHAQPLTTGMFRADYLNKEKWGLVGKVTGVNKQAIETAISNGYLPILTSMAETDDGQILNVNADVAAAELARALEPLKVVYLSEKGGLFDAGGQKISAINLDEEYEHLMSQAWVKYGTRLKIKEIKELLDTLPRTTSVAIIHPEELQKELFTDSGAGTLIRRGSKLQASTSLSEFKDLEALKSVLIRDREGPDAKETVEKYLDFLKENPFKAYFDSSMNALAIVLPASEGRQATLATLTITKSGWLTNIADNIFTALKKEHPSLVWTVKEDDENLGWFFDKADGSITRQGDVMFWYGIENGDEIVKLMKDFTENGRAMLGNSNLESRLRQAASKPAAQQVRGYSTLARRPALPKFSISNRRGYLTQTNPNPPVGKQNASMDRPARVALIGARGYTGQELIRLIDSHPNMELHHVSSRELAGKKLEGYNKQEVIYENLSPEDVRDMEKRGEIDCWVMALPNGVCKPFVEAVWEGRKASGHKSVIIDLSADYRFDNKWTYGLPELVQRSNIIQATQIANPGCYATAAQLGISPLVPHLGGMPHVFGVSGYSGAGTKPSPKNDVENLTNNIIPYSLTGHIHEREVSSQLGAEIAFMPHVAVWFRGIHHTISIPLNKSMTSRDIRQLYQDRYAGEKLVKVVGEAPSVKNIGGKHGVEIGGFEVDKSGRRVVICATIDNLLKGAATQCLRKFSILSSLAECLCXPHXQENMNLALGYAEYEGIPTM

SEQ ID NO: 3772 - protein, 523 aa, Neurospora crassa
  unsure (1)..(523): unsure at all Xaa locations
VVGQFDYSDEDVNKGVVEFLRQMGRWVPSPXTNAATSSDKLRIAAEGLEKDGASMSQIPTYVTAVPNGTEKLVIHCXQVPAPMANLLXWXGLYMAVDLGGTNFRVCSIQLNGDTTFRLTYTKVAIPRELMVAKTAEELFAFLAKQVEIFLRTHHGEHFEAHIRRRMTMSSPEGFKDENVFRLGFTFSFPVQQLGINKGTLIRWTKGFDIPDAVGKDVCALLQTEIDKLHLPVKVAALVNDTVGTLMARSYSSPGKSGAILGAIFGTGTNGAYVEKLSNIKKPLAGEYDKSTGEMVINTEWGSFDNQLKVLPNTPWDVQLDLATPNPGIQMYEKRVSGMYLGEILRLTVIDLLKNPDVALFKDDNSSYNDWKSTTNIAEHSPIYKQWGLDTSVLSVAAADSTPELSILRQELEANLHIYAPSLEDAQAFKAIAGAIGRRAARLSAVAIAAIVLQTGKLNDPEQDEPIDIGVDGSLVEHYPYFRDMIYEALRVIKGIGEEGAKRIRIGIAKDGSGVGAALIALVA

SEQ ID NO: 3773 - protein, 267 aa, Neurospora crassa
  unsure (1)..(267): unsure at all Xaa locations
SGKVMAMKEIRLELDESKFSTILKELVILHECASPYIIDFYGAFYQEGAVYMCIEYMDGGSIDKLYAGGIPENVLRKITYATIMGLKCLKEDHNIIHRDVKPTNILVNTNGQVKICDFGVSGNLVASIAKTNIGCQSYMAPERISGGGMSAAGGAAAGTYSVQSDIWSLGLTIIECAMGRYPYPPEVSSTIFSQLSVGLLSASLSSSLKRTHKLTEXTIQAIVEGDPPGLPSEGYSGTAQDFVKSCLNKIPAKRHTYPMLLMHPWIK

SEQ ID NO: 3774 - protein, 642 aa, Neurospora crassa
VTPISSVLIANRGEIALRVARTAASMGIRTTTLYTDIDAASQHAKCTPYALSLGAPSAYLDGPRIVELAKQHGIQALHPGYGFLSENPAFAKACEEAGIVFVGPPAKAMTDMGDKARSKEIMNASGVPCVPGYHGSEQSVEQLKAKAADIKYPVLLKSVKGGGGKGMRIVRNADEFEAQLKSARAEARASFGEGGEVMLVEKYIVRPRHVEVQIFADRHGNCVALGERDCSVQRRHQKILEESPAPLLDDVTRKDLWDKARKAALAVDYVGAGTVEFILDKDTNEFYFMEMNTRLQVEHPVSEMVTGTDLVEWQFRVAAGEKLPLTQGEIEARILERGAAIEARIYAENPEKGFFPDSGTLVHLSKPQTNEDVRIDAGFVEGDTVSEAYDGMIAKLIVRGKDRETAIRKLELALREYEVVGLSTNIEFLKRLCNSQAFIEGDVETGFIDKWKTELFEAKPTSNDVFAQAALGLLGTQTQNVPAAHGQALGFGEATTQNSRKFAFRVQDDASTEEGKIVEVEVAQLNNKLFTVSVRKEGDDKPQVFENIVSKSTSTTAPTSSAKKTKLTTYFPLARVDTTLVQDPADNEKLTVFQLGHKTQLRLVSPVWFDKALGLKEVAASVVAPMPCKILRNEVEEGQPVE

SEQ ID NO: 3775 - protein, 255 aa, Neurospora crassa
  unsure (1)..(255): unsure at all Xaa locations
GDGACGKTSLLNVFTRGYVCDXTAIASQSKNSRSTSRPAYFPTVYEPTVFENYVHGTFAEKVTEASSNAILMLTQTIFVDNVHIELSLWDTAGQEEFDRLRSLSYGRFFAFPGSRXPCYVRDVXLAVYXMTTDLIMLCYSVDSKDSLENVESKWQGEIAENCPGVKIVLVALKCDLREATEDEEDGGANEDGAQREKKPMISYDQGLEVARRIKALRYLECSAMRNRGVNEAFTEAARVALSVKKDREESKCVVM

SEQ ID NO: 3776 - protein, 595 aa, Neurospora crassa
PTILPLLTAQDCREHVHLIIGSNPLAASRVAQSLSVGAKPILIAPVESDMTPTAADSQQNQKRELHHNLANYISSGALTHLDRPFADEDLTTLGRSEVDNVVDAVFVTQHDQLLAERISALCKRKRIPVNVLDNPALCSFSLLSVHVDGPLQIGVTTNGRGCKLASRIRREVASALPKGLGAACARLGDVRRRIITEDAEARTAAGSAIAAAVNEGVDDSIDQSATFNKLVTELDVQAEAAKTRRMRWLAQVCEYWPLKKLVEITDDDVESILQAYPGFSSDNSSASPQPVLPGAVSEGGSSSTTTTSSSSNGRIGRIFLAGSGPGHPDLLTRATYKAIQSADLILADKLVPSGVLDMIPRRTPVSIARKFPGNADRAQEELLEQALEGVRAGKTVLRLKQGDPFIYGRGGEEVAFFREHGLGDRVVVLPGITSSLSAPLFAGIPATQRDVSDQVLICTGTGKKGKPPAPPEYVGSRTVVFLMALHRIGGLVKELTTRLGEADGVAEVQEGEKQRALWPLDTPCAVIERATCPDQRVMRTTLRYVEQAIEQEGSRPPGLLVVGRACEALYTPKQEGQPWVVEDGQFKDLDFEDSL

SEQ ID NO: 3777 - protein, 620 aa, Neurospora crassa
  unsure (1)..(620): unsure at all Xaa locations
SXPPLLHDTIPQHFASVVSQHGDRPAVIARSPTAIPDAFPNLAPDQLPEALETAHTYEELDRVSNRLAHSLRSLGVKKGDRVAVSLGNCAEYAAITYAVFKLGAILVPLNPGFNAKQVSAALNHLNVELLIIGAITDLAYKPCRGRSNLPLLRDIVPDIESGRIEAPHVPSLRTVVVLDNTPSHPASEFPPLSSCRSLIPFSILMDGSGAPVTPDSPLCPSETINIQFTSGTTSHPKAAMLTHTGILNNGALIANRMGLEPTDSMVVPPPLFHCFGCILGYMATATTGAAILFPSPAFDPLASLRMAADHKATGLYGVATMFVAMLELIGAQSHLSDPLIPLKDIEDFPNHLRKGIAAGSSVPESLMRRLYAKIGLQDLVICYGMTETSPVSLMTAPSDPFEKRTASVGKAMPHTKVKIVDPLDRTRILPIGERGELASAGYLVMKGYWGDPEQTAEVMITEPDNDGSGSSTTWMYTGDEASMDSDGYVEITGRIKDLIIRGGENIHPLEIENCLFQHPLIAEASVVGVADEKLGESVGAFIIVHKDVEPVEGEGGGGDVLSLESTAKGRSEGKKTLTRREIREWVAKHLSQHMVPKHVFWVDEYPKTASGKIQKFKLRD

SEQ ID NO: 3778 - protein, 294 aa, Neurospora crassa
ADVETAKHASTTAVTDKSSSGANAAQQNPQGQRPIQDMSRMTLYEKLAYQFPYDVESKFPAYIWQTWKWTPAHGEFNFRDQEATWTQQHPGFIHEVITDKVAVHLIRLLYASVPEVVEAYNALPLPVLKADFFRYLILLARGGIYSDIDTYAIRSAVEWIPDSVPKDAIGLVIGIEADPDRPDWKEWYSRRIQFCQWTIQSKPGHPVLREVVSRITNVTLAMKRNGTLRGVVDKNVIEFTGPALWTDVIFEYFNDQRYFDMTHSAGSIDWKNFTGMEASKRVGDVVVLPITSFS

SEQ ID NO: 3779 - protein, 2539 aa, Neurospora crassa
  unsure (1)..(2539): unsure at all Xaa locations
NDPFADFASLQLKAQNTLSLLKLAVQETPDVLKQTTDGNEFLLRGPEPLWLWFQPRLLALLGRSKLLGITSAIEDFFHFTLQTVAERVPLWDLGPGLLQVFPSKLARXASATSRNWLCSNRXCXCKSPAILEHFQSNPLADMNARNSNLDIQLPPDTFLRALDLDDPDTPSKFFYKIRDSEHAIRHAISLFHILKSTILPVGAAEPPLLYRGNIAWLMDVFQPLFSALVHWSPQLKISLAPYVQTAIDLAEAADDTLRPKAISALALICGEVFDRSRNILAKTSLGWLRERHSPWLCSILSRKQIVTGLXCSCSNPESSSPPSVSLQLASPTRIYGLVHQKCHIWFNWCXHPIXRSAILLQQVVSAETSFSQVPEELSSSKFVDVTLRQQVGLLGLDPVVEDGEPAPKRRKLVEHQALSADIVEEICRVANLPISEDICSLEDSLMXVGRVEGRPYFFFLLTIIVMPFPKLTILRQCRVIELISFVPCATDNTLGLEEGRLGSLALSSASLECSHCSIFGYSAFTQACDDAVTKTTAYKILEKLVKSPGFRDSRRPRVYAIVRLQRMLRHTVLPEFRDLEQSILGQWCVQSLRSSIRELRIGAGRALAVLLDPDVPDFVRPIARGNQNIVLDILKLITDEDALHLHETCILAWGQAGRVVSVDHLNLILIKLVEYLGYNNSVVSSMAVNEILNIATYRGITPLQLFAPYWENMAVLVVKDLVSAPQTTRLVAETLQLSIEELLCLLQKHALPWLVLAKNLGVIEKIAEARGEKSTSQPCIDSANFPSIIALLLIQDVPDVEEHAMELLCVISPKFKEPNPGELNSDEKRPVSVRDRLAEILRVEPLGVLFELFKASGGADERKKAWYVTFTDIXKPEADNAQIRKGISILATRSSPLTEKGAEPPHIIERFLEKYTLGLVSRLSERITDIDVPIPDRRRCLRAMEEMIRVCRSSVTTARSQVCCSGSVTPAWKHLYSPHSSHRYRHVYCLALGCDELRSDAFSCWSVMIMNMDEMDVPNLLDTTLWVITHHWTCFDDSTKQQAQGVLDALSKTNGHDLVKATASMTTFNHLPDLAEHRKRLGLLSQSGLTRQDLFRTFCRRLRHDHPGVIEQALTELLELLRQHQDYIQASALAEQPKSFIPGLTRSVLDCAAKYNGWQPGIMRLCAECMGIIGCLDSNRMESNREQKRFVVSQNFMDFRETADFVCFMLENVLVKAFLSTTDTKFLSFLSYAMQELLAKTGIKLAYQSQGQGQHETLYKRWRSFNDITKEILTPFLTSEFIVSSGMIGLDTNYPIFHPQKSYETWLKTFVLDLLRNPQNPNSAILFPPLCRLIKVHDPCVSEFLLPYVVLHAVIGSEGPSQTPDESQMLVAEEGSTRAEAHEKKTSGSEWRKKVMSELKTILEYQPPETATHSEKEEVKLCYEVCTFLMTVYYLNXLKXAVFRILDYFKNWLHIKKSQSATKEKDARWCPLVEEVLSSLDPELVARRAIDCGQYARALLFLEPHIESRRDEAIGDEATRLMRSVHDIYTQIDDPDGLDGISACMKDLGFKEQALSHRKAGRWTAAQTWYEIQLAESPDDVNLQLDLLTCLEESGQYGEXHLLSLGXWYIRSXHCVQTIFXVLLEGIDKTPSSLSKVMPFVLEASWATGRWQIMEKYLRSYTEGDVTDVFNIGIADALLCLKEGDGERFQELLQAMRDKVASSMALSATSSFRTCHDVMLKCHVLEDLEMIANAEPVEGEGHAPLVKALERRLEVLGAYVSDKQYVLGVRRAAMELMRYVSCLISELIELISDKSLGRNSETKRYSSSWLATARLARKSGSTHQSFNAVLRAQQLGDSSAVIEYAKLFYKDGQHRKAIQLLQRAIDDDLFNDGMMAIDTPTSSKSQQSHRNLLKARAHLLLAKWLDSTGQTHAGALRSKFQEAAKTHPQWEKGHYYLGRHYKKVLESEKALSPDDQSDAYLTGETAKLVIENYLRSLNFGTKYVHQTLPRILDLWLELGTQVDAPSLGMVTLSAELQSRRRTILHELYKHFNRHLPKMPAYIFYTALPQIVARIAHPNQDVFRVLEQMIIKVVEAHPRQAIWSLFSFMTGRTNGARRHRGQKVLDDLRAIAKRVDETGYDLKQLLKMGEKLAEQLLLACNKGDFQSNRTVKASITRDLNFNHKCTPCPLVVPIETCLTATLPTLTDNTRKHKAFSGDVITIDRFLDDVLVLGSLAKPRKLTARGSNGQLYGLLIKPKDDLRTDQRLMEFNGLINRSLKRDTESSKRQLYIRTYAVTPLNEECGIIEWVDGLKTLRDILLGIYKTRNITPNYGQIAELMKQACTSDDNLHLWSRSVLGMFPDVLPEWFISQFPDPSAWFAARLRYTRSCAVMSMVGTILGLGDRHGENVLLEEGNGGVFHVDFNCLFDKGLTFAQPEKVPFRLTHNMIAAMGIYRYEGPFRNCSELTLKVLRQQEETLMTILEAFIHDPTLDLQRTKKRTHDVVKLNPTSVVESIKRKVRGLLPHEKIPLGVEGQVEELIKQATDPKNLAAMYIGWCPFL

SEQ ID NO: 3780 - protein, 807 aa, Neurospora crassa
  unsure (1)..(807): unsure at all Xaa locations
APIKMAPRKKIAIMTSGGDSPGMNAVVRSCVRMAIHMGCDAYCVYEGYEGLVRGGDFIKQMDWFDVRGWLSEGGTLIGTARCMAFYERAGRLTAAKNMILNGIDALIICGGDGSLTGADRFRAEWPSLLEELVSTGELTAEQIQAYKHLNIVGIVGSIDNDLSGTDATVGCYSALARICLCIDMIEATASSHSRAFVVEVMGRHCGWLALMAAVATGADFLFIPEKPREDNWREEMRSVIQQVRFPCSAWATVPPNKQWLTNRKQQHRRLGKRKTIVLIAEGALDKFGNKITPEEVRDLLADKNGLALDTRITTLGHVQRGGTAVAYDRMLATLQGVEAVKAVLEATPETKTCFIAITENKIVRKPLMEAVLDTKQVAKAIESQDFDGAMALRDAEFSEQYKSFMMTTAGQIDHETLLPEKEVSDDHAICASSGXVELTSIQRMKIGFINVGAPAGGMNAAVRAGVSYCLSRGHEPIAIHNGFAGFARHHADSPGSVRPFDWLEVDGWASKGGSEIGTNRELPSESGMETIANLIEQYQFDALFLIGGFEAFHAVSQLRKAREQYPSLCIPMTLLPATISNNVPGTEYSLGSDTCLNELVDYCDKIKQSASATRRRVFVIETQGGRSGYIATLAGLGVGASAVYLPEEGLSLEMLSEDVRHLKEVFAQDKGQSRAGRLILINEKASKVYNAKLIADILRDEAHGRFESREGIPGHMQQGGVPSGMDRCRAVRLAIKCIQQLEKYGRNVHNRVKMDPMSASVIGIKGASVIFTPVQKLEEEETDWPNRRPKAAFWLSMKEIVDILGGR

SEQ ID NO: 3781 - protein, 733 aa, Neurospora crassa
REDEISKLLSNIRPDEDIPPEERGDTPPDLKYPLYPHQQLALKWMTDMEGGHNRGGILADDMGLGKTISTLALMASRRAPEGEVVTNLIVGPVALIKQWELEIQNKMKEDRRMKVYLYHGGSKKKPWTELQKYDVVLTTYGTLTAQFKKHHHYLEKNTESLNGLDEQAEKRYRLECPMLHPSTKFFRVILDEAQCVKNANTMQSRAVRQVRATYRWCLTGTPMMNSVSELSSLLRFLQIKPFCDEKKFKEAFASLDHKYTGRDVEKSTAMKQLQALLKAIMLRRMKTTVIDGNPILNLPPKSLYTEHVEFSEGELEFYKNLQEKSQVIYGRYVRNNTVGKNYSNILVLLLRLRQACCHPHLTDFEANPKNHLAEATMIELAKTLEPVVIDRLKQIKAFECPICYDAVIDPTILLPCGHDICADCFSSLTDQSAMNGIRNGQDGANVAKCPVCRGPADHTRVTNYTSFQAAHMPEALEKLDNDDADSLVGDGSDTSDGSLGSLSGEKKRKAKSEGKRPTKVKPEEKEDWKPTVFDQLRKEANASRNQDARDRLLQYTWDHWQDSAKVSRVTELVDQFQQFNEKTIIFSQWTSHLDLIECSLKFKLNIKYRRYTGNMSRSQRDNAIQAFVEDPDVKVLLVSLKAGNAGLNLTVASRVIVCDPFWNPFIEDQAVDRAYRIGQQREVHVYKILVQETIEDRIIELQNLKRNIVETALDETEGKQLARLSIDDLNYLF

SEQ ID NO: 3782 - protein, 747 aa, Neurospora crassa
  unsure (1)..(747): unsure at all Xaa locations
QKAKEALTSAPSSKKVDDLKNEFKETDKSARLTTDYGVKQTTADDWLRIVSDDKIGPSLLEDPFARERVRIPSYXHFSARIAANNILSDHRFDHERIPERVVHARGSGAFGKFKVYESASDLTMAPVLTDTSRETPVFVRFSTVLGSRGSADTVRDVRGFAVKFYTEEGNWDLVGNNIPVFFIQDAIKFPDVIHAGKPEPHNEVPQAQSAHNNFWDFQFNHTEATHMFTWAMSDRAIPRSLRMMQGFGVNTYTLINAQGKRHFVKFHWTPELGVHSLVWDEALKLAGQDPDFHRKDLWEAIENGAYPKWKFGIQAIAEEDEHKFDFDILDATKIWPEDLVPVRYIGEMELNRNPDEFFPQTEQIAFCTSHVVNGIGFSDDPLLQGRNFSYFDTQISRLGVNFQELPINRPVCPVMNFNRDGAMRHTISRGTVNYYPNRFDACPPASLKEGGYLEYAQKVAGIKARARSAKFKEHFSQAQLFYNSMSPIEKQHMINAFGFELDHCEDPVVYGRMVQRLADIDLGLAQTIAEMVGGEAPTTTNHPNHGRKTINLSQTEFPPATPTIKSRRVAIIIADGYDNVAYDAAYAAISANQAIPLVIGPRRSKVTAANGSTVQPHHHLEGFRSTMVDAIFIPGGAKAAETLSKNGRALHWIREAFGHLKAIGATGEAVDLVAKAIALPQVTVSSEAEVHESYGVVTLKKVKPESFTDAVKIAKGAAGFLGEFFYAIAQHRNWDRELDGLHSMIAY

SEQ ID NO: 3783 - protein, 487 aa, Neurospora crassa
  unsure (1)..(487): unsure at all Xaa locations
KYPAKRHAQRVADYIRNKMPGASGVLYLEGRATKLLEDNDEAEPFRQRRYFYYLTGCPLADCHYMYDLDADKSTLFIPPIDPDSVIWSGLPVSVDEAKQRWDVDDVKYTSDVNATLAHVGSSKPKGSSVFALANQVSDKVTFLEFDNKNFSILKEAIEVTRVVKDEYELAIMAKANEISSDGHKMVMQKVKHVQNERELEAVFLGHCIAKGARNQAYHSIVASGRAAATLHYVPNNADMAGKLNLLLDAGGEWDCYASDITRTFPINGKFTKESREIYDIVLKMQNECIAALKEGVLWDDVHLLAHKIAIDGLLQIGILQGDKDEILESRTSVAFFPHGLGHYLGMDTHDTGGNPNYADKDTMFRYLRVRGRLPAGSVITVEPGIYFCNFIIEPFLKDPKHSKYINADVLEKYWDVGGVRYVDCDLFACMVWKGRMLILSLLCRIEDNLVITKDGTYNLTTAPKDPEEMEKIIQQSXDKAGHGEYVL

SEQ ID NO: 3784 - protein, 294 aa, Neurospora crassa
IGAWPWGDKSTWHYKEEEFPAIEAAWRQLYDAGINFIDTAQAYGSGESERLVGKLVKGLPRDSYVIQTKWLGTALDAKNYVHASDAPYKTLKSSLERLGLEYVDIYLVHGPTHPQSVKTVAEGLAKCVNEGLAKAVGVANYGNDKVLEMKAALAEHGIPLATNQVEYSILRRYPEIHGEIKMCLDNGMVFQSYSSLAQGRLTGKYTVEHPPPKTYRFSSYPMEEIKETLAVLEKIAKARGKAMASVALNYNISKGALPLVGIRNPEQARQAIDALGWRLTEQEIIELDRVSVEG

SEQ ID NO: 3785 - protein, 336 aa, Neurospora crassa
SATTQSPPTITGNNLLLKITHAALNPVDLHILRLFPHWLPFRRNPTPGFDFCGRVVGAGPDVDTNEFTVGDVVCGALGAGDVFWGKGSLAEYLLVSSSLVAKKPKTWGGLNGGNEVSGEEAVGLFGIAGQTAVLMAQTAGVSSDADWKGKRCLVNGASGGVGSILTQILKGKGAEVWGTTGSAEGEELVTQCGGKVVNYKDHHPVTAHLAELFGEDKLDFIFDCAGSQDMFSQSPGYLKKEGKFISIAGGPSQGVVPYVKNKLRPVWLGRTPREFELLLLIPGKKTVREVGRLVEEGFIERGLVDGGVWEMEELVKAYERLGSGRAKGKVVIRVGE

SEQ ID NO: 3786 - protein, 519 aa, Neurospora crassa
  unsure (1)..(519): unsure at all Xaa locations
MAGKQNQAAPKKAVAPRQQHYEFGGPXVNQKQNPXLHLVRVQTTPRXQAXQRSNSIGAFGITFGLPILVHVFNLFCNDISGCPAPSLLHPKSLDLAQLKREIGWPDNGVFGLFSWSATLWTLGYYALSLVQYRFLPGHHVEGTELSTGGRLKYKLNAFNSAMCTLAILAAGTIAQGAEFPVWTFISDNFAQIISANILFAFALAIFVYVRSFDVKPGNKDMRQLAAGGVTGSLIYDFYIGRELNPRITLPLIGQVDIKEFMEMRPGLLGWIILNCAFIAKQYRLYGYVTDSILFITAIQAFYVFDGIYMEPAVLTTMDITTDGFGFMLSFGDVVWVPFMYSTQTRYLSVHPQQLGAFGLIAVGAVLAAGYSIFRLSNSQKNNFRTNPEDPSVKHLTYLQTKTGSRLITSGWWGIARHINYLGDWLQSWPYSLPTGIAGYQILSAGSNAPGAITMLDGREVVQGEARGWGIVFTYFYILYFAILLIHRDLRDDEKCSKKYGDDWEKYKKLVKWRIVPGIY

SEQ ID NO: 3787 - protein, 442 aa, Neurospora crassa
  unsure (1)..(442): unsure at all Xaa locations
ILTRVTRQGYTVVCFLANVGQEENWDEVRAKAKKLGAEEMVILDLQQEFVDQIVFRAIQCNAIYEDRYLLGTSLARPIIARAQVRVAEQYNCEFVSHGCTGKGNDQVRFELAFQVCXFPPLEPHPTHKHXRDTRACNPEIKVIAPWRLPEFCARFQGRQDLLKYAADKNIPVSSTPKAPWSMDDNLVHCSYEAGILEDPNHTPPKELWTRTVDPQDAPNTPQEFTIVFEKGIPVKVIVDGKETTGSVELFKLLNKIGHDHGVGRVDIVENRFIGLKSRGCYDTPGLTIARLAHLDLGSCSSCLTWSGXIDCXYGFYRGLVMDSRVRELRDQFVTISWSRQLYNGMYFSPERELXVVSYPKLKTDEQSPTVIPLQRRELHHLLPQNVTGEVRMMAYKGNAYVLGRKSDASNLYSEADASMDSLEGFSPMDTTGFIEINAIRLK

SEQ ID NO: 3788 - protein, 714 aa, Neurospora crassa
PPGGTHRMNLGGEDEKPALEQYGIDLTAKAREGKLDPVIGRAAEIQRTIQILSRRTKNNPVLIGCAGVGKTAILEGLALEIVKGAVPESIKNRRVISLDLGSLIAGAKFRGDFEERLKKVLGEVQEANGEVILFIDELHTLLGLGKAEGSIDASNLLKPALSRGELQCCGATTMTEYRQIEKDVALARRFQPIIVSEPTVEDTISILRGIKEKYEVHHGVRITDGALVAAATYSNRYITDRFLPDKAIDLMDEAASSLRLQQESKPDDIQRLDQKIMTIQIELESLRKEKDVASVERREKLEADLKKYQDEVAVLTERWLKEKAEIDSIKQTQAELDRARIELEQAQRTGNFARASELRFGVIPNLEKKLPKDGERPTRDLSLIHDSVTADDIANVVSRITGIPISKLSSGHTERLIHMEDILRESVRGQDEALKAVADAVRMQRAGLSGENRPLASFFFLGPTGVGKTELCKKLAGFLFSTETAVVRFDMSEFQEKHTISRLIGAPSGYVGYEDAGQLTEAVRRKPYAVILLDEFEKAHRDISALLLQVLDEGYLTDAQGHKVDFKNTIIVLTSNLGADILVGANPMVPYKETEDGDIHPDVKQAVMDVVASQYPPEFLNRIDSFIIFKRLAMEALRDIVDIRLKELQERLNDRRITLDVPEEVRQWLAERGYDPKFGARPLNRLITTEIGNGLADKIIRGQIKSGDKAVVEI

SEQ ID NO: 3789 - protein, 406 aa, Neurospora crassa
DNVFTTHDDNSKVYDHSAKRLVRRVMEGYHGTVFAYGMTGTGKTFSMQGTASSPGVIPLAITDIFSYIRETPSREFLLRVSYLEIYNERIHDLLSMATGGNGPGAPAQEEIKLREDSKRGVYATPLKEEIVQSPTQLLRVIARGDQARRVASTQFNARSSRSHAVVQIVVESRERVPAGDSSGGSKRQGLLPGGVRVSTLSLIDLAGSEKAADTKERRQEGSHINKSLLTLGTVIAKLSENKDKDDKHLPYRDSKLTRLLQGALSGNSLVSILCTIQCGAGGSTAGSTHINETLNTLKFASRAKNSIVSRAKRADEALGAGGDGNARVLLERYRMEIAELRKELEKQAKANSQKEADEEMERDAKEELARELEMEQRHEEQMLEMQLARTALKERIDHLNRLILSS

SEQ ID NO: 3790 - protein, 376 aa, Neurospora crassa
  unsure (1)..(376): unsure at all Xaa locations
YQDSLANACGMNVNTRILQFKPAPPESSKPIDLRQQYNRPLKAANSSAQFRRRVATAPERVLDAPGLIDDYYLNLLDWSSGNQVAIGLERNVYVWSADEGSVNCLLETSPDTYVSSVKWSGDGAYVGVGLGTGEVQIWDVAEGIKIRSMFGHDSRVGVMGWSKHLLSTGARSGLVFNHDVRIAEHKVAELVSHTSEVCGLEWRSDGAQLATGGNDNLVSIWDARSLAVPKFTKTNHKAAVKALAWCPWNINLLATGGGAYDRHIHFWNTTSGARVNSIDTGSQVTSLRWSPRYREIVSSSGYPDNSLSIWSYPTLVRNVEIPAHESRVLHSCLSPDGQMLATAGKXSLCENSXFEAHTDRDYXPPTKVXSSGRSLR

SEQ ID NO: 3791 - protein, 327 aa, Neurospora crassa
LDPLGFEDEMCPVCKSRKYLNPDIVFVFNPECYHSMCLNCANRLFNDGPNQCPHAGCNKTLRRKGFRSAFFGDLAVEREVDIRRRVAAVFNQVEDDFETLQDYNNYLQMVEDLTFELVNGTDERRRQAEAQLQAWEAEHRADIERNKKAGREADEISRVRLAAERDAVRQRRIEAIKEAEAEKRERVRSREMELDNLAKGTTAMTAEPATKVQLKRRGQVNRVAETASNPAIATTGMGTGASEVERLSIRGLKEKPKAPAPQGPYDPFGGMDFAPSRYKLHGGLSHPLMEKYRLDRQHVAGGYSFDDFAARALYEAFAGLGVFVEDE

SEQ ID NO: 3792 - protein, 1075 aa, Neurospora crassa
  unsure (1)..(1075): unsure at all Xaa locations
LAALVPQWTSAQHVSVVATSSGPGVLSGTVAGDSPMFTFPASADIGPNVLPNIFDPQAVNVQSVCPGYTAANAQKTEKGLTADLTLAGPPCNVYGNDIEHLKLTIEFQADNRINVQIQPRYTGPGNETWFILPEVLVPRPEAEPDANAARSKLEISWSNEPTFSFTVKRKETGDVLFTTEGRVLVYEDQFIEFGSSLPENYNLYGLGEVMHGFRLGNNLTRKSLYLTXMCIVDCIXLTPSPGTLFAADVGDNLDANIYGNHPIYLDTRYFTKDESGKLSYVSDPADKNAKYVSYTNGVFLRNAHAQEVLLRPEGITWRTLGGSIDLYFFEGPFAQDIIKSYQLSTVGLPAMQQYWTLGFHQCRWGYSNWTVVKDVVDNFRKFGIPLETIWSEXTQVLQHQNLPHPCFYXLFXADIDYMKGYRDFENDPDQFSYEEGARFLEELHKNHQHYVPIVDSAIYVPNPDKPEDDYEPYHRGLEADAFIMNPDGSLYIGAVWPGYTVFPDWIGAALNGTGTVGWWTDEFVRYYKKVAFDGIWIDMSEVASFCIGSCGTGNLTLNPVHPPWGLPGEPGALVLDYPEGFEKTNASEASSATSVYKTQNPDPTTTASTTSTTSYLRTTPTPGVRNINYPPYVINNFHGDIGTHALSPNGTHHGGTVDYDFHNLFGHQILHATYQALLKVFEGKRPFIIGRSTFAGSGKWAGHWGGDNYSLWAFLYFSIPQALSFSIFGFPMFGVDTCGFNGNTDHELCSRWMQLSAFFPFYRNHNVRGAISQEPYVWSSVIDASKKAMRIRYLLLPYMYTLMAQASLSGDTVMRALSWEFPQEPWLADADRQFMLGSAVMVTPCLVQGANTVDGVFPGVGDGTIWYDWYTYKAASEGVQPGENVTIDAPLGHIPVFLRGGHVIPVQEPGMTTTESRQNEWSVIVALDGAGKANGTLYLDDGESLEPGENVSGLMXVFFRSFYFSSLFRECSVGRLPLAPLATRSKVLTGFGCFXFTVEKNSFRVTPQGKYLDRNSLANVTILGVAEAPLGVAINSHLLGSASWSYDSEGKFLSVTELQDNFKEGAWASNWTLSW

SEQ ID NO: 3793 - protein, 677 aa, Neurospora crassa
  unsure (1)..(677): unsure at all Xaa locations
MAIFAMGWQKPDNVAGSSAPAIMVGLFVATGGLLLGYDTGXASLLNALGRGEHVDATDSICHGACNGICDGYWLDAALSQTRRPGPRDNTKLKCXLCTSGLXTINGILAMKSFKDHFSTGYIDGNGQPGIYPKESALIVAMLSAGTAIGALLAAPLGDHYGRRRSLIGAIGIFVIGAILQVCAYNIDLLVAGRCVLLPLGFAWRIPELTWTISGTVAGVGIGIVSVLVPLYQSEMAPKWIRGTLVCTYQLSITMGLLAAAVVNILTYKLKTAAAYRVPIGLQLTWACVLALGLTVLPETPRYLIKRGDKNAAALSLSRLRRLDITHPALVEELAEIEANHQYEMALGPDSYKDILFGEPHLGRRTFTGCCLQMLQQLTGVNFIMYYGTTFFNNAGVGNPFKISLIMQVINTASTIPGLFVVESWGRRRLLMVGAIGMAICQLLIAAFATASGSNNLSAQNKVLITFVAIYIFFFAASWGPVVWVVTSEIYPLKVRAKSMSITTASNWFLNFGIAYGTPYMQTNSAASDESSIDLGSKVFFVWGAFCIVAVGFVWCMVYETSKISLEQIDEMYERVDHAWHSRRFEPSWSFQEMRDLGFSDGGIPPTQQLQQQPQQPQQQQQQHHQQQQHQLQVDLQQSQSRTSNSSTSQTDTGGSNNTGASQDDKLVASLGNIDLSY

SEQ ID NO: 3794 - protein, 338 aa, Neurospora crassa
VFILSVGQAPARQCALKAGLSNKVVATTVNKVCASGMKAIILGAQTIMTGNADIVVAGGTESMSNVPHYMQNLRTGVKYGDGGLVDGIQSDGLRDAYGKELMGVQAELCAKDHELSREAQDEYAINSYQKAQAATEAGLFKEIAPIEVPGGRGKPAIKIDRDEEVKNLNIEKLKSARTVFQAKDGTVTAPNASPINDGAAAVVLVSEAKLKELGIKPIAKILGWGDAAHEPERFTTAPALAIPKAIKHAGIKEEDVDFYEINEAFSVVALANMKILGLEPEKVNVYGGSVAIGHPLGCSGARVVTTLTSVLAEKKARIGCAGICNGGGGASAIVIENL

SEQ ID NO: 3795 - protein, 251 aa, Neurospora crassa
TKAGVTVGKLRANPNKDIARIASEIVNKWRKLVEAAKEAKKKSQAAAASGASSPAPNASPAPASSAYNKPYTGDVEKRHFKTDKVDINRTSSQTRNNTIGVLYNGLAYRRTESIEEVVKRAVEVENALFKACKGENQEYRSKGRTLFTSLKRKDNAALGRRVMSGELPVERLVVLSDKELASEEQRARDEELEKENMKKAQVPMAEKSISDALKCGKCGQRKVSYSQAQTRSADEPMTTFCECTVCGNRWK

SEQ ID NO: 3796 - protein, 958 aa, Neurospora crassa
  unsure (1)..(958): unsure at all Xaa locations
INNSFGPGGNDGLTEMLGNLQSGGEIDQRGKADDAIDFEDIDLSDEDELPNDEPSTSGTSGELPSLIDDAGTNDDDDLFGGDPSSPMDTAHDGLRSSPPPLDVHDDVDAKKRPDAAAGESLEDLRNLNFDNDEEPHATNQDPDIPPPAENFIDAVKQLFPGFEENAILHWNELLKPKNATWISKKPPKAPKPLIPSKLSLELDADQEKQFRIPGPATGSVWQRIKEAEARGLFCLEEPEPLEQTDLEVFSLDDETDSERIGGYTLQDIATICQDWEQMIFLGDSLAAAIEPGPQPKPDNMLIKDEPDEEADWDAMFLDEPAQKRRKIEIPKGLPPIAHFTAPNLDEFEQVTSKLGKRVILDMNDPYLLIDDVESERSSKRRKTQHKTVRLANGKAGRDLIQRFNFSSDAAYDALKENSQNRVRATLATIPVEHSLPAQRLSWPYYRVKLAASDPHSYHRPQLHPKKDLQYLIRFDKPAIIKRKTLKGKRVSEVFKSTHDLSLNDNSTAILFEYCEEIPTVLSNFGMGQKIINYFRRAKGADSRPEKRELGETCILMPEDRSPFAIFGHVHPGEVVPTLHNHMFRAPIFKHNPRNTDFLIGRSSTGQKGSTWYIRNIDHLYVVGQTLPSMEVPGPHSRRVTNIAKNRLKMVSYRLLRKSEHVTLHDITKHVAESNESQNRQKLKEFLRFRKETKDWALPEGEELMAEPAIRSLVRPEEVCLLDAMQVGLHEIEKGGYDATDSLKDDDIGVDVNDELSPDALANKMAPWKTTKAFLDASHGKAMLAVHGAGDPTGKGLGISFLRTSMKGGYLEQLQGPMATSADAIERQRKANGGHMYNVKNQDTLYTEALTDIWNRQRESLLDSQEHDDEDVLGQEDEDERFNVQGSQFAQTPVVQDGFSQISQSATSAINRKKLVITREVRDENGQTRTVTEVVRDPAVIAQYVKRRRQEQKSEIEXV

SEQ ID NO: 3797 - protein, 449 aa, Neurospora crassa
DEVSALVLDPGYCNTRAGYAGEEMPKQVLPSFYGHINGRDVFGDEYIVPKPGFEVRNYMNRDSVVEDWDAATRMWEHVLVKRLQPERSTPPSKKGINISDDGDVPMEDDGNNNEDATDALEKPLAENPLLMTEAPWNSPKAREKAIEISMETWGVPAFWLSKTPVLAAFAAGKATALVIDVGGANTSVTAIHDGMVLKRSIQRSPVGGVWLSSQICKMWDGSEPKVDVVPRFMVESKKPVEAGAPAEANLRKFNFDIHPSFRAYEEERVLTEFKESVVEVWRGPQRFTTPGNEDAVRTQPGRVFEMPDGSNQMWREQRFKVSEGMWDETAAYNSTDEEGRVTKAQTIPALIKAALEGVDVDLRPNILGNVVVTGSTSLLNGFNDRLNHELAQMYPGVKIKIHAAGLTTERRFGAWIGGSILASLGTFHQMWISRKEYDENGAGIVEKRC

SEQ ID NO: 3798 - protein, 617 aa, Neurospora crassa
  unsure (1)..(617): unsure at all Xaa locations
MASRRLALNLAQGVKARAGGVINPFRRGLATPHSGTGIKTQTTTLKNGLTVRTPALPSPGFRARPRARLRPDCLPPRLLLRTPSHLQTCPNVNCYHRVASQYSPYAQTSTVGMWIDAGSRAETDETNGTAHFLEHLAFKVRPRIHESRVLSPGCGXLXYGALGCWIGRLYERASGXFDDDTQGTTKRTQQQLELEIENMGAHLNAYTSVRLILSSGASAARXPASTAENTVYFAKALNEDVPKCVDILQDILQNSKLEESAIERERDVILRESEEVEKQLEEVVFDHLHATAYQHQPLGRTILGPRENIRDITRTELVNYIKNNYTADRMVLVGAGGVPHEQLVEMADKYFSKLPATAPVSSASILSKKKPDFIGSDIRIRDDTIPTANIAIAVEGVSWSDDDYFTGLVTQAIVGNYDKALGNAPHQGSKLSGFVHKHDLATSFMSFSTSYSDTGXERPCLVSHLFFIHLLSSFFSFXRTTTDMANYSLWGIYLVTDKLDRVDDLVHFSLREWTRLCSNVSEAEVERAKAQLKASILLSLDGTTAVAEDIGRQIVTTGRRMSPAEIERIIDAVSAKDVMDFANKKIWDQDIAISAVGSIEGLFDYARIRGDMSRNAF

SEQ ID NO: 3799 - protein, 676 aa, Neurospora crassa
KEILSGIQGMAHPGEVTAIMGASGAGKTTFLDILARKNKRGQVSGDFYINGEKVSDPEYKNAVGFVDQEDTMLPTLTVHETILNSALLRLPKDMTRAAKEQRVIEVEKQLGIYHIRDSLIGSEEGKGRGISGGEKRRVGIACELVTSPSILFLDEPTSGLDAYNAYNVVECLVTLAKTYKRTVIFTIHQPRSNIVALFDRLILLAQGKTVYSGPLHQCQEYFDQIGYTCPPGFNIADYLVDLTMHAGSTSSYDDGTLSVDGVSVGPSSTRAVKSIASVSGVSIGDDSLVESSSSRPRNKRRDSVRRRQERELYTRRKQAVDTAASSDAGDEIGGYKLQKQPPVTPLRSTNDDLHDLPPLAATGTDLDVLIESYIHSDIAASTHEEIHQAIAAAVNSNGQNSNGYVADGNIYTGTMGKGYARVGLFRQFVILSQRTWKNLYRNPMLMLTHYAIAILLAVFAGYLFYGLTLDIAGFQNRLGLFFFVLALFGFSTLTSLGVFSQERLLFVRERANGYYSPITYFAAKVLFDIVPLRIIPPILLGAIIYPMTGLVADYQRFFVFILVLVLFNLAAAAICLFIGILCKDGGVANLIGSLVMLFSLLFAGLLLNHNAIPAAALWLQWLSIFHYGFEALIVNEVTQLTLVDHKYGLDITVPGATILTTFGFDNSAMWRDIMNL

SEQ ID NO: 3800 - protein, 557 aa, Neurospora crassa
  unsure (1)..(557): unsure at all Xaa locations
GTLDNLPKDLRNEIEHLERLFTVDGAKLKEVTNHFVHELEKGDYSTNCKDTTCPXLEEMLTASFVHRLSVQGGSIVRFSIHRATQIQKRTSLTRGLLXPMNPTWVMSFPDGNETGTYLALDMGGTNLRVCQVTLTETKSEFDIIQSKYRMPEELKTGDAEELWEYIADCLMQFIETHHGDPTKLDALPLGFTFSYPATQNYIDEGILQRWTKGFDIAGVEGHNVVPMFEAALQRRVGCVLQLSLISCXCYFCLXGVPIKLTALINDTTGTLIASAYTDPKMRIGCIFGTGCNAAYMENCGSIPKLAHMNLPPDMPMAINCEWGAFDNEHKVLPRTPYDVIIDKDSPRPGQQSFEKMVAGLYLGEIFRLVLVDLHDNQEIKIFPGQDIAKLRKAYSLDSSFLSLIEEXVXPLCKTXRLATNEHLQGPFENLSETFELFQTKLGLTPTGPELELIRRTAELIGTRAARLSACGVAAISKKKGYKQCHVGADGSVFNKYPNFKARGAQALREILDWPEKADPKEDDPIEILAAEDGSGVGAALIAALTMQRIKQGNMHGI

SEQ ID NO: 3801 - protein, 960 aa, Neurospora crassa
  unsure (1)..(960): unsure at all Xaa locations
SSPLRQQTETQSDADRTPRANGRSQLIGGMAVNQKKKKKDYTECXPHSADSSPIRYASSSSPGRQLTQQSDLRSESSQLFVSSQRSVAGRSRRGDINGDPLRTPAQIPRRIILDDAGRVIRDAPGSDANSFVTNNPNTSEADALGGQSQGLVWGTTISLDDSFSAFKDFLRNFTRKYRMWADGADEAETIGHPDADSKPYWEALENMLLLGTNKLYLDLRDLKSYPRTLKLWHQAQHYPTEIIPVMDQCVHDCMMELAQKEMASQRASQNSRTAPGASQSSEPNFPSSERSEEPPTPRPAQTAAPTIEDQVSQMAYVVRPWGLDKITNLRDLNPSDMDKLVSIKGLVIRTTPVIPDMKDAFFKCSVCGHSITVQLDRGKIREPTECPRARCASKNSMQIIHNRCAFEDKQVIKLQETPDNVPAGQTPHSVSVCVYNELVDFCKAGDRVELTGIFKVTPVRVNPRMRTVKSVHKTYVDVVHVQKVDRKRMGSDPSTLDLAEEEEAHANGQSMDEVRKVSPDEEERIKETAARPDIYDLLSRSLAPSIYEMDDVKKGILLQLFGGTNKTFEKGGSPKYRGDINVLLCGDPSTSKSQLLSYVHRIAPRGVYTSGKGSSAVGLTAYVTRDPESRQLVLESGALVLSDGGVCCIDEFDKMNESTRSVLHEVMEQQTVSVAKAGIITTLNARTSILASANPIGSRYNPDLSVPQNIDLPPTLLSRFDLVYLILDRVDEKNDQRLARHLLSMYLEDKPESAQQANDVLVSFSPSVNPHEDEPQTNQLPLKKTARRVLTSYISYARSHIHPALTPEAGRELVDAYVEMRKLGQDVRAAEKRITATTRQLESMIRLAEAHAKMRLSQTVTRDDVREAVRLIKSALKTAATDSQGRIDMSLLTEGTSAAERQRKADMKDAVIRLLDEMTSGGQVVRYSEVARRLGEGAGVQVEPAEFAEVMRALEMEGAV

SEQ ID NO: 3802 - protein, 273 aa, Neurospora crassa
YQLEELIGKGSFGRVYKATDNKSNAVVAVKIIDIEESDRENPRLADTYSEFMKETSALKLLSNSGAKNINLILDVLPVGQSMWLITEYCAGGSVATLMKPTAPGGLQEKWIIPILREVAEAIFWVHKEGIIHRDIKCANVLVTETGAVQLCDFGVAGIVETKFDKRSTFIGTPHWMAPELFEPTPSYSTPVDIWAFGSMVYEIASGLPPNVMSGFNIPQLGNYIKSHAPRLEGDQYSDNLKDLVAFCLVEDPAKRPTIEQVQRHPYIFNTSSE

SEQ ID NO: 3803 - protein, 790 aa, Neurospora crassa
FIVSGALVATWVIGLIFFVSSKAYKPSSSFAHDPQATVTHGSGKKVTLDQVLNNEWRAKSHSISWIAGVNGEDGLLLEKEGANKDYLVVEDVRAQNPSSVEASKSKTLIKDKLFEFANKTYWPTVTVPSRDLKKVLLATDVQNNWRHSYYAVYWIFDVETQQAEPLVPYDADARLQLASWSPTSDAIVYTRDNNMFLRKLDSDKIVQITRDGSADVFNGVPDWVYEEEVLASGVATWWSEDGNYVAFLRTNETGVPEYPIQYFVSRPSGEEPKPGEENYPEVRQIKYPKAGAHNPIVDLKFYDVKRGDVFSVDISGRFADDDRLITEVIWAGKQVLIKETNRVSDVMRVVLVDVGSRTGKAVRTVDVNDIDGGWFEISHKTKFIPADPANGRPDDGYVDTIIHNNGDHLAYFTPLDNPNPIMLTSGDYEVVDAPSAVDLQRNLVYFVSTKESSIQRHVYQVKLTGEDMTPVTDTSKEGYYAISFSTGAGYALVSYQGPNIPWQKVISTPSNPDKYEHVVEENKDLAEAAKKHELPINIYGTINVDGVELNYIERRPPHFDKNKKYPVLFQQYSGPVSQTVKKTFAVDFQSFVAAGLGYICVTVDGRGTGFIGRKNRVIIRGNLGTWESHDQIAAAKHWAQKDYIDEDRLAIWGWSYGGYMTLKTLEQDAGQTFKYGMAVAPVTDWRFYDSIYTERYMRTPQTNPEGYESAAVTNVTALSQNVRFLLMHGVADDNVHMQNSLTLLDALDQRSVENYDVQVFPDSDHGIYFHNANRIVFDSEYFNVLLWPSR

SEQ ID NO: 3804 - protein, 628 aa, Neurospora crassa
  unsure (1)..(628): unsure at all Xaa locations
RVVSYSDGIARVHGMANVQAEELVEYVPVPNLTDAPSPQIXPFIPRFASGVKGMCMNLEAGQVGVVLFGSDRLVKEGETVKRTGEIVDVPVGPELLGRVIDALGNPIDGKGPINCKEKRRAQLKAPGILPRQSVNQPVQTGLKSVDAMVPIGRGQRELIIGDRQTGKTAVALDAILNQKRWNSGSDEDKKLYCVYVAVGQKRSTVAQLVKTLEENDAMKYSIVVAATASEAAPLQYLAPFTGVSGCRILSPPIISRPLQLPLEHLQIFVXRLVYIWEDVFQITGNPFHSSSYPSQIYARPLQHFCTSLLNFSTDLSNTIRPHHTSSRIPAPRPVRNQSDQTGXPEASKHRRVVGEYFRDNGKHSLVIFDDLTKQAVAYRQMSLLLRRPPGREAYPGDVFYLHSRLLERAAKMNKTHGGGSMTALPVIETQGGDVSAYIPTNVISITDGQIFLESELFYKGVRPAINVGLSVSRVGSAAQLKAMKQVAGSLKLFLAQYREVAAFAQFGSDLDAATKQTLNRGERVSANRLNSPCLGAELTSLSTVTELLKQKQYSPMAVNEMVPLIFAGVNGFLDSVPVAKILQWEADFLAHLKTNEPEIMATIDKEGAISKDLEAKLRDVIQTFTKSF

SEQ ID NO: 3805 - protein, 1385 aa, Neurospora crassa
  unsure (1)..(1385): unsure at all Xaa locations
EADEAYVIGKRGQYTPVGAYLASDEIVKIAVEHGAQMIHPGRIEPFTXRPXCRFYXSSHRYGFLSENADFARKVEKAGLIVSCPDHAXLERGVHVIRPMRSAXALTCSLXFIGPSPEVIDALGDKVSARKLAIAAGVPVVPGTEGAVDTFEAVKDFTDKYGFPIIIKAAYGGGGRGMRVVREEASLRESFERATSEAKSAFGNGTVFVERFLDKPKHIEVQLLGDNHGNIVHLYERDCSVQRRHQKVVEIAPAKDLPTETRDAILADAVKLAKSVNYRNAGTAEFLVDQQNRYYFIEINPRIQVEHTITEEITGIDIVAAQIQIAAGATLEQLGLTQDRITTRGFAIQCRITTEDPAKNFQPDTGKIEVYRSAGGNGVRLDGGNGFAGAVITRKXFPLSPFMPQRPFPKTPRPQMHRLMSFQLSMGHSCYLSTHTCINQMHRDTRGMASTALLRPFDISSRLFCNKKLHANLRRIPQFPAACCFTLKHLFRGKQMAGAWTHXCGAGPKDPQIIRGVDRASCAASTHQHIFTLAVVNSNHHIYQSPPLSVTTNHQSRPLSRXCHXHXGITAFYDRXVVTQSLADPDLHDHRLSVDTCTNLPSITSMLVKVSCRGSTYEIARRKVLRALIEFRIRGVKTNIPFLASLLTHPTFIEGNCWTTFIDDTPSLFDLVGSQNRAQKLLAYLGDVAVNGSSIKGQIGEPKFKGDIIIPELHDASGKKIDVSQPCTKGWRQIILEQGPKAFAKAVRNYKGCLLMDTTWRDAHQSLLATRVRTVDLLNIAKETSHALHNLYSLECWGGATFDVAMRFLYEDPWDRLRKMRKLVPNIPFQMLLRGANGVAYASLPDNAIEHFVEHAKKNGVDIFRVFDALNDIHQLEVGIKAVQKAGGVCEGTVCYSGDMLNPKKKYNLEYYLKLVDELVALDIDVLGIKDMAGVLKPHAATLLIGSIREKYPDLPIHVHTHDSAGTGVASMVACAMAGADAVDAATDSLSGMTSQPSINAIIASLDGTDKDTGLDVHHVRALDTYWSQLRLLYSPFEAHLTGPDPEVYEHEIPGGQLTNMMFQASQLGLGSQWLETKKAYEEANDLLGDIVKVTPTSKVVGDLAQFMVSNKLSKDDVLARAGELDFPGSVLEFLEGMMGQPYGGFPEPFRTKALRGRRKLDARPGLFLEPVDFAKVRKELARKFGSVTECDVASYVMYPKVFEDYKKFVAKFGDLSVLPTKYFLSRPEIGEEFHVELEKGKVLILKLLAVGPLSENTGQREVFYEMNGEVRQVTVDDKKASVENVSRPKADPTDSSQVGAPMAGVLVELRVHDGTEVKKGDPIAVLSAMKMVRCPLHPFTQMTQYXFVSYRKMVISAPHNGVVSSLAVREGDSVDGSDLVCRIVK

SEQ ID NO: 3806 - protein, 243 aa, Neurospora crassa
YEKAVAHAIGMKAGDKVLDLGCGRGRVAAHMASMTGATVTGLNIDPNQVAQAQEFNNLKGFKNTFVQQDMNTLPLPFADNSFDCFYQIQALSLCKDLPTLFREVYRVLKPGAKVSLLDWVSLPGYDPSNPEHLALMRRVKPLIGAVGTPTPKSFEKALEDAGFVVTKSENASIDGLQAPLIDRVDIYFRTMRQIILGLVKIKVLPQHFKTLINRLCLDGQAFVKMDRMRLISTSYWIVAEKPL

SEQ ID NO: 3807 - protein, 765 aa, Neurospora crassa
DQSEFEPCWALLRDAMTDIHLQNAGRLSFEQLYRASYKIVLRKKGALLYERVRDFEQEWFRDHIMPNIAALITKNLINISLLQHPGSSSHERREMGEKFLRGIRDSWTDHNRSMNMIADVLMYLDRVYTLETKQPSLFAVTIGLFRNNVLRSHIGAAAEDIEQDFVVFDILCAVILDLINMERDGDIINRNLVRKITAMLESLYETDDEIENHRLYLTLFEPRYLEASTEFYRKECEKLVQEANCSTWLRHAQRRLNEERERCGTTLSIMTTDKIASVVEKELIEAKLDVFLAMEGSGLKPMIDNDRLDDLSILYQLISRVDSTKSALKVILQRRVRELGLEIEKALKNTDFSVAGAAAGDGEDAGEAAEKAKPQTLNPAQQQTAAAIKWVDDVLQLKDKFDRILSDCFCDDLLLQSAITRSFSDFINSFNRSSEYVSLFIDDNLKRGIKTKTEAEVDAVLDKAIVLLRYLTDRDMFERYYQKHLAKRLLHGKSEIHTEKEMVSRMKSEMGNHFTSKFEGMFKDMELSKDLTDNYRDHIASLGDADYKMVDLNINVLTTNNWPPEVMGGGTSKGEGAKLDCFYPPEIKRLQESFYKYYLKDRSGRVLTWVSSAGNADIKCVFPKVPGKETGPLSKERRYELNVSTYGMIVLMLFNDLVDGESLSFDEIQAKTNIPAPELMRTLASLSSVPKCRVLLKEPATKNVKNTDKFSYNAQFVSKAIRIKAPVISSISKVEGDEERKETERKNDQTRAHVIDAAVVRIMKS

SEQ ID NO: 3808 - protein, 351 aa, Neurospora crassa
  unsure (1)..(351): unsure at all Xaa locations
TSIGTGYDLANSIFSPDGRNFQVEYAMKAVENGSTSIGIRCKDGIVLAAEKVITSKLLKQGANKRIATVDRHLGIVVYVDLFLFLFVWAGFIHELRPSAGQLEPGSPPSSAIAXTNHTPTFTTFXSSSTITNHKLRIRLXXVYSGMIPDGRHFVDRARDEARGWRDNYKTPISTKDLAGRMGGYMQAYTLYQSVRPFGITAIIGGYDSELDTPVEGEVGSGPSVGAGGKVEGKKHGGPFLYMVEPSGLYWGYYGAATGKGRQAAKAELEKLDLSSDGESSLTLEQAVKEAARIIYVAHDDNKDKEFELEMTWISGADGPTKGRHQEVPEALRKEAEKYAERMTAKDIEEEE

SEQ ID NO: 3809 - protein, 536 aa, Neurospora crassa
VVLIQLPNSLAFAPVLLGTLAAGLTATLVSPALTSDEIAWILQNSRPRAIITAKACLGAMREALEKQEPRDRAFFDAVPIFIFDAAKDHYPSVSSSSPPTSVGSGSSSSSKKTNKTQDWKVLLRSSRATVVPSSFLPSSASPARTAVILWSSGTSGRSKGVLLSHHALNFSGAHMWHDAADYHSLAKVRQQRWLGYVPFYHVFGLCNIVLLAIMTGSTVYVMPSFSLDGMLAAIPKRKITYLHMAPPIAVMLAKAPVVEKYAKRDPKTGKNGFSSIVAAVTGGAPLGHEVVVEVYKRCGFRVRLGYGLSETCSTSLQRGTSEKEMVEQAGETGVPHWGVEVMIADMDVPAPGLVDGKTKAARIGQEGEILIRSPTLLSAYLPVGMFRTPKGQEPDMSVTREALTVDGWFRTGDVGTISAQGRLRITDRLKELIKVRAYQVAPAELEAVLCSSPSVADAGVVGVYDESEATEWPRAYVVPHKPEALENKTELEKLAHELRVLVEKRTTKYKWLMGGVVFVKQIPKSPSGKILRRILK

SEQ ID NO: 3810 - protein, 444 aa, Neurospora crassa
VSRRGYATAEPDLKTVLKEAIPEKRELFKKVKAHGNKVLGEVKVENTIGGMRGLKAMIWEGSVLDANEGIRFHGRTIKDCQKELPKGKNGTEMLPEAMFWLLLTGKVPSTNQVRQFSRELAEQAALPDFVNKLLDGFPKDLHPMTQFAIAVSALNHTSKFAKAYEQGLNKADYWEPTFDDCISLLGKLPTIAAKIYQNSYKGGGALPAEVDLEQDWAYNFAAMLGKPGKENENFQDLLRLYLALHGDHEGGNVSAHTTHLVGSALSDPFLAYSAGLQGLAGPLHGLAAQEVLRWILQMKEAIPSSYTDEDVRSYLWNTLNSGRVVPGYGHAVLRKPDPRFEALMDYAASRPKIAADPVFQLVLKNSQIAPEVLKQHGKTKNPYPNVDSSSGVLFHHYGFHETLYYTATFGVSRGLGPLAQLIWDRALGLPIERPKSINLEGILK

SEQ ID NO: 3811 - protein, 197 aa, Neurospora crassa
DVSKEDQVEKMVSHLDSWGGLDIIFNNAGIMHSQDDDAVATPESIWDLTHNINVKGVWFGCKHAVLSLRKHKKTKGSIINTASVVALVGSATPQLAYTASKGAVLAMTRELAMVHAREGFRFNSLCPAPLNTPLLQDWLGDDKAKRLRREIHFPTGRFGEAVEQAQAVVFLASDEASFVNGHDMVVDGGMTKAYVTP

SEQ ID NO: 3812 - protein, 373 aa, Neurospora crassa
  unsure (1)..(373): unsure at all Xaa locations
DIPKEQWAQVTEKDGGYVALFSFLSRSWNFDYVPYXHQYAVITYKKIPVPTPGHDEVLVNIKYSGVCHTDLHALDNDWPLPRKTPVIGGHEGAGVVVQKGELVTNVDIGDKVGVKWLMSTCFHCTFCQQALESLCPKAQLSGYTKDGTFQQYCVANAAHLARFPPQTDLSAVAPIMCAGLTVYKGLKESDTRPGQYVAIVGAGGGLGTIGIQYAHAMGLNVIAIDGGKEKGEACKKLGASMYIDFKESKDLVADVKKATHDGLGPQGVVLLAPQEQPFQQATGYVRSHGTVVCIGMPAGAKVSMPVFDTVVRMIKVKGSYVGNREDTAEALDFFLRGKVHAPYKVIGLSQLQSVFDEMRANRVIGRYVMDMSK

SEQ ID NO: 3813 - protein, 364 aa, Neurospora crassa
  unsure (1)..(364): unsure at all Xaa locations
RVEDPTVRSGGCLTIYTTELELDEEGTRIALTIVDTPGFGDQIDNEASFSEIVGYLERQYDDILAEESRIKRNPRFRDNRVHAMLYFITPTGHGXVSLPLLHILTHLESQLTCAISLRELDIELMKRLAPRVNVIPVIGRADTLTPAELAESKKLVMEDIEHYRIPVYNFPYDIEEDDEDTVEENAELRGLMPFAIVGSEDIIEIGGRKVRARQYPWGVVEVDNPRHSDFLAIRSALLHSHLADLKEITHDFLYENYRTEKLSKSVEGGAGVXVLPXSFRLQPRSGVEYXRXYSDSSMNPEDLASQSVRLKEEQLRREEEKLREIEVKVQREINEKRQELLARESQLREIEARMQREAAAAAQA

SEQ ID NO: 3814 - protein, 504 aa, Neurospora crassa
  unsure (1)..(504): unsure at all Xaa locations
MRGTLIFSGSSCPALTGKVCENLGMTPADAELTQFSNGETSVRILTSVREKDVFVVQSGSPKINDTIMELLIMISACKGGSASKITGMSAAQQQSIQCEGXPGPPFXAVLPYFPYSRQSKKKSHRGAITARMLANLLGVAGVKHIITVDLHASQMQGFFKCPVDNLHAEPLIARWIRQNVPDWKEAVVVSKNAGGTKRVTSLADALKLNFGMVTTDKKRGNGNMTGSMLLNPIDAVLDPIGEQVNEAVEHEEPSVSNITQPIAGTTSPARRPNGSSMHSAKSLPSRLRSSTSALDGVDEEGEDGVEYNDQRAHEVTQARLVQGHIVPDDFESPAVSAATSVAGDDPMTMSHASSFFAPQHHAALGGSGDAAESSDEEEEILKDPKVEHMVTLVGDVKNRTVFIVDDMIDKPGSWIAAAETVVKRGLAKKVYCIATHAVFGADCLEQLQDCDCIDHILVTNSYPIPEEKARNASKLTVLDLSYLLAEAIRRNHYGESISPLFQHI

SEQ ID NO: 3815 - protein, 456 aa, Neurospora crassa
  unsure (1)..(456): unsure at all Xaa locations
VLIGVFVAFGGLLFGYDTGTISGVIAMKYWNERFSTGYIDADGRPAISPSQSSLIVSILSAGTFFGALASPLLADKIGRRWGIIISSWVFNFGVSMQVISVAIPLFVAGRFFAGLGVGLLSALVSDASFFFFSIKSWPWYANSAPFIVPLYQSETAPKWIRGMIVGVYQLAITIGILFAAIVNNGTHEREDTGSYRIPIALQWLFSLTLIIGMHFLPETPRYCIKRGDMTRATRALARIRCLSPNDPAILAEMEEIRANYQYELSLGNSSYLDCFRKGMLKRMLTGMVLQILQQLTGSSFHLPCSPCCSTMTVFXLEELYRRNFIFYYGTQFFENSGISNSFLISMILATVNVLSTVPAVFMFDKFGRRPLLLWGGVAMHICHFIVATLGTSTTSQTATGVIIVLNVAAQKASITFVCLFIAFFAATWGPLAWVVTAELYPLKHRSQMLSISTATN

SEQ ID NO: 3816 - protein, 939 aa, Neurospora crassa
  unsure (1)..(939): unsure at all Xaa locations
TVEIAEDVDGGTTQRRVSSHDPEKIQSSAGTTHKFSEQIPHEMLEELAPNGESDYICEKVDNMSEDEAIAIVQESVRFHADDWNFPSEMRERMKRLLEGPKAYGEFYDRDLRIDATLMRYSSPYPGVCAVQELKDDPTVPIETIRAYFLGVAWAVIGTFMSTFFNSRFPSIGLLHIVSRTHCSFKIXSLGLTVSAGLSGSVIQILLFPCAKFLEWVLPDWGITVWGVRHSLNPGPWTFKEQMFSTICYNIAIYTTNSYGMVRFRYGDWDDVYXLAGQILVQRLDGYYGLKFVNFGYQLMLTLFVQLMGMGFAGYLRRFSVYPVKALWPTILPTIAMNRALTRPEPKENIYGWTISRYRFFYICTLTMAIYYWFPGYLFTALSTFNWMTWIAPDSVVLSLLTGSITGLGLFNPITTFDWNVATSSYAALSQPFFATCTMYFGGILGGLIILGIYYKNMNYTAFLPINSSSAFANDGTPYQVQKVVVNNQLDQTKYQNYSPPFYSAGYILTVGANFCFYPVXVNLFTTPIVLIXSVLHSXLLFLHHGQPMEDYWPSLCXFLPWVALRKGQLENAMDIHSRLMAQYPEVPDWWFLIILVGAIVVSVLFLKIYPLDTPIWLVFLVIGINLVFAVPLSFLSATTGTNLGLGALIQVITGFLLPGNTNAFLFAQTLGSWALAGYGDNMVQDLKMGHYVRIPPRAVFRSQIGTIIITVFVAVGTQDFIMTNVKGLCTPNQPSRFTCANDGNPLYASSLMWGLLGSDRMFNSLYPLFKWCFLIGTCIALVFLFGQTYGPRYLPGVKDQLRQRLSRRMFSLLDRTLFPFVASLLWLNPILVIQGVQHWAPSNMSYKTPGFILSYVFMYWMPKHRLAWWEKYNYVLSAALTAGVAVSGLIIFFAVGYNPKKLEWWGNTVSGAGVDGRGTGVLEIPKDRGYFGPEKGTFP

SEQ ID NO: 3817 - protein, 449 aa, Neurospora crassa
LAGGLDPLMVQYNESIHFDRALFAQDITGSIAFARANAKAGIITQDEFNKLEQGLLAVKKEWEDGTFKIVPGVDEDIHTANERRLGEIIGKDVAGKLHTGRSRNEQVATDMRMWLRDELRKIEKHLQDFLNVTAARAEQEIDVIMPGYTHLQRAQPVRWSHWMLSYGFAFASDLERLREVIKRVNRSALGCGALAGNPFGIDREMMSKELGFDGLLWNSMGAVADRDFVAETLQWGSMLMQHISRWSEDLIIYSTSEFGFVRLADAYSTGSSLMPQKKNPDSLELLRGKAGRAFGHMAGFMMTQKGIPSTYNKDLQESWEPMLDHVKTVSDSIQIANGVLATLSIQPEKMKESLDPFMLATDLADYLVRKGVPFRETHHISGRCVALSEQTGIPMDKLSYEQLKGIDARFEEDISKVFDYEKSVEMRSAKGGTSKACVQEQIQVLKSMI

SEQ ID NO: 3818 - protein, 359 aa, Neurospora crassa
VNRARLIEENKITHILSVINYTLPADPAFRNVQHLSIDIDDVEEADILVHFPKMVRFIERGLYGDEAASIAFGGDNAPVVVPTPASASAKINGDDETAHDADAITAAPPITTTTITSQQQQTKPGAVLVHCAMGKSRSVSAIVAYLLWKHPHRFGRSDPSTPARRAVTQAINWVRQTRPIAEPNDGFMEQLELWWTMGCPLESGDDAVENHPAYQRWLYKREVEDATRIGRVPDWIRFEDEEAAKLASENNNKEAEAGGGAASLSLRCKKCRRTLATKPFIVPHHQGKGNKERDCGHYFVEALSWMRPTLEQGELEGRLTCPNQKCLASVGRYTWQGFRCSCGDWIAPAFSLQKSKVDE

SEQ ID NO: 3819 - protein, 515 aa, Neurospora crassa
  unsure (1)..(515): unsure at all Xaa locations
TKGGALFGFDISSMSAIISTQPYLCQFNQLGHNEKGLCLGPTNDVQGGITAAMPGGSWLGALCSGFVSDTFGRKRSIQIGSVIWYVVSASTTSREPNNXPFLAGLIGSVIVCASVNIPMLVVGRIINGFSVGICSAQVPVYISEIALPSKRGRLVGFQQWAITWGILIMFFICYGCSFMKGTAAFRVPWGLQAIPAALLFLGLVFLPESPRWLCKKDRWDEAKDVLTLVHGKGNPNSPWVHREMQEIREMVEFERANADVSYFELFKPNMINRTSIGVFTQIWSQLTGMNVMVCLPIILAPCFTKVIADHQQMYYITYVFTMAGLADGSENAVLLPSGIQFVINVVMTIPALLWMDRWGRRPTLLVGAFFMCLWLCVNAGLFAVYSRPARPGEFTSPAESMAITGAPAKAVIASTYLFVASFAPTWGPVSWTYPPELYPLRLRGKAVALCTSANWAFNFALAYFVPPAFANITWKTYVIFATFCAAMFIHVFFMFPETANKPLEEVEEIFDDTKP

SEQ ID NO: 3820 - protein, 1162 aa, Neurospora crassa
  unsure (1)..(1162): unsure at all Xaa locations
MGTEIELDVEGQTEPPICGFKSPTTSKTTTRSPTLTTLNTGTIIGEECEYRANDNATITTAATGIGPGDLPSFTPEAAHTLSVPDVCAFLRTDPENSPSMPXSRNALHSKVWSLIXSCRNGIDNDEAARRLQHHGPNKVEGAKGLSLWTILLRQVSNSLTLVLVITMVLSFAISDHIEGGVIAAVILLNIIVGXDWTMXIHVLVAPLLAEMLTTASPISFLQDYRAEQTIQALYALSAPTCKVTRSGVTSTIKAETLVPGDIVRLGVGDVVPADLRLATSINLSTDEALLTGESLPVSKHAELVMARDRDVPLGDRSNMVYSASTITRGRATGIVVSTGMGTEVGKIAGLLRDSNGGRNKKRVDKEEMGTLRSLTVRARNGMRVLLGLDGTPLQVTLSKFALLLFALAILLAIIVFSVSKFDVTDEVLIYGICVAVAVIPESLIAVLTIATALGTRAMARGNVVIRKLAALEAVGGVTNICSDKTGTLTQGKMVTKKVWLANGTEVEVLGTTHPFDSTSGSVSIGEEVFSLADHGMKDPEEAIGEKGENLKEFLESIALCNNAVVTKAEEAGTYSAIGEPTEIALQTFAMRFGMGKSSVLAIVDGQSQQQLLFEFPFDSSCKRMTVVYTSTESSGAGDSYAYTKGALEALLPLLDASDEQKVEIVAKAEALAAQGLRVLCVAKRSVNGALFQAGDDVSASPEREKASASIVPERSSVEMHLTFLGLAGIYDPPRLESAAAVQKCQAAGITVHMVTGDHVKTATAIACEIGILRSDRLQNGTEVMVASAFDSLSDAEIDALESLPLVLARCSPTTKVRMVEAMHRRKAFCVMTGDGVNDSPALKKSDVGIAMGLSGSDVAKEAADMVLTDDNFASIVTAIEEGRRLFDNIQKARIXPSKRTEKVMTNKRNSSSLLHLLISNIAQVILLLIGLSFKDNDGISVFPLSPLEILWANLVTSSFLALGLGLEDAQPDVMQRPPHDLQVGIFTRELIVDKFVYGTAMGGLCLAAFTSVAYGMSGADGLGEGCNEDWTSECGVAFRARATTFATLTFLLLVTAWEAKHFTRSLFNMHPEKYSGPLSVSKTVWQNKFLFGAVSAGFVICFPVIYIPVINHVVFKHNAITWEWGVVMACVVVYVAIIEGWKAFKRRTLKAKMVTGVGGEGV

SEQ ID NO: 3821 - protein, 369 aa, Neurospora crassa
RYWGKRDTKLNLPTNSSLSVTLSQADLRTLTTASCSASYPEGDSLLLNGEPSDVSGARPQACFRELRARRAALEAADPSLPKLSTMPLRIVSENNFPTAAGLASSAAGFAAFVRAIANLYELPASPSELSLIARQGSGSACRSLFGGYVAWRMGEAADGSDSMADQVAEASHWPEMRALILVASAAKKGVSSTSGMQQTVATSSLFKERITSVVPKNMEIMEKAIAERDFAAFAEVTMRDSNSFHATCADTYPPIFYMNDVSRAAIRAVEAINAAAGRSVAAYTFDAGPNAVIYYLEQDTEAVVGNLYSVLSKVDGWKASAVEGLKANASFDESVVGLLKNGVSRVIMTSVGEGPVATQEYLVAEDGTP

SEQ ID NO: 3822 - protein, 231 aa, Neurospora crassa
LPTSQQQQQSSSSSSWSSWLPFMSSSSGSTTTGAAAAAGATPQLNLGEHREISSIPRAATTGPSACPSNAEQETGADTSTGNWVYPSEKQFYEAMKRKGHDGASAADMKTVVPIHNAVNERAWAEILRWEKPFTGEACGCAEGPKLQSFMGESKRMTPKARLNTLLGYTAPFDRHDWIVDRCGTRVDYVIDFYAGRNNDRAGAGKLNFYLDVRPKLNTWEGVKMRALRFVG

SEQ ID NO: 3823 - protein, 1211 aa, Neurospora crassa
  unsure (1)..(1211): unsure at all Xaa locations
RQSSILGFFSKAASSGTPTNAGANTNANANANATIGASSPASDATATPRAGQKEKSPECLKESTKSNSILPPRRRKRLDETPVPSSXRRSTPRAPRKTQALPIPRMMTPGPSXCPVAPSGARRVISSLFXTSIXANPSRLQAKAVINYAESSDDDGDDVFLSFSGRPKSSRPSRSRSRPQVLDEDDEDDAFEIDDNAINEEEDDDMADFVVDDDESDQGPSKSKKRKRPAARPSAPRKKSAVSSPPSPRRSSRQEEYDQDEEMMDDVPRTSTALKWKYDPDNIEPTEPRSAAPRSAQTPSATKPKTKAHTREPEERYPWLADIQDANRNRPGHPDYDPGSVYVPPSAWRQFSPFETQYWEIKKNLWDTVVFFKKGKFYELYENDATIGHQLFDLKLTDRVNMRMVGVPESSLDMWVNQFVAKGYKVARVDQMESALGKEMRERDTKAKKADKIIRRELTCILTGGTLVDGSMLQDDNAVYCAAIKESVVDDKPAFGIAFVDAATGQFFISEFEDDVDLTKFETFVAQTSPRELILEKSHLSTKALRILKNNTSPTTIWNYLKPGTEFWDADVARRELDCSGYFVSGEGQEEVWPAKLKEARDKDLLMSALGALTQYLRMLKLERNLLSQGNFAWYNPIHRNGTLILDGQSLINLEIFANTANGGPEGTLFHLLNRCITPFGKRLFRQWVCHPLCNIQKLNERLDAVDMLNDDHSLREQFSSQMSKMPDLERLISRIHAGACRPEDFVKVLEGFEQIDRTMELLESYGGGNGLVDRLIASMPDLKEPLGYWKTAFDRKRARDDKLLIPEPGIEEDFDRSQAELDRIKGELQELLERQKTALRCKTAKFTDVGKEVYQIEVPKTVKVPPKWRQMSATSAVKRYYFKELEDLVRELQEAEETHSQIVKEVASRFFKRFDLDYETWLQAIRIISQLDCLISLAKASSALGQPCCRPVFVNDERTVVEFNELRHPCMLNTVDDFIPNDIKLGGDEANINLLTGANAAGKSTILRMVSACLGRGGIHLFXCSSSANAFRAQSCIAVIMAQIGCYVPAVSARLTPVDRIMSRLGANDNIFAAQSTFFVELSETKKILSEATPRSLVILDELGRGTSSYDGVAVAQAVLHHVASHIGCVGFFATHYHSLATEFENHPEIRARRMQIAVDEENKRITFLYKLEDGVAEGSFGMHCAAMCGIPDKVIRRSEVAAKEWEHTS

SEQ ID NO: 3824 - protein, 535 aa, Neurospora crassa
AYQSTRWASQRSKNIPQRTGRILSTMLGLSRQSWIILALSAIIIMDVSKTVLKDSKKEEHSLAKPTYASRKEMLDAANEIAQILGQDAVTSDAHVLEHHGHSDWSTSNSPGRAVAVVYPRTTDHVSAIAQICNARNLPMVPFGAGSSVEGNFSQPYSGICIDFTYMDRVIAFHPEDMDVVVQPGVNWVDLNNQIAHTGLFVPLDPSPTATVGGMVSTNCSGTNAMRYGTMKDWVLNLTVVLPDGRVIKTRRRPRKTSAGYNLTSLFVGAEGTLGIVTEVTLKLAPIPKETSVAVVAFPTIHSAAAAASKLIRSGIQLAALELMDDEQMKLLNAHGSDAVRKRVWDEKPTLFLKFSGTTKDAIKSDVSRVGDILKPLTDSKFHFAKTKQDELDLWSARKEALFTMVNTRPKGTEIWSTDVAVPISRLAESIEISKRECGSLGLFASVVGHVGDGNFHVSMMYDPTNAQQKQAVAKCVKNMMTRALEMEGTVSGEHAIGIGKKECLVDELGEETIGLMRQLKASVDPKWVMNPGKVF

SEQ ID NO: 3825 - protein, 1289 aa, Neurospora crassa
TWTDYLLLLIGTISALAAGVPFPLMGIVFGQLVDDMNGATCAVEQHDTNPFRYEHDINDKVLIIVYIAIAAFCLIYIYVLSWSLISQRLAARLRNKYVSALLRQPPAFFDTRAAGGEVSTRLHGDMAALQAGTSEKVGVLLASISFFITAYVVAFIKQAKLAGILISMIPAYLAMGLVGGAYFQKYMIKAAGAIASASSIASEALKNVIVVQAFGAAPRLEAKFADHMATARDAGIKRGMSAAVQAGLLYFIAYAGNALAFWEGSRMVADAMAGKGSETIGQIYTVIFILVDACVVLGNISPLLPLLGGAQAAFDRLMKDIDEPSPIDGTSDKGVVLPFETRGEIRFENVSFSYPSRPDQLVLKNVDLTFPAGKHTAIVGLSGSGKSTVAAMISRLQDPNSGRITMDGYDLKELNVRSLRSFISLVQQEPSLLDRSILENIALGLINSPKPEHQRLKDILHSHELADLAKKGKDSIDPTIVSSFGPLVQEIINLIQHAATEADAAGFIERLEKGYGTYAGPSGSMVSGGQRQRVALARALIRDPKILLLDEATSALDSASERRIQEAVDRAAKSRTVISIAHRLSTIRNADKIVVMEAGKVIEEGSYDELMAKEDGAFAKMANLQTLGTAHKAEAGSSVSGESIESSSSATGTSVEKPSAPEVAVTPAPPPAVAEAAALVETRLPASTPTRPLSSVVRSLGRFLRPSLGWLVIAIFAAVIVGGTFSGSGVLFGFTISSLNPCSGSMDKVLYYGKFFGGFLFMLACIEFFANFAAWSCFALIAEKLLYAMRVLSFRSLMEQGVQWHQSEGRSPSSLLTIITKDSASVGAFSGSTIGTVFSICVNFIAAIILSHIFAWKIAIVCLSIVPILLGTGLMQLRMLARYEERHAEAFNKATSVAVEAVQTIKTVAALSLEHEVLGSYQRLLKNNRDEMVKAAAFTNIWLALANSISFLVYAFAYWWGSQRIMHGEYSQRDFFIVLVAMLVSAQLWGQMFSLAPEFSRARLAISRILGVIGLGSNDHVHDSSSPASKTTDPEATGESSASRLSPQKKSGVQITFSDVSFAYPSRPDHPVLDSVSFTIQPGQFVGLVGPSGAGKSTIMNLVQRLYSPTSGSITIDGVDISSTQSSNTFRDSIALVPQEPALFDGSVKFNVGLGARPGHEASDAEIEEACRLASIHDVIASLPEGYETECGASASRLSGGQRQRLAIARALVRKPRLLLLDESTSALDAASEAALQEGLEKVARDTTVLAITHRLHTVQKADVIFVVEGGKVVDRGTHSELMARRESY

SEQ ID NO: 3826 - protein, 363 aa, Neurospora crassa
VEKYRPVSLSDVSGQQDILATINKFVDTNRLPHLLFYGPPGTGKTSTVLALARQIYGAANMRQMVLELNASDDRGIDVVREQIKTFASTKQIFSLGSSSSRSGLAGFKLIILDEADAMTSTAQMALRRIMEKYTANTRFCIIANYSHKLSPALLSRCTRFRFSPLKEKDIRVLVDKVIDEENVKILPDATDALVRLSKGDMRRALNVLQACHASSKWWCPRLAFCCGPQANPGQPGTPLQPKNAPKIAEKDIVRETITIRTIYDCVAAPPPDAIKKILSTLLSTSDVTTCLSTINTLKVAQGLALADIITALSEEIVKLEVKPQVMITWLDELAKIEHRVASGAGEVIQTGAVVGAIRNGVEL

SEQ ID NO: 3827 - protein, 723 aa, Neurospora crassa
TRKGVPCRRSGQRQERGQEGDKMDVDSKPAASSASTSVHDRSEPKSLADDSINHLPISDYMNRQIRQVLAGVKKTKAGYHFRLPVSELWPGLWNEYSAKVKDPTDIQTMEKRLRGNLAKYHTLGDFKRDLEKLVQNSIAFNGEYHDVTAAARSCRDTILARLGGCPAFEPSRPEKKDFAKQHPTRHAEPRAASHLSSPSAPLPQRPQQPRVNTAAVPAPSSSKSIESPAFAIPANNNGMPLIRRDSTKPDSRAKRPVKPTHSKDLVYDTKRKKKLIPELRFCEEVLTELRKQRYYEFNEAFQKPVDPVALNIPTYHKIIKKPMDLSTMQSKLNAGDYASAKEFERDFDLIIKNCRLFNGEQHIVYEQALRLQSLYRREMSKKDEWLAKHAPAPAPHLSSNTSPRLKDESDWEEPESEGEPEVDEELKGAQQRLASYMKRLEEEQKKINDIMLEMNPNMADVEIAQSVVAMLQKQIITERSKIASMQPTKKAAPAKSHHANKPSVSKPKKAMPAGGSSHHAGGHVAKKASVSHSSMGGHGGGMGGMPKKAAARKPAPKRKMGTVEKEVIAAGIAELEGAQLERAIEIIKSDTGTGENDSGELELDIDQLSQEALTQLYDLAIKAFPHLQREKERTMAAQAPAPPPAAQRSKPVQKTKKNKPMSKMEQERRLQQLNELRAQAGRQGSGSQEPLESIEGTGRTSAEPAPQHHREEDSEDEESSEEE

SEQ ID NO: 3828 - protein, 371 aa, Neurospora crassa
  unsure (1)..(371): unsure at all Xaa locations
NSXPIRTGVGAYRDDKGKPYVLPSVRKAEDKVIHSRMNKEYAGITGVPEFTKAAAVLAYGKDSSALDRLVITQSISGTGALRIGGEFLNRFFPGAKKIYIPTPSWANHGAVFRDSGLEVAQYAYYDKNTIGLDFEGLIRDLKAAPNSSIFLFHACAHNPTGVDPTPEQWKEIEAVVKDKGHYSFFDMAYQGFASGDIHKDAFAVRYFVEQGHNICLAQSFAKNMGLYGERVGAFSIVCADADEKKRVDSQVKILVRPLYSNPPIHGARIAAEILNTPELYEQWLTEVKEMADRIIKMRALLKENLEKLGSKHDWSHITSQIGMFAYTGLTPEQMEKLAKEHSVYATKDGRISVAGITSENVGRLAEAIFKV

SEQ ID NO: 3829 - protein, 454 aa, Neurospora crassa
LDPKAETALLHKLDSVFVPIIMLVYLSCFLDRSNIGNVKVAGMPEDIHATPAQFSTAVSIFYATYVAFEAPWAILLKRLTPRVTLTTLCVVWSLTTIFSGFITNIGGLYAARLVLGACEGGLFPGLNLYLTMVYKREEQARRVSYLFVCTAIAGAFGGLLAYLILKMDGVGGQAGWRWVYIIEGIFSVLIGALVWFALPNDPTEAYFLNEEEKRMMRVRARQRAQYMGSEDFSWEEIRIALKDTKLWLSGAIQFCQDILLFGFSTFLPSIIQSMGHTSIEAQYLTIPVYITGGLFFMGLAFLSDKIAVRGPLVAFANIFGILGYILIICPTSNGVKFFGTFLCAAAVYSGPGLNLTWLNVNVAPHYRRAAAIGFQQTMANTAGIVAGQIYREKPYLLGNAFSLAALVVSEFLIAGLWLYIRSCNRKKERISKGEIEDTRKVRTGDGALDFKYHL

SEQ ID NO: 3830 - protein, 548 aa, Neurospora crassa
  unsure (1)..(548): unsure at all Xaa locations
VSYTSLSAFIQPSSKPALSTPDLSTALTHGSLRDFTNNFALPSKALDVPQRGQLTKPIVCIALPNGPVLAAVCLAVANTCTASPVNCDKAVGAEQFRADVRQTGASVILTSAKDAERLGLTGPSSWTALEGLTVLLVESDLAQRGQPTQISIRDLTGQLVTPQVAGCSQPAPNGTDDVAIILFTSGTSGTKKLVPITIQNIVAGVAFVIDSWGLTPDDVCLNMMPLFHIGGLVRNIFSPIFSGGSVICCSAFDPTLFWDVMQDHGATWYYASPSMHQMILDQAEDRPEALAKSRVRLVCNAAGGLLPALAVKLKETFNGAIVLPSYGMTEXVPRLCLSGLSHXPMTDACPSQLHQQTTNLTKPGTSGVAVGPELAILDWNNIRQPSDTVGRICVRGEPVFPGYLTAEGQYDSSTFTPDGWFDTGDLGRLSSDGYLFITGRSKEVINRGGEIISPFEIENAIIAAAQDPKSPIFNRVLQALSFSVRHDVLQEVVGVVLVTPPGAQRVDTRQLHQALKQSLQQVKWPGLIVYMEDVPKSNNKVLRIKLAD

SEQ ID NO: 3831 - protein, 380 aa, Neurospora crassa
KFEGWLGFDKSSAHGNMQWGEFEPKPWEETDIDIKIECCGVCGSDIHTLRSGWVCLLFACCFKISVCQVLDANNSLQGPTNYPCCVGHEVVGTVVRAGSKVEGGIKVGDRVGVGAQSDACRNRTDKHCKICADGNYNYCRVHHVGTYNGVYMNGGKSYGGYATYQRVPSFFAVKIPESMPSSHAAPMLCAGVTTYAPLKFHGVGPGKRVGVIGLGGLGHFGVMWAKALGADEVVVISRSSSKKADAMAMGATGFIATGEDPEWLNKNRSSLDIILCTASSADMPFNDYLFLLDLDGVFIQVGAPDDDLPRIKQMALIFNRIKLTGSLIGSPDDIREMFQLAVDKKVQPWISEIPMKEANKAIVDFEDGKPRYRFVLKNED

SEQ ID NO: 3832 - protein, 872 aa, Neurospora crassa
  unsure (1)..(872): unsure at all Xaa locations
RVPILANFEEWMKMATDNKINAANSWNFALIDYFHDMSLLKEGDGVNFQKASCTLDGCVKIYTSRVDSVATETGKLLSGLADSRDSKKRDRGEGEDGGDDDEEEDEVDENGNVLKKRRKKVGCSAHCYGRVAXYXQLQTQRSSEATLAPSFASLQLKKFELEFSVDPLFKKASADFDEGGAKGLLLNHLMIDSQGRIVFDSSDDAIDTLDSRNQKAAEENDQDADPDAMDIDAMEIDGQTEKTQTRTQQQEEEEEDDVEIDIASLGARFFPDLGRLDEMDVCPSLKTFILGDPSGSLDIPFLRAPEDWRQEQDRAKTPGLGNKSGFIIDDENPLGFDDDDALGAFDLGGDVDVAFGEGGEAWAREAAIEPQMMRVFDAGLDIGEGEGGDDGDGVDGDLEMIDQDKGDFGMVNMTNAQKTDRLHEDILSYFDQALSKNWTSAEHWRIRKIKDVNKPQTGEPQRQRKEKQAFEIDFFTPVDRTLHDVLHTQATTNSAISLPKKDWKSKSRNLLPDDKHFSSKQLLNLFLKPKARLGRKQRAFGRSNADNQNPDQVPEGTMDEAFWAQQKAPLNQGPSSQDDHLPQGDYDANFFQDDGLPFANGGDDDDDEDMDEEVFADARDHFSPGPGGTQGDGAAGKEGTAGLTMDVGMTGAFNGLTVTNPADLAFGTMLVTQSRRVRPEYVQYARRAKKVDVRRLKEELWRGMGMDMLNGARFFFFFFFFFFSSLLFSSLFFFSFFFFLFVSSSFYFSQLLTTRTTDTNNNNNNNTNPEDSLLSPPPTTTPSAQPPSSSVEPPKEGEEEQQEKPTLKFTEVMNSLQKVYPKQAMDDISTSYCFICLLHLANEKGLVIEKSEELTELYIKKDANAVVEEGGE

SEQ ID NO: 3833 - protein, 303 aa, Neurospora crassa
  unsure (1)..(303): unsure at all Xaa locations
PVAFTNXQSPQLSWIIILFGSIFGFRDQNDGSNGAPVIVWPTYSWFTLVFNFFLILGIFIVIASDSAQTYHVAIVGYLAVGLVGSTSSINNLIYSGVASMEATAAGYILLSMVTVCGSPLTSPSWLTPFANVPPIIWIFYFGSAPSAVPRAYIDSFALTKESTLPAHHMSRQTMNHNGLSSPNAYGSYNMRPETSASGLQPPQMYTGQLNGLENPARQSQIPQGFSSNNIPKPQGEGEIVPPTEYPYRAKAIFSYEANPDDANEISFSKHEVLEISDVSGRWWQARKENGETGIAPSNYLILL

SEQ ID NO: 3834 - protein, 92 aa, Neurospora crassa
FTLDDVRKHNSKDDVWMVIHNKGDLLFPLFPQMVTPLLTFSVYNVTTYLEDHPGGSIILREVAGTDATEQFVEIGHSVEATDILEELYVGDL

SEQ ID NO: 3835 - protein, 262 aa, Neurospora crassa
EAQKEFTHFPRSRPAKKERKVAILKIPTNSTSGPAVKPPVKVMDPADWRKFKLVRKVLVSPNVYHLVFALPHPTDVLGLPTGQHVALRALIDGKSVSRSYTPVSNNSDLGRVELLIKVYDQGLMTKHLERMEIGDQIEMRGPKGAMQYVPNSYAKEIGMIAGGTGITPMYQLIRAICEDESDKTKISLLYANNTEADILLREELDGFVKAFPDKLSVQYVLGQADENWTGLRGFVTADMIKDFLPPAADTTKMLLCGPPPMV

SEQ ID NO: 3836 - protein, 258 aa, Neurospora crassa
RPVTILGGGVLGRRIACSFVAGGFNVHIRDPSPQAREDALKYIDENKEFYTTFCPNGEPAPYGTYTASADIETAVKDAWLVIEAVPEKIELKIDTFGQLDKYAPKDCILGSNSSSFRSGLMLDLVSDERRKMVCNVHYTMPPMVRTVELMTDGYTHQEIFPFLSDVLRLCGMLPATARKEVYWVSKVIPDDALGLLKHMAPLTLASFIFNRIWAAVKREVLTTLAEGVSDAAEIDALWAHMFQTSVVPCQMMDRVGLD

SEQ ID NO: 3837 - protein, 304 aa, Neurospora crassa
  unsure (1)..(304): unsure at all Xaa locations
FNVDGWACLVTGGGTGIGLMNAQALAANGARVYITGRRYGVLVNAAKEHSPKEGNGKIIPXVQSLPLLADLPRKKTPPXQIHVSSIGPCDVTNKESLESLVHKFSSLEPHLNLLVCNAGISGPKADPSVSSSAKDIAHELWTKENFSDWSSVFTTNVSSVYFTTIAFLPLLQACSAAHPEGHNHMAGNVIVISSMSGIMRNAQKHFAYNASKGATVHLTKLMSTEFEKTGVRVNSIAPGYFPSEMTTGDSDEKNKSELSDDKVKGHGHKVPAQRAGHDEEMAMAVLFLAKDRYVNGSVICVDGG

SEQ ID NO: 3838 - protein, 1627 aa, Neurospora crassa
  unsure (1)..(1627): unsure at all Xaa locations
EEAYRRSAANTVPNELHHRASRDDDEKPDETNPELSTSSISHHGDGDGDGAWGERDVGGPVDREAAMQEFQELQLGLSRLSRERSTASRPSSRPASRASRASRATSGGRPDGLFKRLSVAVSNAMGDGKPQDQEDSDDEGDNGDVSSSERNSGDDFHLEQFMRDGHLEKRNEAGESTKKVGVVFKNLTVKGVSTGATFVRTLPEAILGTFGPDLYRIIGNYIPALRFGRQPELRTLLHNFTGVVRHGEIMLVLGRPGSGCSTFLKVAANNRGDYAAVEGEVHYGGISAEEVAKKYRGEVVYNGEDDIHLPTLTVEQTLKFSLYNKTKKRLRGDMELIITALLKMFAMSHTRHTIVGDAYVRGVSGGERKRVSIQESLATKSSVVCWDNSTRGLDASSALDYARSLRIMTDVSDRTTITTLYQAGEGIYELMDKVLVIDEGRMLYQGPASKARQYFIDLGFHAPPRQTTPDFLTSICDPNSRQFRPGWKDRCPKTAEELEKAFLASEAYQDVLADVRDYEAYLQETNHADTHAFKESVVSQKSRRVSKESNYTVSFFKQVAACTRREAWLAWGDKQELRTKFFIIIGCALVVSSLFYDSPLDTSGAFMRGGTTFYSIIFLGWLQMGELMKAVSGRAVVERHKAYAFYRPSAVNLARAILDFPLLLIQVIVFSLIVYFMTGLDRDPGKFFTYVLLIFTTTYCLTALYRMFAALSPTIDDAVRFAGLALNLIVMFCGYVIAKPVMLGQKIWFGWLYYVSPVGYSFEAVLTNDFHGRQMQCSPGMLVPQGPGVQQQNQGCTLPGGMPGDDTVNGDAYLAQQFQYTRGHLWRNWAVIIAFSVLYLLVTVLATEKLSFVGGGGGALVFKKTSKAKKNLTLGNQGQHDEEKGSSRGSSTDDIGKKTPQGPSRKEMDGTIEKSQKVFTWENVTYTVPTPQGPKRLLNNVTGYVKPGVMVALMGASGAGKTTLLNTLSQRQTVGVVTGDMLVDSKPLGTEFQRSTGFVEQMDLHDESTTIREALEFSALLRQSRDTPRAEKLAYVDSIINLLELEEIQDAIIASLGVEQKKRLTIGVELAAKPSLLLFLDEPTSGLDSQSAMSIVRFLRKLCAAGQAIICTIHQPSSDLIQEFDKILALNPGGNVFYFGPVGENGSSVVNYFAARGVECPPGKNVAEFLLETAAKPHKRKGEDGKSRRIVWATEWKESEEYRQVLTEISQIKKARALANQLTLANDQAQPVQHEFAAPIPTQAWLLTKRMFIRQWRDPSYLYGRLFICLIMGIFNGFTYWKISSPHYSRPLSLTDLQNTLFTAFLIIMIPSTVLNAVLPKFYMSRSLWEAREHPSRIYGWVAYCTAEILSEIPGSVVAGTIYFLAWYLPTGLPRGAGSTESESAVYVWLMSVAFMVFIASWGQWICAFAPSFTVITNVLPFFLVIFSLFNGVVVPWAQMNVAWKWWLYYINPATYWIGGNMAAVLRGQTVHCTNNEMAVFRPPVGESCQSFAGTWLSDVGKGYLTTIGVGNDGGFECGYCPYADGEEYLASLNVKSSQMWRNFGIFAAFCVSNWAXVFPFFPWQLLKQKCXQSDEQLVYFFIYTVRVKGWSFGFGFVTSVVGAVISTVKESVEGLFGKKEEKEEKK

SEQ ID NO: 3839 - protein, 1116 aa, Neurospora crassa
  unsure (1)..(1116): unsure at all Xaa locations
AQKKRKASPDVEMADGAAAAAPVANAAAAVTHPQAQAAPAPQKDNIDNNDNNNNNTTTSAVQPTIPNGDAAAAADDVQSPQSPHGLGDNKRRKKTDEAEPIMTDAFQTAESREVTGAQGFAPTEGESIVLSHNIQHQVALPPDLDYEYIPLSEHKPPAEPARTYSFKLDPFQALSVASIEREESVLVSAHTSAGKTVVAEYAIAQCLKKNQRVIYTSPIKALSNQKYRDFQAEFGDVGLMTGDVTINPTASCLVMTTEILRSMLYRGSEIMREVAWVVFDEIHYMRDKIRGVVWEETIILLPDKVRYVFLSATIPNAFQFAEWIAKIHRQACHVVYTDFRPTPLQNYFFPAGGKGILLIVDEKGNFKENNFNQAMAMIEEKKGTDSNDWSAKQKGKGKNKKTNKGGEAADEKADIAKIIKMILKKNFQPVIVFNFSKRECEQMALASSSMKFNAPDEENMVNKVFENALASLSEDDKNLPQISNILPLLRKGIGVHHSGLLPILKETIEILFQEGLIKVLFATETFSIGLNMPARTVVFTQVTKWDGQQRRPLTSSEYIQMAGRAGRRGLDDRGIVIMMVDDKLEPETARAIVVGNQDKLNSAFHLGYNMVLNLLRIEAISPEYMLERCFFQFQNAASVPQLERELISLQQERDAIIIPDESIVKDYYGVRQQLEEYNKDMVFVIQHPQNCLGFFQEGRLIHIKSPSGVDYGWGVLIKHIQRQTPKNGQPPYPEQESYVLDVLLKVSGDFNPKTRGEGPMPEGIMPAGKDSKNARWEVVPCLLNCLRALGQLRVFLPKRLESADEKDGVGKAVDEISRRFPDGIPILDPMENMGINDDSFKKLLRKIEVLESRLVANPLHNSPLLVELWNQYSLKMQLGEQIKEKKKAIARAHSVAQLDELKSRKRVLRRLGFINDAEVVQMKARVACEISSTEGHELLLAELLFNRFFNELSPEICACILSCFIFDEKIETQALKEELAKPFREIQAQARIIAKVSAESKLDVNEDEYVQSLKWQLMETVLAWAQGRPFSEIWYVCLSTPNPPPPXIMFANQICNSKMTNVYEGSLIRLFRRLEELLRQMAEAARVMGSEELKDKFELSLSKIRRDIVSFNSLYL

SEQ ID NO: 3840 - protein, 416 aa, Neurospora crassa
  unsure (1)..(416): unsure at all Xaa locations
YVLGVGMTKFIKPRGKVDYTELGFEAGVKAMLDAQISYDDVEQGIACYCYGDSTCGQRVFYQFGMTQIPIYNVNNNCSTGSTGLAMGRNFISSGAADCVLVVGFEKMQAGSLQSHFNDRENPLGTTYKMMATTRGVTKAPGAAQMFGNAGREYMEKXAKSHIISVXCYRKRHNDXPHSFSHRYGAKPEDFAEIARINHAHSVNNPYSQFQDVYTLDQIMQSPKVHEPLTKLQCCPTSDGGAAAVLVSQEFLDARPHLKDQAILIAGQCLATDAPSLFSKSAIDLMGWDMTQHAARVAMKEAGVKPSDFAVCELHDCFSANEMILIDALGFSEPGKAHEFVRAGNITYGGKVVVNPSGGLISKGHPLGATGIAQCAELVWHLRGWANNRNVPHTKYALQHNLGLGGAAVVTVYKRAD

SEQ ID NO: 3841 - protein, 1427 aa, Neurospora crassa
MFDELTFKPACDDRLIVRYSPNTGAVTAATPPRLVAEITSPSFLDYDLVSDFFLTYRQFLDSHDLLSMLFARLRWALAREGDLGTVVRVRTFVALRHWILNYFMDDFVVDYDLRVSFCNLLNDVVDEWAEVSKAHKIEMKTLPELKKCWRRICSQFWDGPDFDASLAADIPITPGGIAGHRDPNLTPSFWVKYDKGPPQLDELNVPTTPRGPTSFYAEIAKAGHIDSIIVGERPGTPENPEIDEPQRNQASPTSVTSVEVVSCSFPIKSSRHTQVASNRPLTAHPADPSSVYNTTEGIATTPRSLTGKRVRPQHSSHKRNNSLSDSLHDHATLTERVLYKNAEFLLTLPYAGSLIQGNIFPPGQAFVEVRPNSAMGDPSGQTTVFQPVEVRKDKFIGSAMSSHGMKKLLGSVRRALSHKTSTHPSNQTMLANISPIGPEGATTNRPPGTAVVPQSKARQNGVRPPVRIDLLGAGVAEDFKKAIREDAAVEAEKLEYAVPPATGNEEAKSHGNAMEYSAAHMDTAFNLRSVEDVQHRSDMGISSGSDSIVIVDGTTLQPVMSGALPAASSSASFSHSFIPITADPTPPNTPPDLQREHQERLHTSWANKSFATRSRPIRRRRLYLTLLLEKGKTSHQTIFGQPSIDHVMQDFDQTPRSGLHGHFRNLSSRSQHSTWSARHGRFASYTSDIMPQPTVRSFDATTYSEESVADDSSQVLIPQPLRILRRRPGGDLRAVTNVGDLDHPPLRTSRSVGSLTTYTDSFASSFIRSPAHQDSSSFVDVNNRPEMFSLGALAEQNPKKRHLSLFSTHSSKPVMRPSFEAEAIKLAQIPDDEEDGGVEAALLKLEGKYERKSTIRLSMDLPKFKAEQNTNPLPTQPEEVTGEERMEQRHIRAAGKNIYMPPSPTTPAPMDIADSYLDVTPRQHRITNAESFISATSRDSYNSSPLLEQEMMDNYGVNQDTLQSWTDRSILQPPSSDEQSVQSSQHPSIASFDFVEKADSMEPVKVDDAIPTAEPEQSFLTLESEDDTDLSSEMSAEPFDASVDDYGVITPSAVGVAISTEPAHSLAENQFGPNPPSPPTIMIQALQMLPDMAKGSASQQQGGWHTKPLPPTPDTTPTTTAAPYGQYQHSFPVQPTASKGTPRDKRQLDVPSPLPEASDVTEASDSRLSAHLPFILAFDSEILAQQFTLIEKDALNEIDWRELIDMRWKNAEQKGCDARSWVSFLRDTDAHGVEVVIARFNIMVKWAISEIVLTRDIEERARCIIKLIHIAAHCRRFRNFATMAQLTIALMSNEIGRLNKTWAMVPSSDQRTMQELETLMSPTRNFYNLRKEMEGGDSKTADEGCIPFVGIYTHDLLFNAQRPSEIASSPTTAPLVNFERCRIAAGVVKTLLRLLEASNRYSFQPIEGITERCLWMGALDDDEIRRL

SEQ ID NO: 3842 - protein, 602 aa, Neurospora crassa
QWILDYLSSMGFTQPTPVQKSCLELFRGNKDVVVEAVTGSGKTLAFLIPVVEVSRISCCLPAQDDHMLTDSATETPARRRTSQRNHVQGIIISPTRELATQIYNVLVSLVKFHEPSAEAISHAKSDEKRPTATQPVVVPQLLVGGTTKAAEDLGTFLRLSPNLLIGTPGRLAELLSSAYVKAPASTFEVLIMDEADRLLDMGFANELNRILGYLPKQRRTGLFSASLSDAVERLITVGLLYPHKITVRVKSLKDGGIIQERKTPMSLQMSYLVTPASQKMPAIVQLLEKLEPRPQRSIIFFSSCMAVKYFSRILGAVLPAGFSVTSLHGKLEPKVREKNYERFVNTTSPMVLLTTDLAARGLDIPQVDLVIQHDPPTDTKVFIHRCGRAGRAGRRGLAVVLLQPGREEGYVQLLEVRQTPITPLEKPAISVTPDEVERVSAAFRSQALADREIFQMAQLAFVSWTRSYIEHQASSIFRIADLDWLDLAKGYGLLELPKMPEVREAKIDRSLGLGINTEEIPFKDKVREKKRQEELAKWKEEKAKRAQEENTGDKRKKNEAWSGKAEQEETKLQRREKKRRKREAKKFSEMTEKEKEEHLKLE

SEQ ID NO: 3843 - protein, 856 aa, Neurospora crassa
  unsure (1)..(856): unsure at all Xaa locations
QTPQGGAGLPGRPVQQAAGGGYGGGATPTNYGSPGGRAPSQPQYSGSGAGGYGGAPSEKSYGGGGGGGYGGQPAPGGYPSQPAGRGVPLRLAKVDDKTLQSLYIFGNMXVPCATHGQSIQSKVVNLVLSCAVSPNDFPPNHDGTDLYIRLTGRQLRGDYVVTARPTPGFRPGHISLSDPQRTWCGVGMMDELMGEVYDPFARGGDAYIGSMDVEIGFASTNRIVDTPYDQDELAKVFLKTFQNQVFAPGQRFLLDVKNIPLAVMVKTVTLVDLTMLGSGEAPTRSDPGARGILTNQASIGFYKDARSPIKLKGSNKRPAANAIIAPDFKFENMGIGGLDTEFSTIFRRAFASRIFPPGLIEKLGIMHVKGMLLYGPPGTGKTLIARQIGKMLNAREPKVINGPEVLNKYVGQSEENIRKLFADAEKEYKEKGDESGLHIIIFDELDAVCKQRGSGAGGGTGVGDSVVNQLLSKLDGVDQLNNILLIGMTNRKDMIDDALLRPGRLEVQIEISLPDEHGRGQILKIHTSKMKENKVMADDVDLAELATLTKNFSGAELSGLVKSATSYAFSRHIKVGTMAGVSEDVANMKVNRQDFLNALDEVKPAFGADESELEKHLAYGVIHYSKSITSILEDGLLYVNNVRKLERLKHMTVLLHGPSASGKTALAAHIAMKSDFPFIKFITPTDMVGFRDEVAKKDYMHKIFTDAYKSPLSLLIIDNIERIIEWNPVGPRLSNTILQALVTLLVTPPPKGHRLLILATTSQRTVMEQLDVTESFDYQIAVPAVNNLQELGAVLNEVGAFGGDQAAVSEVLNTLREYTGSDSVGVGVRTILTIAESADTSPDPKGWFVEKMAGLI

SEQ ID NO: 3844 - protein, 400 aa, Neurospora crassa
  unsure (1)..(400): unsure at all Xaa locations
NSYIEGIVRGYRNSLLTSTNYTNMTQCESIDGEPLSPISIPDPFHLHPHRPNNIAHDLKLQLGPAYGDFLASLPPKPSTSALAAKTTDKLVSEFRYVRANAAGSLAKFMDYLTYGYMIDNVALLITGTLHERDTRELLERCHPLGWFETMPVLCVATNIEELYNSVMIETPLAPYFKSSLSLQDLDELNIEIVRNTLYKNYLEDFYHFVNTHPDMAGTPTAEVMSELLEFEADRRAINITLNSFGTELSKADRKKLYPNFGQLYPEGTLMLSRADDFEGVRLAVEGVADYKSFFDAAGLGGGPSGPGNMGGGGTEGKSLEDMFYQKEMEISKMAFTRQFTYAIVYAWVKLREQVRLGFPCVVRXASVDXCDIXEIRNITWIAECIAQNQKERINNYISVF

SEQ ID NO: 3845 - protein, 214 aa, Neurospora crassa
  unsure (1)..(214): unsure at all Xaa locations
KKVVVVGDGGCGKTCLLISYSQGYFPEVXRPTPTKVSLGLALTVINFANRNYVPTVFENYITYPTHPPTGKTVELALWDTAGQEEYDRLRPLSYPETDLIFVCFAIDCPNSLENVMDKVSLHTVFYPSFHLRSCXHTFPVYPEVLHFCPYTPLILVGLKSDLRNKKTCIDMLKTQGLTPVTTEQGLAVAKKMGAQYMECSSKEMKGVEEIFEQA

SEQ ID NO: 3846 - protein, 498 aa, Neurospora crassa
  unsure (1)..(498): unsure at all Xaa locations
FINNEFVEGVDKKTFEVINPATEEVICSVHEATEKDVDIAVAAARKAFEGVWRDVTPQQRGIYLLKLADLLEKNLDLLAAVESLDNGKSITMARGDVGAVVGTIRYYGGWADKIEGKTIDISPDSFHYTRQEPLGVCGQIIPWNFPLLMLAWKVGPALATGNTIVMKTAEQTPLSALVFAQFVKEAGFPPGVLNIISGFGRIAGAAMASHMDIDKVAFTGSTMVGRQIMKAAAESNLKKVTLELGGKSPNIIFNDADIDQAIDWVNFGIYFNHGQTCCAGSRVYVQEGIYDKFVAAFKQRAQQNKVGDPFHDETFQGPQVSQLQYDRIMGYIKAGKEEGATVETGGERHGDKGYFIQPTIFTNVRHDMKIMKEEIFGPVCAVAKFSTEEEVIKLGNDSNYGLAAAVHTKDLNTAIRVSNHLRAGTVWVNTCKYTCFVLEGVTFHRANQNLFQQTNALHHQLPFGGYKESGIGRELGEAALANYTQCKSVAIKLNXDNP

SEQ ID NO: 3847 - protein, 476 aa, Neurospora crassa
  unsure (1)..(476): unsure at all Xaa locations
MSTIPKPGPANLRPGAGLDEWLEEAKQCHYLPEPVMKQLCEIVKEVLMEGTXAPTTSQDYTCPRARARSHPVFPRRARQGNLSSXLVSPRHQESNIQPVVTPVTICGDIHGQFYDLLELFRVAGGMPGETNVQAPKTATTVITSEDIEPPTEITDPNLKKKIKSSTDSEAGAGSEKESPSEETPQSSANTGSQSADTRFVFLGDFVDRGYFSLETFTLLMCLKAKYEGPPFXFWFGSRCXHFSPNRYPDRIVLVRGNHESRQITQVYGFYEECQQKYGNASVWKACCQVFDFLVLAAIVDGTVLCVHGGLSPEIRTIDQIRVVARAQEIPHEGAFCDLVWSDPEDVDTWAVSPRGAGWLFGDKVATEFNHVNGLTTIARAHQLVNEGYKVGHHFLLLSTVMRRNASXPAFLIXFHFAEKSVVTVWSAPNYCYRCGNVASIMTVDRDQNTKFSIFSAVPDDQRHIPAGRRGLGDYFL

SEQ ID NO: 3848 - protein, 957 aa, Neurospora crassa
  unsure (1)..(957): unsure at all Xaa locations
MAPKQDTPFRSADMSMVQLYISNEIGREVCNALGELGLVHFRDVMPPESLPCLYSITRTHQQRQQTITSTSASHXQYVPLXLNSELSAFQRAFTQDIRRLDNVERQLRYVPSSRSHHLASWLTGVCQGYFHSQMEKAGIPLRKFDPDVDILTPPTTTEIDELAERAQTLEQRVSSLNESYETLKKREVELTEWRWVLREAGGFFDRAHGNVEEIRASTDNDDAPLLQDVEQHNTAADVERSFSGMNIGFVAGVIGRDRVDAFERILWRTLRGNLYMNQAEIPEPLIDPTINEPVLKNVFVIFAHGKEILAKIRRISESMGAEVYNVDEHSDLRRDQVHEVNARLEDVQNVLRNTQQTLEAELAQISQSLSAWMITISKEKAVYNTLNLFSYDRARRTLIAEGWCPTNDLPLIRSTLQDVNNRAGLSVPSIINEIRTNKTPPTYLKTNKFTEAFQTIVNAYGTATYQEVNPAIPVIVTFPFLFAVMFGDFGHALIMLCAALAMIYWEKPLKKVTFELFAMVFYGRYIVLVMAVFSVYTGLIYNDVFSKSMTLFDSQWKWVVPENFKEGMTVKAVLREPNGYRYPFGLDWRWHGTENELLFINSYKMKMAIILGWAHMTYSLCFSYINARHFKRPIDIWGNFVPGMIFFQSIFGYLVLCIIYKWSVDWFGTGRQPPGLLNMLIYMFLQPGTLDGGVELYPGQATVQVILLLLAVIQVPILLFLKPFYLRWENNRARAKGYRGIGERSRVSALDEDDEEDPSNGDDYEGAAMLTHDEHGDGEHEEFEFGEVMIHQVIHTIGEFSFFRSSGICQRXRANNRTEFCLNSVSHTASYLRLWALSLAHQQLSAVLWSMTMAKALESKGLGGAIFLVVAFAMFFVLSVIILIIMEGVSAMVSVPLLMXMYGKSFANEDXNDSFHSLRLAWVESFSKFAEFGGWPFTPFSFKQQLEESEELKEYIG

SEQ ID NO: 3849 - protein, 127 aa, Neurospora crassa
VAQLLYGHGDLKNPLPETVRVLDELITDFIQGVGFEATRAAHHAGRQKVKFEDFEFAMRRNPRFMGKIQEVFEKKKEIEAARKNFNIEDQLMKDADKEEKEKEKKGGSADKGDKEKGEKGEKEKEKG

SEQ ID NO: 3850 - protein, 625 aa, Neurospora crassa
  unsure (1)..(625): unsure at all Xaa locations
MSDIEKGSAGSHDKETRVDAATLPAYEAGSVAEAQQEDFMTRNGLNLASFKPRRFHTGDGTEIERTMKSRHLHMIAIGGSIGAGFFVGSGKALHNGGPASLLIDFAIIGVMMFNVVYALGELAVMFPVTGGFYTYSTRFIDPSWGFAMGWNYVFQWAIVLPLELTVCGFTVGYWNQDISVGTXTYSFWSVYNKKDTDRKNSRWITIFLVAIIIINVFGTLGYAEEEFWASAFKLGATIVFLIICLVMVLGGGPKGSRYDHYTGAALWYSPGAFANGFRGFCSCFVTAAFAFSGTELVGLAAAEAKNPVKSLPGAIKQVFWRITLFYILGLFFVGLLIPYDDENLLGANPFINVNASPFVLVGKYANLTGFDSFMNVVILVSVLSLGVSCVYGGSRTLTALAQQGYAPKIFTYVDRSNRPLFSVLLIIAFGPLAYVNLAAAGPTVFDWLLSLSGLAALFTWGSICLSHIRFRKAWALKGHSVEEIPFRAAGGVWGSWLGLVLVVLVLIAQVCAFFFFFFFFCRSLRSIYISXQGANKCINSFYVAICPPGGGFNTVEGFFVQYLALPVVIVFWIGGFIWKRTSWLRVDQIDVDTGRREHDWESINAYQAELAAMPAWKRWFHKLFV

SEQ ID NO: 3851 - protein, 376 aa, Neurospora crassa
  unsure (1)..(376): unsure at all Xaa locations
MSTMGPATVHPETHVGFDSITSQIERKLLKRGFQFNVICVGTSTSPFSAINLCPRNXHRFHPGQTGLGKSTLINTIFASHLIDSKGRLQPDETVRSTTEIQSVSHIIEENGVRLRLNIVDTPGYGDMINNDRCWDPIVKYIKDQHSAYLRKELTAQRERYIQDTRIHCCLFFIQPSGHSLKPIDIVVLKKLSDVVNVVPVIAKSDSLTLEERQAFKERIKEEFAFHNLKMYPYDNDELDEEERSLNQQIKVGFCTCPRKXQXLTXHRSLIPFAVVGSEKSIVVNGKQVRGRQNRWGVINVEDENHCEFIYLRNFLLRTHLQDLIETTSQIHYETFRAKQLLALKESSAQGHSSRPISPAADREMSRNSQRMTMNGY

SEQ ID NO: 3852 - protein, 1170 aa, Neurospora crassa
  unsure (1)..(1170): unsure at all Xaa locations
MTKTEPDKAAAGDHVSGQSNKPLSRPAHALTHQDLAHEIGADPLSGLTPDEAKRRLEEYGKNELGEAEGVQPIKIIIAQIANAMTLVCFPFPSSSSSLFLFLFCDSNXQQTGLILAMAVSFGIKSWIEGGVVAFVIGLNVVVGFFQEYSAEKTMDSLRSLSSPTATVVRGGEAMVVPSGEIVPGDLVEVKMGDTLPADIRXPVDHSLHYPPLQWLIRFFFGXTGLIEAKNFETDEALLTGESLPVRKTVESTFDDTTGPGDRLNVAYSSSTVTKGRAKGIVFATGTFTEIGAIASALNKKDSKVRPVKRKPNGHAGPHRYLEAYTLTLGDALGRFLGVNVGTPLQRKLSKLAMLLFGIAVICAIIVLGANKFNTRQEVIIYAVATGLSMIPASLVVVLTITMAAGTKRMVERNVIVRNLKSLEALGAVTDICSDKTGTLTQGKMVARGAWIPGMGTYTVELGDEPVNPTKGDIRFAKQMPSEVDFKSTNAEKSSTGPVTAPGELLTSSTTRLQDFLSVCSLANLATVFSKESEETPGTEQWHARGDPTEIAIQVFASRFDFNRLRLVSGSNPEWQEVAEFPFDSDVKRMSVIMKNTQTQEHWAFTKGAVERVIGACVNYFDSDGPDAEAKPVTDEFRADILKNMESFASLGLRVLALASRRLPSDGTTWNEETSRSLIESELTFRGLIGLYDPPRPSSASAVHQCHEAGISVHMLTGDHPETAKAIAIEVGILPPLSSMSRVSAAVAHAMVMTASQFDALSDDEVDALPVLPLVIARCAPSTKVRMIEALHRRGRFCAMTGDGVNDSPSLRRADVGIAMGLSGSDVAKDASDIVLTDDNFASIVAAIEEGRRIFDNIQKFVLHVLAENIAQAGTLLIGLAFKDASGLSVFPLAPVEIVWIIMITSGLPDMGLGFERAVPDIMARPPQSLKTGIFTLEFIIDMIFYGLWITALCLASFVLRVYAWGDGDLGSGCNEHYSDSCETVFRARATTFACLTWFALFLAWELVDMRRSFFRMQPGSKKYFTQWMVDVWRNKFLFWAIVGGFVTLFPTLYIPVINHAVFKHTGISWEWGIVFVAAGLFFGGVEGWKWAKRVFLRRRARRGAAKSGGGAGGQGKLWKDMDVEEKIFGEYFGSPASTDEVSLQDTHTRGHEKKNDEGATGQRQENQGRD

SEQ ID NO: 3853 - protein, 840 aa, Neurospora crassa
  unsure (1)..(840): unsure at all Xaa locations
QLQQDLKPRRGQSALFDSFSYLSSDDAPWNHTVVAWTGEIEEVKSAQHAGKAPATTVGQPSLNPLSRPVPIDGSVTPPAHPTADGLWIPKEDMHLLEHDLSHNRKIKTVPVWLADDIEGHDDGIRLKDQARWRRYAEHSLYTLFHYKQNEPADGRAERIQWADYYRMNQKFANKILENYKPGDIVIVHDYNLMLLPSMLRQRAPHMYIAFFLHSPFPSSEFLRCLPRRKEVLEGVLGSNLVGFQSYSYSRHFASCCTRVLGFPSDTTGVEAYGTRVEVGVFPIGIDAIKVAAAAWKPSATAKFEGLKKMYAGKKLIVGRDKLDSVRGVPQKLMAFERFLELYPEWREKVVLIQVTSPTNIEEEKEDSENKISSRVNELVMKINGMYGSLGDTPVQHYPQYISQDEYFALLRAADIGLITSVRDGMNTTSMEYIICQRDNAGPLILSEFSGTAGSLKDAIHINPWDLTDVAKQINNALTMSQERRQSIEKSLLEHVTNKNVQFWITGLLRRLISVLANRKDIIATPLLDRATMLRKYRAANKRLFMFDYDGTLTPIVREPSAAIPSERVINSLKALAADPRNAVWIISGRDQEFLQQHLGHITELGFSAEHGSFMRHPGSTEWENLAEKFDMGWQAEVLEVFQKYTDKTPGXFFDSPFLTEKKKKKKTTANMNLLGSFIERKRCALTWHYRLADPEQGLHMARDCQKELETTVGRKWDVEVMAGKANLEVRPTFINKGEIAKRLVTEYNAELKALAAKSSGSPDKVASEKLEFVLCMGDDFTDEDMFRSLNVLSGPGEDAEIKPENCFTVTVGASTKVTLARWHLLEPEDVIECVALLAGV

SEQ ID NO: 3854 - protein, 332 aa, Neurospora crassa
LPIISLAPLFSPSSSLSSRLEVAKQIRQAATTNGFFYITSHGIPPSIIQEAQESAFQFFRSPVSEKEKASMHNSLYKYGWKPPRTQRLNPFESVDHRESFSWRYDPRYDPSVKNVEEEIPDEVKAMIKHDPDDYPWSAVPPEFKAAVIRYFQAVLHLGRVLQRAFALSLGLEETAFDEKSRWPDLGMAVNYYPPLSASGKEEGKGDETKVSIGSHTDFQLFTILGQDEVGGLQVLSRSGQWLNAKPIPGTFVVNFGDYMQRITNDKYVSTVHRVQNYSGKERLSMAFFFGFNLNETCEVLDSCVEEGEEPKYEAVSCWEWTQRRVRMMHDVK

SEQ ID NO: 3855 - protein, 60 aa, Neurospora crassa
KGEKKTSLFVAHRLRTIYDSDLIIVLKEGRVAEQGTHRELMERNGVYAQLWRAQEMLMTE

SEQ ID NO: 3856 - protein, 526 aa, Neurospora crassa
IMKEMSKYLWPKGSWGDKARVLLAIGLLVGGKVLNVQVPFYFREIVDSLNIDFSTTGGSVTAVAGAMILGYGAARVGAVVSQELRNAVFASVAQKAIRKVARNTFEHLLNLDLSFHLSKQTGGLTRAIDRGTKGISFLLTSMVFHIVPTALEISMVCGILTYNFGWQYAALTALTMVSYTAFTILTTAWRTKFRRQANAADNKASTIAVDSLINYEAVKYFNNEAYEVGRYDKALAQYEKNSIKVATSLAFLNSGQNIIFSSALTVMMYMGAHGVATGQLTVGDLVLINQLVFQLSVPLNFLGSVYRELRQSLLDMETLFNLQKVNVTIKEQPNAKPLTLTRGGEIEFKDVTFGYHPESPILRDLSLTIPAGKKVAIVGPSGCGKSTLLRLLFRFYDPQKGAIYIDGQDIRSVTLESLRRAIGVVPQDTPLFNDTVEHNIRYGNLSATPEQVIEAAKAAHIHEKIISWRDGYNTKVGERGLMISGGEKQRLAVSRLILKDPPLLFFDEATSALDTHTEQALMENIN

SEQ ID NO: 3857 - protein, 485 aa, Neurospora crassa
  unsure (1)..(485): unsure at all Xaa locations
ALLXRRTITTMSTPIPRPPGIPVLGNVFDITPSNTWWSLKALAEKYGESRSQRVHGYTSXHDSGEIFQVKILGKTIVFVASAALAEEICDEQRFQKYVGGPIVEIRATVHDSLFTAFHHEQSWGIHHRIIAPLLTPQAVSGYTDDINLCATEVIQKWASLGDSNVLEPLVDLNLLNLEATSLTLFSQKLNCIQAGGHPVIQAMEDAVSEAIMRPTRPGLVNWLLYSSKFKKATKTLRTWAADTVKYRQENPTDKHDMLWAFMNAKDPETGKGLSESEILDEIVTMPIGSATAPCAVTATIYYLLQNPEVVTKAREELDRVIGTGPLKDEHLSQLHYIEGITRETLRLSCAAPGFNIEPIPRQNKADKSPLLLQGGKYQVAHDQKLIIVLAGVNRDPAVFEDSLAFKPERMMGEEFDRLPKGVKKWYGNGKRECIGKEWANNFLKIVTARLIHEIDFEVADEGYEFRQDGWFQIRPVAFKVRVKPR

SEQ ID NO: 3858 - protein, 837 aa, Neurospora crassa
  unsure (1)..(837): unsure at all Xaa locations
QSFSMSQSSQSVYRQYTDPPNRLHNDHAVPTIYSVSLFSSSPIFILSPLCSDXQLQATYSGVGVYEMEVNNVAVMRRQKDGWVNATQILKVANIDKGRRTKILEKEIQIGEHEKVQGGYGKYQGTWIPFERGLEVCRQYGVEELLSKLLTHNRGQEGETGNVDTPTKEQAMAAQRKRMYNASSQENRGIGSTGTFFKNISSTASTAVAAISKARFDSPAPRNRSGPSRAPSFNRQSSMQDVADFPNSQQSLVSTEYATQTQNADSGFGSQTTQPLAGDGLEQPPRKRQRVLTPARSFGGQTPGHQPLDPFNAGNIANGDSGSPTEPSNSFNYDQVTANDGDASYALGPLRPLPYENNADAEAKRGMLMGLFMDANGPEEAIQAALCNVSPQELDSPIDTQSHTALHWAATLSRMPLLRALIHAGANPWRVNACGETALMRACTVTNSMENNTFPELLDLLGCTLDVTDDKGRTVLHHIAVTSAVKGRHYASRYYLESLLEWVVRQGSAPSSQENGIGDRKGRRMGIARFMSEIVNAQDNSGDTALNVAARVGNRSIISQLLEVGADPTIPNRANLKPLDFGIGIADAETNDDPAQEKTGATTGSGHKSRETSDEVVRCKFFFLIFYPSCSIANVKPAITHLIGESASIFQNELKKKQESIDTLHSQLRVTSSQVGDARRTLESLQEKLKAQQLAKQKIVNFNRACEEEEQILIELEQRHGRLDVASANAWEMELESALEIVKTQSPKGLDPDSRPSLPSAAVLRARIKALRARSSKTRQAVAALQAQSKEKELKYRRLVSLCTRRPEIEVEALLDTLTRAVESEKPELEIARVRRFL

SEQ ID NO: 3859 - protein, 925 aa, Neurospora crassa
RIAIREQLAALVIFAVLLSLAIVSIPVWIFVNNFVIGVKTDGLALSASLKASRISSEIDLIQTACTTISTRLLLQQAFEDFYTNEYYGNQTADVWEQALEDLASALSTSNVSGLLQARLYSRNTTGDPRGLLNITGQDALDDPVYLPYRSPTGADIKLGDPDYGFPPMLYPNITYENKNLPSPYKANTVQFSANIFPGVSLSNGSEGNGILLGPLVVNESYALVSITVPVRENQSSRFILGYMTVIASARQLVQVQRSNEGLGETGVALFIGPVNPWNHFNSKMPASNQTWSPPRDEFARTNQVHFLLPPAPQPGQEDRHSDHSFESGAYDAPFDPATYQAVLDLFVEKNNQTNNATSKISTKNEQGKKVAIGAARPQTSLVTWAVIVEQDKREATEPIRTLRNILLGCVFGTAGLVLLLTIPCAHLSVMPIRRLKEATEKSIAPPGYEDLSDSDYDEENPSSGGTTSGRSEKSWLKSLKRRMRKSKRARLRAAAAQDAHRHAFKIPAKVEDRKHYITDELTELTQTFNEMSDELLKQYTSLDEKVAERTRELEISKKAAEAANESKTLFIANISHELKTPLNGIMGMCAVLMEEDDVLRIKQSLKTIYKSGKHSRPLCIPSAFHQTNRDDRDLLLHLLEDLLSFSKNQIGQQVSLEEREFRLGEIRSQMLAIFDKQIRENKITFTVSFVGTDILESSPERRSGIDKRLPALGPPGVGRLKDMCLWGDQHRILQVIINLVSNSLKFTPAGGRVELRIRCVGEMEQTHNQSRSSSLSKNSHRPGRSRHRLGSGSRDSQSSKGAPHSPNLNQSSGTALSINPMDPKSPHVHIRERSPTPPPPNAKTFMFEFEVEDTGPGIAEHMQQKIFEPFVQGDLGLSKKFGGTGLGLSICSQLATIMGGTIGLKSTVGVGTTFTMRIPLKYVRD

SEQ ID NO: 3860 - protein, 386 aa, Neurospora crassa
  unsure (1)..(386): unsure at all Xaa locations
KPQXRKRTRLRLNKQTSWPTHLPRAPXSARTSKVLPWLLPLPSPRRRPRPFTRDKDDDNNAQLEIGIEFNLDLRPEDLDLIKELGAGNGGTVSKVRHIPTNTVMARKVCWTSQGFQASPLXAPLTKHRWAGYHVEAKKEMRKRIVRELQIMHGCHSEYIVTFYGAFLNEHNDVIMCMEYMDVGYVASWTACSLRSGDXLTLVVXSLDRISRVFGPVRVDVLGKIAEATLGGLTYLYSKHHIMHRDIKPSNILVNSKGHIKLCDFGVSGELVNSVADTFVGTSTYMAPERIQGDKYTVKSDVWSFGLTVMELAIGKFPFASDQLGDDAENAPAGILDLLQQIVHEPAPKLPKSDAFPQILEDMIQKCLYKEPERRPTPQELFVSCSF

SEQ ID NO: 3861 - protein, 427 aa, Neurospora crassa
  unsure (1)..(427): unsure at all Xaa locations
SATGGDERLIYGVSAMQGWRISMEDAHTTVLDLLANNPKEAKDHSQKLSFFGVFDGHGGDKVALFAGANIHDIIAKQDTFKTGNYEQALKDGFLATDRAILNGTILRTPDCVFLAACVLCGAVRCDAVPHTVRNGNEGNXYSPPLMLQDPKYEEEVSGCTACVGLITDEKIFVVSYNRTKKTTPARELLALTSSVYRANAGDSRSVLGVKGRAKPLSFDHKPQNEGMQLRALAGSSDDKVPSXPVHVCGSLGEKARITAAGGFVDFGRVNGNLALSRAIGDFEFKKSAELAPEQQIVTAYPDVMVHDLADDDEFLVLACDGKRRLEPVXNRAVSXHRFSARYLDCQSSQAVVEFVRRGIAAKQDLDKICENMMDNCLASNSETGGVGCDNMTMIIVGFLRGRTKEEWYEEIAKRVANGDGPCAPPEY

SEQ ID NO: 3862 - protein, 777 aa, Neurospora crassa
  unsure (1)..(777): unsure at all Xaa locations
ILPIILPPATLRPLAFRTFTKKHSLTLTSTALQELATFIGRHCGSGWREEGLAEKVLEEVARSWKNRNGGVIVEGNSPELKDILKTLEGNMSGGKILTGPRSLSRQNSLLLEPDQDEQHAHSRLGLRPVPSLTREDSNASFGMSGLEFTEEPEDDSVRDVRRWLKVIHAFDQPRLMYNVGKKHFERYGPLLFITLFTXVTQLTFVGILPNPPYLPAASHKTDAFRNRYNVIHQRILRNEAFQSSSVQGSSLRQRTNANGLSSHKITPIANLLGRHGSNHMLLGMLVVLPTGSLAISDLTGTITLDLSHAVAIPEDSAWFTPGMIVLIDGVYEEEEETMTMGNGLSGSSGVGGTIGGRFQGFFIGQPPCEKRRVTLGVSGPDGTGADHTIGGGFGWIDFLGVGSERAVGSKMRKLEHRILRQPALLEDGRPSRGRAVIIGELNLDQPRSLQALRKILGLYASDPEGCTPMTFVLAGNFTQHAVMARGGSGGSIEYKEFFDALASTLADFPSLLTTATFVFVPGDNDGWVSAFSGGAATPLPRKPVPDLFTSRIRRVFAAANAEAGLANPGKETEKDAGKRRGGEAVWTTNPSRITLFGPSHEMVLFRDDISARLRRASVRLKNTSKASVEPEPPTNGNDDSAMDNQCPPSSLPDAPDADDEDMADTTMTDAMDVDSAPAPNQKTTMPPPSSIPYDVLAARKLVKTILDQGYLAPFRQAIRPVHWDYTSAMYLYPLPTAMVLVDTTAPPFCVTYEGCHVMNPGSILVPGRKGAARWVEY

SEQ ID NO: 3863 - protein, 788 aa, Neurospora crassa
  unsure (1)..(788): unsure at all Xaa locations
LSSIPVPGPKVKPKKTRGSPSPRYSTSGKEQEKERAVSGLSRRLQDLSICDEKENIPSGSQVTPRKTSQPASQASXSDAKAEPARRPRRRTEGAVPARRKSSLQQSTTAYPETPKAKSRLEDPRAAMERFEVILNSAVVSAHRTASTRKSVSPVKLSFLTKDSNNTAFTGIDVDERLNEVDAEWKVMKEAFSISLQDKKAMETAVQMAKNQGTWQQVYKHARADXHLLVDTLEAERQKLNERNELLQKEMDALRQQFQQLTLTLERQKMDHEYQLQNKSREHEHEVQELQRKLKQESERLQRINREEKDAFERQCRADLEGEKAKAAKEVQDLRLKLGAEQQDINKSLLEKERELRQLQSQLDDLRSELSQEQKNKRALQEQINEMATTNGKLEARNQGLRAQIDFLESDSKQQSDSFAQMEARLREALEIAENAKQKLIKEETERRILFNKYQELKGNIRVMCRVRPALGKSEGSEAKIMFPDAKTSSAQIEVTGLEEKSSFGNINRKVLPFEFDRVFAPSVHNEEIFDEISQLVQSALDGYNVCIFCYGQTGSGKTYTMSSPDGMIPRATHMIYDTITKLREKSWTYTMEGSFVEVYNEELNDLLDGSSNNSKKKLEIRHDDVRKQTTVLNCKTVALDSADKVEMMLKQAQNNRSVAATKANERSSRSHSVFILKLVGENSVTNERCEGTLNLVDLAGSERLKHSQAEGERMRETQSINKSLACLGDVIEALGRGSSHVPYRNSKLTHLLQYSLGGNSKTLMFVMVSPLEAHLKETITSLRFATKV

SEQ ID NO: 3864 - protein, 420 aa, Neurospora crassa
  unsure (1)..(420): unsure at all Xaa locations
SRNKRSGDGASGFGPSTGNLHEYGQHGQQLHPNINAVMADAPLRDKMRTEQRIGAYNIVKTLGEGSFGKVKLAVHRMTGQQVALKIIARKKLISRDMQGRVEREIEYLQLLRHPHIIKLXGTPRRPCAADVGSGPLRTRWLTRRAYQYTVIKTPTEIIMVLEYAGGELFDYIVQHGKMKEDEARRFFQQMLCAVEYCHRHKIVHRDLKPENLLLDDNLNVKIADFGLSNIMTDGNFLKTSCGSPNYAAPEVIGGKLYAGPEVDVWSCGVILYVLLVGRLPFDDEHIPSLFAKIARGSYMVPTWMSPGAASLIKKMLVVNPVQRATIDEIRQDPWFLKDLPAYLHPPVEEFLNTGVDPNKAIKVSDIAPNAPPQEQEKLHNEVTEKISKTMGYGKRDVEEALEADEPSAIKDAYMIVRENK

SEQ ID NO: 3865 - protein, 489 aa, Neurospora crassa
FGFDISSMSAIVVTDQYLTYFNNPHDIIQGAIGSALAAGSVVGSAIAGPLSDKIGRRDSIFFACFFWLIGTSVQVACKNYGQLIAGRVLNGFTVGITSSQVPVYLAEIAKAEKRGSLVIIQQLAIEFGILIMYFIGYGCASIEGPASFRTAWGIQFIPCFFLMVGLPFLPRSPRWLAKVGRDQEAIAVLANIQADGNVDDPRVVAEWEEIVTVMNAEREAGKGWRKFVKNGMWKRTMAGMTVQAWQVRSSLFSPISCPNIITNKCTNILSLFLSTQLAGANVIVYYLTYIAQMAGLTGNVAMVTSGIQYAVFIIFTGVMWLFIDKTGRRTLLVYGALGMAFCHFVVGGVMGAHHDNVPDGVGGNANIVISVHKGAPANTVILFSYLLIVVYALTLAPVCWIYAAEVWSLGTRATGMSMAAMSNWVFNFALGMFTPPAFVNITWKLFIIFGVLCVTAAVWFWLFYPETCGKTLEEIEILFGDQGPKPWKT

SEQ ID NO: 3866 - protein, 570 aa, Neurospora crassa
MVAQQQGKFTVGDYLAERLAQVGVRHHFVVPGDYNLILLDKLQAHPDLKEVGCANELNCSLAAEGYARANGISACVVTYSVGALSAFNGTGSAYAENLPLVLISGSPNTNDPSQYHILHHTLGHPDYTYQYEMAKKITCCAVAIPRAIDAPRLIDRALRAAILARKPCYIEIPTNLAGATCVRPGPISAITDPITSDKSALEAAAKCAAEYLDGKLKPVILVGPKAGRAGSEKELIEFAEAMGCAVALQPAAKGMFPEDHKQFVGIFWGQVSSDAADAMVHWADAMICVGAVFNDYSTVGWTAVPNIPLMTVDMDHVTFPGAHFSRVRMCEFLSHLATQVTFNDSTMIEYKRLKPDPPHVHTAEREEPLSRKEISRQVQEMLTDKTSLFVDTGDSWFNGIQLKLPPGAKFEIEMQWGHIGWSIPAAFGYALRHPDRHTIVLVGDGSFQVTAQEVSQMVRFKVPITIMLINNRGYTIEVEIHDGSYNKIKNWDYAMLVEAFNSTDGHAKGLLANTAGELADAIKVAESHKEGPTLIECTIDQDDCSKELITWGHYVAAANARPPRNMSVQE

SEQ ID NO: 3867 - protein, 498 aa, Neurospora crassa
  unsure (1)..(498): unsure at all Xaa locations
SGNGYTASNILRGTGSVGLSMIFWALGFLTSVANLSVYLEYAAYFPNRSGSEVVYLEQAYPRPRWLFPTAFAFQSVALSFSSSNAIGKXFACSISEAFREKNGWTDXCEQRAVLAQYLFRINGHSPTAWELKGVAVAGYTVAALCTSLSTLTSMPLSHCXLTPFYFSVVSFHTRLSYLFANGIGIIKVLTLIFISITGLVVLGGHVSTTRIPDPRINFRDAFSGQATPYGVTNALYKIIFSYAGFENAFNVVNEVKSPVKQIRRNGFVALLIVAVLYILANVAYFAAVPKDELVQSQQIAASLFFTKVFGSSGAVRGLNFLIALSSFGNLIAVLIGSSRLIRECGRESRGIXLPVMFMVIADTCSFGDDRQGVLPFPRFWASTRPFGTPLGPYFVKWALTILMILAPPAGDAFNFITDLQVLPSAFFQLIMGIGLYVVRYRRSRLNLPRPEFKAWDLVVVFNILVQLYLIVMPWYPPAGGAYAGDVSFWYGTYVVTGI

SEQ ID NO: 3868 - protein, 351 aa, Neurospora crassa
VVVDTGLTALVLPRNNCTNCGKHSLFNPSKSTSFLPQPALFRPIEYGTGADTIPLNQTGRAECEVVTDTVSIQGLSAPKQEFLLCHSYGETLSSQLADGILGIGPADISTWDESGNYTYLPFLPNLVSEGQLSNRIVGLALGYGGQNQQQRGPEASIGGVDDARYHGRIKNVSVDEMLTTLSGVFTLDVQAAYVGSGNNKRVWPNSTNGNKPLVPGVAYIDSGTAYMLAPDQQAAENLYSGISKDIVPLNDRGSWGASCATLDEVATDITFTIGTKTRGEVIEVTIPKSAFNLGEYPGRKGVCQAAFSHWDPPLVEPIEGRRVWLFGSPLIKAYYTGWNAKSSTLGWAEKV

SEQ ID NO: 3869 - protein, 1069 aa, Neurospora crassa
  unsure (1)..(1069): unsure at all Xaa locations
RSLEDWEVEDFVLLATVDGDLYATDRVRGEVRWHFKADHPMVETRHFRTSRSPVDEDFHEMDHWIWIVEPTRDGEIYIWRPSDSGPQLTKMTMTMKQLVETYSGLHMNGIVYTGEKRTNMVTLNAATGAMIKNLGPRGVNINKVESERCLREYALGNSITSECSNRETITLGRTEYIVGVYRTDGSPIASLKYSEWAPNVLDGDLGQQHSATPDKRYITGKPDGTFFGFGLDRENGDRPLFSHQLTSPVARVFDVLRRQWNPTGSSDTDLIILPQPLFPVNPAISRLRSAKVFVNHTEEGSWYALSGTQYPLILHAPPAPIHKFWPLESLNEDKLSEALVGTHDLPDWRIPKEINRLVATFGCASSSRRRRRYYWXPHGSFVSRGTARPTSTGYCYGTACASLXLFPQPLYSSGWNRDCHCRVDKGLDTSVIQERLLLGRVPGFYENAREEGCDLTRFRIHVVRTEPTPTVTDITPRLEAAKEESSKPDASLADSSAGDSGSDEGLAKKEVTFADLPKSSETPPPVDTTDAPAEVVKPKRKAHRGRRGGIKHRKGPRNENTQSRDDEPPEPTVDEVVKKAQEIGQQPKLEPDVITIPNGVDNVSGPILKMGSLEVNQEQQLGIGSNGTIVFAGKWDGRDVAVKRMLVQFNEIASQETKLLRESDDHPNGEWYQHVNLIGHVTLTNCRSHPLFCSTTVCRIPYIALELCQASLADVIQRPSMFRELAQAGERDMPGVLYQVAKGLSHLHSLRIVHRDLKPQNILVNMGKDGRPRILVSDFGLCKKLEGGQSSFGATTAHAAGTTGWRAPELLLDDDGGPGPGATMTFTDPGSSMHSASGTGSGVVGAGVNVRRVTRAIDIFSLGLVFFYVLTKGHHPFDLGDRYMRESNIRKGKYDLQLLEVLGDYAHDAKDLIESMLNSNPKKRPTAIGVMAHPFFWSPRKRLNFLCDVSDHFEKEPRDPPSPALALLEDQSSCVITNGDFLKTLPREFVESLGKQRKYTGNRMLDLLRALRNKKNHYEDLTPQLRKMVGPLPEGYLGFFTTRFPNLLIKCWEVIADLELEESDRFKEY

SEQ ID NO: 3870 - protein, 574 aa, Neurospora crassa
  unsure (1)..(574): unsure at all Xaa locations
SFSPTQIFEEGTTEEKGENARLSAFVGAIAVGDLVKSTLGPKGMDKILQSAYACSPNPPPTCLTRRRHVLTAPSQHSSSTGEILVTNDGATILKSIALDNAAAKVLVNISKVQDDEVGDGTTSVAVLAAELLREAEKLVDKKIHPQTIIEGYRIASQAALKALEDSAVDHSSNPEAFRKDLVAIARTTLSSKILAQDRDHFAELATEAILRLKGSADLSHIQIIKKSGGKLSESYLDDGFILDKKIGVNQPKRLEKAKILIANTSMDTDKVKIFGARVKVNSTSKLAELEKAEKEKMKAKVEKIKAHGINCFINRQLIYNWPEQLFTDAGIMSIEHADFDGIERLALVTGGEIASTFDHPEQVKLGYADLIEEIIIGEDTLIRFSGTAAGQACTVVLRGATDQLLDEAERSLHDALAVLSQTVKESRTTLGGGCAEMVMAKAVEGAATRVEGKKQTAVSAFATALRQLPTILADNAGLDSGDLVARLRKAIYDGLTTYGLDLMTPGGGIADMRDLGVIESYKLKKAVVSSASEAAEVCNPYFNAEYGFEHANHREXLLLRVDDIIRAAPRRRER

SEQ ID NO: 3871 - protein, 413 aa, Neurospora crassa
KAEFGKLLDTYGNEFEVPDFTIKDIRDAIPAHCFERSALHSLAHVVRDIIYLTVTFYVWNKYVTPEYIPMKAARVVLWGLYTFMQGLFGTGLWVLAHECGHQAFSPSRLINDTVGWVLHSALLVPYFSWKFSHSKHHKATGNIERDMVFVPRTREQFASRIGRFVHEISELTEETPIYTLIHLIGQQLIGWPNYLMTNVTGHNFHERQREGRGKGKKNGWFTGVNHFNPSSPLYEEREAPWIIVSDIGIAIAATALIYLGNTFGWSNMFVWYFLPYLWVNHWLVAITYLQHTDPSLPHYTPDQWNFVRGAAATIDREFGFIGRHLLHGIIETHVLHHYVSTIPFYHADEASEAIKKVMGRHYRADVQDGPIGFIKAMWKAARWCQWVEPTEGAEGKGKGVLFYRNQNGLGVKP

SEQ ID NO: 3872 - protein, 487 aa, Neurospora crassa
ALRSISSIRKRLTPDILAQVVSETFSASSPNTQVAEHLLLAVDRPNVTLGSSSDMEIDSGSKSPAKNGGKKDPKEVIPEIDIFLGILAQVHLYDTKQFQRGFALSRFLSERIQSLNRRTLDSLSAKVYFYFSLFAEQLAPLPPSPQSPIVSIRPILLAALRTAVLRKDIDTQASVIVLLLRNYLLTSHISQADLLVQHTQFPENAANNQVARFLYYLGRVRAIQLRYTEAHEHLTAATRKAPSSACALGFSQTATKLLLVVELLMGDIPDRAIFRQLTMEATLHPYFLLVRAVRVGNLEDFETTIAQHADTFRRDGTYSLILRLRQNVIKTGIRMMSLSYSRISLRDICIRLHLGSEESAEYIVAKAIRDGVIEATLDRERGFMKSKEVGDVYATSEPAEAFHDRIRACLALHDESVKVCFFFFFLPLSNSRSYDRFVAHKFFLCRAMRFPMNQHRLELKNAQEARERERDLAKEIQEGDLDEDDLG

SEQ ID NO: 3873 - protein, 931 aa, Neurospora crassa
  unsure (1)..(931): unsure at all Xaa locations
IXVDDEHGFIRFYKSLPQLGEEAIRIFDRGDWYTAHGDDATFIARTVYKTTSVIRQLGRSDHTGLPSVTMTVTVFRQFLREALFKLGKRIEIWASPSGRMNWKVVKQASPGNLQDVEDELGGQFEGAPVILAVKISAKASEARTVGVCFADASVRELGVSEFLDNDLYSNFEALLIQLGVKECIVTQDKGEKEKDPELAKLRQIIDNCGVAIAERSAGEFGTKDIEQDLSRLLKDERAASLLPQTDLKLAMGSASALIKYLGILHDPSNFGQYQLYQHDLAQFMKLDAAALKALNLMPGARDGAKNMSLYGLLNHCKTPVGSRLLSQWLKQPLMNAEEIEKRQQLVEAFANDTELRQSMQEEHLRSIPDLYRLSKRFQRGKATLEDVVRAYQVVIRLPGFIGTLEGVMDEAYRDPLDEVYTNKLRELSDSLVKLQEMVETTVDLDALDNHEFIIKPEFDDSLRIIRKKLDRLRTDMDNEFAEAAEDLGQEREKKIFLENHKVHGWCMRLTRTEAGCIRNNSRYLECSTQKNGVYFTTKTLQALRREFDQLSQNYNRTQSSLVNEVVGVAASYCPVLERLAAVLAHLDVIVSFAHCSVHAPISYVRPKIHPRGTGRTVLTEARHPCMEVQDDVTFITNDVTLTREDSSFLIITGPNMGGKSTYIRQIGVIALMAQIGCFVPCSSAELTIFDSILARVGASDSQLKGVSTFMAEMLETANILKSATAESLIIIDELGRGTSTYDGFGLAWAISEHIVKEIGCFALFATHFHELTALADQYPNVKNLHVTAHISGTDTDTDVITDEDEKAKKKREVTLLYKVEPGICDQSFGIHVAELVRFPDKVVRMAKRKADELEDFTSKHEEENGGGLGVQYSKQDVEEGSALLKDVLVKWKDEVKSGRMSKEEMVARLKELVQKDERLLGNPFFKSVQAL

SEQ ID NO: 3874 - protein, 437 aa, Neurospora crassa
  unsure (1)..(437): unsure at all Xaa locations
ASDPEVMRTFYQRLFPWRYLFQWLNHSPTPTNDFGHREFAFTLQNDAYLRYQSFTTSDLXVCLSGSLPAIHLTNPTNLNRLRKDVLRLMPSRFEIGPVYTANPRDRKTLRNSSAFRPLSKELCFDIDLTDYDDIRTCCDKANICQKCWQFITMAIKVVDTALREDFGFKHIMWVYSGRRGAHAWVCDKSARALDDQKRRAIAGYLEVIRGGAQSGKKVNLRRPLHPHLVRSLDILKQHFQSDVLEAQDPWRTEDQQEKLLALLPSDQKQLVSALRNKWASSPDRPSTLKWADIDSVAKTSTAKNFDTKSLLDAKQDIVLEYTYPRLDIEVSKKLNHLLKSPFVVHPGTGRVCVPIDVKRGLESFDPLGVPTVQSLIREIDEWKKPEPKEGRQEQEVEKHVVDWEKTSLKGYIEFFRSFVIGLMKDEREVKVKREREE

SEQ ID NO: 3875 - protein, 311 aa, Neurospora crassa
  unsure (1)..(311): unsure at all Xaa locations
VGNYTLGRLIGKGSFGKVYLATHKLTNGSKVCCAGGLFLFLPRHSGXFVLQSFSSVAYIGRLKSANKDDTNLAREIHHHRQFVHPHIARLYEVVVTENLVWMVLEYCPGTKKQIPXPPFHLVCALSKVTLTCFTGDELYNYLLQHGKLPVDKVQRIFAQLVGAVCYVHRQSCVHRDLKLENILLDKHENVKLCDFGFTREYEGSAKYLQTFCGTICYSAPEMLKGEKYAGEKVDVWSLGVILFALLCGELPFDDDDEQVTRRKILGEEPVYPDTLPEDALSLLKTLLSKRPLIRPSLPDILAHPFLAEYAP

SEQ ID NO: 3876 - protein, 536 aa, Neurospora crassa
  unsure (1)..(536): unsure at all Xaa locations
IVVIDGWGIPSEESPKNGDAIAAAETPVMDELSKSATGFSELEASSLAVGLPEGLMGNSEVGHLNIGAGRVVWQDVVRIDQTIKKGELSQNEVIKATFERAKNGNGRLHLCGLVSHGGVVSDQCPRNSRXLLVVCTIADSSLPIHSKQTHLYALLKAAKEAGVPKVFIHFFGDGRDTDPKSGAGYMQELLDTIKEIGIGELATVVGRYYAMDRDKRWERVEVALKGMILGEGEESTDPVKTIKERYEKGENDEFLKPIVVGGDERRIKEDDTVFFFNYRSDRVRQITQLMGGVDRSPLPDFPFPNIKLVTMTQYKLDYPFDVAFKPQQMDNVLAEWLGKQGVKQVHIAETEKYAHVTFFFNGGVEKVFPLETRDESQDLVPSNKSVATYDKAPEMSADGVANQVVKRLGEQEFPFVMNNFAPPDMVGHTGVYEAAIVGCAATDKAIGKILEGCKKEGYILFITSDHGNAEEMKFPDGKPKTSHTTNKVPFIMANAPEGWSLKKEGGVLGDVAPTILAAMGLPQPAEMTGQNLLVKA

SEQ ID NO: 3877 - protein, 465 aa, Neurospora crassa
  unsure (1)..(465): unsure at all Xaa locations
MGDVLVETPASVTQPQKKSAPSAIPNIETFEGVSTEGGDDYITLKKLQRQLEYIKLQEEYIKDEQRYGHRSSTRXELDEEGLTTWYLARSLKRELVRAQEEIKRIQSVPLVIGQFMEAIDQKYGRPMQPPVFKTGPDXPFLSATGIVQSSTGSNYVVRILSTLDRELLKPSSSVALHRHSNAVVDILPPEADSSIAMLGADEKPDVTYADVGGLDMQKQEIREAVELPLTHFDLYKQIGIDPPRGVLLYGPPGTGKTMLVKAVANSTTANFIRVVGSEFVQKYLGEGPRMVRDVFRMARENAPAIIFIDEIDAIATKRFDAQTGADREVQRILLELLNQMDGFDQTANVKVIMATNRADTLDPALLRPGRLDRKIEFPNLRDRRERRLIFTTIAGKMSLAPEVDLDSLIVRNDPLSGAVIAAIMQEAGLRAVRKNRYNIIQADLEDAYSSQVKGTSDENKFDFYK

SEQ ID NO: 3878 - protein, 272 aa, Neurospora crassa
GQPFDIVKVRLQTSTQYSSALTAAASIYKHEGALAFYKGTLTPLLGIGACVSIQFGAFHSARRFLEQRRAATDKSFIPGVSNLGYGEYYAAGAFAGVANSVISGPIEHVRIRLQAQPHGAGRLYSGPWDCVRKLSQQAGGVLPGLYRGEVVTVLREAQAYGLWFLAFEWLMNADAARNKIDRKEIPSYKIALYGGLAGEALWLGSYPLDVVKSKMQTDGFGAGQKYKSMRDCFAQTFRAEGMRGFWKGIGPTLLRAMPVSAGTFAVVEMTMR

SEQ ID NO: 3879 - protein, 440 aa, Neurospora crassa
  unsure (1)..(440): unsure at all Xaa locations
MKGALLTAAMLLGSAQAGVHTMKLKKVPLAEQLVSVDCLPXWLLWTLVDDVGYQESVPIDVQVQHLGQKYTGLRTESHTQAMFKATDAQVSGNHPVPITNFMNAQCKHHTLLXSLGVCWRGHSNXRLVDFSEITIGTPPQTFKVVLDTGSSNLWVPSSQCGSIACYLHNKYESSESSTYKKNGTSFKIEYGSGSLSGFVSQDRMTIGDITINDQLFAEATSEPGLAFAFGRFDGILGLGYDRIAVNGITPPFYKMVEQKLVDEPVFSFYLADQDGESEVVFGGVNKDRYTGKITTIPLRRKAYWEVDFDAIGYGKDFAELEGHGVILDTGTSLIALPSQLAEMLNAQIGAKKSWNGQFTIDCGKKSSLEDVTFTLAGYNFTLGPEDYILEASGSCLSTFMGMDMPAPVGPLAILGDAFLRKYYSIYDLGADTVGIATAKR

SEQ ID NO: 3880 - protein, 483 aa, Neurospora crassa
MSAANGRQPEVQPCRYKVGKTLGAGSYSVVKECVHIDTGRYYAAKVINKRLMAGREHMVRRPFLPSSKAMCDPLPYPNQQTIGSNEIAVLKKVSMGHQNILTLVDYFETMNNLYLVTDLALGGELFDRICRKGSYYESDAADLIRATLSAVAYLHDHGIVHRDLKPENLLFRTPEDNADLLIADFGLSRIMDEEQFHVLTTTCGTPGYMAPEIFKKTGHGKPVDIWALGVITYFLLCGYTPFDRDSDFEEMQAILNADYSFTPLEYWRGVSDNAKDFIRRCLTIDPAKRMTAHEALQHPFVAGWARGTDGAEADKGANLLPTVKKNFNARRTLHAAIDTVRAINKLREGQFMNGGRSREPAKKAAAGAGAVPPAAGGGGGGPGVDDGLAVALGPTLGKEASMVSTASSNVTKDSGYATQPEGEGGSRDGDDVLMKDASVPAPTSSSPAPVHGNTQNAQHAGVPSILRPAVSRIRLSRLVKACG

SEQ ID NO: 3881 - protein, 395 aa, Neurospora crassa
YYNETHAALRAEIREWVETAIDPYVTEWDEKKEVPAEIYKEMGKRGYLAGLLGTKYQSNYVENPIKSVPAEKWDLFHEMLVTDELSRTGSGGFVWNVIGGFGIGCPPLVKFGKKPLVDRILPGILNGDKRICLAITEPDAGSDVANLTCEAKLTEDGKHYIVNGEKKWITNGIWSDYFTTAVRTGGPGMNGVSLLLIERDFPGVSTRRMDCQGVWSSGTTYITFEDVKVPVENLIGKENQGFRVIMTNFNHERIGIIIQCLRFSRVCYEESVKYANKRRTFGKKLIEHPVIRLKLAHMARQIEASYNWLENLIYQCEKMGETEAMLRLGGAIASLKAQATVTFEFCAREASQIFGGLSYSRGGQGGKVERLYRDVRAYAIPGGSEEIMLDLSIRQ

SEQ ID NO: 3882 - protein, 381 aa, Neurospora crassa
  unsure (1)..(381): unsure at all Xaa locations
SSMSIYSFLIAVRSDGQQLMNEAGETTSHLMGMFYRTLRMVDNGIKPLYVFDGAPPKLKSGELAKRFQRKQEATEGLEEAKETGTAEDVEKFSRRTVRVTREHNAECQKLLKLMGIPYIVAPTEAEAQCAVLARAGKVYAAASEDMDTLCFNAPILLRHLTFSEQRKEPIQEIHLEKVLEGLGMERKQVCFPPLPFVSSGYQKNTAICXQHPLLQFIDLCILLGCDYLDPIPKVGPSTALKLIREHGTLEKVVEWMKADPKGRYQIPEDWPFEDARTLFFEPDVRPADDPLCDFKWDKPDIEGLIQFLVHEKGFSEDRVRSAGTKLEKNMKTSQQARIEGFFKILPKTEEEKKAHKRKLEEQAEQKRKKVKEEKKEKAKLK

SEQ ID NO: 3883 - protein, 161 aa, Neurospora crassa
  unsure (1)..(161): unsure at all Xaa locations
GSNRVASCSRTGILTCSIEXFHWQATIMGPADSPYTGGVFFLNIQFPTDYPFKPPKVSFTTRIYHPNINSNGSICLDILRDQWSPALTISKGMFLCVHALLASAHMVLRLLTSVQVLLSICSMLTDPNPDDPLVPEIAHVYKTDRARYEATAREWTRKYAI

SEQ ID NO: 3884 - protein, 391 aa, Neurospora crassa
AFASATSNAPSFNWEDPLNHKSLLTEDEIAIGETAERYCQEQLFPRVLQAYRDEHYDPKILEEMGDLGLLGATIEGYGCAGVSSVASGLITRAVERVDSGYRSGMSVQSSLVMGPINDFGTAEQKERFLPGMAKGKIIGAFGLTEPNHGSDPGSMETVARPHPTKEGVYLLSGSKTWITNSPIADVLVVWAKLQETGKIRGFLVERSACPPGTLETPQIKNKTGLRASITGMIQLDNCPVPKENMFPEIEGLKGPFTCLNSARFGIAFGMMGALEDCLARARTYALERKQFKGNPLAKYQLVQKKLAEAATDVAYGTLAAIQVGRLKDEGKATPEMISMIKRQNCDRTLYHARTLQEIFGGNAVSDEYHIGRVVANLYVTQTYEGQSDIHS

SEQ ID NO: 3885 - protein, 395 aa, Neurospora crassa
  unsure (1)..(395): unsure at all Xaa locations
DPLRLVAGEMKFLTGNIRKLLGSGHPSLDRAAKYYTQAEGKHVRPLIVLLMSRATALCPKAPQRQQSTLQASAAIDTSISPLNILSDFNPSDATPVSIPADTDILPSQRRLAEITELIHTASLLHDDVIDHSESRRGAPSANLEFGNKMAVLAGDFLLGRASVALARLRHAEVVELLATVIANLVEGEFMQLKNTARDEKNPKWSEETLTYYLQKTYLKTASLISKSCRASALLGGADAATVDAAYLYGKNLGLAFQLVDDMLDYTRSEKELGKPAGADLELGLATAPLLFAWKTMPELGPLVGRKFEKEGDAARVCFSCSASCSISLSHTHSHKCXHRYEQARELVLQSNGIEQTRALAQDYAEKAIEAISGFPDSEAKDGLIEMAVKTLKRNK

SEQ ID NO: 3886 - protein, 904 aa, Neurospora crassa
  unsure (1)..(904): unsure at all Xaa locations
RDILPDNFKPIHYDLEIRDLDFTSWSYKGTVKVRLRFPSPRVPSFGAIXLATTTPRIDGKLVKPTKDIVLNTLEIKLLNAKLTAGPQSWESTQFAEDTKAQRSTISFAEELPVADNVSLTLDFTGELNHDMAGFYRSQYKPAAPAAASVPRDDEFHYMLSTQFESCDARRAFPCFDEPNLKATFDFAIEIPDDQVALSNMPVKETKPAGPNKKLVSFERSPVMSTYLLAWAVGDFEYVEAFTDREYNGKKLPVRVYTTRGLKEQGRWALEHAPKIIDYFSEQFEIDYPLPKSDILAVHEFTHGAMENWGLVTYRMTAILFDEKLSEARFRNRIAYVVAHELAHQWFGNLVTMDWWDELWLNEGFATWAGWLATDHLHPDWEVWPQFINEGMDQAFLLDSVRASHPIQVEVRDALDVNQIFDKISYLKGCSMIRMLASHLGIKTFLKGIALYLQRHAYGNAKTEALWNALSEASGVDVNTIMRPWIEEIGFPVVSVTEGKDQISVKQARFLSTGDVKPEDDKTTWWVPLSLRGKIGSQDIEPLSLQTKETTIDGVSQDFYQLNANATGFYRVNYPESRLKTLGTQLAHLTTEDKIFITGSAADLAFAGNSTTAALLSFVQGLKNETHYRVLSQALDSVNTLKSIFGDDEEVKKGLEKFTLELIDKALKEVGWEPKQGENYNIPLLRKRLLLTAVANSHEEVINEAFRRWNEWRANPTGAPIPADLRLPVYRAALKKDPANAVAAIKEEWFTTPAIDGKEVCLQALGQVTDETLIEDVLLPFLFDSAPPAHPRDSVPGADMHILSGNMAGNRIARPLLWAYLRDNWDKFNAKLGGNPILVDRMVNVSLPKFADLETLKEIEDFFSKVSTKGFDRTLEQVKDKIRGRAAYKMRDAEVVKSWLKANGY

SEQ ID NO: 3887 - protein, 293 aa, Neurospora crassa
  unsure (1)..(293): unsure at all Xaa locations
LQDKVILISGGGRGVGLTQAEAVLEAGARVHVVDILPDPSTDPDSPFSAVAKRATEELGSSITYHRVDVRNQQALNEVVQGIAKKEGRMDGLIAAAGIQQETSALEYSREDADKMMSVNVTGVFMTAQAVARVMVENGWPGSMVLIGSMSGTVANRGLICPXVLCSFACLLASFSLFPLPTQSFNQTDPPPEKKSAYNASKAAVLQLGRNLASEWGEHGIRVNTLSPGYIVTAMTAGLFEAFPERRTAWPDANMLKRLSYPEEYRGAAIFLLSDASSFMTGADLRIDGGHCAW

SEQ ID NO: 3888 - protein, 1755 aa, Neurospora crassa
  unsure (1)..(1755): unsure at all Xaa locations
HSSAPLRTIKEIQFGLLSPEEIKGMSVAHIVYPETMDETRTKPRDGGLNDPLLGSVDRQFKCKTCGENMSECPGHFGHIELARPVYHPGFIKRVKKMLEIVCHNCSKVLADEFVQPILQGSLDLRTLTSLLXNDKEFAAAMRIRDPKVRFNRVWAVCKKKRRCENEVVKKSDDDEFNPLADAKGELPGHGGCGNDHPTVRQQALTLYAQFDTKDEEGVKSKEKKIITPEMALNILHNMTESDMIDIGINISQARPEWMIITVLPVPPPPVRPSISMDGTGTGMRNEDDLTYKLGDIIRANGNVRQAIQEGSPAHIINDFENLLQYHVATYMDNDIAGQPQALQKSGRPVKAIRARLKGKEGRLRGNLMGKRVDFSARTVITGDANISLDEVGVPRSIARTLTYPETVTPYNIGKLTQYVQNGPNEHPGAKYVIRSDGSRVDLRHQRRTGPLQLEYGWKVERHLIDGDYIIFNRQPSLHKESMMGHRVKVMPYSTFRLNLSVTSPYNADFDGDEMNLHVPQTEETRAEVKELCMVPLNIVSPQRNGPLMGIVQDTLAGAYKLCRRDVFLTKEEVMNIMLWVPEWDGIIPVPAILKPRPRWTGKQIISMVVPKIINLKNIDEDDGECPLKDKGILIQQGEVIFGLMTKKIVGAASGGIVHLCYNELGPSGAMDFLNGCQRVVNYWLLHNGHSIGIGDTIPDAATIAKVQTHIDDAKAEVKQLTDMATNNQLEPLPGMNIRETFENKVSKALNTARDKAGTTTESSLKDINNAVTMALSGSKGSSINISQMTALVGQQIVEGKRIPFGFKYRTLPHFTKDDYSPEARGFVENSYLRGLTPSEFFFHAMAGREGLIDTAVKTAETGYIQRRLVKALEDSAAQYDGTVRNSLGDIIQFVYGEDGLDGIAIENQPVDHFTISNKAFDKRYRLDVMDEEVSSGELEALEYGKELASDPTVQELLDQEYEQLSVDRHMLREIQRTKGNNDTKMQLPLNIIRIIDTAKKLFKVDETARSDLTPKDVIPAVKAMLDRMIVVRGDDPISKEADYNATILFKAQLRSRLAFKRLAVQDRINKLAFNHILGELENRWSRSMVSPGEMVGVLAAQSIGEPATQMTLNTFHFAGVSSKNVTLGVPRLKEILNVASNIKTPSMMVYLDSKAATQEEAKKMRSAVEHTSLRSVTAVTEIYYDPDITSTNIPEDYDLVESYFLIPDQSGDEPDPIENQSRWLLRITLDRQKMLDKGLRVEDVAHRIKEVYKKDVAVVFSDNNAEEMVIRIRVIKADDDKDEDGNKIIEDDVMLKRLEKHLLDGCTLRGVEGIERAFLNKGVKLIEAKDGSMKHSKVDDECQEWYLDTQGTSLREVLTVEGVDTKRTTTNDLWQVVDVFGIEGARAALMHELTAVLAFDGSYVNHRHLALLCDVMTYRGSIAAVTRHGINRADTGALMRCSFEETVEILLEAAAVGELDDCRGISENVMLGQMAPMGTGAFDVFLDPKMLETVISDNSRMGLMPGMTVKGSQLDGAATPYDTGSPMADSGFLGSYSPTMGNFSPIQGAGSDSPTNNGFGTDYGGVGGYGSGTSYSSATSPRATSPFTPTSPFSYGGYSPSSPAAGYSPSSPLLDSAGRFASSPQFSPSSPSFSPTSPMLRPGSPTSPSYSPTSPSYSPASPAAARYSPTSPAQQFSPTSPSYSPTSPSYSPASPAFQATSPSYSPASPTWSPTSPDAYSPTSPSFQRSPGQQLSPTSPTGYSPTSPQYSPRTPG

SEQ ID NO: 3889 - protein, 405 aa, Neurospora crassa
  unsure (1)..(405): unsure at all Xaa locations
MNLLLAEDYLLQDYPEHITNTIRSGHSTCVRFNRTGDFLASGRVDGTVVIWDLETMGVARKLRGHSKNITSLSWSRCGRYLLSACQGWKAILWDLQDGSKYCEVRFRAPVYGAELHPMHQMLFVVSSIVPLHCNRDXSNHCNDSHQFAAALFEEQPMLVDVKESAQGANPVEVRHILPSVEKRSDDGADTPTKEKHAKEDARHMTTAIVYTATGEHLLAGTTKGRLNIIDATTHKIIYSEKIAGGVITTLRLTESGKELLVNAQDRTIRTFKVPDLTSADLDPDTIQIPLEHKFQDLVNRLSWNHAAFSSTGEYVAASTFNNHELYIWERGHGSLVRMLEGPKEEQGVIEWHPHKPLLAACGLETGRINIWSVTSPQRWSALAPDFVEVEENVEYIEKEDEFDIH

SEQ ID NO: 3890 - protein, 520 aa, Neurospora crassa
  unsure (1)..(520): unsure at all Xaa locations
YLVTLLACLAAKSIAVPLSPAFPAPELQYILNHSEALLLLSSAKFTNKAQEVLKTELDSKPTLLELTKFQGGSQHEQVTLDSKSGPGEAGMMLYTSGTTNRPVGNLSDPSFQHQEVGNXHSIQKGVLIPQSVMTAQARSLIHAWEYTPADHLLHVLPLHHIHGTINAIFTPLFAGSSIEFMFPFNPDAVWKRFAAPFLPDTSDKKKITFFTVVPTVYSRLLTTHKNLPGDLQTATRKAIAPSNLRLAISGSAALPTPIKKAWHELSSGNVLLERYGMTEVGMALSCGLETADRVDGSVGWPLPGVEARLVDIENNTIIEPGQERDPETGRERAGEIQLRGPSIFREYWRNPEATAKEFVTDEKDVAGSKGRWFKTGDVAVRRPAPEGAGKSDLKSQKDWARGDMYFILGRKSADIIKSGGEKVSALEVEREMLSLPQVAECAVLAVPSGKWGQKVGAVVILDKEHVPEGRWTPLEMRRALKDRLAAYKIPQVLKIVDKIPRNAMGKINKKNLVKEVFADE

SEQ ID NO: 3891 - protein, 1258 aa, Neurospora crassa
  unsure (1)..(1258): unsure at all Xaa locations
GITKRSKDKAARAERSAGGDKSSSAKPKKATFDTTKKKEIGVSDLTLLSKVSNEAINENLKKRFEGREIYTYIGHVLVSVNPFRDLGIYTDQVLESYKGKNRLEMPPHVFAIAESAYYNMKAYSENQCVIISGESGAGKTEAAKRIMQYIANVSGGGSGDIQQIKDMVLATNPLLESFGNAKTLRNNNSSRFGKYLQIHFNAQGEPIGADITNYLLEKSRVVGQIANERNFHIFYQFTKGASQQYREMYGIQKPETYLYTSKAKCFDVDGIDDLAEYQDTLNAMKIIGLSQQEQDNIFRMLSAILWAGNLVFKEGDDGYAAVSDQSVVDFLAYLLEVDPAQLVHALTIRILTPRPGEVIESPANVPQATATRDALAMAIYYNLFDWIVERINLSLKARQATTNSIGILDIYGFEIFEKNSFEQLCINYVNEKLQQIFIQLTLKAEQDEYAREQIKWTPIKYFDNKIVCDLIESTRPPGIFSAMKDATKTAHADPAASDRTFMQSINGMSNPHLTPRQGAFIVKHYAGDVTYSVDGITDKNKDLLLKGVQNLFQASQNQFVHTLFPQQVDLDNRRQPPSAGDRIRTSANALVDTLMKCQPSYIRTIKPNENKSPTEYNEPNVLHQVKYLGLQENVRIRRAGFAYRQSFEKFVDRFFLLSPATSYAGEYTWTGSYEAATKQILKDTSIPQEEWQLGVTKAFIKSPETLFALEHMRDRYWHNMATRIQRMWRAYLAYRAEAAIRIQRIWRKKRVGAEYLQLREEGHKVLGGRKERRRMSILGSRRFLGDYLGINATTGPGAQIRNAIGIGSNEKAVFSCRGELLEHKFGRSSKPSPRILVVTNSKFYIVAQVLNQGHVQIMAEKAFPLASIKFIGASTARDDWFSLGVGSQQEPDPLLNCVLKTEMFTQMKRVMPGSFNLKIGDAIEYAKKPGKMQLVKVLKDAPTSQDFYKSSTVHTQPGEPPNSVSRPQPKAKPVPPRPITKGKLIKPGGPGGRPARNANPNRTAQPRPGGGPSIAASNPLASSAAAASSRPVPAHPGAAATPAAAKSLPSHTRQQSSTSTVRPPPPPPPAPAAKPKIMAKVLYDFAGTRENELSIKAGDMIEIVQKENNGMFPPLPSHLSSSXKYRNPDNDFHRWWLAKTPEGQAWVPAAYVEEQAPAPPVVAPRPPPPPPPAANGGGRVAPQPPAKRPVAGRKPAPAPAVASLQNRDSGMSLNGANGSGSDASRSSTPTPSIAGSLADALKARKQAMAKRDDDEDDW

SEQ ID NO: 3892 - protein, 233 aa, Neurospora crassa
  unsure (1)..(233): unsure at all Xaa locations
LPKRIVKETERLMAEPYVHTILIPRSKQSRPKSXLLLPDRSVPGISAVPHEDNLRYFDVEIHGPSQSPYEGGLPXTPRLPLHSSLTFRAPXEHTTXSLTGEPNTHTGGVFKLELFLPDDYPMTPPKIRFLTKIYHPNVDKLGRICLDVLKSEXSRERKAAIVGYASSEKLTHDTKPDRNWSPALQIRTILLSIQALLGAPNPDDPLAPDVAKTWKENPSVAVATAREWTQQYA

SEQ ID NO: 3893 - protein, 403 aa, Neurospora crassa
  unsure (1)..(403): unsure at all Xaa locations
MSPSLVDNHAAAYIAAPSSAKAPMIQKPGNTFGMSSPIESKFLSQPRDLGIVAVGFSGGQVCDALYFFLFFXRVWHPLTRPKFXCKPGVDAAPSALIESGLLTQLREELGYRLHGDDEVHLYTDLVPKEDPPHRNMKNPRAVSNVTKRIAEQVHSHAKEGRLVLTLGGDHSIAIGTIAGSAKAIKERLGREIAVIWVDAHADINTPETSGSGNIHGMPVSFLTGLASEDKEEFFGWLKPDHLLSVKKLVYIGLRDVDPGEKRILRENGIKAFSMHDIDKXAXSPMNDMSIPGASCXSLPLSYQHGIGRVMEMALGHIGNDTPIHLSFDVDALDPMWAPSTGTPVRGGLTLREGDFICECVHETGSLVAVDLVEVNPTLAAPNDVGAHETVRAGCSLVRCASRR

SEQ ID NO: 3894 - protein, 267 aa, Neurospora crassa
LAGQRVLILGGTSGIGFAVSEASLEAGLLVTVSSSSAPKLSTALDRLRSSPAYVPSSTSVAEGGVPRLTGFTCDLSNPSTVEANLTQLLDQATLEGRHKFDHVVFTAGDALALTPIGQITPEGYARASAVRFTAPLILSKLLSTEKYFNHSVYSSITFTSGTNSEKPAPGWSVVAGVCGAIEGLARGLAVDLKPTRVNLVSPGAVKTELFSAFGEGEQLEQLLDGFKKQTLTGTVGTPEDVAEAYIYLMRDRYVTGRCLGTDGGRLL

SEQ ID NO: 3895 - protein, 801 aa, Neurospora crassa
  unsure (1)..(801): unsure at all Xaa locations
MVHFHLNPSLWAVLLAFTSLQPCSADKRVDLIVRPDGGNVSSPIMYGLMHEVLFTILCLLTERVXRXSRSQTLQDINNSGDGGIYAELIRNRAFQSGDESRYPVTLDGWSAVNGAKLSLKKLSQPLSAALPYSMNVAVPSSSNKTVGFANAGYWGMDVKVQKYTGSFYVKGAYQGKSFTASLQSALTGEVFGTTKVPVQKAGNDWVKYDFNLVPEKAAPNSNNTFAITFDAAVSYLPRHHDRDTREQXTLTNTIQGVRGGSLDFNLISLFPPTYKNRPNGLRVDIMEALAALKPVRCCSIPTFTSNMIXHRRQKFLRFPGGNMLEGNTLPTWWKWNETIGDLKNRPGRAGVWGYPLSAGLGLVEYMQWCEDLNLEPSQFSPSSIVKPCKPLTIXPVLAVWSGLALDGGELPESRIDEAVQSALDELEFLTGDASTHWGGIRASILGHTRPWKIRYVEIGNEDWLGGGSTGFENYKKYRFPAFFKAFQEKYPEIQLIASPSVFDGMTIPKPAGGDYHPYLTPDNMVSSFNKFDSLTRDNLTLIGMFYYILEPXDIRRDTDFLSRRGSINTPQRRYRLEWQSYPFPWWGGSVGEAIFLLGLERNGDKVIGATYAPGLRNLNRWQWAMTQIQHAADPALTTLSTSYYVWKAGPSSFFFFFFFFFFPVQIDVXLTMILYQLLGTTAITKTLPVTATTGGIGPLYYVAGKTERGSSVFKAAVYNSTEPVAVSVQFAGLGEKVKQPHKKTATATLTVLTGPTNPYEYNDPWKHNNVVKETKTKLNAKEGGIFSFTLPQLSVAVLETD

SEQ ID NO: 3896 - protein, 441 aa, Neurospora crassa
  unsure (1)..(441): unsure at all Xaa locations
THIGPWQLGKTLGKGASARVRLARHRTTHQLVAIKIVAKSTAHVTQATSMANLDRVDYRKPSISTDGVRRMPLAIEREVAILKLIQHPNIIKLHDIWENRQDMXDKHCYTRFLVIGSANIWSSYLVTEYVEKGDLFDFINWNGSLNEEEAIFYYRQIMSALEYCHSFNICHRDLKPENILLKADGQIKIADFGMAALHQEPTHHLKTACGSPHYAAPELLKHQPYKGSAVDIWAMGVILFAMLAGRLPFDDSDMDAMLQRARKGYYKMPSELSREAKDLIRKILVVNPLQRITMKQMWKHPLIKKYDYVDDYQQSDGQPQDVLRNADIGPIPEKEVDPQILRQLKAMWHAYSEAQIKEKLGQTKXVYASFIQSLPTPHANPCATDQTTRRCFIGFSTGIDMHNSRTITTTFPFRRAISTTXSPLTGASASRPANSHSPLET

SEQ ID NO: 3897 - protein, 1095 aa, Neurospora crassa
  unsure (1)..(1095): unsure at all Xaa locations
GAIVRVKLKDFVTYNEAEFFLGPSLNMVIGPNGTGKSSLVCAICLGLGFPSSVLGRATAVGEFVKHGKDEARIEVELQGKPGEDNYVVGLLIIRETNKTRFTINREQATHKEVRQLMKSLRIQIDNLCQFLPQEKVAEFAGLTPVELLEKTLQATAPEEMIAWQSELKDHYRVQAEAQRSADESGEEIKRLEERQAALQTDVERLREKEQYEAAIAKLKKLKLVVAYNEAREQFHVEKRKKKEAERRLNQLQRDSAPSLEAVNKKQEYVEGVKAAVETRTARLRDAEKDADNAAEESRRLRAKSGTSLVNLKRNKAHLLLEDRNLARSVRRSPSWKPSTNRTLGILIQPNGTGGLXVILSXRRSSDLVTMLTPNSESKSMXFAIRNRKSLKXMIQVTTLKTQGREINRTIRAAEEKIAALDSHQGQLLSQLQQANRDAAQIWEWLQENQNVFEKEVFGPPMLTCSVKDPRYSNLIQAFLQESDFLCFTSQTRKDHKTLSDQVINKMGLSATLRCCEADVDSFRRPTSQAELNAFGLDRFIIDCLEGPSPVLAMLCSEKKLHSTAVGLADISEEQYHKITLDGRIRFFAAGKQSYMSNRRVEYGPNAVSTRVMQVRPGKFWTDKPVDDSVKREMERLRDRARFEREELKQTHDELVGRMDVLRNEIITIKDKLVRYPAFNSWFQSTDTHKQEQIRAEKNELQREHSIWQALPDKIGRFSLTRTSHASCXHXLLESEKRSEQDKRQELIETQAQLADLEKQHDRAVLKTAEAVLQHQAKLSGIREAYQALQEAKVLLIEAQSDFEVLKERNAEIIKNLEDEKRALTEISGQIAEIRQRATEAKAAAEEALSEEERSGGEFSALAKATTLEQVESDLRAQETLADGIEANNPHALKEYQDWAQKIEREQANHERRAAQLADVNAKIETIRSQWEPRLDELVSRINDAFSYNFEQISCAGEVGVHKDEDFEKWAIEIKVRFRYVSPSSPFLLPPDHXPLSTQQSRRSPPRLDQHRQSGGERAVSTIFYLMSLQSMAQAPFRVVDEINQGMDPRNERMVHERMVEIACGERTSQYFLITPKLLSGLRYDRRMRVHTIISG

SEQ ID NO: 3898 - protein, 597 aa, Neurospora crassa
  unsure (1)..(597): unsure at all Xaa locations
DDTFEDLTGNGSAVSVVHKQVDKNLPKPYPVPTSRRKERDSEPGEHTTSRNPRSPRPPRPCHXANIPAQPCCPLPTGTLPGKRARLTHGQEIXHVEGPHSRGARAAKQTQCQATGQRDPAVXGSCHHVALCWCXLLIDFLDYYFDLLTYVGQRQNRLNAFKAEFPPPPETDEETYKQMWHKYAGRERANLRKRRVRLRQGDFQILTQVGQGGYGQVFLAQKKDTKEVCALKVMSKKLLFKLDEVRHVLTERDILTTAKSDWLVRLLYSFQDDKNIYLAMEYVPGGDFRTLLNNTGVLSNRHARFYIAEMFCAVDALHQLGYIHRDLKPENFLVDSTGHVKLTDFGLAAGFLAPAKIESMRIRLEKASETSVPFGKPMDQRTVAERREGYRTMRDRDTNYAKSIVGSPDYMAPEVLRGEEYDYTVDYWSLGCMLFEALTGFPPFAGSTADETWRNLKHWKEVLKRPVWEDPNYFLSNRTWSFITTXVXCDKKKRYGAXMLTSVXLHQLPIAAFNNIKDIYAHHYFAEVDWAILRETKAPFVPELDSETDAGYFDDFSNEADMAKYKEVHEKQQALEGLAERGEEMNKSLFVGFTFRHR

SEQ ID NO: 3899 - protein, 377 aa, Neurospora crassa
  unsure (1)..(377): unsure at all Xaa locations
VQQTCIPQAMLGGDIICQAKSGLGKTAVFVLTTLQQVEPVAGECSVLVMCHTRELAFQIRNEYNRFSKYMPDIKTGVFYGGTPIQKDAEVLKNKETHPHIIVGTPGRLNALVRDKHLRLGSVRMFVLDECDKMLDQIGKFPLXSTADRWSLTPQIDMRRDVQEIFRATPQQKQVMMFSATLSDEIKPICRKFMQNPTEHYVDEDTKLTLHGLQQYYIPLEEREKNRKLNELLDELQFNQVIIFVKSTLRATELDKLLRECNFPSIAVHSGVSQEERYVHLSRHHCVGAYXLSLXYRRYKEFKEFNKRICVATDVFGRGIDIERINLAINYDLPADADSYLHRVGRAGRFGTKGLAISFVTTDQDKEVLKAIEKRFEV

SEQ ID NO: 3900 - protein, 553 aa, Neurospora crassa
  unsure (1)..(553): unsure at all Xaa locations
EEGDIGPELPELEDQLFGPVEQRGRRGIDFSAIAELQLVQEGPTRVEPIDSFRAAGLHPAMLRNVELAGYDVPTPIQRYCVPAISQGHDVIAIAQTGSSSSDAPVMSILDTDKSLGSGKTAAYMIPIINKLMGKAKKLAAPRPNPVTYQPGIDQPCRAEPLVVVVCPSRELAVQIFNEARKFCYRSMLRPCVIYGGGPMREQMEQIAKGCDILVASPGRLIDFMDRPDILSLRRVRYMVIDEADEMLHDDWKDELDQILSGGGKLTLHSIFLLPQTVWXAQANTFSSTDQEEGNIKYMLFSATFPKAARDLATTHLADNHVRLRVGRAGSTHSNIKQDVIWVEPYLKKQACLDLLNTVPPGRTIIFVNSKRAADELDDFLFNKGVPCVSMHSDRTQREREAAMRAFRAGRSPVLITTAVTARGIDVRNVLHVINFDLPSTMYGGIEEYVHRIGRTGRIGHRGLATSFYTERDEDLASVLTRTLLETGQEVPDFLQQYIPEDTQESSLRGRFRLEEDVGGGGDDADGDDAGGGWGGGGGADDAGDNAGGDGWGA

SEQ ID NO: 3901 - protein, 146 aa, Neurospora crassa
HPKANVEKMSRGEPLTDADRAGWLQALAEHETAKPPTSSSPHLVITCSALKRHYRDILRLGSEHAGDLRIRFIFLQAPEEVLTERAHNRKGHFAKENLVHSQFTILEMPDPTKPKEEGGEPDVLVVNVGEKEKGVEEVVREVVGRV

SEQ ID NO: 3902 - protein, 465 aa, Neurospora crassa
ASSHLINYGTTFLPDLIVSASHLSLFTAPSPGSSSPYGRAITDWTSGQMSSLLGHSHPEIVSVISSHASSLDHLFSGMLSPPVLNLAKRLTSVLPDGLDRAMFLSTGGESNEAAIKMAKTYTGKFEVVGLGASWHGVTAQANSVQYHAGRRVGWPLMPGGLMLPSPNAYRCHQGFRKREEKGLKGDGASGGEEESKKGDADEKENGKKNQGENEEEWEYDWEAEMLYGWRLIDQQSCGSLAAVIVEPIQSSGGMHVLPHGYLRRLKTECEKRGMLLIVDEAQTGIGRTGEMVAINHDGVVPDILTLSKTLGNGLPLSAVVTSHAIADVCAERDFLFYTTHVNDPLPAAVGDKVLEIVVRDDLVSHARRMGEILHSGLNQLKKRYACIGDVRGRGLMAGVEIVEDRRKGKEPGLELAKRIGDRAYELGLWCNLSTHPSFGGTFRIAPPITISEKEVREGLAVLEEA

SEQ ID NO: 3903 - protein, 564 aa, Neurospora crassa
RLRSYFRPGTTSNPLERRLLLKIDFFILTFCCLSYFLNYLDRTALSNAYVSGMKESLSFRGNQLNQINTCFTIGYVLGQIPSNLSLHYIAPRIFFPGMMVLWAGLTMVTAAARHPGDIMAIRFFQGIAESTTFVGTHYILGSWYTEQELGKRSGVFTASGLAGTMIGGFVQSGIHGSMDGLRGLSGWRWLFVIDGIITLPVAIYGFCLFPDTPKTTRAPYLSVQERELAIRRMEKKRQGEPAEMGRSSSGDTLVVEAETSVSKPDIQPRPEPEPKPSPSSATDHHLTTHPSSTTSTSTSNNPQETTAHAAAKTESSLTKTHPFSLPFLRSLFSSYHCPSFIFLWILAGETESFSSNALLSLYLKSHPSNSSSPSPSSSPSVPNNPAPTAPRYTVSQLNTYPTGVPAVGILSTLFFAFITDLYPNHRSIVGYFIGIIGVLTPSLILAAEHGHFGVDPAGNKATAVVMGMYYLSGSVYACQATFFAWANDAMTRDGKEAVFRGVVLAGMNMGNNAVNAWWSIVFYGADMAPWFERGMWAMIGTSVGLAVWTGFLSYMERRSRRRRR

SEQ ID NO: 3904 - protein, 598 aa, Neurospora crassa
PDFFAGARLNFAENLLFPGNAQVNGSDVAVITATENDEHLTETTWDELREQVRQCSNALQAAGVKENSVVAGFVANHVQALVALLSAASLGAIWTGISPDNGVSAVLDRLVQIKPKVLFSDNATLYNGKEWSGKAKTLEVVEALQKHGLELVVVVKGLQNFETGLDEIRVKGVKAEEYDEFLHSSPKEEPLVFAQLPPSHPLYVLYSSGTTGLPKAIVHTAAGTLLQHKKELFIHSNLSPRSRMLYYTTTSWMMHHWSVSSLSCGASLVLYSGSPFRPHGYLSLPRLLSSLKVTHFGTSAAYLTTLEANSVRPIDPVHNLDLSSQEAIYSTKKTLPPSTFAFVYTAFPSTINLASITGGTDIISLFGAPCPLLPVRAGEVQCAGLGMAISVIDSASDASDPRPVDPVGSEGDLVCLKPFPCQPLTFFGPGGDDKYRAAYFERFGTAMWHHGDFVRMNPSTGALVMLGRSDGVLKPAGVRFGSAEIYNVLIRFFASEVEDAVCVGRRREFDRDETVCLFVVMVPGKSFTSELRDRIKNVIKRELSPRHVPGVVEECGPAGIPRTGNGKKIEVAVKQILSGLKVKTNASVANPEALEWFR

SEQ ID NO: 3905 - protein, 574 aa, Neurospora crassa
SHESTTLFQPPSLEETLKRQRAEAQFGPLNSQSHRYISTHDGSTLEPPVEDEPPYYYVLTTYLSYLILIFFGHARDFFGKRFGDQNHYKALRAQNGYAPLNDDFDNFYVRRLKMRIDDCFARPTTGVPGRYITLLDRKSDDFNRNYQYTGTCTETLNMSSYNYLGFAQSVGPCADAVEECVHKYGLSACSPRADTGTSDLALEVEREIAKFVGKPAAMVFSMGFVTNAGSFPALVSKGDLIISDELNHASIRIGARLSGAVIRSFKHNNMDDLEKLLREAIAQGQPRTHRPWKKILVAIEGLYSMEGTMCDLPGILALKKKYKFFLYIDEAHSIGAVGANGRGVCDYFNVDPAEVDILMGTLTKSFGANGGYVAAEKHIIDKLKATNAATLLGESPAPAVLMQILASLKIIEGELAPGQGEERLQRIAFNSRYLRLGLKRLGFIVYGHDDSPIIPVMLYNPGKISAFSHEMLKRKIAVVVVGYPATPLISSRARFCVSAAHNKDDLDRLLAACDEVGDILQIKFSTGVAGGLEPLPAGVTPEMEKEYIKAKGQALIKPPRWKLEDVIARGVEDA

SEQ ID NO: 3906 - protein, 417 aa, Neurospora crassa
  unsure (1)..(417): unsure at all Xaa locations
VLKGSKKRQAEDKWKLPNSPCRTRFAPSPTGYLHLGSLRTALFNYLLAKATGGQFILRIEDTDQVITTQHLVPQDHRWSIRRRSRGXCSLLYPXTRLVHDAEQRLFDDLRWAGLSWDEGRQXHPMSLHSSFIPASPCXLCLFCEKAPMFRDHMDRIGRXDAKQLWCITGGGWLTIYICQSERLLLYDEHANQLIREGKAYRCFCSPENLERHKQAAHESGESTAYPGTCRNVSLEESDDRAAKGEKYAVRFKSSDKPIIIEDILYTRYRKREPEEDFIIRKRDGFPTYHFANIVDDRAMKITHVIRGAVRCIFLNLSVMFPISANPSPSRNWLISTPKHVELYNAFGWEPPKFAHVGLLVDKERQKLSKRHKGVDMSWYKDNQIPPEALLNFAVLLGWSQKSGEPDFMTLQDMVDRF

SEQ ID NO: 3907 - protein, 306 aa, Neurospora crassa
DALYAYDSEAHKAVVNSRPWTNDHKYFKTVRISSVAMIKMVMHARSGGNLEVMGMMQGYIEGSTMVITDAYRLPVEGTETRVNAQDEANEYMVEYLRLCREENRLENVIGWYHSHPGYGCWLSGIDVGTQSLQQQFNEPFVAVVIDPDRTVSQNKVEIGAFRTIPEGIKPFAATNTTTGDGQSVPLNKVEDFGAHSHRYYALDVEHFKSTLDSKLLETLWNKYWVQTLAQNPLLTNRDYTSSQMVDLGSRISKASKSLEMLSTTGQRGPKSDAVDQNIEKLLSEVKQIAAKERSGLMAAEVKGKVF

SEQ ID NO: 3908 - protein, 405 aa, Neurospora crassa
  unsure (1)..(405): unsure at all Xaa locations
ILRNGHFVSRASDYIIYSVEAAVIDRVVAQYGPCVLPXPLSPSRRLDLNRVPRFXATKLGAIVGGQTSCKDPEIKAFEKYLPADVDIVSCHSLHGPNVDPKGQPLVLIKHRASDESFSKVEHVLSCLNSKVVYLSADEHDRITADTQAVTHAAFLSMGKAWHATKQFPWEGTRYVGGIENVKINLMLRIYAQKWHVYAGLAILNPEAHKQIAQFAKSTTELFQLMLEGHSDELRARVYAAKEKVFGAEGSPKWASKPLLRDDVLDQFSLRQPENGGPSAPSLPNNHLSLLAMVDCWSALGIVPYDHMICSTPLFRLWLGVTEHLFRTPGLLDECLKVGIEDRTFRRDDLQFTIAAAGWAECVGLRQFETWRERFAVTQAFFEPRFKGAVEVGNAMIKAVLASDEK

SEQ ID NO: 3909 - protein, 363 aa, Neurospora crassa
LLFALGSNGSGQLGIGHKEDVSVPKDAHFDADLPATASITKIVAGGNHTIILTTTGDIYWSGDPNTGACGKFTQTQISQPPRFHPVDISSVSTPQDPFRVGMVAAAWEASIFTRLDAQGRNTRVYSCGTGLKGELGLGTFIFRTATPSLIPDFPPPDTEVVDLAACMGHVVAVLSNGDVWGWGNGRKGQIGAPEDIVHSPRKIEGLGFKVVKAVCGKEFTCFLGSPESGNIMVLGSDKWGIRGEVPDQVVGWREVGASWGNLFILKGDGSLLSWGRNDHGQLAPANLPQTKHIAVGSEHALALSEEGDVTAWGWGEHGNCGPLSSSDVTKGQQNVIASSKFIPSGAKITTIGAGCATSWVAIQ

SEQ ID NO: 3910 - protein, 458 aa, Neurospora crassa
  unsure (1)..(458): unsure at all Xaa locations
DMPIQDALELSDDSDVEVHPNVDKRSFIRAKQNQIHAERQQRKLQIETLKYERIINDTLIKRISSLLASLKAHASEVSSRNPGEVAFQAVIESAAGLDPKDDQPPPRPAGVHNAEQPLPTYTKMMATLLDDVNKTLEEKKVEQDKRYEATIAEVEEHLKKVTNLQGELLNKLDELEKIDKSKITSESIHTGFDSTHINKAKASTSGDKKEASKVELLNPNYSATDSLPAPSTTTNDDDDDAEIEASPAAKQFASIKADDYRESLAFLTKHPEILTEKETDGLLVLAFDAQLQNRDDYARNCVHQALLLQYCRALGRDGVALFFKRITTQGHQAQEVFFKDVQDTFYKIKNRAREINLQRAKEEAEGGSQEGVEQIQLHAVEPGTVININIPPADSEDPEVQQARAIFESFSPEMKKALESGKLDEVNKVLGKMKVEEAEELVSKFGDVSXQSFSSVLI

SEQ ID NO: 3911 - protein, 539 aa, Neurospora crassa
  unsure (1)..(539): unsure at all Xaa locations
KAHDAVKPVADSFAHTTLESFEEAFNGMNSQAKALWDEIKLLVPENAFDKPTWFSKPKAAKRRKDWDHVVKGADVQKLWVKGADGEKHREVGGQLDNFNLRVKSVDPSKLGVDKVKQYSGYLDDEENDKHLFYLXVNHARMYLVSKNHGADSDCPGFFESRNDPKNDPVVLWLNGGPGCSSLTGLFLELGPSSIDKKLRVVSNEYAWNNNASVIFLDQPVNVGYSYSGNAVSNTVAAGKDVYALLTLFFHQFPEYAKQDFHIAGESYAGHYIPVFASEILSHKDRNINLKSVLIGNGLTDPLTQYEHYRPMACGEGGYPAVLSESECRSMDNALPRCQSLIRNCYESGSVWSCVPAAIYCNNQFIGPYQRTGQNVYDIRGKCEDDSNLCYSALGWISDYLNQKDVMDALGVEVEGYESCNFDINRNFLFQGDWMQPFHRLVPGILKEIPVLIYAGDADFICNWLGNKAWSEALEWPGKNGFNKAELEDLSLPKADKEYGKVKSSGNFTFMQIYQAGHMVPMDQPENSLDFLNRWLGGEW

SEQ ID NO: 3912 - protein, 929 aa, Neurospora crassa
  unsure (1)..(929): unsure at all Xaa locations
NSPAPPSVLNRGRVQPRSGRTPGCVGLQNLGNTCYMNSALQCLRSVEELTKYFLTHEAKKEINPDNPLSHNGDVAMAYMRLLDEIYKNPAPNSVAPRHFKGIVGRYAPAFSGYGQQDSQEFLGFLLDGLQEDLNRIKKKPYIEKPDSTDDMIGNPAAIKEMAEKVWDITKKRDDSIIADLFTGLYKSTLHCPVCDKISITFDPFNNLTLPLPMSNVWSRTVKYYPLNEPPVEIVVEVDKTSAFKAIKEFISTRVGVPPERLVGGEEFKGKFFKQYDDMMAINEEIQPGDVAVIHEVEAPPTNVNAKKAKKQVYRSLLDDAEEEPAQPTSNPLAERLLVPVLHRTMDPNGAGVRYHRKVEDIPPPHYIVLTPQEACDENIIRRKILQKVATLSTWSEFTADEEASEATDPEMVNGASDIDSADSKVVAKSVEGEEDIVDVTMGNTGFCQTNSVASSSNVSDFHEYVDLYMVSLTWNKNSLPALLKRFKSQQPKWLDPSVFLNPALQNLFAMSYFRELHGGVPTGWQSVNDTSKHERLSSRAPKTDSSDVEMRSPNALDGSDDSGSEEASSEQVDSVTRMADESSEGSDAPKGSVSQIDALSLVVRLTWYNVLTPXSGSIHRXSSXGSKCRSTRQKQEDESWPHLWQEGXEAFXKEQLRKRAAAAQQPIEVPEQDYRVDSEEGPLVRLGEGIVVDWYEDAFDTVFSPANRTYNKIETLNDPSLGAKKRQRELRKKHGISLDDCLAEFEKEEILSEQDTWYCPRCKEHRRASKKFDLWKTPDILVVHLKRFSSVGWRRDKLDVLVDFPIEGLDLTERVIDKEDGKQEIYDLIAVDDHWGGLGGGHYTAFAKNFVDDQWYEFNGKTFNALVLGGQGKCXQAVDSSVSKVTDTSKVVSPAAYLLFYRRRSDKPLGGPKCEEVAQRYSLDDDEEM

SEQ ID NO: 3913 - protein, 1007 aa, Neurospora crassa
  unsure (1)..(1007): unsure at all Xaa locations
SPAVERVTDQLEKPSLDDRSYRVIRLPNKLEALLVHDPTTDKASAALDVNVGSFSDEDDMPGMAHAVEHVSFRALFTRKGKFFCDIFVYXPWXSXFXLLFMGTKKYPVENDYSQYLSTNSGSSNAFTAATHTNYYFEVSAKPSNDEELSATNPSPLYGALDRFAQFFVAPLFLANTLDRELRAVDSENKKNLQNDTWRLHQLDKSISNPKHPYCHFSTGNLETLKVLPESKGVNVREKFIEFYQKHYSANRMKLCVLGREPLDVLEGWVAELFSDVENKDLPPNEWTDEAPLTPEQLGVVTFAKPVMDSRELNITFPFLDEHLLFEELPSRYLSHLLGHEGPGSIMAHIKSKGWANGLSAGAWTVCPGSPGMFDIQIKLTQEVCPPYLVIILXIADPNAKGLKNYEEVVKVVFQYIALLKQTGPQEWIHNEQKIMGDIDFKFKQKTQASSFASKTAGVMQRPLPREWLLSGTSKLRKYDANLIRKGLDCLRPDNFRMSIVSREVPGKWEHKERWYGTEYSVSKIPSELMEEIKKAATISDQERIPDLHLPHKNQFIPTKLEVERKEVKEPALAPRIVRNDDLVRTWYKKDDTFWVPKANLIVSMKSPLIHASAESVVKARLFTDHVKDALEEFSYDADLAGLSYLVSLDSRGLFVEVSGYNDKLPLLLERVLITMRDLEVRDDRFDIIKERLTRAYRNWELQVPWYQVGGFTEWLTAEHDHTIEELAAELPHITSDHVRQFRKALLAQLHMEVYIHGNLYKEDALKLTDMVESTLKPRVLPRSQWPILRSLVLPPGSNYVWKKTLKDPANVNNCIEYFLYVGDKNDSLIRAKTLLLAQILQEPCFDQLRTKEQLGYVVFSGVRATSTSYGFRFLIQSEKTAPYLENRIELFLERMAKWIEEMDPRQFEAHKRSLIVKRLEKPKFLDQETNKQWSQIHSEYYDFEICKYLTFEIALTTLSLYXPFPLAQRDAAHVKPLTKEELIEFFKHYIHPSSPSRAKLAIYLEAQ

SEQ ID NO: 3914 - protein, 717 aa, Neurospora crassa
  unsure (1)..(717): unsure at all Xaa locations
LXTLIDFGQHDEVVLRLNAIHRLSTIALALGPERTREELIPFLDGXPTLRPSFSLANPPAPASGYTAAGTLEIRLLTLLNAESVEDEDEVLVALSEELGNFVEYVGGPAWGHVLLSPLENLAAIEEPVVRDKVRIRDHFLASCHATRMCTDKRFRAVESLNKICTQLSSQQVEEYFIPLTIRLSKADWFTSKVSACGLYTTPYSKVSPPIQEQLRQQFGQLVHDETPMVRRQAATNMAKFVKEMPAPIVIEEMIPMFQHLAQDDQDSVRLLTVEILISIAEVVPKEQQASHTVLLTSLRSLIEDKSWRVRYMIADRFEKVRGRAKHLASPHINSWMTNSTYQIAKAVDDEVVSRDLVPAFVKLLKDNEAEVRTAIAGQIPGFCALVDRNVLLNDIMGSVEDLVSDSSQHVRAALGTQISGLAPILGKQEYVPAVRHGFFDAYANYCTRTIDHLLPMFLQMLKDEFPEVRLHIISKLELVNQVIGIDLLSQSLLPAIVQLAEDKQWRVRLAIIDYIPLLASQLGVKFFDEKLSQLCMGWLGDTVFSIREAATQNLRKLTEVFGVEWASEAIIPKVMAMGAHPNYLYRMTTCFAITVRDSMAYENQXSPCLTSVYRPWATVVSLDVIAKSILPMLEKLTADSIPNIRFNVAKTYGIIIGVLRRLPDEGTIYTLEKEGKPATPSPKGQELIQQRIMPCLEKLQKDDDVDVRYFATTAAAQ

SEQ ID NO: 3915 - protein, 601 aa, Neurospora crassa
  unsure (1)..(601): unsure at all Xaa locations
PKEVFNWRLWFAVLSFGLLGAARGVDEGLINGALKSKNFQDSINYASYSTVEQANIKANISSMVQIGSVGGALMXGTIPFQHLFFFFVFFFSVPLGLLTDTGCSAFMICDRIGRIWATRILCLLWMLGIAIFMGSNGNLSLVYFGRFVAGLGVGQVGFTLLMASSQWEFSXYERNRSFXSPVVGPVYIAEIAPASIRGFCVCKXSPFIPSAVYSLFSHKTLSTPTNSLLXLKKRYLHRFVYLGIVLAYFTNYGCQLHLAETPARWMVPTSLHIIFAGLILLLTFLQYESPRYLVKTGKSDKALHVMSRLRHLPPDHDYVRREINAITLSHHEEMEASKGAGWLGILKETFTVRSNLYRVGLTLGPRLWVNGPAPGSITIYAPDLFELLGLTGTKESLLVTAIFGIVKLVAAIVCALFLVDFIGRKRSLLLGIACQAISMIYIAAFLSATPELGNEEGYVIPANSGKLRASRGAIVMIYLSGIGWALGWNSMQYLLSSEIFCLRLRAFCSSLAMCLHFANQYGSARAVPDMLLPVREGGISGQGTFWFFSAVTILGGVWVWFFVPETASRSLESMDRLFSLPWWQIGRYGNREAEALDEAER

SEQ ID NO: 3916 - protein, 337 aa, Neurospora crassa
VRVNHHDAKTFAAALLTASGVSAKNAEITASGLVQADLRGVESHGILRLPSYLSRVRSGVLDPAAEPELKQITPVVAQIDARNGFGFPAAHLGMDTAIKMAGVYGIGMVSVKHSNHFGMSAWIVKQAVDADMMSLVFTNSSPALPVWGSKEKMMGVSPIACGAPGGKGEGSKPFILDMAPSVAARGKIYKALRRGEKIPTDWALDGEGKQTDDPAKALEGVMLPMGGPKGSALAIMMDVFSGVLSGSAFAGGVTGPYDMSKPGDVGHFFVAIKPDLFMSLDEFRERMDILYQKAVNSEKMHGVDRIYFPGEIEQLNEEQRLKDGIPYAKAEIDALNA

SEQ ID NO: 3917 - protein, 438 aa, Neurospora crassa
  unsure (1)..(438): unsure at all Xaa locations
TTTLVLDNGADTIKAGFVSDDKSDGKPRIIPNCLARDRHRKIYVGSELEKCKDFSELAFRRPVEKGFIVNWEAQKEIWDREFFDDKAAQKCDPSDTRLILTEQPNSLPSLQTHCDQIVFEEYGFASYYRGLGMSPPRELLGKGCXPCFLGPVFNAYRDIQSIFRTPQSTIDSPAQVILLIDSGYSHTTVTPILQGRPLHPAIRRLDVGGKLMTNYLTRLLSVRHFDMRNEPYIVNEMKEAVCYTSLDFKGDLEKTWKGTRGEKREDYLSGAGIAKDYVLPDSHTRFHGVVRDYEPGVSARARKGIVSTEDVLTLRNERFVVPELLFNPSDIGIRQPGIADLVKQSLLAVPIGLWPGLLANIVVVGGNSLSEGFCQRLQTEILKRFPDECRVRVARPEDPIISTWLGAANFAKHEHASKLEVTKQEYEEHGAAWVARKF

SEQ ID NO: 3918 - protein, 468 aa, Neurospora crassa
  unsure (1)..(468): unsure at all Xaa locations
RQPVDKKPETGTIDLTGTDDEEDSAPLPPAPRNIPKNLPKTRPTFDDPTPSALGSRKRTHDDEIKLPHARLKKATRAPVGGKIQPEWRAVPSQDSCPWMRDAEDHSASPTMGRWLHKEIIDFYEYVKPRAFEKRIREEVLDEINRFVRNTFSDAGVYPFGSFPSGLYLPTGDMDMVLCSDQFKRNYRAKYDTRRTMYRLSDALKQRKLAFQNEVEIIAFAKVPLVKWVDSRTGLKIDVSFENDTGLQAIKTFHAWRDQFPVMPVLVTLIKHFLCMRGLNEPVNGGIGGFTVTCLVTSMLQLMPQIQSGSMDPNHHVGDLLMHFFDLYGNRFNYRTTAICLNPPKYLPKVSAHYCMPCARFGXCIIQHKINTFAYKNYDRFSIIDPNNSENDIAGGSSNTGTIVALFKQAYELLAERMAQLAQSPDRRNASILEVILAGNYSTFRNQRAHLEKLAAPNGPAGPRRRXVV

SEQ ID NO: 3919 - protein, 1549 aa, Neurospora crassa
  unsure (1)..(1549): unsure at all Xaa locations
PTHPEPGSSHSHNDQMTGTRATSMTDVDGSTARSEKEKDAQHANDSDSTCEEDEDRIEENRRASQVLALARKYTSQSHAAVPEGKTVFQVDDENSPLNPNGPNFNSRAWAKALVEQISGDGLQFRTTGVAFQNLNVFGFGSATDYQKDVLNVGLEIFSQVRNLIGMGRQRRIDILRDFDGVVRKGEMLVVLGPPGSGCTTFLKTIAGEHDGIFIDDQSYFNYQGMWCRKIXSLFVLCVELVSLTRRLLRYTAKEIHTHHRGEAIYSAEVDTHFPQLTVGETLTFAARARAPRHIPDGVTKTDFSNHLRDVVMAMFGISHTINTRVGNEYIRGVSGGERKRVSIAEAALSGAPLQCWDNSTRGLDSANAIEFVKTLRLQTELFGSTACVSIYQAPQSAYDLFDKAAVLYEGRQIFFGRADEAKQYFVNLGFECPARQTTPDFLTSMTSPTERIVRPGFEGKAPRTPDEFAAAWKNSAEYKSLQAEIEEYKKEHPINGPDAEAFRASKKAQQAKGQRAKSPFTLSYIQQVQLCLWRGWRRLVGDPSITMGSLIGNFIMALIISSVFYNLQPNTDSFYRRGALLFFAILMNAFSSALEILTLYAQRPIVEKHARYALYHPSAEAVASMLVDMPYKLANSIVFNVTLYFMTNLRREPGPFFFFLLVSFVTVLVMSMIFRTIASSSRTLSQAMVPAAIIILALVIFTGFAIPTTYMLGWCRWINYIDPIAYAFESLMLNEFVGRKFQCEAYVPSPSIPTYANVGNLNRVCSAVGSVAGQDYVLGDDYLRESFNYVNSHRWRNFGIIIAFICFFLFTYIVAAEAVSAKKSKGEVLVFRRGYKPASFKENKGDAESGGVQVAGKGHVSDGNTSDKEAGFLQAQTSVFHWNNVSYHVPIKKEIRQILNNVDGWVKPGTLTALMGVSGAGKTTLLDCLADRINVGVITGEMLVDGKPRDTSFQRKTGYVQQQDLHLETTTVREALNFSALLRQPAHVPRAEKLAYVDEVIKLLDMEEYADAIIGVPGEGLNVEQRKRLTIGVELAAKPPLLLFVDEPTSGLDSQTSWAILDLLEKLTKSGQAILCTIHQPSAMLFQRFDRLLFLAKGGRTVYFGDIGKNSKTMASYFERQSGVKCPPDANPAEWMLEVIGAAPGTHSEIDWHDAWRSSPEYQAVQEELQRLKNNSNHADALEMDGDAGGYREFAAPFFEQLREVTYRVFQQYWRTPSYIYSKTALCISVALFIGFVFYNAPNTIQGLQNQMFAIFNLLTIFGQLVQQTMPHFVVQRSLYEVRERPSKVYGWKVFMLSQIIVELPWNALMGAIMYFCWYYPVGLYRNAEPMGQVTERGGLMFLLLLAFMWFTSTFTDFMIAGFETAEAGGNIAQLLFSLCLIFCGVLASPEAMPGFWIFMYRVSPFTYLVSAMLSVGVANTDVHCSDVEFLKFNPLNGTCGEYMSDYIKAAGGYLLNPDATDECSFCPIDKTNMFLASVSSDYADRWRNFGYVFFFSPLSPFPSSRLEQRLLIYSSTIASLFAYIAFNILAALAVYWLVRVPKKNGIFG

SEQ ID NO: 3920 - protein, 645 aa, Neurospora crassa
  unsure (1)..(645): unsure at all Xaa locations
MNGIKDLGLGFSKASTRLHFFSLLLALGSFVWGXDFSSSSSPKHRGITEIKSLYQVKCIDLVIGELAPELHLLTLHRYNVGVLASVLAHPGFRETIPGYGPYKRGLITSINYLGTWLSYIFFSRPATDLLGRRYAAMVGMSVLCVGQALQAAASGSVALSMVIFGRVVSGLGTGIVSTSVPLYQRYVTGIFLFEIHHKRDDLHVHRADPXSVASEIAPAKQRGRLVVLNHVGFVAGLASGFWXVVSITTTSSHSDILXGGYAITFWNSSHGYLSGWRLSVSLSFIPALIFFVGLPFLHESPRWLVEHGRPDEALKALQFYREGSFTPSQIQSELTDIKRNVCAYQATSLKKWTSLFTNPSLFTRLWRAALLHFMAQMCGATAMKYYLPDLFRVLGLSPRVSLLAGGIESTLKIGCTVLEMFVIDKVGRRMTLAVGAGIMAFALLVSYTFLFACWTXLGLGLGQRNVKVKFXLLTPKPGHQDQGALPLAYPNNTNRASDYTCVVFIFIYSLGYSMGFGPAAWVYGSEIFPTAARARGLSFAASGGAVGSIIVSQLWPIGIAELGSKIYFFFMAVNLACVPIIFLLYPETKGRPLEDMEVLFGGYEGGTPSTTSLLLADEREDGNEEDEENETLGRPLLGDGRGMAR

SEQ ID NO: 3921 - protein, 540 aa, Neurospora crassa
IRFLKLVAIFAPVIITVPVIWFGERQPDRDDERSGTLWWYGFLVQAMEWAGPAFIKLGQWAASRSDIFPDEMCNIMSKLHDDAPAHSLHATKRIVEAAFNGRHFDEIFEEFDEKPLGVGAIAQVYRAKLKPDLTMPADADLSSSTHRFVKNVGTVLKATPKRVPSSHVAIKVLHPGVERTVRRDLRIMRFFASMINAIPTLEWLSLPDEVDQFGDMMKLQLDLRIEAANLSRFRKNFKDRTTAWFPYPYTEFSTRNILVEEFAHGVPLADFMANGGGVFQHDIASEGLDAFLRMLLLDNFVHADLHPGNIMVRFYESEKPPLSLHWDKPSDANPAGKNGDVTEKVLSRLWPYRNNKELWIAELEKIDEEGYRPQLIFIDTGLVTELNATNRRNFLDLFRAVAEFDGYKAGHLMCERCRQPDAVLDKEVFALKMEHLVRDVKNKTLALGNIKIGDILEKVLNMVRQHHVRLEGDFVNVVISILLLEGIGRALDPDVDLLSSSLPILRQLGAQGGKDMLMEGDVHMMAVWLGLEARRFMQAS

SEQ ID NO: 3922 - protein, 409 aa, Neurospora crassa
  unsure (1)..(409): unsure at all Xaa locations
MGWFWADGNASAAAPVVPPSHKDLAASGAVPPVCHRRPRNPPSPGPSQLPVESDLTSLSQPCSPSCPMHNKTMDALSAHKPVTPAPEPTPAAAAPSKCPVNHGAKDTLAAAAAAVAPKQPQPENHQPAAASEPSFFSKLNPLNYMFSSISQEPAPNQAIALPTERDPSSIPKGTGDGNWEYPSPQQMYNALLRKGYTDTDITAVESMVAVHNFLNEGAWNEIVEWERRFGKGLMRGWEIMKRGEENAPMMLRRLEAQENDPEPQPTLIRFQGRPKDMTPKAALLQVLGRINSKYAXVQSSFVFFFSRXGWKKXLFFCXRCDFTHYLAPEPPFDRHDWYVSRDENGQKKEVRYVIDFYSAPPEPTGEPVFYLDVRPAVTVTGACERLLRWGGDVWWKASGGEVRERERSK

SEQ ID NO: 3923 - protein, 2222 aa, Neurospora crassa
  unsure (1)..(2222): unsure at all Xaa locations
AVAVGQTLSKYMEALLDPIFACELTPKLTQALVDMAFYIPPVKATIQERLLDMLSKVLCGEPFRPLGAPHPNTLTSIPAIPKDPKDPSVQERGKAEVKLALNTLGSFDFSGYVTLQFPKKPDWPKKFQSRSDAASYEEGQSSGHWPAYTDTPLERELTVAAGHVLNEFVRDVAIKYVEDDDPEIREAAALTCCQLYVRDPIVNQTSYHALQVVADVIEKLLTVGVSDPDPGIRRTVLAALDERFDQHLAKAENIRTLFFALHDEQFAIREVAVSIIGRLARYNPAYVIPQLRKTIIQMLTELEYTDVARSKEESSKLLSLLTQHAQDLVKPYVNSITEVLLPKARDPTPSVAATVLQAIGELCTVGGESMLAYKDTLMPIIIDALQDQSAPIKREAALHTLGQLASNAGYVIKPYLEYPQLLEILQSIIRGEPQHGTLRQETIKLMGILGALDPYKHQVXDTLRSIPDEIKHLRHLTDHLYEMLQASPAKDSMASQVANVASARSGNPSNKTPDSLKTALTNLMQVEERTDDNKRNNEAAQLTDVSLMMGGLTPSNEDYYPTVVINALLQILKDQSLVQWHGNVVDAIMSIFITLGLKCVQFLDRVVPAFISVIRASSNARLEFYFNHLSRLVSIVRQHIRVYLKDIIDVLQEYWHTTLALQSTILGLIESISRSLEGEFKIYLAKLLPLMLGVLEKDVSTKRQPSEKVFHAFLVFGSSAEEYMHLIIPVIVRLFDSHSQPLFLRKSAIETIGKLSSMVNLNDYASKIIHPLTRVLASGEPSLRVAALDTLCALMLQLGRDYLHFEHTVDKAISMYAIQHSNYEKAIEKLKKGEALPQNLAPRFEDISMEGFAAENNPPKKLTLNPVHLKQVWETKGKSTKDDWHEWFRKFSTTLLTESPNHSLRACASLASNYQPLARELFNSAFVSCWSELYEQFQVCQRGIXNDPSRILTACLTGDLITNIENTIKSENVPPDLLGQLLNLAEFMEHDDKALPIDIRVLGREAARCHAYAKALHYKELEFLQDHNSGAVEALIVINNQLQQSDAAIGILRKVKTYREGIQLRESWFEKLERWDEALNFYCQREREIPEDQPVPVDIVMGKMRCYHALGEWDSLATLAGKTWANSAPEIQRRIAPLATTAAWGLGKWDSMDSYLQSMKRFSPDRAFFGAILALHRNQFREAMACIEQAREGLDTELSALVSESYNRAYQVVVRVQMLAELEELIVYKQCDGEKQATMRRTWETRLKGCQRNVEVWQRMLRLRSLVMTPQENMHMWTKFANLCRKSGRMGLAEKSLKQLIGTDSPLDSVIPYWHDRHPGSVGNRIASPILYAVLKFQWEIGQSPGFRNSEHRVAEKTLYCLQRFTQETAHRVETSRMHMAAHAQNGMEVQNQPGFAEFNEEMMHPQAQKHWLEQTVLLAKCYLRQGEWMVSLNKDDWQQRYRAEVLDCYYKATHYNNKWYKAWHAWALANFEVVQYLTGNREVDVRNNGEQNYIIQYVVPAVRGFFESIALSSGSSLQDTLRLLALWLTHGGHIDVHNAVTEGFTRVSVDTWLEVIPQLIARINQPHKRVQQSVHGLLADVGRAHPQALVYPLTVARKSWHNTRRVRSANQILESMRQHSLRLVEQAEIVSGELIRVAVLWHELWHEALEEASRLYFGDHNIEGMFATLEPLHELLEAGPQTLREISFAQTFGRDLSEARDWCRQYQETQDSNDLNQAWDLYYTVFRRITRQLPQMTSLELAYCSPNLLNAKDLELAVPGTYRSGQEVVRIMSFDATFSVISSKQRPRKLDIVGSDGKTYTFLLKGHEDIRQDERVMQLFGLCNTLLANDSECFKRHLNIQRYPAIPLSQNSGLLGWVPNSDTVHQLIREYRDSRKILLNIEHRIMLQMAPDYDNLTLMQKVEVFGYALDNTTGQDLYRVLWLKSKSSEAWLDRRTNYTRSLGVMSMVGYILGLGDRHPSNLMLDRITGKIIHIDFGDCFEVAMKREKYPERVPFRLTRMLTYAMEVSNIEGSFRTTCEHVMRVLRENKESVMAVLEAVSILCYVPFLTGSLTDTRNSSFHDPLLNWRLTNPTSPPGPNFNAEREVAMPGGPGPRARRPSILDAPVAPTEFLAAQAAPGADGHGMGMSANPGRSRARTNSSAIYPTGSSMVNGHGNNQQEQQEVQNARALEVLDRVQQKLTGRDFKPHEELNVTDQVNKLIIEATKLENLCQHYIGWCSFW

SEQ ID NO: 3924 - protein, 526 aa, Neurospora crassa
  unsure (1)..(526): unsure at all Xaa locations
VTAIGGFLFGYDTGQISGMLLFSDFKNRFGQITQPDGSKEFESIIQSLLVSLMSIGTLLGSLTSSXXALLFPPSPSPTHSTXTPTILTNTSLQHRHLWGRRKSLTFGVGLFIIGNIIQITAMHSWVHMMMGRFVAGLGVGTLSVGVPMFQSECSPREIRGAVVASYQLLITFGILIANIVNYGVREIQEQDASWRIVIGLGIFFSLPLGVGVLLVPESPRWLASKEDWEGARMSMARLRGLKHDPHNELVEDDMKEMREVLEKERTAAVGTWKECFIPNKNGVPKQVYRTFLGIGIHFLQQWTGVNYFFYYGATIFQSAGIKDPIQTQLILGAVNVFSTLFGLWVVERFGRRWPLFIGAIWQASWLAVFASMGTALEPDQNKASGIVMIVSAALFIASFACTWGPIAWVVIGESFPLRTRAKQASLATAGNWLGNCKFIFFPLPFFPIHQQKLTNLPTVMISFLTPLATDGIGYAYGYVFVATNIMGALLVWFFLYESTSLSLENVDLMYSEPGIKPWNSHKWMPP

SEQ ID NO: 3925 - protein, 511 aa, Neurospora crassa
MVCDFFFPQPGGIESHIYQLSTKLIDRGHKVIIITHAYEGRTGVRYLTNGLKVYHVPFLVIYRSATFPTVFSFFPVFRNIVLRERIDIVHGHASLSSLCHEAILHARTMGLRTVFTDHSLFGFADAASILTNKLLKFALSDVDHVICVSHTWYAPSHPPSSSLQPPTNKVTSKENTVLRASLDPLMVSVIPNAVVADNFRPLGYPTTTSTPPSSISSPIPGLPPNPSSSLSSSLTPPRRILGPHDPITIVVISRLFYNKGTDLLTAAIPRILAAHPNTRFIIAGSGPKSIDLEQMIEQNVLQDRVEMLGPIRHSEVRDVMVRGHIYLHPSLTEAFGTVIVEAASCGLYVVCTQVGGIPEVLPGHMTVFAKPEEDDLVAATGKAIAALRRNEVRTELFHEQVKNMYSWTNVAERTERVYNGISGAISEAEFYGYDHLKDHRNGSNGSWTAVTATRGMRSGVQSFALIDRLKRYYGCGVWAGKLFCVCVIVDYLIFLFLELVFPRESIDICPD

SEQ ID NO: 3926 - protein, 426 aa, Neurospora crassa
LLEKTYAHELIFNKEGQVTGGSLPALVERLTTHESTPDAMFVSTFYLTFRLFCTPLKFAEALIDRFNYVGEAPHVAAPVKLRTYNVFKSWMESHWQEETDAEALPVIKDFAESKLTELLPSAGKRLLDLAEKVANSGGTLVPRLVASISKTGTSGSQFLSAETPLPSPNLSRGQVHALTNWKAGGVSPSIMDFDPLEIARQITIKQIGLFCSITPKELLGSKWTKNKGVGAPNVKAMSTFTTGLSNLVVDTILQFDEIKKRAAIIKHWIKIGSQFLALNNYDGLMAVTCALNDSSIKRLRMTWDTISSRRKETLKSLQAIVEIGQNHKALRARLAEQVPPCLPYVGMFLTDLTFIDAGNPAKKTTDTGLTVVNFDKHMKTAKCIGELQRFQMPYRLTEVPDFQEWIVSQIERAREIEKTGRTPAQV

SEQ ID NO: 3927 - protein, 731 aa, Neurospora crassa
  unsure (1)..(731): unsure at all Xaa locations
SPGIVLANXTPRHQIQAVIFILKREPGNRFSQASKASVSTSMCPRYVFLSNTFRHQTYGTVLTDAYLPYLHLXSSLGVSQENHGGLIADVMGMGKSLTILTTILMHCRGCSQLSSFLFPVAKRRXTRTKNTNTSHSGCCTLSAXVFVQLPCSKPALTTQRAHAQLGSRDSEVCPPHSTSFPELLAPLVSXSELRTSSHMPGALNLILFHGQGRPKSPESMASTDVVLTTYGTLAADHKNARLLQKMEWYRVVLDEGXNXTFHCSVCGHHNKPLANXAITAHWIRNASSQQFRAATSLSTSRRWCLTGTPIQNKLDDLASLAHFLRVPPYPEKTVFRKYVLEPLEKGDQGCADPLRSYLRQHCLRRTNKCLNLPNLSEKTVYLQLSMQEQETYDKILSTAKRALDDIVSSANKPKQVKNEKVTVFFTTLTSLRRLCDLGTLPPIQSSPGDLGQPTEDTDMLCELCSSQDADGSLLLKDHQFCPECSRPLRTQRSASNTGYLTPASLPRDCXRSCNEPPHPVHGQWPLHKALEGQRQRAPGPPISNWHQAVSSYFVSGSTSTPDSXRSASLIFSAWTSSLRYLAQLMQQAGIPHAQIDGRTSNAERLRHIKAFQEDSQVPVLLMSIGTGAVGXAMIHLIVSVVSSPFLTFLTEXTLPPHVLSSPCPYLLPPYSTSNYISPTAKPHLTAASHVHIIEPQWNPSVEEQAIGRALRMGQTKEVVVTRYIMKGTVEQ

SEQ ID NO: 3928 - protein, 725 aa, Neurospora crassa
GVGLSVFGGVLQEIMYFKPQVVYVSVMFLTVLAQALGTALSQLIPRKGAIGRFLNPFPWNRKEHTAAVLMASAASVSALSTEALSVQELWYGGYPSTAAGVFITLSSQLIGYGAAGMMRSVLLYPTKMLYPANLPITTVMETLHKPKAETAKRFKVFWIIFVAIFCWEWFPEYIFPILSAVSIFCLADQNNAVFTNLFGGSQGNEGMGFLNICFDWNYIAGFGSPLWMPLQTLTNSFIGYLGGIILSMGLYYSNIWRGMDFPFMSQLLYDGSSNSTNYVVYNETLIMNSDFTIDTDAVDKVGVPYLTATYVNYLITTNASLTATLIHMLLWNYDDVSKAWSWITLDKLKSLLKPSTYFFWKSTGARTEVEKEAIRQDPTIDPHYRLMVDYDEVPSSWYFVVFVISIIVGIVCLYVMKSTLPWWGFIIGTLLLIVLIIFFGAQSAITGFTVNMQPVMQMLAGYMFPGKPLGTYLNFNPTSKTNLSTNLLLSIANMYFTTYTYNGLSQGILLLRDLKLAQQNKLSPRATFTTQMVGCVIGALLNYVMMISIVKNQAPLLKSAEGSNVWSGAQVQQFNTLAIAWAIAPKMFSIGARYQWVTAAYLVGFLAPLPFYIMHRFVFPRQRIWSYLNTSIILWYLGELFVGLNASITSYYILGAFGQFYLRRYRPQWFVKWNYLVSAALDGGTQVMIFIATFAVFGGSGKAVPFPEWAGNHPNNLDYCKYNSS

SEQ ID NO: 3929 - protein, 342 aa, Neurospora crassa
MSPSTLRQSTCALLALSLVTTATAGPCDLYDAAGYPCVAAHSTTRALYSAYSGPLYQVQRTDGTTTDIAPLSAGGVANASTQDSFCAGTTCVISIIYDQSPRGNHLTRAPPGSAGSGPAPGGYDNLADATAAPVYLNGHKVYGVKVAPGTGYRNNDAKGTATGNAAEGMYAVLDGTHYNGGCCFDYGNAETNSVDTGAGHMEAIYFGNCNVWGTGQGSGPWIMGDLENGLFSGQNAKYNGGDPAINYRFVTAVIKGDSSNLWAIRGGNAASGSLSTYYSGPRPSGYYPMKKEGAIILGIGGDNSHGAQGTFYEGVMTTGYPSDAVEDKVQADVVAAGYATSS

SEQ ID NO: 3930 - protein, 650 aa, Neurospora crassa
  unsure (1)..(650): unsure at all Xaa locations
MPPSASKQKRLAEKAAKANKGKAAKEVELDAFGKPVVSDEPATKSEQMDEVKRLAQQMDKHGLSDRVTTGVLASTKASKDVKITSVSLVFHGRVLIKDATLELTLGRRYGLLGENGCGKSTLLKAIAAREYPIPEHVDIYLLNEGAPPSELGALDWVVTEAKNELARLESVAEKILEEEGPDSPSSRTSTMYVSPKSYDHTELGAFTILTLPSQHIDKMDPSTFETRASLILTGLGFNKQTIQKKTKDMSGGWRMRVALAKALFVKPTLLLLDDPTAHLDLEACVWLEEYLKKWDRTLVLVSHSEDFLNGVCTSMIDMRLQTLIYYGGNYDTYHKTRAEQETNQMKAYQKQQDEIAHIKKFIASAGTYANLVRQAKSRQKILDKMEADGFIQPVKQDRVFSFRFADVEKLPPPVLSFDNVTFSYSGDPKDDLYRHIDLGFDMDSRTALVGPNGVGKSTLLRLMTGKLSPTDGVVQRHTHLKLGLYSQHSAEQLDLTKSALDFVRDKYPDKSQDYQYWRQQLGKYGLSGEAQTSLIGTLSDGQKSRIVFALLAIESPNMLLLDEPTNGLDIPTIDSLADAINAFTGGVIVVSHDFRLVLFPLCYPHVTWMLTQXKNRLLDKIAKQILVCENKTIKQWEGSISDYKNYLRKK

SEQ ID NO: 3931 - protein, 133 aa, Neurospora crassa
THSSIPTVGFNLKRVQRGHVTLKCWDLGGQPRFRQMWERYCRGVNAIVFIVDIADPRLLPQAKDELHSLMRNETLQGIPLLVLGNKSDLPERLSVDELIDAMDLKSIAGREVSCYGISAKEEMNLDAVLQWLM

SEQ ID NO: 3932 - protein, 1232 aa, Neurospora crassa
QPTSQDWDVEFNQVRREKLFRDPPTDRTAYPALQAAVDPHIESFNALFRDDGKPSLLDHALAEIGTKTFLDGDERADPQGKNKLTIRYKSIELQKSQVPPTNRWAKNREIFPAECRERHVSYRGKLSATFEYRINDGEPHEFVRELGQMPIMVKVSLVTRDIPSLHHRCLTILLAKKQSNKCHLQNNSPAQLVARKEESEELGGYFIVNGIEKLIRMLLVNRRNFPLAIVRPSFQNRGASYTPYGIIMRSVRPDETSQTNVLHYLSDGNVTFRFSWRKNEYLIPVMMIMKALVETNDREIFEGLVGPPQSKGVANTFLTDRVELLLRTYKKYGLYSKTQTRAYLGQKFRVVLGVPDTMSDYEVGTEFLRKIVLVHLGSQDVTEQQDADKFNMLLFMCRKLYALVAGDCAVDNPDAVQNQEILLGGFLYGQIIKERLEELLTVSFRASLRDYLRRNPTVSFQSDTFLKDFPIAIFRRANENIGQSLEYFLSTGNLVSPSGLDLQQVSGFTVVAEKLNFLRFISHFRMVHRGSFFAQLKTTTVRKLLPESWGFLCPVHTPDGSPCGLLNHLAHKCKIMTESVDASTISRLAFELGVVNISSAATSESVVVMLDGRIVGWCTPEECKSIAETLRYWKVNGENGVPLQLEIGYVPPSNGGSYPGLYMSSQPARMVRPVKYLPLQKEDFVGPQEQPYMSIACTEQEVIPGDSTHVEFDPTNILSILANMTPFSDFNQSPRNMYQCQMGKQTMGTPATALAHRTDNKMYRLQTGQTPVVRAPLHNTYGFDNFPNGMNAVVAVISYTGYDMDDAMILNKSAHERGFGHGSIYKTKKVSLKDDSRTRSAKSIVKMFGFAPNSTIRESTRDMLDNDGLPRVGRLLREGDVICAWHTVSADYNGQLVNRDGVTHYERYKDSEDAFVEEVRVIGADNGTEPLQTVSIKLRIPRSPVIGDKFSSRHGQKGVLSQKWPATDMPFSETGIQPDVIINPHAFPSRMTIGMFVESLAGKAGALHGLAQDSTPFKFDEQNTAGDYFGHQLMKAGYNYHGNEPLYSGITGEEFQADIYIGVVYYQRLRHMVNDKYQVRTTGPVVPTTGQPIKGRKKGGGIRVGEMERDALLAHGTSFLLQDRLLNCSDYSKSWMCRQCGSFLSTQPTVSPFIGKRKAVSTVRCRNCAVRLDDMEDVDLMQIDGEIWEDGSGTQWIGGENTTIVAVPGALKYLDVELAAMGIKLKYKVDKK

SEQ ID NO: 3933 - protein, 519 aa, Neurospora crassa
  unsure (1)..(519): unsure at all Xaa locations
KLDAFTKTVEDARIRTTSGGIVTIVSLLVVLFLSWGEWRDYRKVVIHPELVVDKGRGAHTYPNNSNPXTVELDRQDKTDRKNKSXPXRNATGERMEIHLNITFPKVPCELLTLDVMDVSGEQQHGVQHGVKKIRLRPQSEGGGEIDAKVLSLYVFPYPSPPSITYYQXHHHXHILHPTATPPDESATHLDPSYCGPCYGAPAPYNAKKPGCCSTCEEVREAYAQASWAFGDGATMEQCQREHYTERLAEQRHEGCRIEGGLRVNKVIGNFHIAPGRSFSNGNMHVHDLAQWWSTPVPGGHSFSHIIHSLRFGPQLPDDLVRKLGGNGKNTLWTNHHLNPLDNTKQETNDPNYNFMYFVKIVPTSYLPLGWEKQAAQNKAAWEQDHSVGLGAYGYGSDGSMETHQYSVTSHKRSLTGGDDSKEGHGERLHSRGGIPGVFFSYVGPLSLFGCCCCWMVLVMTSANKVGDRTISPMKVVNREERAKSFLGFLAGLCAVVGGTLTVAAAVDRGLFEGTVRLKK

SEQ ID NO: 3934 - protein, 290 aa, Neurospora crassa
GFDFSNYNRNAALHARGVPLPKATSTGTTIVGCIYDGGVVVSTSVVLSLFHHALHPACHSSLAVTTLHVPMYPSNNSLTTCSPFQIAADTRATSGPIVADKNCEKLHFIAPNIWCAGAGTAADTEFTTALISSQLELHSLSTGRKPRVVTCMTMLKQHLFRYQGHIGAYLVVAGVDPTGTHLFTVHAHGSTDKLPYVTMGSGSLAAMSVFETQWKPQLNKEEAMKLCSQAIEAGIWNDLGSGSNVDLAVITPEKTTLHRGFVKPNERTQKLKSYKFKRGTTAVLNEKVIK

SEQ ID NO: 3935 - protein, 97 aa, Neurospora crassa
ARLCQAIVDEDVEHVQDWLAQEGANPNTRDHTGRTPLHLAVMSSSPAVVRALVEAGARLTARLADGRTALHLAASRGDVEIVKILMNKSNANEEEFE

SEQ ID NO: 3936 - protein, 266 aa, Neurospora crassa
  unsure (1)..(266): unsure at all Xaa locations
QTTFVKRHLTGEFEKKYMATLGVEVHPLGFSTVSLDGPRLQQTCACTRARSTNPMLTQPSPRANFGQIQFDVWDTAGQEKFGGLRDGYYINGQCGIIMFDVTSRITYKNVPNWHRKRPSSCRTRHDVXQPSLTTHLGDLTRVCENIPIVLCGNKVDVKERKVKAKTITFHRKKNLQYYDISAKSNYNFEKPFLWLARKLVGNNALVCYPTPQLHERSDVXLCLXEFVAAPALAPPTAVVDQELMEKYRAEMDEAAQMPLPNEEDDD

SEQ ID NO: 3937 - protein, 532 aa, Neurospora crassa
AARRIHATANHLRPAAAALESTATSYPTTHDKIADVKDTPWFIDNKFVTSSTTQYIDLHDPATNNLVTRVPQNTDEELKAAVASAQKAFESWRNTSVLHRQAIMFKFVGLIRENWDRLAASITLEQGKTFADAKGDVLRGLQVAEAACAAPELLKGEVLEVAKDMETRSYRDPLGVVAAICPFNFPAMIPLWCIPIATVTGNTLILKPSERDPGAAMILAELVQKAGFPEGVVNIVHGAHRTVNFILDEPAIKAISFVGGNKAGEYIFARGSANGKRVQANLGAKNHAAVLPDCNKNQFLNAVVGAAFGAAGQRCMALSTLVMVGETKNWLPELAERAKALNVNGGFEEGADLGPVISPQSKERIESLIASAEQEGATILLDGRGYKPAKYPNGNWIAPTIISNVTPSMKCYREEIFGPVLVCLNVETLDEAIELINSNEYGNGVAIFTRSGPTAETFRRRIEAGQVGINVPIPVPLPMFSFTGNKKSIAGGGASTFYGKPGVNFYTQLKTVTAHWAAQDAIGQKADVAMPT

SEQ ID NO: 3938 - protein, 539 aa, Neurospora crassa
  unsure (1)..(539): unsure at all Xaa locations
PTKLKAPFLEQFTDGWDARWKPSHAKKETGPDTEEEWAYVGEWSVEEPVVFNGMEGDKGLVVKNAAAHHAISAKFPKAIDPKAKDLVVQYEVKLQSKSLLPATRSSXQAIANTHRPDGLECGGAYLKLLRENKALHQDEFSNTTPYVIMFGPDKCGHTNKVHFIFNHKNPKTGEYEEKHLSAPPTAKIVKTTELYTLIVHPNNTFLIQQDGETVKEGSLLEDFVPSVNPEKEIDDPNDTKPEDWVDQARIPDPDAKKPDDWDEEAPYEIVDEEATMPEDWLVDEPQTIPDPEAQKPEDWDDEEDGDWIAPTVPNPKCFEVSGCGPWTKPMKKNPDYKGIWSAPLIDNPAYKGPWAPRKIANPDYYEDKTPANFEPMGAIGFEIWTMQNNILFDNIYIGHSVEDAKALADETFFKKHPVEEKLEEAEKPKPEENKPSSPSDLKFTEDPVTYIKEKVDLFVTIAKKDPVEAIKFVPEVAGGAAALLVTFIAILASLVSGGSSPAPAVKKAAKDVKEKAKDVKDKAAEAVATGTEKAKEATK

SEQ ID NO: 3939 - protein, 294 aa, Neurospora crassa
SDRKEGAIYQVGKPLGKGGFAICYDGKLIGSSKRYALKIVKAQMASKMEQKFQTELQIHSKMRHVNIVQFHRAFTFENCTYLVLELCSNGSLMDMVKRRKGLTEPEVRFYTVQIAGAIKYMHAKGIIHRDLKMGNIFLDKYMNAKIGDFGLAALLLTGKDMQIMRRTTLCGTPNYIAPEILEKGKKGHDHMVDIWSLGIIVYAMLTSKPPFQSSTTDEIYRRARERDYEWPSPDATQKYYSLEAKDLVASMLQDADMRPDPDTIVSHPFFTSGYMPVPSDISSRLRDSPPQNPA

SEQ ID NO: 3940 - protein, 843 aa, Neurospora crassa
LTNPRHLSKMSRKRKAESGEVLKIGNKTISLEGYLTKKPKTASTPSTSTSDNNTPAPSTENDTTTTATDPKEFKPSRPLTGDPSLFATRRALPLYLYQDRIRSILSKKDVLVLVGETGSGKSTQVPQFLYQERWCQRRRVKVKTKVLDKDGNEVLEEGGKAKTREETVNVGGVIAITQPRRVAATTLAGRVAKECGTPLDTSGRGTGFKGRGPKGKDGKGPKGGKEGEEWDEEKDVVEEMGKNNGGDEEVIEENGNEKKDRKDQEKGLVGYSVRFDHRVPPGTKIKYVTEGMLLQELLRDPHLRQYSAIIVDEIHERSVDVDLLSGFLKQIVTGDKAGRGGIPLKVVVMSATAQVERIKKFFSSDDSLKKGTSGEEVEYLEIEGRQFPVEVIHEPKPVPDIQEALLKTVFKIHTQEPLSDKHGKKDILCFLTGQEEIEAAQRLIEEFAETLDPKVPKVKVFPLFGQLSMEAQHEAFQPIKHPFTRKIVLATNIAETSVTVPGVRYVVDCGKAKVKQYRPRLGMESLLAKPISKSSAIQRTGRAGREGPGKCFRLYTADTFATLPKTDLPEILRTDVLGAVLTMKARGIDDVLSFPLMDRPELEAVENALVHLHVLGALGDDGRITDTGRKMVLFPVTAPYARVLLAAADPRYDCLLEAIDIISCITAGDDIFMQVRSEEDKEAVDVYRKELQRREGDLITYLNTMQRFVSTPSADRGTFCKQRRINVRNMRQALNIRKQLRSLSVKNKMLAEFPAPDAEVTYQPVSPETAERILKAFLKGFAMKTAVLAPDASYVTAHGKHVVAIHPSSSLHGVKREAIMFLEHVYTQKNYAKKVSAIQAGWI

SEQ ID NO: 3941 - protein, 651 aa, Neurospora crassa
  unsure (1)..(651): unsure at all Xaa locations
LKTVGFNICEQDAQVSVQRADITYNNADRTVVFNVAGTSNQVQNVTAHLSVTAYGMNIYDNTFNPCDEGTFVKQLALVCGSSGSSVIGVGEICXRSIVPAGSFSAKGSQVLTPEVASMIPPIAFQIPDIAAMAKLELLSKESGQNVACIQSEVTNGKTAAVPAVSYIAAGVAGAALILTGISAAGAAVAGSSAAAGSAGGAASSAGVGTISPSFTEVFGHFQGMAMNGMLSVSYPPVYRNFAKNFGFSTGIIPWAAMQTSIDDFRQKTGGNLTHNSFTFLRENATLVFPDNTTTTLHENKASSAPVKRAFTEFIRLAAREIETSVNLTDSSAANTTDSGNGTTTASDNTDSFRVAVKGIQSYVQQLSIPSANMFMTILLIVAIIIAAIVVGILLVKVVLEIWALFGSFPAKLSGFRRNYWISITRTITSLIMLLYGVWVLYCVFQFTQGDSWAAKLLAGLTLGLFTGILAFFSYKIWSTARELKKREGDVAGLYNDKNIWVRYSLFYESYRKDYWWIFVPTIVYMFSKSVVLAGADGSGMVQTIAQLTIEGLMLCLLIWSRPYERKSGNVINIMIQTVRVLSVVCILVFVEEFGIAQTTQTVTGVVLIAVQSTLTGILAILIVWNAINALCKANPHRQKRKEMGMFFTFLP

SEQ ID NO: 3942 - protein, 242 aa, Neurospora crassa
QVVDAIKDLVQDCNFDCNDSGIALQAMDNSHVALVSMMLKTETFSPFRCDRNIALGVNLTSLTKVLRAAQNEDILTLKAEDAPDVLNLVFESSENDRISEYDLKLMDIDQEHLGIPDTEYAATISMPSSEFKRITTDLMAMSESVNIEASKDGVKFSCQGDIGNGSITLRQHTNVDKPSENIEIELSEPVSLTFSLKYLVNFCKASALSSTVKICLSNEVPLLVEYNISASSYLRFYLAPKV

SEQ ID NO: 3943 - protein, 397 aa, Neurospora crassa
PDKMTASSDHPITTPPRAPSPVHGFGTLAVHAGSPHDPATGAVIEAISLSTTFAQTAVGKPVGEFEYSRSSNPNRANFEKMVAALEHAKYALAYSSGSATTANILQSLAAGSHVISVSDVYGGTHRYFTQVAKAHGVKVTFTPEIEVDIRDHITDATKLVWIETPSNPTLRLVDIRAVATAAHERGILVVVDNTFLSPYVQNPLDHGADIVVHSVTKYINGHSDVVMGVAAFNSDELYARLSFLQNAIGAVPSAFDSWLAHRGAKTLHLRAREATTNATAIAHALEASPLVISVNYPGLESHPHRAIALKQHRNGMGGGMLSFRIHGGHAAAEKFCQYTKIFTLAESLGGVESLCEIPSSMTHAGIPKAQREAVGIFDDLVRISCGVEDAEDLKADV

SEQ ID NO: 3944 - protein, 460 aa, Neurospora crassa
  unsure (1)..(460): unsure at all Xaa locations
GRKIFKVFNQDFIVDERYTVTKELGQGAYGIVWYVHLLLLPFLLSRLCFWAAAHLHVSCHILMIQADLPFLLNSAAVNTQTNEGVAIKKVTNVFSKKILAKRALREIKLLQHFRGHRNVGCSHTHITIDAWXLTVAISGSLITCLYDMDIPRPEMFNETYLYEGTSWLMPHEKMGLHTNLGVLLQSLMECDLAAIIRSGQPLTDAHFQSFIYQILCGLKYIHSANVLHRDLKPGNLLVNADCELKICDFGLARGFSVDPEENAGYMTEYVATRWYRAPEIMLSFQNYTKASMLFLKLPPXYRFQANTHSLVDVWSVGCILAELLGGRPFFKGRDYVDQLNQILHILGTPNEETLSRIGSPRAQEYVRNLPPMPKKSFQQLFPQANPDALDLLDRMLAFDPTSRISVEDALKHPYLAIWHDASDEPDCPTPFNFDFEVVDDVGEMRKMILDEVFRFRQLVR

SEQ ID NO: 3945 - protein, 379 aa, Neurospora crassa
YDDNNPNHHYWWTACAPSLTSILRHSHSYTPSQQSLHISWFRNNVIPNLGPRPSSSYRLRSPLNYEGSPYRATWNFCSAPAGSPSSSSVAGTLRFSFDPIPATGSIKKDPTNQEEYKRLFPLLARECHGKGETKVDLTWYDEVKEHMYLTPSEQVVFQSKIVSRGSQLPPEHAAIAIGCVGEKRVLKPYFFAGPKSMVTGLSPHQVLFSALRAIRTKAEELKPAIDLVEDYVASRKAVMMPNCIGIDAVSPDQGARVKLYTLIPSNAFCVMRDAITLGGRLTSPEAMRGVGILRGIYHLLRGDRSPINDATENMSKPCRYESKSNSYWKGFTSYEMRPGREEPEVKVYVPLMQIFETEQAVIEGLEEVWRGFGWGELGK

SEQ ID NO: 3946 - protein, 161 aa, Neurospora crassa
EYRTKFLTRAFGGNAQVACYFLAVTIFGLGLVRDFLYERALRDQPSHPLLEGTYVKYAAYALLALGNLLVITSTMRLGITGTFLGDYFGILMDGIVTGFPFNVTSAPMYYGSTMSFLGTALLYGKPAGLLLTAWVLFVYIIAIQFENPFTAEIYAKRDRER

SEQ ID NO: 3947 - protein, 1502 aa, Neurospora crassa
  unsure (1)..(1502): unsure at all Xaa locations
PXSRSQKHGIRKKFSHPRGSVELLCGASADRQQRSCSNNSSCNSNKPAVKGHQRQALRQLNASIANLLLYRTSPRPSSTYHLQRPRHQRPLSTHSQHQQQMKPSWRPRSPSRAMDTILEKPMDIVLKSRTMALPVVEDTGPKPRIVITNLVLINFKSYAGRQEVGPFHASFSSVVGPNGSGKSNVIDSLLFVFGFRASKMRQGKISALIHNSAQFPNLDYCEVEVHFQEVMDLVSQTLFXRESLCXHXXPGGGHEVIPDSTLVISRKAFKNNSSQYYINGKSSNFTTVTTLLRDRGVDLDHKRFLILQGEVESIAQMKPKAGNEHEDGLLEYLEDIIGTSKYKTPIEESATEVETLNEICMEKSGRVQHVEKERNSLEDKKNKALAYVRDENELALKQSALYQLYISECDDNIAVTEEAIGQMQAQLDAELEKHHGSEQLIKQLEKAYSKGSKEYDSWEKQTQQLVKEMNKFEQERVKFEEKRKFLTDKRKKLEKTIANAEKTAVEAEETIQNCTKEIERRQKDIVFLEKKVKEEEAELATIRESLKGKTQKYSDQIAAKQKSLEPWKDKINQKQSAIAVAESELAILREKANAGTVALEEMETKIVAIQERQAAKAEEMEQCKAERANLIKEGKKIEAELSKLAEEEPKYRQQLSNARQKADEARSSLSATQNRGNVLTALMRMKESGRIDGFHGRLGNLGAIDQKYDIAISTACGALDNFVTDTVEAGQQCIEYLRKTNLGRGNFMCLDKLRVRDMSPIQTPENAPRLFDLVKPKDDKFRPAFYHALQDTLVAKDLAQANRIAYGAKRWRVVTLAGELIDKSGTMTGGGTTVKRGLMSSKLVADTTKEQVDKLEADRDTLEQAFNEFQDRQRELESRLRQIQSMIPQLETKMQKINLEVESSERNLADAQRRIKELSKEQQPSKTDDNRVAALEKEIAKLEGEVEKLREEMSSVEDEIKALQDKIMKVGGEKLRSQKAAVDSLKAEIATQNEETSAAEVKMAKAEKQKHKLEKDFNKASKELQNAIQETEALEEEIQNQGDTAESLTTRVEEAQEALKEKKKELAAMKKELDEKTAELNETRAVEIEMRNKLEENQKILSENQKRLRYWEDKLSKLALQDIEDLERGTSGDAAAPQQLADPDAMDVDDPDSILQAQLEAEAAEAEENEEDEEEEEEEEDEDPEAMSLDEDDEEPRQRKQKTPKKQKQKRRQQTGKTPRKPRNPLELPRYTRDELADMSKEKLKGEIAALEEKISNVNIDLSVLSEYRRRVEEHLARSSDLASAVSQRDAAKKRLDELRRLRLEGFMEGFSTISLRLKEMYQMITMGGNAELELVDSLDPFSEGILFSVMPPKKSWKNISNLSGGEKTLSSLALVFALHHYKPTPLYVMDEIDAALDFRNVSISPFPLFLPLPFLFFFFFLSSLRSIPAPPPSLFFSFPTDKAKKVSIVASYIKERTKNAQFIVISLRNNMFELAARLVGVYKVNHMTKSVTIENHDYIQR

SEQ ID NO: 3948 - protein, 338 aa, Neurospora crassa
  unsure (1)..(338): unsure at all Xaa locations
LQLATSAHVKYIQSLDSRKDEYDYWLTEHLRLNGLYWGLTALHLLGHPEALPRAETIDFVLSCQHENGGFGAAPGHDAHMLSTVSAVQILAMVDAFDDLETRGRGKAQVGKVCVACHQTXVNPHXHFVLTLSGPDIASLQNRQTGTFAGDEWGEEDTRFLYGAFNALSLLGLLHLVDVDKAVDHIAACANFDGGYGVSPGAESHSGQIFTCVAALTIAGRKELIDVDRLGRWLSERQIAGGGLNGRPEKKEDVCYSWWVLSSLEMIGKTHWIDKAKLTSFILSSQDTDKGGISDRPGDMVDVWHTCFGIAGLSLLDYPGLEPVDEVYCMPKSTIKRVL

SEQ ID NO: 3949 - protein, 1201 aa, Neurospora crassa
MGVNGLWTVLQPCARPTNLSTLNRKRLAIDASIWIYQFLKAVRDKEGNALRNSHVVGFFRRICKLLWYGIKPVFVFDGGAPALKRATIQARRRRREGRRDDATRTAGKLLAVQMHRMAEEEDERRRKRAEAREGNKTAAAAAAAEEEEQEVLPDMDKVVYADELGMSKQERQKSRRFHKQDAYHLPDLDGGIEAMGKPDDPRIMSVEELEEYARQFENGEDINLYDFSKIDFDGEFFKSLPPADRYNILNAARLRSRLRMGLSKEQLDVMFPNRMDFSRFQIERVKERNHLTQRLMYEMGMTGLDLTLAVNATRVAGDQNREYILVKNEGAEGGYALGVVSTEKDKGQMTNPIDVDELEFQFQGKGEEEEDSEEDVEFEDVPIEGLNRLPKLTRAAGYRPRGTANSRRQFYEPRQSEEAEDEDEDDEALFVDNGQDAVYGEENAVEADEEEDLNKAIAMSLQNQHGVGLSEEKEDEDMEFEEVTPPEWTQKAVEAPKPIVSTSGRMVAHIVNNRASAAVPRRRESTDSSDSEGDIRAAMAAARRKQAKAPAPKPVVENRPAPTNTPFKGPLPFEKLNWKQLLGGNRPKAKSQKEKVSEPPKPVETGEMEPQSDDDAGGFEKEPKDAPRPLPPWLANNDEDIRDTVRKQREQDRQMAEEDENLAREEQARIRKQREDEVMMIESSDESDGDLEILDAPPSPKKLTQMPGPSLPSLDDEVSQEPVETSRQSPSPNEEEGDDIVFEDVTLPSQTMTLSFGPPATQAEEDAQIEADLFKDVLPPPAQQERVEGLAAVPDDTTTDIVPDPDAPALSEFEDDFSDPEEQELLASLAQEAEEHARFATQLNHKTFQENQAAYEQELKALRTQQRKDRRDADEVTQIMITECQALLRFFGIPYITAPMEAEAQCAELVRLGLVDGIVTDDSDTFLFGGTRVYKNMFNGNKFVECYLSSDIERDLSLSRDQLIALAQLLGSDYTEGLSGVGPVTAVEILSEFPPEPTPISSLTTFKEWWTKIQSSPQPDPSLLSTPFRRKFRKAQATKLFLPVGFPNPAVFDAYLHPEVDSTPEPFQWGVPDLEGLRQFLMQTIGWSQERTDEVLVPVIRDMNKREREGTQSNITRFFEGGVGSGTVRNLGGGGNEEAFAPRRNEVKGSKRMAEAVGRLKARNSKGNSGGGGLSLALPVMAMGPLNGEEEGGNKKRKRGK

SEQ ID NO: 3950 - protein, 540 aa, Neurospora crassa
  unsure (1)..(540): unsure at all Xaa locations
MGNSSSKDAGASSKNRGDDDLKSYPSFSKSDTKDSSRSFRGLRSKIPGGSKTDSPRNSTILSSEEVAEKMNALSGKNGRPSVHTRPSRRDMSPSPASPSTSSPSSPSLDTATLASPTGEPLPPPSPVHNATGGHHDVRAAQESGEVDHISDQPPSGGGGANSNQQPGQSILVKRENTINPVYDTPNQDPQNEQAVSGVAMSDIKDIDLDDFIKRLLDAAYAGKVTKSVCLKNAEIVAICHRARELFLSQPALLELDAPVKIVGDVHGQYTDLIRMFEMCGFPPNSNYLFLGDYVDRGKQSLETILLLMCYKLKYPENFFLLRGNHECANVTRVYGFYDECKRRCNVKIWKTFVDTFNCLPIAAIVAGKIFCVHGGLSPALGHMDDIRNIARPTDVPDYGLLNDLLWSDPADMDQDWEANERGVSYCFGKKVISDFLATHDFDLVCRAHMVVEDGYEFYTDRILVTIFSAPNVSCVTFGSICKISLTWXQYCGEFDNWGAVMAVSTELLCSFELLKPLDSAALKTHIKKGRHRRNNMLNSP

SEQ ID NO: 3951 - protein, 814 aa, Neurospora crassa
  unsure (1)..(814): unsure at all Xaa locations
DTTHTPTNVTLEFGGWNETAPHHGVDLRSLSRSIRRALAAGYTSDDKQSLVLFVQTVTGTAGLYLGRNVNIQSTAPDALIAFENALYASNNTGGSKAIQLCGHDYDGDHVVGFIATSNTSFTPVQQAIRSWKNATCLSFDTVRNIPATVDFTTPLVLPSNGTTNSTYSASTALRAIRGNHLQARAECRTIQVASGDSCAKLATKCGISPSDFTKYNPDSKLCSSLMPLQHVCCSSGTLPDFTPKKNSDGSCASYAVVQDDTCSAIAAAHSLTVDQIESFNKQTWGWSGCSRLMAQAVICLSYGTPPMPAPLANAVCGPQKPGTKKPDNMDDIQKLNPCPLNACCDVWGQCGITAEFCTDTNTGAPGTAKPNTNGCISNCGTNVVKGKPPAQWISLGYYEAYSLGGRSCLYQDVRQIDTNKYSHIHFAFGDITPDFKVSAGDVISTYEFEAFRSMTNVHRVISFGGWAFSTDAATYNIFRTGVTAANRLTLATNIANFVKEKGLDGVDIDWEYPGVCTLPLLLLLLLPPPPLRTRATERCXLFPGPDIPGPPPGADDEGTNYLAFLVVLKNLLPGKTVSIAAPASYWYLKQFPIAQISKVVDYIVLMCYDLHGQWDYGNKWSQEGCANGNCLRSHVNLTETKTALAMVSXVPNISQDPLPLGVYLRTLIPLLTPPPAPDHQAGVDSGKVVVGVSSYGRSFNMADAGCYSKDCFFTGSATASDASKGPCTDTAGYISNAEINDIIVNNASRVNQNFIDSSSNSRIVVYDNNQWVAFMDDSIRAARTAIYKGLGMGGTSNWATDLEKYHDAPSISKD

SEQ ID NO: 3952 - protein, 785 aa, Neurospora crassa
  unsure (1)..(785): unsure at all Xaa locations
MAPSYSSNGGYGYSSSSFQPKHRRSDSTSFLDDLRAFLAHSSRSAWRFWRERGRFIAWAALVNAGRRLRMNLTYNRLFSFPHLLVAAWIVVLLWGERWVFHSAVEECEWGNWERWVRKTSPISCCVWEKEENEKEKMLIMVXLQPPGANPHRLVLVADPQLIDPHSYPGRPWPLNPLTMTIVDNYIRRSYTQMQSQLDPDTIFFLGDLFDGGREWKTAHGDFRDPEWGPHPKDEQKYLKSWNKKYNEFYWLKEYARFGEIFFTPWLEAGQKPENEHKRRKLIASLPGNHDLGFGAEIKLPVRNRFEAYFGEGNRVDVVGNHTFVSVDTVSMSAASLSEIARQDVQPIYKPTEHFLNQVKWTKQKAVEKELRYLRGEVPEVKLHHRIEELNQANFKDQPHLVHDENSQKVPDLPTILLTHVPLYRPPGTPCGPKREHWPPTPPPKGQTEPVFPDHRNAISVYRGYQYQNVLDEKQSISLIEKIGNVIHAFSGDDHDYCEVVHAPDQGSVREISVKSISMAMGVPTPGFQMVSLYNPLDPVTGKPLAGDGQPTMQTHLCLLPNQISTYLHYVGLGIFCIILLAIRAFLVPVLNLPRFALDSDSDSSHHHPSGISILPVFKAKQEDYDEYSLPSAGYSASSKYGSSGTSGERRSRTASVSSSSLKSNNLRNGHHNEKSGGSSGRSRKSSVYSNSNKSVKGGWSWGGKHGHHHHYHQPRIEIPGENEEDLYYGGAFTTSSSSSKWRARQSRKKQKPKTAMGVVVTELWTTVWRVAWMVVVVFGWLAWKG

SEQ ID NO: 3953 - protein, 309 aa, Neurospora crassa
KFNKEKWVASLTPEQRDLLQLEIDTLDESWLAHLKEEIVTKEFFDLKRFLKKEWETKTIFPPKEDIYSWFVFFFPSLFSPSSLLPFPPSSPLFYHPVHSIFITNTHPKQHRSRHTPLPTVRVLILGQDPYHNHNQAHGLSFSVRPPTPAPPSLRNIFIGLARDYPSFTPPPSKSGLLTPWATRGVLLLNTCLTVRAHEANSHANRGWERFTQKVIDLVNERQKKGVVFMAWGAPAGKRMAKVDGKRHLVLRSVHPSPLSAHRGFFDAGHFKKGNEWLEGRYGKEGRVDWSLVEGKSIFADEDGEKGKTE

SEQ ID NO: 3954 - protein, 409 aa, Neurospora crassa
NEPVEITAAQKMLSATSGSLLTGLLVTPLDVVRVRWQSQSFTRPSPTAHTVTDFAKLAGSQISNPAFRPANLGVTACCREVFFANNSEGCIVATGPRIGSGAITASAIPCAVEETKQRNFNSTLDGLRKIARNEGFTSLWRGLSPTLLMAIPANIIYFTGYEWLRFNPSSPIQQTVKEEYAALVAGAGARILAATAVGPIELFRTRMQASPGSTTGSHLTHTFRGIKDMVYAHGYRSLWRGLTLTLWRDVPFSGMYWWGYETIRGKLTDAREARSRGRGRTLDLDSEERHRVRRRSQSRENHAETFTDSFIAGALSGAFASVATMPFDVGKTRTQVYRDTGAATKAAIAVTMEKSAVRPEERNMARLLWHIFSTEGVAGLFRGWIPRTLKVAPACAIMISSYEVGKRAF

SEQ ID NO: 3955 - protein, 314 aa, Neurospora crassa
  unsure (1)..(314): unsure at all Xaa locations
DLLRRLNPKHTAEHLNNLITLAPDLTEDLLSSVDQPLTVKRCKQTGRDYLLCDYNRDGDSYRSPWSNQFDPPLEGGNQGGSGGDGEGDGGEGGAAGSIMPGERVRKMEIKANEAFDVYRELYYEGGVSSVYFWNLDDGFAGVVLLKKVSYSSVVVICFGLDCTGWTDARETLALAGAYRHYIQEQVCXPTLMSTASPTNPSSSGVWDSIHVFEASERGRTSNYRLTSTVILSLATKGNALGEVDLSGNMTRQVEQDLPVENDESHIANIGRLVEDMELKMRNLLQEVYFGKAKDVVGDLRSVGSLSEGQRDRDA

SEQ ID NO: 3956 - protein, 319 aa, Neurospora crassa
  unsure (1)..(319): unsure at all Xaa locations
LYSSQYYAACTFGGLMACVSLXFSDIAVRAGKWRDXLVLXGVTHTAVTPLDLVKTRRQIDSKLYKGNFQAWGHILRHEGVRGIFTGWSPTFFGYSAQGAFKYGWYEFFKKKYSDLAGPENAHKYKTALYLSASASAEFLADIALCPFEAIKVRMQGTIPSQYKGTFDGFSQITAKEGWGGLYKGLYPLWGRQIPYTMMKFASFETIVEMIYDRLPGGKSDYGKAAQTGVSFVAGYAAGILCAIVSHPADVMVSKLNAYRKPGEGMGAVTSRIYKDIGFKGLWNGLPVRIVMIGTLTGLQWMIYDYFKVFMGLPTTGGAA

SEQ ID NO: 3957 - protein, 319 aa, Neurospora crassa; identical to SEQ ID NO: 3956
  unsure (1)..(319): unsure at all Xaa locations

SEQ ID NO: 3958 - protein, 258 aa, Neurospora crassa
  unsure (1)..(258): unsure at all Xaa locations
NQRTTLPTNQVGQELRKMTAFIKQEAEEKAREIQIKADEEFAIEKSKLVRQETDAIDSAYAKKFKQAQMSQQITRSTMANKTRLRVLGARQELLDEIFEAASAQLGQATHDLGRYKDILRDLILEGFYAMNEPELVIRARQADYDAVREAAGWASAQYKHKTDKDVKATIDAENPVPEGRXVIHTHTMLRAVVKRKKKKRXCXQELIYSAGGIIIVGGNGKIDIDNTFEARLTLLKDSALPAMRKALFGENPNRKFFD

SEQ ID NO: 3959 - protein, 1405 aa, Neurospora crassa
  unsure (1)..(1405): unsure at all Xaa locations
PRTIFCGLPLADEFKDDEGHPTQQYPRNKIRTAKYTPLSFVPKNLWFQFHNIANIFFLFVVILVVSSRLLHRCAAPLHPLSLGSPLPPADYAHPCSGPRASDAFXASSVVDADAXPSFXIFPIFGGVNPGLNAVPLIVIICVTAIKDAVEDYRRTVLDNVLNNAPVHKLHGIPNVNVEADNVSLWRRFKKANSRFFGALWHKTEGLWKKEDDNPILKNHTASHDEPDPRMSMESRTSRARRSLNVVRDEVEMTPVPSPLPHQPNEMDFPGEGSSRQVDNKYALQDIKGDLVNRNLPISGKARFAKDAWKGLVVGDFVRIYNDDEIPADIIILATSDPDGACYVETKNLDGETNLKVRSALRCGRGMKHARDCERAQFIIESEPPQPNLYKYNGAVRWLQELPNDEDGDPIPMSEPISIDNMLLRGCNLRNTEWALGVVVFTGHDTKIMMNAGVTPSKRARIARELNINVVYNFTILLIMCLIAAIANGVAWAKTDASSYWFEWGSIGGTSGLTGFITFWAAVIVFQNLVPISLYISLEIVRTLQAYFIYSDINMYYEPIDAPCIPKSWNISDDVGQIEYIFSDKTGTLTQNVMEFKKATINGQPYGEAFTEAQIGMSKRSGGGDIESEIARIKDEIEQAKARTLHGLREIHNNPYLHDEDLTFVAPDFVEDLAGKNGPEQQKANEHFMLALALCHTVVAEKQPGDSPKMIFKAQSPDEAALVATARDMGFTVLGMSDGGVNVNVMGKDMHYPVLNIIEFNSSRKRMSAIVRMPDGKIKLFCKGADSIIYARLKRGEQKELRRETAEHLEMFAVEGLRTLCIAEKELTEQEYYEWKKEHDVAATALENREEKLEEVADKIEQDLTLLGGTAIEDRLQDGVPDAIELLGNAGIKLWVLTGDKVETAINIGFSCNLLNNDMDLVRLQVSEDEAGVQQEAEYLRLAEEELDRGLAKFGMTGSDEELRQAKKDHEPPAPTHGLVVDGFTLRWVLSDTLKQKFLLLCKQCKSVLCCRVSPAQKAAVVSMVKNGLDVMTLSIGDGANDVAMIQEADVGVGIAGEEGRQAVMSSDYAIGQFRFLTRLVLVHGRWSYRRLAETISNFFYKNMVWTWAIFWFQIFCDFDISYIFDYTYILMFNLFFTSIPVILMGVLDQDVSDTVSLAVPQLYRRGIERLEWTQTKFWXVFFAPIIIWLKVSANKIPRAYMADGIYQSVMSFFIPFIFCILTPAASGNGLDVQERTRLGCYIAHPAVLTINMYILMNTYRWDWVMLLVVFLSDIFIFFWTGIYTATSYSGQFYQAAPQVYAEFTFWMAFIITPTICLLPRLVTKCIQKQMFPYDVDIIRERISTGEYKAIEVPVVAPVEDEALKGTSSGSSESSSSRAKSKSSKHSKHTHYASVDEDRRPIYPPS

SEQ ID NO: 3960 - protein, 619 aa, Neurospora crassa
  unsure (1)..(619): unsure at all Xaa locations
TVRAXYTLPFPSYTFPVRSXPYXQAHHNRVVGSYIPESSWALVWSALAALAVWYMASREDQPIRYTIPPPTSPRRRTSLKTPRSKPRVPQAIQCYAPATGQFLGFVNPSTPEGIDRAIDQAHAAQVEWAKTTFRQRRAVLRSLLQYVLDNQEEICRVACLDSGKTMVDAQLGEILVTAEKLQWTIKHGEKALRPESRPTNLLMAYKRNTVHYEPLGVVAALVSWNYPFHNLIGPVISALFAGNGIVVKVSEQTAWSSQWFTSVIRGALVAHGHNPALVRTYHWSLVPYSLPWPLLTNLFRTETVVCWPQTANHITSHPKISHITFIGSQPVCKKVAESASKALIPVLAELGGKDASIILASAPKSDLPRIVNTLMRGTFQASGQNCIGIERIVVAPQHYDTLLSMLTPRVRALRLGPTADVGAMISDNAFARLEGLVADAVKQGARLLAGGKRYAHPEYPSGHYFVPTLLVDVTPDMAIAQEECFGPIMVVMRAASSSAEDILAVANAPDFGLGSSVFGSEWDSTLHEVVRGLKAGMVAVNDFGATYAVQLPFGGVAGSGYGRFAGEEGLRGLCNIKAVCEDRFGWLGVRTAIPRPMQYPVPDQERSWRFARGVVEVGY

SEQ ID NO: 3961 - protein, 941 aa, Neurospora crassa
YQQKLFEELRKEDELVILARGLGLMRLITNLLHSYDAAGNNLIVVVNAEDRENAWIGEALAEHAAISMSPKARGLTVVNTDFTSVGTREKMYAQGGIFSITSRILVVDLLTNLLNPETITGMLVLHADRIVATSLEAFIFRIYRQKNKVGFLKAFSDNPDPFTVGFSPLATMMRNMFLRKASLWPRFHVQVAQSLEGKKKAEVIELEVPMTDSMREIQTAIMECVEISIHELKKENTGLEMEDWNLDSALTRNFDRMVRRQLEPNWHRVSWKTKQIAGDLTVLRGMLQSLLALDAVSFLQQLDTIHAAHKPAPGTTRQTESPWLFSDAAQTIFETARQRVYSSKQKAGPNSTIESLKPVLEEQPKWAVLADVLEEIDRDLYFEPAVRDDSNGTILVMCADTDTCRQLRDYLQTMHIRPRTAKKVEEVYDPEEDRPSGAFLMRRKLRNYLNWKREFAQVNATLFSENQKALSGAVDPRLPQARGRGGAPANKRRRVRGGGGGVGSNPSRHENGSIVQHFEKPNEVADLMSEIQITEDDAGGQAAEEIITFATADPLEDMDDYYQLYDMQDLVVIHAYEGDQDEHVLEEVKPKYIIMYEPDASFIRRVEVYRSSHNDRNVRVYFLYYGGSVEEQRYLSSVRREKDAFTKLIRERASMSIVMTTDSHGVEDPESAFLRTINTRIAGGGKLAKATAQPPRVVVDVREFRSSLPSLLHGRSMVIVPCMLTVGDYILSPNICVERKSVSDLISSFKDGRLYAQCETMFQHYRNPMLLIEFDQNKSFTLEPFADLSGSLRSVNPENAGANDLQSKIVLLTLAFPKLRIIWSSSPYETAEIFERLKALEEEPDPVAAVRAGLGEGESPEDGVNEGKGAVNGGSTFNMEAQEMLGKVPGVTPKNIRNITAEAENVREVANMEVEELGRLVGREAAGKIVEFFKKDVLEDY

SEQ ID NO: 3962 - protein, 639 aa, Neurospora crassa
ILSDDDKETVKRCVPKQTNKIHAVAVARLYVAYPNPSRWTYTGLQGAVVLANDLVGNTYWIKMVDISGKCENDDCVAGHHLADIGQPGNRGVIWDQEIFDTWNYNQDRVFFHTFELEECLAGLSFVDEKEAKQFLKKMNDREKNASKATSKTPFGGASQAHHHKHHGLFGGLFGGHKHASPTATPPESPRAAAPAGRMRAGSTNGINGYKPPSEFATLDAFDPLWREHFGDDLKAQGLDDDFIRENQDFIIEFLKQEQAKQGIHTSTPPPPPPPPSAPPNGPAMRAPPPPPPAAAPRSVSESITPSTSRRGPVPPPPPPARRSGKLDTENHQEPAPPPRFAVPPPIADAGKFAHSDPPRHTPSAPGPPPPPRPPKTPLEDQDPSQRFSVPPPFTGQRSVPPPPPSRSSVPPPPPPRNSAAQPPLPPKAPGPAPPLPPASSRPPPMLPTRSPAPPQAPPLPTSNAPPPPPLPATQAPPPPPLPATSAPPPPPPAPPAPPAPPLPAAHAPPPPPPMPPMPAPSGGAPPPPPPPPPGGMGGVPPPPPPPPPGGMPPPPAPALPPVDGSRSAVLDGIKTAGGIRALKKVDRSQIRDRSGAAVPGGSDSGPASSGLPPAGAAPGGGGGMADALALALQKRKEKV

SEQ ID NO: 3963 - protein, 530 aa, Neurospora crassa
  unsure (1)..(530): unsure at all Xaa locations
SSVNNEKAVHPEYTEDVALESAGWDEQRTKKLLRKIDSRLLPFLALLYLLSFLDRTNIGNAKLELLTQDLKLTGLKYNDALGIFFPFYVLAEVPSNMAMKRFRPSIWIPSIMIAWGVCCTLMGVVQNYHGLMAVRSCLGLAEGGLFPGITYXYVSPFCLSSNRIHLQYPSITMWYRRHECGFRMAIFFSAATAAGAFGGLLARGILEMKGVGGYNGWRWLFILEGILTFIIGMLTLSCLFLRCAFXXFLPAVIAFFAMYDYPQTAKFLKPEEREEIAARLKRDRSSLADEFDIKYFYAALKDWKIWVHMFITIGVYTGLYSYSLFVPTIINSIGTFSPEQSQLLTVPPYVVACLFCIGAGWYADRLKQRGIFMLFFMGMAYVSPQIQLCITCXXLSSIIGLIMLMATRTPAVRYLGCFFLASGIYPNVPQGVAWNGNNIGGSLKRGVGIAMHVGFGNLGGVISSYLFLAKQSPHYYQGFGTLLGCQVMAFVLSAFMTIYLRRENARRDREYKPPSEYTEEEKIAEREKGD

SEQ ID NO: 3964 - protein, 212 aa, Neurospora crassa
GEVVYPQFAYPMRKEIIPIWLAAFLASIIPIFIILCMQIRIRSFWDVNNGVLGLLYSLITAAVFQVFIKWLIGGLRPHFLTVCKPDITRATNTQIAEKGYSAQGFAEIYYTKDICTGDPNEIDDSLESMPSGHSTAAFAGFIFLALYLNAKLKVFSNYHPALWKLAAVYAPVLGACLIAGALTIDEFHHWYDVLAGAVIGTIMAFSAYRMVY

SEQ ID NO: 3965 - protein, 500 aa, Neurospora crassa
  unsure (1)..(500): unsure at all Xaa locations
DFETNSVNENSLLRKLDVRLLPAVGILYLLSFLDRSNVGNARIEGLASDLGMTGNQYLTGLTLYFIGYAIFEVYRVYSRQYREDFSLTRXXIPCNIVLKRTTPRFWLPTLTILWGIVATLMGIVQNLTGFFIARFFLGVAESGLFPGVVYYFSMWYKRRERQFRISLFFGAAALAGSFGGILAYGIGFMRGTVWEHGWRWIFILEGIATVLIAFGAYWFIYNYPDTAEFLSDKERKFIRARLASDSDATHDERFTWDNVLRAIKDPKCWLYGLSFHTMSLPLYTFSLFLVSXYKKKERTSLTCLIYXPLPQPSIINALGYRAATAQLLTIPPYAFAFLTTLTVATVSERLHQRAIFIIGSATFAIIGYIMLLANKDPIAHPGLSYAGTFFAAGGIYPATALALSWPAINVSGQTKRAVANAMQISIGNLGAVLGTQLYRSRDGPRYIVGHSFALGYLAGNVIVSSLLYFILSRENKKRDGIVPEVAEVGHLKDWDGDEDL

SEQ ID NO: 3966 - protein, 819 aa, Neurospora crassa
  unsure (1)..(819): unsure at all Xaa locations
MSRLLRAKKLVAPALVAGVAGGSLYYMYKPRNIPGYEGPVVPPPIFGADGTFKLPRFPQVKSRDQQIADLKKSNSGNKEDEYDVLVIGAGATGAGVALDAATRGLKVAVVERDDFSSGTSSKSTKLVHGGVRYLEKAVWNLDYAQYELVKEALKERKYFLKTAPHLSSWLPIMLPLDQWWKVPYYWAGTKFYDFLAGSEGIESSYFLTKSKAIDAFPMLKQTDLVGALVYYDGAHNDSRMNVSIGMTAALYGATVVNHMEVTGLQKGENGKLCGATLKDLVTERDGNEATPFNIKAKCIINCTGPFTDSIRKMDDQDCKEIVAPASGVHVILPGYYSPGKMGLIDPSTSDGRVIFFLPWQGNTIAGTTDEPATITKNPLPDEKSIQWILNEISHYLSPDINVRRGDVLAAWSGLRPLVRDPKAKNTESLVRNHLIDISPSGLITCAGGKWTTYRQMAEECVDAAIKEFNLPVKPIANPPLVSGTEHVEDDAVLDGSCQTHRVRLIGAHGFSRTLFIHLIQHFGVETEVAKHLTESYGDRAWTVASLCKATNKRFPAKGERIAELYPFVDGEIRYAVRHEYAQTAVDVLARRTRLAFLNAQAALEALPKVIDIMADELKWDAKRKDVEWKDSKLFAPCHSLLHYPLLGHPLMSTSLPFFLQLQTNNSXRTCSHTAVAFLESMGLPQPMLTTTRQQVEKGKLDWSNSLEWKMYSRHDKPVDEKERNEQAEIAGRAGTHRXXWALSPFGAKRDGIIKGTVEEGXQNLYCIGDXMGFPWFRSKGVFVVLDWTGLDWTGLAGWVGMNVRGSLTLTLFSVGDVVS

SEQ ID NO: 3967 - protein, 617 aa, Neurospora crassa
  unsure (1)..(617): unsure at all Xaa locations
MAQYTASTGSSLRASPNLRQHHADTSAAPDTTEKFPDFDTSQTTNGYPSGNGRSTNAGSNAPSDQWRPRRESKVTWAPRDSPGPVNAYSHGRGHSRQTSISNAIHRMRSGSMSQNAHEIAEALRAPVSYKLIVRTFAPTAIPLCKANLFSSSLXGLCMMWYWSSALTNTSSKSILTTFDKPATLTLIQFAFVCSYCLLASWLASTFPKLRTAVPALKHPIRKPSRDVIVTTLPLAAFQIFGHLLSSSATSKIPVSLVHTIKGLSPLFTVLAYRLIFDIRYPRATYYSLVPLTIGVMLACSGKHSFGEGQFLGILYALIATIIFVTQNIFSKRLFNEAARAEQEDGHSNGHRSKKLDKLNLLCYSSGMAFILTGPIWLWSEGFSIIGDFLWDGSVDLSETPNSFDHGRLTLEFIFNGTFHFGQNILAFVLLSMVSPVTYSVASLLKRVFVIIIAIIWFRSPTTNVQAVGIALTFLGLYLYDRSQEKNKADQRARSLSRSKMHESILPLNTKQTTETSSQYQPSSSLNTQIGGYGYMPSIQPTTSSADLGANKKDDGPNPSSVSTTAGGGRQRGASMAKANGGWLPPGTRQEHTWRVGDGRGQNGGAEVSGPAGVAVMS

SEQ ID NO: 3968 - protein, 600 aa, Neurospora crassa
  unsure (1)..(600): unsure at all Xaa locations
PRYFLPTGAVVDGQXYQQHPTTPAPWLRCRPVTTLALYTDPASVQQVKFDTDKLPPILNALETQNNGQKLVLEVSVRGTKNGLINPDDDQRDXCSXANALTSPAAHLGENVVRCIAMDGTEGLVRGAKASDSKLLFXSPRXRVWPDSLTXSYIIAGAPITIPWVSPSFXLTAKSGQATANGAVLLTQKCSVGPATLGRIINVTGDPIDERGPIKTDKFRPIHAEAPEFVEQSTTAEILVTGIKVVDLLAPYARGGKIGLFGGAGVGKTVFIQELINNIAKAHGGYSVFTGVGERTREGNDLYHEMQETSVIQLDGDSKVALVFGQMNEPPGARARVALTGLTIAEYFRDEEGQDGMCSGEVMPLEGKPLLTQSVVLLFIDNIFRFTQAGSEVSALLGRIPSAVGYQPTLAVDMGQMQERITTTTKGSITSVQAVYVPADDLTDPAPATTFAHLDATTVLSRGISELGIYPAVDPLDSKSRMLDPRIVGQEHYETATRVQQILQEYKSLQDIIAILGMDELSEADKLTVERARKIQRFLSQPFTVAQVFTGIEGKLVDLKDTIASFKAILAGEGDDLPEGAFYMVGDFASARAKGEKILAE

SEQ ID NO: 3969 - protein, 874 aa, Neurospora crassa
  unsure (1)..(874): unsure at all Xaa locations
MNDISDNSSNSLANGGTVANSDIPKDGTGMSLYIPRFSLPIWCQKLIQKCAGVLSIDPWLEPFKDTLKSRYSKAQSWIDTINKTEGGLEKFSRVQSXAALWKLPKLLTHVQLQGTEIFGFNVDKDNTITYREWAPNAKQASLIGEFSTYHDTRPRYCELGAILTLIRQWDRNAHRMKKNEFGVFEITIPPTANGQPAIPHNSKIKVCECFNSACATPIRHNVLMFISXQITLELPDGQWVDRLPAWIKYVTQDLSVSPAYEARFWNPPQSERYTFKHKRPSKPESLRIYEAHVGISSPECKVATYKEFTKTMLPRIKNLGYNAIQLMAIMEHAYYASFGYQVNSFFAASSRYGPPEDLKELVDTAHAMGIAVLLDVVHSHASKNVLDGLNEFDGTDHQYFHGGGRGKHDLWDSRLFNYGHHEVMRFLLSNLRFWMDEYAFDGFRFDGVTSMLYLHHGIGTXVICSPMVNLALANRIQWFLGGYHEYFGPDVDEEAVVYLMLANEMLHQLYPNVITVAEDVSGMPALCLPLSLGGVGFDYRLAMAIPDMWIKILKEKKDEEWDMANITWTLTNRRHGEKTIAYCESHDQAXVTYPVATCSDSGXRSNRLVGDKTLMMHLCDAELYTNMSILTPLTPVIDRGMALHKMIRLLTHSLGGEGYLNFEGNEFGHPEWLDFPREGNQNSFWYARRQLNLTEDGLLRYQYLNNFDRSMNLTEDKYGWLHAPQAYISLKHEGDKVIVFERAGLVFVFNFHPSNSYTDYRIGIEQAGTYRIVLDSDTKEHGGFNRLDPQTRFFTSDLPWNNRKNSTHVYIPARTAFVSFPRYAAAHCILALNGXLICGSQVLALEVHPFRVGYERPDIPSVVQVRVMRITAAG

SEQ ID NO: 3970 - protein, 1022 aa, Neurospora crassa
  unsure (1)..(1022): unsure at all Xaa locations
SQQRRHESALHSPPDPNDNFLSGSAANYIDEMYLQWKQDPKSVHVSWQVYFKNMESGNMPISQAFQPPPSLVPGAANVVPGLAAGAGVGIGEGANVTNHLKVQLLVRAYQARGHHKANIDPLGIRNTPASKGFGNIRPKELTPEYYGFTEKDLDTEYSLGPGILPRFARDGREKMTLREIIDACEKIYCGSYGVEFIHIPDREKCDWLRERLEIPQPFKYSIDEKRRILDRLIWSSSFESFLATKYPNDKRFGLEGCETLVPGMKALIDRSVDYGVKDIVIGMPHRGRLNVLSNVVRKPNEAIFSEFAGMAGADEEGSGDVKYHLGMNFERPTPSGKRVQLSLVANPSHLEAEDPVVLGKVRAIQHYNNDESDHKSAMGVLLHGDAAIAGQGIVYECLGFHNLPAFSTGGTIHLVVNNQIGFTTDPRFARSTAYCTDIAKAIDAPVFHVNADDVEAVNFVCQLASDWRAEFKQDVIIDLVCYRKHGHNETDQPAFTQPLMYKRISEKSPQIDIYVDQLLKEGTFTKEDIEEHKQWVWGMLEESFSKSKDYQPTSKEWTTSAWNNFKSPKELASEVLPHMPTAVDKPTLEHIGTVIGSTPEGFHAHRNLKRILTNRTKSVVEGKGIDWATAEALAFGTLVKEGHHVRITGQDVERGTFSQRHAVFHDQETEDTYIPLQHISEDQAPFVISNSSLSEYGILGFEYGYSLQDPNGFNMWEAQFGDFANTAQVIIDQFLASGESKWMQRTGLVMSLPHGYDGQGPEHSSARMERFLSLCNEDPRIYPSPEKLERQHQDCNMQIAYMTSPANLFHILRRQLKRQFRKRKFPWLNXHVSRQNANFVSLSLVIFFSKALLRHPVARSDIEEFTDDAHFRWILPDSAHQTGEIKAPEEIERVILCTGQVYAALLKHRQDNKIDNVAITRIEQLHPFPWEQLRENLDQYTNAKTIVWAQEEPLNAGAWSYTQPRLETLLNHTKHHDRKHVMYAGRAPSASVATGKKSSHVKEEKELVDMAFSVTQSKLKGE

SEQ ID NO: 3971 - protein, 663 aa, Neurospora crassa
MAPIEIPRGQASYKKREGIITLTPDKTALIWSPLPGTGPPVISLSVSNITNLQQTPKTNPKVVLRVVEKPKAPGADPAAYPFQFTHATEARNEADAIKDLLSQIIAELRGDDPSLPKPAKSGPNGAGASAAMAMASAVNSKHLPFRWFEDDMLKADVELQQSLMKKDKALAHIYNDAKLSKPDSLSDASFNSQFWATRISLLRAYAIELNQKKGSYNVLSTIKPRTENGELKLNINHEQVQLIFQQHPLVKRIYNENVPKLTESEFWSRFFLSRLSKKLRGERITDNDNTDPLFDKYLEADNTMAVPAKITATSVPPIINIEGNEENQGGFRGGNLKDVEMRPRANIPIIKTLNSLSEKIMANVAPTDVDPSAASYSKDGIADALSKQLALQDLRGDAEAQLIRLSVKDTSTFFTGNQPSLTDQEAADARLYATQVPSDVLFEVQADMDTLDSDGRGGIDLHRSIGVDPDSDDEGNNSLDSKSGPKPQHVGSRAALRFAQNQILESMKSARSHLTTTTTHGGSHTTTTNASEERPMSLPTDIAHRATLTCATTAEFLKQFWTVFNNSSNSSPEKQQELAYLADSLVRSKQRIEALADEAEKRRQEIMEKRKREIREYYQKTGRKAKWVPVGGGRDAVWAAFEGVVGGLERAVAVWEMVKSGRI

SEQ ID NO: 3972 - protein, 473 aa, Neurospora crassa
  unsure (1)..(473): unsure at all Xaa locations
MSTFGHYFRVTTYVYKQTAMPIGIQRXQSNSYGESHCKSVGCIVDGVPPGMELTEDDIQPQMTRRRPGQSAITTPRDEKDRVIIQSGTEFGVTLGTPIGMLVMNEDQRPKGECQLLHHKPLCSACRXRCSVQDYGNKTMDIYPRPSHADWTYLEKYGVKASSGGGRSSARETIGRVAAGAIAEKYLKLAYGVEIVAFVSSVGSEHLFPPTAEHPSPSTNPEFLKLVNSITRETVDSFLPVRCPDAEANKRMEDLITKFRDNHDSIGGTVTCVIRNVPSGLGEPAFDKLEAMLAHAMLSIPATKGFEVGSGFGGCEVPGSIHNDPFVSAENTEIPPSVAASGAARNGIPRPKLTTKTNFSGGIQGGISNGAPIYFRVGFKPAATIGQEQTTATYDGTSEGVLAAKGRHDPSVVPRAVPIVEAMAALVIMDAVLAQQARHTAKSLLPPLKQTINSGKDTVGNGVSENVQESDLAQ

SEQ ID NO: 3973 - protein, 287 aa, Neurospora crassa
  unsure (1)..(287): unsure at all Xaa locations
TEPTQGTFNFTEGDIVVSLAHQHHKVLRCHALVWHSQLAPWVEAGTWTKDELRSVIVSHITNVMTHYKGQCYAWDVVNEAFNEDGTYRESVFSTVLGGDEFIQLAFETASKLDPQAKLYYNDYNLESPSAKTEAVRKLVRQLQNKKIKIDGVGLQAHLTAESRPTLDEHVAAIKGFAELGVEVALTELDVRLEMPANATNLAQQKEAYKNVVNWFLEFILSTCXXFHXKNXAVGACVQVDGCIGVTIWDFYDPFSWVPAVFPGEGAALLWFDDFSRHPAYEGVVEAL

SEQ ID NO: 3974 - protein, 658 aa, Neurospora crassa
  unsure (1)..(658): unsure at all Xaa locations
QWAAINNQYAMCKFLIDKGAEINKKGGESVATPLQWAAQRCHYYTVHLLLQHGADPLITDSQGYNTLHISTFNGNVLLIVLLLHQGIPVDVEDAYGHTALMWSAYKGFPACVDVFLRWGASVHAKDEQGFTALHWALVKGSPGCIQKLIEYGADRFAKTANGKTPAITAQELNTVAAWQKALDECGYDEHGNAIVPSWPGASYLLQDRRSFMTKFTFLWPFVMVWATMVVMAGMPVFVGIPLGVLAGYAVQWVAQQVIAYAPPDMRQLQKTPWMAGIFAGSLFLCIMNWLLHIFGSTMFGQDSAVIPNLLFAFFISMTIWFYIRCMVDDPGFVPKMGGVAEQKAVIDELISLWKFDESNFCVTCMIRTPLRSKHCPXVSTLRGEAXSVSISNQNXVRMGKLTGNSHCPWVYNCIGVNNHRHFFFYLINLTLSVVTYDWLTYRCESVPSPSYRQLLTQADLSTLSETASDECNILAPSLCRIVNADTYSLLTAIWASLQLTWVSMLLFVQFVQVSSAMTTYENMHGIDNYSATSLNSSFTSTGAPLNPPSLPAPGPSPAAGGARHGGRHAHGHNHKQGFIKQWSRLLGVDAFIETAAGRGATTGKGSKRNKRGNPYSRGCVTNCKDFWCDPSPMFGKHENGAAVLGGVPVNYTDMYESP

SEQ ID NO: 3975 - protein, 206 aa, Neurospora crassa
DTAILLLSDSSGLDSPANLLLADSFARAGYLTVVPDLFSGSPSPIDLTTPGFNLTLFLSEHPPSVTDPIIASTISFLRSSLNVTRIGAAGYCFGGRYAFRFLDDSLPPNERVDVAFVATPTLLQDDEVLEIDGPVSVAAADNDGMVSAARRAEIEALLLETEQEYMVSLYSGTLHGFASSADVSGREQRFAKESAFLQAVRWFDEF

SEQ ID NO: 3976 - protein, 453 aa, Neurospora crassa
  unsure (1)..(453): unsure at all Xaa locations
VDCDHIGGPTAAVIAYHNPDITVNVVDLNEQRIAAWNSSQLPIHEDGLLKVVRTARDGTVDTTVKIPGLPRSFKLDARSPNLVFSTKVNEAIEVADVIFICVNTPTKTYGLGAGSMADISMVESASRTVAQHAKKGAIIVEKSTVPCGTARVIQDIVSGLDXDVLTGDRMLTATSSNYYRPNDEFEILSNPEFLAEGTAVENLMHPDRILIGSARTLAGMKAAESLKNVYAAWVPQERIITVNTFSSELSKLVANTMLAQRISSMNAVSAMCEEIGLGSDVDDVSLALGQDSRIGPKFLQAGVGFGGSCFEKDILNLSYLARELHLDVVADYWLGILKINEYQRERYAHRVVKELNGSLRGKKISVLGFAFKDGTNDTRNSIAVHIIKSLAEEMPLEIGIFDPGCAANEIMEEIEKIGLTKAQLERVKICSNWRESVKQASAVCILTQWKQFR

SEQ ID NO: 3977 - protein, 712 aa, Neurospora crassa
  unsure (1)..(712): unsure at all Xaa locations
MAADAGLDAGFIPALHKPSALLPIAKHREALLYTVETHPVTIVVGQTGSGKSTQIPQFLEKAGWCADGKVIAITQVCPALLNTPNNPRLTWICXPFPCSSPRRVAASTVAIRVAEEFGCELGKEVGFSIRFEDVTSEATRIKFLTDGLLIREALVDPLLSRYSVIMIDEAHERSISSDILLGLLKKIRKKRPELRIIISSATLQAEEFLRFFSDSTGEAKSADNVQSDEKQDAPVGAIVSLEGRTYPIDILYLEKPAEDYLEKAISTVFDIHTNEPKGDILVFLTGRDEIEKAVEAVSERSAQLPVGSEAILPLPLYAGLPTEKQMYVFDETPANFRKVIFSTNIAEASVTIDGIVYVVDSGFVKLRAYNPQTGIETLTATPVSKASAAQRAGRAGRTKAGKCFRLYTEEAYQALHDANPPEIQRSNLAPFVLQLKALGIDNVLRFDFLTPPPAELMTRALELLYSLGALDDYAKLTKPLGLRMAELAVEPMMAKTLLSAPSFGCLGEMLTIAAMTSLGGSIWVQPDGGKDEAESARRKFAADEGDHLTLLNVYQAFVTKGRKEARFCHDNLINFKAMTRAMSIRAQLRRWLERFGITEDGLSVPQPAAAAAAAAAAGVNKAEQIRRCLTTGYFAHAARMQPDGSFRNVSGTTVLHAHPSSLMFNRKADWVIFHEIMESGEKTFIRDITKIEKNWLVEYASAFYSTMXRQSI

SEQ ID NO: 3978 - protein, 505 aa, Neurospora crassa
  unsure (1)..(505): unsure at all Xaa locations
MSEKLMDTIRHYASFPATGVSLRQMVQFGEKPSTGKGGQKRHLVRPQSILQANLRRHTPGTLFRASQFLAEELPIRLAHRVQELDNLPDGLNEMPSVKKVQAWYAQSFEVRTITVSSYPPSPCPTMLVNIXRVNSRKSHQLPRPHLPKDVRERLMKPSRSGKHAYLPEATPNPSIEEGQYASHNGASYASGLNHKKFSASRRYFAMVDDTGDWPPDLHLYNQKFAQTLHKIKRRHDSVVTTMAQGILEYKRKRQRMQIDHNIQSFLDRFYMSRIGIRMLIGQHIALTDQNHYRDPSYVGIICTKTYVKDLAQEAIENARFVCEDHYGLFEAPKIQLVCNPNLNFMYVPGHLSHMLFETLKNSLRAVVETHGQDKQEFPVTKVIVAEGKEDITIKISDEGGGIPRSAIPLVWTYMYTTVDRTPNLDPDFDKSDFKAPMAGFGYGLPISRLYARYFGGDLKLISMEGXVARTASXGVMHANSLGSIDTETDVYLHLNRLSSSSEPLQ

SEQ ID NO: 3979 - protein, 271 aa, Neurospora crassa
  unsure (1)..(271): unsure at all Xaa locations
ATNGIVLATEKKSSSPLADPSSLSKISLITPNIGMVYSGMGPDYRVLVDRARKVSHTGYKRIYNEYPPTRILVQDVARVMQEATQSGGVRPYGVSLLIAGWDEGILPEDELEEQKSKDEMVADDGETKKKATGKTGGILKGGPMLYQVDPSGSYFPWKATAIGKNATTAKTFLEKRYTEGLELEDAVHIALLTLKETIEGEMNGDTIEIGMLCDGYGCTCLTDTGCGXHVCTGIVGPPADHLLGVEGVEGAKGPRFRKLSPQEIEDYLTNL

SEQ ID NO: 3980 - protein, 1168 aa, Neurospora crassa
  unsure (1)..(1168): unsure at all Xaa locations
MPADIRSFFGPKGGAPPAKPATPAPKKEEEKKTRGSKAXTMIAITSLSRYINNLVAGPRKVVEDSEDDEVVEVSLVKSISSQNXHLTSMCRVKKPTKAAPKKKVAXVFMKHLSVPCHPIPADRLSREPVKGVETDAAKYFATSKTKTAAASQSTPKKTPAKPEPEEPKVALRTSPRKKATPAAKAPEPPKTTTKKTSTTKKPTTAYKSYDKDDDGDAYMDDEHDAGEDIFAAEFKGGSKRKKDDDYAEEDSDEELLPKPKRMASRAKTAAVAESDDEDVKPGPSKPNKKSTTTTAGKRKSSVVISDEEDEEEEEVKPAKKKGAPAKPRAPRAKKDAAVEEPEDVKKILDNIPTIEAPDAPPKDPNVKFDWKTKAAGAGNAGPPPMAGTADIPEGEIDCLAGKTFVFTGLLKTIAREEAQALVKRYGGKVTGAPSSKTDFVVLGDDAGPSKLRKIKEHGIKTIDEEGLFYLIRTMPAGGGTGKGAEKAKQKREEEEKKVREEAERLDREEKALRLAAEKEAKKAAAARGVSGPVPAALPPPSSQLWTTKYAPTAMNQICGNKANVEKIQNWLKNWPKSRKYNFQKRGADGSGGYRAIIISGPPGIGKTTAAHLAAKMEGYDVIESNASDTRSKKLIESGVSEVMTNTSLLGFFGGDGKHADARKKKIVLVMDEVDGMSAGDRGGVGTMAKFCKKTEVPLILICNERRLPKMKPFDHVAFDIKFQRPTVDQIRSRIMTICHREGLKIPPPVVNALIEGSGRDIRQIINMISTAKLDQTTMDFDQSKQMSKAWEKHVILKPWDICQKLIGGGMFAPSSTATLNDKIDLYFNDHEFSYLMIQENYLRSRPMVLNQKGYTPREQNLKYLELVDEAAESISDGDLVDRMIHGPQQQWSLMPTHAVFSTVRPSSLIAGQFVGQAQFTSWLGNNSKYGKLNRFNREIHAHMRLKSSGDAQEIRQQYMPVLWDKLVKRLEVEGKDCVPEVIDLMDSYYLTREDFDSIKELGLGHMAEETVNIETQTKAAFTRMXVSFPSPHFTTHLILLTIPPFHRYNAASHPVPFIKASSVLAPKKLAKEVPDLEEAIEEDFEGDDAGLIDDAAEVDEDEDVDITKDKYIKQPKAKKAAAKKSTAAAGKKKAAAKAKDEDIVDDDEDDEDVGAKKPAARGRGRPAK

SEQ ID NO: 3981 - protein, 393 aa, Neurospora crassa
  unsure (1)..(393): unsure at all Xaa locations
LIVDKHRPRSLDALTYHTELSERLRSLVSRPSCSPRAKEAPRXXHSXAQSGDFPHLLVYGPSGAGKKTRIVATLKELYGPGVEKIKIDARVFQTSSNRKLEFNIVASVYHLEITPSDVGNYDRVVVQDLLKEVAQTQQVDLSAKQRFKVVVINEADHLTRDAQAALRRTMEKYSPNLRLILLANSTANIIAPIRSRCLLVRVAAPTHKEICDVLASSAKKEGWPIVKGLHQRIAEESGRNLRRALLMYEAVYAQKXAVHPNPKACHALQLLTTNARHSEKVTDSTPIPPPDWEALIGQIAKEIMEEHTPARILQVRAKLYDLLTHCIPATIILKTLTFKLIPLIDDALKADVIYWSAFYEHRIRTGTKVIFHLEAFVAKFMRIFEMYLMSMDL

SEQ ID NO: 3982 - protein, 521 aa, Neurospora crassa
  unsure (1)..(521): unsure at all Xaa locations
IHVLHYRCTTITTIIMGYTTLWKRLSPTQLNLAIQTFSLISIFFEGYDQGVMGGVNASPRYVTEVGIGLPDGTVTDEVHQGGIVSVYYVGCIFGCFAGGWLAIGLGELTGMCSYLPTYLPTYYILEDTAPFFFGFEEVIXXLMTSXWYYISLFIGAVLSLIGGVLQAATQSSDFMIVARVVTGLGTGALTGITPVLVSETSTASHRGGFLGYVFIANYLGIAVAYWIYFGMSFLDNGYSDVQWRFLLAFQCFPAILLVLGIKLLPDSPRYLASVGRLDDAREVLEHVRGTHDATAVEMEFQEIAAVAKTSQKSSPIQFAQILAGQGGKPGSHLGRRAWLCMLLQIMGSWTGITAVTAYAPVLLSAAGYDRLTQNGLTGGLSTVGIVGTIISAQIVDRLGRRKCLMGGSFALFVVNLVAACVYEGARAHPERSSSFAPAAVTMLFLFNICYAATWGTVAFLIPTEIWSSDMRAQGNGFGITGWAIGVGWTVLVNPIMFRHLENRTYFLFAGLNLLWIPIVYL

SEQ ID NO: 3983 - protein, 732 aa, Neurospora crassa
ATLWKSPERIDKASVQLYDAFRDACGYQAGVQVKVTVQEGKLPEAEEVVLEQLPPEKAGKDAETAASIDPSDLPGWEFFLAGRLSMIEHVHAGLTFKNLYARGPQRSFVVASVNGRPTGNARYLDGKTKVRIGAPSPAGQVDGVPQGKLEVTGVRGLDAQIEKLNDLLSQFTDPWVFQGKPRYRGIVIHGGHGTGKSMLLNTIAATGWGTVYRIQPKDKLADIQDMFQKARLEQPSIILIDQLERLIDKERNNRTSVIQALCEALDTLGADAQETGEIPKVAVVVTCLDYTTDVPEDLKDPGRLTGEVYLPLPDVDGRKEILASFNLRVTPEEEDALLRSLSERTHAYNGKDLRRIVDEAEFIARTRINRVKKTTTPTSTEDVISLDDQPPATEEVSTLLESMHLSPSNASTATTTTTLTSYFLASDYEEALRLVRPSAMHDVNLKPPPIHWSDIGGQASVKVSLRRAVRMSTEPVHVLSRFFARPPKGFLLYGPPGCSKTMAAQAMATESGLNFFAVKGAELLNMYVGESERAVRRLFQRAREVAPSMIFFDEIDSIAGQRAGFGHGGSSTSGGSSSGLNVLTTLLNEMDGFEALTGVVVLAATNRPQALDPALLRPGRFDELIYVSPPDQEARAAIFKKEAEKRQMLIGDEDIKRLATITDGFSGAEIKGICAVAGTRAYDRYLKLDSVEEDTAVGITMEDLEMAAKGMMRQITPEMIRGFEQWEKQFRR

SEQ ID NO: 3984 - protein, 457 aa, Neurospora crassa
  unsure (1)..(457): unsure at all Xaa locations
QPSTTTTSKTVASRRHASSLSQRPDASHVMFPGAVKSAFCNTMTFEEPSKYDALPTYRAVDQHGQVVDPSFKPDLSDKEVIKLYHDMLTVSIMDLIMFDAQRQGRLSFYMVSAGEEAVCVGSASALSPEDVVFCQYREQGVFKQRGFQLSDFMNQLFANHKDSGKGRNMPVHYGSKELNIVGLCCLFRAHVTILFGIKXWLTLLFDYXHTISSPLATQLPQAAGAAYALKIQRMQNPTVPPRVVAAYFGEGAASEGDFHAALNIAATRGCPAVFICRNNGYAISTPTLEQYRGDGIASRGLGYGIETIRVDGNDFWAVREVTKRARELALQDGGKPVLIEAMTYRVSHHSTSDDSFAYRAKVEVEDWKRRDNPIGRLRKWMEAKGIWDENMEREARDSIRRDILKAFSQAEKEKKPAIRTMFEDVYEEMTPEIKAQMKELKEHLEQYPEEYDLGDFE

SEQ ID NO: 3985 - protein, 868 aa, Neurospora crassa
  unsure (1)..(868): unsure at all Xaa locations
RDLTRKSLSFDDNQVGVKFGESEDEEEEVENSPYPEVRAAVPNFDQDLPCNTIRAWTIGLGLIFLGASMNTIFSLRAPSISLGSLIAQIIAWPLGHGWARFMPQREFNTFGKRWTLNPGPFNIKEHSVIVVMASVSFSVAYATDIILAQKVFYKQDFGLLWGVLLTISTQSLGYGIAGMLRRFLGKFCMISKVTNSFINFTIIDTVYPASMIWPGNLVGVTLMHAMYGQNEKKDPTIMGGSIPRYRWFAYITLGSFLYYFIPGFFAQFLSSFAVVTWMAPNNPVVNQLFGYSTGLSLLPITFDWAQITGYVGSPMVPPGKIKCHHALDSLKGNANTPVRHAIANTLAGVVIFFIIAASFLQYTGAWYGKYLPMSDSNVYDNTGKTYDVSRVLSKEFTLDEEAYNTYSPLFLRYVAPPSLLVRFQPTAVIXLEHSTTFAIAYGLSFAAISSLIVYTYLHHGKTIWRQWKNSTSERPDVHMKMMRKYKEAPTWWYMSLFAVVSTNFCLDXHITCRTNHCAXKLDAALGFFTVLGWQTNLTWWAFLLAVFISFAFSLPIGIIQAVTNNQIGLNVLTEFVFGYIQPGRPLALMMXEASPFSSRSLSLLSIPRXLTKTAPLAKXQLQTFGYITMSQALTFVGDLKFGHYMKLPPRVLFSAQVVATTFSCIIQILVLNFALRTIPEVCTPSQPQHFTCPGGRVFFSASVIWGLIGPARMFSPGQIYSSLFLFFILGAVVPLGIWLLLRRAQKRNPHTKTWLRYVIAPVIFGGAGSIPPASPLNYLSWGIVGYGFQYVVRKRHFGWWSRLNFLTSCGLDLGLALATLVVFFAFTINEISPPSWWGNDVVKGTLDFKGMAVRERVGEGETFGPRVW

SEQ ID NO: 3986 - protein, 479 aa, Neurospora crassa
  unsure (1)..(479): unsure at all Xaa locations
MRRVVVTGLGAITPLAVGIRPTWRRLLDSHSGIVSVADLEPQDKWKELTSTVGGLVPTPARNKQNVDEQHTWKAADWLEPSDQRRMSLFAQYSVAATEMALQDAGWKPTRQEDLEATGVCMGSGIGNLDDFYNTSVTYDKEGKSAHRFDLEPDVPPXCTSLTCLLXGYKRVSPLFVPKILINLGAGHIAMRYGFRGPNHSATTACTTGAHSIGDASRFIAFGDADVMVAGGSESCIHPLTFAGFGRSRSLSTAYNHDPTSACRPFDKDRAGFVVSEGAAVLILEELEHAKRRGARILAELTGYGCSGDAHHMTAPRDDGSGAFLSMKRALKNAGVKPGDVDYINAHATGTAVGDAAEAIAIRSLMMGEEGVDDESRITVSSTKGAIGHLLGAAGAIESVFSILAIAEVSVWNVAPESCCLCXYVTTGSHPPTLNLTSPNVGVGFNFVPVQAQQKEVKVAMSNSFGFGGTNASLVFSKFE

SEQ ID NO: 3987 - protein, 273 aa, Neurospora crassa
  unsure (1)..(273): unsure at all Xaa locations
LTLVLAATRDMGIGLNGGLPWTGLKKEMAYFARVTKRLPSQVIXLYVLPSLLFLSSSCTSSPPSLAFLATQSPSPNQDXLHIAARRYQSLNAVIMGRKTWESIPPKFRPLKGRLNIVISRSVTSSPSLSSPSSSSSSSSEVEEGPVMASSLEQAIEYLHHCQQQQQQQQQQQQQEQQQKVGKVFVIGGGQIYGAALKLPKEVSKRILLTRVLSPEFECDTFFPLELKEEGEASGSEEWVRKSKEELDQFVGEEVPEGLQVENGTEYEFQMWER

SEQ ID NO: 3988 - protein, 735 aa, Neurospora crassa
  unsure (1)..(735): unsure at all Xaa locations
RILCVAEKPSIAKAVATHLSGGSYQTVGCRFVFTMSGRDHCXRARQHDTRDRYTKNYVFTCDFGPPWGRSTVTMTAVRGHLTQLDFHQEFKKWEYPPPDRLFDAPVQTVYPHVCLAIANKCRAHHPCLHFXCXQRDSCXDMKNIAQNIENQARQADILYIWTDCDREGEHIGSEIREAARKGKRNIQVYRARFSNIERSVSSPSRCLNPSITDMPNPISRHILSAARRPVALDDKQAEAVAARIELDLRIGSAFTRFLTLSLRPLGGAMADLVLSYGKSEWSLYCHYESDXTGSCQFPTLGFVVDRYFRVRNFVPEPFWSIKVMHEKEGVKVNFNWSRNRLFDRLSVLLLYERCLAAKIAKVTEVKEKQTKKWKPLPLTTVELQKMATRFLRMTGQEAMTVAEKLYNKGFISYPRTETDRFDKGMNLRALVQKQTQDQRWGPFAQNLVDGAFQQPRQGRNDDKAHPPIHPIIYAAPTVLDDQEKRLYEFVVRRFLACCSEDARGAATDVEITYGEEKFVAHGLIVHQRNYLDVYPYENWTGTAGLPKFTVGETFEPTEAMMTEGKTTAPSYLTEADLIALMDANGIGTDATMAQHIEKIKERQYVQVVERGGNGGGGNDEDDGAAGGARGGRGGRGGRGRGGGRGGRGGGGVGGGGARGGVKEFIPTSLGVALIEGFERMNFETSLGKPFLRKEMELKMKAICEGRLTRDALLRESIASYRQVYDQSREEVNLLK

SEQ ID NO: 3989 - protein, 1081 aa, Neurospora crassa
  unsure (1)..(1081): unsure at all Xaa locations
IDIPVQDQDDEAVEIDLEVLADDPTELCTLFEMEGAARTYWMTVSLAYAKQKKIDFAIEMLIKGANAMQANNPREKLSIVSALCWMYLWKSREAPRVAPEDALVSEAKTKEYYLQLATQSLNEASRINPAFPPLFLARGVLQLLRASLQPPSKAPGAVDPEKTETLRAALKSFDDALRVSSGKNMLAVIGKARALFSLGRYADALVAYQDALARAPDLVDPDPRIGIGCCFWQLGYKDDARIAWERALEINAESKVGNILLGLYYLDASGHVPINSPEFIKLYKKAMTEYTQKSYKLDKDLPLTCATFASYFLSRKQFDHVEALAHKAIQFTDVNAIASDGWYLLARKEHYANNLERAADYYRRADDARGGTERGYLPAKFGAAQLSVIKNDLGEAKLRLEKMIQQSKNYEAMILLGNLYAEEVFANQFAPVKEDKSAEAKKAISLLESVRTAWKDPKKSLAPDAAVLLNLARLYETENPDKALQCLQQVEQLELDQVPQSERPDEVEGEAAIKAALRRFLPPQLLNNIGCFYYQEEKHELASELFEAALSSCMRIGEKDDDTDTDALVTTISFNLGRSYEARGMSEKAVEVYEGLLKRHDDYTDARTRLAYIKLRNNPGTKEGPDAVAKLYQENSSDLEVRALYGWFLGKLSSRKRPNNIAEDPEQRHYKHTLQNYDKHDRYALVGMGNLHLISAREMRRESEADRQKRSAAYSRAVEFFDKALQLDPKNAYAAQGIAIALVEDKKDYKGALQIFIKVRETIKDVHVFVNLGHIYAELKQFTKAIESYEIALGKEGKAKDANILSCLGRTWLNKGRAERNLDAYKTALEYAQKVCXFQHQSXRQXLTLFQTLEVAPEQVHFKFNVAFVQIQLASFINGLPEHQRTSTQLEEAASGLESAITALDEIAASDHPPYPKHDIEQRANMARNTQRKQLERALASQRDYESKNKEKLQLALEQRQVALKKKEEEIRRKEEEERERQEKIKREREEIAARDRKLAEQRAEEDRQRREAEMTTDSETGEKIKRQKIKKASSTPAKRERGGEERERKGRAQRKKKTSRRDRDNDDSDGSGSDAEEGGR

SEQ ID NO: 3990 - protein, 907 aa, Neurospora crassa
FTDRAKKALEDAMALAEQYAHSQLLPVHLAVALLDPLPDPSKDQQNAPAGATSSLFRQVIERAHGDPQLFDRALKKALVRLPSQDPPPDHVSMAPSFHTVLRKANELQKTQKDTYIAVDHLITALAEEPSIMNALKEANIPKPKLVTDAIQAIRGTKRVDSRNADTEEEHENLAKFTIDMTAMAREGKIDPVIGREEEIRRVIRILSRRTKNNPVLIGEPGVGKTTVVEGLAQRIVNADVPDNLANCKLLSLDVGALVAGSKYRGEFEERMKGVLKEISESKEMIILFIDEIHLLMGAGASGEGGMDAANLLKPMLARGQLHCIGATTLAEYRKYIEKDAAFERRFQQVIVKEPSVSETISILRGLKEKYEVHHGVTISDAAIVAAANLAARYLTSRRLPDSAIDLIDEAAAAVRVARESQPEIIDSLERKLRQLKIEIHALSREKDEASKARLEQAKKDAENVEEELRPLREKYEQEKQRAKALQEARMKLESLRQKAEEASRMGDHSRAADLQYYAIPEQEAVIKRLEKEKAAADAALNAAAAETGGAMITDVVGPDQINEIVARWTGIPVTRLKTSEKEKLLHMEKHLSKIVVGQKEAVQSVSNAIRLQRSGLSNPNQPPSFLFCGPSGTGKTLLTKALAEFLFDDPKAMIRFDMSEYQERHSLSRMIGAPPGYVGHDSGGQLTEALRRKPFSILLFDEVEKAAKEVLTVLLQLMDDGRITDGQGRVVDARNCIVVMTSNLGAEYLSRPNAKDGKIDPTTRELVMNALRNYFLPEFLNRISSIVIFNRLTRREIRKIVELRIAEIQKRLQDNDRNVKIEVSEEAKDKLGALGYSPAYGARPLQRVLEKEVLNRLAVLILRGSIRDGEVARVVVQDGKITVLPNHPEVNDEDDEMMLDEEDAVDE

SEQ ID NO: 3991 - protein, 309 aa, Neurospora crassa
  unsure (1)..(309): unsure at all Xaa locations
MASASVSSTGTSTSESSSSAGYEQSISPKQFHLGMFEIGRPLGKGKFGRVYLARERSSGFICALKVLYKSELQHGTGVEKQVRREIEIQSNLRHPNILKLYGHFHDSKRIFLILEYAGKGELYKHLRKENRFPEWKAAQYVAQMASALKYLHRKHVIHRDIKPENILVGIHGEIKISDFGWSVHAPNNRRQTLCGTLDYLPPEMIRSGSKDNWYNEKVDLWSLGVLTYEFLVGEAPFEDTPIMTQKRIARADMTIPEWVSKEAKDLIKKVRSHCFPXGWSFNANPLSSCWYSDPEKRLPLEEVENHPWI

SEQ ID NO: 3992 - protein, 840 aa, Neurospora crassa
  unsure (1)..(840): unsure at all Xaa locations
SDSDFIDQLIPVLKDATASGRTATLVQSLSQYAEEREGDIERIGLTQHEEFLGSVSQLQTIREETVALTAEILDLNQSIQASTEKLAEQKQALVDTRRVRQNITDVSDALRESLKIMHAVNNAHDLIRKKKYYGALKSLEDLQNEYLVPIIQNKYATQYRLADLIQKSIPASRKTISEAVMTDLNTWLYRIRETSQFLGEVAFFGTRQRLDRQRERAEQNPYLGHFKLNSAIELVFDESDEFDVLDNEEVQVDFTPLHEALHIHEALGQIDKFRAEYAATRRQQKELLMPSSVNLSSDEEENSLRDLLEQITGFAVIEKATIQRAPQLRSTVEVDELWDSMCQTAIRLISRSLTDVDNAELLLKIKGDIALFIQTMEVSSLVPVEVFGTLICLAELNYSVSTLNNFQLTLFYKYAELLKRRFSDDFQEIVSTDDYMPMQINNAEEYEKVLKVSWYTEEKAQKSSRTSPITCFASEFLHXHEIRFPCVLPFSQMYPLCCIDIRNFLNQFYFFSNDHFQHPNIVDETLRKVAISLLSHFNFMVSRSNRHWQSLDELLTEKVCRTLVERLNSQYLGQIVQILINLEHFEEACHQLEQELIRARSSTSAGGPVSLKSTEEFRSNKKTAEKRIFELVNSKIDDLVDTSDYNWYVRPTAPRDFLPTDHRNRMTPSKPTEPSNYMQTLTRYLENIMGSTLLGLPREIKELIYFDALSHAANKDSGKLPPHSPSELXPLSLMKVFAVLTPPETVLTQCRSSKQALPLSPDVKKINANAVAAMAMDVQHLSAFVANLENAPMLEQNLDELQQTIALMQSDNHDEFFDISTRNKKYGRVDAMNGPILLEK

SEQ ID NO: 3993 - protein, 510 aa, Neurospora crassa
FFYLSGADFPGCAVTYDIPRQELILWIRRNDPRLSLWYGTTPSIDESKSKSDVSDVRYIDGLTAYLHAVLTPENGGGGGPLYVLSPDQLPKLSPSPPQYSFFKGMHGSASRGLKIDTTSLLPAIEAARVIKTPHEISRIRRAVSLTSLAHRMVLQRIKHLTNEREAHAVFEGFCISQGAPHQSYAVIAASGPNASTLHYDANDEPLEGRQTMLLDAGCEWGCYASDVTRTFPLNGKWTKEGEEIYKVVERMQRECIDAIRPGRLYYKLHLVACLIAVEELMKLGILYNGTRSEILARGTVAAFFPHGLGHHVGLEVHDVSGRERLLLTGSTVSSSGVNSQRVPGFQEPRRRMKREQVTPEDLAAMYREAMMDRDDVEQNVVGPPPPYKGRQRLRENMVVTIEPGMFVYFPSLFPLLLFLLPQLFSLFLSSEASSKTNSLTQSYFHRPYIQSFFLSNPDHAKYINTKVLDKYWDIGGVRIEDCILVTKDGYENLTTAPKGKEALKIINAGI

SEQ ID NO: 3994 - protein, 649 aa, Neurospora crassa
MSTDYAYDEEGHLWPFFVFTLTSIVTVPITYSLIKSSRNDPAAALKRIQTDYKHDQSAVVDTLRKSEKRKDGSKPWLIALVIAGWAVMGYMIYLIKTTDAPVQHLWNPYDILGIAESATEKQIKKTYKMLSLKFHPDKARPDASKNETIDDLNRRYVEISKAYQALTDEDVRNNFIQFGNPDGKQGFSINIALPKAIVSDGNGKYIVLIYFALFGVLLPYLVGSWWYGTLRRSKEGVLMESANRLFKEYQDNIDEGGVVAALSSGQEFEDLFKGDKADAGLSKIESKVMASDELPPKEKKKLEDVENGPRRKALALLWAYLGRIELGDATLEKAKFQVAPIAHALNKSFNAIALAYMNTAPLLASYFASQRLIQAIPPKASPLYQLPHFNSAVVRAVEGDSRVHTTVQAFMDQPDAKRRSLVVGKGLLTDAQYKETIAYAKQLPYLRVAKAFFKVTGEKFIIPSSLVTLVVKGRFVPPGSEKVPDVTPIDLEDIDPAEDDLDAILGRKKTKKVVGKDEKGKPIYEESAESEDVYPPLASSPYFARDHSPRWHVFLTDSKQGRVAVPPFTFVSFDRPIYESDGKTPTFAMQTMKAQFQAPPQAGHYTFVMHVVCDSYVGFDTKMEVTLVVEDASRAAEMKDEEEISEPEE

SEQ ID NO: 3995 - protein, 785 aa, Neurospora crassa
SLRILLIGSGGREHALAWKLSQSPSVESIIAVPGNGGTAGLPKVTNNNTVSENDFAGLVDLAKKERINLVVPGPEQPLVDGVENVFREVGIPVFGPSKDAARMEGSKTFSKDFMKKHNIPTAAYENFSDFEKASEYLKKVGHNVVIKATGLAAGKGVIIPESQEEAQQALKDIMLDRQFGNAGDEVVIEEFLTGDELSILSFCDGTTIKSLPAAQDHKRIGEGDTGLNTGGMGCYAPTKIATPALLAQVEREILQPTVDGMRKDGFPFKGCLFTGLMITPNGPKVLEYNVRFGDPETQTVLPLLKSDLAEIMVACSGPIPLLKYVPVEVEQKFSATVVVAAPGYPNSYPKNIPMQVSTPPAGTNIFHAGTKLSGDSLVSSGGRVIAAEAVGETLRAAVDKAYEGVKLINFDGMYYRKDIAHRAFRDEKSSSDKLTYAQSGVSIDAGNELVDRIKAAVATTRRPGADAIIGGFGGEVDLSQAGYPGAPIIVGAIDGVGTKLIIAQKMNKHDTVGIDLVAMNVNDLVVQGAEPFMFLDYYGCSRLDVSVAAAFVEGVAQGCKDAGCALVGGETAEMPDLYTGDDYDAAGAAIGVMKPTQRLPRKEAMAEGDVLIALASSGVHSNGFSLVRKVVDKCGLSYTDKAPWDSSATVGESLLTPTRIYVKPLLKVLAQTGEAVKGMAHITGGGLTENVPRMLPKHLAAEIDVATWEHPPVFKWLRESVVPTEMARTFNNGVGMVLAVAPEAADAVVKGLEAEGEKVYTIGKLVNREGGEKGEWCVLKNLESW

SEQ ID NO: 3996 - protein, 458 aa, Neurospora crassa
  unsure (1)..(458): unsure at all Xaa locations
YHAAATNVAIAAENEYAAHNYHPLPVVFAKAQGVHVWDPEGKHYLDFLSAYSAVNQGHCHPELVKALTEQASRLTLSSRAFHNDVFPVWAAKVRSVFGYDMVLPMNTGAEAVETAIKIARKWAYKVKGVPHDKALVFSAADNFHGRTVSCVLSAKLFTPIFXLKLLQMTAISLSVDPESRDNYGPYVPQIGAVSPSTGKTIRYNNIADLEEVLEAHGKETAAFIVEPIQGEAGVVVPDEDYLQKVSALCKKHNVLFICDEIQTGIARTGRMLCSDWANIKPDIITLGKAISGGMYPVSAVLADKEIMLVVEPGTHGSTYGGNPLGCAVSLRALELVEEEGLVEKAEKLGQIFREGVEAFKSPIVKLVRGKGLLNAVVIDESAAAGRTAWDLCILLKEKGVLVSNVRSFRCXXXCXPQIPAKPTHGNIIRFAPPLVITEEELRGAIKTFGEALQELPTV

SEQ ID NO: 3997 - protein, 1448 aa, Neurospora crassa
STSASSRTQDIEELREEARRNNPNGLSRAVSGISVEQAENDFRELRRELSRASRTQSHANRSTHHGDAEKGQMHVETSSESAPEQFDLEAALRGDLEAEREAGIRPKHIGVYWDGLTVKGIASSTNFVKTFPNAFIDFFDVVTPVVNMLGLGKKMPEATLLHSFRGVCKPGEMVLVLGKPGSGCTTFLKNIVNQRDGFTSVTGDVLYGPFTSEEFLQYRGEAVYNMEEDMHHPTLTVEQTLAFALDVKIPGKLPPGITKQDFKEKVITMLLKMFNIEHTRHTIVGNPFVRGVSGGERKRVSIAEMLITNACVLSWDNSTRGLDASTALDFAKALRIQTDLYKTTTFVSLYQASENIYKLFDKVLVIDEGRQVYFGPTSEARGYFESLGFAPRPRQTTPDYVTGCTDDFEREYQEGRSPENAPHSPETLEAAFNESKFARELEREMADYKQSLVEEKDKYEDFQIAVREQKRKGAGKKSAYSVGFHQQVWALLKRQFVLKMQDRLALALSWLRSIVIAIVLGTLYLNLGQTSASAFSKGGLMFISLLFNAFQAFSELAGTMLGRGVVERHRRYAFHRPSALWIAQIFVDQAFSASQIMLFSIIVYFMTNLFRSAGAFFTFYLMILSGNIGMTLFFRIIGCVSPDFDYAIKFAVVTITFFITTSGYLIQYQSEQVWLRWIYWINILGLSFSSMMENEFSKIDMTCTDDSLIPAGPEYTDINHQVCTLPGSTPGTKFISGKAYISQGFSYNASDLWRNWGIVLALIIFFLIMNVVLGEIMNFSGGGSLAKVFQRPNEERKKLNAALQEKRDARRKARKEHDGSDLKINSESILTWENLTYDVPVPGGTRRLLNNVFGYVKPGQLTALMGASGAGKTTLLDVLAARKNIGVIGGDILVDGIKPGKEFQRSTSYAEQLDVHDPSQTVREALRFSADLRQPFETPREEKYAYVEEIISLLEMETFADAIIGSPEAGLTVEQRKRVTIGVELAARPQLLLFLDEPTSGLDSQSAFNIVRFLKKLAAAGQAILCTIHQPNAALFENFDRLLLLKSGGRCVYFGDIGKDACVLSDYLSRHGAVPKETDNVAEFMLEAIGAGSAPRIGDRDWADIWADSPELANVKDTIQQMKEARKSAGEQVNHDLEREYASPLWHQLKVVTHRTNLALWRSPNYLFTRVFSHAVIALITGLTFLNLDLSRESLQYKVFVCFQVTVLPAIVISQVEVMYHIKRTIFFREQSSKMYNSFTFAASMVIAEMPYNIFCAVIFFVFVYYMPGLNSESSRAGYQFFMVLITEVFSVTMAQCLSALTPTVFISSQFDPFIMITFALFCGVTIPAPQMPKFWRKWLYELNPFTRLIGGMVVTELHDLPVICKDYELQSFTAPAGQSCGEYMEPFFKRGGAGYLVNNATSACQYCAYKVGDQFYEPLGISFDNRWRDLGIFLAFIGSNLIILFMA

SEQ ID NO: 3998 - protein, 694 aa, Neurospora crassa
  unsure (1)..(694): unsure at all Xaa locations
DPNTLSNYDAWRTRHTTANLKIDFTAKCLRGSVILELESQTDKASKEIVLDSSYVTVNSIKLNSAPSLWETKARTEPNGSPVHIAVPEGAAKGEVVKVEIELATTDKCTALQWLTPAQTSDKAAPFMFSQCQAIHARSLFPCQDTPDVKSTYDFNITSPYVVVASGVPVPDETKDLGEEKLYKFQQKVPIPSYLFALSSGEIASAPVGKRSCVCTGPNELKASQWELEGDMDKFLEAAEKIVFPYRWGEYNVLVLPPSFPYGGECKKARXREXRYAVNADNVPPPIGMENPIFTFATPTIISGDKQNIDVIAHELAHSWSGNLVTSCSWEHLXVAGHWSINHRXLLTSGXWLNEGWTMYLERRILASIHGGDAHFDFSAIRGWKALVRINDTDQNPASPLSLLEXEVPTNNCLTEEAIKEYGEDHEFTKLCISHKGIDPDDAFSTVPYEKGFHFVWSLDRLVGRENFDKFIPYYFGKWSNKSLDSYEFKDTFLEFFSAPEYSDLKDKIASIDWEGRFHSTGLPPKPEFDTSLADVCYELAEKWKSKDFTPSPSDVASWTGNQVLVFLNAVQDFEEPLTVEQSVSFRCLPLYFQSAVRXYNHSKRLAKAYGLSESKNAELKAAYYHIAMRSKDASAYQGVADLLGEVGRMKFVRPLFRGLNKVDRELALKTFEKNREFYHPICRQMVEKDLGVSE

SEQ ID NO: 3999 - protein, 435 aa, Neurospora crassa
  unsure (1)..(435): unsure at all Xaa locations
MCFGGRGKDDEAEASRSRELDKQIRADEKRLSKEVKLLLLGTDLQLLLDPALRPRRLXHLASIGAGESGKSTILKQMKLIYAQGFSKNEKLEWRPVIFANILQSFRLIFDAMNEFNIKLEDEDNEASLIQWTLISAVLQLTXVLTKNMVQMMVDYEMRGDEPLPLEYFEPAKKLWQDSGVRQAIEKGNEFALHDNLQXVCVRNPLSMFLHLANLSFSFCSDLDRLWDRNYVPSDQDLLRSRLRTTGITETVFDLGQLTYRMFDVGGQRSERKKWIHCFENVNCLLFLVAISGYDQCLVEDKDGVRPSPACCXEGGGXPLRRTKMNEALMLWESIANSHWFTKSALILFLNKIDLFKEKLPRSPITNHGFTDYHGPPDDSKQASKYFMDKFRALNRNPDKEIYGHFTNATDTNLLKITMGSVQDMIIQRNLKQLIL

SEQ ID NO: 4000 - protein, 337 aa, Neurospora crassa
  unsure (1)..(337): unsure at all Xaa locations
KESQYLPEELPIWNFDGSSTGQAPGENSDVYLKVSXSRLWHSCTLCRTMALTXLSSHSPVAVFPDPFRGSPNILVLSECWNADGTPNKFNHRHEAAKLMEAHADQVPWFGLEQEYTLLDINDRPYGWPRNGFPAPQGPYYCGVGTGKVVQRDIVEAHYKCCLYAGVKISGTNAEVMPAQWEFQVGPCDGIEMGDHLWLARFLLHRVSEEFGAKVSFDPKPIPGDWNGAGLHTNFSTENMRKEGGMKYIEDAIKKLEARHKEHIAVYGEGNDKRLTGRHETGSIDSFTYGVANRGASIRIPRECGAKGYGYFEDRRPASNADPYQITGIIMETCFGAV

SEQ ID NO: 4001 - protein, 475 aa, Neurospora crassa
  unsure (1)..(475): unsure at all Xaa locations
KNIPDVDFDVGESYAGTLPISQDPEEKSELFWWFFPSTNPAAKKEILIWLNGGVSSTLSNPXYEYISLTNYTFLPGCSSLEGFLQENGPFLWQYGTYKPVKNPWSWHTLTNVIWVEQPVGTGFSTGNVTATSEEDVAAQFMGFWKNFIDTFAMQGYKVYITGESYAGLYCPYIASAFLDANDKTYYDMSGLMIYDPVISWDEVAEQVPVVQFTEYWSGLFPFNDTFREHIKSVDAKCGYSDFVSQYLVYPPKGLQPSKLPGTDKTGTTRDECWGLFYEIFDAILLLNPCFNIYQVATTCPLLWDVLGFPGSMGYLPEGAKVYFDRDDVKKAVHAPENVKWSSCSEQNVFVGGRDRSEPSSFHALPHVIDATKNVIIGHGALDMVLIANGTLLGIQNMTWGGKLGFQNKPDQPFYVPYNTMSDLSTLAAGGVFGSMGSERGLTWVQIDMSGHMVPQYAPSAAYRQLEFLLGRVNCL

SEQ ID NO: 4002 - protein, 278 aa, Neurospora crassa
  unsure (1)..(278): unsure at all Xaa locations
SPQGRIFQVEYAAEAVKQGSVVVGIASKTHAVLVAIKVLRPDHPSRTTLPIHVSSHPSXGQVKLTMFLSLCPRNAEELSSYQKKLFPIDEHVGIAIAGLTSDARVLSNFMKQQSLGHRLTYGRNMPVRTLVDMIGSKAQINTQHYGKRPYGVGLLVAGVDDHGPHLFEFQPSGMTEEMVAFAIGARSQMARTYLEKNLEAFADCGREELIRHGLKALKESLVQDRELTIDNTSVAIVGVEKQEDGTTKPQPFMVYDGQDVSAWIESVADNQEAAPAAA

SEQ ID NO: 4003 - protein, 281 aa, Neurospora crassa
ATLIFIHGFSDHINRYYGFFPSLAARGIAVYGFDQRGWGRSVKKPADRGLTGPTSRVIADMVAFIEPHLSDAPGAPPVFIMGHSMGGGQVLTLALRRAVPGAHRQPSAGLAAGEPLHRVCPELKPGFIKVYGGRFASKIFPHRQLVNKIPPEDLSRDPEVQKSIAADELLHNTGTLEGLSGMLDRTDGLTRGTIRPVGGENTKIKAIWLGHGSSDKATDYNASKRYYDRVIASTVKDRMFKRYEGWFHQLHADGPCSEEFYKDVGDWILERSEDADSGKFE

SEQ ID NO: 4004 - protein, 551 aa, Neurospora crassa
  unsure (1)..(551): unsure at all Xaa locations
CSYLHKNVCEYPTVTSAKAVFPKPKPKKPAEPRRSGKKVKVLHLSDLHLGEATCXIIFRSANMLTTFDPRYSVGSEANCTSYMCCRYSEPPANGTVPEISVSAPLFGYYKCDSPFYLALAALQSIGPLTGTSAKNPPAFSLYTGDLIAHDDENQASRAYVEATEVAIWETFKAYIGGPIYTALGVSSTRNRXNPFYSEPAXNSPPNAVXNHDTTPADYEAPHAIDNNSTLGSQFSWNYAHVSSLWAHYNWLPSSVAQQASTHYAAYAVSPPHHPNLKIITLNSDLYYQHNPFALLNASNPDYSGMFSCLITELQAAEDAGQRVWIVAHIPTGWDGGSALPNSADYFYQIVERYSPHVIANIFFGHSHEDQATIYYRNNGTAQTREEALVTGWVGPSLTPLQNLNSGYRMYEVDTGSWEVMEAFTFYSDVGSYTNLSSSVDGEGNGGQGEGPVFKLEYSTRATYGPAVNWPSDAPLNATFWHGVTEAMERNRTLAELFTQYQGKSSAKSKKCETEECTKAKICYMRSGSTALGKQCKQGYGSVQXGSVGFLW

SEQ ID NO: 4005 - protein, 383 aa, Neurospora crassa
RPTLDRPFGIHLWPIFSKAFEAVVGYPAEDFRFVPGETPMSTLKETSIFIVIYYTIIFGGRELMRNREPFKLRTLFLIHNFYLTAISAILLALFIEQLLPIVVRGGIFHAICHIDGGWTQPLVVLYYVCCCGSPPDGLLGSALTLCSLNYLTKYLELLDTCFLFLKKKPLSMLPLKKRMSRAVQRFLTFCSFLHCYHHGATALLCYTQLIGSTSVSWVPITLNLTVHVVMYWYYFQSARGIRIWWKEWITRLQIIQFIIDLGKFFFFSFATISSPTLTLCAYRLCLLRSYTYFTSTYFPWMPNAGKCAGEEFAAFSGIGILSSYLVLFISFYFATYKKDGKRPTGRKSLRRMSQAPLPDPKDIVSAKASGARPSGAATARSRK

SEQ ID NO: 4006 - protein, 786 aa, Neurospora crassa
  unsure (1)..(786): unsure at all Xaa locations
MAHDNREPREVKNHLLFEVATEVAHRGMRKSINCARKELPIXQLFXVGGIYSVLKSKAPVTTAEYGDRYTLIGPLNHQSVRCSCALYTVAXNMVVDRNDSRRAVEVEELEPSNPELKATIQAMRDRGIGILYGRWLIEGAPRVLLFDTKTAYGYMNEWKTDLWNVASIPSPDNDEETNEAIVFGYLVAWFLGEVSTCVTKQRGARSXQNRSLYCHEKRKAVIAHFHEWLAGVALPLTKKRQIDVTTIFTTHATLLGRYLCAGSVDFYNNLQWFDVDAEAGKRGIYHRYCIERAAAHSCDVFTTVSHITAYESEHLLKRKPDGVLPNGLNVTKFSAMHEFQNLHQQNKEKIHDFVRGHFYGHYDFEPENTLYFFTAGRYEFRNKGVDMFIESLARLNHRLKTAGSKTTVVAFIIMPAQTTSLTVEALKGQAVIKSLRDTVDVIERGIGRRIFERSVKWHEGDPLPEEKELITSQDRVLLRRRLFAMKRHTLPPIVTHNMLNDHEDPILNQIRRVQLFNHPSDRVKIVFHPEFLSSANPVLPLDYDDFVRGTHLGVFASYYEPWGYTPAECTVMGVPSITTNLSGFGCYMEELIENSSDYGIYIVDRRSKGVDDSVNQLTQYMFEFTQKSRRQRINQRNRTERLSDLLDWKRMGMEYVKARQLALRRAYPTSFNGEEEEDFIPGVEQKISRPFSVPGSPRDRTGMMTPGDFASLQESHEGLSTEDYVAWKLPXVMVMSSQHVEKXYXLFXFXXGRDPEEYPFPLTLKQRTGPGSPLDSIQGLQLNGTR

SEQ ID NO: 4007 - protein, 288 aa, Neurospora crassa
IGSGTYGKVFKALNVYTKKQVALKRIRMEGERDGFPVTAVREIKLLRSLSHRNIVKLMEVMVEMNECFMVFEYLSHDLTGLINHPNYTLDPAQKKHLALQLFEGLDYLHTRGVLHRDIKAANILVSNEGVLKLADFGLARFYAKHHQLDYTNRVITIWYRSPELLLGETQYGPAVDIWSAACVMMEIFTKRAIFPGDGSEINQLDKIHSVLGTPTRNDWPNIIEMPWFELLRPTQRRANVFAEKYKELVTPAAFELLLWMFKYDPDKRPSAAQVLAHPYFTTEEPAPR

SEQ ID NO: 4008 - protein, 416 aa, Neurospora crassa
EQRLINEEYKIWKKNSPFLYDMMLSTALEWPTLTTQWFPDVKNPKDKSHTVHRLLLGTHTAEGKPNYLQIAEVEIPKMVELNPRDYDEERGEIGGYGSKASSGEPLCIRFKITQKIDHPGEVNKARYQPQNPDIIATLAVDGRVLIFDRTKHSITPSGTPSPQLELIGHKEEGFGLNWNPHEEGCLVTGSEDKTVLLWDLKTYEGTSKQLKYSRKYTHHSHIVNDVQHHPLVKSWIGTVSDDLTLQIIDVRRPETDKAAIVARNGHSDAINALAFNPRVETIIATASADKTIGIWDMRNMKSKVHTLEGHQDAVTSLEWHPTESAILGSGSYDRRLLFWDISRVGDEQTQDDAEDGPPELLFMHGGHTNHLADFSWNRNDPWLVCSAAEDNLLQIWKVANSIVSKEPADMSTPELD

SEQ ID NO: 4009 - protein, 444 aa, Neurospora crassa
  unsure (1)..(444): unsure at all Xaa locations
IESNYDETVDSFDEMNLKPELLRGKNTIPDRAVYTCSYADRRCXGIYAYGFERPSAIQQRAIMPVIKGKKIPLLDTMGNSRXLFKGHDVIAQAQSGTGKTATFSISVLQKIDPSLKACQALILAPTRELAQQIQKVVVAIGDFMNIECHACIGGTSVRDDMKALQDGPQVVVGTPGRVHDMIQRRFLKTDSMKMFVLDEADEMLSVCILSSAHNRSDAERXPFSFLQRGFTEQIYDIFQLLPQSTQVVLLSATMPQDVLEVTTKFMREPVRILVKKDELTLEGIKQFYIAVEKEEWKLDTLSDLYETVTITQAVIFCNTRRKVDWLTDKLTARDFTVSAMHGDMDQAQRDLIMKEFRSGSSRVLIATDLLARGIDVQQVSLVINYDLPANRENYIHRIGRGGRFGRKGVAINFVTADDVRMMREIEQFYSTQIEEMPMNVADLI

SEQ ID NO: 4010 - protein, 899 aa, Neurospora crassa
  unsure (1)..(899): unsure at all Xaa locations
VTRIVTPGTLIDENFMDPYANNYIMAIHLPSDSLEGSSSFQEALNTGTGQKKESLVGLAWLDLSTGNFYTQQTSLIALGSVLLRVSPREIVLDKSLESAEGHDILSVLNEERYPVTYSPQSENIQTLKDWAPMLDAKIPTETVIRFTDDEIKAGNVLLHYVTDRLQGLSMKLQPPIRHDNMQIMTIDKNSMRSLEIKKTMREGFFAGSLLHAIRRTVTKSGARLLNEWLSKPSLLPLCSLCRXIKSLTDLGAPSTSLSVINSRLDLITRFISNPDLSDAITVLLHRSHDTQRLVQKFALNRGDADDLLRLASTIKATEDIVNHLKSTMSSEDNNPEEDDCLTKLIDRISLEQPLKLAKRIWDAIDEEGLVQQHQLEDSETGEMLALAQEIVKGEGTEEDGRALLPKGATAKSNRARAELTQNRNQQEKDLSKDNRKMSLRNYYGEDNQVWIMKPKANRALAKLHAELRSLQEQKEKLTEEFRAKYAAPSLTLNWKAGLGHVCVVRGRDARLAMGETSRRTRTSSSSSNSMSDPIADTTDADAADADGEPIPEPVPEPESLSTLRTLSTTRTTRTFHHPLWTSLGESLDHVRLRIRSEETALFSSLRSNVVTLLIKLRRNALVLDELDIATSLARLATEQNLVRPILHDSSTTNGSQGMGTRTVIVGGRHPTVEPSLLSRGMTFQKNDCLIGSPGQGAIWLITGPNMAGKSTFLRQNALITILAQMGCYVPADYAELGIVDAIFSRVGSADNLYADQSTFMVEMMETAAILRQATPRSFVIMDEIGRGTTPEDGTAVAFASLHHLLTVNKCRGLFATHFHAVGDMLKEQGLVVEDGASSAGASWGVAMYCTDVEEDESGGFVYVHKLRKGMNRQSHALKVARLAGLPEPAIKIAQQVLAV

SEQ ID NO: 4011 - protein, 1062 aa, Neurospora crassa
  unsure (1)..(1062): unsure at all Xaa locations
MGGESATQSKPISAYPLRAPKPVGQYITNIYKDRISQFYAKGQWEHNNLNAMMYEGVAEGEPHVKLFVWDAPDQDRPTFDEAVKHEFRKTEVGARFGPAWSTHWFKVVLTVPEDLRDKRLLELHWDANNEGMVWTHDGKPLQGLTGGGERTEWILPDSFRDGKEHIIYIEMACNGMFGAAGGGDIIQPPDPNKHFRLDKAEIVAVNPDARQLYIDIWIIGDAAREFPSESWEQHQALKTCNEIIEAFELGNKDSLKKCREIAQQYLGPDVDSARVYDTKRGKAPLVFGIGHCHIDSCWLWPWDETKRKVARSWSNQCDLMDRYPELNFACSQAQQYKWCKTLYPHVWERVKSKVADGRFHPIGGSWVEHDTNMPSGESLVRQFVYGQRFFESNFGKRCQTFWLPDTFGYSSQLPQLCRLAGMTRFLTQKLSWNNINKFPHTTFNWVALDGTQVICHMPPSETYTAEAHFGDVKRSMSQHKSLDQDHTSLLVFGKGDGGGGPTWQHLEKLRRCRGISDTVGLLPRVSLGGSVDDFFDSLERKADSLVTWFGELYFELHRGTYTTQANNKKFNRKAEFVLRDIEQLATIASLKDKDYKYPKKEIDEMWEATLLCQFHDCLPGSSIEMCYDDSDKVCLGLISLFVMKDYXLPFDQLYAQIFKTGERLLRDACKALGVFQVDATGVERGIALNTLPWYREELVEISKGDFALAKGVGPLLKLQQYEIMQVDDGVKLHKLSNGVFVLENKRLKVRVEAGTITSLYDKYDRREVIPEGQRANQFVIFDDKPLYWQAWDVEVYHLDTRKELQSSETQVHEEKTHRVSVITKTKISEQSHISTIISLSAAVNELQSYIEVQSTVEWHETMKFLKVEFPVDIRNTEASYETQFGIVRRPTHYNTSWDMAKFEVCCHKFADLSEHGYGVSILNDSKYGFATTGSLMRLSLLRSPKAPDAHADMGAHTIRWAIFPHTGSLGAMTVRKAYEFNNPLKLLESPHSFATLDEQEPPVWFTDNSNPSLILDTIKRAEDDEDVSVETIESPVKKKKGQSVILRIYDSLGGRARGTIET

SEQ ID NO: 4012 - protein, 830 aa, Neurospora crassa
  unsure (1)..(830): unsure at all Xaa locations
IPSFASTQLTLLSSELAAEIAENSELIGLHTPTALQRAGLALTNLVVNAQRTGYGGKTVLELGPDSATVTITSSSSSSSSGQKGGGYDGPELPEHGIRTGDIVVVSEQPAGSAKKREVRELEKKGAKGVVTRVGRGVVGVALDEDKGEENVVGTGGLGGSGRVWMVKLADDVTYRRXAFDDLMREXELGRGGRFGLVDDERKAKKENRGWGNRNLMVITVKPQLTRXLQDERNHGEASEDERVGTSMFIRVLFGQSSPSPVPADLTNDPEVGNIDWVDPTLNDSQKDAIRFALASREIALIHGPPGVCLYVPSPQSVAYMSNPPLQTGKTHTLIELILQLLRRDLRILVCGPSNISVDNIVERLSPHKLPILRLGHPARLLPSVLSHSLDILTTTSDAGAIVKDVRAEMDAKQASIRKTRNGRERRAIYAELKELRKEYRERERRCVSDLVGRSKVVLATLHGAGGYQLKNEEFDVVIIDEASQALEAQCWVPLLWAKKAVLAGDHLQLPPTIKSLNSRAATTKEKKEGQTLETTLFDRLLTLHGPSIKRMLTTQYRMHEKIMRFPSDELYESKLVAAEHVRERLLKDLPYEGVEANDDTTEPLIFIDTQGGDFPEKNEEELDGNGSTDKKKVIRSLHGESKSNEMEAALVRQHVRGLIKAGVRPDDIAVVTPYNAQVSFFFFSPSLIVIHSWCSCLFPFPTWFLFFFGRKKRNAYPGSPYALHETTCCVHPCHDMEKHITRPXQLTNSSFVLAXSQLSILAPLKDEFPGIELGSVDGFQGREKEAVIVSLVRSNDEGEVGFLGEKRRLNVAMTRPKRSLTVIGDSETVK

SEQ ID NO: 4013 - protein, 283 aa, Neurospora crassa
VIAPLDVVKIRLQLQHHSLSDPLLHQRRAEIIGGGPVYKGTLPTIRHILRTEGLTGLWKGNIPAELLYVSYAAVQFTTYRSITQFLQAAFPKDQNKQLPPSVESFIAGASAGGVATAVTYPLDLLRTRFAAQGVERVYPSLVQALKTIYASEGVTGYFRGLGPGLAQIIPYMGTFFCVYETLRPRLSKLELPYSSGSAVAGVLASVMAKTGTFPLDLVRKRIQVQGPTRGMYVHKNIPVYDGGMVKTVATIVRREGVRGLYRGLTVSLFKAAPASAVTMWTYE

SEQ ID NO: 4014 - protein, 461 aa, Neurospora crassa
  unsure (1)..(461): unsure at all Xaa locations
DFEIIKPISKGAFGSVYLSKKKSTGEYFAIKVLKKADMVAKNQVTNVKAERAIMMWQGESDFVAKLYWTFSSKDYLYLVMEYLNGGDCASLIKVLGGLPEDWVKKYLGEVVLGVEHLHSRGIVHRDLKPDNLLIDQKGHLKLTDFGLSRMGLVGRQKRALNNGADAAPDLLKQGPFVRSSSIASSRSTSLDVHARNPSPLSTPQMTPSDYGAGLGQPSYFNLGVLSQEPRRLCANRSDSGGSEALSHMLPNLSLNDTLSVPPQAIQSPGRAXRSRRGHNSRLRLALPRNHAKQRRRQQRYSSTTASYAPAELGAFRPSGYQSPFCGTPDYLAPETIRGEPQDETSDWWSVGCIMYEFLYGIPPFHAPEAEQVFGNILARKLEFPDDSDMEISSEAKDLINKLLCSDPHQRLGANREDKFQSGGEEIRSHPWFEGVNWETLLQDDAQFVPQPEHPEDTEYFD

SEQ ID NO: 4015 - protein, 470 aa, Neurospora crassa
FRNAVLPGAGLGLEGYVLFSIGNIEPLFKATWPQCWGHNATECSSNWIAAVTYLEVIGIMVGQLVVGVIGDWIGRRWGLIQDAAIMFVGLLMLTASWGLTLQGWVICYAWSLFFYGKFLLKAQQSRITCKANTFCLAGFGVGGEYPITATSSMENSVASGKLSTRNDRLHRGRKVTTAFLMQGWGQLINQALLIILLLIFHAGSGSPPYGLATVQWTFRLSFAIPAVGTLWLVYYRTYKMPHASRQLIAAKKKTNVTGYDFDSLAMTTRHFGGRLLATAGCWFCNDVFFYGNKLFQAQFIAVISGGSSSVLTGWIWNLYNVIISLVGYYLASLLMDNRFYGRKMMQQVGFLMCFIMFVVPAFKLEYYTSPAGIKSFQAMYFLSSFFNQFGPNSVTFLVAGEVFPTPIRASAHGFSACCGKAGALLASVLYNYIDTQTKFYVVPWFGLAGMILTWLFLPDTTGLDLKEQER

SEQ ID NO: 4016 - protein, 457 aa, Neurospora crassa
  unsure (1)..(457): unsure at all Xaa locations
ADQERQHALASFKAKLIESREWEAKLKNLRLELKGLQKEYDQTEENIKALQSVGQIIGEVLKQLDDERCTSCIPYPFSGDHYELIMPQLIVKASSGPRYVVGCRSKVDKAKLKQGTRVALDMTTLTIMRMLPREVDPLVYNMSLEDPGQVSFGGIGGLNDQIRELREVIELPLKNPELFLRVGIKPPKGVLLYGPPGTGKTLLARAVASSLETNFLKGSSHPLCLASXRRQYSNTCHXYCAFVVVSSAIVDKYIGESARLIREMFGYAKEHEPCIIFMDEIDAIGGRRFSEGTSADREIQRTLMELLNQLDGFDYLGKTKIIMATNRPDTLDPALLRAGRLDRKIEIPLPNEVGRLEILKIHASGVVIEGDIDYESVVKMSDGLNGADLRNVVTEAXVDNFLLLKKCRPCSTQLTLLFYIVVCFAIKDYRDAINQDDFNKAVRKVAEAKKLEGKLEY

SEQ ID NO: 4017 - protein, 725 aa, Neurospora crassa
  unsure (1)..(725): unsure at all Xaa locations
DSANLGLSRLEYRGYDSAGLAIDGDKKNEVLAFKEVGKVAKLKELIDSQNLDLEETFDSHCGIAHTRWATHGPPSRVNCHPHRXVLRLSGTAFEQWTSSDQVNHSSDPNWEFSIVHNGIITNYKELKTLLEGKGFKFETETDTECIAKLAKYLYDQHPTVGFTDLAKAVINELEGAYGLLIKSVHYPHEVIAARKGSPLVIGVKTQKRMKVDFVDVEYADDQPLPAETASQNVALKKSAAGLLSPNGLLGAADKSLLHRSQSRAFMTDDGMPMPTEFFLSSDPSAIVEHTKKVMYLEDDDIAHIHEGSLNIHRLKKADGSSNVRTIQTLELELQEIMKGKFDHFMQKEIFEQPESVVNTMRGRLDVANKTVTLGGLRSYIDTIRRCRRIIFIACGTSYHSCMAVRGIFEELTEIPISVELASDFLDREAPVFRDDTCVFVSQSGETADSLMALRYCLERGALTVGIVNVVGSSISMMTHCGVHVNAGPEIGVASTKAYTSQFIAMVMFALSLGEDRASKKERREEIMEGLGKISEQISSVLTQDRKIKQLCEERFRNQKSLLLLGRGSQYSTALEGALKIKEISYLHCEAVMSGELKHGVLALVDENLPIIMILTRDKLFRKSLNAYQQGTFTTFSQXLKPTDKMLTLAPSTVVARKGKPVVICNESDAEFQTSDAVKIEIPKTVDCLQGILNVIPLQLIAYWLAVMEGLNVDFPRNLAKSVTVE

SEQ ID NO: 4018 - protein, 282 aa, Neurospora crassa
  unsure (1)..(282): unsure at all Xaa locations
QPRDDVYGAYDHSYLQNSGPKQATQAPIVTGTSVIAMKYKDGVVMAADNLGMLRKKIKXHPSHITPCXLVLENSSYGSLARFPDVKRLRVFLDSSVVGFSGDVSDMQFLDRHLTDLSIDEAYEDPSCTAAPNGKGHLNAANLHKYLQKLLYKRRNDFDPLWNQLLIAGFDGHSKPYLASVDLRGTSFTSPSLATGFGSALAQPIMRRYAETEEDAAKLTREQAVEVIKECMKVLYYRDARSLDRYSIAVVTKDGVELKEDEQLEKQSWAFAERIKGYGTQTV

SEQ ID NO: 4019 - protein, 611 aa, Neurospora crassa
  unsure (1)..(611): unsure at all Xaa locations
SSGLRKKVTVFQQPHYSEAFITSILLSIPEGAKVGEYTSQYQNLDTPSFNCKWALGADRLIQSIIGAFLVIGGDGRFWNPEVIQLIAKIGAAYGVKKLLIGQDGILSTPAASHVIRKRKATGGILLTASHNPGGEEQQPPXLSRLTRCXQWLRSKNDFGIKYNLANGGPAPESVTNKIYEVSKTLTSYKIASIPNIDISTIGTKTYGDLEVEVVDSTADYVEMLKDIFDFDLIKKFFATHPDFKVLFDGLSGVTGPYGKAIFQQELGLGSESTQNCEPSPDFNGGHPDPNLTYAHSLVETVEKNNIPFGAASDGDGDRNMIYGAGAFVSPGDSLAIIAHHAQLIPYFKKNGVYGLARSMPTSGAVDLVAKKQGLNCYEVPTGWKFFCALFDANKLSICGEESFGTGSNHIREKDGLWAIVAWLNIIAGLGVANPGVAPSIKQIQKDFWAEYGRTFFTRYDYEDVDSEGANKVVGILRDLVADPNFVGSKVGGESCDDCPYQAVLQMLTGDPFLSRSYVTEAGDFSYTDLDGSVSSNQGLYARFSSGSRIVVRLSGTGSSGATIRLYIEQHSTDPATYDMDAQDFLAPEIKMATELLKFKEFVGRDEPDVKT

SEQ ID NO: 4020 - protein, 715 aa, Neurospora crassa
  unsure (1)..(715): unsure at all Xaa locations
PDPRITTELLKHQKQALYFMTEREKDLIQDYGDKLTRSTWQRRKDPRGVDFYYNVVTMQNQRERPPPALGGILADMMGKLFVYSHYECSDXQFAIRLGKTLSILSLITKTMDQAAAWSLEAPVQPPKPPEKKQPNAARYFEVPKPQAMGLTPVRLNGKATLLVCPLSTVTNWEEQIKQHIKPDTLSYHIYHGPNRVKDVKKLAQYDLVITTYGSISSELNARAKNKAGIYPLEEIAWFRIVLDEAHMIREQNTLAFKSICRLQASRRWAVTGTPIQNKLEDLASLLAFLRVKPFDEKIKFLQYIIAPFKNADPEIVPKLRVLIDTITLRRLKDKINLPPRTDEIIRLDFTPEEQRVYDWFAKTAKERVSVLTGQAIGQERIIGGKTMIHILRSILQLRLICAHGKDLLNEEDLKELQGMTADTAIDIDSDDDSGQLVLSESKAYEMLYLMQEGNSDNCARCNTKLGSNEVVDVESERQEDIIGYMVKANCYHVYCNKCVDHIKNEACPTCSGMTRPGCINSTAPVPWPNTNREPPRSRTGDANQDLTAYSGPHTKTRALVAELLADKQKSEAAPHEPPYKSVVFSGWTSHLDLIELALEDAGITFTRLDGKMTRTARTAAMDKFREDPSVQVILVSIMAGGLGLNLTTASSVYVMEPQFNPAAEAQAVDRVHRLGQKRPVRTVRYIMANSFEEKMLRLQEKKKKLASLSMDGRDK

SEQ ID NO: 4021 - protein, 443 aa, Neurospora crassa
HEYNITRPKGYTVSYHFNPDMEPHHFGLTHPMKPFRLTLTKSLVTAYGMNFAMDNYNTRIATYEELNSFHTSDYLDYLHMAPPEEMPRDIDNPDKEVKFNLGGSDCPLFHGLYDYCSMSAGSSLDAARKICNKQSDIAIAWGGGLHHAKKSEASGFCYINDIVIAILQLLRCYPRVLYIDIDVHHGDGVEEAFHSTDRVLTCSFHKFAPEVFFPGTGGLDDNGPKSEHNPGAHHAINVPLNDGITDEQYGHLFQSVIGKINEKFRPSVIALQCGADSLAGDRLGRFNLQVQGHGACAKFCKTFGIPMIMFGGGGYTPRNVARAWAYETSVAIDVDEKINKIIPDHTPWRKHFVQEELFPSLEQILGEPRANRNSQKRLQEIIQHVHEQLRFVNAAPSVQQQVIPPDLGGIRDDVEDRLKEESEERDEGLRRDREEGLGISGEF

SEQ ID NO: 4022 - protein, 510 aa, Neurospora crassa
  unsure (1)..(510): unsure at all Xaa locations
AFENTSTSIAAAQMRNALTKLAETVKDPDQKKLFETEMDNFFSLFRRYLNDKAKGNEVYVSXHALSPAALLSQTANXLFTANWDKIAPPAPHQIVDYESLANNNSVDFLNKLAVLKLNGGLGTSMGCVGPKSVIEVRDGMSFLDMSVRQVEHLNRTYGSNVPILLMNSFNTDDDTAAIIKKYEGHNVDILTFNQSRYPRIYKDSLLPVPKSFDSPLHDWYPPGHGDVFESLYNSGILDKLIERGIEIIFLSNADNLGAVVDLRILQHMVETDAEYIMELTNKTKADVKGGTIIDYEGSVRLLEIAQVPKEHVNEFKSIKKFKYFNTNNIWMNVQAVKRVVENNELELEIIPNEKTIPGDKKGESDISIVQLETAVGAAIKHFKGAHGVNVPRRRFLPVKTCSDLMLVKSDLYTVKHGQLQMSSARFGDAPLIKLGNDFKKVSDFQKRIPSIPKIIELDHLTITGAVNLGRGVTLKGTVIIVATEGQTIDIPPGSILENVVVQGSLRLLEH

SEQ ID NO: 4023 - protein, 384 aa, Neurospora crassa
MDSVPAQTHQGFKEAGAASASHLTTTTSLPTKVESRTAVMEALEDIVYGSVRSLTNNIHNLSNLSLTHLSIAAGIVGKYIEYPFDTVKVRLQSQPDHLPLRYTGPLDCFRQSIRADGFLGLYRGISAPLVGAALENSSLFFFERIGRSLLYSSGFAPRDSELSLSALWFTGGFSGAFTSLILTPVELVKCKIQVPDEPGGAGARQRQLKPIPVIKEIFRHEGLRGFWHGQLGTLIREAGGCAAWFGSKETTSKWFRGRNERALLKRGASQEEVVASRERPLPLWQQAIAGASAGMSYNFLFFPADTVKSRMQTSPIGGGGDNGGKGAATMMPKKSFGEEARALWKQAGIKGFYRGCGITVLRSAPSSAFIFMVYDGLKKYFPMA

SEQ ID NO: 4024 - protein, 702 aa, Neurospora crassa
RREPPDLAALLRKKKEEEAAAAKPRFIPKKERERLEAEKKAKEEEERKRKEEAKPQPNGTNHNGNRMDGIQSHHNHNPQRNIPTGPKAMRYDDDRGPNGMSNGRDYRDNRDNRDNRDRNQRGAKRGAPNDDEEKRAKMERNDEAELRARYMGPVVNQSTFSAKKKRRRTAANKFNFDWDADDDTSRPFDPIYAERQEPLVRLGGYEMTEEMVMRKAEAIRRGDPETGEERARQYLEQHRRIKEMEQRKNLGKHWSEKKLEDMKERDWRIFKENFGIATKGGAIPNPMRSWEESTLPRRLLDIVKNVGYDEPTPIQRAAIPIALQARDLIGVAVTGSGKTAAFLLPLLVYISELPPLTEYNKNDGPYALILAPTRELVQQIESEAKKFATPLGFTVVSIVGGHSLEEQAFALRNGAEIIVATPGRLVDCLERRLLVFSQCCYTIMDEADRMIDQGFEEPLTKILDAMPVTNEKPDTDDAENPQLMSRYVDGKDRYRQTMMYTATMPPIVERIAKKYLRRPAIVTIGNAGEAVDTVEQRVEFVSGEDKRKKRLQEILNSGQFKPPIIVFVNIKRNCDMVARDIKGMGYSAVTLHGSKTQEQREAALASLRNGQTDILVATDLAGRGIDVPDVSLVVNFNMATNIESYTHRIGRTGRAGKSGVAITFLGPEDNDVLYDLRQIISKSSISKVPDELRRHEAAQNKP

SEQ ID NO: 4025 - protein, 323 aa, Neurospora crassa
  unsure (1)..(323): unsure at all Xaa locations
MGHEDAVYLAKLAEQAERYEGTLNQSMPDADRHRLISSAVQEMVENMKIVASEDRDLTVEERNLLSVAYKNVIGARRASWRIVTSIEQKEESKGNSTQVSLIKEYRQKIESELAKICEDILSVLDQHLIPSATTGESKVFYHKMXAYNAPSRLPCRSLTPVTGRGDYHRYLAEFAVGDKRKDSADKSLDAYKNATDVAQTELPPTHPIRLGLALNFSVFYYEILNAPDQACHLAKQAFDDAIAELDTLSEESYKDSTLIMQLLRDNLVSTLEEVGFGXTALTLFFSHRLSWTSSEAEAPAAQGEAAPEEPKADAPAAEEPKAE

SEQ ID NO: 4026 - protein, 383 aa, Neurospora crassa
  unsure (1)..(383): unsure at all Xaa locations
RPTCYRSYKSEKEVDPPCEREGCEGTYRLLRHVSXVVXHNIICANEXLTMCLLLPSFVDCPGHDILMSTMLSGAAVMDAALLLIAGNESCPQPQTSEHLAAIEIMKLDKIIILQNKVDLMREEAAKQHYESILKFIRGTVAGKSPIIPISAQLKFNIDAINDAIVNTIPVPPRDFSMDPQMIVIRSFDVNKPGAEIDELKGGVAGGSILHGVLKLGDEIEIRPGIVTRDEKGDLKCTPIFSRIVSLNSEANDLKYAVPGGLIGVGTRIDPTLCRADRLVGFVLGLKGRLPEIYSEIEVNFYLLRRLLGVRTADGKQAKVDKLAKNEVIMVNIGSTSTGAKVSAIKKDAAKLILTSPACTSIGEKVALSRRIEKHWRLIGWATI

SEQ ID NO: 4027 - protein, 411 aa, Neurospora crassa
PKKITLKAPSGTTPVQTPLLAPKVRLKSQGKIPTRPLGEGYDSEADDREVDPVIEEQLILRMMPGEHCDYLRKAVAERKVGVPKHQGGADVTMKFLDEEGRRVMFVIQGQPYAAILVDLPTITEGMKTWDKKSMVKSADICQMILVFAKVKDEAEAKSVPLPKAVEHGHRWPHGITPPMHDARNRRFRKRLSKLEIQNKEAEVERLLAADREALNSRYELVAEGGHGNTAAPESDHEYGDEDGGMGGEEDRLEDYFGDANMQNQDDDNLFDDLEAEFENAADTPAEAMDAMDFGAATPTALGGGMDLPTPPTANTGTPTAAQTEESAAEAVSEEDESDEDDEDDEGDMDDDGDEERHDEVAGVKAEIATLRKQLASYEEQLSKATSIIMKKRLEGSIKNIKSEIKLKQSSI

SEQ ID NO: 4028 - protein, 567 aa, Neurospora crassa
  unsure (1)..(567): unsure at all Xaa locations
RCFGDKGDVEDITEGTTHPSSHDGSLDQEPVNAPPHVINTLSHTDPPLPADIISTVEFDHTGNYLATGDKGGRVVLFERNETVSGVAANPPSPFPFRLICWPASCLCLAYLWTKKTCEYKFHTEFQSHEPEFDYLKSLEIEEKINKIKWCRRQNASHYLLSTNDKTIKLWKVFEKSLKVVAENNLSHDLTPASVAGGGGAPRALPHTQFRSPADLKLPRLTHHDTVVAAVPRRTYANAHAYHINSISVNSDGETFISSDDLRINLWNLNIQDQSFNIVDIKPANMEELTEVITAAEFHPLSCNWFMYASSKGTIKLADMRERALCDQHAKSTLDFGELCLKCFFFFFFFFFFISILRXSLLTIRFFLPCIVFEQEEDPSSRSFFSEIISSISDVRFSHDGRYILSRDYLTVKIWDVNMERQPVKTIPIHEHLRPRLCDTYENDSIFDKFEVVFSGDAKNVMTGSYNNNFMIYPSDPDKEVEVVLQADKSAFKAKKVGVPTPINSSTSPTANGGKKGNSRAGSPAAAGQGQRMRKETDADQIDFNKKILHMSWHPFEDSIAIAATNNV

SEQ ID NO: 4029 - protein, 468 aa, Neurospora crassa
MIKRHLEFTPLATRVLSPMHIHNSPYQLARTQLHVASVPTSLPCREAEFSLVYSHLEAAITDGSGTCIYISGTPGTGKTATVREVVSHLDAAVRADELDDFIFVEINGMKITDPHQSYSLLWEALKGQRVSPSQALDLLEREFSHPSPRRVPCVVLMDELDQLVTKNQGVMYNFFNWPGLRHSRLIVLAVANTMDLPERTLSNKISSRLGLTRITFPGYNHEQLMRIVQSRLEGVPGDIVDADAVQFAARKVAAVSGDARRALDICRRAVELAEADAKVVAEAEPPTPSKKKGVEDKVVSKKKGSAGRVTIETVRRAINEATSNPLQQYLRGLPFASRLLLTALLLRTQRTGLAESTFGDVLEEMQRMIKLATGGDSRPLNALMATAGVSAADYGDGIMGGPRSKPDVRQMRPGGLAIAAVDLTGAGVINLEAHKAERPSKIRLAVGDEEVRLAFRDDPEIKTLGVLL

SEQ ID NO: 4030 - protein, 374 aa, Neurospora crassa
  unsure (1)..(374): unsure at all Xaa locations
MVPVNRAQSPVCPQSKASIAIVVTFETSSLTXSPPNQTAFHFVAGLGSGVLSAILLQPIDLLKTRVQQSGKHSLRAALAELRSSQQGLLPSLWRGTLPSALRTGFGSAIYFTTLNTIRENAARHLPSLAAAAPTIAAASGIVAPNANQTSSSLPKLSNTGNLLAGAVARSFAGFILMPLTVLKVRYESSFYKYTSLAGAARDIARTEGARGFFAGFGATAIRDAPYAGLYVLFYEKSKQHLSNLFPQPPQPQLSTTTTLEAAAGQDGGGRMSQSRAASINFASGVFSAIICSIISNPFDAVKTRIQLQPKKYRNMVQASRKMLAEEGVRSMMDGLALRMSRKAMSSALAWTVYEELIRRAEGAWTKRGPEEVQL

SEQ ID NO: 4031 - protein, 1240 aa, Neurospora crassa
  unsure (1)..(1240): unsure at all Xaa locations
MGFLGVYRAIYDYTPQGEGELTISEGDILYVLEKSQEDDWWKAKKKANAADDDEPVGLIPNNYIEEVCNVVRGLDLDCVQCHLGTCTCLEDSKLAGLGIQMDHLNXPRTPXRQAKPVSYARALYEYTRQTDEELSFPEDAQLSVFDTSDPDWILVGHDGDYGFAPANYIELGDGQAGQVEEEEEATAPPPPLPQRTPSVSVDVASPPLPARSVPSEPSTPVAASNPAAAAIAGVMANRSSFQPPAPISVPQPQRQSYASEDYENEVRSPPLPSRPRGDSQIAPEQKSYRPVPPPAQSAAHDTDDYGISPRTSQAPPPQTAALTPGGFHMYNINEMTSVMGKKKKMPTTLGINLRTGMILIAPEHSHDGPSQEWRADCMTHYSREGKHVFMELVRPSKSVDFHAGAKDTAEEIVAMLGDMAGTVRLEGLKEIIAAGAGGKKKKGAVLYDFMAQGEDEVTVGVGDEVVILDDTKSDEWWMVRRVKNGKEGVVPSSYIEINGVWEEPETAVTGIAVGMSEVEKNRLEEARLTKEAIKAAQREEEKEKQKRNSEVGPGLQLQERNSSLPATDDNRRGKQRSSRREPGQNSSSKSSSKSSKYTHVQIFFQSMQNTDSLSQEPDPSKVRTWTDRSKSFSVEAQFLGVKDGKIRLHKMNGVQIAVPVSKMSVEDLEYVERVTGESLDEDKPLSDLRNKRSAGESSRSSRSTRDRERDRGSSSRVGATIDSSKKPDYDWFNFFLGCDIQVGLCERYSQAFLREAIDESVLPDVDATVLRNLGLREGDIIKVMRYLDNKYMRNKKGEEGEGGLFSGPGGALRNNTKKGRPAPPVEVSNTVDPNAFSKDSGAGSGKSSSPTAAATPTPSASKPSSGFDDDAWDVKPTKTKTPEPAAQAVAPAPAAAPAAAPAPAAPALVDAPAPPPPAALTKSMQELSLLTQPLEPEKVAPPPVVQPAITLPPPSAAPAPAAAAPAQVPQLTGATPGFFTGMQPPAVGAQILPQNIARQRPLAPQFTAAPGGLVAPPPSRPLSAPQSAQPSAFTPPPIQPQMTGFQAPQIAPPGQSLGDLAQQRLQQQYTAQMQAQQQQMQQPMMTGMQPMMTGMQPQQTGFGQFPPQQQPFMPQPTGFGMQQQQQPMMTGMQPQQTGFGQFPQQQPQPFMPQPTGYGHVGGGLPPPLQPQATGMSFTQGFGNGPQQHQQPLVPQQTGPAPPVRFGISGDAKKLAPQATGRRANLAAASKFCPHKRHVLL

SEQ ID NO: 4032 - protein, 327 aa, Neurospora crassa
  unsure (1)..(327): unsure at all Xaa locations
MPLEAVMIVVDNSESSRNGDYIPTRYDAQADAVNIIFQNVVQGNPESSVGLMSMAGRGPEVLVTLTTDQGKILEGLHRTKKNIRGSAQLSRAIQVAWVCGIPSXSLLGDYRQLTSYSTYHSLALKHRQNKSQRGRIVIFVCSPIEEEESDLVKLAKKMKKNNTSVDFVLFGDIDDENQKKLEAFNREVKSGEGSNMVVIPPSSKLLSDQLISTPILLGEAAAGGSGGAGGDAGGAANEDFPFGIDPSVDPELALALRMSMEEEKARQEKRAKEEAEAAKKASLEDVKEEAGESEPLLGKDGEPSGSGSKKDGDKPGKSDDGDKMDTS

SEQ ID NO: 4033 - protein, 453 aa, Neurospora crassa
  unsure (1)..(453): unsure at all Xaa locations
MSRYLRPAVRLAATASRVQVARPAAPSFFKPASVAAFQKRTYADAPAGTKDYTVRDALNEALAEELEANDKVFVMGEEVAQYNGAYKVTKGLLDRFGDRRVIDTPITEMGFTGLAVGAALSGLHPVVSTLLRRDPSXRTHRTSHDSXKLGFILSYTSSPTSVQPYGCDYAHDSNDGQQRNRNKHLAEAHKLIMFLLPQHLCEFMTFNFAMQSIDHIVNSAAKTLYMSGGIQPCNITFRGPNGFAAGVAAQHSQDYSAWYGSVPGLKVVSPWSAEDAKGLLKAAIRDPNPVIVLENELMYGQVFPMSEAAQKDDFVIPFGKAKIERAGSDLTIVTMSRCVGQSIVAAEALKKKYGVEVEVLNLRSIKPLDLDAILKSIKKTHRLMTVESGFPSYGVGAEIVALAVEYGFDFLDAPPQRVTGADVPTPYAQGLEEMAFPTESLIENHAAKLLKLI

SEQ ID NO: 4034 - protein, 405 aa, Neurospora crassa
  unsure (1)..(405): unsure at all Xaa locations
MPSTIALEKEDHQRDAEFKKVMHGDSAKAAGGVAALLKKNTEAQQIAVDEYFKHFDNKTAEAETQADREARTKEYATLTRQXVPSPCLARFLLCANTWRLTNAFPAAYYNLATDIYEYGWGQCFHFCRYSPGESFYQAIARHEHYLAAQIGIKKDMKVLDVGCGVGGPAREIAKFTDAHITGLNNNDYQIDRATHYAVRDGLSGQLKFVKGDFMQMSFPDNSFDAVYAIEATVHAPKLEGVYGEIYRVLKPGGTFGVYEWLMTDNYDNDNVEHRDIRLAIEVGNGISNMVTISEGLAAMKNVGFELVHHEDLADRNDPMPWYWPIAGELRYMQSYLDFFTVVRMTHTARRILHGFAGILETVGLAPKGTKKTADALARGADGLVAGAKKKLFTPMYLMVGKKPLN

SEQ ID NO: 4035 - protein, 383 aa, Neurospora crassa
  unsure (1)..(383): unsure at all Xaa locations
YNNAVYWPNHSVYRGDTPGSLNYGCINRVYYAFANIMADGGVFVSLFRRHLPSLSTSADLFWXLSDEWADVTAPCDGVQGALGSLMHLKQKYPHLQVVLSIGGGASSETFALVASSAILRNNFAQSARGLVEASGLDGIDSTAPFPSPHLASSNIVANDHVRVRRLSHSCLVTHVQIPNDLVEMFDXQHQVVWDYPCSPQQGSDFVSLLAAVRVHLPEDRYLLTAALPGAKSILQNINVRQAAEYLDSINLMAYDYFGSWSHRSGHHSQLYAMNKEEASGASSVQYLMASAVPGKKILFGIPLFGRSFLHASGSGHKFQGAGGGDDGSFEYCQLPRRGTKEQVDKRAVAAQCVGGDGGFVTYDNPDTVKAKATFCKQKGLGVS

SEQ ID NO: 4036 - protein, 433 aa, Neurospora crassa
  unsure (1)..(433): unsure at all Xaa locations
SGDKNHTVTIAESATVLQLKTLLAGEEYENISPEQQRLIYSGKVMKDDEVLSFYKIKHMNTVHMVKRPASAATASSGSTSTPAQPAIPQNMAAGTPSNNLLAGLTGARFAGQVPLPSRDLFGPDGGVRHPFLGPLDPXHSCLTNDVLXMGAPPSEDEIANMLSNPAMAQVMAEAFNNPAVIDQMIASNPMLANMPADRARELLNSPMMRNMMTNPEALRMAARMRRMMGGGANAFPAPGVTDNTPNATTGAGNNNANADAQNPFAMFLPFGVPPAGAPPAGNPFAALFGNPAGSSPASTGASTESARSGDAASAPATGATSGSGQQADPLASLFGALGGAGQPGQAGAANPFGLPPISPEALQQMMQAFGGGGLGGFGGNPVAPPDNRPPEERYAEQLRQLNDMGFFDFDRNVAALRRSGGSVQGAIEHLLGG

SEQ ID NO: 4037 - protein, 388 aa, Neurospora crassa
  unsure (1)..(388): unsure at all Xaa locations
WRKLPISLTELCIETTLRCGQSFRWRKINEQWSECTPLSYFFSFYFFSVQSIKSXQFSRHCVLKGRLISLKQDPTHLHYKVTWPTSTATPKNEHPQDFEDDTSVLLHNYFALSHSLTTLYAQWSLSDANFARRAPAFTGIRILNQDAWETLISFICSSNNNISRISQMVLKLCTHYGPYVATVEGEAFHDFPGPEALAGEGVEAHLRELGFGYRAKYIAETAGCVAQVYGERWLLRLRNPGVPALRAAEEDILVKKEEGAEEKESVESKADLDNPPTYQKAHEALLTLPGVGPKVSDCVCLMGLGWGESVPIDTHVWQIAQRDYNFGGKGSAKTKTLNKAMYVAVGDHFRKIWGPQAGWAQSVLFTANLKSFSEQAAGVEKKRVVKVE

SEQ ID NO: 4038 - protein, 600 aa, Neurospora crassa
GTTGCVLASRLSESPNVSVLLLEKGRVHDNFLSRIPLLSQNFEFPFLQSVRRDSDPIPAANGRRAALWTAEALGGATRINALLWTRGGAGGYNQWSEDYGLEDWSWERVEPWFRRSEDVVRPRKPGLTLGCIPFVEEAAMRVGLPVGDGVNDPCANAQGCFVMDQTIDGKGQRMSAYKAWLPKEMVRERKGLKICTGVVASRLFFSKDGTRVTGVRVREGDREYTVKARREVIVCSGTICTPQLLMLSGIGPRQHLESLKIPVLHDLPAVGQGLSDHTSVPIIMELPRKHTLHCLENAFVFLWHLLLYLFFGRGLLANGTTPRSIFVRIAALDENTMTVRHVDDSDQDTMDISPPRDIPDVEIMINPVNCLTVSVSGKSLFTWYTTLIQPYSRGHVKVASDDPLADPKICYPMMTDARDRATMRKAVRFTMRLAEEFTNTGYPQEAPLTIAPGMDLVYLDALYKTKTGLLQRFWTTKKPADEEPVPVPGKDPLPGATQLSASTSTNSESEMQQFQKPNWRTVTDKEIDAYASRVCVSSLHVSCTCRMSNNSREGVVNQMLKVHGIENLRIADASVFPKIPSAHTMAPVVMMAERCAEFVK

SEQ ID NO: 4039 - protein, 441 aa, Neurospora crassa
SLNNVLSVDRATKTALVEPNVPMDKLVEATLPHGLVPPIVMEFPGITAGGGFAGTAGESSSFRHGFFDDTVREVEMVLGNGEVVKVKNPDLPREVSSTATAAENGGDLFRGAAGAVGTLGTTTLLEVQLMDAKKFVKTEYKRANSVAEAIRMVREETQNAENDYVDGILFSKDHGVIVTGKLVNELPSPPPSSSSSSASEKPIKPQTFSGPWDPWFYLHCQSRTLSPSTSTTPNSSPVVATDYVPLAEYLFRYDRGGFWVGAAAFQYFSWVPFTKLTRWFLDDFLHTRMMYRALHGSGESARFVVQDIAMPFETSEEFINYTSSSLGIWPLWLCPLKRRAPPTFHPHTTRPGTDPSDEKAQDDMMLNIGVWGWGPDSPQEFVAKNIELENKVHELGGMKWFYAHTYYEQEKFWKMYGGRTWYDALRKKYHAEHLPTVWDKI

SEQ ID NO: 4040 - protein, 628 aa, Neurospora crassa
  unsure (1)..(628): unsure at all Xaa locations
KDDADLTFSDLGLDPRLVQAVAKQSFEKPTLVQRKAIPLALAGQDVLCKAKTGSGKTAAYVLPVLSGILKRKAVSYLDTREKKLCCDKVGCXRKGNHKQTDPTPFTSALILVPTRELADQVHKAIDAFSAFCTKDIQSAKLTDNVSDAVLRSLLANAPDVIVSTPARAWHNIESGALSVAKLQYLVLDEADLVLSYGYDEDMENIARSLPKGGVQTTMMSATLVSDELDTLKGFFCRNPTMLDLKEEFSNEDEKLTQFYVKCGEDDKWLISYLIFKLQLIKGPCLVFVADIDRAYRLKLFFEQFSIRSCVLNSELPINTRIKIIEEFNRGIYDIIIASDERSEVFLEDEKTEEKKEEQGEKKEGDEKKNGKGKKKKGRRDQEYGVSRGKSVCVLVLHGSGYXPKXSQGIDFKNVAAVINFDMPTSSSSYIHRIGRTARAGRAGIALSMVVPHDLFGKHKPTSIKQCEKDEKVLAKVMRQQAKLNRKLEPYNFNKDQMEAFRYRMNDGQYPLSPLSFRPFDHSFSNXAIALRAVTKVAIREARTRELRQELLRSETLKRYFEENPHELSHLRHDGELGTKMRQQAHLKHVPDYLLPQDGKNALTETQIGFVPFKKQGDDKKTRGKKGAK

SEQ ID NO: 4041 - protein, 605 aa, Neurospora crassa
  unsure (1)..(605): unsure at all Xaa locations
PAAFLVSALTLTQVVTATPFSPPRQKNIGTSDDSAAAASSSQAASNQERRDAVKQAFQISWDGYYKYAFPHDSLRPVTNSYEDDRXFPHSFLPLLSQLNTTLTPPHRNGWGASAIDAFSTAIVMRNWPVINQILAYVPQIDFTRTSSEISLFETTIRYLGGLLSAYDLLTTPPLYADAKAAAPDVHLNSTSSQTATDAILAQAIRLADALSVAFDTPSGIPDNNLIFDPVTGPKRTGSQTNGIATIGTLVLEWTRLSDITGNSTYAQLAQRAEAFLLNPQPSAIAEPFPGLLGTNVNITSGLFVDSTGGWGGGTDSFYEYLIKMYLYDPDRFALYRDRWILAADSSIQYVASHPTTRPDLTFLGGWKGPRGNTTLRFSSGHLDCFDGGNFILGGLTLSNKKYLDFGLELVKSCAETYSATATGIGPELFSWQDNRTPLNATNNRGPPSAEQKAFYEKNGFWITNEQYVLRPEVIESMYYAWRATKDEKYREWAWAAFKAINATTRAGSGYSSVANVNKVGGGSKTDFQESFWFAEVLKYCWLIFQDVSFCSLFFPLLLCSRRGGIDKKKKKMLTGKQEDDPWQVKADQTNEFVYNTECHPIRLAK

SEQ ID NO: 4042 - protein, 221 aa, Neurospora crassa
QPTPQALPGARSSSGSSILVSPRQKGNPVLASIKSTAWEYSDIPADYVLGTTTCALFLSLKYHRLHPEYIYTRIRLLQQNRYNLRILLTLVDIPNHEEPLRELSKTSLVNNVTVILCWSAQEAARYLELYKSYEHASASAIRGQQKTTYAEQMVEFVTVPRSVNKTDAIALVSTFGSLRNAINVATEANGEERLGNVQGWGEKKVKSWRRAVEGSFRVRKT

SEQ ID NO: 4043 - protein, 383 aa, Neurospora crassa
  unsure (1)..(383): unsure at all Xaa locations
RRQEDEGLKNQNLGTTYTIDIDIGTPPQTVTLILDTGSPDLWVNPQCETSGQEKYCNSFRQFDYTKSKTIQDTGAADILKYGKGNVTIEYVTDDVIIGCTYLLSPPPPPPFFFFFLFVFSASTXANKATTAAKIKSQILGIGFESIDIPLGILGLSPSVSPDGTSPYPYLLDSMASQGIISSRAFSLDLRSIDNPSGAIIFGGVDLGKFSGSLAKLPMLDPSQTPAGVDRYWIVLSGVGMTYPDGEEVESEEIGVPVFLDSGGTLSRLPETIFQAIGDSFPGSQYDPESGFYIVDCAVAEQAGSVDFIFGSSGSRSSKKIRVPYGDFVWEVQTGVCVVGVLPTDDEPVFGDSFLRAAYVVFDQDNRNLHLAQAANCGEQIVEI

SEQ ID NO: 4044 - protein, 491 aa, Neurospora crassa
  unsure (1)..(491): unsure at all Xaa locations
QQVFGHPAPHVAGGWNISPSRQQLISSLMTLGAFLSSSLAGPTATFLSRRQTIWAASLLCIVSNVIMMATTSIGGLYAGRLLLGLANGFYMTFSQLYIQEVAPARYRGLMISSFQVWTSVGTVIGGVVDNFTEKIDGRDSYLIPLGLIFVFPVVISLGLFAVPESPRWLMMQGREEQARKSLRWHRPYSDRMVEEEIRDIQLALAAEGETVKGASVWDMFRDPVDRRRTVLAVCGLTVQGASGAMYMIGMFDSXNLVVVVMDNGXRATAYGTYFFKMAGIGKPFENHVILTSLGVVAILVNSAMVTHFGRRRIFLISGLILCGVAQLLIAVVYTVKPGTKSTGQAIVGLAVVYILGYNGMVATYAWISGGELPSQRLRSYTFGLATAIGFFAAWLTTFTAPYFINPESMNWGPKYGYIWTPSCWFLRECSPVSCLPISGRXADEKSARSLWVYFYLPEVKGRTLEEIDQMFEARLPARKFRKYVCVGRDGG

SEQ ID NO: 4045 - protein, 468 aa, Neurospora crassa
EASDKGTFNVVNPATGEMSCKVPEATEDDTNRAVAAAKAAQPGWAALDPAKRGAYLKKLAALIREHKSTLHHLEAISMGVPVNHFFHADFGADELDYFAEAWPHIQGQSSVNTPGYVTMTFRQPFGVAACIIPWNAPLYFFATKAAAALITGNTVVLKSSEKAPLAVAYAAELVAKAGFPPGVFNILSGHGLPSGRCLARHMDVRAISFTGSSRTGKLIQEEAAKTNLKSVTLELGGKSPAIIFDDANIEQALTDTMSSIVLNAGQVCIANSRVYVQKSVAPKFIEAFTKRMATIRGGNPLDPQTQMGPQADEIQYKNILSYIEEGKKSGKLAVGGKGQLDERKGYFVEPTVFLDTPEDAKIMKEEIFGPVLNINTFETEEEVVAKANDTEYGLWAAVFTNDLSRAMRMAKALESGYVSINCSSPSIGRDLPFGGYKGSGQGREGRLHSMNHFLEIKSVIIKLDEKAS

SEQ ID NO: 4046 - protein, 392 aa, Neurospora crassa
  unsure (1)..(392): unsure at all Xaa locations
QTLDEKPEGYKPEELPIWNFDGSSTGQAPGDNSDVYLXVIMRLIVMMKQGHHLLTTSQKPVAVYPDPFRPSQQXATSPYCNLHIVLLLTVHIDILVLAECWDADGTPNKYNHRHECAKLMELHAKHEPWFGLEQEYTLLDLNDRPYGWPQNGMSLPSAHPCPCPDTHXQHAGYPAPQGPYYCGVGAGKVVMRDIVEAHYRACLYSGIKISGTNAEVMPAQWEFQVGPCVGIEMGDQLWLARFLLHRVAEEFAVKVSLDPKPIPGDWNGAGLHSNFSTVEMRKEGGMKQIEAAIKKLEGRHKEHIAGEFVRSEEEWSGVGTEANAGKTVYGEGNEKRLTGRHETGAIDTFTYGVANRGASIRIPRECAAKGYGYFEDRRPASNADPYLITGII

SEQ ID NO: 4047 - protein, 386 aa, Neurospora crassa
IVVTCALRTPFTKGGKGGFKDTHAADLMAGALRGLIERSKIDPSLVEDIKVGTVLAPGGGATEMRAAALVAGFPESTAVHTLNRQCSSGLQACVDIANAIRSGMIEVGVGAGVESMSTNYGPAAVAEFSDLLESHKEAANCKVPMGVLSEDMAKDKGVSRKDQDAFAASSFQKAVKAQKEGLFKEEILPLKAKFEDPKSGETKEILVDRDDGIRDGVTAESLGKIRAAFAKDGSIHAGNASQVSDGAAAVLLMKRSTAEKLGQPILGKFVAASVVGVKPLLMGIGPWKAIPKVFELTGINKDDVDIFEINEAFASQCLWCANELGIPMEKINPKGGAIAFGHPLGCTGARQVSTLLYELKRTGKKVGVTSMCVGTGMGMAAVWVAE

SEQ ID NO: 4048 - protein, 411 aa, Neurospora crassa
  unsure (1)..(411): unsure at all Xaa locations
MSTFTTNGAGAENDGEKVNTHIVTLTRFLTEEQVKHKEATGDFTYVIHHLHQFPSCXPRKQPNQRELPANMKPQKLLCHALQFSFKSIAYYIRRATLVNLTGLAGSSNTTGDEQKKLDVISNDLFIEAMRSSGKCALLVSEEEEHVIYFKDAKNARYAVACDPIDGSSNLDAGVSVGTIFAIHKLAEDSTGTKEDILKPGTELVAAGFTMYGASAQLVITMKGGSVNGFTLDQGVGEFILTHPNMTIPRKRSIYSVNEGNSLYWEDDVKAYFNSLKETQEDSGKPYSARYIGSMVADAYRTLLYGGMFAYPADKKSPKGKLRILYECAPMAMIFENGKSCHSSSITSPLERPDRNMMMDTNMLCXNDSGGQAVDSKMNRMLEVVPEHIHDKAGIFMGSYDEVEKVKKYHGK

SEQ ID NO: 4049 - protein, 353 aa, Neurospora crassa
  unsure (1)..(353): unsure at all Xaa locations
VKXLLISLCNSMKKVLAINRYTGIDQRSSIGNPDHPLVNKPNPPTVKELHEVFMSDGVPLAVEASRKAMAEARLVPAQITHMVSTTCTDSANPGYDHYVAKELGLSDRLEKVLLHGIGCSGGLAALRTAANLCLGHTARGKPARILVLALEVSTTMVRSELESIDALQETRIGIALFSDCASAVILSNGIGEAPGKPAIYDLLGWENRVIPDSEHDLGFDVDPMGWKVVLSPRVPVLAKASLQPTYADLLSSLQDQLPSSYQKPADFDWAMHPGGATILSGAESAMGLTPEHMRASYDRYINHGNSSSATIFSVLNRLREKDMDALAPGGKVKEYVVGCAFGPGINVEMCMLK

SEQ ID NO: 4050 - protein, 649 aa, Neurospora crassa
RVVERRKALSKSEKEQRREIHKIHLLCLLAHVERRNRWCNNPKVQEALRPLLTDKMRKSLIPRASLNQYGRTESLKAGLQETSTMFKTKFQITERGLRRALWAEDEEQLKNVDGYSLFLSTSCYPLSFESLANTPFPYSTNSQMTSETVKSKGDFLQAAKCLSGSRDVGAQLFCALLRSIGVQARLVCSLQPLSCVPGAPTMPKQPKTKSLNASKGPSAADRYAAAMSKYDNTVATPDPRTPAFLSGRSRLGHPNATAYNVPSMTAPPPPPSRPEIPKAKTIKGESPYPIYWVEVLDEAQQKWHPVDPLVTNTQWRPRALEPPASDKENSLTYAIAFDEDGFARDVTRRYAKAYNSKTKRQRIDGPISPTTPSGINTGERWLRRLFLRHYTATDFPTDLDQIELNELAALEGAEPMPRNVQDFKDHPIYALERHLRRNEVFLPGAQSTGTVSAGSKAPVERIYRRKDVVVARSREKWFRLGRVVKPGEEPVKVLPPKRKRSSKFGGEMISSTSPSLETDNEDDEGDLFGDYSLAKAGGTPLYTPQQTELYVPPPVSKSGKIPRNKFGNVEVYVPSMVPAGGAHIPHERAAQAAHILGVDYAPALTGFEWKGRKGTARILGVVVPEQAAEAVRAVITGLVDMMEEEREER

SEQ ID NO: 4051 - protein, 381 aa, Neurospora crassa
  unsure (1)..(381): unsure at all Xaa locations
MGYPETFEGFVVDSPKTWNQFHRHELKPKPFGDDDIDVQIECCGVCGSDIHTVTGGWGDFEGPLCVGHEVVGKAIKVGKNVTEIKQGDRVGVGAQVWSCLKCDVCKSKNEQYCPHMVGMCLSPLPHXPFRAHHXXGLLKTTYNANYEDGSTAHGGWASHIRAHQYFTFKIPDAIPSHLAAPLLCAGITTYSPLVRANVGPGKTVGIIGVGGLGHLGIQWARALGAEVHVLTHSAYKADDAKALGAQNVIVTSDDEKWAEPYKFKFDFLLNCADATHKFDMKTYLSVLKVGGEFHMCGIPDKPLPPLEVLAFMQNGAKLSANHLGNHQEMKAMLQLAAEKGIVPKVETVQLGEDGCKEAVERVKEGNKVHYRLTLTGFDKVF

SEQ ID NO: 4052 - protein, 273 aa, Neurospora crassa
TAGADHYNGMLDCFKKIVKNEGVCFLFHRAWVVWRELTPFFHSPSRLYRGITAPILMEAPKRATKFAANDKWGKFYRDLFGQQQMTQGLSVLTGASAGATEAFIVVPFELVKIRLQDKASAGKYNGMVDVVVKTVRNEGLLAMYNGLESTLWRHILWNAGYFGCIFQVRQLIPKAETKKGQTINDIIAGTVGGTVGTIFNTPMDVVKSRIQNTIKVPGQVPKYNWAWPAVLTVFKEEGFGALYKGFIPKVLRLGPGGGILLVVYTGVMDMFRK

SEQ ID NO: 4053 - protein, 325 aa, Neurospora crassa
ELNAKALDNFVYSKVDRDMIRFLATAASEVIQCDPTMMPSPTVAATSGREQQPTAPPKVVKCEDGGLPTLEAFISQLVVSSNVQVPTLMSSLVYLRRLKSRLQPNAKGLRCTTHRIFLAALILAAKYLNDSSPKNKHWASYTNMSSSAYNFGFSRTEVNLMEKQLLCLLDWELRITEEDLYRELDYFLAPTRRDYEVRYARRMREKAEKRQRQLEERPGSRLPLPPPPPSTSSSSSNNSNSLLTSLLPHPAAAPARATVTPLATPRHPVFPAPHLRTPAPPAARQPPTANWIFLTLTLPSTATTTTSLLLSRLAYRRRMPRPCTS

SEQ ID NO: 4054 - protein, 1395 aa, Neurospora crassa
  unsure (1)..(1395): unsure at all Xaa locations
LKHKVEAIKELEQSSGIPARELGVTWKDLTVQVINSDAAIQENVLSQFNIPKKIQEGRQKPPLKTILDNSHGCVKPGEMLLVLGRPGSGCTTLLNLLANKREGYVAVNGDVHFGSMNAKEAHKYRGQIVMNNEEEVFFPTLTVGQTMDFATRLNIPYKIPDGVASPEEYRKENMDFLLEAMSIPHTKDTKVGNEYVRGVSGGERKRVSIIECMASRGSVFCWDNSTRGLDASTXVTPIMLTKHSRIRLTYPXALEWAKCIRAMTDVMGLSTIVTLYQASNGIYDLFDKVLVLDYGKEIYYGPMKEARPFMESLGFECQEGANVADYLTGVTVPTERVIRSGFEKTFPRNADQLREVYQKSDIYPRMTAEYNYPTTEEAREKTKLFEEGVAVEKDKHLAKDSPYTVSFFQQVKACIARQYQIVLGDKPTFLIKQGSTLAQALIAGSLFYNAPDNSAGLFVKSGALFFSLLHNSLMSMSEVTDSFSGRPVLLKQKGMGFFHPAAFCIAQVAADIPVIILQVTVWSIVLYFMVALSMDAGAWFTYWVILIAATMCMTAFFRAIGAAFRTFDAASKVSGFMISALIMYNGYMIQKPKMHPWFGWIYWINPMAYSFDALLSNEFHDTIIPCVGVNLVPNGPGYADLDHQSCAGVGGAIQGENIVYGDNYLKSLSYSHSHVWRNFGIIWAWWVLFVGITIFATSKWRPLSEGGPSLLIPREKAKIVKAIQNNDEEKAGATSSGEETVYDKEASAGEAKDSDKDLVRNTSVFTWKNLTYTVKTPSGDRVLLDNVHGWVKPGMLGALMGSSGAGKTTLLDVLAQRKTDGTIKGSILVDGRPLPVSFQRSAGYCEQLDVHEPFSTVREALEFSALLRQPREIPREEKLKYVDTIIDLLELHDLADTLIGRVGAGLSVEQRKRVTIGVELVAKPSILIFLDEPTSGLDGQSAYNTVRFLRKLADVGQAVLVTIHQPSQQLFAQFDTLLLLAKGGKTVYFGEIGDNAQTVKDYFAKYDAPCPEETNPAEHMIDVVSGSLSKGKDWNQVWLESPEHQAMTEELDRIIDDAASKPPGTLDDGHEFAMPLLEQLKIVSMRNNISLFRNTDYINNKFALHIGSALFNGFSFWMIGDSISDLQMRLFTIFNFIFVAPGVIAQLQPLFIERRNIFEAREKKSKMYSWIAFVTGLVVSEIPYLCVCAVLYFACWYYTTGAPHASSRAGGTFFVMLMYEFVYTGIGQFIAAYAPNAIFATLANPLVIGILVSFCGVLVPYQQIQVFWRYWIYYLNPFNYLMGSMLVFNLWDKEIECRDQEFAVFNPPNGTTCAEYLEGYMMGMGRATNLINPSATEGCRVCQYTSGSDYLQTINLKSYGYGWRDAGIVCVFVASSYAMVYALMKLRTKTSKKAE

SEQ ID NO: 4055 - protein, 545 aa, Neurospora crassa
  unsure (1)..(545): unsure at all Xaa locations
HHVFSDPAIAAYWAEVYERAGYENRHRFDPLFQWDASEERKLVRKMDFRIVFWAWIMFCSLDLHRKSINRAISDDMLPELGTXVCPVLPCRGSALPCIHVDFGYLYLEVXVVLTHPRMNTNDFNYGQTIFLAAFLLAELPSGLVAKKLGADRFVPMQIVSWSILSGAQVWITKRAHFYVIKALMGFAMGGFIPEIVLWLTYFYKSNEMPLRLAFFWTALSTVNIAGSLMAAGILQMRGIRGWSGWQWLFLIEALMSFVVGICAFVLMPPGPCQTKSWFRGKDGWFSEREEFILVNRLLRDDPSKGDMNNREGVSAQGLLKALKEWEMWPLYIVGVCAYIPPGPPGEYLSLILRTHGFSVFQANLLTIPAYFLFACNLVILSYFSRRFKERGFIASLSQWWMLSFFAAIVALPDAGVWVRYALLIGILSYPYCHAILVAWTAENSNSVQTRAVSTALYIMFVQDGNIIYDNIYREDDKPLYKRGNKVLLAMVCLNIVLFYLTKAFYVWRNKVKEEKWKAMTPEEQRDYVLTTLDEGPKRLDFRFAH

SEQ ID NO: 4056 - protein, 356 aa, Neurospora crassa
  unsure (1)..(356): unsure at all Xaa locations
MADHTEVDLDSIIDRLLEVRGSRPGKQVQLLEAEIRYLCTKAREIFISQPILLELEAPIKVSIVFFLLSLYIASACAILPLRQCSXLTSCPTSLICGDIHGQYYDLLRLFEYGGFPPEANYLFLGDYVDRGKQSLETICLLLAYKIKYPENFFILRGNHECASINRIYGFYDECKRRYNIKLWKTFTDCFNCLPIAAIIDEKIFTMHGGLSPDLNSMEQIRRVMRPTDVRYTIHARAFRLLRLVAVTXDTNNSARFPDCGLLCDLLWSDPDKDITGWSENDRGVSFTFGPDVVSRFLQKHDMDLICRAHQVVEDGYEFFSKRQLVTLFSAPNYCGEFDNAGAMMSVDESLLCSFQV

SEQ ID NO: 4057 - protein, 348 aa, Neurospora crassa
  unsure (1)..(348): unsure at all Xaa locations
EELKAEIKAEAKAAASAGASQLRSFVAGGFGGVCAVVVGHPFDLAKVRLQTAEKGVYTGAIDVVKKSIAKDGLRRGLYAGVSAPLVGVTPMVYVHPPPFHLYPFPPPSLSPQQPPRXHFSPQNQVAVSFWGYDLGKQIVRATSTVAPDGNLSIAQISAAGFFSAIPMTAITAPFERVKVILQVQGQQKLAPGEKPKYSGGMDVVRQLYKEGGVRSVFRGSVATLARDGPGSAAYFAAYEYIKKALTPKDPVTGEASGKLSLGAITVAGAGAGVAMWIPVFPIDTVKSRLQTAEGNVTIGGVVKQLYRAGGYKAFFPGFAPALARAVPANAATFLGVELAHQAMNKAFN

SEQ ID NO: 4058 - protein, 198 aa, Neurospora crassa
SSAAATQLRKELKQMQKDTDIPGISCGLVNDNNIFEWEVMLMIPDEVKYYGGFVLCLSPLFSSFSSCLSTEYTDIFFRQTGGNFRAHLHFPPNYPLMPPTFTFQNPIPFHPNIYPSGELCISILHPPEEDKYGYEDASERWSPARSPEKVLLSIISLFSDPNPDSPANVEAARLLREEKEGKHKEFRKRCRACVRESL

SEQ ID NO: 4059 - protein, 1095 aa, Neurospora crassa
WVRGVYQAFKHKSVVPSQRGKEAPASTGKILNLLRGDVYEVAQRFWEASTLLTKPLSVIVSIVLLWNILGSASLYGILVIVVGMAVNYYMTGLLKRVEKKRRATTDVKLERTSQFVESLRHLRWYDWQDRWLGHIMEIRQKELFQRVKSNVVDRSINVINNITSYMFPVVGFAAYTLILHRPLTVDIAFPALGLFTMLQNNLRDLPSLYTSLTNARVAMRRIEDFMLEPDKDDNEDDETVTPAFHQSNLEISIRNASFSWPGSDTTVLDNISFVCEPGLALVCGKVGIGKTALLQAILGELDQHSGEKNVPAEMIGYCAQMPWLESMSIRDNILFSTPFDEARYWQVLRACCLVEDLRKFKGGDRSLIGENGTGLSGGQRARVALARAVYSRSRILLLDDPIAALDHQTAETISRNLFADQNSPLTAGRLIVLVTHRVDIVQQYAYQVLDIVPGGTSQDFQQKGNCGTREGTGSTGRTTPESSPIAGSSTSQNTEDSSSEEEAELATVAGKFIQEEHRVHGGVMATVYWQYVKAGKLSWWATMVTLCLLIRMTNLGYNWFLKEWGEQYRESTELGDRPYILISHAAFKADGIIEPGRHLPPPGKNVRPWLTCLAIIALVQVLFEALSDLALIAIIYNAGKSLFAKAMRCVTNATFRFYDVTPVGRLMNRLTSDMGTIDGQIATQVLTLAFYSLGWMTSMFVIATATPVFIIPSVGTTMLFVYLYGRYLPASQDLRRLETVSLSPLMSNFGTLLEGLTTVRAFRAEPHFQNRIIATTDDFQKMDHIYWSLQAWLQYRFDLVSGLSVYALTLTAIIHGLSSGMIGFVLAAAANFVESTHQVCHRYGDMQMQFVSVERIIELLSLEQEQANTDNPPPAGWPSCTDDIVFDKVTLRYAPEFDPVLVDVSLVIPGGSTVAVTGRTGSGKSTLAYALLSTIQPDAGTGGQIRIGSVDIAKVDKHILRRHITFVAQDPVLFAGTLRDNLDPLDEHSEGERAQVLKTVLNNGFTLDTRVDGGGKNLSQGQRQLVGLGRAILRRSAIVIMDEATASIDVETATYIHQLLRMELRHSTVITIAHKVEAVKDADFEIVLDKGRVVK

SEQ ID NO: 4060 - protein, 710 aa, Neurospora crassa
  unsure (1)..(710): unsure at all Xaa locations
MSWKLTKSMSANPRLFPFPFPTAEHHIXHVGTPELKETHLGPLSSPFSRSPSTSTITDKEDKSQAGSSGAATPSNENTIGRRSARLVHSAITRLTSFPFTAASEALTQAPIVKPPKPGILVVTLHEGSGFSLPEQYRNVFSSNHGGNSMSTGSALNVAGSIRTNNSSRTANFLSGSSRPQSSGGFGAIPTNHGRISTKYMPYALIDFDKVQVFVNSVEGNPENPLWAGSNTQYKFDVSRVTELAVHLYIRNPNAAPGSGRSQDIFLGVVRINPRFEEKQQFVDDPKASKKDREKAAADFANKERALGHSGVEWVDVQYGTGKLKIGVEYVENRAGKLKIEDFELLKVVGKGSFGKVMQVRKKDTNRIYALKTIRKAHIISRSEVAHTLAERSVLAQINNPFIVPLKFTFQSPEKLYFVLAFVNGGELFHHLQKEQRFDVNRSRFYTAELLCALECLHGFNVIYRDLKPENILLDYQGHIALCDFGLCKLDMKDEDRTNTFCGTPEYLAPELLMGNGYNKTVDWWTLGVLLYEMLTGLPPFYDENTNEMYRKILSEPLHFPGPEVVPPAAKDLLTKLLNRDPQQRLGANGAAEIKAHPFFHAIDWRKLLQRKYEPAFKPNVVSIKSAAYSPVEQAQCANYGDYRVDALDTANFDPEFTSELPQDSYVEGPILSETMQNQFTGFSYNRPIAGLGDAGGSVKDPSFASSLQDN

SEQ ID NO: 4061 - protein, 580 aa, Neurospora crassa
  unsure (1)..(580): unsure at all Xaa locations
ANTLSAWSDLQSHHSKVGKTFVLKDAFKSDPERFSKFARTFTLPADISSDSPNATDILFDFSKNLVTEETLDKLVRLAEEAGVEKKRDAMFAGEKINFTEDRAVYHVALRNVSNQEMKVDGVDVMNTKGGVNEVLQHMKEFSEQVRSGEWKGYTGKKLTNIINIGIGGSDLXVQTSCLPSARERSIDXQVPSQGPVMVTEALKHYGAKDMTLRFVSNVDGTHIAEALAASDPETTLFLIASKTFTTAETITNANTAKSWFLEKTGGQGDITKHFVALSTNEAEVTKFGIDAKNMFGFESWVGGRYSVWSAIGLSVALYVGYENFHKFLAGAHAMDNHFRTAPLKENIPVLGGILSVWYSNFYNAQTHLIAPFDQYLHRFPAYLQQLSMESNGKSITSDGSAAKYTTGPIVFGEPCTNAQHSFFQLVHQGTKLIPADFILAAKSHNPISNNLHQKMLASNYLAQAEALMVGKTAEEVRAEGNVPEHLVPHKVFLGNRPTTSILVGGHIGPAELGALIVYYEHLTFTEGAIWDINSFDQWGVELGKVLAKKILKEIDEPGAGSGHDASTGGLLGAFKKYADF

SEQ ID NO: 4062 - protein, 310 aa, Neurospora crassa
LMCPECKEDPPHLVEEFSSGDMVCGSCGLVLGERIIDTRSEWRTFSNDDQGNDDPSRVGDGPNQLIDGDQLQTTIAFDGKNGKNLSHLQNKITQDKNSKQLMQAYRDIQGLTDSINAGTQVANAAKHIYKLVEDNKALKGKSQEAITAGCIFIACRQTGVPRTFREIYSLTKVSKKEIGRVFKQLESFLQKIGGEEHAITTSIPTFNQQYQGKGSTTATELCARYCSNLNFRNSVAVEDVARQLADKTSTISELAGRSPLSVAAACIYMASHIRNESRTSKEIATVAGVSDGTVKTAYRLLYNKKDKLLE

SEQ ID NO: 4063 - protein, 541 aa, Neurospora crassa
  unsure (1)..(541): unsure at all Xaa locations
MPSNTQTEFAPAPERNPDKYGPNANNNQKKCSQLASDFFKDSVKRARERNQRXMLQRCAFAPTSRRDRCXHPFQQSEMEQKLGETNDARRRESIWSTAGRKEGQYLRFLRTKDKPENYQTIKIIGKGAFGEVKLVQKKADGKVYAMKSLIKTEMFKKDQLAHVRAERDILAESDSPWVVKLYTTFQDANFLYMLMEFLPGGDLMTMLIKYEIFSEDITRFYIAEIVLAIDAVHKLGFIHRXASPEAMLWKRDTDTVVHAEDIKPDNILLDRGGHVKLTDFGLSTGFHKLHDNNYYTQLLQGKSNKPRDNRNSVAIDQINLTVSNRAQINDWRRSRRLMAYSTVGTPDYIAPEIFTGHGYSFDCDWWSLGTIMFECLVGWPPFCAEDSHDTYRKIVNWRHSLYFPDDITLGVDAENLIRRYACFXLPPKSRAHHIDLSXPICNTENRLGRGGAHEIKSHAFFRGVEFDSLRRIRAPFEPRLTSAIDTTYFPTDEIDQTDNATLLKAQQAARGAAAPAQQEESPELSLPFIGYTFKRFDNNFR

SEQ ID NO: 4064 - protein, 1170 aa, Neurospora crassa
  unsure (1)..(1170): unsure at all Xaa locations
MVRTRRSVVAADEVVGRSFDEALLVETGDRLALGVNVITTDMNIPVAAPIAEIKKPRGRPRKSATPAVSATASSVPTPATYTSGSEYATPLTSHAATPTPSLLKENVRSTRSTQSAPKIEVAIPVLKASHTMQTTLRSSASATTSKRKRNMVADSQEDDSDDGHDAKLARMLQDEEDAKVASSSKTPSFRVDHLGSTPRSTRSSHRGNTNVSSSKTKKEVIADSEDDGFDDSPDATLARKLQAEEYGEEDSEVEAATSNVKALGLRRSSRRLNSSPVRASSNVTGKSTAVAKGNQSAPTRNSTRRGVAESSTQVLGFRTAKDLIADSQDDDDDFDSLSAFESDDNDSDVSAQGGRPSAAQKGKGKAIAPPPESEDENDSDDSVLSLPDEADEMSVLGTGSYVSIDEDPDFLLPPNLQASVHGSDDDEDATLGAHIAEAGEGLDRIRAQMSNRRAYRSYRSNRRVKKDRLRLEKQHPELTTMWKDLENMPVLKAGRAEQPKSISRQLKPFQLEGLAWMTAMEKTEWKGGLLGDEMGLVRHGFLLDFSLVSVCXLLLVTSXGKTIQAVSLIMSDYPAKKPSLVLVPPVALMQWMTEIESYTDGTLKTLVVHGTNSKSKNLTVKNIKSYDVIIMSYNSLESMYRKQEKGFKRKEGLYKEKSVVHQTEWHRVILDEAHRXVLNRRILTTEXRLTYHTTSIKSRTTMTAKACFALKVTYRWCLSGTPLQNRIGEFFSLIRFLNIRPFTCYLCRGCPCKTLEWGMDDDNRCKHCNHSAMQHVSVFNQELLNPIQKFGNRGEGALAFKKLRILTDRIMLRRLKKDHTNAMELPVKEINVERQFFGEVENDFANSIMTSGQRKFDTYVATGVLLNNYANIFGLIMQMRQVADHPDLILKKNGEGGQNVLVCCICDEPAEDAIRSRCKHDFCRVCVKTYVHSATDPNCPSCHIPLSIDLEQPELEQDEAQVKKSSIINRIKMENWTSSSKIELLVHELHKLRSDNASHKSIIFSQFTTMLQLIEWRLRRAGITTVMLDGSMTPAQRQASINHFMTNVDVECFLVSLKAGGVALNLTEASRVFIVDPWWNPAAYVYPYGVTXRTFXLTCSQXMQSADRCHRIGQSRPCTITRLCIEDSVESRMVLLQEKKTNMINSTINADDAAMDSLSPEDLQFLFRGN

SEQ ID NO: 4065 - protein, 557 aa, Neurospora crassa
  unsure (1)..(557): unsure at all Xaa locations
MAEQEHNGVNGFHSESEQRNQPVNGDASEAVNGNPSNGLRVTIEESASSAVNGGSPTNSMLTPIRQRMERKKSSPMMPTFMVSAPGKVIVFGEHAVVHGKVRRSSTXIMVMLEKGVMIPRGXRLSLFARAAIAAAISLRSYLLVNTLSKSKRTVTLKFPDIDFNHSWNIDELPWKIFQQPGKKKYYYSLVTEIDQELVDAVQPFLADVSIDKPADIRKVHQNSAGSFLYMFLSLGSQSFPGCQYTLRSTIPIGAGLGSSATIAVCLSAALLLQLRTLSGPHPDQPPEEARLQIERINRWAFVYEMFIHGNPSGVDNTVSTQGKAVVFQRTDYNQPPSVRPLWDFPKLPLLLVDTRTAKSTAHEVAKVATLKKKHPQLVGTILTAIDQVTQSSAQLIEEQGFNTEDEESLSKVGEMMTINHGLLVSLGVSHPRLERVRELVDHEGIGWTKLTGAGGGGCSITLLRPGVPREKLDKLEQRLDEEGYSKFETTLGSDGVGVLWPAVLKNGMDEDEEGGMEIDLEKFLSADSNEALEKLVGVHGDRGEREGWKFWRVENRD

SEQ ID NO: 4066 - protein, 588 aa, Neurospora crassa
  unsure (1)..(588): unsure at all Xaa locations
KGSXPGRSSPVKAPATTTSNPTTTNTTSQTASQPSEPTTVLERSQQRYEKTRPFEAARQQKGLSKLPKEDQKGWICDQLLHLTNRLPAASRSSLLGPKASKEIWWTVNGTNSIVRGLKHKPKPHTTWGTDRNGHDVGSYTIERFDERFRKRIALTALQVSSRVFRENVEREKRGFVDARSGREIIVTEREIDEEKVRRSKMAALKKDLYGAITGKLAESVEWEDVVPIPHEEPEGALAAIIYPAEYAEGMLHTSFLSPPHQSGHDQSXFSSKKIAMSYLRAVMTTKEYSPRCLRLTEHIIAMNPAHYTVWLYRAANIFALGISIPDEIEWLNEVALANLKNYQIWHHRHLLVEHYYPTISSDPDALAQFAKQERGFLIAILSEDTKNYHVWSYRSWLVGKLGMWEDEEELKSIEKMIDEDVRNNSAWSHRFVLVFSNPKYATPGKAATEKDEKVPQELVEREVKYAQNKVYLAPQNQSPWNYMRGVLVKGGQPLASVQEFVEEFVNKLGEGEEEEEVKSTHALDLLAEIYAEKKENEKADLCLRRLAEKWDKIRGGYWEWRRKCLTQSETEKAPGEQVEKAEEGIAAA

SEQ ID NO: 4067 - protein, 206 aa, Neurospora crassa
MSLNVAQRRLLQEYRALTNNPPEGITAGPISEDDLLHWECLIQGPEGTPFEGGVFPAELKFPNDYPHMPPTMKFLGDIFHPNVCSSSPSSSSFFISLILHLVLLTICGGQACKVLTEINPPTVYPSGLVCISILHPPGDDPNHYETASERWSPIQSVEKILLSVMSMLAEPNDESPANVEAAKMWREKRSEYEARVKASVRASLGL

SEQ ID NO: 4068 - protein, 279 aa, Neurospora crassa
  unsure (1)..(279): unsure at all Xaa locations
MVGNKQVLYKLVVLGDGGVGKTALTIQLCLEHFVETVSVLFSQPFSLQADRLPPQLHIPALPTSLPGLANXPPTCILSLSLISTIXYDPTIEDSYRKQVVIDGQACMLEVLDTAGQEEYTALRDQWIRDGEGFVLVYSISSRSSFARIKKFHHQIQRVKESTSSPSAYPGSSPLAATNPSAPVPIMLVGNKSDRVTEREVSTQEGHALARELGCEFTEASAKTRTNVEKAFYDVVKQLRKQRQQGQSTPRALPPSGNSKSEKYSGTEKPKRPRGKCLII

SEQ ID NO: 4069 - protein, 914 aa, Neurospora crassa
QGDQHDDAQAPFLSENPMPYDNDRLGTDTPPVRPVSAYSLTESYAPGAGTTRAGVAVNPTPPPHGGYGGGGVSSGVDQGYNYGGDYATDPAYRMSAIDEDDSWLRRQQPNAAPTGGLKRYATRKVKLVQGSVLSLDYPVPSAIRNAVQPKYRDEEGNNEEFFKMRYTAATCDPNDFTLKNGYDLRPRMYNRHTELLIAITYYNEDKVLLSRTLHSVMTNIRDIVNLKKSSFWNRGGPAWQKIVVCLVFDGLDKTDKNVLDVLATIGVYQDGVIKKDVDGKETVAHIFEYTSQLSVTPNQALIRPVDDGPQTLPPVQFIFCLKQKNTKKINSHRWLFNAFGRILNPEVCILLDAGTKPSPRSLLALWEGFYNDKDLGGACGEIHAMLGKGGKKLLNPLVAVQNFEYKISNILDKPLESAFGYVSVLPGAFSAYRFRAIMGRPLEQYFHGDHTLSKLLGKKGIEGMNIFKKNMFLAEDRILCFELVAKAGQKWHLSYIKAAKGETDVPEGAPEFISQRRRWLNGSFAASLYSLMHFGRMYKSGHNIVRMFFFHVQLIYNIANVIFTWFSLASYWLTTTVIMDLVGTPVTASSSSAEHHGWPFGDTVTPFFNAVLKYIYLAFVILQFILALGNRPKGSKWTYITSFFVFSLIQSYILVLSGYLVARAFSVPLDQQLQLDNAKDAMASLFGGSGSAGVILVALVTIYGLYFLASFMYLDPWHMFHSFPYYMLLMSTYINILMIYAFNNWHDVSWGTKGSDKAEALPSANVSKGEKDEAVVEEIEKPQEDIDQQFEATVRRALAPYKEDETPEPKDLEDSYKSFRTMLVVSWLFSNCLLAVVITSDNFNTFGIGVSIAVHLIVTLNHLLIYIDSQTASARTAWFFKFLLFATGALSVIRFIGFCWFLGRTGIMCCFARR

SEQ ID NO: 4070 - protein, 146 aa, Neurospora crassa
  unsure (1)..(146): unsure at all Xaa locations
RXXTDLSELSLGSTMKTEFPDPDDILNFILYIEPDEGMYKGGKFSFTFNITPNFPHEPPKVQCREKIYHPNIDLEGKVCLNILREDWKPVLNLNAVIVGLQFLFLEPNASDPLNKEAAEDLRSNREGFKRNVRTAMSGGTVKGQTY

SEQ ID NO: 4071 - protein, 620 aa, Neurospora crassa
  unsure (1)..(620): unsure at all Xaa locations
PVPILQCLQIKTLDSKNGGAGATERFRIVLSDLKNYVQCMMATQTNHLVHDGLLQRGCIVRLKQYQLNVSRAKSTPIYPSANSGNPXHXLFKSSILIVLDLEVIQSLGCPEKMGDPQPLGPRSAEPQQNPNLGSTGFYGVKSEPTQDTKPQFPRQMPSRNASGGQGSSTIYPIEGLSPFSHKWTIKARVTSKSDIKTWHKASGEGKLFSVNFLDESGEIRATGFNDQVDQFYDLLQEGQVYYISTPCRVQLAKKQWSNLPNDYELTFERDTVIEKAEDQTSVPQVRFNFVNIQELQDVERDATVDIIGVLKEVQEVTQIVSKTTQKPYDKRELTLVDNTGYSVRCTIWGKTATNFDAQPESIVAFKGTKVSDFGGRSLSLLSSGTMAIDPDIPEAHHLKGWYDSSGRNNTFATHNNMQTLGGATGRKDDAKTISQVKEENLGTNEAPDYFALKATVVFIKQDNFAYPGCRSEGCNRKVTDMGDGTWRCEKCQINHDRPQYRYIMSVNVNDHTGQLWLSCFDDTARVIMGKSADELMEIRETDETRLPAEFEQANCRKLNFRCRAKMDTFGEQQRYVSGVILTIRWTLLTHCLLQIRYQVMSVAPLDYKMEGNKLNELINS

SEQ ID NO: 4072 - protein, 690 aa, Neurospora crassa
  unsure (1)..(690): unsure at all Xaa locations
DVIYELQSIMRLHELDVQDMFFKWESYCIKMDMDQPKMSMSTVRKFKQDLQDTLERANRAQALEQVKTEKRPGGTPRPGARNNSDVFGMLDGLTTPAARRAAKLGSARKTPMGTPIGSRLKNEPVSSPMKLEAQLDAMGVIPYVQTSSLHTYCMYLANRSKTIFFQRXTNAGEVIEILNENLPAPEPPIAPFGESRIKLTAASDLKKLGYKPLAMKLSEASEILDDRIDDFTSLVLEHYKLDESVFGSAAMQSTTEIVAVGRVASDTSEGKLNAASLVLETSRKLGGGFRVPLNVSKLKGYQFFPGQIVALRGTNTTGREFTVNEVIRMPLMGNAASTLETMAAHRERLRGGPDAMDTDDENPMPLNVIFASGPYTADDNLDFEPLHTFINEAADTYADAVILTGPFIDAEHPLIASGDFDLPEEAVYDPDAATLNTVFKYLISPALNRLVSANPHVTILLVPSVRDVIDRHVSWPQDPFPRKELGLHKSIKILGNPMTLSLNETLVGISSQDALWELKHEELIGGTVEDTNGLSRVARYLIEQRHYFPLFPPTDRTKLPKTGRQVIDGQAAPGAMLDISYLKLGEMVNVRPDVLIVPSALPPFAKVCFFFVVLLNLLFILGMRAVTDFLVXVIESVLVINPGYLSQRKRAGTYARMTLYPPKLSEADAAPGGMLAHRIFERARVEVTRI

SEQ ID NO: 4073 - protein, 1303 aa, Neurospora crassa
IVEGLLRQRPIPPSKDGRHIPLKPGLVRQTPLNDERTGQPYVSNFIRSSRYTLYDFLPKQLLFQFGKLANFYFLVIGILQMVPGLSTTGTYTTIAPLIVFVCISMAKEGYDDYRRYRLDKLENRSAAFVLDPDGTVSTRVRGRKRGMLMEMVKGKKSAEGGAATELAGLERVTTAEVDQSEGEGGGEPWARIEWQDIRVGDIVQLRRDENVPADMVLLHATGPNGVAYIETMALDGETNLKSKQACPLLLNHCSSTNDMAHCDATVVSEDPNLDLYNYEGRVTVNGETMPLTSNQIVYRGSTLRNTTQAIGIVVNTGEECKIRMNAHKNVRTKAPEMQFMVNRIVMLLVVFVVALAVGCTGGYTMWHRSNERKAWYLIQQKVPIKEIVIGFIIAFNTLIPLSLYVSLEIIKLGQLYLLADVEMYDPKTDTAMSANTTTILENLGQVSYVFSDKTGTLTENLMRFRKISVGGAAFLHDMDIRRDAEKAKQEQLAQDLPKRSLSISAKPRPSNVEASLEPLAEESSNEPIVANQSAWHSSAGVKHGQREPNTEELIRYLQQRPNTPFSRIAKHFILCIALCHTCLPETKEDGEMTFQAASPDELALVEGARDLGYLVIDRPSQAIRLQTRDADGNPVTETYEVLDVIEFSSKRKRMSIVIRMPDGSTCIFTKGADSMILPRLKQSNLAIQTAGKIGQMASMRKSMEQEKALRRLSLHSIKRDSMNLVRASRASMDHRRVKGSQRRSTFFTDEVDSWLVRRETDEFDDSNPPPRRSMQRGRSFEVGRPHDPLDGMVDEHLALNEAAVFERCFKHIDDFASEGLRTLVFAYRYLDGEEYRKWKTIYHEATTSLVNRQERIEAAAEIIEQNFDLAGATAIEDKLQHGVPETIDKFRRANIKIWMLTGDKRETAINIAHSARICKPFSEVYILDATQGDLQERLASTLIDVGRGMVPHSVVVIDGHTLSVVEEDESLRVLFFDLVVRVDSVICCRASPSQKATLVQSIRQQVPKAVTLAIGDGANDIAMIQASHVGIGISGREGLQAARISDFSISQFRFLQRLLFVHGRWNYIRTGKYILGTFWKEIVFYLVQAQFQRYNGYTGTSLFESTSLTVFNTLFTSLPVILFGIFEKDLEADTLMAIPELYTYGQKEKAFNVRLYIGWMFMAVSESVLIFSIVWYVYGITLPPENAALYPVGTLAFTICVIFINIKMLVLELHNRIAICFAGLFISVFGWFLWNLLLSGIFSAKMSPYLVRDGFIRGFGQHAPWWVVCIIALSALLIFEVAISAVRRSLWPTDQDLMKEIEH

SEQ ID NO: 4074 - protein, 591 aa, Neurospora crassa
  unsure (1)..(591): unsure at all Xaa locations
ERKLGTWSTAFLIFNRVVGAGIFSTPSSIIHNTNSVGATLLFWVLGGVMTFWXVLYHPFLPCPTPSLCTFTTLTTRKAANSHPQPQSGLAVYLEFGTAIPRSGGEKVYLERVYRKPKYLATCIFAVQFILFAISTVGSVSFSSYLLRCVLGSPDTTTTGGTAQEDATKYEGTWLNRGIAVAAITAVCLIHAFLPRLGIWLSNGLGVFKLVLLILVVCTGFRALAGNMEGESPRNFSSFDGPGDATGNGDDQTDGMGNNVAGSAAGYALALLQVLYSYGGWENANYVSDPSEVGGDGLVRXCXQRVCRCXSEVRDAPKTLRLAAPIAIGTVTVLYVLANIAYVSIPSSVSQELPXLTTHSSPPMTKDELSKSGVVPTAIFFTRVWGPSAFTERVMPLFLALSALGNVFAQSFAMPRVKQELAKEGTLPFSRFWASDWPEQKSPTGAILLHWIFTVALILGSSTKDVYQFLSNIFTYSGNWIKVFLGVGLLYLNFTPSENWTTPENKRFHSYPVLTVFWVVGLLYTCAAPFIPNTLLTKVHFSVVPALGTGMLVIGVMYWVVWAKVLPAFGFSIQHEVVVLPDGSERVKYKRV

SEQ ID NO: 4075 - protein, 185 aa, Neurospora crassa
  unsure (1)..(185): unsure at all Xaa locations
QDNSGTIEREEFLSLPQISTNPLATRFVTFYPYTYPCSYQYIACFWLSPRGNAVWAQYATSFRVKTGDXRFPTWVLCRMIAIFDEDGGGDVDFQEFVSGLSAFSSKGNKEQKLRFAFKVYDIDRDGYISNGELFIVLKMMVGSNLKDQQLQQIVDKTIMEADLDKDGKISFEEFTKMVENTDCQH

SEQ ID NO: 4076 - protein, 250 aa, Neurospora crassa
  unsure (1)..(250): unsure at all Xaa locations
ACLFDMDGLLLDTEDIYTLCVNELLRKHKKEKFPLPWSIKAQLQGRPGPAALDIFHNWADLPITREQYKEEYYALQAQKFKHTTALPGVEELLQKLGSTRYWDLKGDASATTNGATDKPAPKPHRVHIALATSSHEANFRMKTNHIQELFSVFETHRRVLGDDKRIPEGRGKPLPDIYLIALKTINDSLPEGEKPITPEECLVFEDSIPGVEAGRRAGMRVVWCPHPMLKKEVGQEWRRQAGSRGSSXPS

SEQ ID NO: 4077 - protein, 479 aa, Neurospora crassa
APTEPLFLHSGQRRSQITWPPSSSPLADSYSSLQVWKINRERAVDYLNTRNRIYVVDGYAGWDEKYRIRVRVVCARAYHALFMRNMLIRPPREELEHFHPDYTIYNAGSFPANRYTEGMSSSTSVAINFAEKEMVILGTEYAGEMKKGIFTVMFYEGPVKHNILTLHSSANEGKDGDVTLFFGLSGTGKTTLSADPNRRLIGDDEHCWSDRGVFNIEGGCYAKTIGLSAEKEPDIFNAIRYGSVLENVVFNPETREVDYGDATLTENTRCAYPIEYIPNAKIPCLSPNHPKNIILLTCDARGVLPPISKLDSAQTMFHFISGYTSKMAGTEDGILEPQATFSSCFAQPFLALHPMRYAKMLAEKIENHNANAWLLNTGWVGAGFAQGGKRCPLKYTRAILDAIHSGELANVEYENYEVFNLQVPKSCPGVPSELLNPKTAWTAGANSFDTEVKKLGGLFLENFKKYESEATEDVIKAGP

SEQ ID NO: 4078 - protein, 139 aa, Neurospora crassa
FDLFDSNKDGLLSYEEFRFVLRALGFELPKAQTFDLLIRHGQKPANWPLDQECPPVYRLFNLPTAQAIAGTLIRQRDPKEELRRAFRLFDIDGKGMITQDDLRRVSKQVGNNIPDADITAMIEEFDASGKGGVDEDEFL

SEQ ID NO: 4079 - protein, 483 aa, Neurospora crassa
DAPVYTLAEGRPVQDPSAATVLMGSKPRGGALSLLADTQLIETLAHFPRERIPERVVHAKAAGAWGEFECTEDVSDFTSVDFLNKVGKKTKVLARISTVAGEKGSADTVRDIRGFAVKFFTEEGNWDFVGNDLPVFFIRDPVKFPSLNRSHKRHPQTNVPDSTMFWDFHNNNQEGVHCLMQLFGGRGIPASLRNVNAFGNHTYKFGKPEDGTFKYVKIHLKPDAGIKNLESDEALRLAGEEPDFHIKDMYNAIERGDYPTWTMYFQIMDPKDAETYRYNIFDITQTWSHRDYPLRPIGKLRLNKNPENHFQDIEQAAFSPSTMVPGIGPSADPMLQARMFSYPDAARYRVGPNYQQLPCNRALHVYSPYQRDGPMRVDGNYGGDPDYVRSSFRPMRFGPPDVAHDEWAGKVALFTSEVTDLDFEQPRDLWKIFKETGEDKRFAKNVAAHVGKALPEVQKKTIEMFSKVDQEVGEAIQRELDEL

SEQ ID NO: 4080 - protein, 499 aa, Neurospora crassa
SIGGTIGTGLFIGSGSALAKSGPAGVLIGYCFIASIVYSIMMSLGEMATYVPVTGGFTTYAARFVDSSLGFSMSWIYWFSWAITFALELVATGLIIQYWDDSLSIGIFIAIFWVVIFVINLFPVSWYGEAEFWMSSVKVITVLGFLIFGICINAGAGQQGYIGFKYWHEPGAFAPYIVDPSRPVAKWVGFWSVMIQAGFSFQGTELVGIAAGETEDPRRNVPRAIRMTFYRIFLFFIMTVFFIGILIPYDNKDLNNGGYTAAASPFVIAAQLAGVKVLPDIINAVLLTVVLSAANSNVYSGSRVLVSLANDGMAPKWFKMTTKSGVPYIAVMFTSAFGFLGFLNLSPNGSQAFDWLLNISGVAGFIAWSGILIAHLRFMKGLEAHGIPRSKLPYRATWAPYYVYYALFFCILITLTQGFTAFMPWSVEEFFVAYVSLIIFAVMYLGHKLYTLIVYGAAACKPVSAKDMDVTTGSLDLDAEIPDEVEEPTSIWKKIGTGI

SEQ ID NO: 4081 - protein, 233 aa, Neurospora crassa
LYSNITWHPSLSRHERNQLRGQRGFTIWFTGLSASGKSTVATALEQHLLHIGLAAYRLDGDNVRFGLNKDLGFSEKDRNENIRRIAEVCPIHQLPSFLPFTLVCFSCLLPWILPFQVAKLFADSATIALTSFISPYRADRQIARDLHANATQAGDDVLPFIEVFVDVPLAEAEKRDPKGLYKKARAGEIKDFTGISAPYEAPESPEITIRTDLLSVEECVKKIVDYLAEAGLI

SEQ ID NO: 4082 - protein, 411 aa, Neurospora crassa
  unsure (1)..(411): unsure at all Xaa locations
ILEFSIPSFKIGTLDALVQHADDLTKLNAICEAVVSKVADSLAGILDGDEDKISQQKMVNDSKHCSSVDLMAPLLCRXCXQCPEPTDSYICSFQWNKVRYRAEKPLGELIENLQKDIQNIDNDVKAKFNQYNAVKTNLSALQRKQTXVTQCCTVSRLLRKTLTALQGNLATKSLTPIVQPDVLIQDSEYLETHLIVVPLSARKDFLRSYETIAEMVVPRSALQIAQDDEFILFAVTTFKKTSADFLHKCREHKWTPRQYKYVEGGKEEEQRELERMVREEKKVWGEALHMGRSGWSESVMVWAHVLTLRVFVETVLRYGLPLEFVCALVKVGLRXGMTTLRLTLTLWQTIPKQAKKVKTALDKAYSYLGGNAFGRDKRGRFTKDDASLASEMAAAGYSAGDANEYTAYVYY

SEQ ID NO: 4083 - protein, 837 aa, Neurospora crassa
AAPEPVPEPIPKVTDESEQKGDVVASFEESAVTPRPEPSQKPYEPTSFLKKYPVSLVNVENLTEEPYDPKSQVIRAVTNEIVNVFKEVASMNSLFRDQISTFSMSQSTGNVMAEPAKLADFAAAVSAGEPAELQEVLSSLNVEERMHKALLVLKKEHVNAQLQSKITKDVEQKITKRQREYWLMEQMKGIRRELGIESDGKDKLVEKFKELADKLAMPEAVRKVFDDELNKLAHLEPAASEFNVTRNYLDWLTNIPWGQSSAENFDILNAVKVLDEDHYGLKDVKDRILEFIAVGKLRGTVEGKILCFVGPPGVGKTSIGKSIARALGRQYYRFSVGGLTDVAEIKGHRRTYVGALPGRVIQALKKCKTENPLILIDEIDKIGRGYQGDPSSALLELLDPEQNGSFLDHYLDVPVDLSKVLFVCTANLTDTIPRPLLDRMEVIRLSGYVADEKMAIAEKYLAPQAQEMAGLKGVDVQLTKDAIEELNKSYCRESGVRNLKKKIEQVYRKSALKIVQDLGEQALPESEALTEEGKAAQEETEKKKSEEAASGETSSPKAATEASEKETTEKPRVAMKIPEGVHVVINKDNLKDYVGPPIFTSDRLYDVTPPGVTMGLAWTSMGGAAMYVESILQSALTSKSAPSLEITGNLKTVMKESSAIAYSYAKAVMAKDFPKNRFFDKAKIHVHVPEGAVQKDGPSAGITMTTSLLSLALDTPIDPQIAMTGELTLTGKVLRIGGLREKTVAARRAGCKMVVFPEDNMSDWLELPEVRLYILAHQHNPHPDKLLTLSLSPNVKEGIEGRPVRWYSEVFDLIFPKLDREKANKSRIIEDDKSEKE

SEQ ID NO: 4084 - protein, 308 aa, Neurospora crassa
  unsure (1)..(308): unsure at all Xaa locations
PAEVQAVNVPDGTTDFIPLRGKKYDLKKPHITELPITWGNWCKXLFFFSDSFESLGKQKTLTVSPLTDKHVNWLNTTFIIFVPLAGLISAYWIPAQTKTILFSIAYYYFAGLGISKHAPHPRISEPGPXLTHSPLAAGYHRLWAHTSYKATLPLKIWLAAGGAAAVEGSARWWSRDHRAHHRYTDTDKDPYSVRKGLLYSHIGWMVMKQNPKRIGRTDITDLNEDPVVVWQHKHYIKCVIVMALIVPTLICGLGWGDYAGGFIYGGILRIFFIQQATFCVNSLAHWLGDQPFDDRNSPRDHVITALVT

SEQ ID NO: 4085 - protein, 1443 aa, Neurospora crassa
  unsure (1)..(1443): unsure at all Xaa locations
FKNLFAFTRPAHVSLMVTALCGSAVIAAGRTAYAVLLGKIFEVCTSYGAGVIAASELLHQVSHWCLYMFLLGIGMWVVCSFDVALWVMAGELRAKTTRETLFSTLLKKSAAWFDLREHGMSSLMTAIQTXVLRSPFGEKHYLTHTPPERQARELQMGTSQVFGFLVCDLLVFFSCIIVALYYSYKLTLVMLSTALPSALILWLIARFLDPAIAGQKRELAEAAKHATAATTAIDLVKAYNAADHESFQFISAVRRSSKYYTRQVLSNNGQMSYIKLWMMSLFVVGFYFAVVLVNREELTPGNALTTFYCALISFQSLQNLGPQWIILAKGMAAGQSLHDLVRQADPGQTKTCKEPGGLRPPTCQGDISLSNISFAYPSAPSNLVLQPSSFHFTPGSLTFIVGRSGSGKSTLGNLLVRFYEPLTGQITVDGQPITRLDLGWVRQNITLIQQSSVFFNDSLFQNVAYGGYQPDRVTVEDVKVACSMALLQTTVAGMPQGLDTQIGPGGYSLSGGQRQRLALARAKIRDPPVLILDEITSGLDPVSRGLIMDAIRIWRRGKTTIIITHEVGCIGEGEMVYVMEDGRVVQQGHGKQLREEREGLFAGLVASADHDGGDHGEGAEDSEKEEKEVESELEDIQELEEEESEEEVIEEATYVQLVRGLSLRGQRGSIVFPRLTFGYDTYSSADNRQSRPLSRLLGAGRVPVHHPHPHANPDGTRDVSPFSKPDDRRHSTSSIELITQTGLSVKKTRVANARRAQHPDQKVTEAQSNGSLDSLELFFLDKLANKKQRAGFRKKRRNSMASVVSAASHSSNPQLSKKQRHSVNNRLPSLSAILRTVWPTLDLRSKLELFLGICLGLVVAAANPLFSYVFAQLLSSFWSSPSARLAAGSKYAGILAAIACADALATFGSYYFLEKVATKWVTTLRSEAMTRILAQPKSWFDKNSHSPAKIVACLDRNAEEMRKLVGMFLPILIIVCTMITVAIVWALTIQWDLTLVTLAGIPAAVITGRLNALFSDKWESRCDQAALRTGQVLTETFGNIKVVRALTLEGWFTRKYEAKTTEAYQLGLRRATYVGLFFGLNQSIAYYLTAMIFYYGAKILSQDRASVTDLLRVINLILFSLGTCVNMLANVPQIAAAKATATQMLYFANLSHSSSHESQGSQRISNPLPIRMQNLRFAYPSAPDTLVLRNLNLTINPGTCTAIVGSSGCGKSTIASLLLNLYPPSVSTPTNNSLTFNSIPSDQVHTPSLRSCVGYIPQHPFLLPTTLRENILYGLPDSSPLRLPSHFHCLVHACQLASIHDFIISLPASYDTVVGEGSGLQLSGGQAQRVSIARALVRSPKVVVADEPTASLDAEGAEAVREVFARLVHGNRTGVHIDTSKEGKGHQGKEGKNEEMAIIVVTHSKEMMRIADRVVMIEGGMVVEEGGYDELRRTKGGRFAGMV

SEQ ID NO: 4086 - protein, 738 aa, Neurospora crassa
  unsure (1)..(738): unsure at all Xaa locations
IXQITNEVSNRATPSLVGFGPKSRYIGEPAKTQEISNLKNTVGCLKRLAGRTLDDPDVAIEQQFISATLVDVNGEVGAEVTYLGEKRKFSATELIAMFMSKIKQTTQAEVKVAVQELVLSVPAWFTDKQRRSILDAAEIAGLRPLRLINDTTAAALGWGITKLDLPGPEEKPRRVAFVDVGYSNYTCSIVEFKKGELSVKSTACDRHFGGRNFDKALLDHLHKEFLGKYKIDIFTNPKAVCRVLAAAEKLKKILSANQQAPLNIESLMNDIDVRAMITRQEFEAMVEPLLAKVHVPLEQALADAKLTKDDIDIIEVVGGGSRVPSVKERIQAFFGKQLSFTMNQDEAIARGCAFSCAILSPVFKVRDFQVQDIINYPIEFTWEKDADIPDEDTSLVVFNKGNVLPSTKILTFYRKQPFDLEARYTNPEELPGKTSPFIGRFSIKGVHATEGPEDFMICKLKARINIHGILNVESAYYVEDQEVEEEVKDENGDVSNILISDNRTSSDSPTKRRKLFDGSTQSLDGGTHENLDEEKLTHEKVVMEGDKPKTRKVKKQVRKGELPVVSATPSLDPAAKNAAIEREQAMIMEDKLVADTEEKKNELETYIYDLRNKLDDQYADLASEEEKEKIRAKLMEVEVCHFFPPLSKXPADTNQIKQDWLYDEGDDATKAVYVAKIEEIRALAGPVVQRYFDKVEAERQALQEKLEAEKAAKKAEEEARKAKEAAEKAAQEGAKDDE

SEQ ID NO: 4087 - protein, 1182 aa, Neurospora crassa
  unsure (1)..(1182): unsure at all Xaa locations
KKGNKKANDDWEAELGESIAPVNNNGADAAAASPAAADDEAASGGGGLMERMRKAKEKRKKKGLADDWEAELGEDAPGAEKPAAAEPVPDLSAKVAEEANLDDEFALPEKKGKGGKGKQQQQQQKAAPAAAAKKDEDAADEDGPRVLTKAEKEKLKKEREKQRKKEAGEYPVIITITHXXLYIHQTQTEDXQQLLFTKQAAAKKKGTTPAAAAKAEPAKEEKKAETPSPVSTPASTPAPEAAAGGKKKKLPAHLLALQKQQEELRRRQEEEARLLAEEKARIEEEERAAAEEAKRKEEERARKKEKEKQRIEQLKKEGKFMTKAQKEEKARNERKLQQMLAAGIKVNALEGEESKKKPVYDDKKKRAANKKVSLSGILATITVYYGRRXPVSTCYRRTRKRLSPRPLSAQDSPLEALVKEQEEKARIEREKAEKEAAAKAEAAKAAAEDSVDEDWEAAVASDKEDVKDSWDADSDEEEETKKEETKKEASKPAAANGKTQAKKEESESESESEEESEEESSEDEEATARELEEARRKKEAAERREKAHQAALAARSADNLRSPICCILGHVDTGKTKLLDKIRQTNVQEGEAGGITQQIGATYFPVEAIKQKTHVVNRDGKFEFKVPGLLIIDTPGHESFSNLRSRGSSLCNIAILVVDIMHGLEPQTLESMRLLRERKTPFIVALNKIDRLYGWKKIENNGFQESLALQNKAVQNEFKNRLEQTKLAFAEQGFNSELFYQNKSMAKYVSLVPTSAHTGEGIPDMLKLIVQLTQERMVGSLMYLSEVQATVLEVKAIEGFGMTIDVILTNGILREGDRIILCGTEGVIKTNIRALLTPAPLRELRLKSQYVHNKEVKAALGVKISAPGLEGAIAGSRLLVVGPDDDEDDLEDEVEADLASLFSRVEKSGRGVSVQASTLGSLEALLDFLKECKIPVANVGIGPVYKRDVMQCGIMLEKAPDYAVMLCFDVKVDKEAQEYADQQGVKIFTADIIYHLFDSFTKHMDELLEKKKEESKLLAVFPCVLAPVAVFNKSGPIVIGVDVVEGQLKINTPISAVKTNPVTGAREVIDLGRVYVPPFFFPFHPMILLSMTXSLTDSCKCSTSIERDHKQIPVCKKGQPSVAIKIEMGGNQPTYGRHLEEKDMLYSKISRASINCLKEFYRKDVTNDEWQLIIKLKPMFDI

SEQ ID NO: 4088 - protein, 234 aa, Neurospora crassa
  unsure (1)..(234): unsure at all Xaa locations
RSKRGATGTNRSTGKSSLAVRFVDGHFVESYYPTIENTFSKEIRWKNQDYSTEIVDTAGQVRFFLTPFPPYPIDVNFTRATHFTDTSTSTGEYSILNSKHFIGIHGYMLVYSVSSLASFEMVQVIRDKILNHLVSSILFIQTSSWIITMISYXLQQGTDNVPICIVGNKSDLRPEQRQVTPEDGKALAEKYKCAWTEASARYNENVARAFELLIGEVEKSNNPTATNENGKCVV

SEQ ID NO: 4089 - protein, 1692 aa, Neurospora crassa
  unsure (1)..(1692): unsure at all Xaa locations
SYDVGTRAWQPDPTEGWVASEVVKKTVDGNKVTLIFECENGEVVAYAFPSLGIFRLLCFGLRALRAGALQDANMCYCLQTKTVEVSLEALQSGGHESLPPLMNPTMLEASDDLTNLSHLNEPAGKYTHTFALTRPAIGRTPRTXCXXHVLCLVLQAIRLRYAQKEIYTYSGIVLIATNPFARVDSLYVPGMVQVYAGKQRATQAPHLFAIAEEAFMYGLFANLTIHVDLXSLTXQXDMLRDGKNQTIVVSGESGAGKTVSAKYIMRYFATRESPDSPGSRVKKGGHESMSQTEEAILATNPIMEAFGNAKTTRNDNSSRFGKYIEIMFDKATNIIGAKIRTYLLERSRLVFQPLKERNYHIFYQLVAGVTDKERQELGLLPVEQFEYLNQGNTPTIDGVDDKAEFNATKASLKTIGVDEGKQTEIFKLLAGLLHLGNVKIGAMRNDSSLDPSEPSLVKACEILGIDAPEFAKWIVKKQLVTRGEKIVSNLTQAQAIVVRDSVAKYIYSSLFDWLVEIINHSLASEEVLTRVTSFIGVLDIYGFEHFAKNSFEQFCINYANEKLQQEFNQHVFKLEQEEYLREQIDWTFIDFADNQPCIDLIEGKLGILSLLDEESRLPMGSDEQFVTKLHHNYAADKHKFYKKPRFGKSSFTVCHYAIDVTYESDGFIEKNRDTVPDEHMAVLRASTNQFLVSVLDAASAVREKDLASASSNAVKPAAGRRIGVAVNRKPTLGGIFKSSLIELMNTINGTDVHYIRCIKPNEAKEPWKFEGPMVLSQLRACGVLETVRISCAGYPTRWTYEEFALRYYMLVPSTQWTSEIREMANAILTKAFGASTGKGLDKYQLGLTKIFFRAGMLAFLENLRTTRLNDCAILIQKNLKAKYYRKRYLAARNAIVSFQALIRANKARNSAQERRTTKAAITIQRVWRGYKDRKQFLEVRNDVIRAQAAIKGYMKRKKIMEERVGNAVLIIQRNWRSRQQLRSWRDYRRKVTIVQSLWRGKTARKDYKALRAEARDLKQISYKLENKVVELTQSLGTMKNQNRELKTQVENYEGQVAIWRNRHNQLEARAKELQAEANQAGIAAARLEQMEAEMKKLQASFEESVANVKRMQEEERELRESLRATSVELDSARIESQRQEAEKNSLRQQLADLQEALEQARRQVPINGDILNGNGIAPQVPTGLINLVSSKKPKRRSAGAEPREMDRYSMAYNPRPVSMAVPGLNRQTTLSGSTFVPGVDSIELELEGLLADEDALNEEVTMGLIRNLKIPSPSTNPPPSDKEVLFPAYLINLVTSEMWNNGFVKESERFLANVMQSIQQEVMQHDGEEAINPGAFWLSNVHEMLSFVFLAEDWYEAQKTDNYEYDRLLEIVKHDLESLEFNIYHTWMKVLKKKLFKMIIPAIIESQSLPGFVTNENNRFLGKLLQSNTAPAYSMDNLLSLLNNVYRAMKAYYLEDSIITQTITELLRLVGVTAFNDLLMRRNFLSWKRGLQINYNITRIEEWCKSHDMPEGTLQLEHLMVSIVKXTFHDALGANHSTASTKLLQLKKATLNDIEIIQDICWMXVYFLVPTSYAPIILTFIRRLSPNQIQKLLNQYLVADYEQPINGEIMKAVASRVSEKSDVLLLQAVDMDDSGPYEIAEPRVITALETYTPSCESIRLFGXRECITDRETTGLQTPRLKRLAEIVSQQAI

SEQ ID NO: 4090 - protein, 550 aa, Neurospora crassa
  unsure (1)..(550): unsure at all Xaa locations
GCSRIADYEVLGKLGEGTFGYVFIVCFPRAIVAIIDTILLSEVHRARSRKTGALVALKKIIMHNERDGFVTVLALRFGLGFDGPXRXLAHQFPITALREIKLLKLLSHKNVLRLEEMAIEHPPRSRSTCHELQXRWPLLKXTPSSADKRTRPIVYMVTPYMDHDLSGLLDNPSVRFTEPQVKCYLLQLLEGLKYLHANHILHRDMKAANLLINNKGVLQIADFGLARHYEGDIPQPGKGSGEGKRDYTSLVVTRWYRPPELLMHLKRYTTAIDMWGVGXDXTCSLDALSFMLTTITDAVFAEMLEGKPVLQGESDLHQLELVWDLCGTPSEETMPGWRTLPGGQAFSSKPRPGNLARRFEKHGPVVISLLKELFKLDWRSRINAIDALNHPYFRTAPLPALPGDLPTFEESHEFDRRKFQDRKAALPPAPKGGTVGRGAVVNSQGPDTGFSGRDGYGGGGRNGANGGRYPPYHRGPPPGDERVPSWHSARGLPPRPPMPADYHGSGPMDHTDGYRDRPPRRGPGGPPGGGGGPSNVDTYIPSYDRDGPAP

SEQ ID NO: 4091 - protein, 598 aa, Neurospora crassa
  unsure (1)..(598): unsure at all Xaa locations
RTPTHRPHKPETMTTPQEQAIAFKNEGNKAFAAHDWPKAIEFYDKAIELNDKEPTFWSNRAQVRAAAPVAYVASPTVALFXSGRVTTNRDFLLRRIAHLKTEAYGYAIRDATKAIELNPGFVKVRPSPSWLTLPQSYQSLWRQVANASSSXSEPLPSVXAYYRRATAYAAILNPKEAVKDFKTCVKIAPDNKDAKLKLVECEKIVRQLAFFAAIEVGDELSAAEGLDVESMAVDASYDGVRLEGNEMTQEFIDDMIERFKRGKLIHKKYVYQIIIAVRNIVYNEPTMVEVDIPEDVQLTVCGDTHGWFALAWPPPSXWLLTNCEXAQYFDLMELFRLNGFPSDKHYYLFNGDFVDRGSWSTEIALLLYAYKWLRPNGFFINRGNHETDDMNRVYGFEGECKHKYNERXASRTLCAHYATSXIFEHTPADTSHLLPRTYKLFSESFSALPLATLIGKKFLVLHGGLFSDDNVTLDDIRKLDRHKQKQPGQAGLMMEMLWTDPQPFPGRGPSKRGVGMQFGPDVTKRFCDKNGLEAIIRSHEVRMDGYEEEHDGKCITVFSAPKYCDMTENKGAYINIGPDYKLKFSQFDAVPHPNIKPM

SEQ ID NO: 4092 - protein, 1822 aa, Neurospora crassa
  unsure (1)..(1822): unsure at all Xaa locations
MSSHDKNGRATSSSGKASSFFSRATGKNKADKRNASDEGGRYLAADNDAASTHTARSSRHYRDSSVISLDRPDTPESGLNMTAGVVTTIPYDPVSPDNRSPVALDHLPRPDQMPLRRELVPHHLNKGTGDFHQYPTIDQSPSSPYNGQSPSASSSRSTLATANITMASTGRQAQFQQWGPPRESSLPGYNSRGHSYMTTRSSGDNASIYSGRDGHYQEAPGTSHRSSRIGLPSTSSQSSLPFSPCPXGQRYPAVNQGRCRPPGLRRIQLSQPDDDNVIEQMFINLMQKRGWHNLPDQAKRQMIAYPAAKKWTLIYQDRLTEWQGEQKRRQTAKIGQYSNVDITQSSDDEGSPEWYVRKVMENALDSKGLGGLEVNLRTQQIGWVKRFIDCQGQIALTNVLLKMNRKTAYGPAQPDNGRLDKNLDREYDIVKCLKALMNNKFGADDALAHQQVIVALATSLISPRLTTRKLVSEVLTFLCHWGEGKGHVKVIEAMDVVKAQQGENGRFDAWMRLVEVTVDGRGKMGSLVGASEEVRSGGIGMENLLMEYAVATLILVNMLVDAPEKDLQLRIHIRAQFTACGIRRILNKMEAFQYELIDKQIERFRSNEAIDYEDMLERENSSIKDSIEGEVKDLNDPVQIVDAIQQRLNGTKTQDYFVSALQHLLLIRDNDGEERLRMFQLVDSMLSYVAMDRRLPDMDLKQSLNFTVQSLLDKLHTDSEARQALDEALEARQIADAAMAERDEMKERLALGADGLVAKLQKQIDEQAMFIEAQKRRAEGLKSELASLQTLRAKEAQRYELETRELYLMLRDAQDVAASNATKGNAKLGEEDVARMQGILDRERLLERLQMQIERQKTQFKLEGRVWGEVIGPSDRLRALREEMDGFGDDTPEVVPPKDFTNSMLGSVKRSTRIPRKPVGSRSDHVEDVLEESDVEIGDDGEIVYEKPRVVKIRRPVVDPKQTNGMFNELTGKVRRYDASDSEEGDGITTGPSHPSMESQTPITPSDTETPKIQVTDATGPSAPAAASGPPPPPPPPPPPPPPPGFLPGAPAPIPGAGGPPPPPPPPPPPPPPPGGLPGAAPPMPGAGGPPPPPPPPPPPPMPGMAGMPPPPPPPPPMPGMPGMPPPPPPPMPGPASGRFLAQNAGLPTTNSVGLPVVRPKKKLKAFHWDKVDTPLATHWAAHTPSPESREEKYHELSKKGILDEVEKLFMAKEIKKLGGGGAKKDDKKQIISNDLRKAFGKKRMMSRNSMKASRXQFTEIALAKFSQFPVEKVVQMIIHCDKDVLDNPVVMDFLQKDDLCNISDNTAKVMAPYSKDWTGPDAGKDTREQDPNELTRQDQIYLYTAFELHHYWKSRMRALALTRSFEQEYEEITEKMRAVVAVSESLRDSVSLMNVLGLILDIGNYMNDANKQARGFKLSSLARLGMVKDDKNESTLADLVERIVRQQYPEWEDFAKDIEGVIAAQKINIEQLQADAKRYIDNIKNVQMSLDSGNLSDPKKFHPQDRVSQIVQRVMKDARFKAEQMQLYLEEMVRTYNDIMVFYGEDPSDDNARREFFSKLASFITEWKRSREKNIQLEEQRKRNEASMKRKNAQFKALQASEAQGPASPTSTGAMDSLLEKLRAAAPQTRDQRDRRRRARLKDRHQVRIASGQQVPDFNEIPEVEAALQTGKSAASATTDDDGAGNGLVSPDALPPTKEAPDAEEDDVARRAAALLQSFQGGDGAEDDAEKRESLRKSRRQTAAEERNMRRRRREKAQTSTAGEEGKDESTAADGSEAAPSASAEDLSAAEAKTDGPSSPRPGTATGAEASEETETTPTAT

SEQ ID NO: 4093 - protein, 470 aa, Neurospora crassa
  unsure (1)..(470): unsure at all Xaa locations
RADITYFGAGPAALPTDVLETAAQALLDYQGTGLGIAEHSHRSELAAKIINEAKADLATYLDFSPEQYEVLFMQGGGTGEFAASMYNLVGAWVSRQHAAVQKELGEGAAADEAQVLAALRQRVESGLKVDYIVTGSWSLKAYQEAVRLLGPEYVNLVCDARTINDGKFGKIPDESTWKLSKDAAYVYFCDNETVDGVEFPNFPKILEPKEDGTGPIVVSDMSSNILSRRIPVNNYSLLFFGAQKNLGCTGVAVAILKKTFLPPTLSQPSPALLRKLALPIPPIVLQYEIIAKNNSLYNTLSIFSRFLPNFFRGACVPGXQSDSVYIAGQVLKKLLATFPNGVDGQQALAEKKAELIYSALEAHPEAYKIVPDKSARSKMNICFRVIKVGSSFFGAGCSFVVEKWANMSFQGGNVDEAEKAFLKESTAINLTGLKGHRSVGGIRASNYNSIPLEGAEKLANFIHEFAKAXA

SEQ ID NO: 4094 - protein, 400 aa, Neurospora crassa
  unsure (1)..(400): unsure at all Xaa locations
EDDIQEIQQEISVLSTCASSYVTQYKASFLRGHKLWIVMEFLGGGSCLDLVSLVPLLLLSHTMSLFPACXTRLCAPAQTGKLSEVHIAIVCRELLLGLDYLHSEGKIHRDIKAANVLLSEAGKVKLADFGVAAQLTHMKSQRNTFVGTPFWMAPEVIQQAGYDFKADIWSLGITAIELAVGEPPYANIHPMKVLFQIPKNPPPRLEGKFSREFKDFVAHCLIKDPAQRPTARDLLRHRFIRTAGRVEALQELIERKQMWDAKQDRVKLPVFYQETLHTMSPKDDDDEWVFDTIKSVALPKNLLNVSTTPTKSRDPSRVRETEEGMRRMEVRDGPLQPSTPQTVRKATVRRQPSAAAAHQQRRLSTSTGSPRPPVAAAKRPLQTDMSFGNSGSTMRLFRRV

SEQ ID NO: 4095 - protein, 409 aa, Neurospora crassa
RLVNKLQDVFTTVGVNNPIDLPQIVVVGSQSSGKSSVLENIVGRDLVRIPPPPPPFPAPSLSSLSTLVSPLPKIANARPLFVLFSSLPRGSGIVTRRPLVLQLINRTATQNGFGNELDDNTDKAANTDEWGEFLHIPGQKFYDFNKIRDEISRETEAKVGRNAGISPAPINLRIYSPNVLNLTLVDLPGLTRVPVGDQPRDIEKQIRDMILKYIQKSNAIILAVTAANVDLANSDGLKLAREVDPEGQRTIGVLTKVDLMDEGTDVVDILAGRIIPLRLGYVPVVNRGQRDIDNKKPINASLEAEKNFFENHKAYRNKSSYCGTPYLARKLNLILMMHIKQTLPDIKARISSSLQKYTQELESLGPSILGNSANIVLNIITEFTNEWRTVLDGKSTELSSQELSGGARI

SEQ ID NO: 4096 - protein, 604 aa, Neurospora crassa
HKAAHINMSARLSKDGKSQSGTKPGFAEVWRLIKIARPEVKAMSVAFVLLLISSAVTMSIPFSIGRILDLSTQGPAGEVRLFGLTLYQFFGGLAGLLTLGATANFGRIIILRIVGERVVARLRTNLYRRTYVQDAEFFDANRVGDLISRLNSDTVVVGKSITQNVSDGLRSMVSGAAGFAAMFWLSPKLTSIILIMVPPIGLGAVLYGRNIRNLSRQIQKNVGSLMKIAEERLGNIKTSQAFAAEVQEVGRYNKQVRKIFALGRKEAIVSGVFFSSTSYAGNLAILALLIVGGNLVRSGAMSLGDLTSFMMYTVFAGSSLFGVSGFYSELMKGVGAASRLFELEDRKPAIPQTVGVKVESAQGPIKFSNVTFAYPTRPAVTIFNGLDFEIPSGTNVCIVGPSGGGKSTVASLLLRFYNPTSGSITINGIDISKMNAKSLRRRIGMVSQEPVLFSGTIAENIAYGRPRAPRTEIIAAAQKANCGFISDFPEGLETQVGARGAQLSGGQKQRIAIARALLKDPDILILDEATSALDAESETLVNSALAELLKGRSTTISIAHRLSTIKRSDKIIVLSSEGTVAEIGSYTELSANKDSHFSKLMEWQ

SEQ ID NO: 4097 - protein, 609 aa, Neurospora crassa
  unsure (1)..(609): unsure at all Xaa locations
MAGPQLLQNDSPNGWIVQKFGGTSVGKFPDRIAEDIIRXGQWGEIWVWCHTAHECLVNKGPVTDLTLKTRAYVKDHRLVVVCSARSTGKKVTGTTSRXVVHLIMKPSLITQLNPFRPWPTPAANSAHRLLEVFKNLKAIAAYASDEHKQDALLKDAKRVMQDICSDHTAAADKFIQDAELAAIVKEETVKECQLLIEYLEAAKRFHLEVNSRAKDRVISFGEKLSCRFMACMLKDRGVDAEYVDLADVLHLDASIERLDATFYREAAEVIAKKILACENRVPVVTGFFGNVPGGLLDGDVGRGYTDLCASLAAVGLKADELQIWKEVDGIFTADPSKVPTARLVPSITPSEAAELTFYGSEVIHHLTMDQVIKATPPIPIRIKNVKNPRGEGTIVKPDPLLAPDQTLQRHQQNGTCNGTKTNGTGQKSNKPKRPTAVTIKDKISIINIHSNKRSIAHTFLARLFAILNKHRVSVDLISTSEVHVSVAVHMGNAEMTNFDAAVKDLGDCGDVSVLHGLAILSLVGAEMKNMIGISGKMFSTLGDHRINIEMISQGKLGSXSCLCVCVCVCESIWMANHCGXIGASEINISCVIDARDAERAMNILHTNLF

SEQ ID NO: 4098 - protein, 133 aa, Neurospora crassa
  unsure (1)..(133): unsure at all Xaa locations
GQITTKELGTVMRSLGQNPSESELQDMINEVDADNNGTIDFPGMIXTFRTMDLPARRXQXPIEFLTMMARKMKDTDSEEEIREAFKVFDRDNNGFISAAELRHVMTSIGEKLTDDEVDEMIREADQDGDGRID

SEQ ID NO: 4099 - protein, 817 aa, Neurospora crassa
  unsure (1)..(817): unsure at all Xaa locations
MTPRFAHHSPPPHSPLRFSHLPTQAVMELYRVKHPTNDAQVTDYLKKKGFTKTEAVFRQETAHLGPDGRPAQRNEENGPRKYLKAFILLRDWIENNLDIYKVRDDEGEHPNDPWQXCXQAIFELRKLLWPVFVYSYIELVSTGYVEEAKHYLATLRPHFDAVHREALDLFTTVTLPQHIRENQTIKLYRENKYRIPLNQSLSGNLFHFLEREADAGGSTITFILQTFCQVDVSARGPIEPFSFEAIYRRAHNLDLDEIDQLEGIPGVFTGVTNRDVLDSSAPLKLGPLPMEPELREDVRAELEDEDQRHPPVEGRSTLVEEFDQRIKREESADAPSRTDLPLPPSRARDVVMEMQKVRENRDRFKIEGRTGGAGVPVSACMFTFHNSLGEVSFRTCSSVRLYHADYFLLSVSCMDFSNDHELVAVGTMDSYIRVWSMNGKPLRSSVASEKDLQVNNRKLIGHSGPVYGVSFSDSIANLDRNVFPEADGAKPDTSTKLLVSCSADGQVRLWSLDHWACLCIYKAHDGPVFRVLWGPHGHYFATGGWDKTVRVFAQDRASALRIMVGHDTPISAIAWHPNGTYIFSASDDTDKSIRMWSVVTGNCVRIFTGHTDYISALQCAPNGKILASADTGGNIFFWDIAKGARIKRCRGHGKGGIPSLSFSAESNVLVSGGLDGTVRLWDVELPADPSKSSQLAITSSGAAVGGGASGQQADGAASGDSIAVASGGGPNGNSITVGGTGSAATPAAAANATGNTGTASGSANGSSGAVTGKKKGKEVQITPDQISAFATKKTPVLKVQFTRMNLVVAGGCYDPER

SEQ ID NO: 4100 - protein, 727 aa, Neurospora crassa
  unsure (1)..(727): unsure at all Xaa locations
MATAETFEFQAEISQLLSLIINTVYSNKEIFLRELISNASDALDKIRYESLSDPSKLDSCKDLRIDIIPDKANKTLTIRDTGIGMTKAVSLPRINLGLVKVTMRXLNTLRDLVNNLGTIARSGTKQFMEALTAGADISMIGQFGVGFYSAYLVADRVTVVSKHNDDEQYIWESSAGGTFTIRPDTEGEPLGRGTKIILHLKEEQLDYLNESRIKEVVKKHSEFISYPIYLHVQKEIEKEIPDEEAEEVTEEGDDKKPKIEEVDEEEEEKKKEKKVKKIKETKIEEEELNKQKPIWTRNPQDITQEEYAAFYKSLSNDWEDHLAVKHFSVEGQLEFRAILFVPKRAPFDLFETKKTKSNIKLYVRRVFITDDATDLVPEWLSFIKGVVDSEDLPLNLSRETLQQNKIMKVIKKNIVKKSIELFNEIAEDKEQFDKFYSAFSKNIKLGIHEDAQNRSALAKLLRFHSTKSGDEMTSLSDYVARMPEHQKNIYYITGESIKAVSKSPFLDALKEKGFEVLFLVDPIDEYAMTQLKEFEGKKLVDITKDFELEETEEEKKQREQEEKEYEDLCKALKNILGDKVEKVVVSHKLVGSPCAIRTGQFGWSANMERIMKAQALRDTSMSSYMSSKKTFEISPKSPIIKELKKKVETDGENDKTVKSIVQLLYETSLLVSGFTIDEPASFAERIHKLVSLGLNLDEEPEAAADAPAAAEGTPAAETGDSAMEEVD

SEQ ID NO: 4101 - protein, 618 aa, Neurospora crassa
  unsure (1)..(618): unsure at all Xaa locations
MTSTSTSADAFAGQGDNILRPRPRKPLHTQVSQLSHDANGDSDHANGTGATRYGHHNKTKRGRDLPDISPECXLICXHSVTGVSSGRSTPIPSDAPPSIQSLSTARKQVRAEQRRRIFPTIEFASRVSHFDPNSDYRDFHGFFNLFWIGLAIMAITTCLRNIKDTGYPLRVQIWGLFTVKLWHLAIADFLMVATTAVSLPLHKVFRAAPAGGVLTWAKGGMAIQSIYQAIWLAVWIVIPFWLEWTWTAQVFLLLHTMVLLMKMHSYSFYMGHLSETEKRLRALDDPATASKAPAYLYPTPENPLGTVASPKQRAVEAAAEASSKETEEISTPNEDEEITQLREDLARELTSPMGNITYPANLTWANYLDYLCCPTLCYEIEYPRTAAIDWQNLLSKVLAVFGCIFLLTVISEEFILPALTDASIRLDPTLRAAAGDSGPLTALEALLVLAETISWLLFPFMLTFLLVFLVIFEYVLGAFAEITHFADRHFYSDWWNSTDWMEFSREWNVPVYNFLRRHVYSASRPHVGKANATVITFLISAVGHEIVMACITKKLRGYGFICQMLQLPIVMLQKTELVRGKKTLNNVCFWCSMILGLSLVSCSPPFLALSLSNIEGDY

SEQ ID NO: 4102 - protein, 339 aa, Neurospora crassa
  unsure (1)..(339): unsure at all Xaa locations
EQFCAFKLKTTKGNNFCRNEYNVSGFCNRQSCPLANSRYATVRTSPKGTIYLYIKTVRIRSLWQTYQIPGTNXLTHPSPFLQIERAHMPSKWWEKIKLSQNYAEALQQIEDRLQYFPKFLLHKCKQRLTRLVQVATRMRKLAAEEDRLGEKLVPKMAPKVKHREEARERKALIAAKLERTIERELLERLRQGMYGDQPLNCSESVWKKVLQGLEKEGEGTRDKDLDEGIEDEDEEDEEEEELEEEIEDGNVEYVSDFEETDDELNDIEDWLGSDDEDDAEDDDDEDDDDDDEGDSEEDTKKKTKAGDKRKRGKVTKMKARKKKEIEVEHETDREKLLAF

SEQ ID NO: 4103 - protein, 285 aa, Neurospora crassa
MPPKKQSSSGGNKPSGSGSSSGRSSSGSSCRCSCRCRCSIGGWLKFFAILFALVAPIAYVLEQRLESFYVFDTEHLHDLSKRAISAHGNDTKAIVKYIVDELNDRNGVAPYVNNDEEWVFNNAGGAMGAMYIIHASITEYLIIFGKPHPPARVSQACASRFFRPITNSTLHTTGTAIGTEGHTGRHTADDYFHILTGTQTAYVPGEYEPEVYPPGSVHHLVRGTVKQYRMPESCFALEYARGWIPPMLFFGYADTLSSTLDFPTLWRTSVITGREMISNLLKGKF

SEQ ID NO: 4104 - protein, 1508 aa, Neurospora crassa
  unsure (1)..(1508): unsure at all Xaa locations
MAEFPDEKEKEISLPNPVADQRHRDDEIEEAHRSDEDVEKIAIGSSVVEENDEKRAELNRMRTNATNTSVTTAATIHPHVKPKPWYKQPNPLRWGKIAPIPETRRPSPEYNAGFFRSLFFSWMGPLMTVSEAALERVIYTLKTNNXHLXTGYKRQLELNDIYQVNPARSVDPLTERMRESYKRRVEKGDKYPLLWAMHETFFWEFWIGGMCQLAASILQVMSPFTLRYLIQFATNAWVATHSGAPPPGIGSGLGLVFGITAMQILQSLCINHFIYRGMLIGGMARASLISLIYEKSMVISGRAKAGGADASDVPAAKAAAEKDAKKKSKKKGKKGQAGVEGDGAGWGNGRIVSATEATTCYXWLTSLQINLMSVDTYRVDQASGLFHIIWTAPVSIIITLVLLLVNLTYSALAGFALLIIGIPVLTKAIKSLFARRKAINKITDQRVGLTQEILQSVRFVKFFGWESSFLKRLQEFRDREVSAIQVLLALRNAIMAISISLPIFASMLAFITYSLTNHGLAPAKVFSSLALFNGLRMPLNMLPLVIGQVTDAWSSISRIQDFLLSEEREDEAIIKPDAPNAIEVHDASFTWERTPTQENESTVGGAGPKSKPEKGAKGKPKDVEAATPPSGDDSSTLVEEQEPFKLQDLNFTIGRNELVAVIGSVGSGKTSLLSALAGDMRKTSGEVVLGAQRAFCPQYAWIQNATLKDNILFGKEMDPEWYRDVIKACALQPDLDMLPNNDLTEIGERGITISGGQKQRLNIARAIYFDADIVLMDDPLSAVDAHVGRHIFDNAILGLLKDKARILATHQLWVLNRCDRIIWMDGGRIQAVDTFDNLMRDSEEFRQLLESTAQEEKKDEAEAPAATSEEEAPKKKKKAKGLMQAEERAVASVPWSVYTSYVKASGSYLNAPIVLVLLVISQGSNIMTSLWLSWWTSDKFGLSLGQYIGAYAGLGAMQALLMFAFMVSLSMFGTTASKNMLRQATFRVLRAPMSFFDTTPLGRITNRFSRDVDVMDNNLTDALRMYFFSIGAIISTFALIIAYFYYFAIALVPLFTLFLFATGYYRSSAREVKRFEAVLRSTVFAKFNEGLSGVASIRAYGLQNRFVEDMRKAIDDMDSAYFLTYSNQRWLSTRLDMIGNALVFTTGILVVTSRFSVNPSIAGLVLSYILAIVQMIQFTVRQLAEVENGMNAVERLLYYGTQLEEEAPSKTIDVRPSWPEKGEIIFDNVEMRYRAGLPLVLQGLNVHIQGGERIGIVGRTGAGKSSIMSTLFRLVEISGGHITIDGIDISTIGLQDLRSRLAIIPQDPTLFRGTVRSNLDPFGEHTDLELWSALRQADLVQDDQATTTTATPSASGNALVVAETPAASNGNSNNRIGLDSVVEEDGLNFSLGQRQLMALARALVRGSQIIVCDEATSSVDMETDDKIQRTMASAFRGKTLLCIAHRLRTIINYDRICVMDKGRIAEIGTPMELFEMEGGIFRGMCERSGIRAEDIRLAREIVDNDRAL

SEQ ID NO: 4105 - protein, 448 aa, Neurospora crassa
  unsure (1)..(448): unsure at all Xaa locations
SGMCKAGFAGDDAPRAVFRKCSHYSREVLLLETGNVSAELLASPPRPNVPAMLTCRDSSIVGRPRHHGYACHFPPRVPCAQHSKTFRKNXQHASIMIGMGQKDSYVGDEAQSKRGILTLRYPIEHGVVTNWDDMEKIWHHTFYNELRVAPEEHPVLLTEAPINPKSNREKMTQIVFETFNAPAFYVSIQAVLSLYASGRTTGIVLDSGDGVTHVVPIYEGFALPHAIARVDMAGRDLTDYLMKILAERGYTFSTTAEREIVRDIKEKLCYVALDFEQEIQTAAQSSSLEKSYELPDGQVITIGNERFRAPEALFQPSVLGLESGGIHVTTFNSIMKCDVDVRKDLYGNIVMVSPRSLWRWQYRLGPLTESSLVGGTTMYPGLSDRMQKEITALAPSSMKVKIIAPPERKYSVWIGGSILASLSTFQQMWISKQEYDESGPSIVHRKCF

SEQ ID NO: 4106 - protein, 358 aa, Neurospora crassa
  unsure (1)..(358): unsure at all Xaa locations
DAGLSPALVETVAGLSAGSMATLIVHPLDIVKTRMQGMFTVLQILFRXTTDFSHSSPPKXSNQPFAALTTVSVFRSLAQTDRPLAALYRGLTPNLIGNATSWASFFFFKSRFERLIAHLKAPSSPPAPSHLGGEPTTLPQNVTPDRETQAQIKSHLSPTDFFAASLLAGAATQIITNPIWVLKTRMLSTDRLAADAYPSMFTGAVRLFRSEGILGFYRGLGVGMLAISHGAVQFAVYDPARRMYIASRDAKRRLAGQEIASEDERESQRISNEATIVLSTAAKLVAGTATYPLQVMRARLQHHQADELFGRGIGGVVAKLWREEGFRGFYRGMMPGVVRVLPATWVTFLVYENVKYYL

SEQ ID NO: 4107 - protein, 401 aa, Neurospora crassa
  unsure (1)..(401): unsure at all Xaa locations
VIREKVQDGVTGETREIQYTQCKIVGNGSFGVVFQTKLSPSNEDAAIKRVLQDKRFKVGTARIGRRVSRFMKLTDIXNRELQIMRIVRHPNIVQLKAFYYSNGETCKSPTHWSSSPCFSYSLSLXKDEVYLNLVQEFVPETVYRASRFFNKMKTTMPILEVKLYTYQLFRALAYIHSQGICHRDIKPQNLLLDPTTGVLKLCDFGSAKILVENEPNVSYICSRYYRAPELIFGATNYTTKIGEFSWEHQPRCTCLRHWLIMLCRVWSTGCVMAELMLGQPLFPGESGIDQLVEIIKVLGTPTREQIRTMNPNYMEHKFPQIKPHPFNKVFKKADADAIDLIARLLEYTPTERLAAIDAMVHPFFDELRDPSTRLPDSRHNSGTVRDLPPLFDFTRHGMYFS

SEQ ID NO: 4108 - protein, 552 aa, Neurospora crassa
  unsure (1)..(552): unsure at all Xaa locations
LFKDIWHAMTSYDRRXCFLPPYFPVLGSIAYMSWLGNRAGIDSPYRTGRHVPLNRNSGLAGVTTASDSRADINSPYLQGDGRGSTMSFDTAYGGRAISPMPSPANGGPYSPGLVSQRQSVHQDAFDVHSPTGEIPMQNFQNGGPPPPPVASSWEKIDRWAEENYPELFDQLGEGCTVNDLNELEYQLDCTLPQDLRQSLQIHDGQERGGLPTGIIFSSMLLDCEEMVQEWENWKTVNQEFMLDPVLVKRQSQAFAAQASSSKDAPNRNQNWRQELLNKQDSVPPAAIQKAYAHPAWIPLVRDWGGNNLAVDLAPGPKGHWGQIILFGRDYDTKYVVARSWAHFLAMVAEDLSSGRWFVDEDTNELKLREFKATRVEPSYFEILRWRMDQKYGRTANKRKSMAPSMASASGMRSPPTPGSPYQSPTEHNEPRGRSLHRLTGTSPMSSPIRPGYGKPSPLARVAEEAPPTTSLTASNASLEAKAADNLMELNTPRTSGEHSKEDIKVNEDSPAKERTSEDKEKKPETEANGKATESKGKQTTVEDAEDMKDIEI

SEQ ID NO: 4109 - protein, 1136 aa, Neurospora crassa
  unsure (1)..(1136): unsure at all Xaa locations
MADRYGQQPQSYRGNSGFGNLGRRNDDYDPYGDGYPSDRYGTSTNPASRPSTASRNAPPPRSAQRGRTGAGDMQIQSNAERQIGNVLDLIKREWPAMVETDCIPVQLALQLLDTSSVGRAHEYRNFQQTHQFLQESLKNIVHDHHQGFNSSIGTFHKIQGSIQSSQKKVRALKESLAASKTALCTTNPELKQLHATSRMYDGVLQTLNELDDLRTVPDQLEARISEKRFLTAVEVLQNALRKLRKPELDNIGALSDLRSYLANQETALMDILVEELHEHLYLKSPYCQERWQNLAKVQGISHETYGDAPGVAPFHGILDTIDWEKSVAEDPQKNPEADTFYYVTLLVEALNRLGRLETAVDMLKQRLPVELFAVVNETINDVDQKHPSSLRGGASGSHGLNIYGHRETRMRADVIHDLLSTLYGKFEAIAEGHRVLHEAIKALIRREGAGNNSVLLGGFKELWNLYQNEIRALLHNYVTTDADVYQFSRTPRPGMGMNGRADSARDNLFKFSEVDAKSAEMASEYEALDSIIRAAVPGLTDSTRRDNKKGSLIIPRSEPITSRKSAGYGSGSSQQNSGTYKSLVEPSVFNMSLLLPPTLIFLQRLKSIVPPGSDLATSTLTSFLDNFLVNVFQPQLDETLGKLSDTVFGEADAFQQDSDWAQVAKRPVYKGTTAFFTVITAFCRMLGTIPHDQALSTLIITQMVRYYDRCFSWYKALVTKTQEGGDKQIREKEKLRASAILATEPSEVRETIQRLWKSENLNDLELLYREVNQLIAWANGRDLDASDIIQDRDMIQSMCLLYTSMKWLSVKIHGLRHITRNETDSSKSSFPTKAEKKRWTLLNDPSKATGGEAPVYLPMTEETVEXVYYPIYFPSSTLISIRLLTHSPLRNFDSILVSYDELASTALLTLHLEIRTRILHSLQTALSPLTTAPYLLDQEVNEPDPEILSLNSEMVAYDEILVRCLRLREVQFVRNGLGKLINGFLIKNAPMTAPMNAKGCGRMQLNILVLQQNLKNIEEGVDLVRASNYFEMFERGVDAILEKAREGVASSGSQETGDAGRKSEDAGEEGAETPNSRKSAEIFGDDKDRFSYDELKALVELCYSEQLADPERGVAAAAKRQMADKLLNLSEYMWQS

SEQ ID NO: 4110 - protein, 170 aa, Neurospora crassa
  unsure (1)..(170): unsure at all Xaa locations
QHSFIAVKPDGVQRGLVGNIISRFENRGFKLVAMKLTQPGQAHLEKHYEDLNTKPFFAGLIKYMNSGPICAMVWEGKDAVKTGRTILGATNPLASAPGTIRGDFALVRWPSSLHPFHDSLYXLNDXPQDMGRNVCHGSDSVENAKKEIALWFKPEELNQWNHHSAAWIFE

SEQ ID NO: 4111 - protein, 926 aa, Neurospora crassa
HDFKKCDQAGFCKRNRAFADHVVANTAWESPYNILADSASFKDGQLQATILKTVNDAGETVRLPITVSFLESGTARVTVDEEKRQKGEIELRGDSKARKQRYNEAEQWVIVGGLTLDKEAKVDYQDDTQITVQYGPESKFEASIKFAPFSIDFKRDGDTHIKLNDKGLLNMEHWRPRIDASPAPEKQEGEDNSSSETESAETTAAQVPEAYPGEDQNTWWEESFGGNTDSKPRGPESVALDISFVGYDHIYGIPSHTGPLSLRQTRGGEGNFQEPYRMYNADVFEYILDSPMTLYGSIPFLQAHRKDSSVGIFWLNAAETWVDITKEKESKNPLALGIGSKTSTSTHWISEAGLLDVFVFLGPTPQDLIRKYSELTGTTAMPQEFSLGYHQCRWNYVSDEDVKDVDRKMDKFNIPYDVIWLDIEYTDDKKYFTWDGHSFADPIGMGKQLESHGRQLVAIIDPHIKNVDGYKVSEELKSQKFAVNNKDGEIFEGWCWPGSSHWVDAFNAAARKWWATLFKYARFEGSMRNTWIWNDMNEPSVFNGPETTMPKDNLHYGNWEHRDIHNLNGLTFHNATFEALKSREAGEFRRPFVLTRSFFAGSQRLGAMWTGDNQAAWDHLEGSIPMVLSQNIAGFPFSGADVGGFFGNPEKELLTRWYQAGAFYPFFRAHAHIDSRRREPYLAGEPYTTIIAAALRLRYSLLPSWYTAFRQAYLTNEPVIKPMFYTHPNEEAGFAIDDQFFVGNTGLLAKPVTQKDKETVDIWIPDNEVYYDYFTYDIIPSNKGKTVTLDAPLSKIPLLMQGGHIFARRDRPRRSSTLMKWDDYTLVVTVGKDGKTAEGDLYVDDGDSYEFEKGQYIYRKFILDGDAKTISSVDGEDRKKVKEGDWMKKMHQVTVDKIIIVGAPASWDKQEVTVESEGETWTATLE

SEQ ID NO: 4112 - protein, 1133 aa, Neurospora crassa
  unsure (1)..(1133): unsure at all Xaa locations
MSRSSAGSSRSVQGPGGGPAGGGSTRRNNVSNHLPALASFTVVTIGLFCSPPFSRVFPSTCARHDASPLLCSNPPLPFASSLLTRASDNSSSGGSSSVPLSQIERSVTHLLVATKQLLETLTQWSRGNATDTQVSDVYVRLGYEFNMACRAFTAINVDIDDLGNVPEMLRTILEATLSQEASAESLEKYLPKIRDIIINLLHGLKRKQQKLRHRQQRDREPSIAGDDGGYGPSRGPGPSSSGVPTRTTSTSTMASVNSGLTNMLNEGLESNGYRPDSFRDDSRNSGPTTASPTRRLPSQRDQSRGSVTSDQSSLSSNTMQNIPVMAPYPGEETIPTGPPAPPEINVDNFPPPPPPPKGSGQSALAALQRGGNLERRASRRYEAYQISKYLGAMVPPQTTPIPDRGNREARRESLRAMHVRETPRHSRNVSNQSQRTIGLDSSPVRVPSRVPEEPETADSYTFSKADNLNVQAPDDKYPTPSATLNGPLADPIPMVDEVDSSKPAATRPAPAPAAPQHQHKPSIRASTPDKQPPSSFMLENSPPATKELTLFLQYKSKVKKFVLPEGYEHLSMARLQLAFIEKFSWNTQQNGADLPEIYIQDPVSGVRHELEDLSDIKDRTVLVLNVEVLDEVKKHIDKSIGSIKTIIQQVKQNVDDQNAAIQRVSERQQETAKDLARIAATPPPTIIAPSGMDSTASPRSSSSSVAGAAALAGSSSKKLSPSQLTEIQSLRRDLAVLRQTYSNFQSEVQGSMTTLRNKANNVKTAAAKLSVPDGEGDSGRAYVTKGRKLLNADSDRLVNQVDDLQDLIEDLRKDVVHRGVRPRPNQLESVTKDITTLSKELKKMEEFMKKEKPIWTKIWEKELEEVCQGRDELRLMEDLMIDLRDDLEKASETFALVEQATKEQMKEGGQGNTVNGSVSNGPTPFGAFSRGLKSISEKVTHADPSEAKEGVLGEVRALQPNHQSRLEAIERAEKLRQKELQTRMVNPLTKELASFVEEGKLKKSGGVEEVERARKAKDDQIRREVWERMNGLIAENDDDGEDEEDDEEEEEEEEEEXGEEEEEEEGEEQEEGEEGEEKASGSTKESVDGEEDKGEVKEKNKENVKAEEKLDADEGEEGGKAKAEAAKEPDATA

SEQ ID NO: 4113 - protein, 559 aa, Neurospora crassa
  unsure (1)..(559): unsure at all Xaa locations
MFKLGRNRALASAFAATSRVRRRRPSASRDVVLCTVASHRIQNKATRKLTTCSKHTAPLASRLPSVSQQQRRALSIHEYLSADLLRQVSTHPQSSGAHRIGLSLSLSLPLPTYPAPPRRYLTPSIGPDFXRDTTHNSYGIGVPKGDVARTGAEAEAIAKQIGGEDMVIKAQVLAGGRGKGTFDNGLKGGVRVIYSPTEAKMFAEQMIGHKLITKQTGAQGRLCSAVYICERKFARREFYLAVLMDRASQGPVIVSSSQGGMDIEGVAKENPEAIHTTYIDINVGVTDEMARDIATKLGFSEQCVEEAKDTIQKLYKIFCEKDATQIEINPLSETSDHKVMAMDAKFGFDDNADFRQPDIFKLRDTTQEDPDEVRAAQAGLNFIKLDGDIGCLVNGAGLAMATMDIIKLNGGQPANFLDVGGGATPAAIREAFELITSDPKVTAIFVNIFGGIVRCDAIAHGLINTVKSLDLKIPIIARLQGTNMEAARQLINDSGMKIFSIDDLQSAAEKSVQLSKVVKMGKFIFILQLGKAKQSMCVLTLLFSQLVDIDVGVEFTLGI

SEQ ID NO: 4114 - protein, 744 aa, Neurospora crassa
  unsure (1)..(744): unsure at all Xaa locations
VENGHGATEEPLIVYAQSGQATVGLYIGQGLQNQGLSESALSILQDNLDTLNVSTPSLAMQLCGPGYDSAHTFGVMLTSNATFAPIQDAIKTWANATCLSFAGSKSFAGEAVFTTPLLPTNGTVGSNSTIGSNSTIQARGLGRRYHRALHARAECKSVQVESGDSCASLATKCGISGADFTKLHPDSDFCAKLKPKQHVCCTTGDLPDFRPVPNSDGSCFSYQVKANDNCANLGAEYGLTNEDIEGFNKDTWGWNGCELLFKDTIMCLSKGSPPFPAPIANAVCGPQKPGSKPPTDGSKIADMNPCALNACCNVWGQCGITKDFCVDTNTGAPGTAKNGTYGCISNCGTDIVKGDGSGAIKVAYFEAYNLGRDCLFQDASQIDTSQHTHIHFAFGTLTPDYEVEVGDVLSSYQFQEFKRVRGAKRVVSFGGWDFSTMPATYSIFRNGVTSANRLKMATNIANFIKEHDLDGVDIDWEYPGAPDIPGIPAASLDDGPNYLAFLVILKNLLPGKSISIAAPSSYWYLKQYPLKQIGAVVDYIVYMSYDGHGYVFIFHQXVRSFCXLRKQAWDAGNRFSQEGCDTGNCLRSQVNLTETKQSLAMITKAGVPGRKIIVGVTSYGRSFEMAQPGCWGPSCTFTGDRTNSYAKPGVCTGTAGYIADAEIAEIMAGTGSKRSGRVTASFVDASSNSDILVYDNTQWVGYMSAATKKSRAALYTAWGMGGTTDWASDLQKYNDVPSPAKDWN

SEQ ID NO: 4115 - protein, 506 aa, Neurospora crassa
  unsure (1)..(506): unsure at all Xaa locations
FVSRSPGRVNIIGEHIDYSLYSVLPMAITADTIIAVSTHLPAPKEGTFRIQIANVLDSKFKSREFDIPYDSVDIDATVHEWTNYFKSGLRGALELLRKKHGANFKPKSMQILMDGTVPAGGGLSSSAAFVTASALAVMAANGEQTVDKKELTELAIVSERAVGVNSGGYVKTSNYRFHTRTXNXHHVAEMDQSASVFSERGSALFVSFTPTLLARPVSFPPTTPELTFLIAQSFVTADKFVTGPIHYNLRVVECTLAAAYLNAVLNPPGTLLPGDASPLGISLQGFHETYFALSEHNSGATSSKSVTEQLEHLLELTKQTLTKEEGYTRSEIAAVLGLPSTSELDQKFTSRFPVRAERFKLRQRAIHVFSEALRVLKLMDLLETSSSSSSSSSSSSSSTITSTPKDLNSRLGALLNETQDSCREVYECSCEEIDRICAIARQAGSYGSRLTGAGWGGCSVHLVPADKVSNVKEALEREYYSKLELTEEQREGAVVVSKPGSGSALY

SEQ ID NO: 4116 - protein, 616 aa, Neurospora crassa
GTTNSAVAIMEGKVPRIIENAEGARTTPSVVAFTEDGERLVGVAAKRQAVVNPENTLFATKRLIGRKFTDPEVQRDIKEVPYKIVQHTNGDAWVEARGQRYSPSQIGGFILQKMKETAESFLSKPVKNAVVTVPAYFNDSQRQATKDAGQIAGLNVLRVVNEPTAAALAYGLEKEQDRIVAVYDLGGGTFDISVLEIQNGVFEVKSTNGDTHLGGEDFDIHLVRHLVQQFKKETGIDLSGDRMAIQRIREAAEKAKIELSSSLQTDINLPFITADSSGPKHINQKLTRAQLEAMVDPLIQRTIEPVRKALKDANLQAKEIQEVILVGGMTRMPKVAESVKSIFGRDPAKSVNPDEAVAIGAAIQGAVLSGEVKDLLLLDVTPLSLGIETLGGVFTRLINRNTTIPTKKSQVFSTAADFQTAVEIKVFQGERELVKDNKMLGNFQLVGIPPAHRGVPQIEVTFDIDADSIVHVHAKDKSTNKDQSITIASGSGLSEAEIEKMVEDSEKYAEQDKERKAAIEAANKADGVLNDTEKALNEYADRLDKTEADAIREKIANLREFIAKSQSGEQALSADALKEKIDDLQVASLNLFDKMHKARAEAGEQQQQSTEGEKKE

SEQ ID NO: 4117 - protein, 670 aa, Neurospora crassa
  unsure (1)..(670): unsure at all Xaa locations
WWKDGVVYQIYPASFKDSNGDGLGDIPGIISKLDYIQNLGVDIIWVSPMYVCASCQTLXNXWXSASADLGCNRFESPQVTSLFLINGCVLTRXXPFYIIPTACLELLADTSDMLDDMGYDVSNYEEVYPPYGTVKDMENLIEACHKRXTSCIAMPXLDLYXRVFRGMRLVLDLVVNHTSDQHAWFKESRSSKDNPKRDWYIWKPPRYAEDGTRLPPTNWRSYFSGSAWEYDEHTNEYYLHLFAKEMPDLNWESEECRKAIYDSAMRFWLDKGVDGFRVDCVNMLVLFMPCSPXPRPDTNXHWFLSGTSKSTEFLDAPIVDSRFYEQPAWCYYANGPRMHEFLREMNEKVLDRYDAMTVGELPHTPDPKRVLDYVGRKDKQLSMVFQFDIVDIGQGGTHKYHFEEWKLPVLKKIVEKWQRFIEGTDGWTTSFCENHDQGRSISRFASDAPEYRVLSGKMLSLMMCSLTGTLFIYQGQEIGMINVPKDWPIDYYQDIESVNFYKLMAAKTNNDPEEMAYVMRSLQTLSRDNARIPMQWDDSPYAGFTERKEGAWAHVHDLYPEINVAKQLDDPNSTLSFWKDMIRFRKQHSEVLVHGTFEACDIENEKTFVFVKRFGGKRVVVTLNFSNEEQEVVLPEHEKGLKFMVGNYGNEEGGMGERRRLRPWEGRLYM

SEQ ID NO: 4118 - protein, 503 aa, Neurospora crassa
  unsure (1)..(503): unsure at all Xaa locations
IMYSLGYSGTIIMEGYGMALLTYFFSVESFNAKFGVFDTTTGKYEVCCTAQSHSGWDRVVXNRGQCXHGYLISLRTKWKALLPLLAQVGAIFGVVLTSFFVKWFGYKHTVLFMLILCAAFGFVPFFANNVVILAIGCLAQGIPWGLFQVASPAYSSEIASLRMRPILTTWNNLCWIIGQLLASAVAYGFHSLQNEWAYRVPFALNWVFIAFLFVAIFVAPESPYWYLQKNRVEDAHKAIKKLVRKGSEERTQEKLALMQHAICHEMKHVADNQTRWQRISAMFRGTDRRRTEITCNTWMIQALCGSSLIGWAPKLFESVGMASDKALAMNIALPCAGIVGTIASWWLMQKMGRRRIFFWGLISMAIVLTVCGSASLATTPESVSAAGAILVVYTAIYDLTIGPICYSIVSDIPSVRLRTETIALARGLYLAANLFNLFLTPKMLGMDSKSWNWGAKTGFLYAGICGLGALYTFYRIPETKDISVRGLSILFNEKVKASKFSAT

SEQ ID NO: 4119 - protein, 1443 aa, Neurospora crassa
  unsure (1)..(1443): unsure at all Xaa locations
VAKRDKYAELRELRQSGKKKTYDVGEIDELYEEVDENQYKKIVRDRLNEDDFVVDDNGEGYADDGREEWDRLPQYHSDSEEELGLPGSKPRKCEQIERXNPTMGATYKALWFWYXPSFSSLLAKKQKEHEDAKRDANDRDITEYFTKGAVKAPPKQKVIKTEEDEKFLDDLIDQVTAQIPVPVTRVSKKRDRSVERRKVRVLSPVREPRPPMAKRAKTVDDRASSPAGDDDLLPDDDYLPAMDDEPAPVSDYLMSDAIMPSSPAAKVATRRTFGRPEPKKNEDDEDEDEDMMEVAHTGAVTAASVNISASRQIKKILKTEPVPASSSPARAPAPEVDAASWNEINQKLNVVSMSQSEGRSVGKIDYKDAIEEDGSLNMFWTDYTEVNGSLCLFGKVLNKKTKTYVSCFVKVDNILRKLFFLPRKYRVRGGEETTEEVEMMDVYNEVDEIMTKMNVGMHKIKACTRKYAFELPDVPKESQYLKLLYPYTKPAMEPTHKGETFSHVFGTNTALFEQFVLWKNIMGPCWLKIEDADFTSLRNASHCKLEVLVEHPNMVSVPDNAESIEPPPLTLLSLAMRTAFNPKDNKQEILAVSGRVYLDVSLSDTTPPDKLASRSFTAVRPYGSAFPIGFETLAKERNRGVLKLFKQEHEILNFLLAQIDVVDPDVILGHQLEGVDYSILLNRLHEKKTHQWSRLGRLRRSQWPSSIVKMGGNVFAERQIMSGRLLCDLANDAGKSVMTKCQTWSLTEMCSLYLGGESRRRDIDNEVALKTWANADKHGLMDYISHAETDTYFIAALALRTQILPLTKVLTNLAGNSWARTLTGTRAERNEYILLHEFHRNKYVVPDKQTFKGRQRIEEENAEEEGGEGGKKKDKYKGGLVFEPEKGLYDKFVLVMDFNSLYPSIIQEYNICFTTVDRTSLVSQGPSSVDVQANAKXSEDDDAVPEVPKEQAQGILPKLIATLVSRRRQVKSLMKDKNATPEELATWDIKQLALKLTANSMYGCLGYTKSRFYARPLAVLTTYKGREILRSTKELAESNSLQVIYGDTDSVMINANKDNVAEALRVGHEFKKAVNERYRLLEIDIDNVFRRILLQAKKKYAAINMVEVNGKWVEKMEVKGLDMKRREYCGLSKEISNRILTEILSGDDTEVSVQRIHEYLRDISAKMREGAVPVQKYIISTQLGKAPKDYPNADSMPQVQVALRELAKGKTIRKGDVISYIITGDSKTTSEAVAKRAYTPQDVLKAESGLSPDVEWYIGKQIFPPVERLCANIVGTSTSQLAENLGLDVRRYSSNTNNNSSGPQDLEIHPLESQIPDSLRFQSCARLSLRCRKCKTSHPFEGLASPSSVNNVTPSGIQCPSCQYVLPMLSVVAQVEAAVRAQTARYYEGWLVCDDSSCGNRTRQISVYGTRCLGSKGLARGECGGRMRYEYTERDIYNQLVYF

SEQ ID NO: 4120 - protein, 478 aa, Neurospora crassa
  unsure (1)..(478): unsure at all Xaa locations
AEKKKREAEAAAAAQRQQQQQQQTGDDDDANGPPAKRRRLSPDRDAAAAAPTASSNDSSKLLRFEGGRFGKCRSVENYDKLNDIEEGAYGWVARAREIETGKVVALKRLKIDPKDRSGLPVTGLREIQILKDCSHRNIVKLKEVVVGDDTSKIEKXATIPFSNFAFFFSFLHVLSEFDXRLFHSIFIVLEFLEHDLKSILEDMPEPFLASEVKTLLLQLCSGIAYLHSHYILHRDLKTSNLLLNNRGQLKIADFGMARYVPDPPPPKLTQLVVTLWYRAPELLLGAARYGPEIDMWSVGCIFGELLTREPLLQGKNEVDELTKIFELCGLPTDESWPGFRRLPNARSLRLPSSSSSSSSSSKPPSTGGLIRAKFPLLTAAGVSLLASLLSLNPSRRPTASEMLEHEYFRQDPKPKQEAMFPTFPSKAGQEKRRRRETPNAPQRGQKVQDLGQVDFSSLGGIFGSGREREERGGGFSLR

SEQ ID NO: 4121 - protein, 336 aa, Neurospora crassa
  unsure (1)..(336): unsure at all Xaa locations
AFIAGGIAACGAVTATHPFETVKIRMQLQGELQSSTSSPHFYRGPIHGVSVIVRNEGLGGIYRGIGCAYIYQILLNGCRLGFYEPMRHALATTLFNDAKTQNLGINMFAGAASGIMGAMAGSPFFLAKTRLQSYSPFLPVGTQHQYKNAWDGLTKIYKGEGVKGLYRGVGAAMIRTGFGSSVQLPTYFFAKRRLVKHLGMEEGPALHLASSTASGFVVCVVMHPPGMFFFFFFFFFLLPSSWLSSPLTLFWHSWDNXNXQXTKLDTIMSRLYNQNGNLYKGVFDCLAKTIRAEGFFAIYKGVIPHLTRILPHTILTLSLAEQTTKLVKKLEDKILG

SEQ ID NO: 4122 - protein, 430 aa, Neurospora crassa
TSTIQVTSGIQNLNMDSPAKKLDFGATDKENKPFDEDLAKLEAEIDAEHNANKKAAEAKKMAPTLKPEEANEPLLTENPQRFVLFPIKYHEVCHASQTFQTTRKVVHGLIGYPHYRIWQMYKKAEASFWTAEEIDLSKDLHDWNNRLNDDEKFFISHILAFFAASDGIVNENLVERFSGEVQIPEARCFYGFQIMMENIHSETYSLLIDTYIKEPSQRTYLFNAIDTIPCIRKKADWALRWITDKSSTFAQRLVAFAAVEGIFFSGAFASIFWLKKRGLMPGLTFSNELISRDEGLHTDFACLLFSHLNNRPSKQLIQEIIVDAVRIEQEFLTEALPCALLGMNADLMKQYIEFVADRLLVALGNEKIYRSTNPFDFMENISLGGKTNFFEKRVGDYQKAGVMNSTKKADADAEVAKNENGGDFTFDEDF

SEQ ID NO: 4123 - protein, 577 aa, Neurospora crassa
  unsure (1)..(577): unsure at all Xaa locations
MGLSGLPLNFAVAGIAAMAFWLFGXDLFHFLLAXLAHDYLXLTTLTVSRYDMSVMVSTCNISSFPCQHSKAAAANDLSGWCHHESPFTSVFPSMEDPNIQGIVIAAFELGALVGALACLDIGDRLGRRSTVWFGMLFMLVGGILQCAAWHVGQLATGRVISGIGLGLQVATVPSWQAECAKPHSRGRWGEXIHERRTFAWNLVADTEXQSMIEGGLQTFGVACGQLIGYGFFFVKGQAQWRVPVGIQLIPAFIVFIFINFLPESPRWLIKHGRIDEVSGLRLRYHTKSMLSNSPGTHNLAKLRGLSPDDPLLLAERDAIIASYEAQSQMAVFSYKELFDNGPTKTLYRVAIGTFFQAAQQLSGINMVSTYANKILQESFNLSPSMSHLIAAMGGLEYALCSLLSVLLIEGLGRRRSFMITAAGMAVCFAIIAGLTSTADRTCQLVAAGFLFLFNTFFGLAWVGGPFLYSAEIAPLRCRSQANAIASAGNWLFCFIVVMIIPPALANIGWKTVSPVRSPTYLPVMAYGRPFDQSXPLTHDVYXQYIIFAVFNFLFVPIIYFFCVETKKRSLEELDVIF

SEQ ID NO: 4124 - protein, 653 aa, Neurospora crassa
  unsure (1)..(653): unsure at all Xaa locations
PAKEKAEEGXQIRLAGNLNGTIATPFSQSIATTHRQYQPPHAITMASEFSKKRKLKDAKIATEDGAATDKKTKKVKKDKKEKKAAEEVVEDATPEEENDAQKAEEQQDGDEVIPTGNGDKEDSDDKDAEAGDELTKTNDSLIAPSIATNATDFSELNLSDKTMKAIAEMGFTKMTEIQRRGIPPLLAGKDVLGAAKTGSGKTLAFLIPAIEMLSSLRFKPRNGTGAIVVTPTRELALQIFGVARELMKNHSQTYGVVIGGANRRAEAEKLGKGVNLLIATPGRLLDHLQNTPFVFKNMRSLIIDEADRILEIGFEDEMRQIIKILPKEDRQTMLFSATQTTKVEDLARISLRPGPLYVNVDEEKQFSTVEGLDQGYVVVDADKRFLLLFSFLKKMQKKKVIVFFSSCNSVKYYSELLQYIDLQVLDLHGKQKQQKRTNTFFEFCNAKQGTLICTDVAARGLDIPAVDWIVQFDPPDDPRDYIHRVGRTARGNNTKGRSLLFLQPNELGFLAHLKAAKVPVVEYDFPKSKILNVQSQLEKLIGQNYYLNQSAKDGYRSYLHAYASHSLRSVFDIHKLDLVKVAKVCFLFSPFFFPNTRTVTNVLQKQSFGFSTPPRVDITLASSMSRDKKQTSRRAYGSQPKQNRHXARRDSVF

SEQ ID NO: 4125 - protein, 691 aa, Neurospora crassa
QQVDRSIALLEERIQAGDVIYGVNTGFGGSADTRTDAGSEPLMRLQGALVQHLNVGILTHADKDRDGSNSWAGKPYDNELLRSHALPSPVVRATMLIRCNSLMRGHSGVRPLIMENILKLLNRDMVPIVPLRGSISASGDLSTLSYIAGALEGNPDIYLKARKPHNRTEILPADKALSLAGLEPVRFQVKEGLGITNGTAPSCATASIAIQEANQLAVLVQLLTAMGTEALAGTAANYHPFISSVRPHPGQAEAASNILAFLAGSKIAAPCEAHPESEDEPAKVRGLAQDRYALRTAPQWIGPQLEDLELATKQVQTELNSTTDNPLIDPTSGLIHHGGNFQAMALTSAMEKTLLALQNLGRLLYAQSSELLNNMTNKGLPPNLSADEPSQSYTCKGFDVNMAAYMAELAYLAKPISPHVQVAEMNNQSVNSMALVAARYALEAVEVVNLMAATYIYVLCQALDLRVLQLEFREALSVRLRDLVLSHVARQRSLKSKEEEHKGLSEVDITESQRRAGKLAECILDQWDKLASLDVAERASVATKQSALDALELLHCGTEYGRRTWGFSDLQAYHLKTARVVADCYGDHRNALLEGKQDTRRWLSGGSTVVYDFVRKELKTPLNRGVVDHPPLLKEQLTRLKEAIRSEAGTRAKEIEEGNDLRSRNRILGSMASEIYEAIRSGELYSRIMAF

SEQ ID NO: 4126 - protein, 265 aa, Neurospora crassa
  unsure (1)..(265): unsure at all Xaa locations
GRGIGREMALELGRRGAKVVVNYANSDISANEVVQAIKKIGSDAVAIKANVSDVSQIERLFREAKQRFGKLDIVCSNSGVVSFGHIKDVTPEEYDRVFNINTRGQFFVAREAYKNLEVGGRLILMGSITGQAKAVPKHTVYSASKGAIETFVRCMAIGRWLSWILLGDKCXPQDTLKDFGDKKITVNAVAPGGIKTDMYHAVCREYIPGGDKLDNQGVDEYAAGWSPLHRVGLPIDIARVACFLASQDGEWINGKVIGVDGGACM

SEQ ID NO: 4127 - protein, 403 aa, Neurospora crassa
DFWAGYVSGAIGIVIGNPLDILKVRLQAGGGSSSSSSSSSSSLLPTPIPNSTPSPPPSAAAAAAAAAAAPPTTSGTPSTTSWIRPFLRGTAAPVLGYGALNALLFVSYNRTESAINHFVFGIDPSLPLQTGVNLWSTWIAGAVGGLATWVVSTPTELIKCRVQLAAEEQQQQQQQQGQQGSRRGTIQGSSSSSSRRRRRGGIGIVGTEKKGSSSSSWQVTKHVLRTQGIKGLYFGGAVTALRDSIGYGFYFWSYELSSRWMVAAAAASSSSSSSSSSSQAGGILTSEATRVLLCGGLAGIITWASIFPLDVIKTRVQTQGILPLPLASGSGVIETQGEQTALLDRTASQRKQRPLGAWEVAKLTYREGGVKPFFRGLAVCSVRAFIVNAVQWAMYEWIMTELG

SEQ ID NO: 4128 - protein, 917 aa, Neurospora crassa
  unsure (1)..(917): unsure at all Xaa locations
KQVKQNLLEEGNFINYKKMSENLAVVRSRLNRPLTYAEKILYSHLDNPHEQDIERGVSYLRLRPDRVACQDATAQMAILQFMSAGMPSVANPTTVHCDHLIEAQVGGEKDLERAININKEVYDFLASACAKYNIGFWKPGSGIIHQIILENYAFPGGLLIGTDSHTPNAAGLGMAAIGVGGADAVDVMANLPWELKAPKVIGVKLTGALNGWTTPKDVILKLAGILTVKGGTGSIVEYYGMFHLSNHVSHLVGSIFGIPTMPXTFRQWPHSNSSMLLQIIQWHCDFLALHXLVCQMHLDFVWMLLVGKSRGLAVXPTFFRGASCQQXLSAPKHQNVIPAQHDDANNYAGEGASSMSATGKVSXLRQKAYVLIFANTYCXATCGNMYSSSRHFCXXAFGCLLTLNRGAEIGATTSVFPYDKAMFDYLVATKRSDIAEFAKTYQKELQADEGAEYDQHIEINLNELEPHINGPFTPDLATPISKFAQAAKENNWPEELKVGLIGSCTNSSYEDMTRAASIARDALDHGLKAKAAFVVTPGSEQIRATIARDGQLQTFEEFGGTVLANACGPCIGQWDRRDTPKGTPNSILSSYNRXETLPLSFIVRTRNANCNSXXFTGRNDGNPATHSFVTSPDLVVAMSIAGSLYFNPLTDSLKDKDGKEFKLQAPTGAGLPDRGYDPGQNTYQAPPADRATVQVQVSPTSDRLQVLSPFNAWNGKDATDMPILIKAQGKTTTDHISMAGPWLKYRGHLDNISNNMLIGAINAANGEANKVQNFTTGEWDAVPAVARDYKAKNIPWVVIGDWNYGEGSSREHAALEPRHLGGLAIITRSFARIHETNLKKQGMLPLTFADPADYDKISPEDKVDILCTELAVGKPITMRVHPKNGKDFEVKLNHTFNDAQIEWFKNGSALNTMAKNA

SEQ ID NO: 4129 - protein, 416 aa, Neurospora crassa
AASIPSTSGNHIKASSSCTFSGSTGFDLLNKGHSSCQEIVISDLQVPAGKTLSLDKLNPGTTVTFSGKTTFPYTSSGFAGPLLSISSSSKLTIRGLSSSVLYGSGEKYWDGLGQKGPIKKPKFFQVHNLEDSVIEGVTILNAPVQVMSINGCKNLTVTSFTLDNKAGDGDWKAGKGGRNTDAFDIGSSSNIVIDGAKVYNQDDCVAINSGTVSFFPPLSPFLSGVPSANQGFCFNQDITFRNGLCSGGHGLSIGSVGGRSDNTVKNVLFENSVIANSENGKHPFSPWLHRHLATGGMDSNAPTCDTSGARIKTNYGTTGLVSNITYRNVKLQNITKYGIMVDQSYGSSSKNASPTNGVPITGFTLSNVTGNVLSSGTNIFINCGDGSCKQFEWNQVDVKGGKKSSKCLRVPSGAWC

SEQ ID NO: 4130 - protein, 409 aa, Neurospora crassa
  unsure (1)..(409): unsure at all Xaa locations
CKANGLRGIYNAGATCYQNVVLQSFLHNPILRNFYLSDGHQSGSCDTPHCLSCAMDDMFQEFYASETTNGYTAANILSGFWISENKAFENLVANKEQDAHEFFQFMAEELHERNGDGKRPEIGSEHTCNCIIHQTYYGKLQTSTTCQNCGGVTNQAQSFLDLSVPLENLTQKRGKKNLTNGDGVASTRTQNSVTLQECLDEEYIKSDKCEYRCQNCNSVQQARRQTSIKKLPNVLSIQLKVRLPESFLMHIPYWPLPLASLGDNRSXQLPTEVRFKQGRNDRAQKIETPVQFPLQLNMLPYTTRARTQDLKDNYELQRSCTYDLLCVVVHVGDMDTGHYISYCRVGDQVSLTSEPXHTSSSXRVRLADPLPLAHLFKWFAFNDHKVELAQKSDVLNAKAYLLFYIVRSL

SEQ ID NO: 4131 - protein, 228 aa, Neurospora crassa
ANAFATLLGLCGILSLFSSLRYCLGDPADKTNIYYALAFLPFGLFFDFMDGKVARWRKKSSMMGQELDSLADLVRVHHYCPRFPNSSTPTLSGTSSILTHNPSNQQISFGVAPAVVAFAIGIRTPLDHLCLGFFILCGLTRLARFNVTATAIPKDANGKAAYFEGTPIPTTLGLDAIMAYWVSQGWIHDSLPWGTMFQGTALEFHPIVLIFMLHGCLMTSKTIHIPKP

SEQ ID NO: 4132 - protein, 419 aa, Neurospora crassa
  unsure (1)..(419): unsure at all Xaa locations
GARKISFNVSEQYDIQDVVGEGAYGVVWXVDHHRXSWPIWENHESXQVIGTSSAVHKPSGQKVAIKKITPFDHSMFCLRTLREMKLLRYFNHENIISILDIQKPRSYETFNEVYLIQVXSRAGSVLQNVIMFLTNMAGHPRNLMETDMHRVIRTQELSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDCMVSCHPKFQHMAALRGXDXRALLVTDHHQLTLILDVLGTPTMEDYYGIKSRRAREYIRSLPFKKKVPFRTLFPNTSELALDLLEKLLAFNPVKRITVEEALKHPYLEPYHDPDDEPTAPPIPEEFFDFDKHKDNLSKEQLKQLIYQEIMR

SEQ ID NO: 4133 - protein, 311 aa, Neurospora crassa
  unsure (1)..(311): unsure at all Xaa locations
TPVFLLKTKSTPGDSYQEQFSSETDGFNFEPFFVPVLEHRFKDEGLATVRNLLKTKAIGTGFDCAYGGLVFTSQRAVEAFTHLVQEVNRXDVLHPFQKAKPHNSCVGDDRWPHLQDIPVYSVGPATTRALKAVPQRPPLQVFGEHTGNGETLAPYIIEHYGEWYKDRSIKPPLLFLVGEQRRDIIPKKLMDPALPSDKFIRIKEVVVYGTGVMKSFQQDFTKLLQETQDRPARWVVVFSPSGCDGMLSALGWLNESSGRVGDDFQQEDRKTYIATIGPTTRLHLVKNFGYEPDVCAEQPSPEGVWQGISRF

SEQ ID NO: 4134 - protein, 560 aa, Neurospora crassa
  unsure (1)..(560): unsure at all Xaa locations
SVHGLPGDFNLVALDYVPKAGLKWVGSVNELNAGMSTSLFPPAXSLISNNFSYAADGYARAKGISALVTTFGVGELSAINGVAGAYSEHVPIVHIVGCPSTISQRNGMLLHHTLGNGDFHVFANMSENISCDVAKLVKPSEIAYQIDHAIRECWIRSRPVYIWLPTDMVEKKIEGARLDTEIDLSEPENDPDREDYVVDVVLRYLHGAKNPVVLVDACAIRHRVTEEVKRFIEKTKLPVFVTPMGKGAFDETSEHYGGVYAGTGSLPEVAKRVEGSDLVLSIGAIKSDFNTAGFSYHTSQLNTIDLHSDHCTVRYSEYPGVAMRGVLRKVTERIDMSKLSITPSPPVENAVAENRDDSQAITQAWFWPRVGEYFQEGDVVVTETGTANFGIWESRFPKDVMGVTQVLWGSIGWSVGAAQGAALAVKDLEQDRRTILFVGDGSFQLTCQEVSTMLKHNLEGHHVSASVFYLSYLVXGXLDELRLTGLPQSFLIYNEGYTIERYIHGMDADYNDVTRWNYTDIPAVFGAKEGQSQKFVIKTKDELERLLKDKDFNEYKGLQF

SEQ ID NO: 4135 - protein, 1104 aa, Neurospora crassa
PKTQYELMRDNNFEHLQHQDADDQRATQRLRFKPNQLGDNAVADNGILESITCINFMCHTRLHCELGPLLNFIVGENGSGKSAILTAITLCLGGKASSTNRGGSLKSFVKEGTEKAVLIVKIKNQGQDAYRHELYGDSIIVERHFSKSGSSSFKVKTATGQIVSTKKQEVEEIVEYYALQVDNPLNVLSQDNARQFLNSSTKQQKYKFFIEGVQLQQLDNDYRLIAESLELMESKIPDQEERVKAAAEELKRAKSFKDAMDGNRKLRAKQHQLRSQMCWLQVVQEEAKLTKLDEKIAQLADQMAEVDRQRNEKGVDLERVENQIRAFQQRLEEAIQRKTEFEEQVDEGRKKAQAIRDELAQIQADERAAHQNLRSAATTVKDFEEKVAAEEKRLEEATGEALLSKTRELEKAKEYVTEVEAKISKAKEDEKDLLNKRDEAQKARDAKAVECSLKRDEITVAEQELRTSEKDQGSIYAAYEPKLPELLKMIEKETRFQKKPVGPLGAHIQLLKPEWSLILEKTFGTALNAFIVQSMAEQKLLQGLMNKLNIRQCPVFIGNRHPLNTDGKEPDPSFDTILRVLKIDNMMVRDQLIINHMIEQVILIPQRTKAEDIMFSGARPRNVKACLSFHDKKRDEGLRLVVNNSGGMSTSPVPPLRNQRPRMKADIGSRLAYQKETLRQLELEYSVLDREHRQLQQEVQKIISDLTKLQRDKKTLDSELRHARVQVEQVQYRLDEYEGGDSRLTGLKAELAAAKEKEEACGLQYGNLRIRKDEKNQASTEAQAQLTEIRKESEKYEREVKKLQEKKARLEDVRKINLTEVNEAHASFEIFKGDKEEAEKEREKGAEDVATFTKQIIEALGSEERAHVNPTDKYEELEKQYQSIQNQLEKERRKRGMTDEEVYANLTRAKETYDDAKRSLEGIKTVNSRLRRTLTIRLEKWRKFQRYISSQSRANFIYLLSERGFRGKLLLDHERKALDLVVEPDKTEKRAAGRNTKTLSGGEKSFSSICLLLSIWEAMGSPLRCLDEFDVFMDNVNRAISTNMLVSFIDDGNDGDKQWYIHEPLLTWPQITAARRSVNRQYIFITPNAIEGRNTLDKDVKIIR

SEQ ID NO: 4136 - protein, 520 aa, Neurospora crassa
  unsure (1)..(520): unsure at all Xaa locations
EKDLVIIGGGVAGYVAAIKAGQEGLKVRRIANQLHRNTDEXRQYLTAISHVAWKXVACIEKRGTLGGTCLNVGCIPSKSLLNNSHLYHQILHDSKHRGIEVGDVKLNLAQLMKAKEQSVSGLTKGVEFLLKKNGVEYIKGAGAFADEHTINVKLNDGGETSVKGKNILIATGSEVTPFPGLEIDEKRVISSTGAIALEKVPEKMLVIGGGIIGLEMASVWSRLGAQVTVIEFLDQIGGPGMDLEVAKSIQKILKKQGINFKTGTKVVSGDKTGETVKLEVDSAKGGKPETVSGPXYPAGYLFVVVIFKADIVRTQLEGDVVLVAIGRRPYTEGLGLENIGLEKDERGRVIIDSEYRTKIPHIRCVGDVTFGPMLAHKAEEEAVAVVEYIKKGYGHVNYGCIPSVMYTFPEVAWVGQSEQELKKAGVPYRVGTFPFSANSRAKTNLDTEGMVKMIADPETDRILGVHIIGPNAGEMIAEGTLALEYGASSEDIARTCHAHPTLAEAFKEAAMATHSKAIHF

SEQ ID NO: 4137 - protein, 366 aa, Neurospora crassa
DTVIRKYRELNERIKAEGLYDCNYVAYAIEGFRYTLLFCGCLLFLKWGWYVPSAFCLGSFWHQLVFTAHDAGHMGITHHFHVDTVIGIIIADFIGGLSLGWWKRNHNVHHIITNSPEHDPDIEHLPFFAISHRFFTNLRSTYYDRVMEYDIFAKFFVSLQHYLYYIIMMFARLNLYRLSWEYLLKGQAPKHGPAWWHRHLELVGQVFFWCWFGYGIMYKAIDGNWNRFVFFMISHAVTSPLHVQITLSHFAMSTSDLGPHESFPQRMLRTTMDVDCPEWLDFFHGGLQFQAIHHLYPRIPRHNLRKTQKLVQDFCNDVGIPYALYGFVEGNKHVIGRLADVARQAAILRKCQQTIVDGSIGHSHAH

SEQ ID NO: 4138 - protein, 729 aa, Neurospora crassa
LSLREQENVVNKIEKENFGLKLKIHFLEEALRKAGPGFSEAALKENTELKVDKVTMQRELQRYKKTLSTAEKDLEKYRAQMMEMQEKAAKKFSDGNQRAELDRLRQLVEEKEAEIRRLQQLLEQGQGENEKLEELQEHIEEEAEELREKAAEFEEQLKEAQVRIAELEDKAASSDVLREAQETIRGSSARCEASRAAAGRHEGQGGGGHFQKDRAEADLQELQNEMANKSVITKGLSRQVEEKVARLQSELETARQECVTVAQQRDAQSAQVENLKSTLRQVQQERQSLEQTRASMAARLERGQAQLDQLSSEKQLLQERHDAMANESASLRREMSGLQTAVSALELNMERERQNALNIEQNIRAQYKDEMDRLNNHALSVEQNLRAQYAEEMKRLNNEISDLQAECREKDNLYDNDSEKWEAERRKLEAELNRAQERASGLQVSLDQLRQTEGNLSNKEARLQHALQLENERHKREEALLSRQIQELQQNLQSRQAMLEDLRKEMRQVQDQHRQTQLDYQAQTDKIAALEDEVEVLQAALDEESERAGQDLEKLQEECMDLKQKLASAQATSSAARASMNTSNSNAPTYNESQASLRIQLADANENLARIMKEQKMLQERYNNLDAEARSLRINLSHATAERDELEAELQQHRDQGPDQDTFQLDQEKLNLRSAKTRLDNEIRRLREENRSLLERQRSMQKSLEEEIEKASAEEERLNQEILQLQAKV

SEQ ID NO: 4139 - protein, 598 aa, Neurospora crassa
  unsure (1)..(598): unsure at all Xaa locations
SNGTRIPGDLVMGRPRSQSKPPHARPTPESSAPRRSDEHTHTRQSSFTISAAAASSALNALTLRDNNERSPLEGGEGLRLRTAPLQTPRRRPLPATGNTDEEDTAYSAKGSATTTRKSNRKMSDPTLAQRKPISRTSYLTSTARPASGRSATTQDVDTPRMSAKARGKKLEQVPISSSSEDSEYGTPRRPTTRQHLRQILKQRDVSLVADTPAHNSESQESEGNDGAAQQRSEAAKWNKQKAKILRRLPPGVDEHAAKQILNEIVVQGDEVHWNDIAGLEVAKNALRETVVYPFLRPDLFRGLREPARGMLLFGPPGTGKTMLARAVATESKSTFFSISASSLTSKYLGESEKLVRALFTLAKVLSPSIIFVDEIDSLLSQRSGSGEHEATMRIKTEFLIQWSDLQRAAAGKEPAATGTKENGTDDDVNRVLVLAATNLPWAIDEAARRRFVRRQYIPLPEADTRAIQFKTLLSQQKHTLTNEDINELVDMTDGKWRYPFVNVSPANXLPGRAARQVPFAKHVHLAGFSGSDITALAKDAAMGPLRSLGEALLQTTMDQIRPIELKDFVTSLATIRPSVSKANLKFYEDWARDFGERG

SEQ ID NO: 4140 - protein, 301 aa, Neurospora crassa
  unsure (1)..(301): unsure at all Xaa locations
QTRMQIVNSNPSAVYHGVIQSTYRIASTEGIFSLWRGMSSVIAGAGXFASPSLRISRLPTNVNLIGPAHAVYFATYEAVKHLMGGNKVGEHHFLAAATSGACATIASDALMNPFDVCPPIYAYTLCGPIHVKAXFXRSRNTVIKQRMQIQNSAKMYRSMLDCAKYVYRNEGLGAFYVSYPTTLSMTVPFTALQFLAYESISTSMNPTKKYDPATHCLAGAVAGGFAAALTTPMDVIKTMLQTRGAAQDAEVRAVNGFVAGCKLLYRREGVKGFFKGLKPRVLTTMPSTAICWSAYEASKYV

SEQ ID NO: 4141 - protein, 1090 aa, Neurospora crassa
  unsure (1)..(1090): unsure at all Xaa locations
LNPSPARAPSVAPTNMTGMRSGDYGLGPKGDQYKGQVFYNAEGQLVSELEPDLAEGKKIEERPISSQRKIWVFTVWALTWWIPSPLLKFVGRMKRPDVRMAWREKFVLCLIIVLLNAIIVFWIIFFGRLLCPNFDKAWTLEEIQNHAAGDDFWVSIDGKVYDITKFWRLQHSDNNIDTTSDVMMPLAGQDLSAYFVAPLYITCPGLGIADSTTLQFNTTPEYVVAQHISGPTQPNIRSKLSERYWYTERFLPAIKEYYHGDVVWDSKKIKQEGLDWNHPWFIYEDLVYDMTDYMYTAKRMNNDATYTFIDAKITNMVKNNPGQDLTEQINDLIDRASSNTTQYNSVMNSLNCVKNAFYVGKPDFRYSARCQVNNYILLAFSVIICSIIVVKFVSALQFGSKRRPAPQDKFVICQVPAYTEGEDSLRKALDSLTALQYDNKRKLIFVICDGVIVGAGNDRPTPKIVLDILGVDPKVDPPALAFKSVGTGAEQLNYGKVYSGLYEFEGNVVPYIVVVKVGKESEQSKTKPGNRGKRDSQILLMSFLNRVHHRAPMNPLELEIFHQINNIIGVDPELYEYLLMVDADTCVREDSLNRLVAACANNAKIAGICGETSLQNEDLSWWTMIQVYEYYISHHLAKAFESLFGSVTCLPGWXVLPFLRSLIVCRQYXQFNSFTMYRLRTVDKGKPLIISDDIIREYSDCYVDTLHKKNLLSLGEDRFLTTLMTKHFPYMSYKFIPDAYCQTAAPETWSVLLSQRRRWINSTIHNLAELIFLDEMCGFCFFSMRIVVFIDLFGTIILPATCVYIVYLIYTASSHTAPFPLLSIIMIAAVYGLQALIFILKRQWQHVGWMIIYLLAFPIYSFILPIYSFWHQDDFAWGNTRVVIGESGKKQVVAVDEEGFNPRAIPLQRWDEYALANNLPGRRGGPLEKGMDEHLGGMYEETYEVDDMKSVYSSVRQPSVLTGFGGRGAGAYMPPHSPGFPPNGGGSGAMTHASTFVGASPFTEQNNLMNRQSMASMGTMVEMQRRASPYQDFPGGHSRGPSQGAMRSMTNTPPALGAGGMVNARLSTATGMSLGIPGHRPGMSHSESSR

SEQ ID NO: 4142 - protein, 408 aa, Neurospora crassa
LLSSARFTLSLLPIRLAHRIQALRNLPYIVVSNPNISRIYNNYQHSLSTLLPWQGKTISSLDDEIKFTQVLAELVQTHTDTIPILAKGFIECRKYISPSEVTRFLDEHLRARIGTRLVAEQHIALHYSSTPHFDPEASPTLCPEPKTHPSYIGVIDTTLRPASVIDSCGDFVADICELNYGVRPEWVVDGEPDATFAFVPMHLEYIVTELLKNAFRATVENGMSREPVVVTIAPEPASSSASAATPGVYSDYCPPNSSQKNSSSSSSSGSNSISSSQQGKAAAQQQQQQQQKQAQHGIIPLHDRAPGVTIRIRDRGGGINPAVLPNIWRYSFTTFNDADDDDHHESPGAWGEEAMGLISNTGVGGSTIAGLGYGLPLSRAYAEYFGGGIAVQSLYGWGTDVYLRLKGV

SEQ ID NO: 4143 - protein, 340 aa, Neurospora crassa
ITVLGSLNIDLVAYVSHHPLPGETMTANSVAVSPGGKGANQAVACAKLSRSHTSSSSSSSSFAEETAHITMLGTVGADSYGSLLKENLAKHGVDVSGVRVLDSPPGAKTGMAMIVVDEPTGQNRIILSPEANHFLQPEHVSEVAHLSSSSVGGAAQEKPDLLIMQLEIPVPTVLQALRTAKQNGVQVLLNPAPAVPLPDEAFDGLAHLVVNETEAAILSGLEESVLDTEEGLEKVGKVFLEKGVKTVIVTLGGRGVFFMTGGGEGGSKKGLIKAEKAKVVDTTAAGDTFVGMYALEVVIAAKKGEQFDIEGAVRKANKAAAKTVERPGAQDSIPWRDELL

SEQ ID NO: 4144 - protein, 75 aa, Neurospora crassa
ATTVRSVKSLIPLLDRVLVQRVKAEAKTASGIFLPESSVKDLNEAKVLAVGPGALDKDGKRLPMGVNAGDRVLIP

SEQ ID NO: 4145 - protein, 217 aa, Neurospora crassa
  unsure (1)..(217): unsure at all Xaa locations
QVYVPTVFENYVADVEVDGRHVELALWDTAGQEDYDRLRPLSYPDSHVVLICFAIDSPDSLDNVSEKVSIPPAYLARPCLXGYNSLTIKNSWHSEVLHFCRDVPIILVGCKKDLRHDPKTIEELRKTSQKPVSPEEVREAETLAADDAPFVSKCFPSACSGMYANALINRGEALRKRINAHKYLECSAKTNEGVREVFENATRAALLKKTKTKRGLC

SEQ ID NO: 4146 - protein, 761 aa, Neurospora crassa
  unsure (1)..(761): unsure at all Xaa locations
MAPAVGIDLGTTYSCVGVFREDRYVTAPGRLTLAHLESYXLIFTSCEIIANDQGNRTTPSFVAFTDTERLVGDAAKNQVAMNPANTVFDAKRLIGRKFSDPEVQADMKHFPFKVIDRGGKPVIQVEFKGETKVFTPEEISAMILQKMKETAEAYLGGTVNNAVVTVPAYFNDSQRQATKDAGLIAGLNVLRIINEPTAAAIAYGLDKKVEGERNVLIFDLGGGTFDVSLLTIEEGIFEVKSTAGDTHLGGEDFDNRLVNHFVQEFKRKVSDAWKTEFNAXTIWLMAXNVSFNAYCQMLTPSQHKKDLSTNARALRRLRTACERAKRTLSSSAQTSIEIDSLFEGIDFYTSITRARFEELCQDLFRSTLQPVDRVLTDAKIDKSQVHEIVLVGGSTRIPRIQKLISDYFVSILPHVQYGKEPYSLTFFFSFLHQNGKEPNKRXAFSCQSLFDLFFCEFLGIFPWFLGKWTNIYITSINPDEAVAYGAAVQAAILSGDTSSKSTSEILLLDVAPLSLGIETAGGMMTKLIPRNTTIPTKKSEVFSTFSDNQPGVLIQVYEGERQRTKDNNLLGKFELTGIPPAPRGVPQIEVTFDVDANGIMNVSALEKGTGKTNQITITNDKGRLSKEEIERMLAEAEKFKEEDEAEAKRVAAKNGLESYAYSLRNTLSDSKVDEKLDAADKEKLKSEIDKIVAWLDENQQATREEYEERQKELEAIANPIMMKFYGAGGAPGGMPGAAPGGFPGGAPGSNDNEGPTVEEVD

SEQ ID NO: 4147 - protein, 381 aa, Neurospora crassa
MADIQDEAGPFLPPTISPPALLSGVSQTYFSPIPPQLLADNTPCCLGVDEAGRGPVLGPMVYSAFYLPLTLSDPLLKQKHSFDDSKVLTPAVRLSLMKELCTKDTELHDNCGYATSSLSPLSISSGMLKASKAQIYNLNQQAMDATIALIKGIYERGVNVTDIFIDTIGQPAAYQKKLERVFPTAKITVAKKADSLYPVVSAASVVAKVTRDIALEVLWADRSKQMRKRKRDDEAGLEKRAKLERGDTTGTNGTDAMDVDEPSHTQSDSPKPAAEEDEEEEVETNEAMAWGSGYPSDSKCVSWLKQNMHPVFGWGPECRFSWGTAKDMLETKGGVKVDWPEEEEEETQKLTDFFMAKRDQAEVDVDDLGTWFGAPAGVECF

SEQ ID NO: 4148 - protein, 451 aa, Neurospora crassa
  unsure (1)..(451): unsure at all Xaa locations
ERRFLFKLDAVILTLASLGYFIKYLDQVNITNAFVSGMKEDLKLFGNELNYMQTCWTVGYVIGEIPRXVSIPPMTFSPLTPQQCXSSHSNILLTRIRPSIWIPACEVVWAILTILLAKCKTTTQVYVLRFFIGLAESVFYPGMQYIIGSWYRKDELAKRSCVFHASGAIGTMFSGYLMAAVHKKLAGVGGFKGWQWLFIIDTVISLPIAISGFFLMPDLPEITKAWYFSADEITLAKERMRLEGRAPRAPYTKAKFKKIFSSWHIYLLTALYIFFNNGNGASGQPAFQLWLKSKGHPITEVNTNPTITAAITVITTLIYAWTSDTVFRGARWPPIVFSGLVNIVIYSSLAAWNIPDGWKWACFFLAGFGGGISGLTFAWAHEICGDDNEERALVTGTMNEMAYVIQAWLPLLIWQQVEAPVYHKGYMTSIFIAVAMILTAVLVRFLHHKER

SEQ ID NO: 4149 - protein, 1050 aa, Neurospora crassa
  unsure (1)..(1050): unsure at all Xaa locations
DTQSAPNADELDEEAALKKLTENVRDQDDLERDITLQASRALIEAEDKRDQKRIEKAEATRTRLENQKKTQQQKLRPGITNPTARLRIQQEIARIDAEIELCDKDIADFRARIEQRNQQGETGTLAPATGKILPNETQREYLIRTGKITPFAKFGGPRPAEVEGDLANAIVDAEDEAVAEELEEKENDGPRSHQNLRLPGFADENEVATVAVADDFSLRPRKRRRVQPPPESDDEFVLGESGSEAASPEADASDDYDDYEMAGTTLKKRKKAVREADGDDKVDLTGIDDGNEKVYQARLKGWVTRRSNARRARQQRLGQPIDKDDDGTEEWFKPAPDQPDHQFENGLKLPGDIYPALFDYQKTSVQWLAELYAQQVGGIVGDEMGLGKTVCSLRCPPWESTERCXRDVVQLISFVAALHYSQKLDKPVIVVAPATVLRQWVNEFHRWWPPLRVSILHSSGSGMLNVRNEGALDDREDDYGKRKPKKSSQAAKKIVDRVVKHGHVLVTTYAGLQTYGDILIPVDWGYAVLDEGHKIRNPNTAITIYCKELRTPNRVILSGTPMQNNLTELWSLFDFIYPMRLGTLVAFRNQFEIPIKLGGYANATNLQIMTAQKCAETLKETISPYLLQRLKVDVAADLPKKSEQVLFCKLSKPQREAYELFLKSDDMTAILNRTRQSLYGIDILRKICNHPDLLDPRLKDDPSYKWGSTSKSGKMAVVKSLLPMWKRLGHKTLLFCQGTQMLDIIEAFVRRQDGINYLRMDGKTPVKDRQTLVDQFNNDPDLHLFLLTTKVGGLGTNLTGANRVIIFDPDWNPSTDVQARERAWRLGQKKEVTIYRLMTAGTIEEKIYHRQIFKQFLSNKVLKDPKQQTSFNLNDLHDLFSLSSYEDGKTETAELFKGSEVKRLPSGPTEIVLPGNDTPVLRAPGASKPVEVKDESTSEDETSNLRHLEGVAGLETFNDDGPAPAPNEEDRLMEGIFARSIHSALEHDEIMNGKKPTVKADRRILQAEADRVAAQAALALRRAGEEARNVPIGTVTWTGEYGEAGRPAPR

SEQ ID NO: 4150 - protein, 429 aa, Neurospora crassa
GGGYGGGGGGYGGGGYGGGGGGDRMSALGAGLQKQNWDMSALPKFEKSFYQEHPSVANRSPAEVDKFRADHSIAVFGNNVPKPVETFDEAGFPRYVMDEVKAQGFPAPTAIQSQGWPMALSGRDVVGIAETGSGKTLTYCLPAIVHINAQPLLAPGDGPIVLILAPTRELAVQIQQEISKFGKSSRIRNTCVYGGVPKGPQIRDLSRGVEVCIATPGRLIDMLESGKTNLRRVTYLVLDEADRMLDMGFEPQIRKIIGQIRPDRQTLMWSATWPKEVRNLAADFLTDFIQVNIGSMDLAANHRITQIVEVVSESEKRDRMIKHLEKIMEGRENQNKILIFTGTKRVADDITRFLRQDGWPALSIHGDKQQNERDWVLDQFKTGKSPIMVATDVASRGIGMYPSYPSALPKPLPPSSLPHLRRLPAYVRA

SEQ ID NO: 4151 - protein, 125 aa, Neurospora crassa
  unsure (1)..(125): unsure at all Xaa locations
QRMQTDPPAGVSASPVPDNVMTWXGERSLLRCRYGRSTPGMAMTDMSLHIGNAVIIGPADTPFEDGTFRLVMHFEEQYPNKPPSVKFISEMFHPNVYATGELCLDILQNRWSPTYDVAAVLTSIQ

SEQ ID NO: 4152 - protein, 444 aa, Neurospora crassa
  unsure (1)..(444): unsure at all Xaa locations
ARTAAGSASRTSRVACARLFSTQSALRQQIQDAYILSGVRTPTAKVKRSVKSAISTTQRLCXRLQFNGSYTTVPAPKLGAVAIKEAVKRSGIPVEKITDVYMGNVLQGSVGQAPARQAAIFAGLSPNVEAITINKVCASGLKAVVFAAQNIQLGLAEAQVAGGMENMTRTPYYVPRASGMPPFGHIKMEDGIIKDGLTDVYNEFHMGNCAENTAKKFQISREQQDEYAIQSYKRAQEAWASGKFAEEVVPVTVPGKKGDKIIEVDEGYNDIKLDKVATLKPAFVRDGTGTVTAANASTLNDGASALVLGNKSLAQEFGKGSRVLARIVSSADAAMDPIDFPIAPSKAVELALKRAGISKDQVAIWEFNEAFAAVIKANEKILGLEGAVVNPLGGAIALGHPLGSSGSRILVTLLHQLQPGQYGVAAICNGGGAATAMVVQRIES

SEQ ID NO: 4153 - protein, 302 aa, Neurospora crassa
LRSSHVVLITGPSEGGLGAETAISLAHANPALLILVGRSLNKIQPTIDAIHAVNPSIAVKFIAADLTSLNSVREAARSILDDASIAHIDVLINNAAVMACPYELTVDGFEMQFATAHLGHFVLTKHILPKLRASAGAGKPQTRIINVSSLGNTLGGIRWDDPSYTKRPEEYKPWDAYGQAKTANVLFTVALNKRLLAKTGIRSYALHPGGIYTPLLRHMNDELMEEITQRVTKGEMQLKTVQQGCATTLRAALDPELEKAGEDGVFLSDCQFTKDPELVAPRALDEEDAERLWGLSEELVGE

SEQ ID NO: 4154 - protein, 717 aa, Neurospora crassa
  unsure (1)..(717): unsure at all Xaa locations
MAELDTLDLVVLAAILLGTVAYFTKGKLWGVTKDPYASSLANASGAKAGKTRNIVEKMEEQGKNCIIFYGSQTGTAEDYASRLAKEGKSRFGLETMVADLEEYDFDNLDTIPDDKVVFFVLATYGEGEPTDNAVDFYEFITNEDVNFTEGNEPALGNLNYVTFGLGNNTYEHYNSMVRNVDKALQKLGAHRIGDAGEGDDGAGTMEEDFLAWKEPMWKALAERMGLEEREAVYEPVFSIIEREGLTKESPEVYLGEPNKMHLDGTAKGPFNAHNPYIAPIAQSYELFSVKDRNCLHMDIDISASNLNYQTGDHIAVWPTNPGEEVDRFMNVLGLSEKRHTVVSVKALEPTAKVPFPTPTTYDAIVRYHMEICAPVSRQFLAQLAAFAPDAEARAEMTKLGAEKDYFYEKISLHHLNIARVLDIVGKGQKWTNIPFSAFIEGITKLQPRYYSISSSSLEQPKTISITAVVENTQLPGRDDPFRGVATNYLLALKQKQNGEPEPCPFGLSYELTGPRNKYDGIHVPVHVRHSNFKLPSDPSKPIICIGPGTGVAPMRGFIRERVQQAKNGEKVGKTLLFFGCRKSTEDFMYKNEWGGKSRATLEPLLVTSICXHKWRKFQEAKEILGDNFELITAFSREGPKKVYVQHRLKERAEEINQLLEQKAYFYVCGDAANMAREVNTVLSQIISEQRGIPEAKAEEIVKNMRSSNQYQVRLRCD

SEQ ID NO: 4155 - protein, 412 aa, Neurospora crassa
  unsure (1)..(412): unsure at all Xaa locations
ATQFEVSQPPSDAISAVIFAPDNTNRLLVSSWDRNVYLYEIAEGTEDATLINKFEHRAPVLDVCFGANGNEAYTASLDCSVKRFVALIAYYLWDAQHYATDLCGCXRESNRIDLSTGEQTVLSTHEKPVRCVVYSPQHCKSESLQSNHPTTTPRITFDMYLRHQLIWQSPLPAMLISASWDHTLHVHNTSAPASTPITISLPGKPHALAASPSKVVVAMTARLVHIYDLPTLATALSSADSASANITPWQQRESSLKFLTRAVACMPNDAGYATSSIEGRVAVEWFEDTAESQARKYAFKCHRQTAPEEEGGGDVVYPVNALTFHPVYGTFASGGGDGTVALWDAEAKRRMRQYQKFPDSVAALAFSNNGKYLAIGVCRGFETDMEDFNSEGRTKVFIRELGETEAKGKGPK

SEQ ID NO: 4156 - protein, 157 aa, Neurospora crassa
  unsure (1)..(157): unsure at all Xaa locations
MVRLKDRYLLVNIVYADIPPGQKGTVPDLLLYNQPTLGELRPQTILKGIRSQVNALFGDCGSGSVERSLQGKHTTELXNLHLVKAATRLTWYTVKYLSTATSTFILRISRAHYRLVWAALTFMDRLPVKDGRPCIFRVVRVSGTIRKVEEEAIRRAK

SEQ ID NO: 4157 - protein, 224 aa, Neurospora crassa
  unsure (1)..(224): unsure at all Xaa locations
GAFLESVSPYAWADLGIALCIGLSVVGAAWYVREKATHPSPSAAWRPLQPAREELGXSLGXSTEQGIFITGSSILGGGVKAPRIRTKNLISIIFCEVVAIYGVIMAIVFSAKLQPVTGAQYYSGDSYYTGFALFWAGLTVGMCNLVCGVAVGINGSGAALADAADPTLXACCRDPDKEVVESCYXCVLVLNSFVKILVIEIFSSVLGLFGLIVGLLVSGKAPDF

SEQ ID NO: 4158 - protein, 458 aa, Neurospora crassa
TGPRPAPRTSAPSGTNRDTVAYGDGPVQVSFGEGYGVTNKGWFDTFASLDLLSKRDARDGQALGAFQNASSIDPTTKTRSFSAVTYLTPEVRARENLKILTNTHVNKVLFDTTGPEPVATGVEINVNGIVSQVSASLEVILSAGALQSPQILELSGVGSKEILAQHNIPVVFENPAVGEGMQDHPIVCQSFEVKEGTPSGDVLRDPPEIKALLDKYTADRSGPLGQLTISVAYTPLVNKTGVISDEGVKKLFAGRDFSNPARAAIRDIVTNPNEPTFQYILFPTQVHIADKPDNMATHLIPVEPENFLTVMTILNSPFSRGSVHIQSSDPKAAPVWDPKYNHDDLDMELLARGVQFVEHLVAPESALGKLLNQSGRRLPQLKGDDLETAKEIVRQRQISVFHVSGSCSMRPREQGGVVNERLQVYGAKGLRVVDASIFPIEPAGNIQSVVYSVAERAA

SEQ ID NO: 4159 - protein, 518 aa, Neurospora crassa
  unsure (1)..(518): unsure at all Xaa locations
GKLTDILCPKAQICARAAGGHNAGHSIVREPXWLQVPDAPRCLRDTMYASRKDHXHCRRATVANGVEYDFHLLPSGLVNPNCMNLIGSSVVFHVPSFFSELSKLEEKGLTDVHNRILVSDRCHVNFDLHAAVDGLEEVELGDRKIGTTGRGIGPSYSTKMAVWXTPKDTLRPEXRRXQDHVSYRESGVRIHEIFNEEIFERKLRQLAAGYKKRFGDLLKYDVEEEIARFKEYRVKLARYTVDAIQYMKEAQDRGYKILIEGANALMLDIDYGTYPYVTSSNTGLGGIITGLAINPTKIDNIIGVVKAYVSFFFFSHLXSPAGYDVMIWFANPRFRDNRPLRVGGGPFKTEDLEEAGTKLQEIGREWGVSTGRKRRCGWLDLVVLKYSTAINNYTALNLTKLDILDTFETIKVAVAYKDPQTGEEVEYFPADLDILDSLEVVYKELPGWNKPITDCKTYVSFYRLGSFITVFAALLTTHLXYDLPKEARAYIEFIEEFVGVPICYIGTGPKREDMIVRK

SEQ ID NO: 4160 - protein, 968 aa, Neurospora crassa
  unsure (1)..(968): unsure at all Xaa locations
DGRQERVQFDKITARVSRLCYGLDMNHVDPVAITQKVISGVYGGVTTAQLDDLVSTFSPVPLLVPIINHELTHNLSLAAETAAYMTVTHPDYAILAARIAVSNLHKQTKKQWSLVISELYNYVNPRTGKHSPMIAKDVYECVMRHKDEFDSAIVYDRDFNYQYFGFKTLERSYLLKLDGQIAERPQHMIMRVAVGIWGDDVERVIETYNLMSLKTFTHASPTLFNAGTPQPQLSSCFLVDMKEDSIEGIYDTLKTCAMISKMAGGIGLNIHRIRATGSYIAGTNGTSNGIVPMLRVFNNTARYVDQGGNKRPGAFAIYLEPWHADVFEFLDLRKNHGKEEVRARDLFLALWIPDLFMKRVEQNGQWTLMCPHECPGLADVYGDEFEALYEKYEKEGKGRKTVKAQKLWYAILEAQTETGNPFMLYKDACNRKSNQKNLGTIRSSNLCTEIIEYSAPDEVAVCNLASLALSAFIDYENASYDFKKLHEVTQVVVRNLNKIIDINHYPVKEAHNSNMRHRPIGVGVQGLADAFLALRMPFDSDAASKLNIQIFETIYHAALTASCQLAKEQGPYATYEGSPVSQGILQYDMWNVTPTNLWDWTALKADIKKYGVRNSLLLAPMPTASTSQILGNNECFEPYTSNIYQRRVLAGEFQVVNPWLLRDLVEMGLWSDAMKNRIIAEGGSIQNIQSIPNDIKALYKTVWEISQRTIVKMAADRGAFIDQSQSLNIHMREPTMGKITSMHFAGWKMGLKTGMYYLRTQAAAQPIQFTVDQEALRATDDRVAPAHSGLKKRSPPAGTYTSIVLRENTSGPRPYAQTGVSGTSTPIGTRDVPTPASTPPPTEVPETLVQSDNRPRPLVSPAKSAGFKADLPEPESPKALATDPIVKTEDIGSPLLERKEGQNEDVDEDSQERDENIYSNAPLSEQQVAACKXQDLAPTRPXDTHXPHQITGAWNPGADPSSCEMCSG

SEQ ID NO: 4161 - protein, 532 aa, Neurospora crassa
  unsure (1)..(532): unsure at all Xaa locations
MISRSALSRGSQLALRRPAAAKTAQRGFAAAAASPAASYEPTTIAGVKVASRDDSGPTTRLAVVAKAGTRYEPLPGLTVGLEEFAFKAGPRSTASGPXEREKTPMSXXLAHLGEVHRNTNKRTALRITRESELLGGQLQAYHTREAVVLQASFLREDLPYFTELLAEVISETKYTSAXXYLPSHETKRWLLLTVVVVALPPHSPEFHELVENCIHEKQAKLDSAAIALDAAHNVAFHSGLGSPLYPTVDTPTSSYLNENSVAAFANLAYNKANIAVVADGASQAGLEKWVEPFFKGVPATSSGNLNTAASKYFGGEQRVAKNGKNAIVIAFPGASLGVPHPETSVLVGLLGGVSNIKWSPGFSLLAKATAANPGAEAFAHNYAYSDAGLLAIQITGKGAAVGKVAVEAVKGLKAIAAGGVSKEDLTKAIAKAKFNLLSASEVSGTGLVHAGANLLAGGKPIQVAETLKALEGVTAEKLQAVCVNLQEVGKEKKDMLTNVQQAAKKLLEGKASVSAVGDLHVLPYAEDLGLKV

SEQ ID NO: 4162 - protein, 257 aa, Neurospora crassa
QISNTAELNKVIFKNKAEAPFGRKFVSLFPGLGYAAGYKVLQRIYKYGGQPVARDFLGTHYGKDFENAFGKKTGKAIMHSTAGSLIGIGEIVLLPLDVLKIKRQTNPEAFKGRGVFKIIKDEGFGNLYRGWGWTAARNAPGSFALFGGSAFAKEFLFGLNDYNKATWFQNFVASIAGASASLVVSAPLDVIKTRIQNRNFDNPESGFRILTNMAKNEGAGAFFKGLVPKLLMTGPKLVFSFWLAQTLIPAFDIAFRK

SEQ ID NO: 4163 - protein, 304 aa, Neurospora crassa
KKGVRDFTFGRILGEGSYSTVYLATDRQTLREYAVKVLEKKHIIKEKKIKYVNIEKNTLNRLTEHPGIVRLYYTFQDETSLYYVLDLCTGGELLGVLKKTGTFDVECTRFYGAQILDAIDYMHSRGIIHRDLKPENVLLDEQMHVKITDFGTAKLLRDPRDPRPPEETPGQSGEDDERAASFVGTAEYVSPELLTEKSASTASDIWAFGCIIYQLLAGRPPFKAGTEYLTFQKIVKLEYEFPPGFPSAARDLVERCLVLDPAQRFTVEHIKKHEFFAGQMFGKELWRMKAPRLRPYVPGSQEQQ

SEQ ID NO: 4164 - protein, 560 aa, Neurospora crassa
  unsure (1)..(560): unsure at all Xaa locations
MMVPVLSRQALRHASVARVALPSLTRWYAWYPPHTVVKMPALSPTMTSGGIGAWQKKPGDKIEPGEVLVEIETDKAQMDFEFQEEGVLAKILKDSGEKDVAVGNVSTYLHYLSSHESSYLPNTPALPTPTPXLHAHLLPSRPSSPLDPESTLLPLCLVRASCPVSRLSGDMSWCRXASTRPASPXLVRAXCRQTTHADHASSSFSSPIAILVEEGTDVNAFKDFTLKDAGGETSPAVPKDEPKNESTASAPTPAPTPAPEPENTSFTGRFQTALEREPNALPAAKRLAREKGIDLRNVKGSGPGGKITEEDVKKALASAPAAGAAAAAYTDVPISGMRKTIAARLKESVTENPHFFVSTNLSVSKLLKLRQALNSSADGRYKLSVNDFLIKAMGIASKRVPTVNSSWRDGVIRQFETVDVSVAVATPNGLITPIVKGVEGKGLESISAAVKELAKKARDGKLKPEEYQGGSISISNMGMNPAVQSFTAIINPPQAAILAVGAPQKVAVPVENEDGTTGVLWDEQIIVTASFDHKVVDGAVGAEWIRELKKVIENPLELLL

SEQ ID NO: 4165 - protein, 1106 aa, Neurospora crassa
  unsure (1)..(1106): unsure at all Xaa locations
SQIDSLISFIASHCSSGKGLGTTSSAIYDTAWLSMIQKPANSSHFLFPQCFTYLLRHQLPSGGWTSYATPVDGILNTAAALLALKRHSMCLISSPPCPQPTQQHQQELDNWPLHHRISQAESALQSMLLHWDVATTDQVGFELLVTRLLSLLQDAGVQGLSDFPGSAPLQALHDAKLAKLPANYVYQARSTLHHSLEALVGYIDFSKVGHLKEENGSMLASPASTAAYLMGLAEKGMWDEESEAYLRGVLDRERFEGEGDGEKEDGGVPCAWPTETFEVTWVVTTLAEAGVRFGNKEGEVIRGYLEEGWRRQGGLFSFCEFLPCCSTYPRWLVLLVERGRTKRXLTRLCAVPGGLVDADDTARAIMALNHLGTKVGVESLIRTFEAKDHFRTYEGERNPSISANCNVLSCLLMMDDPTIYAQQIVKTAKFLCEQVYTDSVREKWVSASFPFXXASGTNTDRKVQHINELYWMMLLSQSLATLFDTMAANPSLETSIFQLAPELQEQIPMTSLHVLTKVLGSQGLDGSWANGIAEVTAYGILTLSWLSHLPWIQQLGRMHGVNFITAGIESGKAFLEAHKHDWKKGQYLWIEKVTYASPVLCEAYCLAAAVIPVPDFTGLTGDANGQVVYRTKESLFVSEGLLKGVLKAGQLMSLTPLFRDLAPQLLRVAEMQACYALGFLQRKRKELGIFPSTGGDEKYMAFIPLTWTANNALRVQATAGYGHGHSGGLSNYVLQEMMVLSMLNYQVDEYMETAVERDFLGFYSGSWGSLEAVREAIGQVFEEFAPPGRKRSIWGDADHTPTNLKEIRSTLSRYVRHILLHPAVRSAPASVQARLRNEMHTFLLAHVQHAADNIHFAAASNQTCQVDNSWERETGLPSPPITEPHDPSSPPPSKRRRLASSSSSYSSSSHKAQEQKPKIFSPTDSRTFYSWVRTTSADHTSCPFSFTFYTCLLSHCHPYNSNKTENLFNKDARTSYVTEAMVRSLASLCRMYNDYGSIARDASEGNLNSVNFAEFHLAAGAAGKGCSEEGNQNSGEEEEAEREEKKKAKEELMWVAEYERRGLERTLGELGGLVGDGKMERVKLFVDVTDLYGQIYVVRDIGVGVK

SEQ ID NO: 4166 - protein, 762 aa, Neurospora crassa
STLADTRLHVLIADREQNVYQIQDNILPRPLSQNASSQTADLRFTYEAYPFSFKVTRVSTGDVLFDTSPSPLIFETQYLRLRTRLPSNPNLYGLGEHSDSFRLATNGYKRTLWNSEAPYIPQNQNLYGSHPVYFEHRGGNGTGGTHGVFLRSAAGMDVVIGKSDAGEQYLEYNTIGGVLDFYFLAGPGPEEVSKQYAQVVGLPAMMPYWSLGFHQCKYGWPDLGHVKQVVQNYSDAGIPLEALWDDIDYMDNKLDFSTDPVRYPHDQLKGFVDELHGKDMRYVQILDPGIRYKSDYGPYTRGAEKDVFLKAADGSWYRGLQWPGEVVWPDWIAPQTKEWWTTEILTFYDPNNGINADGLWVDMNEASNMCADTTCLSSAQKTRSLPQSLIGKIHPRAPGDRHQKTRSLPQSLIGKIHPRAPGDGQHLGLPNRDLFTPKYQIANHYPTLSSRTLFTNITNSDGSTQYDTHNLYALTMSSVSRSALISRSPTKRPFLLTRSTFSGSSRFAAHWFGDNFSSWADYRASIRQLLSFSAIHNYPMVGSDVCGFNGQAQENMCARWAVLGAWQPFYRNHADISAPDQEFYRWPSVAAAARKAISVRYRLLDYIYTGLYYASKTGEPALAKPLWFLFPSDPATYGIDTQFFLGDALLVSPVVEDDAHSVTFYLPQGKWYDFFTHHRIDQTSAGTVTVSGVGWDQIPVYIRGGSISALRLSDASFTTGQAMTTAEVRTRNFEIIIAPDQNGKARGRLYLDDGESLDSSGK

SEQ ID NO: 4167 - protein, 348 aa, Neurospora crassa
  unsure (1)..(348): unsure at all Xaa locations
QWVVTSKEKGFDGLVKEQGAVPQPGDNDVLVRLYGASLNYRDLIIPQVSTXRYIFPSXCTNRHXQKKTQGKYPFPLDLPVVAASDGAGEVVAVGSKVTKWKKGDKVTTLFNQWHQFGDIDTRAASSGLGGVFDGTLRQYGVFHEDGVVRTPSNLDHVEAATLVCAGLTSWNALYGLKTLKPGQWVLTQGTGGVSLFALQFAKAGGAKVIATTSSKEKAEMLKKLGADHVINYREDPNWGETARKLTPNNQGVDHIIEVGGAGTLGQSLAAIKYEGIISIIGFLGGAQPKESILETLSRICTVRGVYVGSRQLMEEMCAAIEANDIHPVVDKTIFTLDQAKEAYEYMVS

SEQ ID NO: 4168 - protein, 683 aa, Neurospora crassa
  unsure (1)..(683): unsure at all Xaa locations
HIEQTSSNLEANINLEAKLKNPLDGLSRVELLSRVETFCAEKNLTEHLPLFRKGALIAQSPDSYASISGPEALDDEEKAVLLKEVEHKWRLPARLFLTIATCSIGAAVQGWDQTGTNGANIFFPNYYGIGGDTAREKLLVGLINAGPYIGSAXVFSSVFLDVHVQQTRXFPAVVALILTKVTSNRFIGCWLSDPINNWIGRRGVIFVSAHFCIWPVIGSAFCHTWPQQLACRLLMGIGMGVKASTVPIYAAENSPASIRGALVMSWREYTQVFLTTAPSAQLMKDANTRPFQEMWTAFGIFLGTAFNLAVFHASSNVNWRLMLGAPFIPAVPLLLLIYLCPESPRWYMKKGRYPEAWKSMVKLRNHPIQVARDMFYIHSQLEVEHQLLAGSNYAKRFVELFTVPRVRRATLAAFTVMIAQQMCGINIIAFYSTTIFKDSGSTEFQALLSSFGFGLVNWLFAFPAFWTIDTFGRRSLLLFTFPQMMWTLLAAGLFTLLDMGPARTGLVALFVFLFAAFYSPGEGPVPFTYSAEVFPLSHREVGMGFAVATCLFWASVLGITFPFLLDSLGTVGAFGLYAGFNLVAFIAIFLVVPETKQKTLEELDYVFAVKTSKFMSYQCTKALPWFIKRWCFGRGMQSWSHCMSLIGSRRRRRRGEQRRREGQRRRERSPLLLQELSWMRRRD

SEQ ID NO: 4169 - protein, 221 aa, Neurospora crassa
GADSRTTTGAYIANRVTDKLTQVHDTIWCCRSGSAADTQAVADIVQYQLGLYHMVNGRPPTTQIAAAVFQEIAYANKDRLTYVFGGPLPFISLCCVFLSFSCALFLFSYHAQVGFRADYWISTVAGLIIAGWDARHGGQVYNIPLGGSLHKQPYSIGGSGSTYIYGYCDANWKEGMEEAEAVAFVKEALKEAIKWDGSSGGVIRMVVLTEKGADRHLYLPD

SEQ ID NO: 4170 - protein, 458 aa, Neurospora crassa
EQQEDQHGDEDDDQDSVSSDSSDDGIVDPNIQDDMEKLQNTFPNFRQQYRLIKRIGEGSNHQDQDPSSPATMLTTSLFQGTFSTVYKAEDLVYDQYDNSWDYEQESDKWAPPPLRTYGRSSGSSMTSRPRRKPKYVAIKKIYVTSSPTRILNELDLLHDLRGCTSVCPLITAFRETDQVIAILPYFRHADFREYFRKMTPTDIAIYLRSLFTALESVHRHKILHRDIKPTNFLYDPATRRGVLVDFGLAEREGSECKPCLCHEDSTTRRNRLRTAHLNSSVPHNGYPKQDTRPSRRANRAGTRGFRAPEVLFKCTEQTTKIDIWSAGVILLTILSKRFPFFNSADDVEAMIEIATIFGIKRMRQAGQLHGCMFETTIPTIGTQGFSFERIILWSTCRDTGVKMPEDEKLAVEFLAKCMDLDPARRISAEDALNHPFLQMGLEKEHGGSQSGEEEEEGE

SEQ ID NO: 4171 - protein, 934 aa, Neurospora crassa
  unsure (1)..(934): unsure at all Xaa locations
NHHYPSLPEPLPVKIKTKVRSSSSSVPKGHAQIALFESPTGTGKSLSLICGSLTWLRNHKRLQFDSEIEKIQQQMEASGEPEWMVESAIKRKREELAQKYEEMERTLERIRQKEREMEKEGEEGQARGGKRRKLDRGKGDEEKGGKKKESGGSRGLTASDEDKEFLIGDWRDEGGLDENDPMGQLSKETRELLEKVGMGTAGGKKEANEGPVAEEEIKVSXTGWRGLQKEXNLHNGQIFYTSRTHSQLTQFIQELRRPEFPASVPTPNPQEKPAKEIVKQIPLSSRQKLCINPTVNKLGTLAAINERCQSLQQPKTPKDQRCPYLPNAANLKATHEFRDTALATLPDIEDLYQTGKQLQICPYYASRAAIPGAEVITLPYPLLLQKSAREALGIRLEGNIVIIDEAHNIMDAVSNVHAAEIKYTDLKRAKLSLGMYYQRFHQKLTGENKVMVAQLQRVVEALGVYLKTKLDKAALGLKADQEGIVLDTSLLLKTGGADQINLYKLIRYVQESKLAFKIEGYISYCEEEGRDTDDEEAETEIKARQGRPPVLHTLCSFLTALTNLSSEGRIFYEKIPPPRGELQDMKLSYMLLSPTHAFSSIAESARAVILAGGTMSPFEDYKAHLFPDVPPEKITTLSCGHVIPPDNLCVWTLGSIAPNPKVDTGIGEDCFDFTFAKRSNPNMINRLGLVLLNLCSVVPDGVVAFFPSYGYLEEVIGVWKTHEQAMGPKTIWERLESKKALFIDSKTESSEQTLQKYSDVIHSEVRPLSPAGSRVKGAMLLSVIGGKMSEGINFSDRLGRCVVVVGMPYPNPHSPEWLARREYLEANFIKRYTASQQTSTATAPLPAPVIPPPSNTTHYSTNPSSSRNKDKHKPANVRKLAARDSHQFYENATLRAVNQSIGRAIRHQNDYAAIVLIDNRFEKEHVRAKLPGWI

SEQ ID NO: 4172 - protein, 453 aa, Neurospora crassa
  unsure (1)..(453): unsure at all Xaa locations
AQSRYVANNPLSKKQHELAVESLPGGNTRTLLHTSPFPLCMKHGKGTFVWDEDGHKXVKCSISHPAAGIKPPHSSLIPTYLPLTXYTDFVGELSAGLYGHSHPVIRAAILSTFDEIGLSLGSTTTYEARYASLLCQRFKLERVRMTNTGTEANLHALAAARHYTRKKKVVVFNGGYHGACFSFGGGKAAPNTADKGDFVVVQNYGDDEAAAEARRVIEETAREGDLAAVLVEGMQGAGGCLPGSKEFLLAAQEAAKNTGAIFILDEVMTSRLAPNGLGQELGLSPDLVTLGKYLGGGFSFGAFGGKKEIMDSVYDPRVKGSLAHSGTFNNNTMTMCAGFAGLNQVFTEEVCVELNRVGDVLRGRLNGVAKRTRLRFTGRGSLIGLHFRENGTFESQERADLRDLFWFEMLEEGFWTTRRGFIAMMLDTPKDELDRFVDAVGRFLERHAGIMMV

SEQ ID NO: 4173 - protein, 328 aa, Neurospora crassa
  unsure (1)..(328): unsure at all Xaa locations
LDRSYSDLTPWKALVYYYRRTSWLGGGQKFVIILAANVGGGVMEWKGAREWAIERDSIRNKKKYVAKWGYDLEIVDMSTKKRYAHEWRESWEKVDFIRSTLRKYPKAEWXVPTLSLPGCDPWLIFSQVWWLDLNTFIMEPSKSLQDHIFDHIEDVTYRDINEYNPLNISHPPADPYLDELSKSPIGDGNPNSIHLMLSQDCSGFNLGSFFMRRGTWTDHLLDVWWDPVAYEQKHMEWEHKEQDALEQLYTAQPWIRKSTAFLPQRMINSFPTGACSEKGTDPRIHYDQKDRDFLVNMAGCEWGRDCWGEMYNFRELSYHLNRSLWERF

SEQ ID NO: 4174 - protein, 746 aa, Neurospora crassa
FMDDDDDDDAQQQRRSERARRRAPRHKYKELLQELADRKINEIVIDLDDLQSWEEDVNEGLKLVESVERNTKHYVEVLSRAVDKLMPQTSNDITFKDDVLDVLMANRQQRNRTLTEAAENLRDPDMLNDTYPAQLTRRYTLVFKPRTMTADGPQKALSVRQVRGDHLGHLITIRGIATRVSDVKPIVQVGAYTCDRCGCEIFQPVTDKQYAPLTLCPSKDCKENQAKGQLYPSSRASKFLPFQEIKIQELAEQVPIGQIPRTLTVLAYGSLVRNVHPGDIVDISGIFLPTPYTGFKAMRAGLLTDTYLEAHHIVQHKKAYTEMQIDPSLLRRIAKFQQTGNTYEYLAKSIAPEIYGHLDVKKALLLLLVGGVTKEVGDGMKIRGDINICLMGDPGVAKSQLLKYISKVAPRGVYTSGRGSSGVGLTAAVMRDPVTDEMVLEGGALVLADNGICCIDEFDKMDDNDRTAIHEVMEQQTISISKAGISTTLNARTSILAAANPLYGRYNTRLSAVENINLPAALLSRFDIMFLLLDTPTRDTDAQLAKHVAYVHMHNRHPDIGTGTGPDSSVFSPEEVRAYVAKAREYRPVVPQAVSEYMVKTYVRLRAQQKRAEKKNQNFGHTTPRTLLGVVRLAQALARLRFSNTVTQDDVDEALRLVEASKESLAQDDRNTGNKRAMNASSRIYNLVKGLADSGACRPDDTPEEEEEDEFGVEMSLRKVKERVIAKGFTEQQWLSALDEYTDLDV

SEQ ID NO: 4175 - protein, 1115 aa, Neurospora crassa
QFTQNGWPITTPRQETGLHLELLHPTKHQSAGQPQPKTPPRKPPPAESKSSKSTSSRKRPEPQTDDSEDDVPRDAKRRRSNGPSAATDTEDAVASLKLSSSSRTERYALNSSRPSQDEQEKEEDVAERKKKEELHRKFVKKLGHPDSMFSYRQRDTESAAVEGEGEEGEDDEEEPAPKTTAKKKGAKTGKLTPMELQFLEIKRKHMDTLLIVEVGYKFRFFGEDARIAARELSIVCIPGKFRYDEHPSEAHLDRFASASIPVHRLPVHAKRLVAAGYKVGVVRQIETAALKKAGDNRNAPFVRKLTNVYTKGTYIDETGELDQPGETTGASSGGYLLCLTETPAKGMGTDEKVNVGIIAVQPATGDIIYDEFEDGFMRREIETRLLHISPCEFLIVGDLSKATDKLIQHLSGSSTNVFGDKSRVERVPKSKTMAAESYSNVTDFYAGKAKDSDERSAALLNKVLKLPEAVMICLSAMITHLTEYGLQHIFDLTKYFQSFSTRQHMLINGTTLESLEVYRNATDHSEKGSLLWALDKTHTRFGQRLLRKWIGRPLLDQQRLEERVSAVEELLNNQSTAKVDKLVNMLKSIKADLERSLIRIYYGKCTRPELLSTLQTLQKISFEYARVKSPADTGFSSTLLTSAIMTLPSISPMVTAHLSKINAEAARKDDKYAFFLEQHETEDISEHKLGIAAVEQDLDEHRSEAAKDLGKKVPVNYVTVAGIEYLIEVPNTDLKRVPASWAKISGTKKVSRFHTPTVLRLIAERDQHKESLASACDQAFSDLLSQIAGEYQPLRDAVSSLSTLDCLLSLSTVAALPGYTKPTFLPSSHPSFLSITEGRHPIAEHLLPNGYIPFTMSLGTLSSSASSPDPNPTSPSGKPALAQLITGPNMGGKSSYTRAVALLVLLAQIGSFVPATSMSLTLSDAIFTRMGARDNLFKGESTFMVEVSETAAILRQATPRSLVVLDELGRGTSTHDGRAIAGAVLEYVVRDVGCLMLFVTHYQDLAGVAEGLTVGEGEEKRRGVECVHMRFASNKSRTSMDDDAMEVDGDGDGQEGAGADKDEEEEITFLYDLAPGVAHRSYGLNVARLARIPRKVLEVAARKSSELEKEVRAKR

SEQ ID NO: 4176 - protein, 429 aa, Neurospora crassa
IPSLYSPLLTDNFGRKTPIIIGCVIMIVGAVLQATAKNLDTFMGGRTMLGFGNSLAQIASPMLLTELAHPQHRARLTTIYNCLWNVGALVVSWLAFGTNYINNDWSWRIPALLQAFPSIIQLLGIWWVPESPRFLIAKDKHDEALHILAKYHANGDPNHPTVQFEFREIKETIRLEMESTKNSSYLDFFKSRGNRYRLAILLSLGFFSQWSGNAIISNYSSKLYETAGVTDSTAKLGLSAGQTGLALIVSVTMALLVDKLGRRLAFLASTGGMCGTFVIWTLTAGLYGEHRLKGADKAMIFFIWVFGIFYSLAWSGLLVGYAIEILPYRLRGKGLMVMNMSVQCALTLNTYANPVAFDYFGPDHSWKLYLIYTVSFSSPFFLFFGATNTNSSEKCWIAAEFVFVFFMYVETKGPTLEELAKVIDGDEAD

SEQ ID NO: 4177 - protein, 829 aa, Neurospora crassa
  unsure (1)..(829): unsure at all Xaa locations
PSQVVVGSQSAGKSSVLENIVGRDFLPRGSGIVTRRPLILQLINVPADDDAEDATHPSYRNPNAAGRNEWAEFHHIPNRRFTDFGDVKREIENETARVAGTNKGINRQPINLKIFSPHVLNLTLVDLPGLTKVRRFEALVNMPSXLGLTYIRAGPIGDQPTDIEKQTRNLISEYIAKPNSIVLAVSPANVDIVNSEALKLARHVDPMGRRTIGVLTKVDLMDHGTNALDILSGRVYPLKLGWIGVVNRSQQDIQGNKPMEEALKSESEFFRHHPAYRNISTRCGTQFLARTLNTTLMAHIRERLPDIKARLNTLMGQTQQELASYGDMHFSGKEHRGSLILQLMTRFASSFIASIDGTSTEISTKELCGGARIYYIFNSVFGSSLESIDPTSNLTALDIRTAIRNSTGPRPSLFVPEMAFDLLVKPQIKLLEPPSQRCVELVYEELIKICHTCGSTELSRFPRLQAKLIEVVSDLLRERLGPASNYVESLISIQRAYINTNHPNFLGAAAAMSHVVSNKQERERKRLIQEERERRERRRLKELGTNATETPIEGEEESTTLEKTDNVHVRKTAGKGARSMSPAVRENGPGSIASALNGARSNSPSRFNGGQGVGNAKESFLNYFFGKDGAIVPGPSNSGNIGRHVNQAMEPTFSQSMRRPDDRQVRAPAQSMKVDDDMDYVGNAKGHXACELAIFALSLLQMFFFFFFFFFFFSFCAAYANNFLMQSNDGEPAMTDREAMEAELIRALISSYFNIVRESIADQVPKAIMHLLVNHCKDVVQNRLVSELYKETLFEELLYEDDAVKKEREKCEKLLQTYREAAKIIGEVV

SEQ ID NO: 4178 - protein, 464 aa, Neurospora crassa
  unsure (1)..(464): unsure at all Xaa locations
YADTLPFLRINSSTRVIFQGFTGKQVRSPCHSFMNISYVHPSXRGAGLSGTANAKDSLAWGTKIVGGVIPGRTGEHLGLPVLPSVRQVRNEPDSXLSTSWSSLSSNSRTPKELTLGLXAMEYLKPDATGIYVAAHQAPGAIEEAIEAEVPLIVAVAEHIPVHDMLRVSSLAQEEAQLRSALIYXHLYVXIHSMLKTQSKSRLVGPNSPGIISAVGKCRVGKQVVSTAHIQHIVGGICVPGKGKDNISISSLIGFQPLPCFSPGRVGIVAKSGTLSYESRQYSPLPKVSLKSSPNMGAHLILITAYFAAVASTTRAGLGQSLCIGVGGDMVPGTDMVEALSVLEKDPDTEAIALIGEIGGMGELEAAAWIKEYYSRSKSSQVCHTAYXIFAAMYWVCCEMANMVLDRPIIGLIAGVNEAPGRILGHAGAFTFLGEPTAKAKIAALEEAGVILVNHPAKIGDTLKT

SEQ ID NO: 4179 - protein, 283 aa, Neurospora crassa
LAVGIDRSARSPAILVAPSIEDWMEGAQRTSAPVKSFPFDYRRGPDELAIERLASYLQLSNKGDSAVDSLRRLIETLATLFYEKEGLLLTTHIVERLRGIKVVHARFAFDQATFRNGTPPDKIKAMYVCATDEPAEAKAERSGIVYIKLPGEDATIGTLVNGAGLAMNTVDALADAGGKAANFLDTGGKATSQTVKESFMIILQDPRVRVIFVNIFGGLTRGDVIAHGIIVAFKELSLTVPVVVRIRGTNETEGQKIIADSQLPLYAFDDFEVAAAKAIELSR

SEQ ID NO: 4180 - protein, 279 aa, Neurospora crassa
  unsure (1)..(279): unsure at all Xaa locations
VLYSGSFIGASFSTHAWQLLLSQGVCFGLGMGFCFTATVGIVPQWFTKRRSFANALATGGSGFGGLTYALGANAMIANLGLEWAFRILAITCFTVNGCVSLIIKDRNKAVGAKHIAFHKDLFFQPEYWLFVGWGFFGIIGYIIVVFSIADFALQAGFTSNQASLASAMFNCKRRPFSSRXKYGKQRLGLVHPRXPFPLNSVSQALGRPAIGLLSDRLGKMNVAGIGTLIASVVAFFLWIFAGKYFAGLIIYALFGAVAGIIWPCVGPVGAEVVGIQLLP

SEQ ID NO: 4181 - protein, 380 aa, Neurospora crassa
  unsure (1)..(380): unsure at all Xaa locations
VRGYNPLTPPDLLQHEIPQTAESKQTVINGRKEVVAVVNGTDEKERLLVVIGPCSIHDPNAALEYCDLLLKEKEKHKDELLIVMRSYLEKPRTTVGWKGLINDPDIDNSFQINKGLRLSRQLFVDLTSKGMPLASEMLDTISPQFLADLLSVGAVGARTTESQLHRELASGLSFPVGFKNGTDGTLGVAIDAIGAVRHPHHFLSVTKPGVVAIVGTVGNEDCFVILRGGTKGTNYDAKSIAEAKAALEKSGLRQRLMIDCSHGNSNKNHKNQPKVAAEIAQQLENGETGIMGVMIESNINEGKSFYFVYFFYWGHMTVXIXSCSLTQRTGNQKVPEEGKCGLKYGVSITDACIGWEDTVATLDTLAQAVKKRREVLSKNA

SEQ ID NO: 4182 - protein, 1369 aa, Neurospora crassa
  unsure (1)..(1369): unsure at all Xaa locations
CQCNSDLPMAAFKLALASAFLIRLMGWLPVLSGLTAASLTIPLNLHLSRKQRDQNFGLMRVRDYKAHLLAEALLGMRQIRYSALEDFWEDKILASRDDELKQYWRVALGKCLIFLTVNFAPLLLASVAFTVYVWQQGFHIKASVIFTALGLFDQLDDAVSLLRKVQVNLLEAWASVSRLDKYFGRLDKQVVTKPGSLIAFEDATVAWPRPEDTDKVGDAQAPPRGAHTMLKDINVKFPPGELSVIAGKTGSGKSLLLAAILGEVKLIAGDIYVPSAPEPSEDENISDQDWIIPSLTCFVSQTPWIESGTVRDNVLFGLKFDRLRYRKVLCACALEKDLQLLADGDQTEVGPRGVSLSGGQRWRTALARALYSRAGIIVMDDILSAVDTHVSRLIVGEALAGELAVGRTRILATHHVDLVRPYARCLVRLSSGRLKSVVYKAPESQNIRPATSMLEPGSLTWTRPDGNGAASSSSSTARATESRQTGEEKRAVGWVKWDVYKAYYEASGGTLNWALGMAVLFLGHVLGIIRTWSLKELAQRASSVEASSQTSSTTQYHQTYWQMTFGYVADQHMPWSSKLIFAFVSSGTRIQTILKKCNXLDVIGISTYVLVCFLVGASQLIRDIAFTLIGMRASKKLFEQLTHTILRAPIRWIETVPAGRVLNRFSSDMSVVDKPLATPTFTFLQAALLLMIIVVTWYVVPVAFCCMMXCYTQEWIQLTCPTQFLRLAIRPLLCILLFALYVYIANYFIYVAREVKRLKSVSNSPIYDQFSSVLSGLTTIRAFQCTQSYTNNLYRLIDANSSANWAQQLLKRWMGFRMGMLGAVFVTIVASVVALGGVGAALAGFSLSFAFRYTSALTSLLESVAALELGFSSCERVLEYIEVERESEQGLDAPAAWPADGNIEVENLTASYACDLPPVLSDLSLTVGAGERVGIVGRSGAGKSTLASVLFRLLEPSRGSVRIDGLDISTLKLTQLRKSLVIIPQDPFLFSYAYEIDLLHLLMWILMHSVNRGTLRSNLDIEGRLDDTEIYDALRSVNLIGSTYNNQSYPPSFYTPVMGPSTAVSTHPNTASTTPLLAPIVFPQTVDFAVEPAAEEVDMFDDIHTLGDNRVQITPFVLDTSDIDPLNLLTFDSHPENPTLLTSILEVEQTPTSEPAHILEPSPTEEEPISPPPVTLPAPLLPLPPSPAISATTTATNYTAPDRHRINPFTDLSHPIITGGSNLSQGQRQLVCLARALLTRPKIMILDEATSAIDKATDAAIQRSLRKCVESTGTTVLVIAHRLSTVADFDKILVLDKGQVVEFGAPRELVRRGVERERERHRQDDGGHDGGASDHGERLAERSVGSNDYFGDDECSEEDMEDADTSTFW

SEQ ID NO: 4183 - protein, 288 aa, Neurospora crassa
IPVTHQSFPGMETEMPNPQPLWDEIPTADGKSQKYRAAGKLKGKKAIITGGDSGIGRASAILFAMEGADSVIAYLPEEEEDAQETKRRVEAYGQKCHLVSTDLRDRENCKKLVDEAVKIFNGQIDILFNNAAYQMVVDDIKDLSEDQWINTFNTNIHPYFYLAKYSLPYMKRGSTIINNASINAYIGRPDLLDYTSTKGAIVAFTRGLSNQQAGKGIRVNAVAPGPVWTPLIPSTMKRENQEQFGSTPLGRPAQPSEVATAVVFLASEDSSAFSGQTLHPNMGTVVSG

SEQ ID NO: 4184 - protein, 475 aa, Neurospora crassa
  unsure (1)..(475): unsure at all Xaa locations
MHLPTVLSVIFAAAGVTAQLNDLAVAAGLKYFGTAGQEGTITSDTTYRNIINNVHEFGQLTPENGMKWDATEGQPGKFTFQSGDIVAGVAKSNGQLLRCHTLVWYSQLPSWGKYLYLLSLRSTWGWNGVLTGNIQVSNGSWNRNTLQSVIESHISNVMGHYKGQCYAWDVVNEAISDDAQGNYRDSIFFKTFKTDYFPIAFNAAKKADPNAKLXVCSSHQPHQHDGTQTNTSQLYNDYNLEYNGAKTERALELVKLIKAAGAPIDGVGFQAHMTVGGTPSRSAMATLLKRFTALGVEVAYTELDIAHKNQPSSSSVQAQQATDYANMVGSCVDVDGCVGVTIWGFIDKYNWIQNGNAAIFDSSFNKKPAYSAISSVLAAAATKAPTPAKNANSPPAVHTTLRTAIATAPACRRPPLPPRPRRRLLPSRLSRPPVPLLARSSRRWAQCGGNGYTGPTACQAPYTCKVQNPWYSQCL

SEQ ID NO: 4185 - protein, 810 aa, Neurospora crassa
  unsure (1)..(810): unsure at all Xaa locations
PIETKTAAIAKDGSVDAESAGERFNMFLAANFHTTNYLXQRVIQISQQTLPSITPLQLVTKTLDTSDDPTENIYTFRAFVLGLGLSAFGAVLGEIFYFKPQTVNVSIVFLIMIAYCLGEATVLIPRWGPVGRFLNPGPFTQKEHVFIVIMASSAATCALGTEQLAAQSLYYGNQPNAASAIFMLFSSQCIGYGLLGGIRKAFIYPTKFVWPSQLPNAALFQSMHLNKELAKKRLKIFWCICLAVMVWEIVPQWMFPLTTGISIFCLANQDSAFFTRLFGGANGNEGMGFLSWCMDWQYIGEKEFTLPLSTLVNQLIGYIGCIALTLGAYYSNLWDAKRFPFMAQSLFTSNGTVYDQTQILGPDNQVDPAALQAYGLPRFATSKALSLLMKNMGITAAVVHVILWNWHDIKFIFGPFRPSTWKQNVQKARTWWHHGFSSSFWKNFTSDADTPRKEYPGTEGDPHYAAMRAYKEVPSLWYLSILAISIMIGLICCYQQKTGLPWWAFLLAVLLAWILTIFFACMYGIVGFYYQPTSAVQMIGAYMVPRRPVANMMFTLYGSNALVQAIQMLGDLKLAQYAKLPPRATFLAQILGTCAGSVFNWVMMNSIVDNRRDILLSVQGTNVWSGQNVQTYNSQAVAWGGTANEILXVELTVPLASMSEMCADTRYHSGRHGTYWMVPMGLFFGIFAPLPFWIGQSGVSSSNGRXSPWYLCXQMLYSGHKYFPQLRLNHINTFLICTWLGWLSVGINSSLLAYFVFGFFSQGYLRRYKPALFAKWNNICAAAIAGGCSLIIFILTFAVAGGSGKARDFP

SEQ ID NO: 4186 - protein, 263 aa, Neurospora crassa
LEGKVALVTGAGRGIGRGVALELARRGASVIVNYVSSAGPANEVVKEIESLHNGARAIAIQADVRRVSEIDRLFAEAKRAFGRIDIVMSNSGTESWDKTEDVTEEKYDYVFDLNAKAQFFVGQAAYKHLERNGRVILMTSIAAGLMGVRNHALYNASKMAVQGFVKAFATDFGDKGITVNGVAPGGIKSDMFAENAWHYIPGGTPDLGKDKIEKMMAEHCPLGRCAVPEDVARVVAFLASEDGGWVNGEFSGFRCEGYLDDDD

SEQ ID NO: 4187 - protein, 221 aa, Neurospora crassa
  unsure (1)..(221): unsure at all Xaa locations
AWLYLFAVLINAVNLFLQVFFTIMYSDLEWYVGHLIPLSKASARTRDLASCALCGWRLFSQQTVANGISSDYINPIDLCNRLNTYIIPEVAVHGFLTFLFLINGYWLPLVLNLPLLAWNVKKXVLTTAWMAISAACANRITNHAVQDVDNAHLLDATEIFRKLNVHKKVVISSTQPTASAVVELQELLLTDLRALXESFTKLGFHLILFFFYLYSMIVALI

SEQ ID NO: 4188 - protein, 539 aa, Neurospora crassa
  unsure (1)..(539): unsure at all Xaa locations
TESSAEVGLTEALAQADPKSALSGLTPKQIQEFIDLNPALANELLAASGSSGTTDVMEAFKKLKIQDIITGLASSGKNRKDMASYKFWATQPVPQFDEKPAIFEEGPLKIQKVEDIPDEPIPLNLAPFRWVTMDLTDEKQMQEVEKLLYGHFVEDDEAMFRFKYSTSILKWXVTLGEGYFSRVHVACANDFGLGSLMSPGWRKEWHVGIRSGDTLCAFIAAVPTEIRVRDKVIQGSEVNFLCIHKKLRGKRLAPVLIKEITRRINREGIWQAIYTGGIVLPRPVSTCRYYHRALNWQKLYEVGFSPCPSNSKPAFQVRKYALPEQTSTKGLRELQVKDLDAVHSLLERYLKRFDLTPVFNREETEHWLLHKKDSYAEQVIYSYVVEVSFQLRSLFLTVELVRXSDXDASGKITDFFSFYLLESTVIRHPKHNSIRAAYMFYYATETAFTEPFDKGALTKRLNDLMADALILAKRHNFDVFNALSLMDNALFLEKQKFGPGDGQLHYYLFNYKANPIHGGVDKKNRLDEDNLSGVGFVMV

SEQ ID NO: 4189 - protein, 313 aa, Neurospora crassa
MAQETTRDGSDSPSGSVSPPIANGTNNKKDKKSSKKRAHSSGERRSSVSKPARDPSDKPEESPSKKKKRKTTSSTAAAAVPSTITEEVSPSTSVTRSPSPVIDFDGLSRPSRGTRERLEETEAQKQERLDKMKGAVRTLLECIGEDPDREGLLATPERYAKAMLFLTKGYQENVRDIVNGAIFQEGHNEMVIVKDIEVFSMCEHHLVPFTGKMHIGYIPSNAVIGISKLPRIAELFARRLQIQERLTKEVANAIMEILKPQGVAVVMESSHLCMVMRGVQKTTSSTITSCVLGCFESREKTRLEFLSLIGVNR

SEQ ID NO: 4190 - protein, 348 aa, Neurospora crassa
MASTTTDPTPATQYGGNNNPIARGALIVIEGLDRSGKTTQVKLLEDRFLKAGKKVKTMRFPDRTTPIGQMIDSYLKSQAQMDDHVIHLLFSANRWEAVYVFFFFLFFFLFSPLLDWGGTYTNRQTDRQTNKFFSINQKKITSELSQGTTLILDRYYHSGIVYSAAKQNPSLSLSWARAPEIGLPRPDLVLFLDLDEEQARLRGGWGHELYEKAEMQRRVRELFWGLSLGRVGTVTVPVGGVSALGGAGTGGEKKRGGEEVNKREAVMLAEGPTEMEEVAVGAPTPLAGAAGGPHIDREYAFRQEEEDLHVIDASASVEEVAEELWKVVSARVDAVERGEVGKVVRRVL

SEQ ID NO: 4191 - protein, 482 aa, Neurospora crassa
LWNPENVKDVAESIGINLTEEPLRVLTQDVEYRIGQVVVEALRFMRAANRTTLTVQDVSQALRVLDVEPLYGYDSTRPLRYGEASIGPGQPLFYIEDEEVDFEKVINAPLPKVPRDMSFTGKLVSVLSLTQCSPHLNLVASANTFLPLARAHWLAIDGVQPSIPQNPTTAETSSKDLLPKGPGANPAVAALAGNDNVAFRPAVKHVISKELILYFDKVQAAIMDDDPDEEKTRLRSAALDSVRSDPGLHQLVPYFVSFINNQVTHRLDDLFVLRQMMELTGAILDNPSIFLDPYASSLAAPVLTCLMARKLGGSESSLEGTDALKDQYRLREVAASLLGTIARKYSKTNALLRPKLTRTCLKFFLDPSKSPAVLYGAISGLAAAGGPEAVRILVLPNLKMFDEGILTPLREKGEASHFEYEALVGGIMKAIETLVEGITLPVVADVAELEREGQLVIEFLGRTIGERVARLGNQHLNRGILE

SEQ ID NO: 4192 - protein, 529 aa, Neurospora crassa
  unsure (1)..(529): unsure at all Xaa locations
RKIGVTGAVFLILNKMIGTGIFSTPSSIFASTGSVGVCLLMWAVAGLLTLSGLSVFLEFGLAIPKSGGEKNYLERVYRQPVYLITSVFAVQIVLLGFSAGNSLAFGRYVLLALGYNLPDGWPARTIAVLCITFVVFLHSVLPKWGLRLTNALGVFKVLVLLLIVFSGFAALAGHRRVPDPHNFDDMWSIEKGDGFGGGGAYAYATALLQVVYSYKGWENANYVMGELKHPKRTLSIAAPLAVVGVTILYVLANVAYFAAIPKAELAKSEVIVAGLFFRNMFGESAAARSLPALVALSNIGNVLAVSFTHSRVNQELAKEGVLPGSKFWASTKPFNTPLLQXVAQVIWFFFSSCHFLTRXXLLLHWIVTVIVLVGPPPGPAYNFLVNLYCSLLPCCHVCCCHVQVXPCGTRYTYPGAWINGLVAGGLIYLRLSKTEEWSSPWRTWLPVIFIYLCLNMFLAITPFIPPNDDWNADGYPYYAFPLVGTGVLGLGAVYWVVWTKVLPRFGGYELVAERVLDETGAEVVRYRKL

SEQ ID NO: 4193 - protein, 328 aa, Neurospora crassa
GTYGVVYKARDLANSGRIVALKKIRLEAEDEGVPSTAIREISLLKEMRDPNIVRLLNIVHADGGQGHKLYLVFEFLDLDLKKYMEALPVSDGGRGKALPEGTGAGLHNLGLGEDIIKKFMSQLCEGVRYCHSHRVLHRDLKPQNLLIDRDGNLKLADFGLARAFGVPLRTYTHEVVTLWYRAPEILLGGRQYSTGVDMWSVGCIFAEMCTRKPLFPGDSEIDEIFKIFRYVYAVTFSWHLSASPLVRYTDLFSSKQLLGTPTEDIWPGVTSYPDFKASFPKWVRDYNVPLCQNLDDVGLELLESMLVYDPAGRISAKAACNHPYFEDY

SEQ ID NO: 4194 - protein, 194 aa, Neurospora crassa
  unsure (1)..(194): unsure at all Xaa locations
MANFRQFRPDDLNKFSKCNLDPFTETYELGFYLQYHAKWPSLFQVAEDQHGNIIGYSEHSLFITLCLTVYXHTQTVMGKLESSPDYYKFSEHYLPWHAHITAVTVAPEARRLGIGKMLTEQLEAAADANDAWFVDLFVRSTNHKAIQFYKSMGYSIFRTVKDYYGDHSSDPTKSSEDAYDMRKPMKRDVKKEHI

SEQ ID NO: 4195 - protein, 507 aa, Neurospora crassa
MVMPTVVSDRMGTIDFIDYTNNHVFSKCQTDSLNTVNNGSLKHDDYLHGLANGKLVAKQMIGDALRQRVESIDSEFCEPGDEDTFFVADLGEVYRQHLRWKLNLPRVKPFYGELSQLLCASYRGFSLLTWMFVIAVKCHPDERLLQLLAALGTGFDCASKAEIEQVLRMGVDPSRIIYAQPCKTNSYLRYVAQQGVRQMTFDNADELRKIARLYPDAELFLRILTDDSSSLCRFSMKFGASLDSTDGLLGLARQLGLNVVGVSFHVGSGASDPTAFLKAVQDAHVVFQQAAAYGYSLKTLDVGGGFCSDDSFEQMANVLRAALDEYFPAHTGVNLIAEPGRYYASSAFTLACNIIARRTIQDGSAVSVSDSSSMSDDGSVNNGDARYMVYVNDGLYGNFSSIMFDHQHPVAKILRAGGRTMYNSVAAHESSAEDAIEYSIWGPTCDGIDRITESIRFREILDVGDWLYFEDMGAYTKCSATTFNGFSNEHDVIYVCSEPGAMALLGL

SEQ ID NO: 4196 - protein, 569 aa, Neurospora crassa
  unsure (1)..(569): unsure at all Xaa locations
IRNVVVLSGNSHPKFVDSVCNYLGIPPASRVLEKFSSGETRCEIRDSIRGKDVYIIQSFGVGTNRNAANSNNNNNNNDGSSTSATAETGHVTVNDYFIELCIMISACKTGSARRVTAVLPFFPYSRQPDLPYASTGAPLVSRNHDAVTMTVTEGQGSVSYTFESVPPTPAAHIPRTAGLANGMSRLANGLSGSSITRGSDIRDMAKVMVTGPASDAGSKSLGEKQPQQQKANDKFTTHDFENPAMAMAFQQKVGFKPMMAQAGSLIADLLTCAGADRIVTCDLHESTYQGFFDIPGEFDVPARLRCPFRSTHPSDWESSQVDHLIARPLLKRYIQHHIENYKEAVIVSPDAGGAKRAAAIADSLGLQFALIHKGXSYVGRRPELTSLIVSVTTVLNYIRPVPSRRMKRNXHLSSSPSXNDADRPKPTQTTHPXCLLGNVANRICILVDDLADTVNTITRAAKLLKREGAVQVVALITHGVFSGDAIQRINASALDRVVVTNTVAQHRHLEAFGAARAGGTKEMPDKNKNDVDPRVVCGKLEVLDIAPFFAEAIRRIVFGESISMLVRDG

SEQ ID NO: 4197 - protein, 381 aa, Neurospora crassa
GLQAAAAPTTLTPSTPHKNLFSYLSPRHASLGGHPTPSRTPQSRHGINLDTRAEIYSLSPIKHKSQQLLLSPRKQPRAISKVPFKVLDAPELLDDYYLNLVDWGSANVLGVGLGSSVYMWNAQTSRVNKLCTLEDDTVASVSWIQKGTHLAIGTHKGLVQIWDAEKARRLRTMTGHTGRVGALAWNTHILTSGSRDRLIYHRDVRAPDQWLKKLVGHKQEVCGLKWNCDDGQLASGGNDNKLMVWDKLSDTPLWKYSGHTAAVKAIAWSPHQRGLLASGGGTADRRIIFHDTVRGTVLNEVDTGSQVCNIAWSKNSNEIVSTHGYSQNQIVVWKYPSMTQVASLTGHTYRVLYLAMSPDGKTVVTGAGDETLRFWNLFGKS

SEQ ID NO: 4198 - protein, 1006 aa, Neurospora crassa
  unsure (1)..(1006): unsure at all Xaa locations
RXKGMERKAAEKIPRQQNAMGEALSKSSFAGSLVRRASNTVNKARDILTRRASMNIVNRDADPMVASLRRGSNTFPLGEHNYRGHLLESDDECAIDDAGPLDGLRDAQIPLSIGPEIPVALRQGVMLKKISKKKKEKRITLTLDPDTSKIWWDKSRTGRKSVFIDDIKEVRTAEDIRQYRLDAGVEESEEPRFFSILYTVPEKSGTKVLHLIALNSTDFRNWTTTLDAILQYRQDFTTNLMAFNEKAVHEFWQRQMRKKYADRVIPAEGETIELPDIERICRSLHMHLSPTEIRDNFNAAKAAKATSNGVCDPTSPSSLNFNEFKEFVRLLKARSEISHVFKNHTTNPKAGMTRQEFIQFLKEIQCEDVEEDSTHWNNIFSQFARRRRSKDAEQTISGDESLTISEAGFTGFLNSHFNSLLIQEPSEYVLDRPMNEYYISSSHNTYLLGRQVRGISSVEGYISALERGCRCVEVDCWDGPNDEPYVSHGHTWTTRIKFEEVIKTINKYAFVKSRFPLWISLEVRCNAATQANMAKIMIDIFGDKLVRAPLDPSSDRLPSPSDLIERILIKVKKSQPVPNTPSEESLKTERPGRRRGNSLPSPYQRPSPLPSPMDNTSVAVPGSPSLSPSPMLRATRQINTITEGEVHSHGGPSNSPSEYESDAEKDSGKKVVSKINPILGELGVYCMGVHFDGFDSPDAKKFNHIFSFKEKTFAERSQPGEAKRALYRHNMRYLMRVYPNGGRISSSNFDPLLYWKRGVQMAALNWQTFDLGMQLNQAMFDSGTDLSGYVLKPLEGRQIQVVPTDAAGQLSGKRPRKRISFKIEVISAQQLMRPLNLPKGRTLDPYVEVEIFLADDKRNKQDGATNAPAQETQLKYRTDIVKDNGFNPVFKGNNSYEFIVTTKYPDLIFVRWSVKLGDNKGYNDRSPPLATFTAKLGGLKQGYRTIPLLDHNGYNYLFSTLFCKITKSQPTDIMVTYSSEVPRNSVSRIKNIFNQSGISPKSSMDS

SEQ ID NO: 4199 - protein, 375 aa, Neurospora crassa
  unsure (1)..(375): unsure at all Xaa locations
MAANYWESTQRKHWLFTKDELAAMRAKLEAEEPNLVASFPLPQLRHLNIYFNQRSSYLSTSPTPSTRPSVRXRESPTYFCFTLEINRLGKRMGLRQQALATAQVYIKRFYTKVEIRRTNPHHVLVTALYLACKMEECPQHIRLMANEARGFWPTDFQSQTEVARIGECEFYLISEMSSHLIVHSPYRTLTSLQGELGLAQEDVNLAWSVINDHYMTDLPLLHPPHVIALTAILLALVLRQDPSGRLPGTAASASGLVAASAALAQAQAQAQARAAMMAGGGQTVPGLTPQSSSGLQAMLPPQSPAGEGPAEGNKNPRMAKVHRFAAWLSDSNIDIEAMVDCTQELISFYECHEQYNDKNTREQINRFVKARGLDK

SEQ ID NO: 4200 - protein, 311 aa, Neurospora crassa
FQTALLAGALAGTTVDLSLFPLDTLKTRLQSAQGFFASGGFRGIYRGVGSCVIGSAPGAAFFFVTYETTKGFLSTTGNSTTTTTTTTTTTHTGDTNKGQGKKGLSSPGVQHGIAASLGEIAACAVRVPTEVIKQRAQAGQHGGSSLSSLLHILHQRSTIGLTGVWRELYRGWGITVMREVPFTVLQFPLWESLKKWGRERRQRIGWGLFGDSATGKDDKDVSAPESALYGSLAGGFAAALTTPLDVLKTRIMLSERREGVVSLIQTIWRDGKTKTGSGIRPFFSGIGPRVMWISIGGAIFLGSYQSVVNAF

SEQ ID NO: 4201 - protein, 296 aa, Neurospora crassa
  unsure (1)..(296): unsure at all Xaa locations
ATVAKTRTQLNRRLAEGQKLPWPPFGAQWYAGCTTLIIGNSLKAGIRTVPRHIKRPKKKTVAKQDVGQDFVAFDQYKKLLSDSNGKLSGPGTVLAGFGAGVTESLLAVTPTESIKTTLXVESPSSLHFRSAHRXQEKTQQHDDRKSAKPRLRGFLDAVPVIYRERGIRGFFQGFVPTTARQAANSATRFSTYTALKQLAESYTAPGEKLGAVGTFAMGGIAGLITVYVTQPLDTIKTRMQSIEAKQLYGNSFRCASIIFKQEGVLTFWSGALPRLARLILSGGIVFTMYEKSMDLF

SEQ ID NO: 4202 - protein, 245 aa, Neurospora crassa
DRAHYAPTSPYSDSPQPIGHAATISAPHMHATAIEHLLPSLLPSPSRPAPRVLDIGSGSGYLTHVLAELVGSEGGTVVGLEHIPALRDLGARNMAKSAEGRDFLETGRVRFRVGDGRKGWRETTSDSAATDGASAATTGTTARRRRESSVDERSPMGEVEGQGERMGEDKDEGKWDAIHVGASAKEIHKELIDQLRSPGRMFVPVDDDEMGLGQHVWLVQKGEDGEVSKRRLFGVRYVPLGDPPR

SEQ ID NO: 4203 - protein, 1421 aa, Neurospora crassa
  unsure (1)..(1421): unsure at all Xaa locations
FQRIFRYTDHIGWWTHAAALTCMIASGVLLPLMDLVFGKFVTVFNNFIAGKATPAEFRSSLNNYTYVSIRCGLTPETGCXENLWTSRLYFVYLFIAKLVLVYIWTVRIPPMWDFILISHLHTSQTLASTNAIRITRSLRIDFLKQTIRQEVAFFDLPEAGSISSHLTTNANLVNQGISEKLGLAIQAIATFFAAFVVAFAVQWKLTLITICIVPVIVIVTGICMGIDAKQENEIMIIHSGAAKLAEEVFASVKTAHAFWAFPKLSGKYAAILDEAKAVGARKSPNYAVLFSVEFFCVYAGYGLAFWQGIRMYKEGEVSEPGQIVTVIFAVLLAAQALTQIAPQSVVISKAAAAAHQMFQVIDRKSKIDSLSEEGIKPAECRGDIELQDVVFAYPSRPNIKVLQNFSLTIPANKTTAIVGYSGSGKSSILGLLERWGCPESGTITLDGRKIEEYNLQWLRTKVRLVQQVSMQACSFTSPFPADTINRNPVMLEGTVFQNVVNGLAGTSMADLSDEEKQRLVEDACRAAYAHEFIEKLPEVCDITLPRRSYLTLSGLSTQIGQRGSMLSGGQKQRLAIARSVIANPQILLLDEATSALDPNAEQIVQKALNNVAVGRTMIVIAHRLSTIRNADNIVVMSNGRLIEQGTHDQLVALGGTYSHLVRIQRLGQEPDDDDEPQKDTRAEIGGAAIANTTSNVVETVPDASAMEEGAAKKDDINLLRCLFILMQEQRVLWPAFCWVGICCLAGGKIMASTFSSEFTNTDSQNPGATYPALAIIFSRIMDAFALEGDKMVERGNFFSLMFFIVALGNLVAYAVLGWFCNVIAQVCPHCPTVVVLMRTDVYLQQMVRFYRYTIFDCVVRQDMTFFDMPGNSPGALVSHLSKEPESLHELLSMNMGVIAIVVVNLLSSCILAVVIGWKLGLTLVFGALPPLVFSGYLRIRLEIKLDDDTADRFADSTGIASEAIMAIRTISSLAMERQILDRYENNLRSIAATSVKSLTWTMVWYALSQSISFLSMALGFWXIFSFLLGMTGSSQLTSWLGTAADLVSFGEYTVTQFYTVFIAVIFSGEAAATFFTYTTSESHQLMSTFCTRLILEXALPRRSTPQTSSSGSGTRFVPKTRTITHQMPKNVATAPFPXTAQALEFSYPLRPSARVLKGVSINVCTAPNLIIWPNFVCVLTLVATHQIPPGQFVALVGASGSGKSSLISVFERFYDPSSGTVFFDGEDYQKIHLGRYRANIALVQQEPVLYQGSIRENIAMGVLDATVSDEQILEACRQANIDSFIASLPEGLATPCGSQGLQFSGGQRQRIAIARALVRKPRLLLLDEATSALDTESERVVQAALDAAAKGEGGADGDGIEGNAKGRKRTTVAVAHRLSTIKGADKIFVFSYGRIAEAGTHEELLGMRGMYYEMCLGQSLD

SEQ ID NO: 4204 - protein, 296 aa, Neurospora crassa
  unsure (1)..(296): unsure at all Xaa locations
LPFAVQAASGSGQSTRYWDCCKPSCSWSGKAPVNRPVLACDANNNPLSDASVKSGCDGGSAYTCANNSPWAVNDQLSYGFAATKLSGGTESSWCCACYAXVSLQLLGITRWLTFTAALTFTSGPVAGKTLVVQSTSTGGDLGSNHFDINMPGGGVGLFDGCKRQFGGLPGAQYGGISSRSQCDSFPAALKPGCQWRFDWFQNADNPNFTFKQVQCPSELTSRTGCKRNDDSQFPVFTPPSGGGSNPSTPTTPPSSGGGSGCTADKYAQCGGSGWSGCTNCPSGSTCKTINDYYHQC

SEQ ID NO: 4205 - protein, 903 aa, Neurospora crassa
SEKVLIAQERSAANIVQVFKKPPGGSVSYQAEIRSALEKGSRLISSLQMRLHTKADQNKGRLANTVSVTLPYVKEEVSLAIVFRALGVVSDEDILNHICYDRRDSQMLEALRPCIEEAFCIQDREVALDYIGKRGNGSTGINRNGRIKAAKEMLQKELLPHISQAEGCETRKAFFLGYMVHKLLQCVLGRRDTDDRDHFGKKRLDLAGPLLAKLFRGIVRRLTQDLMGYMKRCVDTNKHFSLALGIKASTLTNGLKYSLATGNWGDQKKAMSSTAGVSQVLNRYTFSSTLSHLRRTNTPIGRDGKLAKPRQLHNTHWGLVCPAETPEGQACGLVKNLSLMCFVSVGTLADPIIEFMIARNMEVLEEYEPLRYPNATKVFVNGTWVGVHQDPKHLVTLVQNLRRKNIISFEVSLVRDIRDREFKIFSDAGRVMRPLFVVEQEDNSESGVEKGQLILTKEHIRRLEQDKELGKYHEDYFGWQGLLESGAIEYLDAEEEETAMICMTPEDLDTYRQHKFKGREFEDDAANRGNSRIKTKFNPTTHMYTHCEIHPSMLLGICASIIPFPDHNQSPRNTYQSAMGKQAMGFFLTNYSRRMDTMANILYYPQKPLATTRSMEYLKFRELPAGQNAIVAIACYSGYNQEDSVIMNQSSIDRGIFRSLFFRSYTDCEKRVGINIVEQFEKPDRSNTLRPKHGTYDKLENDGIIAPGIRVTGDDIIIGKTSPINPDNQELGQRTAQHVKRDASTPLRSTESGIVDSVAFTTNQDGLRYVKVRVRTTKIPQIGDKFASRHGQKGTIGVTYRQEDMPFTAEGITPDIIINPHAIPSRMTIAHLIECLLSKVGALKGMEGDATPFTDVTVDSVSNLLREHGYQSRGFEIMYHGHTGKKLRAQVFFGPTYYQRLRH

SEQ ID NO: 4206 - protein, 328 aa, Neurospora crassa
  unsure (1)..(328): unsure at all Xaa locations
LAVNNLFNVNGIVAVITGGGTGEPLXRSPSCIGXPFNFLGIGLMMARALAANGAKRVYILGRRADVLSAAVRANPEGGIIVAIICDVTDKDALQKCVDKITNDVGYINLFVANSGVLGPANKWDTSLPLSEVRKNLFTNYQMEEMTSALHTNVTGAFFSMVAFLELLEAGNKNAVEKGGFGKPVVPGSNVPSVQSQIIVTASIAGFSRKTVSTPAYGSSKAAMIYLTKQASSALAPYGIRANALAPGCKCSPFRPSWDADANRITVFPSELAAGLIGNRDPGTESFESPHFIPVRKFGGEEEMAGTILYLASRAGSFCNGLILVNDGG

SEQ ID NO: 4207 - protein, 731 aa, Neurospora crassa
NSPYAEVRAVVDNHDDPTMPCSTIRAWVIGLIFSGALGAINQLFSIRMPAITVGLNVAQLLAYPVGKICEKALPDVGFTLFGSRHSLNPGPFSRKEHMLITIMANVAGSTPYTNNIIWSQYLPEYFNQSYAGQFSYQILVALSTNLIGYGMAGLTRRFLVYPSYCVWPASLVTIALNNAFHTESNVPVLGPLKKVFSMSRYTFFLWATLAMFVYFWLPNYLFLALSAFSWLSWISPNNMVLSNITGFNNGLGLNPWPTFDWNVLLFDGTDPLMVPFFSTLNKFLGMFCSFFVVIGIWWTNTYNTGYLPINSNKVYDNTGNRYDISRAINEKGLFDAAKYEAYSPAYLAAGNLVIYLFFFAIYPATLTYILLNHRYEVSMGFKNLWNSLRRNKNTEAGQYKDVHNRLMAVYPEVPEWWYLIILLGAIGCGIGGIAGWETYTTPAVVFYGLILCFIFVIPVGIVKAMTGMEVTLNVLAEFIGGSWVQGNALAMNYFKSFGYVTCAHAVWFANDLKLAHYVKIPPKHTFAAQVVATLVSTFICTGILNFQMNDIPRVCTNEAPNKMTCPGINTFFTASVLWGTIGPKKIFGHNGQYTALMLGWPLGLLLPVITWYIQKKFPQKKWLRQIHPIVLLYGAMYWAPYNLSYVIPSVWIGWLSWIWCRSRFLGFWSKYNFVLSAAFTTGISVAAVIIFFSLDWSGVEVSWWGNDVVSEGCEGKPCLLKTLKEGEIFGP

SEQ ID NO: 4208 - protein, 838 aa, Neurospora crassa
  unsure (1)..(838): unsure at all Xaa locations
FWRFGGYAVASTIENILDRGDFALEELLDESDLIQELKQHNAKLVEYLRDQDVLKRLLEYVVAPKLEPVAAAENEDDAEDENQKGISLPFTRPRASSRATDASNDDSAVEKKRNRYAFVAAEILSSDNWSIFEALMESKDLLREFWQFLKRPAPLDPLQASYFTKVNESLFDRKTEEMIDLLKSLDNAVPDMLKHVDCPMVMDLLLRIISLERTEAGHGIVEVGGSVSALGFPPVLTVDSSSGSIPRMXCPLCFLSSAQNMAWATQTSAADFIKAIITVSANASQNEQTCIGPNELTRQLVSRPCVEQLINYMLGGGNPLTCGVGIVIEVIRKNNSDYDPEATEPNSTPSARDPIYLGTLLRMFADHIPDFMRLIMNAPAQKERFTSTFGDHIEPLGFDRFKTCELMAELLHCSNMGLLNEVGAEEVIAQRDAQRQLLRAQGQLVPVREQEPPSAAEDITMRAAHSSPADTGRKLGVTNTSVDDDGFEEVTHTTDEDITHGIEELPEGSLPGPTSSFLDKDEDDFVDEPLSSPRLRVRDHHNPMEDTAPIKFDDPNLVVAPLSPTKKASVPIRTASAPEGQNDDGNKTEETTANKEGSDSDLKPSEDAQLELRGVSDKPVAPEEMSPHPDDTPAPLFSTSPRTTDLSEPSQDTISKEEQAETSQMSTGGEQSDPDATIAHDASEADKKHEPVVGDYLKMQFVEYKVVPTILSFFFSYPWNNFLHNVVYDIVQQVFNGPMKDSYNHKLAISLFETADITNQIIGGQLTSEKSENERKTRMGYMGHLTLIAEEVVKFTERHETDVLTESILEKVMARDWIEYVEGPLSATRTRDNAVLGG

SEQ ID NO: 4209 - protein, 510 aa, Neurospora crassa
  unsure (1)..(510): unsure at all Xaa locations
LTNLLLTTLLASAGLGAALPPRIGSTVIEAREPELPVSGRKITLPQQKNPRFHKFNGALSVYKTYLKYGAPVPDHLVQAVANHLGISVEEVHNYANTTANARRDQGSATAAPIDQSDSAYITPVSIGTPAQTLNLDFDTGSSDLWVFSNSLPSSQRAGHTIYNPSKSSTAKRVNGASWDISYGDGSSSKGQVYLDKVTIGGLVVSNQAVETAQQVSQSFTAETSIDGLVGLAFGSLNTVRPRQQKTWFENAIGQLDQPLFAADLKYEACKLISLFRLTRIGSVGLDHTSSALGEIWGSSGSSSNPGFRNRRHAIXPDFGDPIRTSMSMIXAYLCSVTDNPSFQTAGTYDFGFIDPAKHTGDITYVPVNTNPGYWTWTSTGYQVGSSPFVSQSITNIADTGTTLMYVPDSILRAYYGQIRGATNSQSYGGYVFPCSTEAPDFTFGVTDEATITIPGRFINYGPVTDDGETCFGGLQTSSDVGINIFGDVALKAAYVVFKGGDSPSLGWASK

SEQ ID NO: 4210 - protein, 525 aa, Neurospora crassa
MPRSGKVYYAHEEEVSCHTFANRRPEADTIRILVSTDNHVGYAERHPVRKDDSWRTFDEIMQIAKKQDVDMVLLGGDLFHENKPSRKSMYQVMRSLRKHCLGMKPCELEFLSDAAEVFEGAFPFVNYEDPDINVAIPVFSIHGNHDDPSGDGHYCSLDLLQAAGLVNYFGRVPEADNIHVKPILLQKGRTKMALYGLSNVRDERMHRTFRDNKVRFYRPNQQKNDWFNLLALHQNHYAHTRTSYVAENMLPDFMDLVIWGHEHECLIDPVRNPETGFHVMQPGSSVATSLVPGEAVPKHVAILNITGRKFEVDKIPLKTVRPFVTREIVLASDKRFKGLDKQNNRHEITKRLMVIVNEMIEEANAEWRAVHAEDDDMDEDMEPPLPLVRLKVDYTAPDGARYEVENPHRFSNRFTGKVANHNDVVRFHCNTKGKSKLRELCDQQLYDTDNIQRTLQLRQACVRTSLRYLSQPIPSRSTTWFKSSLPNSPSRSCRKHHSAMRSTSSLARTISTLSKCSSSSHSPPK

SEQ ID NO: 4211 - protein, 439 aa, Neurospora crassa
  unsure (1)..(439): unsure at all Xaa locations
MRCPIPEHKQNLTFSLPLGDDVLKLFQYAREKQFAIPACNVTSSSTAVAALEAARDQKAPIILQTSQGGAAFFAGKGIKDSAEKREASVAGAIAAAHYIRSIAPIYGIPVVRKXLSLSCSVQLAFQDADMVLVHTDHCAKKLLPWLDGMLEEDEKFFKANGVPLFSSHMIDLSGKSAPDECDRSHQYPSLLTCNYREPVEENISTCVKYLKRMAPMKQWLEMEIGITVRQCHNALAPKGNKTNTCKQGGEEDGVDNSEVDNASLYTQPEDIWQIEEAFRPISPYFSIAAGFGXGXTLPLALDXSELTRXQQRHGVYAPGNVKLHPELLGKHQAYVSEKLGGKDKKPVFFVFHGGSGSSKEEYREAISNGVVKVNVDTDLQWSYLVGIRDYILNNIDYLRSQVGNPEGPNKPNKKKYDPRVWIREGEKTMKARVEEALKG

SEQ ID NO: 4212 - protein, 769 aa, Neurospora crassa
  unsure (1)..(769): unsure at all Xaa locations
DXLSVVTDGELSDLIEDFNEGRIQFAFVKVKDPNSGLPKNVLIAWCGGGVPERTKGYFTSHLAAVSKILHGYHVQITARSDGDLSPESIVQKVADASGAKYTAGGSAPASAVAPPPVAKKPVFTPTTSTSASSFNPIVAARIRNHGGEDDDGWGVDAPPVTRTQLEKVASAYQPTKVNIAELRKNKDDSRSEETQKQNDRPEDIVKGGYQPIGKVDIAALRAQAKKTHDDRPVTVKGAYEPVGKVDIAAIRAKAQQRPTEPEELETPRSLAERTAVFTQAERLTELPKPKVAKKFVGSAAFTGTKAPTPAPLGFSSPAVPTATPIGAASRTFADQGGKTPAQIWAEKKAKQGGAVAFASTPSPAAAPIAAQKSGSEWKSGYAGKSWAPVQAPNYSRGLELHATGGSASQEQYEPEAPASPAGGISALRERFKDTAPVAVRTGSRSAPSVPSPGPATGEEGHTPPPLPTGSRPSGGFALPGLPSRPSVADDEEGNDERQLEEEVRALEPADQHEEEPSSPARIAVPIARSAVPEVEPAGNLPPRPVPVSQDLPKEEDLPVEEDTHDPRAAALNVASESLGQGVEVQQAGSDGGKRALVQYDYEKAEDNEIDLQEGDYVTNIQMVDDDWWMGTNAQGESGLFPSNYVEVVEDDEPAAAFSAAPTVAATQAPVVPSSAQAEAVAPATPADQVAGPTATAQFDYEAAEDNGKXCLEAPHISAAKPRPSSDXRIGTELSFPEGATITGLEFPDDDWWFGHYSGASGLFPANYVE

SEQ ID NO: 4213 - protein, 195 aa, Neurospora crassa
ATVAAGCFWGVEHLYRKHFADKGLYDARVGYIGGDASNPSYKQVCSGTLAVSLLPLWRRLLPPLLGMRSPSLQACSLDCVADKTKDAEATLLIYDPTRLSYTQILEFFYKMHDPTTHNQQGPDRGAQYRSGIFYHNDEQKKVAEEITKKANEQWWGGKIVTEILPAKEWWDAEQYHQLYLVNNPDGYECPSHFLR

SEQ ID NO: 4214 - protein, 567 aa, Neurospora crassa
DVVIVGAGLSGLRAAVELHKAGLAIAVLEESNRVGGQCCTTFARHTTRITSIGDTHTEMLSLAKDCKIDLTKQHKEGLDLQQRYDGFQDSPQVSETIPALETAVWPPQEYQLSFRSLIEDPAIQKFYRRISDLSETWHGPDALFLDAVSFLELVEANFFHSKAVQQEAHFLTRYLLSVDPARVSALYVLDHIASGGGLANLYFHPDSPGGGAHHFRVPQGPRAFITKLVDLLPEGCIHLSTMATKITQQTTPISKIYYPSHPCKVETSPPVDSDSTASTTASTTTKTFYAKKVLLATPPALYSPCWSHLPEVLTFHPPLPPHKLASINRHSGEYNNYGIFTTVTFYFSQPWWREAGLSGSMDCRVTRDLDGPISWVRDTSEDKGGGKINTNKKVWSLTCWCAGENAYEVWKWYDKTYPVDDEKPEEIKGGWKASPVWMHLLRVFKERMDALEMEIPLPGEGFSDSEEEEEKENEMEEGAEPPSVYLFRKWTGLCFTPPRALPSNGEELEELLRTWKYDGPGKGDATFREPFSNVHFAGTETAEEWRGFMEGAARSGLRGAKEIIQAL

SEQ ID NO: 4215 - protein, 372 aa, Neurospora crassa
  unsure (1)..(372): unsure at all Xaa locations
MKASLMMLLAPLAAMAAPTSDNLEPRQASQSIDALMKAKGKLYFGACTDQGRLTSGKNAVILQNNFGQVTPENSMKWDSIQPQRGQYNFGQADYLVNWATANNKTIRGHTFLWHSQLAGWVNNIRDKNQLTTVLQEHITTVMTRYKGKIYGYVSSLHSYLSTYWAXSLTRSSRQDVANEIFNEDGSLRSSIFYQVLGEDMVSIAFKAARAADPNAKLYINDYNLDSPNYAKVTTGMIQHVNKWVAAGVPIDGIGTQGHINAGGGSNLAAAIKALASANVKEVAVTELDIQGNNAGDYATITKGCLSEPKCVGITVWGVRDSVSARPLVTTLXDRRRCXPFFAGSWRPNGNPLLFDANWNPKAAYNSIVQALQ

SEQ ID NO: 4216 - protein, 774 aa, Neurospora crassa
RIFLSAIFLFSAHVFAVSAVLGVDLGTEYIKAALVKPGIPLEIVLTKDSRRKEISAVAFKPSSNGPKKGAYPEREYGSDAMAIAPRFPGDVYPNLKAILGLPTGSAQVREYAERHPSLKLEAHKAKGSAAFKSAGAFTAEEEAWLVEELLAMELQSVRANAEALAGPGSSVRSVVITVPPFYTTEEKRAVELSAELAGLKVLSLVSDGLAVGLNYATTRQFPNVNKGAKAEHHLVFDMGAGSTKATVLSMQSRTVKDVGKFNKTVQEVSVLGSGWDRTLGGDALNYLIVDDMIRQFVESPTAKKAGVTLEAVKSHGRTIAKLTKEAERLRHVLSANQNTQASFEGLYDDVDFKYKITRAEFEEMAATHAQRVSAAVKNALSMAGLQIKDLDSVILHGGATRTPFVQKELESFLGGADKIRTNVNSDEAAVFGAGFRAAELSPSFRVKEIKITDIAYYPAGMKWKNDEGKPKHQRLWIATSPLGAPAKEVTFNNVQDLSVSFYQLVDGAELDTKVFTTKNLTASVEALVEKHKCEKADIKFKVGVRLLSENGEVDVTKAAVECEADEPEKDGFVDGVKNLFGFGKKDKTEGEEDSASASTESSTSTSSSAAASASAETKPSEPKKKQLVQINVDFTLTPTGPTSLLSKASIQALKDRLKSFAASDRTRQLREEALNQLEAYTYKISDILDRESFIAHSSASEREALQQKKDEVSDWLYGDGADATREEFKAKLNELQNIVDPVLKRAEEAEKRPEILKGLQDALDNTNKFVKDIR

SEQ ID NO: 4217 - protein, 368 aa, Neurospora crassa
  unsure (1)..(368): unsure at all Xaa locations
LQPFVADFLMGGVSAAVSKTAAAPIERIKLLVQNQVRSNNYLILPXSTGEGNQLGLCDPRVRXQSQQVYLAVTCHSFNVGDGRTSIPPHLGPGILTTPXDEMIRAGRLDRRYNGIIDCFKRTTADEGVMALWRGNTANVIRYFPTQALNFAFRDKFKKMFGYKKDVDGYWKWMAGNLASGGAAGATSLLFVYSLDYARTRLANDAKSAKKGGERQFNGLVDVYRKTIASDGIAGLYRGFGPSVAGIVVYRGLYFGLYDSIKPVLLVGDLKNNFLASFALGWCVTTAAGIASYPLDTIRRRMMMTSGEAVKYKSSFDAASQIVAKEGVKSLFKGAGANILRGVAGAGVLSIYDQLQVLLFGKAFKGGSG

SEQ ID NO: 4218 - protein, 258 aa, Neurospora crassa
SFSIGAAVARRLWSLGAHLALTYSSSPEKLQALEQELYEAFTNGQTAHGPALSLNRTTANPNPLPFSTHKCDLSSPADIQLLFTQLQDLHGQSGPDILISNAGYGRRIPSILDISLDEFDKMLNINLRSSFLLCKLSLPHMIQRNWGRIIFVSSIAAQGGGINGCHYAASKAGLQGLMKNLARKHAGQGITVNDVAPAMIGETGMIPDAKFVEGTPGDVKNIPVGRLGTTDEVGNVVEMLVKTGYMTGQSVLLSGGLM

SEQ ID NO: 4219 - protein, 485 aa, Neurospora crassa
  unsure (1)..(485): unsure at all Xaa locations
CXHTTPQPDGYLTEERKAADPDHGFSTFFSETGTXRPCSTXHAKRKLTNTNIGNGKYVPRTIYADLEPNVIDEVRTGAYRGLFHPEHMISGKEDASNNYARGHYTVGKELIDQVLDKVRRVADNCSGLQGFLVFHSFGGGTGSGFGALLMERLSVDYGKKSKLEFCVYPAPQTATSVVEPYNSILTTHTTLEHADCSFMVDNEAIYDICRRNLGLERPNYENLNRLIAQGMSWLGSMTCVIFLDXLFPPSVVSSITASLRFDGSLNVDLNEFQTNLVPYPRIHFPLVAYAPVISAAKAAHEANSVQEMTMSCFEPNNQMVKCDPRHGKYMATCLLYRGDVVPNDAHAAVATLKTKRTIQFVDWCPTGFKLGICYQPPHQVPNGDLAKVNRAVXVSLDLCMPXHLVFXPXQXLMLSNTTAIAEAWSALSSKFDLMYSKRAFVHWYVGEGMEEGEFSEAREDLAALERDYEEVAADSMEGEDVEAEY

SEQ ID NO: 4220 - protein, 388 aa, Neurospora crassa
VRDAVTKICSNFPNTYWQQHDQMEEYPKQFHAALAQDGWLGIALPEALGGAGLGISEATMMMQTIAESGAGMAGAQSIHANVYATQPLAKFGTPEQLEETIPNIISGKLRVCFGVTEPNAGLDTLRLETLAKKQDDGSYSVSGQKIWITCAQVADKMLLLARTTALDEVKKPSEGLSLFCIDLNRGDHRLKVSKIKKMGGRAVDANEVFFENYPIPGESLIGKEGQGFKIILHGMNAERCLLAGEALGLGYAALGKAAAYARERVVFQRPIGQNQGIAHPLADVYMRLEAAKHATYHAARLYDASKTDGSIRQEEVGVACNSAKYLAAEAAFAACERAVLTHGGMGYAVEYDVERYFRECLVPRIAPVSREMILNYISEKVLDLPRSY

SEQ ID NO: 4221 - protein, 428 aa, Neurospora crassa
MAVTSSSPGPAPLSLLSNNDDFIAPFNINTKFPSAIVPPRTSSNQPISVAIPSNRISSAGLAATQQAQTRKRKASVAQISLPSMLPTSFSPYTMAPQPPQPPPNPDRFATEDFFSPSRRTWSEEKEKVLTGPYDYLNGHPGKDIRSQMVKAFDAWLDVPSESLEVITKVISMLHTASLLVDDVEDNSVLRRGFPVAHSIFGIPQTINTSNYVYFYALQELQKLKNPKAVSIFSEELLNLHRGQGMDLFWRDTLTCPTEDDYLEMVSNKTGGLFRLGIKLMQAESRSPVDCVPLVNIIGLIFQIADDYHNLWNREYTANKGMCEDLTEGKFSFPVIHSIRSNPSNMQLLNILKQKTGDEEVKRYAVAYMESTGSFEYTRKVIKVLVDRARQMTEDIDDGRGKSGGIHKILDRIMLHQEENVAQKNGKKE

SEQ ID NO: 4222 - protein, 757 aa, Neurospora crassa
  unsure (1)..(757): unsure at all Xaa locations
DTMTHPQDEAQHLSLTDPEGFWGHQAEQLHWHRKPSAVLKRTTKDLKLGTSHSHWEWFPDGEISTCYNCLDRHVLAGHGDQPAILYDSSVTNTKQRLTYKQLLAEVETFAGVLREEGVKKGDVVLVYSQFTQLRLSRVSTEPATDSLPIYIVPMVPATLIGILAINRLGAIHAVVFGGFASTALAQRIEASRPVAILTASCGIEGNKGPVSYRAYIEEAISISSFKPPKTIIWQREQLVWRPIKKTEGERDWQKLVKSARFRNIKVECVPVRSADPIYIIYTSGTTGRPKGVVRDSGGHAVGLHMSISYLFGIHGPGDVVSWASRSQVKASQNESCXQDRDQMGCFSDIGWVVSHSYTLYGPLLTGAATVLYEGKPVGTPDASAFWRLAEEYKINTLFTAPTALRAIRKEDPDNVFITEIGRRGGLKSLKALFLAGERSEPAIINMYQDLLRRYGAAGSQVVDNWWSSESGSPISGVALVPHAGKNRKTNMKDHPPLPIKPGSAGKAMPGFDVRYIIFIISISSDAWXLMLHRNDQSVDDEGNEVPRGNMGNIVLGLPLAPTAFRTLWGDEERFYKSYMIRFNGKWVDTGDAGYVDQTGYIHIMARTDDIINVAAHRLSTGKLTSPIFFVIHLQTYLXHPASGTLEQAVTSHPLVTEACVVSVPDALKGQLPFAFVSTSDGGADVKSDEQLFQDIQKLVRAQVGAIASLGGMIRGKGMIPKTRSGKTLRRVLRELLENAVHDEFEKPINIPSTVEDP

SEQ ID NO: 4223 - protein, 436 aa, Neurospora crassa
DAARAAKSASHVLATLSAEARNDALTAIHAGLTAARDEILAANARDLELARQAAADGKLSASLVSRLDLGKTGKWEDMLKGIWDVRDLEDPVGRVTLRTKLDDGLELERVTCPIGVLLIIFEARPEVIANIAALAVKSGNAAILKGGKESTESFVAISTAISNALSQTQVPNDAIQLVTTRESIPQLLALDRDIDLVIPRGSNELVRYIKENTKIPVLGHADGLCSIYLAASADAKLAADVVVDAKTSYPAACNSVETLLVQESALTTVFPAVASALAAKGVELRCDAASKAALSPEITTNIKDATAKDYDTEFLSLTLAVKTVPDLSAAIAHINTHGSHHTEAILTADQAEAERFMSAVDASGAYWNASTRFADGMRYGFGTEVGISTNKIHSRGPVGLEGLMIYKYKIRGQGHVSAVYGEGEGKKRFKHERLAI

SEQ ID NO: 4224 - protein, 592 aa, Neurospora crassa
  unsure (1)..(592): unsure at all Xaa locations
YLWPANSLKLQGIILVCFVLVLLQRFVNIAVPAQMGRVTDALEPKDGVFKMPWMQVGLLVLYKLLQGPSGLLGSLRSILWIPVSQHTYRALTTAAFEHVHSLSLDFHLGKRTGEVLSALNKGASINQFLEQTTFQVAPMLIDLFIAIIFFYVKFGPMYALFVSVITFYYLFLTIRMAATRADQRRDMVNADREEEAVKNDSITSYETVKYFNAEKYEFARYRNAILNFQAAEAKVTFGMNHMNMCQSMVFMCGFLVIMMTCAYQVSQGTRTLGEFVSLITYLGQLQGPLNFFGTFYRTIQQAMISGERLLELFKIQPSVIDGPDVQDLASCSGHLKWNNVGFSYDKRRPALHDLSFECKPGTTTAFVGESGGGKSTVFRLMFRYYNCQEGSIQMDGHDVKDLTIDSVRRFIGVVPQDTILFNETLMYNLKYANPNATEEDVYDACRAAAIHDRILSFPDGYATKVGERGLRLSGGEKQRVAIARTILKNPQIIMLDEATSALDGETEQKIQSKLISGNFGEGRTLLIIAXSDLCTDHHXIVADDNMYYRHRLSTITHADQIIVLHAGTMVEKGTHQELLALGGRYASMWEKH

SEQ ID NO: 4225 - protein, 870 aa, Neurospora crassa
  unsure (1)..(870): unsure at all Xaa locations
QRHLENHSCXPMEQEDDTATAILKKKKKPNQLMXVDVEDAGHCNLSXHICRVTDAVNDDNSIIALSNNTMEQLQLFRGDTVLVRGKKRKDTVLIVLADDDLDDGSARLNRVVRHNLRVKHGDIITIHPCPDIKYVSLXPGHLVIEWAPCXHSISLXAKRIAVLPIADTVEGITGSLFDVFLAPYFREAYRPVRQGDLFIVRGGMRQVEFKVVEVDPPEYGIVAQDTVIHCEGEPIQRDEEENNLNEVGYDDIGGCRKQMAQIREMVELPLRHPQLFKSIGIKPPRGVLLYGPPGTGKTLMARAVANETGAFFFLINGPEIMSKMAGESESNLRKAFEEAEKNSPAIIFIDEIDSIAPKREKTNGEVERRVVSQLLTLMDGMKARSNVVVMAATNRPNSIDPALRRFGRFDREVDIGIPDPTGRLEILQIHTKNMKLADDVDLEQIAAETHGYVGSDIAALCSEAAMQQIREKMDLIDLDEDTIDAEVLDSLGVTQENFRFALGVSNPSALREVAVVEVPNVRWEDIGGLETVKQELRESVQYPVDHPEKFLKFGLSPSRGVLFYGPPGTGKTMLAKAVANECAANFISVKGPELLSMWFGESESNIRDIFDKARAAAPCVVFLDELDSIAKARGGSVGDAGGASDRVVNQLLTGKLILPWFVPFCCAYXPELXEMDGMTSKKNVFVIGATNRPEQLDPALCRPGRLDSLIYVPLPDEAGRLGILKAQLRKTPVAADVDLNYIASKTHGFSGADLGFITQRAVKIAIKESITADIQRTKEREAAGEDVEMEDEVEDPVPELTKRHFEEAMSMARRSVSDVEIRRYEAFSQQMKNAGPGAFFKFPEGGVESSGNGGAGNSFGDAGNDDDLYN

SEQ ID NO: 4226 - protein, 306 aa, Neurospora crassa
GAAATAAMLSLKSDKKVDTTSLNAPVPAAPSKPGPVPASQVFSAPALAGGYKPVDPSAFFEYGFPGPVADLATRQGFVSSYDRRTKNPHWTVEHITPESLSMSEGDRKKSTFVEDEAIPEKFRGKLKDYFRSGFDRGHQVPAADCKWSQAAMDDTFYLSNMCPQVGEGFNRDYWAHFEDFCRRLTKQYPSVRIVTGPLYLPKRDPSDNKWYVKYEMIGQPPNVAVPTHFYKVIFAEDGKKGGNVALGAFVLPNAKIPNDKPLQDFEVPLEAVERASGLEFASKLPVQRRKRLCAEANCSLIVKDYA

SEQ ID NO: 4227 - protein, 362 aa, Neurospora crassa
LVRLLHAINVTTALVLTSYVVYYHIHHPLIGTLTEVHAIVVWLKTASYAFTNRDLRHAYLHPARGELDALPGLYAECPYPENITMGNLCYFWWAPTLVYQPVYPRTAKIRWSFVAKRCGEVICLSVFIWFLSAQYATPVLRNSLDKIASLDIPSIVERLLKLSTISLIIWLAGFFALFQSFLNALAEVTRFADRSFYDEWWNSESLGVYWRTWNKPVYQYFKRHVYSPMRSRGWSNATASLAVFFLSAVLHELLVGVPTHNLIGMFFSSSFFLFLFFSLWAISQTSHMEELSSNTKITGVAFLGMFLQLPLIQFTKPLEKKTSPNGKLLGNIIFWVSFTIFGQPFAALMYFYAWQAKYGSVS

SEQ ID NO: 4228 - protein, 1895 aa, Neurospora crassa
  unsure (1)..(1895): unsure at all Xaa locations
DQQYYDNRNGGHAAGGQHGEGYYDESYVPQILLSLPPFLNACGXRFVLSCSGYYNADPNNPYHQDGGYYDNHEGFQEGYDNGYYDQHGYDQAGGYRDNHAARGSEEDSETFSDFTMRSDMARAAEMDYYGRGDERYDSQYGDQGGARGYRPPSSQISYGGNRSSGASTPNYGMDYGNVLPAGQRSKEPYPAWTSDAQIPLSKEEVEDIFLDLCAKFGFQRDSMRNMYDHLMTLLDSRASRMTPNQALLSLHADYIGGDNANYRKWYFAAHLDLDDAVGFANIKGKKGNLKRTKKKAKGDEPQNEAEILQELEGDDSLEAAEFRWKTRMNRMSQHDRVRQLALYLLIWGEANQVRFMPECLCFLFKCADDYLNSPACQNMVEPVEEFTFLNNVITPLYRYCRDQGYEIYEGVYVRRERDHEQIIGYDDCNQLFWYPEGINRIVLEDKSKLVDVPPAERYLKLKDVNWKKCFFKTYRETRSWFHMLVNFNRIWIIHLTMFWFYTAYNMPTIITPMYEQQVNQSPPKAAMWSFVGFGGGVAALINFGATLAEWAYVPRRWAGAQHLSKRMLFMVFVLIINLAPGVYVFLPGLKGQALIDHQNSTPVYIVGIVHFFIALITFLFFAVMPLGGLFGSYLTKNSRKYVASQTFTASWPRLNGHDMAMSFGLWVVVFGAKFGESYVYLTLSIRDPIRYIGLMDTSSCLGDSILKTWLCPYQPQITMGLMIFTGMIFFFLDTYLWYVLINSVFSVARAFYLGSSIWTPWRNVYARLPKRIYSKVLATTDMEIKYKPKVLISQIWNAIVISMYREHLLAIDHVQKLLYHQVPSEQEGKRTLRAPTFFVSQEDQSFKTEFFPQYSEAERRISFFAQSLSTPIPEPLPVDNMPTFTVMIPHYSEKILLSLREIIREDEPYSRVTLLEYLKQLHPHEWDCFVKDTKILADETSQFNGETEKEKEKEKEKETVKSKIDDLPFYCIGFKSSAPEYTLRTRIWASLRFQTLYRTVSGFMNYARAIKLLYRVENPEVVQMFGGNSDKLERELERMARRKFKLCISMQRFAKFKKEEMENAEFLLRAYPDLQIAYLDEEPPLAEGEEPRLYSALIDGHSEIMENGSRRPKFRIQLSGNPILGDGKSDNQNHAIIFYRGEYIQLIDANQDNYLEECLKIRSVLAEFEEMKTDNLSPYTPGVKNEVRHPVAILGAREYIFSENIGILGDIAAGKEQTFGTLFARTLAQIGGKLHYGHPDFLNGIFMTTRGGVSKAQKGLHLNEDIYAGMNALLRGGRIKHCDYYQCGKGRDLGFGSILNFTTKIGTGMGEQLLSREYHYLGTQLPIDRFLSFYYAHPGFHLNNMFIMLSVQLFMLCCVNIGVLRHETIRCEYNREVPITDALFPTGCSNTDALLDWVYRCVLSIIFVLFLAFVPLIVQEMMEKGVIRSATRFIKQILSLSPFFEVFVCQIYANSVQQDLSFGGARYIGTGRGFATARIPFGVLYSRFAGPSIYFGARLVMMLLFACLTVWHAALIYFWISLMALVISPFLYNPHQFSWGDFFIDYREYLRWLSRGNSRSHASSWITFCRLSRIRITGFKRKIIGDPSSKLSGDVARAAITNLFWSEMLTPFILVCLTTIPYLFINAQTGVRGEFGPHANDDSIKPTASLIRLLVVTFAPMAVNAGVLGGLFGMACCMGPLLSMCCKKFGSVLAAIAHGMSVIILLVMFEVMFVLQNFEFTPTLLGMIAMVSIQRFIIKMIVSLALTREFKTDTSNIAFWTGKWYSMGWHSVSQPAREWLAKITELSMFGADFILGHLILFSMFPVLIIPKVDVLHSVILFWLRPRYVIPTCSALCFESVANAISLSRQIRAPIYSLKQTKLRRRRVIRYAMLYFVLLVIFVALIVGPIVAGKQI

SEQ ID NO: 4229 - protein, 709 aa, Neurospora crassa
PQTLTEKIVQRYSVGLAPGKKVKSGDYVTLQPHHCMTHDNSWPVAMKFMSIGASKIHDNRQVVMTLDHDVQNKSEANLKKYRQIEEFANTHGVDFYPAGRGIGHQIMVEEGYAWPGTVTVASDSHSNMYGGVGCLGTPMVRTDAASIWATGKTWWQIPPIAKVTFTGLLPPGVTGKDVIVALCGLFNNDDVLNHAIEFTGAEETMRSIPVDDRLTIANMTTEWGALSGLFPIDAVLASWMRAKATVTAMEHPELGDKAKFTHAKIDALLENPLVADPGATYAKQLYLNLSTLSPFVAGPNSVKIATPLKDLEAQNLKLDKAYLVSCTNSRASDIAAAARVFKDAAADNNGVIPKVAPGVKFYIAAASLLEQKQAEDSGDWQVLLDAGAEPLPSGCGPCIGLGTGLLEPGEIGISASNRNFKGRMGSTDAKAYLASPEVVAASALKGKIAGPGWYQKPEGVEKVIIGEGNGVVEQDKAMSIEDALDKIIAEAESLIANAEAGLTPESTSSSSSSSSSSEEESLTEILPGFPEAISGEIIFCDADNINTDGIYPGKYTYQDNITPAKMAEVCMENYDASFGSIARAGDILVTGFNFGCGSSREQAATAILAKQIPLVVSGSFGNIFSRNSINNALMGVEVPKLVQRLREEFGDKVATRRTGWKLTWDVRRSKVVVEEASGKKWEQKVGELPPNVQEIIARGGLEKWVKSQI

SEQ ID NO: 4230 - protein, 618 aa, Neurospora crassa
DFRQIEPRLQALDKHLILRTYLDGYTLGDIDTKIWLALRGNRAAVSFIKRGSLANLARWFNYIEENHPEIQAEIKAKDAAAKAKVAAASKAGASYALALQNADQGVVTRFLPEPSGYLHIGHAKAALLSDYFAHQAYKGQLRLRLDDTNPSKEKQEYQDAIIEDLALMGIKPDTVTYTSDYFDYLYDMCVRMIKEGHAYADDTDQDTMRDQRWKGIASARRDRSVEENLRIFTEEMKNGTEEGLKNCIRAKLSVDNPNKALRDPVIYRCNIETPHHRTGTKWKMYPMYDFACPVVDSHEGVTHALRSTEYTDRNPQYQWFIDTLKLRQVYMWDFARMNFIRTFLSKRKLAKLVDTGKVWGWDDPRMPTIRGVRRRGMTIPALRDFILKQGPSRNVVTMDWTNFWASNKKEIDPIAPRHTAITKKDAVKVVVKGADAPAEPVKQEKPKHPKNKEVGTKQVTFANELIMDQADAKSFKDGEEITIMGWGNGFVRNIDTSAEVIPAFEIDLNLAGDVKSTEKKVTWLASKGQTLVPAELWDFDYLITKDVLQEEDNMEDFLNPVTETMEEAWCDEAAASLKKDDIIQLERRGYYRVDKGLNDWKEGEEKKLVLFCIPTGKT

SEQ ID NO: 4231 - protein, 828 aa, Neurospora crassa
  unsure (1)..(828): unsure at all Xaa locations
LYNYLGRRSFFLVKYSITLNRIAITTSNTLINIRTDTYIIINLSFARKLXKLLKLPIYNNFNPGYITLYKKAKSNSVEVAFKRYIKIQNYKVFNXXIIILPNLKRNIIIGNIXLIXNNIFTNLAYAYLLFPTSXKXNFSRNLKIGKSKDSEPIKYLNFXKDVKAXELLIXKEDKXYYNSYNNSXTILFKIKELERPLLLKLFKSNPSXRPLAILXHRLAQSLSLNAAXYYFNCIDRXFFEXTNEIPLELEELPXISLRRTKPELTQNLYLLYNTXGYYRLKYNXRXIKDRPADLTFISTDPFYKIVKKIYISITNFYKLNRFIEEXYIILYSSLEINEVELKXXILKEVLNYYYNFLKVFSKIKSDALPNLXLNINYYIPLNENARPKDLNYNPLYKISLEELEAYKDYIIKNLNKGFIEPNTAPXTAPILFVLKANKGLYFYIDYRKLNTLSKKDYYPLPFIEETITQLSKVKIFIKIDIXXIFYYIRIFPNNKNLTTFYTXYSAYKYKVLPFRLTNNLVIFXXFINKILISYLNDFYSAYINNILIFSETKEEYKIYIKKVLEQLRDVEFXADIKKYKFYIISTKFLNFIILTEGVSVDPEKVTIVRNXKELTSIKGVQSFIGFYNFYCKFVKEFGRIIHPLTRLTKKDTPFQXTKDYXTSFYKLKDRLLKAPILAHFYYKKPTXIETDAFNRIYTGVLFXLQLSNNNXYLVTFFSETILLIKLNYVIYNKELFTIIKTLTIXRTELISIYPFIVVIDYXALKYFFTKRFLNSQXTGXVELISXYSFKFIYWPKKENIIINALLKKLEDLXTVKDKKEDXYILXLF

SEQ ID NO: 4232 - protein, 1542 aa, Neurospora crassa
  unsure (1)..(1542): unsure at all Xaa locations
ISNPTRINILGKDNIIIDHGIWLNFVAQDLLQNIKSSTYILITDTNLYKTYVPPFQSVFEKAAPQDVRLLTYAIPPGEYSKGRDTKAEIEDWMLSHQCTRDTVIIALGGGVIGDMIGYVAATFMRGVRFVQCPTTLLAMVDSSIGGKTAIDVPMGKNLIGAFWQPERIYIDLTFLNTLPVREFINGMAEVIKTAAIWDENEFTALEENAKAILEAVRSKNKSADRLAPIRDILKRIVLGSARVKAEVVSSDEREGGLRNLLNFGHSIGHAYEAILTPQVLHGEAVAIGMVKEAELARFLGVLRPSAVARLSKCIASYDLPTSLQDKRIVKLTAGKECPVDVLLQKMAVDKKNEGRKKKIVLLSAIGKTYEPKASVVEDRAIRIVLSPCIRVFAGVPKDLNVSVTPPGSKSISNRALILAALGEGTTRIHNLLHSDDTQVMLNAVAQLQGASFSWEEGDVLVVKGNGGKLQATSTPLYLGNAGTASRFLTSVAALCNPSDVNSTVLTGNARMKQRPIGALVDALRANGVGVKYLEKEHSLPVQVDAAGGLAGGVMELAATISSQYVSSLLMAAPYAREPVTLRLVGGKPISQPYIDMTIAMMASFGVQVQRSAEDPNTYYIPQGTYKNPETYVVESDASSATYPLAIAAITGTTCTVPNIGSKSLQGDARFAIEVLRPMGCTVEQTDVSTTVTGPPIGTLKAIPHRRYGAHDXCFPHCVRARLLLPLAPLQITGIANQRVKECNRILAMKDQLAKFGVHCNELEDGIEVIGIPYTELKNPTEGIYCYDDHRVAMSFSVLSTISPHPVLILERECTGKTWPGWWDTMSNYFKVHLEGEEEPHSSHVSHEKPRKGNPKSIFIIGMRGAGKSTAGKWMSEVLNRPLIDLDHELERREGQTIPEIIRSERGWEGFRKAELELLEDVIKNNPTGHIFSCGGGIVETEAARKMLLSYSQNGGIVLLVHRDTDQVVEYLMRDKSRPAYSENIREVYYRRKPFFEECSNFRYYSPHPDGSKALTEPPFDFSQFLSVICGHSNHLEEVKKKPHSFFVSLTVPNVSKALDIIPKVVVGSDAVELRVDLLEDYDPEFVAKQVALLRSAARIPIVYTVRTVSQGGKFPDDDYELALKLYRTGLQAGVEYLDLEMTMPDEVIEAVTNEKGYTHIIASHHDPKATLSWKNGGWIQYYNKALQHGDVVKLVGVARELADNFALARFKASLAAAHDKPLIALNMGAAGKLSRVLNGFLTPVSHPALPSKAAPGQLSAAEIRQALALIGELEPRSFHLFGNPISASRSPALHNALFRDNGLPHQYSLFETDNAADVKDLIRAPGFGGASVTIPLKLDIMPLLDEVSDAAKVIGAVNTIIPVRNGDKVTLRGDNTDWMGMVYALRNAGVVKCTKESPTAGMVVGAGGTTRAAVHALHDLGFAPIYVVARNADRVKALAESFPAEYDIRSLSTPEEVAAESTAQPSVVISTIPADKPIDQSMREVIVASLRHPSVADGKHVLLEMAYTPRHTPLMQLAEDAHWQTIPGLEVLAAQGWYQVCN

SEQ ID NO: 4233 - protein, 462 aa, Neurospora crassa
  unsure (1)..(462): unsure at all Xaa locations
GYXPFMDNSGQISGFFDMEDFGRRFGNYQDADGWVFSAYRQGAIVALLPAGALLGSLVAGRIADTLGRRIAISASALFSCIGTIIEIASTTHWAQFAVGRLITGIGIGALSVVVPMYQSESAPAILRGILVSCYQLFITLGIWTAEMINYGTHDLSNSASWRIPNGISFLWALVLGGGILFLPESPRYAYRVGREDEARNTIARLAGLEPSARSVNMQIDEIRMKLEEEKAGADTKWYEIFGPALLRRTLIGIILQSGQQLTGANFFFYYGTTIFKATGLSDSYVTQIILGSVNAGCTVAGLWVVKNVGRRKALIGGALWMTMCFLVYSFVGRFVLDPVNPASTPQAGNVLIVFSCFFIVAFATTWGPLVWAVVAELYPARYRAPAMALATASNWLWNFLMSLFTRPITDSIGYFYGLVFAGCCLALAAFVWLFVIESKDRTLEEIETMYNQKVSPRHSTHW

SEQ ID NO: 4234 - protein, 1769 aa, Neurospora crassa
  unsure (1)..(1769): unsure at all Xaa locations
MNISQPVSSSLDSVEFTFLTDTEIRAVSVRKIENESTFDSLLNPVPGGLYDPALGSWGDSLXDSPPRRLLSLNVKGWWFRQWCXLMXPFSNSCTTCNLGQSQCPGHPGHIELPVPVYHPVFMDQAYRLLRAQCVYCHRFRLPRREIHRYSCMLRLLQCGLLKEAQMIDSFGESEFGSAIRQFQLADVPEMEDDEAEEEGNNLNDSTIRQREAYVRAVLRDYRTKVTMRDINKGKHEGAADMRRALVKEFLAAIIKDKKCRTCDGISPVYRKDRYTKIFERDLTQKEKAAMAQAGRKRADALAMKGGKKKNHDDDEGIADIESTASESDNSEGEGEELDENGDVVMADAGSKTKAKEKAEKRALPQRYISSLEVKERLNFLFQKEQEIVSLLFSSKPRPKHAKPMTADMFFIQTLLVPPNKFRPEARMGDQVTEAQQNSLYKLILRGSSMVAQISREVSETAKGNAPEDGRRARDINALYQAWTQLQDAVNSLIDRDKNPVQGAAGKRNEDGIKQKLEKKEGLFRKNMMGKRVNFAARSVISPDPNIETSEIGVPPVFARKLTYPEPVTSHNYHDLKNAVQNGMEKWPGASAIEMENGQIINLRNKSSEERQALANQLLAPTNNNFSGVRNKKVHRHLTNGDVVLMNRQPTLHKPSIMGHRVRVLPGEKTIRMHYANCNTYNADFDGDEMNMHFPQNEIARAEALQLADTDHQYISGTAGKPLRGLIQDHLSVSVILCNKDTFFDRANYHQLIYAALRPESGHIMGDKIELLPPAIIKPVPRWTGKQVITTILKNIKPPNCGDLWMNGSTQVKAHQWGDHAPEEGQVTFRDGEFITGILDKSQLGPSSGGLIHSIHEVYGPSAAGKLLSCMGRLLTRYLAMVAFSCGMDDLVMTPKGEADRKEKIKAAAHIGLEVAAKYVSLEEQKPTPEDPLLLQRLEEVMRNDKKQENLDLLMNQRCAQLSSEITKTCLPAGLQKKFPKNQMQSMTTSGAKGSPVNANLISCNLGQQVLEGRRVPVMVSGKTLPSFKPFDTNARAGGYIVQRFLTGIRPQEYYFHHMAGREGLIDTAVKTSRSGYLQRCLIKGMEGLKVAYDTSVRDSDGSIIQFLFGEDGIDISKQKYLNDFEFVLRNLKSELAHLHYSEEGTQALFEHKDEMIKRMKAAIKSRDTRNPLNPIESDVDPALYAFATSENFFEKMTKYVKENKDGLIKEKKGDSSGIIVRKNAEKILAAKYIRSLVEPGEAVGIVAGQSVGEPSTQMTLNTFHLAGHSAKNVTLGIPRLREILMTASSKISTPAMTLYPNAELSDTDCERFAKSISILPLADVTKEVTVREKMGRGLGYPLAKLFEIRLRFFPSEEYCKTYAIEIADVLATVERKFVPLLGQLTKKEIKKKYKENSAATPEIGVKVGTVEMAAPDGERAVGEDGDADDDDDGDDDATNAKSRANRHEAVSYGPNDDDDDAIQKSLQRADDGEEEGEERLEFDDEGYGGSPEPEDRNADGDMSVYKSRSRETRIKDKNDFVARFHCDEQGGEWCEMILEFDPATPKILMLNLVTEAVKKALIQQIPRLGTATFVVENKERLVHTEGSNIKAMQQYADYINPNKIMTNDIAQVLEIYGVEAARNSIVRELSGVFKGHGIGVDPRHLNLIGDYMTRXDFISQHYVNKHQVIDXXFLQKRGFTPFNRMGLTGNVSPFTKMSYGTLSSISRSLPFLXPELIANMSQQKLTVGFLKDAVLDGDWDSLDTPSGRLVVGKLGVTGTGSFDVFTKVP

SEQ ID NO: 4235 - protein, 500 aa, Neurospora crassa
  unsure (1)..(500): unsure at all Xaa locations
LVGGVAVLLSYLLLTISPPHDPSEPPLIKPRFPVIGHLFGLLNHQVNYFSELFARYHLPIATLPIGNQKLYVIFDAPLQQAALKAKDMDAQSFMVDFVPRIFGVKQGTVDKLLGKDGVHPNIMGDMEQVFKSALSGDNLQKLASTTLATMADTLNDVDSKKGTKIPNMFLWLQSLLSRSTSKALWGEKHNPFKDHQVIDAQWYVTFPLPSLSQSXPPPKHHRDFESHLGPLVLGVLPSIVARRAYLARNKVQSALLSYFSARHYETDPSTSYFIRARTRLLKRYDLPDDELAKNEVAITLVATTNVLSTLFWCIAEIWTRPDLLQQIRAEALLAVFGNSQKALSGEDMGTRTITIPATGLDAKCPLLASCFRESIRLASQIVTARRVLKDTLLTDPVSGNSYLLKADTNVMMPAKVVHRNTSVWGADAEGFNPRRFMWEELGPKVERQRKAAFVPFGGGKHMCPGRHFAFTENLALMAALAIGFEIEGLDRSKLKMGDSK

SEQ ID NO: 4236 - protein, 561 aa, Neurospora crassa
  unsure (1)..(561): unsure at all Xaa locations
AAPTVTISTGTIVGANGILTEAFNGIPYALPPTGNLRLKPPVRLKSSLGVFDASGIGPACPQFLADTSSNEFLPQVIDKIVNTQLFKTILNVKEDCLTISVTRPKGTKAGDKLPVLFWIFGGGFEVRNPAYIRDVMNKCXNFTAGSASMYDGAPLVTNAINMGKPYVYVAVNYRVGGFGFMPGKEILKDGSSNLGHLDQRMGLQWVADNIAAFGGDPDKVTIWGESAGAMSVFNQMSLYDGDNTYNGKPLFRGAIMNSGSIVPAGPVDCPKGQKVYDTVVKNAGCSGAADTLACLRALPYETFLKAANSVPGILSYNSVALSYLPRPDGKALTQSADKLMLAKKYAAVPMIIGDQEDEGTLFSLFQSNITTTSKLVSYLNDIFFNDATESQIKSLVSTYSTLISAGSPFGTGLFNEIYPGFKRLAAILGDLIFTLSRRIFLDAATTLNPSVPAWSYLASYNFGTPILGTFHASDILQVFYGILPNYASKSIQSYYANFVYNLDPNDASGGTSSKSKVSQDWPQWQKERKLVQFFSDYAGYLADDFRSDSYNWIKANLDALH

SEQ ID NO: 4237 - protein, 224 aa, Neurospora crassa
  unsure (1)..(224): unsure at all Xaa locations
VAQVPRNFKLLAELEKGEKGMGAGASSFPCWRCAMNAGQTILMICFVRYTGACSYGLEDPEDILMTHWTGTIWGPPHVRLPPSSXSPSSPLAPSXPWSEXGNHENRIYELKMECGANYPKEPPVIHFVSQINLPGVSQTDGRVDPNYVGILRDWTRISAELSRNPRPKEDPLSLEAALIAIRKYVXPENKAIRTEENRKALTMRHCRYMEEHKKLPQPPEGSKY

SEQ ID NO: 4238 - protein, 481 aa, Neurospora crassa
  unsure (1)..(481): unsure at all Xaa locations
MPISKIHARYVYDSRGNPTVEVDVVTELGLHRAIVPSGASTGTSDRRSLIHSSIEMYIMLTITFYRQHEACELRDGDKTKWGGKGVLKAVQNVNEVIGPALIKENIDVKDQSKVDKFLIDLDGTPNKTKLGANAILGVSLAVAKAGAAEKGVPLYAHISDLAGTKKPYVLPVPFMNVLNGGYVXMPYPLSAKQSTNDVAVPHAGGRLAFQEFMIVPSAAPTFSEALRQGAEVYQILKSLAKKKYGQSAGNVGDEGGVAPDIQNPEEALDLITEAIEKAGYTGQVKIAMDVASSEFYKEDVKKYDLDFKNPESDPSKWLTYEELANLYSELCKKYPIVSIEDPFAEDDWEAWSYFYKTQDIQIVADDLTVTNPLRIKKAIELKAANALLLKVNQIGTLTESIQAAKDSYADGWGVMVSHRSGETEDVTIADIVVGIRSGQIKTGAPARSERLAKLNQILRIEEELADNAIFAGEKFRKAVEL

SEQ ID NO: 4239 - protein, 1358 aa, Neurospora crassa
  unsure (1)..(1358): unsure at all Xaa locations
MTPQDDSVNFDIIESHKENIQALPSGRSARKLAELFSPSHGASSSRQALAPQLTPTPNPTEVKSVNDAIRAEYEAELAAFNPEEQDDPLDIYDRYVRWTLDAYPSASATPQSQLHLLLERATRAFVGSAQYRNDARYLRMWLHYIRMFSDAPREAFVFLSRHQIGEQLALYYEEFAAYLEGEGRWAQAEEVYKMGIEKEARPVSRLVRKFGEFEQRRAALPEGAEDQSNSVPVLPVVRKALGVKSDPFLAAGVERLPRDPQAPRPNMGVGGAAAGPSKPKSKLAIFSDADAAAQQPALGSLSAGSKGWDSIGSLADRKKENTVEPKPWAGEVLKAGGKKPVQKMQVFRDTGKFXNPPSLLSSPXTDVDQEXDXLFTMGGALGVLAHSFLYVIVQIKKTTNPMMMNKQQLSQSHIPIHHSQSQVTVNPVSGKRERVFVDLRVIYPTPDEPGTELSFEEIWAARRGWLDVVWEDERKKRPLDAMLTPKRDENMEDLTLEMASTKIVAYHDVLKLDENGKPIYPEHKAGRSAKKNKVIEVNETQISMHLRPTPTRRKTCXRTTIVKAKLDSPSGPKMKKRGSSSEPTMTLHTKAATDDIYDIFNAPLKPTANPSLSDDENRYDSDDYTCGVDDTSKNLATSEAGDETTVVEAIEETDVADEDDDVKSEWSDFTARKHIPDYQGGGDEDHEMTDVLDEELNGQPETSHSQFNHNKVPDENPTQGERPLTHNPPPAPEEVPPTTRNIFVPVPPADYVPTRRPYRDPVEVANNRLPFMTPITERTEFSSLDVTYHHPNMHHPVLTKTPSKAPGLHHDMRDDMSVDGEEEDGQFSENEDEDMLEPESSPLREIPEEDEEEEEQQEKFSPIPVLYGQLGQNQPAARSPLAVKSVTTSPLAHRAVSPLAPRLPGPIIKELQCNPVDELVRKKILANVHPPLTSYEGFYDHRHEKIRKGAEIRKFAQAQSAASKRGRKSTSADKRDSLNEPHPIMLQLPGNPSTKYTIKKELGAGAYAPVYLVENSKPTKTASRTGYGYGQQENENNNLPAHLIRHPREALKMEQPPTAWEFYMMRLAHTRLLAANTSLHHRALASLSPALELHLYQDEGFLFLPFFQHGTLLDVINLFRSESSGVMDEQLAMFFTVELLRAIEALHSVGIMHGDVKVDNCLLRLPTTTDILPTNQYHADGSGGWAARGLTLIDFGRGIDFRQFRQEVQFVADWKPTAQDCAEMREGRPWTWQIDYHGLAGVVHALLFGKYIDTVPCGTSHSRSFGGPGGNDQKRYKIRENLKRYWQTDIWGHCFDLLLNPGSYVDEEEGGNMPVLKGLRTVRERMEGWLEANCERGVGLRGWMGKVEAWSRGRRXRV

SEQ ID NO: 4240 - protein, 287 aa, Neurospora crassa
  unsure (1)..(287): unsure at all Xaa locations
IEYAFKAITAANIMSLGVRGKDCAVVLSQKKVPVCCPGXWEASTGRVICXRLCDNRDKLIDPSSVSHIFQISPSVGCVITGSIADARAFAQRAQGEAAEFRYKFGYEMPCDALAKRIANISQVYTQRVSYLQLPPRRATSLXKEEEDDILTRDSSFQLQAFMRPYGVAVTLISVDSEFGPQLFKCDPAGYYTGYKGTAAGPKQQEALNHLEKKLKNKDHAPGDWKEVVELAITTLSTVLSMDFKKTEIEIGIVGGPRPDGKEGTYPGFRTLTEDEIDERLQAIAEKD

SEQ ID NO: 4241 - protein, 502 aa, Neurospora crassa
  unsure (1)..(502): unsure at all Xaa locations
TARYFSSSSAMAKNTRIETDAFGEIEVEDDKYWGAQTQRSLSNFKINQPQDRMPPPIIKAFGILKGAAAKVNTRYGLGTXIPSSWELWKSYARRSXHLGELQDPKIAEAIQQAAKEVADLKLLDHFPLVVWQTGSGTQSNMNANEVISNRAIEILGGVKGSKKPVHPNDHVNRSASSNDTFPTVMHIAAVLEVEGELLPALKSLRDALQAKVDEFEAKKIIKIGRTHLQDATPLTLAQEFSGYVAQLDFGIKRVEESLPDLRLLAQGGTAVGTGINTYIGFAEAIAEEVTKMTGTEFKTAPNKFEALAAHDALVHAHGALNTLAASLTKIAQDIRYLGSGPRCGLGELNLPENEPGSSIMPGKVNPTQCEALTMVCAQVMGNHVATTIGGMNGQFELNVYKPLIIRNFLHSVRLLADGMRSFEKNLVHGLTANEERIAKIMKESLMLVTCLNPKIGYDMASKVAKNAHKKGLTLKQSALELGALTEEEFDALVKPELMIGPQ

SEQ ID NO: 4242 - protein, 451 aa, Neurospora crassa
EVITTISPTTGEPIITRNGISEEELVQLPETAFKAFQGWRTTKLEDRQIIVKKALKLLAEKQDELAEELTVQMGRPIAYTAKEVATAIKRSEYLLKISNDALKDTDGEEEKGFKRFIRKVPVGPVLIIFAWNVSGVHHVVLTLHPSPLTLRQYPYLILVNALIPALLSGNSVILKPSPQTPTIVEQVAKVFSEAGLPDGVIQYFHSGSPTVIETIVRNPKIANICFTGSVAGGLAVQKAASDRIVNVGLELGGKDPAYVRGDVDIAWAAEEIVDGAVFNSGQSCCSIERVYVDEKIHDEFIAAVQNVLKGYKLGDPLDKGTHLGPVISARSKETIQAHIKDALDKGAKNATPENETFSILPDKGNFVAPTLLTGVDHTMTVMKDETFGPVIPVMKVKSDAEAIQLMNDSEFGLTASIWTKDTAKGYELAEEVEAGTVFVNRCDFPSPVSTF

SEQ ID NO: 4243 - protein, 244 aa, Burkholderia fungorum
  unsure (1)..(244): unsure at all Xaa locations
DIFVVAAARTAIGTFGGSLKDVPLAQLAILAVRGTLERSGIAPSHVDHIVLGNVIPTEPRDAYLSRIAALEAGIPAQTPALNVNRLCGSGLQAIILAAQSLLLGDAQVAIGAGAESMSRGPYLLPALRWGARTGDVQAADYMLGILHDPLHRIHMGVTAENVAEREAITREMQDVLAVESQRRAAHAIAEGYFRSQIIPVEIPSRKGIVIFDNDEHVRPENTFEATVEDXTKPLSMKGRALVGN

SEQ ID NO: 4244 - protein, 510 aa, Burkholderia fungorum
KEAEKAPAQAEAKPQAAEAPAAAPAKAAAPAPQAGSYSGSADIECDMLVLGSGPGGYSAAFRSADLGMKTVLVERYSTLGGVCLNVGCIPSKALLHTALVIDEAEALGAHGITFAKPQIDLDKLRDFKSGVVRKLTGGLAGMAKMRKVEVVTGNGAFVDPYHMEVQTEGGKKVVKFKQAIIAAGSEAVKLPFIPEDPRVVDSTGALELRQIPQRMLVIGGGIIGLEMATVYATLGAKIDVVEMLDGLMAGADRDLVKVWEKYNSKRFANVMLKTKTTAAEAKDDGIHVSFEGEKAPAEAQRYDLVLVAVGRTPNGKKIGADKAGVAVTDRGFIDVDKQMRTNVPHIFAIGDIVGQPMLAHKAVHEGHVAAEAAHGEKAYFDALQIPSVAYTDPEVAWAGKTEDQLKAAGIKYGKAVFPWAASGRAIANGRDEGFTKLLFDEETHRVIGGGIVGLNAGDLISEVCLAVEMGADATDIGKTIHPHPTLGESIGMAAELYESVCTDLPPQKKK

SEQ ID NO: 4245 - protein, 457 aa, Burkholderia fungorum
SVRTRFAPSPTGFIHLGNIRSALYPWAFARKMKGTFVLRIEDTDVERSTSESVDAILEGMAWLGLDFDEGPFYQMQRMDRYREVLKQMQDEGLVYLCYMSTEELDALRERQREAGEKPRYDGTWRPEPGKVLPEPPAGVQPVLRFRNPLNGVVAWDDAVKGRIEISNEELDDLVIARPDGTPTYNFCVVVDDLDMRITHVIRGDDHVNNTPRQINILRALGGEPPVYAHLPTVLNEQGEKMSKRHGAMSVMGYRDAGYLPEAVVNYLARLGWSHGDAEIFSREQFVEWFDLEHLGKSPAQYDHDKLNWLNAHYIKEAGNVRLAELARPFFAGLGIDEAMLAQGADLTAVVGLLKDRASTVKEIAENAAMFYRAPAPDAESLTQHVTDAVRPALADLAAALKAVEWTREAIAAALKATLGAHKLKMPQLAMPVRLLVAGTTHTPSIDSVLMLFGRDVV

SEQ ID NO: 4246 - protein, 393 aa, Burkholderia fungorum
  unsure (1)..(393): unsure at all Xaa locations
MQTDSSFTFVLFGGTGDLSMRKILPALFEAHRAGGMLADSGKIVAVARHAADRSEYLQRVNEHVKPHVSKNGVDEAAWASFLKRIEFVKIDLGNPDDFALLRDAIQDLPGIRVFYLATGPSLFVPICHALASVGLNANARIVLEKPLGYDLKSSNAINDAVGEIFAEEQIYRIDHYLGKEPVQNLLALRFGNALFEPLWRREWVESIQITIAEELGVEARGDFYDNTGALRDMVQNHLLQLLSIVAMEPPHSMDSDSVRDEKLRVLRALKPVDSRDIGKVAVRGQYHSGVIRGTSVPAYATEPGVRPDSTTETFVLLKVEIENWRWAGVPYILRTGKTAGRSRTTEIVVNLTQPXPHNGAGTPHRQRAGANQLMKTLETKEKRRVKXMEKQGG

SEQ ID NO: 4247 - protein, 317 aa, Burkholderia fungorum
MSSHDGLMVFTGNANPALAQEVVKILGIPLGKAMVSRFSDGEIQVEIQENVRGKDVFVLQSTCAPANDNLMELMIMVDALKRASAGRITAAIPYFGYARQDRRPRSARVAISAKIVANMLEIAGVERIITMDLHADQIQGFFDIPVDNIYATPVLLGDLRKQNYENLLVVSPDVGGVVRARALAKQLNCDLAIIDKRRPKANVAEVMNIIGEVEGRTCVIMDDMVDTAGTLCKAAQVLKERGAKQVFAYATHPVLSGGAGERIAASALDELVVTDTIPLGEEARSCAKIRSLTSAGLLAETFSRIRRGDSVMSLFAE

SEQ ID NO: 4248 - protein, 310 aa, Burkholderia fungorum
LHYQNGFANEHESEASPGTLPVGRNSPQRPAHGLYTEQLSGTSFTAGRSEFRRSWLYRIRPSAAHADFVPVDNARYFEAGSASFVPSRFRWMPLPLPTGSTNFIEGLHTMAIAGSPESREGAAYHVYAAASSMDFAFSNHDAEMLVFPQSGTLRAITEFGVLEIGPQELLLIPRGVKFRIELPDGASRGYVCENFGAHLRLPELGPIGSNGLANARDFQAPTAWFEDVRQTTRLLVKFAGSLWQGDLDHSPFDVVAWHGNLCPYKYDMMRFMSINSVSYDHADPSIGALLTSPSAFTGTPNFEIAIFPHR

SEQ ID NO: 4249 - protein, 500 aa, Burkholderia fungorum
VVKEVKVKVGDNVSGGSLIVVLEGAEGGAAAPAPAPAAAPAAAPAPAPAAAPAAAPAPAPAASGGGLQEVKVPDIGDYKDIPVIEVAVKVGDRVEKEQSLVTLESDKATMDVPSSAAGVVKEVKVKVGDTVSEGSVIVVVEAEGGAAAPAPAPKQQAVEQPSDAPATPSPAPAAPSALASGAGDSGWRRRRASREPCVAVRAQVRARTGRRRDAGAGYGSEGRITQADVTAFIKGVMTGQRAAPAGAAAPAAAGGGELNLLPWPKIDFTKFGPVDPKPLSRIKKISGANLHRNWVMIPHVTNNDEADITELEALRVQLNKENEKAGVKITMLAFVIKAVVSALKQFPTFNASLDGDNLVFKQYFHIGFAADTPNGLVVPVIRDADKKGLIDIAREMAELSKAARDGKLKPDQMQGGCFSISSLGGIGGTNFTPIINAPEVAILGLSRGATKPVWDGKQFVPRLILPLSLSYDHRVIDGAAAARFNAYLGAILADFRRVIL

SEQ ID NO: 4250 - protein, 288 aa, Burkholderia fungorum
MKIKRIGVVGAGTMGNGIAQVCAIAGLPVSMIDVSETAIERGLRAIDTSLDALVRKERLSEVEKQAALARVSGTVDYDALAGADLVIEAATENLPLKLRILRQIDGIISGSGVVSTNTSSISITQLAAVLDRPERFVGLHFFNPVPVMPLVEVIRGLQTSDETHAFAIGFAEVIGKTPVTVRNHPGFTVNRILVPMINEAIFVLQERLATADDIDLGMRLGCNHPIGPLALADLIGLDTLLAVMEVLHDGFRDSKYRPAPLLKEMVDAGRLGRKSGHGFYSYSNEEQV

SEQ ID NO: 4251 - protein, 499 aa, Burkholderia fungorum
KRSQKAALFFYIGVGHMAGVKELQAFPMVIGGERVPSASGVWLESIDPYTGEPWAKVPRGDATDAEAAVSAARKALTTGAWHQLSATQRGALLRRLADLISRDWERLAEIEIRDNGKVISEVGPQIRYLAQYFHYYAGLADKIEGAVIPVDRPGMLNYTRHEPVGVVVAITPWNSPLMLASWKIAPALAAGCTVILKPSEHTSVSSLVFSDLFDEAGFPPGVVNVVTGFGAEIGNALVSHPDVAKVAFTGGDVAGQAVYERAAAGLKRVTLELGGKSPHIVFDDADLDGALAAAMDGVFSSSGQMCVAGSRLMLHDRIHDEFVARLLDRVRTLKLGAPMNPATSIGPVTTQAQFERILSYIDVAKQEGARCLVGGVASPEAEGGSGWFVAPTVFGDVKNDMRIAREEVFGPVLSIIRFSTDDEAVHLANDSRYGLASGIWTRDVGRAISVADRIQAGTVWVNTYRAVSAASPFGGMKRSGIGRENGQEAIMGFLQTKSI

SEQ ID NO: 4252 - protein, 394 aa, Burkholderia fungorum
MQRDVVVVSGVRTAIGTFGGSLKDIPPTDLGARVVREALARASVSGDEVGHVVFGNVVHTEPKDMYLARVAAINGGVAQHVPALTVNRLCGSGLQAIVSAAQSVLLGDADIAIGGGAENMSRAPYSMPAARFGQRMGDARLVDMMVGALNDPFQSIHMGVTAENVARKYDISRETQDALALESHRRAANAITSGYFNEQILPITIPSKKGDIVFDTDEHARMSASAEDFSRLKPVFAKENGTVTAGNASGINDAAAAVVLMERGIAEQRGIKPLARLVSYAHAGVDPAYMGIGPVPATRKALERAGLTIADLDVIEANEAFAAQACAVSKELGFDPAKVNPNGSGISLGHPIGATGALITVKALYELQRVGGRYALVTMCIGGGQGIAAIFERI

SEQ ID NO: 4253 - protein, 458 aa, Burkholderia fungorum
AGIQAGDRIAVMLSNRLEAVLCVLAIARAQGILVPIGERLRAPEVAHILQDSQAIALVYQETCEPQLPPAEATPLCAARFCCGTSRCGNPAFEQLLATRAQVQQLPVLTGTVEDDIFGILYTSGTTGRPKGATLTHLNVIHSCLHWVDRLGLVQEGERSVLCIPWSHVAGLCGVVFPLLYLGGALVLVKEFNKRTFLRLASEERMSHALLVPAMYGLCLLDPDLRSFDLSAWRIGVYGSAPMPEATIRRFAEAVPHLVMCNAYGATETASPATIMPPGDGLDQSDSIGKVVACGEIRVMDENGCEMPPGEPGELWIRGPMIASGYWRNPEATESAFVAGFWKSGDIGSVDSQGYVRIADRKKDMINRGGFKIYPAEVENVLCELGGVLEVAVVGRPHVILGETVVAFVRCVDVDVTDAIVREFCSEKLADYKIPDHVVIVEEPLPRNPNGKMQKEMLR

SEQ ID NO: 4254 - protein, 480 aa, Burkholderia fungorum
IKLNDQALLRQHAYINGEWQTADNGSTFTITDPSSGDLLAQVPMMGAAEARRAIHAACIAWSVWRKKTAKDRAIVMRRWFNLVLENADDLATILTAEQGKPLAEAKGEIAYAASFIEWFAEEGKRVSGDTPATPDADKRIMVTKEPIGVCAAITPWNFPAAMITRKVAPALAAGCTIVVKPAEATPLTALALAVLAERAGIPSGVLNVITGDPRAIGAELTANPGVRKLSFTGSTAIGRMLMAQSAPTIKKVTLELGGNAPFIVFDDADIDNAVEGAVVSKYRNSGQTCVCPNRFYVHDAVYDAFVEKLSKAVFELKVGSGRDPGVSIGPLISEAAVKKVEAHIADALQKGAKLEVGGARHELGHSFFQPTVLSDVTPDMMLSREETFGPLAAVSRFSSEDEVVRLANDTEYGLAAYFYSRNIARVWRLAEALEYGMVGINTGLISNEVAPFGGVKESGIGREGSRYGIEDYLVIKYLCL

SEQ ID NO: 4255 - protein, 482 aa, Burkholderia fungorum
LLGDDVWHGRIFTGSWCNGASEAEVKEPASGKRLARIGMADGALVAASAKTAFEAQQEWAALPYDERAAVLRRAARLAEESVEEIVGWIVRESGSTRAKAAFETQVTVKALHEASALPSRSAGEVLPSGPGRLSLARRRPLGVVGVISPFNFPLYLAMRAVAPALSLGNAVVLKPDPRTAVCGGFVIARLFEMAGLPNGVLHVLPGDGAAGAGLTSDPHVAMIQFTGSTNAGRKVGEAAGRHLKKVSLELGGKNSLIVLDDADLDRAVANTAWGAYLHQGQICMATGRVLVQRAIYERFVEKLVAKASSLTVGDPATDDVALGPLINGTQRDHVTRVLDAAQQAGARVEAGGSFRDLFFEPTVLTGVTKENPAFSEEIFGPVAVVVPFDTDEEAIALANDTEYGLAIAIVTSNVGRALRMGERLRSGLLHINDQTVNDEVINPFGGVGASGNGTSVGGPANWEEFTQWQWLTVKGEAPLYPL

SEQ ID NO: 4256 - protein, 390 aa, Burkholderia fungorum
REALIVSAARTAFTRSWKGSFNTTYGATLGAHAVRAALARSGVEAGAFEDVLMGCGNPEGTTGGNIARQIGLLAGLPTKVPGMTLNRYCASGLQTIALAAQRIWTGEGEVFMAGGVESISCVQKYANSFMAEDPALKASHPSSFDTMLQTAEVVARRYGITRERQDLFGVRSQQRACAAAEAGLTADEIVPVRATMTRVDPQTGEASTVDVLVDGDEGLRPATTYEALAAIKPAIEGGVVTGGNASQFSDGAAAVVVADSRYAERHGVQPLGAFSGFAVAGVEPDEMGIGPVQAVPKLLARAGLRVEDIDLWELNEAFASQALYCIDRLGLPEERVNVNGGAIALGHPYGASGTRLCAHALIEGRRRGAKYAVVTMCVGGGQGAAALLKV

SEQ ID NO: 4257 - protein, 433 aa, Burkholderia fungorum
RMERIPPGRWFRKLRLTMGMATFFDAFDSLAIAAALPALSAIWHLKPTDMGVLISVGYAGQLLGALVLGRLAEARGRTNAALISVAIFTLFSALCALAPSYTWLCACRFLQGVGLGGEVPIAAAYINEFSRAKGRGRSFVLYEASFTLGLVFSSLVGAWIVPQMGWRVLLALGAVPAVIILWARRSLPESPRWLAEHGRLAEADEVVSRIERSVEEEGKTLPPPAKAVPRPAMARTRILTRTSLVRSLSVWAMWFACYFLSYGVGTWAPTILRTALHLPLQQALLFSFVLQTLYLCGTLGTAVLVDRLGRKIYFRVAFAGVSIALFCAYSMAGNEIALMALIAGAFVFNAAISVTLYLYTPEIYPTTVRAKGSAFATSFARLASITSPLAIGAIMQHAEFSQIFLMLGLVALVIGGSGALFVTETRNRVLEDI

SEQ ID NO: 4258 - protein, 277 aa, Burkholderia fungorum
  unsure (1)..(277): unsure at all Xaa locations
MAIVKVKPTSPGRRAMVKVVNKDLHKGKPFAPLLDSQSTTAGRNNNGHITTRHKGGGHKHHYRVVDFRRNKDGIAAKVERLEYDPNRSANIALVLYADGERRYIIAPKGVTVGQQLMSGSEAPIRAGNTLPIRNIPVGTTIHCIEMLPGKGAQMARSAGTSAMLLAREGIYAQVRLRSGEIRRVHVECRATIGEVGNEEHSLRQIGKAGANRWRGIRPTVRGVAMNPVDHPHGGGEGKTAAGRDPVSPWGTPTKGYRTRSNKRTTSMIVQRRHKRXG

SEQ ID NO: 4259 - protein, 244 aa, Burkholderia fungorum
WRPFKVTQVVDESSVIRSFYLEPLDGAGLIPHAAAQHLPIRVTLPGCTKPVIRTYTLSTAPADGSYRISVKRQGLVSAHLHDTLRVGSVIEARAPAGQFTIDAAARRSAVLLAAGVGVTPMLAMLRHIVYEGLRTRRVRPTWFFHSARTLAERAFTKEIDQLAASAGGAVRVVRTLTDTEGAQMGKDFDASGRLDVELLRATLPFNDYDFYLCGPAGFMQSLYDGLRELNVADNRIHAEAFGPA

SEQ ID NO: 4260 - protein, 444 aa, Burkholderia fungorum
IDVEFPRDHMPKIYDALILEGSELTLEVQQQLGDGVVRTICLGASDGLRRGTTVKNTGKPISVPVGKPTLGRIMDVLGRPIDEAGPINSDVVRGIHQKAPAFDELSPSTELLETGIKVIDLICPFAKGGKVGLFGGAGVGKTVNMMELINNIAKEHGGYSVFAGVGERTREGNDFYHEMKDSNVLDKVALVYGQMNEPPGNRLRVALTGLTMAEHFRDEGLDVLFFVDNIYRFTLAGTEVSALLGRMPSAVGYQPTLAEEMGKLQERITSTKTGSITSVQAVYVPADDLTDPSPATTFGHLDATVVLSRDIASLGIYPAVDPLDSTSRQIDPNVIGEEHYSITRGVQQTLQRYKELRDIIAILGMDELAPEDKLAVARARKIQRFLSQPFHVAEVFTGSPGKYVPLKETIRGFKMIVEGECDHLPEQAFYMVGTIDEALRKGQE

SEQ ID NO: 4261 - protein, 562 aa, Burkholderia fungorum
LIEPKDGLSYVRGPTDIPLSEATIGQFLRDTAERFPDRPAVVFREQRIRWTWQEFVEEVDVLAAGLLALGIEKGDRVGIWSPNRVEWLLTQFATARIGAVLVNINPAYRLAELEYALNKVGCKAIIAAERFKTSMYLEMLQELAPELATQAPGELHASRLPELRYVIRMCDTETPGMLSFSDVIEEGRASLDVPTLDAIGATLSCRDPINIQFTSGTTGNPKGATLTHRNVVNNARYIAMAMRLTEQDGLCIPVPLYHCFGMVLSVLACVSVGANMVFPGEGFDPAASLAAVAEEQCTALHGVPTMFIAELDHPDFATYDLSRLRTGIMAGSPCPIETMKKVVSRMHLGEITIAYGMTETSPVSFQSSTTDPLDKRTTTVGRIQPHLEVKIVDPLGNIVPVGETGELCTRGYSVMQGYWDDEAKTRESIVDGWMHTGDLATLDAEGYCNIVGRLKDMLIRGGENIYPREIEEFLFRHPKIQSVQVFGVPDSKYGEEVCAWVVLRAGEQATAEEIQQFCQGQIAHYKVPKYIRFVDELPMTVTGKVQKFIMRERMISELKLRQ

SEQ ID NO: 4262 - protein, 300 aa, Burkholderia fungorum
LPLYRYFGGSGAMQLPVPMMNIVNGGAHANNSLDIQEFMIVPVSQPSFREALRCGAEVFHALKKILSDRGMSTAVGDEGGFAPNFGSNDECLSTILQAIEKAGYRAGEDVLLALDCAASEFYHDGKYQLAGEGLQLSSTEFADYLANLADKFPIVSIEDGMHESDWAGWKTLTDKLGKKIQLVGDDLFVTNTRILKEGIEKGIANSILIMINQIGTLTETFAAIEMAKRAGYTAVISHRSGETEDSTIADIAVGLNAGQIKTGSLSRSDRISKYNQLLRIEEDLGAIIAGYPDRSAFYTI

SEQ ID NO: 4263 - protein, 277 aa, Burkholderia fungorum
MKLKGEAVLITGGASGLGRALVDRFVAEGAKVAVLDKSAERLAELETDHGDNVLGIVGDVRSLEDQKQAASRCVARFGKIDTLIPNAGIWDYSTALVDLPEESLDAAFDEVFHINVKGYIHAVKACLPALVASRGNVIFTISNAGFYPNGGGPLYTAAKHAIVGLVRELAFELAPYVRVNGVGSGGINSDLRGPSSLGMGSKAISTVPLADMLKSVLPIGRMPEVEEYTGAYVFFATRGDAAPATGALLNYDGGLGVRGFFSGAGGNDLLEQLNIHP

SEQ ID NO: 4264 - protein, 275 aa, Burkholderia fungorum
LDRYAVIGNPVGHSKSPFIHGRFAEQTGEAIEYGRLLAPVDAFVPTVRAFIEAGGRGLNVTVPFKLEACTFADTLSPRAAAAGAVNTLRVDANGIYGDNTDGFGLVRDIEVNLGVSLKGARILLLGAGGAARGVVLPILERAPHTLTIINRTAQKAEALVDQFAQAARDAACRLGGGSARAIEAGAYDVIVNATAGSLDASLPECDDRAFGSGTLAYDMMYGAHPTVFMEHARKLGARGADGLGMLVEQAAESFYVWRGVRPDGAPVLAELRALL

SEQ ID NO: 4265 - protein, 394 aa, Burkholderia fungorum
MSAPVELHPTSIRRTVETLVHSFAASVVERDERGGTPKKERDALRKSGLLTLSIPTQYGGLGASWIETLDTVREFARIDSSIAHVYGFHHLLLATVRLFARPDQWEPWFTQTARHEWFWGNALNPLDTRTIVRKFDNWYDFSGKKSFCSGALDSEMLIASGFEETSGKLLIAAIPSSRTGITLHHDWNSFGQRQTDSGSALFEKVRVEESELLLDPGPLSTPFASLRPLLAQLIFAHLFQGIGEGVFAEIKHYTVHETRPWFSSPASHANKDQHVLRHYGEFWVELEGARLLLQHATRLFDEAWARGEALNAEARGHVAIAIATAKIAATRSGLDLSSQLFDVAGARATHGALRLDRFWRNLRTQTLHDPIDYKLQEIGEWALNDELPTPSFYS

SEQ ID NO: 4266 - protein, 457 aa, Burkholderia fungorum
LLAWLCFIVIAWVLPTPQGLTHQGRATLAVVAWVAIVWISEAIPVGISGILLPMLLVLSHAVTPFPKAASGFAAPVVFLCLAAFLFSAIMQAAGLDRRIALVLLDKLKVRSANGVIWAMFIVNFVMSLVVPAANARAAALLPVTNGIIGLFGNSARERDARKAIVIQTLVYGSMISGMCILTAHLPNMVVSGLLEKQLGLRISYFSWLRLQWPYLGMFVLTQFWVQRYFKSRGVPVPGGRQAIIEERRKLPPVARQDLTVLLVFAFVGAMWATESLHHLQSEIVALIALALMFAPGVMRFGWKDIQERTIWGTLFLLGGALSLSSAISDSGLAQWAADHIYAVAHGYVWWMTLAIVMIGTHVIRIGMLSNVAAVTMIAPIALALAPRLGLHPVAFTMLISDTDSFAYLLPTQITAGVIAYSSGQFTTADYAKVGIVSVLIAIVYGICVMAPWYAYQG

SEQ ID NO: 4267 - protein, 405 aa, Burkholderia fungorum
MSDIKKVVLAYSGGLDTSVILKWLQDNYDAEVVTFTADIGQGEELEPARKKALQLGIKPENIFIEDLREEFVRDFVFPMFRANTIYEGEYLLGTSIARPLIAKRQIEIARATGAQAVSHGATGKGNDQVRFELGYYALEPGIKVIAPWREWDLLSREKLLAYAEKAGIPIEMKHKQGGAPYSMDANLLHISFEGRHLEDPKAEAEADMWRWTVSPEEAPDQAEYLDIEYEHGDPVAINGKRLSPAEMLTELNRLGGKHGIGRLDLVENRYVGMKSRGCYETPGGTIMLKAHRGIESITLDREVAHLKDDLMPRYAALIYNGYWWSPERRALQVLIDHTQEKVNGWVRVKLYKGSVSVVARDSKETLFDKTIATFDDDGGAYNQADAGGFIKLNALRMRIAENARR

SEQ ID NO: 4268 - protein, 298 aa, Burkholderia fungorum
IRHYLQFKDFSLEDYEYVLERARILKRKFKNYETYHPLHDRTLAMIFEKNSTRTRLSFEAGIFQLGGHAVFMSTRDTQLGRGEPIEDAAQVISRMVDIIMIRTFGQDILQRFSENSRVPVINGLTNEYHPCQVLADIFTYFEHRGPIRGKTVAWVGDANNMLYTWIEAAQILGFKLRLSTPPGYKLDRAVVAAESAPFYEEFDDPNEACAGADLVTTDVWTSMGFEAENEARKKAFADWCVDADMMARANPDALFMHCLPAHRGEEVSAEVIDGPQSVVWDEAENRLHVQKALMEYLL

SEQ ID NO: 4269 - protein, 353 aa, Burkholderia fungorum
MKTYRIATIPGDGIGKEVIPAGAQVLEALARTSKSFAFEFENFGWGGDYYREHGVMMPADGLDAIRNKDAILFGSAGDPDIPDHITLWGLRLKICQGFDQYANVRPTRILPGIDGPLKRCKPGDLNWVIVRENSEGEYSGVGGRVHQGHPIEAATDVSILTRAGVERIMRFAFRLAQSRPRKLLTVITKSNAQRHAMVLWDEIALEISKEFPDVKWDKELVDASTARMINRPATLDTIVATNLHADILSDLAAALAGSLGIAPTGNIDPERRYPSMFEPIHGSAFDIMGKGLANPVGTFWSVVMLLEHLGEFDAAQRVMQAVEAVTADTSLHTGDLGGTATTAQVTAAVCAFI

SEQ ID NO: 4270 - protein, 234 aa, Burkholderia fungorum
TRRPRRGERAPGLDRVTFEEMLEMASLGSKVLQIRSVEFAGKYQVKTRVLSSLTDPLIPLDAEMKSGTLITFEEDETMEKAVISGIAFQRDEARIAVMGVPDKPGIAYQILGPVADANIDVDMIIQNQSVDGKTAFTFTVGRGDYQRAMDILTGQVKGHVQAEQVLGDPKVSKVSVVGVGMRSHVGIASTMFRTLSEEGINIQMISTSEIKISVLIDEKYMELAVRALHKAFEL

SEQ ID NO: 4271 - protein, 252 aa, Burkholderia fungorum
MGFLAGKRILLTGLLSNRSIAYGIAQACRREGAELAFTYVGERFKDRIKEFAGEFGSDLVFPCDVADDAQIDALFASLKQHWDGLDGLVHSIGFAPREAIAGDFLDGMTRENFRIAHDISAYSFPALAKAAQSMFTPDASLLTLSYLGAERAIPNYNTMGLAKASLEASVRYLAVSLGAKGVRVNGISAGPIRTLAASGIKGFGKILEFVEQNAPLRRNVTIEQVGNTAAFLLSDLAAGVTAEIVHVDSGFN

SEQ ID NO: 4272 - protein, 357 aa, Burkholderia fungorum
RVFNFSAGPAAMPEEVLRQAADEMLDWQGSGMSVMEMSHRGKEFMSIHEEALVDLRDLLQVPASHRILFLQGGGLGENAIVPMNLMGAKPRADFVVTGSWSQKSFREAQKYGTVHLAASGQTADGFTRAPARSEWQLSDDPAYVHLCTNETIHGVETFEIPDLGDIPLVADASSHILSRPMDIAKYGVLFGGAQKNIGMAGVTVVVVREDMLDRAQPICPSAFEWKIVAENNSMYNTPPTYAIYIAGLVFKWLKKQGGLAAMEARNLEKSKLLYDAIDASSFYLNKVERGSRSRMNVPFFLADESRNEDFLAGAKARGMVQLKGHKSVGGMRASIYNAVPLEGVKALVEYMKEFEQR

SEQ ID NO: 4273 - protein, 365 aa, Burkholderia fungorum
FGPSYVRAIAPYVAGKPISEVAREFDLDEKTIVKLASNENPLGMPESAQRAMAQAASELGRYPDANAFELKAALSKRYGVPADWITLGNGSNDILEIAAHAFVEKDQSIVYAQYSFAVYALATQGLGARAIVVPAVGYGHDLGAMLAAITDDTRLIFVANPNNPTGTFIEGAKLEAFLDKVPRNVVVVLDEAYTEYLPQEKRYDSIAWVRRYPNLLVSRTFSKAFGLAGLRVGFAIAQPELTDLLNRLRQPFNVNTLAQAAAIAALNDRAFLEKSAVLNAQGYRRLTEAFDKLGLEYVPSDGNFVLVRVGNDDAAGNRVNLALLKQGVIVRPVGNYGLPQWLRVTIGLPEENEAFVAALEKALAT

SEQ ID NO: 4274 - protein, 415 aa, Burkholderia fungorum
MEFLDLGPFSRASGTIRLPGSKSISNRVLLLAALAEGETTITNLLDSDDTRVMLDALEKLGVRLKRDGDTCVVTGTRGAFTARTADLFLGNAGTAVRPLTAALAVNGGDYRIHGVPRMHERPIGDLVDGLRQLGAKIDYEENEGYPPLRIRPGQINADAPITVRGDVSSQFLTSLLMTLPLVRTGSGVSTVQVDGELISKPYIEITLKLMERFGIKVERHGWHQFVVPAGQRYQSPGSIMVEGDASSASYFLAAGALGGGPLKVEGVGRASIQGDVGFADALIRMGANLQMGDDWIEVRGVGHDSGKLEPIDMDCNLIPDAAMTIAVAALFADGATTLRNIASWRVKETDRLAAMATELRKVGAKVKEGEDFIIIEPPEKLIPNAAIDTYDDHRMAMCFSLVSLGGVPVRINEPK

SEQ ID NO: 4275 - protein, 373 aa, Burkholderia fungorum
LRNDAAVGIIGAGTMGAGIAQIAAAAGHRVLLFDARSGAAAQALDKLNADLKKRVDAGKLDSTDARALVARIEPVDAIAAVSEAGIVIEAIVERLDAKRELLAQLESLVADRTILASNTSSISVTALGRDLRLPQRLVGMHFFNPVPVMKLVEVVSGAATDSAVAHAVADLAVRWGKVPIHARSTPGFVVNRIARPFYAEALLLLQDQYATPSQIDAALRAAGFRMGPCELMDLIGHDVNFSVTESMFAASFFDRRYTPSIVQRELVDGGLLGRKSGRGFHDYPAEPLAEAAAMPAQVDTDPPCVSVSGDSFTIATLGAELSGEGWDVEYADPAGASLGRTDNILMKDTLLAGDTLICVTDGRPAAQIAAQSG

SEQ ID NO: 4276 - protein, 259 aa, Burkholderia fungorum
MDMGIAGRTALVCAASKGLGRGCAEALAAEGVDLTIVARTAETLEATAAEIRKQSGVEVKTVACDITTPEGRAAALAACPQPDILVNNAGGPPPGDFRNFTHEDWIRALESNMLTPIELIRATIDSMSARGYGRIVNITSSAVKAPIDVLGLSNGARSGLTGFVAGLARKVAPTGVTINNLLPGIFDTDRIAVTFAAQARSQNISVDQARQQRMKTIPAGRFGNRDEFGRACAFLCSVHAGYITGQNWLIDGGAYPGTF

SEQ ID NO: 4277 - protein, 285 aa, Burkholderia fungorum
MNLTIIGSGYVGLVTGACLADIGHDVFCLDVDQRKIDVLNNGGVPIHEPGLQEIIARNRKAGRLKFSTDVEAAVAHGDIQFIAVGTPSDEDGSADLQYVLAAARNIGRHMTGFKVIVDKSTVPVGTASRVRDVIAAELAGRNAAHMFSVVSNPEFLKEGAAVEDFTRPDRIVLGCDEDVPGEKARELMKRLYAPFNRNRERTLYMDVRSAEFTKYAANAMLATRISYMNELANLADRVGADIEAVRRGIGSDPRIGYDFLYAGCGYGGSCFPKDVQALIRTAADH

SEQ ID NO: 4278 - protein, 240 aa, Burkholderia fungorum
SKVAAITGAAGGLGTGIAKRLAGLGASVALLEPGIERLVSLASELTDSGATVLNVACNVTDAASTRYAAAQVLSSFGRIDVLVNNAGVLARPSALESISLEDWDRSLAVNLTGALLCTASFGAAMLEAGAGSIVNIASIAAYSPNTSVAYSVSKAGLLALTRHTAVEWAPRGIRANSVSPGFIRTPLSEVHYANPDLLQLRTQATPVRRLGTVDDVAAIVGFLASPASAFINGEDIVADG

SEQ ID NO: 4279 - protein, 260 aa, Burkholderia fungorum
RICVVTGGASGIGAAICRAFDAQGAKLAVLDVDRDSGETFARSLRGAVFIECDVADAASVKRAFERIAQRWDRTDVLVNNAGIVGREEYGRVQTRRVQQIEDVRSGRKPGPLRATVSLTDEQWRRMIDIHLNGTFYCTREALLQMERLGQGAIVNMSSIAGLDGGFGNPHYAAAKAGILGFTRAVAKEAIQQGIRVNAVAPGFVDSPLRRSLSEALQQLQIAATPMGRAATGDEIASLVLFLASDDASYLVGETISPNGG

SEQ ID NO: 4280 - protein, 599 aa, Burkholderia fungorum
VKNRKLVDWVQRVAAMTKPDRIVWCDGSQEEYDRLCAQMVEAGTLKKLNPAKRPNSYLAWSDPSDVARVEDRTFICSQQREDAGPTNNWVAPAEMRSTLGGLFEGAMRGRTMYVVPFSMGPLGSPIAHIGVELSDSPYVVTNMRIMTRMGRKVYDVLGEDGEFVPCVHSVGAPLAAGEKDVPWPCNATKYIVHFPESREIWSYGSGYGGNALLGKKCFALRIASTMGRDEGWLAEHMLILGVTSPEGRKHHVAAAFPSACGKTNFAMLIPPEGLNGWKISTIGDDIAWIKPGKDGRLYAINPEAGYFGVAPGTSEKTNFNAMATLKENVIFTNVALTDDGDVWWEGMTDEPPAHLIDWQGKDWTPAGAKQSGRKAAHPNARFTAPASQCPSIDADWENPAGVAIDAFIFGGRRSTTVPLVTEARNWVEGVYMAATMGSETTAAAAGQQGVVRRDPFAMLPFCGYNMSDYFGHWLKTGERLEQLGAKLPKIFCVNWFRKGADGKFVWPGFGENMRVLSWMVGRVEGSAQGAEHAFGVSPHYEDIDWSGLNFSREQFEQVISVDDAAWRDELALHAELFDTLQHGLPPALTQAKRTLEGKL

SEQ ID NO: 4281 - protein, 647 aa, Burkholderia fungorum
MSKALIIAEKPSVANDIARALGGFTKHDEYYESDEYVLSSAVGHLLEIAAPEDYEVKRGKWSFANLPVIPPHFDLNPIAKSESRLKVLTKLLKRKDVDRLINACDAGREGELIFRLIAQHAKARQPVQRLWLQSMTAGAIRDGFARLRSDEEMQPLADAARCRSEADWLVGINGTRAMTAFNSKGGGFFLTTVGRVQTPTLSIVVEREEKIRRFVPRDYWEVKAEFVCSAGFYEGRWFDPKFKRDEFDPEKRDSRLWSLPAAETIVAACRGQIGTVTEESKPSTQLSPALFDLTSLQREANGRFGFSAKNTLGLAQALYEKHKVLTYPRTDARALPEDYMDTVKETLGMLKESNNYLPFAKQVLDKGWVKPNKRIFDNSKISDHFAIIPTLQAPKNLSEPEQKLYDLVVKRFLSVFFPAAEFKVTTRITEVVGHHFKTEGKVLVEPGWLQVYGREISGEDANLVPVQKDEKVKTDRIAAQQLVTKPPARYNEATLLSAMEGAGKLVEDDELREAMAAKGLGTPATRAAIIEGLLGEKYLIREGRDLIPTAKAFQLMTLLRGLGVKELTAPELTGEWEYKLSQMERGNLPRDAFMQEIARMTQTIVKRAKEYDSDTIPGDYATLETPCPNCGGQVKENYRRFACSKCE

SEQ ID NO: 4282 - protein, 458 aa, Burkholderia fungorum
GERVTRPRTLDVFDPYTGTRVGTVPLASVDDVRAAFEYAAAYQAQLTRYERSQILERAASIMRERTEEASDLISLESGLSKQDSRYEIGRVADVLKFASIEALRDDGQSFSCDLTPHGKKRRVFSQREPLAGVIVAITPFNHPMNQVAHKIAPAIATNNRVLLKPSEKVPLSALYLADVLYEAGLPAPMLQVLTGDPREIADELITHPLAELVTFTGGVAIGKYIAARAAYRRVVLELGGNDPLIVLDDADLERAATLAVQGSYKNSGQRCTAVKRMLVQKSVAADFTDLVVEKTRAWTFGDPFDASSQMGTVIDVAAAQLFEARVNEAVASGARLLTGNQRNGALYAPTVLDGVDPSMTLVREETFGPVSPIITFDTLDDAIRISNGTAFGLSSGVCTNRQDAITRFINELRVGTVNVWEVPGYRIELTPFGGIKDSGLGYKEGVQEAMKSFTNLKT

SEQ ID NO: 4283 - protein, 350 aa, Burkholderia fungorum
LAFDALCMATPADALTLPEIAPDTPALLLFTSGSTGRPKVVQLTQAALLNNALGVIDMSALNSEDRLLHVMPIYHTNGVNNQLFAPLLAGSTVLFCSRFRAADMPALLNSYRPTIITGVPTMYSRMLSQSFDTEALAGLRMARCGSAPITETLHREVEAKLGCPLVVSYGLSEATCTSTLNPPQARRIGSVGKVLAGQTVELRAPDGSMSATPGVEGEICIGGANLMSGYLGAPDATARAVTDNWLRTGDLGRFDDDGYLNITGRIKDVIIRGGENLSPLLIESAIVGVTAVSACCVVGMAERDLGEVPVAFVVADEAASGLSVELIQNAVRERISRIFVPHEVFFANTL

SEQ ID NO: 4284 - protein, 254 aa, Burkholderia fungorum
  unsure (1)..(254): unsure at all Xaa locations
DYSNMKNILIVGATSAIAIACARKWASEGARFFLVARNGERLQQIADDLTSRGAQLAACHQLDIDSLDRHAGMLXRAVQEPXXXGXXXASXXXVLVAPGTLPDQARCPSDPAWLVLEFNTNAVSVIALLTPIANILEAQKRGALAVISSVAGDRGRPSNYLYGSAKAALSAFCEGLNARLFKSGVHVMTVKPGFVATPMTAGLPLPGPLVATPDQVATDIVRAVEKRKDVLYTRWFWAIIMLIIRCVPRFLFKR

SEQ ID NO: 4285 - protein, 467 aa, Burkholderia fungorum
ANPKHVADPTRLRNQNLIGGQWKAALSGQSIAVENPANEEIIAQVPRGQQEDIDEAVKVARATFESAAWRKIRPIDRGRILENIARKVEEHAEELSWLESLDTGKAISFARVIDLPSTVDVFRYMGGWCSKLGGTTPPISFDGKEYHAYTRREPVGVVGAITPWNYPLALGSWKIASALAAGCTMVLKPTELTPLSTLRLAELCLEAGLPEGALNVVNGYGHEAGEALARHPDIDKITFTGSTVVGKKIVEYALGNMKRVTLELGGKSPSIVFDDADLDQVGLGAALAVFFNSGQICFAASRLFVQASVYDRVVEAVAAVASQFKVGNGQDTDTMLGPLVSRKQQERVLGYVQSGIEQGASLIYGGQKIGDKGYFLQPTVFADADQSMKIAQEEIFGPVVSIIRFKDEVEAIRLANDTTYGLAANIWTRDIKKAHRVAHRLQAGSVWINCHGVIDPAAPFGGFKQSG

SEQ ID NO: 4286 - protein, 252 aa, Burkholderia fungorum
MRLEGKVAIITGAATGIGNAIARAYVAEGAKVVIADLKGAEAAASELGAGIALGIYANVADPDSTRQMAAAAVERFGKIDVLVNNAGIFTGLSGVPMEGITVEDWDKLYAVNVKGPWLCTSAVSAAMREGGGGKIINIASVIAHVGVPFMLHYVSSKGAVAAMTRAMAREFAATKAGITVNAISPGYTHSANAVANTQQHEQFEGVAAQMRTIGRPQVPEDIAGAALWLASDEASYVNGQNIIVDGGIFMSL

SEQ ID NO: 4287 - protein, 523 aa, Burkholderia fungorum
MKTVQHAAYEILRRHGLTTIFGNPGSNELPFLKHFPSDFRYILGLHEGVVTGMADGYAQATGNPAFVNLHSAAGTGNAMGALANAWNSHTPLVVTSGQQVRSTIGMEPLLANVDAVNLPRPLVKWSTEPASAEDVPRSFAQAIHIARTPATGPVYLSIPYDDWDQPAPEYAHYLAAREVQHAGLPSEAILQALADRLQRATNPVLVLGPDVDAQHANESAVALAERLKMPAWMAPSAPRCSFPTTHACFRGVLPAGIASISRLLDGHDLILVVGAPVFRYHQYEPGALLPAGAELVSITCDVLEAARAPMGDAIVADIALTLEALAARAEPAARPMPVAVARPAAAAETPGPLAPERVFDIVDAIAPRDAIYVNESTSTTNLMWQRLRMTSQGSYYFAAAGGLGFAMPAAAGIQLAQPGRRVIGIIGDGSANYGITALWTAAQYSIPTIFIIMKNGTYGALRWFAGVLGVEDVPGLYVPGIDFCALARGYGVEALHADSGASLTVALERALSSSRPTLIEVET

SEQ ID NO: 4288 - protein, 487 aa, Burkholderia fungorum
MIIESGHLTLAQLRRIAHFSETVQLCPSTFAAIDASAQAVENIVRKGKPVYGVNTGFGRLASTHIPLEQLDLLQRNLVLSHAVGVGEPMSRSVVRLMIVLKVSSLARGHSGIRREVIAALVTLLNADVLPVIPVKGSVGASGDLAPLAHMSAVLLGVGEVTIGERRASANEGLHAAGLEPFTLRAKEGLALLNGTQASTALALFNMFAIEDLFCTALVAGALSVDAAAASVVPFDARIHALRGHQGQIDSAAAYRALLEGSEINLSHSDCDKVQDPYSLRCQPQVMGACLHQMRHSAEVLLCEANSVSDNPLIFPDTCDVLSGGNFHAEPVAFAADNLALAVAEIGALAERRIALLIDTTLSGLPPFLVRDSGLNSGFMIAHVTAAALASENKTLAHPASVDSLPTSANQEDHVSMATFAARKLGDMASNTAHILAIELLAATQGIDLREPHRTSMRLQSVTEAVRRDVGHYHSDRHFSPDIAAIAA

SEQ ID NO: 4289 - protein, 249 aa, Burkholderia fungorum
KVAILTGAASGIGEAVARRYLDEGAKCVLVDVKPADSFGDALRAAYGDRVLTVSADVTRRDDIERIVASTLERFGQIDILFNNAALFDMRPILDESWDVFDRLFAVNVKGMFFLMQAVARKMVEQGRGGKIINMSSQAGRRGEALVSHYCATKAAVLSYTQSAALALAPHKINVNGIAPGVVDTPMWNEVDALFARYENRPLGEKKRLVGEAVPLGRMGVPDDLTGAALFLASADADYITAQTLNVDGG

SEQ ID NO: 4290 - protein, 366 aa, Burkholderia fungorum
MKTKAAIAWKAGAPLTIEEVDLEGPRAGEVLIEVKATGICHTDYYTLSGADPEGIFPAILGHEGAGVIVDTGPGVGTLKKGDHVIPLYTPECRQCKFCLSRKTNLCQAIRSTQGKGLMPDSTSRFSIDGKPLFHYMGTSTFSNYIVVPEIAVAKVREDAPFDKICYIGCGVTTGVGAVVYSAKVEAGANVVVFGLGGIGLNVIQGAKMVGADRIIGVDINSGRVELAKKFGMTHFINPTEVENVVDHIVQLTDGGADYSFECIGNTKVMRQALECTHKGWGQSFIIGVAAAGEEISTRPFQLVTGREWKGSAFGGARGRTDVPKIVDWYMEGKINIDDLITHRLPLERINEGFDLMKKGESIRSVV

SEQ ID NO: 4291 - protein, 423 aa, Burkholderia fungorum
FLGIDLGTGSLKVAIVDENGREQAVASVAYAIETPHAGWAETSVQTWWRALCEAAARLPDGLRREVRAIGFSGQMHGVVLIDEAGEAVRPAMLWPDTRALALLDAWPEPQPNPVAPGMAGPLLRWIVLHEPQSASRTRWALQPKDWLRVALGGAVVTDPSDACATALADPAGMWDAALLDRLGIPRAWFAPLAPSYAAGGVLSEKAAQALGLRPGIVLATGAADTPCAALGSGLAHDGDALLTTGTGGQIVVLAECAPAAARGLHRYRAASDHWYRMAAMQNVGIALERVRGWLSYEWADAYRDAFGDAAGASTTAASGLTFLPYLTGERTPWLNPMARGGWLGLALDHTRGTMMRAAFEGVAFSLRAGLDAIRASGATVTALKLAGGGSIDAHWRQLLADALNVELHAVDCPNAAPRGAAIL

SEQ ID NO: 4292 - protein, 375 aa, Burkholderia fungorum
KPKKSVALSGVTAGNTALCTVGKTGNDLHYRGYDILDIASACEFEEIAYLLVHEKLPTQAELTAYKTKLKALRGLPANVKAALEWIPAAAHPMDVMRTGVSVLGTVLPEKDDHNLPGARDIADRLMASLGSMLLYWYHYSHNGKRIEVETDDDSIGGHFLHLLHGVEPSNAWVDAMHVSLNLYAEHEFNASTFTGRVIAGTGSDIYSALTGAIGALRGPKHGGANEVAFEIQSRYQTPDEAEADIRRRVENKEVVIGFGHPVYTISDPRNKVIKEVAKKLSKEAGNTRLFSIAERLESVMWDAKKMFPNLDWFSAVSYHMMGVPTAMFTPLFVIARTAGWSAHIIEQRIDNKIIRPSANYTGPENLKYLPLNRRK

SEQ ID NO: 4293 - protein, 327 aa, Burkholderia fungorum
MAKPAKRVAVTGAAGQIAYSLLFRIANGDLLGKDQPVILQLLDLPQAQGAVKGVVMELDDCAFPLLSGVVITDDPKVAFKDADVALLVGARPRSKGMERKDLLSANAEIFTVQGKALNEVASRDVKVLVVGNPANTNAYIAMKSAPDLPKKNFTAMLRLDHNRALSQLAAKSGKPVASIEKLAVWGNHSPTMYPDFRVATAEGQDLTKLINDEEWNRNTFIPTVGKRGAAIIEARGLSSAASAANAAIDHVRDWVLGTNGKWVTMGIPSDGSYGIPEDIIYGVPVTCENGEYKRVEGLEIDAFSREKMDGTLQELLEERDGVQHLLG

SEQ ID NO: 4294 - protein, 584 aa, Burkholderia fungorum
LPRRKFDVVIVGAGGSGMRASLQLARAGLSVCVLSKVFPTRSHTVAAQGGIGASLGNMSEDNWHYHFYDTIKGSDWLGDQDAIEYMCREAPNAVYELEHFGMPFDRNADGTIYQRPFGGHTANYGEKPVQRACAAADRTGHALLHTLYQQNVAAKTQFFVEWMALDLIRDAEGDVLGVTALEMETGDVYILEGKTTLFATGGAGRIFAASTNAFINTGDGLGMAARSGIALQDMEFWQFHPTGVAGAGVLITEGVRGEGGILRNSNGERFMERYAPTLKDLAPRDFVSRSMDQEIKEGRGVGPNKDHVLLDLSHIGAETIMKRLPSIREIALKFANVDCIKEPIPVVPTIHYQMGGIPTNIHGQVVGTSKGAEDPVNGFYAVGECSCVSVHGANRLGTNSLLDLVVFGRAAGNHIVKHVKEIKEHKPLPADAADFALSRLAKLDSSSSGEYAQSVANDIRGTMQKHAGVFRTSALLAEGVERIREVADRVDNIHLKDKSKVFNTARIEALEVANLIEVARATMVSAEARKESRGAHAQDDFEHRDDENWLRHTLWFSKGDRLDYKPVHMQPLTVESVPPKARTF

SEQ ID NO: 4295 - protein, 234 aa, Burkholderia fungorum
MAKRTFEIYRYDPDKDAAPRMQTYEIEIDSHERMLLDALLKLKAMDETLSFRRSCREGVCGSDAMNINGKNGLACLTNLNDLPQKIVLRPLPGLPVVRDLICDFTQFFNQYHSIKPYLINDTPPPEKERLQSPEERDELDGLYECILCASCSTSCPSFWWNPDKFVGPAGLLQAYRFIADSRDEATGERLDNLEDPYRLFRCHTIMNCVDVCPKGLNPTKAIGKIKELMVRRAV

SEQ ID NO: 4296 - protein, 425 aa, Burkholderia fungorum
TLSFSDNSPSVEMPIYKGTLGPDVIDIRKLYGQTGKFTYDPGFMSTAACNSAITYIDGDKGELLYRGYPIDNLAENADFLETCYLLLKGELPNAQQNAEFVKTVTNHTMVHEQMHFFFRGFRRDAHPMAILVAAVGALSAFYHDSLDINNPRHREVSAIRMIAKLPTLVAMAYKYSIGQPFAYPKNDLSYSANFMHMMFSNPCEEYKVNDVLVRALDRILILHADHEQNASTSTVRLAGSSGANPFACIAAGIACLWGPAHGGANEAALNMLEEIGSVDNIPEFIKQVKDKNSGVKLMGFGHRVYKNYDPRAKLMRETCHEVLEELGLHDDPLFKLAMALEKIALEDEYFVSRKLYPNVDFYSGIVQRALGIPTSMFTCIFAMARTVGWIAQWNEMIADPEQKIGRPRQLFIGDTQREAKPIAQR

SEQ ID NO: 4297 - protein, 407 aa, Burkholderia fungorum
RFHYGWLTVAVVFLVLLAAAGTRATPSVMMVPLEHQFGWSRATISLAISVNIALYGLMGPFAAAAMQRFGVRPTLLAALGTMAAGVALSSLMTHPWQMVLIWGVMVGGSTGVAALSLSATVVTRWFTTRRGLVMGILTASSATGQLVFLPMLAAIAEHDGWRQVVWTVAIAAAIVIPLVAFLLPERPSDMKLRPYGEPHDTPINGTVTRQNPLAIAFGTLAMASKTRDFWLLFFSFFICGASTNGYVGTHLIAMCGDYGMTEVQGASLLAAMGIFDLFGTTLSGWLSDRFNSRVLLFWYYGLRGLSLMYLPHAFGIDFFGLPLFAVFYGLDWIATVPPTVRLATDVYGKEAAPVVFGWVVAGHQLGAAFAALGAGMLRASLGTYTVASMISGGLCLVAAVIVLRINR

SEQ ID NO: 4298 - protein, 288 aa, Burkholderia fungorum
RRVYMQEVGTRDGFQSEGIFVETRDKIALIDMLSKTGMAKIEVTAFVSPQAIPALRDAEIVLREIERNPGVIYTALVPNVRGAERAIDAHADELNLVMSASESHNLSNLRMTRDQSFNALKQVAAIARDAGLPVNISLSCAFGCPMEGDVSASTVLEWAERFVEEIGSRGVTLCDTTGMAYPRQVAELTSQCVERWPQTELTLHFHNTRGMGLANVLAAIDAGANRFDASLGGIGGCPYAPGASGNVCSEEIVHALELMGYDTGVDLDALIAAARCLPPLIGHDTPSQ

SEQ ID NO: 4299 - protein, 688 aa, Burkholderia fungorum
MEPATSPRTLLDKLWQSHVVAETPNGPTLLYVDRHLVYEVTSPQAFEAIRLSGRKPWRPETVLAVADHNVPTIAAERTSMDAIADPLSRIQVAQLDKNCKEFGIKSYGIRNPQQGIIHVVGPELGATLPGMTVVAGDSHTSTHGAFAALAFGVGTSEVEHVLATQCLSVGKMKSMLVNVEGVLPVGVTAKDVILAIIRRTGTAGGTGYAMEFAGSTIRTLSMEGRMTLCNMAIEAGARVGLIGVDDVTIDYVKGRPFAPAEAHWDAAVAYWRTLVSDADARFDKIVNIDATQLRPMVTWGTSPEMVVTVDDAVPNPLDDPDPVRRATMAGALTYMGLEPGTSLKSISLDKIFIGSCTNARIEDLRAAAAIVKGRHVAPTVQLALVVPGSGLVKAQAEAEGLDAIFKEAGFEWREPGCSMCLGMNDDRLRPGERCASTSNRNFEGRQGPGGRSHLVSPAMAAAAAIAGHFVDVSHGGLLVQPFTKLEALVVPLDRVNVDTDAIIPKQFMKSVQRNGFGINLFDEWRYFDHGEPGQDPSTRRLNPDFVLNQPRFAGAEILLTRDNFGCGSSREHAAWALWDFGIRALIAPGFADIFYGNCFKNGMLPIKLDERIVQQLFDLVGRTPGLRLAIDLEAQRIQPPAGDAIPFDVEPERKRRLLNGLDDVALTLQQTDQIRAYERNRRAHEPWL

SEQ ID NO: 4300 - protein, 347 aa, Burkholderia fungorum
WSDIVHRLTPYVPGEQPVVTHPVKLNTNENPYPPSPRVLEAIRQELGDAAESLRRYPDPTAQKLRETVAAYHGIRAEQVFAGNGSDEVLALTFQALLKHDKPLLFPDVTYSFYPTYARLFEVDYRTIPLDDSFTIHVDDYMSPNGGILFPNPNAPTGRPLPLADIERLVASSPDSVVVIDEAYVDFGAQSAIGLIDRYPNLLVVQTVSKSRSLAGMRVGFAFGNPDLIGALNRVKDSFNSYPLDRLAQAAAAAAYEDDAWFRDTCAKVVASRERLAAGLTALGFEVLPSAANLLFARHEGYDAATLALRLRDKEIFVRHFKAPRIDQHLRISVGTDAECDILLDALR

SEQ ID NO: 4301 - protein, 214 aa, Burkholderia fungorum
NMKLYSYFRSSASYRVRIALNVKNLPYEYVPVHLVREGGEQLKPEYRKVNVDCVVPTLVEGNDVMPQSLAIIEYLEETHPEPPLLPKAPVDRAYVRALALQVACEIHPLNNLRVLKYLKHTLGVDDYAKDAWYRHWVEAGFATFEAHLAGDSRTGKLCFGDTPTIADTCLIPQVFNAQRFKVDTAKFPTIQRIYDHAMQLDAFARAAPDVQPDA

SEQ ID NO: 4302 - protein, 643 aa, Burkholderia fungorum
VELEIDGKKVEVPEGSMVIQAAHKVDTYIPHFCYHKKLSIAANCRMCLVDVEKMPKAVPACATPVSAGMIVRTKSDKAVKGQQAVMEFLLINHPLDCPICDQGGECQLQDLAVGYGKSASRYSEEKRVVFHKNVGPLISMEEMSRCIHCTRCVRFGQEVAGVMELGMLGRGEHSEITSFVGKTVDSELSGNMIDLCPVGALTSKPFRYSARTWELSRRKSVSPHDSVGANLVVQVKNNRVMRVLPFENESINECWISDKDRFSYEGLNSPERLTQPMLKQGGKWVETDWQTALEYVVKGLKGIKGDHGANALAALGSAHSSVEELFLLKQLAQAVGTPNVDFRLRQSDFSAPVNGAPWLGTAIADLSNVDAALVIGSDLRRDHPLFAARLRQAAKGGAKLTLVQATNDDALIPQAQRVVAAPSAWLDALAGIAGAVSEAGGVALPEAFAGTQPSDADKQVAKSLATGERRLVLLGNGAVRHPDFAVIQAAAQWIADATGATQGFLTEAANTVGAHLVNALPGEGGLNAREVFEQPRKGYVLLNVEPEFDTANPAQALAALKQAEMVVVLSPFQTGADYADVLLPIAPFTETAGTFVNAEGTVQTFNGVVRPLGDTRPAWKVLRVLGSLLGLPGFEFETSEEVR

SEQ ID NO: 4303 - protein, 156 aa, Burkholderia fungorum
TIRAATPADTGAIFALTYELAEFESLTHVFVATEEGLHDALFGARPSIEALVAENESRIVGYALFFHNYSSFVGKRGLYLEDVYVQPSQRGSGLGTALLRRLAALAVERQCGRFEWTVLDWNRQAISFYEKMGATVMPDWRVVRLTGNALEQLAAG

SEQ ID NO: 4304 - protein, 265 aa, Burkholderia fungorum
MDLGLKDKVVLITGGSKGIGLACARAFALEGAKVAIVSRDPANLARAYEQLKHEGLHVHRTRADLHEPHSAADIVEEVSTAVGPIDVLINSAGAARRYDPETLDAEAFRATMEAKYFPYIYPQQEVLRRMAERAKSGSGGEPGTIVNIIGMGGKIASDIHIAGGAANAALMLATVGLAHYYARYGIRINAINPGATLTERVEEAVKLEATQQGIGSAEALARGQARVPLGRFAKPEEIADVALFLASRRASYVTGAIVPMDGGSA

SEQ ID NO: 4305 - protein, 323 aa, Burkholderia fungorum
YSRVLGTGSYLPPNRVTNQDLAKRLAEQGIETSDEWIVARTGIHARYFAEPDVTTSDLAFIASQRAIEAADIDPQSIDLIIVATSTPDFVFPSTACLLQNKLGIRNHGAAFDVQAVCSGFAYAVATADSFIRSGQHRTALVIGAETFSRILDFKDRTTCVLFGDGAGAVILQASDEPGVLASALHADGSHSNILCTPGNVNGGVVSGSAFLHMDGQAVFKLAVNVLEKVAVEALEKANLSAEQIDWLIPHQANIRIMQSTCRKLGLPQERMIVTVGEHGNTSAASIPLALDVAVRDGRIKRGQNVLIEGVGGGFTWGASVIRY

SEQ ID NO: 4306 - protein, 297 aa, Burkholderia fungorum
MKFAFVFPGQGSQSVGMLNAFADQAVVRETVQEASDALNQDLGKLIAEGPAEDLNLTTNTQPVMLTASYAMYRAWLQAGGPKPAIVAGHSLGEYTALVAAGAIAFRDAVPLVRFRAQAMQTAVPVGEGAMAAILGLDDDTVRAVCAEASVAGVVEAVNFNAPAQVVIAGNKAAVEKACEVAKAKGAKRALPLPVSAPFHSSLLKPASDQLREYLASVDVQVPAIPVINNVDVAVVNEPAAIKDALVRQAAGAVRWVESVQAMSAQGVTHVIECGPGKVLAGLTKRIDGNLVGASIFD

SEQ ID NO: 4307 - protein, 248 aa, Burkholderia fungorum
MEKTLDKQIAIVTGASRGIGRAIALELARQGATVIGTATSESGAAAISEAFNAAGASGRGAVLNVNDAAAAEALIDGTVKEFGALHVLVNNAGITQDQLAMRMKDDDWDAVIDTNLKSVFRLSRAVLRPMMKAKGGRIINITSVVGSAGNPGQVNYAAAKAGVAGMTRALAREIGSRGITVNCVAPGFIDTDMTRTLPEEQQTALKTQIPLGRLGSPEDIAHAVAFLASPQAGYITGTTLHVNGGMYM

SEQ ID NO: 4308 - protein, 78 aa, Burkholderia fungorum
MDNIEQRVKKIVAEQLGVAEAEIKNEASFVNDLGADSLDTVELVMALEDEFGMEIPDEEAEKITTVQQAIDYARANVK

SEQ ID NO: 4309 - protein, 411 aa, Burkholderia fungorum
VSRRRVVVTGLGLISPVGNNVADGWANLVAGKSGIANITKFDASNFSTRFAGEVKGFNIEDYIPGKEARHMDTFIHYGVAAGIQAMQDSGLEVTDENSERIGVVVGSGIGGLPMIEVTQTELLNRGPRRISPFFVPASIINMISGHLSIKFGIKGPNLAIVTACTTGLHCIGEASRLIEYGDADVMIAGGAESTVSPLGVGGFAAARALSQRNDDPATASRPWDKDRDGFVLGEGAGVMVLEEYEHAKARGAKIYAEVSGYGMSGDAYHMTAPLEDGDGARRCMLAALKNAGINLDQVNYLNAHGTSTPLGDLAETTGIKRAFGDHAKDMVVNSTKSMTGHLLGGAGGLESVFTVLAVHHQVSPPTINIFNQDPACDLDYCANTAREMKIDVALKNSFGFGGTNGTLVFKR

SEQ ID NO: 4310 - protein, 353 aa, Burkholderia fungorum
TPGAPARMPDDYSLILYTSGTTGKAKGVPRRHRHERAAALAHVAQNLYGHGERTLGVMPLYHTMGVRSLLSMALVDGLFVCVRRWNARFALDAIAQHKLTCLYLVPTLYHDLLADAAFASTDTSTVKKLGFAGAPMNDGLLKRLSAAFEPELFVNHYGSSEVYTFSIDQDATKKPGSAGRAGINTRLRVVRLEAHTPEDLAQAGEEGQIIADLLGDEAFEGYWNRPDANAKSLRDGWYFTGDTGFFDAQGDLYVSGRVDDMIISGGENISPVDIESVLSLHPAVDEVAVAGVKDERWGQRVVAFVKRREYVDADTLDAYCRTSNLVNFKRPREYVFVDDIPKSPVGKILRRKL

SEQ ID NO: 4311 - protein, 421 aa, Burkholderia fungorum
  unsure (1)..(421): unsure at all Xaa locations
DETNAMPFDVVSIIGLGYIGLPTAAAFAARRKKVIGVDVSQRAVDTINKGEIHIVEPELDMLVHAAVTQGYLRATQTPEPADAFLIAVPTPFCDGNKPDLSYIEAASRSIAPALKKGDIVVLESTSPVGATEKMSAWLAECRPDLTFPQHSGEQSDIRIAHCPERVLPGHVIRELVQNDRVIGGMTRRCGELARELYQIFVQGDCILTDARTAEMCKLSENAFRDINIAYANELSMICDRLDINVWELIRLANRHPRVSILQPGPGVGGHCIAVDPWFIVDSAPEEAKLIRAARGVNDGKPHYVIDQTKRLAARFKAPVIACLGLAFKANIDDLRESPAIDIVNQLADEKVADIVVVEPNVSVLPDALRGKVELTSLASAIEAADIVLLLVDHREFKDINRRRLQSKLLVDTRGLFAXRSI

SEQ ID NO: 4312 - protein, 343 aa, Burkholderia fungorum
RKAIITGVSGQDGAYLTKLLLDKGYHVTGTYRRTSSVNFWRMRELGVLDHPNLRLVEHDLTDLGSTLRLLEGAQADELYNLAAQSFVGVSFDQPVTTAEVTGIGALNLLEGIRILNPKTRYYQASTSEMFGLVQAVPQREDTPFYPRSPYGVAKLFAHWSTINYRESYGLFASSGILFNHESPLRGREFVTRKITDTVAKIKLGKQDVLELGNMSARRDWGFALEYVEGMWRMLQADEPDTFVLATGRTETVRDFVRMAFAAAGYQLEWSGKEERETGIDVATGKTLVRVNPKFYRPAEVDLLIGCADKAHEKLGWKPATTLEQLCHMMVHADLGRNEHHETF

SEQ ID NO: 4313 - protein, 1384 aa, Burkholderia fungorum
MKALLDLFKQVQQPEVFDAIKIGLASPDKIRSWSFGEVKKPETINYRTFKPERDGLFCAKIFGPIKDYECLCGKYKRLKHRGVICEKCGVEVTLAKVRRERMGHIELASPVAHIWFLKSLPSRLGMVLDMTLRDIERVLYFEAYVVIDPGMTPLKARQIMTEEDYYNKVEEYGDEFRAEMGAEGVRELLRAINIDEQVEMLRTELKNTGSEAKIKKYAKRLKVLEAFQRSGIKPDWMVLEVLPVLPPELRPLVPLDGGRFATSDLNDLYRRVINRNNRLKRLLELKAPEIIVRNEKRMLQEAVDSLLDNGRRGKAMTGANKRPLKSLADMIKGKGGRFRQNLLGKRVDYSGRSVIVVGPTLKLHQCGLPKLMALELFKPFIFNKLEVMGVATTIKAAKKEVENQTPVVWDILEEVIREHPVMLNRAPTLHRLGIQAFEPVLIEGKAIQLHPLVCAAFNADFDGDQMAVHVPLSLEAQMEARTLMLASNNILFPANGDPSIVPSQDIVLGLYYATREAVNAKGEGLTFTGVSEALRAYENKEVELASRVNVRITEMVHNEDKSDGAPAFVPKISLYATTVGRAILSEILPPGLPFSVLNKPLKKKEISRLINTAFRKCGLRETVIFADQLMQSGFRLATRAGISICVDDMLVPPQKETIVGDAAKKVKEYDRQYMSGLVTSQERYNNVVDIWSATSEAVGKAMMEQLSTEPVTDRDGNETRQESFNSIYMMADSGARGSAVQIRQLAGMRGLMAKPDGSIIETPITANFREGLNVLQYFISTHGARKGLADTALKTANSGYLTRRLVDVTQDLVVVEDDCGTSNGVAMKALVEGGEVVEALRDRILGRVTVADVVNPESQETLYETGTLLDEDAVEEIERLGIDEVRVRTPLTCETRYGLCAACYGRDLGRGSSVNVGEAVGVIAAQSIGEPGTQLTMRTFHIGGAASRAAVASSVEAKSNGTVRFTATMRYVTNAKGEQIVISRSGEAMITDDHGRERERHKVPYGATLLQLDGAQIKAGTQLATWDPMTRPIITEYGGTVKFENVEEGVTVAKQIDDVTGLSTLVVIDVKRRGSQASKTVRPQVKLLDANGEEVKIPNTEHSVQIGFQVGALITVKDGQQVQVGEVLARIPTESQKTRDITGGLPRVAELFEARSPKDAGILAEVTGTTSFGKDTKGKQRLVITDLEGNQHEFLIAKEKQVLVHDGQVVNKGEMIVDGPADPHDILRLQGVEALSRYIVDEVQDVYRLQGVKINDKHIEVIVRQMLRRVQITDNGDTRFIPGEQVERSDMLDENDRMIAEDKRPATYENVLLGITKASLSTDSFISAASFQETTRVLTEAAIMGKRDDLRGLKENVIVGRLIPAGTGLAFHKARKSKELSDRE

SEQ ID NO: 4314 - protein, 525 aa, Burkholderia fungorum
EMCVGDALDEAARKWPERTGWVFEEEHISYQQMKEHVDRVARALLASGIERGDVVAVWMPNLPHFAFIELACAKIGAIIGAINTRSKVFEVEHFMKHSEAKLLVMVDRFIKHDFVATLNEVCRGEARQIGGDVAAGGVGQLRKVVSVSSAPDSRAQSWTAFIALGESVTAEALATIQRQQNIDDPILIQYTSGTTSLPKGALCNHRYVLNFGGVLMQRLGMEEGDAFLNTQPFYHVGGSCGAVPAPLTLGCTVVSAEYYEVERILSLIERERCVARSGYGAMYIMEMNHPRFREFDLSSLKAGWCVGTAELMNRVRNEMNIPGLLQIYGATEVGGTSAWVDDPWELRSSSCGSPIYGTELKIVDPATGATLASGEIGEICMRGWWKMNGYLKQPAETASTVDADGWVHTGDLGHVDEAGNLYFSSRLKDMLKIGGENVSAQEVEAVLLSHPRIAQVAVIGAPDERLTEVVMAIVEPRHNEQVTEEEVIAYCAQRMANFRVPRYVRITQTWPLTDSGKIQKHKLRE

SEQ ID NO: 4315 - protein, 237 aa, Burkholderia fungorum
  unsure (1)..(237): unsure at all Xaa locations
DEGRLRYVTICRESRANALSVAMLGSLADAIASAGRVSAIDAIVLRSTGVNFCAGADMGELRTHRRQQYDALRTLIAALDKRAVPLLCVMQGRALGAGCVLSALADVVIASDEATQGFPEMRFGMYPSLVHAVLVQKLPEPLVYALCVGARVLSAHDAWSLGLVTEVLPADDFTKCARDRVEFYVARTAAVRYGREMMDQSAREMLLARVAKAEHIIDRNLADPEVEAMLSSYRKXR

SEQ ID NO: 4316 - protein, 163 aa, Burkholderia fungorum
LTLIVARANNGVIGRDNQLPWRLPEDLAFFKRTTMGAPIIMGRKTHESIGRPLPGRRNIVVTRDATRRFQGCDTAATLQEALKLAAQDQAPEAFLIGGAQLYVEGLRQADKLIITEISADFEGDATFPELDETEWEEVAHETHRADAPNDFDYAFVTYKRKGA

SEQ ID NO: 4317 - protein, 310 aa, Burkholderia fungorum
QPLSGNAMPRCGGIATMMRLPNVGSAEGFDACFVGVPFDLGTSNRTGARFGPRQIRSESVLLRPYNMATRAAPFDSLRVADLGDVAINPYNLHDSIARIETAYDEILQHDCKPITLGGDHTIALPILRAMHRKHGKVGLIHVDAHADVNDTMMGEKIAHGTPFRRAVEEGLLDCGRVVQIGLRGTGYAAEDFDWCRDQGFEVVQAEACWNQSLAPLMARVRERMGDGPVYITFDIDGIDPAFAPGTGTPEIAGLTVPQALEIIRGSRGLNIVGCDLVEVAPPYDPFGTTALLGANLAFELLCVLPGVEYR

SEQ ID NO: 4318 - protein, 320 aa, Burkholderia fungorum
  unsure (1)..(320): unsure at all Xaa locations
CRNVMVAKPSEETPXTATLLAEVMQTVGLPAGAFNLVHGFGPNSAGEFITTHPGINAITFTGESKTGTAIMHAAAEGVKPVSFELGGKNAAIIFADCDFDKTVAGMTRAAFLNSGQVCLCSERIFVERPIYDRFVKALAERAKQIKLGDPTDEATCMGPVISAAHRDKVLSYYALAREEGAEFITGGGTPSFGNQLDGGFWVEPTLLAGLPDDARCVTEEIFGPIGHVTPFDSEAEVIQRANATPYGLAATIWTSNVNKAHRVAQSMNVGVAWVNAWFLRDLRTPFGGSGLSGIGREGGLHSLNFYSELTNVCIHVDAPD

SEQ ID NO: 4319 - protein, 299 aa, Burkholderia fungorum
QVNWKGVFPAVTTKLKDDGSLDHEAIKSGLNRLIENGVGGVVMMGMVGENAQLTADEKRTVLKLAVETVAGRVPVISGLAETSTALAVQFVQDAEAIGVQGLMVFPGLTYRSDDRETVEFYRTIARSTRLGLMIYNNPRGYGVDMRPDLMDQLKDEANVVAIKEETYDTTRVTDLLKRFGDRFAVFCGVDDLVLESAALGVTGWVSGMANAMPKESVELLNLAVAGDFVKARELYRALIDLFHLDVHVKLVQYIKLAENMTAGYPENVKAPRLKLEGEERQKVVAIVEQAIANVRALSN

SEQ ID NO: 4320 - protein, 480 aa, Burkholderia fungorum
ETSMSQYRSFINGEWLGTTSTLPNLNPSDLSDVVGEALLADDALVADAIAAARHAFRSWSLTTPQQRADILDAAGTRILQRKEELGTLLAREEGKRLPEAIGEVGRAGNIFKFFAGEALRIGGEVVSSVRPGMTVEVTREPLGVIGMITPWNFPIAIPAWKIAPALAYGNTVVIKPAEAVPACATELVKILEESGLPAGVVNLLLGPGRVVGEALVASPDIDAISFTGSESTGRAIAVKCVTSGKKVQLEMGGKNPLVVIDDADLDVAVEAALDGSFFSTGQRCTASSRLIVTSAIHGQFVAALQRKASELVVGHALDKATQIGPVLDDRQLQQNLKYLKIAAEEGGQVLGGERVERPTRGYFMRPALVIGTDNTMRINREEVFGPVASVIKVADYEEALAVSNDTPYGLAAGICTTSLKYASHFRRHAEAGMVMVNAPTAGVDYHVPFGGRKRSSYGPREQGTYAREFYTVVKTAYVKA

SEQ ID NO: 4321 - protein, 232 aa, Burkholderia fungorum
VGASAGLGAALARRFAREGLNVTVTGRSRERLDTVVAEIQHAGGQALALPGDVTSESDLAAIARQLAERGTLEVAIFNAAGATRAPTLDLSAEQFEAAWRVTTLGGFLFARAALPPLLAAGRGSLLFTGATASLRGRPPFAAFASAKAGLRSLTQSLAREFGPQNIHVAHVVVDGGIDGERLRTSAPQRAAERGPDGLLNPDEIADSYWRLHQQGRSAWSQEIDLRPFNESF

SEQ ID NO: 4322 - protein, 301 aa, Burkholderia fungorum
IRRVAVVGTGVIGASWAACFLSRGLQVAATDPSSGARQRLEHAVMQHWPTLVTAGLASGASLGNLTFHDSLDAALEGAQFVQENGPERIDAKRELFAAIDAATASDVVIASSSSGLLISDVQTACRHPERVVLGHPFNPPHLIPLVEVIGGRLTSETAIRAAIDFYRAIGKRPINPQKEISGHIANRLQAALWREAFHLVSIGAATVQDIDDAIAYGPGLRWAVMGPFANLHLSGGAEGMRHLLEHLGAPIENWWAQLGTPAMTPDLKRMVIDGVDAALAGRKDSDLAAQRDLIILDVLRA

SEQ ID NO: 4323 - protein, 216 aa, Burkholderia fungorum
  unsure (1)..(216): unsure at all Xaa locations
LTSIPVVAAASRRQRIALIGLRGAGKSTLGALLAKHLDVPFVELDRMIEQEAGIAIGEVITLYGQAGMRRLERRCIEKIIETHPEVVVATGGGIVAEAATYELLLRTFRTMWLKARPEIHFARVMAQNDARIATQTLRNDALEHIHRMLDAREQLYQLANVTLDTSDLTVEQALQRAVECIELNVPVLQTHKTASLPVSIEAKSARXSAALRASRN

SEQ ID NO: 4324 - protein, 476 aa, Burkholderia fungorum
QRWAERDFIVQGARRITGAQHAHAVARVARMLREHGVRTRDPVVLLGYNHIEWLVTFWALQALGATAVLGNAWWSDTETTTVLETVRPTLVISDRARERFGPGDAGFISFSELRPFVEAGEELPLDLTPVDEEWPAWVIFSSGTTGHAKGVVMSHRSVIANIQNVLTLTGRLPSELPPSHRGTVSLVSMPLFHLAGIQISLMSMLSGGKLVFLAGKFDPLEVLRLMERERVRSWGSVPTMVSRVIQHPDFGKYDTSSVSSVQMGGAAVPHALRLEVQQAFPNTRRRVGSMYGLTEAGGVLAAGSGDDLEGKPGCVGKPLPSVEIVIRNPDAQGVGEIAARAPSATSGYLGDPTPIADADGWVLTGDLGRFDDAGYLYIVGRSKDTIIRGGENIASVHVESVLRTHPDVLDVAVVPLPDADLGEEVAAAVVLRHGAAISSEDLRAYASRELGKFEVPSRWWLRHDPLPTNASGKTIK

SEQ ID NO: 4325 - protein, 253 aa, Burkholderia fungorum
RLERKRTLITAAASGMGAAGTRLFAEHGARVAALDRDGAALQRVVDDVKSRGGEARGFVVDLTHRQATLDTVREAVEWLGGIDVLWNHAGMPAPSNIEDFEFEQYERSINLNVTSAVVISSAILPWMTAQKSGSIIFTSSTSGLVGSALSPLYSAFKSGIVGLTKGLAVRYAAQNVRVNALCPGPVSTPMLHNDFIAGDARFDKEENLKRVISVVPMGRMGEPVEIAHAALWLASDESSFVTGVALPIDGGQT

SEQ ID NO: 4326 - protein, 436 aa, Burkholderia fungorum
PVLNPATGKVAASAPAASVQQLERAITAANRAFAGWRDTPFAERRAIVLKIIDIIAANQGELSRLLTLEQGKPLAAAAGEVSATIDYFRYFTTLSLAPEVRQDNETRYVEVRRDPLGVVAAIIPWNFPLLLAAFKLPAALLAGNTVVLKPAPTTPLATLHLGRLIAGAVPAGVVNIVSGGDELGPVLTSHPGIRKVSFTGSTETGKKVMASAATHLARVTLELGGNDPAILLDKVDLEHTATAIFASAFGNSGQVCRAIKRVYVPRPIYEPFCAALAERARAAVVGDGLTDGVQFGPVQNAAQFERLKELHADAQQRGTVMPGGGPVKGPGYFFRPTIVKDIASDSRLVVEEQFGPILPVIAYDELEEAVEMANNSQYGLAASVWSTDSQAAFAVADRIVAGTVWINKHTDRMPDLPIAGARQSGMGVELGEEGLH

SEQ ID NO: 4327 - protein, 493 aa, Burkholderia fungorum
MNETPALPAWLDGSPKLLLIDGQPTPARSGRTFETINPTTGKALAQIAEADEKDIDLAVAAARRALDGPWGRFKPFDRQAVLLKLADLVETHFDELALLDTLDMGGPIRSTGAKRTRAIGLLRFYAGLATSIHGSTIDNSQAGEVISYTVKEPVGVVAAINPWNGPLGLAIWKIAPALAAGCTVVLKPAEQAPLSPLRFGELCLEAGIPQGVVNVVTGFAGAGAALAAHPGVDKVAFTGSTEVGQHIIRASAGNIKRVSLELGGKSPNIVFADANLDAAVPGAAMAVFANSGQICSAGTRLFVQRSIHEEFVERLSSFAKTLRVGNPLDPDTQLGPLVSEAQLKRVTSYLDKGREEGARAVAGGTRLQNDELKNGYFVEPTVFDGVKDDMAIAREEIFGPVISVLPFDTAEEAVQRGNDTEYGLGSGVWTRDIGNAHRVARGLRAGSVWVNCYQVMDPAVPFGGYKMSGYGRESGVEHMEEFLQTKAIWIKTD

SEQ ID NO: 4328 - protein, 531 aa, Burkholderia fungorum
FDYIIVGAGSAGCVLANRLSADPSVKVALIEAGPSDRRFPTNIKSSMPAGMLFLLPHSKYNWQYTFTGGSGVNGRSLLCPRGKLMGGTSSVNGMVYIRGHRLDYDDWAALGNDGWSYQEVLPFFKKHENNTQGEAPFHGVGGEVEVSVPENPNILSRTFIEAAREVGLPMNADANGTSQDGIGFNHVNHKYGRRYSSSRAFLHPILHRRNLHVLTDTLVERILFSGDRATGISILQGAAPTTLNATREVILSGGAINSPQLLMLSGIGPHAELARLGIETRVDLPGVGENLQDHPTVQVSRSNPSAESYALTLRAWPRVLGTPFAYLFAKKGMLATHGAEAGGFVRTLPELDRPDIQLTFVATIKKSVYKMPRTHGMMLMVHLMRPRTRGRIRLTSSSIQDKPELHPRFLDDPEDLQTLLRGVHQARRILGTKAFAPYVGEEVTPGAQYMSDEDLIKAIRAQVGTAYHPVGTCKMGPASDLMAVVDNELRVRGVRGLRVVDASIMPNIVGGNTNAPAMMIGERAASFILGE

SEQ ID NO: 4329 - protein, 244 aa, Burkholderia fungorum
MIVTEEKGALPPDLSRARTVIVTGAAGTLGRAVAKAFGGVGANLVLIDREESALRSAFDNAGENMLLCAARLDEPAAAIPVVEQAVERFGAIDVLCNVAGGFYAGDCVHEMRDETWDLLTNTNARTVLHMAQAVIPKMIAARYGKVINVAAMAAQAGMAHMGAYCASKSAVLRLTEAMSAELRGHGINVNSVMPSIIDTAQNRKDMPDADFATWVRPVDLACIILFLASDDARAIHGAGIPVRG

SEQ ID NO: 4330 - protein, 473 aa, Burkholderia fungorum
SYTDTRLLINGEWCDAASGKTLDVINPATGQAIGKVAHAGIADLDRALAAAQRGFEAWRKVPANERATTMRRAAALVRERASDIGRLMTQEQGKPFAEARIEVLAAADIIEWFADEGRRVYGRIVPSRNLAAQQLVLKEPIGPVAAFTPWNFPVNQVVRKLSAALACGCSFLVKAPEETPASPAALLQAFVEAGVPAGTVGLVFGDPAEISGYLIPHPVIRKVTFTGSTPVGKQLAALAGAHMKRATMELGGHAPVIVAEDADVALAVKAAGGAKFRNAGQVCISPTRFLVHNSIREEFAAALVKHAEGLKLGDGLAEGTTLGPLANARRLSAMSKVLDDARKTGAKVETGGERVGSEGNFFAPTVLTNVSLEADVFNNEPFGPIAAIRGFDKLEEAIAEANRLPYGLAGYAFTKSFSNVHLLSQQVEVGMLWINQPATPSPEMPFGGVKDSGYGSEGGPEAMEGYLVTKAVS

SEQ ID NO: 4331 - protein, 352 aa, Burkholderia fungorum
MNFIHDYRSPRVIFGPDSLARLPQELERLGIDRALVLTTPEQAPLGRQVAEPVIGHVAAFYDGATMHVPALVAEEACKIARTSEANGVIAIGGGSTIGLAKIVALRTELPIVAVPTTYAGSEMTSIFGITEGGVKKTGRDARVMPRAVIYEPRLTLELPLSISVTSAINAIAHAVEGLYAPDATPLLTIMAQEGIAATVRAISRMYQSPRDLQARGDALYGAWLCASVLGNVSMALHHKLCHTLGGTLDLPHAQTHTVVLPHALAYNARAVPDAMRVLRIALGHDDPPTALYELARDNGAPVALRDLGMREEDIEHVGDLALQDRYPNPRELDRDALLALLRDAYHGRPPSA

SEQ ID NO: 4332 - protein, 410 aa, Burkholderia fungorum
FFFDISDIFTFSYAAPALVKEWGLTMSSIAMLTSAGFFGMFLGATLGGMLSDKIGRKRALICYVIAYSVFSLANALAPDIPMLMITRVLTGVGISSATAVVMAYIAELFPAKTRGTWQSWAMVIALMGIPITSWVARLVVPSGPDGWRWIFVWGALGIVFLVFTKHFPESPRWLARQGRMEEADRTLSLIEAEVVRTTGPLPEAVAINRPAEVRAPWTSMFKGQYIGRTMTLWAIWIFQTLGFYGFQAWVPTLLVQHGITIVHSLTYITLINIGAVPGALIAVFLADRFERKFSIAGAAALIAVFGLLYGLSFQPVLIVSFGFLVGMLIQTFAALCYAYTPEQYPTDIRNTGAGFAYGMGRLANVGNSFIVAGIFMNFGYVWVFVYIAGAWLATAAVTLLFGARTTGRRL

SEQ ID NO: 4333 - protein, 671 aa, Burkholderia fungorum
HTPMMQQYLRIKAEHPGTLVFYRMGDFYELFFEDAEKAARLLDLTLTQRGASAGNPIKMAGVPHHAVEQYLAKLVKLGESVAICEQIGDPATSKGPVERKVVRVVTPGTLTDAALLSDKNDVYLLAMCVAHNRRGVATSVGLAWLNLASGALRLAELAPDQVAAALERIRPAEVLVADTPGDAASWTPPVNAGALTRVPVWHFDIASGTQRLCDQLEVAGLDGFGAHSLTCAWGAAGALLLYAAATQGQQLRHVRSLKVEYESEYIGLDPATRRNLELTETLRGTESPTLCSLLDTCCTTMGSRLLRHWLHHPPRESAVAQARQQAIGALLEAPPGAGVDSLRGALRQISDIERITGRLALLSARPRDLSSLRDTFIALPELRAQLAAVSPNADSLARIDASLEPPQACVELLRRAVAEEPSAMVRDGGVIARGYDAELDELRDISENCGQFLIDLETRERARTGIGNLRVEYNKVHGFYIEVTRGQTDKVPDDYRRRQTLKNAERYITPELKTFEDKALSAQERALARERSLYDALLQALLPFIPDCQRVASALAELDLLAAFGERARALDWVAPTFSPDAGIEIEQGRHPVVEAQVEQFIANDCSLTPERKLLLITGPNMGGKSTFMRQTALIALLAYVGSYVPARRAAFGPIDRIFTRIGAADDLAGG

SEQ ID NO: 4334 - protein, 141 aa, Burkholderia fungorum
TRKLEFDAGHRIPDHRSQCRNLHGHRYVLEITLQGDLVDTEGAPDRGMVMDFADVKSLAVEHLVDKWDHAFLVYEGDTQVRGFLETMAGHKTVVLDRIPTVENLAAVAFGILANVYDAHYGVNLRLHKLRLYETPNCWADV

SEQ ID NO: 4335 - protein, 585 aa, Burkholderia fungorum
  unsure (1)..(585): unsure at all Xaa locations
EPIYETKNLVVDLYTENNVIRAVDECSFSLFAGETLAVVGESGSGKTVMTLGPLGLLPEGIAVHMRGTAATSRGDLLRFGGRRRASVRGNDFGVVFQDPLSALNPMRRIGPQLAEQACRFAGITASGTKADAVSNLRRVGIADPEDRYWRYPHEFSGGMRQRAMIALALASRPKILLADEPTTALDATVQAQIISLLKQIQAEDGLAILLITHDIGVVAGMADRVAVMYAGRIVEEGAVTDVLKNPVHPYTQGLLSSVPDLDTPIGEKLTEIPGTPPDLSRLEAGCRFAPRCFAAQPSCSSGSPHPVIRLHNGTHSXSRLLRDAAXIPGGYRVNASNTIAVSDLMVHFPTSRGVTVRAVDGVNLQVQQGEFHGIVGESGCGKTSLARTIAGLQRPTGGSVLIDGRELNDWRGDRLAFSRHVQFIFQDPLASLSRRQTIQESLEEPLRIHGIGPASERRRRVAQLLQLVSLPEACLDRLPRALSGGQRQRVAIARALALDPRILICDEPLSALDVSIRAQILNLFADLQKKLDLSIVLIAHDLAIVRLVCTRVSVMYLGKIVETGPAHDLFAQPRHPYTRALLDAA

SEQ ID NO: 4336 - protein, 263 aa, Burkholderia fungorum
MATQAGKGTALVTGASSGIGAVYADRLARRGYDLILVARDAERLNGLAGRLSSETGLHVETIAADLTVKADVRRIEERLRADRSITMLVNNAGVGATASLIDSDVDALEKMIDLNVTALTRLTAAVVPALVERGNGIVINISSIVALSPELLNGTYSGTKAYVLNLTQSLHHEVSGKGVQLQAVLPGATSTAFWGRAGLPVEHLPSEIVMTAEDMVDAALAGLDQGELVTIPSLPDAADWDRLNSARQQLQPNLSHKLPAARY

SEQ ID NO: 4337 - protein, 771 aa, Burkholderia fungorum
ERITLPLLPLRDVVVFPHMVIPLFVGRPKSIKALEAAMEGGKHIMLVAQKTAAKDEPTEKDMYEVGCVANILQMLKLPDGTVKVLVEGLQRAKTLSIEEQETQFSCEVMPLEPDHADSAETEALRRAIVSQFDQYVKLNKKIPPEILTSLSGIDEAGRLADTIAAHLPLKLDQKQHILEMFPVIERLEHLLAQLEAEIDILQVEKRIRGRVKRQMEKSQREYYLNEQVKAIQKELGEGEEGADLEELEKRITAARMPKEAKKKADAELKKLKLMSPMSAEATVVRNYIDTLIGLPWRKKSKVNNDLSNAERVLDEDHFGLEKVKERILEYLAVQQRVDKVKAPILCLVGPPGVGKTSLGQSIARATNRKFVRMALGGVRDEAEIRGHRRTYIGSMPGKILQSLTKVGVRNPLFLLDEVDKMGQDFRGDPSSALLEVLDPEQNHTFADHYVEVDFDLSDVMFVATSNSLNIPPPLLDRMEVIRLSGYTEDEKVSIAQRYLLPKQKKNNGLKDGEVDVTETAIRDIIRYYTREAGVRSLEREISKICRKVVKMLLLKKAEGAVKVDGSNLDTFLGVRKYDFGLAAKENQVGQVTGLAWTEVGGDLLTIEAAVMPGKGNVIRTGSLGDVMKESVEAARSVVRSRSRRLGIKDEAFEKQDIHIHVPEGATPKDGPSAGIAMTTALVSVLTGIPVRADVAMTGEITLRGEVLPIGGLKEKLLAAHRGGIKLVLIPEENVKDLTEIPDNVKNAIEIVPVRWVDKVLELALERVPSAL

SEQ ID NO: 4338 - protein, 674 aa, Burkholderia fungorum
  unsure (1)..(674): unsure at all Xaa locations
KILIANRGEIACRVAATCKRLGIASVAVYSDADANAKHVAACDEAVHIGGSSAAESYLRVERIIEAARATGAQAVHPGYGFLSENEDFAQACEAAGIVFIGPPVEAIAAMGSKAAAKALMHAAAVPLVPGYHGDDQDAQLLHREANAIGYPVLLKASAGGGGKGMRVVERSEDFAAALASCKREAASSFGNDRVLIEKYLTRPRHVEVQVFADRHGGAVYLFDRDCSVQRRHQKVLEEAPAPGLSAEIKREMGEAAVAAARAVNYVGAGTVEFIMTSTGEFYFMEMNTRLQVEHPVTEMVTGQDLVEWQLRVAADQPLPLTQEQLKIDGHAIEARIYAEHPARGFLPSTGTLKHLRMPEGVEFAIDASGLGEPGRKAPVRIDSGVREGDTITPFYDPMIAKLIVHGATREEALARLSRALHACEVVGPHTNVEFLQSIVASEPFATGDLDTGLIERHHDALFAPRKKPYKEALALACAALLTREGGTAHGASPWDALSHWRSEWRLYADARLARHRQRRRERGPVHGHVRARRRHANARTRRRAXGLQMVGRQRPAXIPRNDRRRARNGPRVRRRDTFHVFCLGEALAFEWQNLLAHAADAEGGEGRLTAPMPGKVIAVLVEPGTVVEKGTPLIVMEAMKMEHTIGAPAAGTVSEVLYAVGDQVADGAQLLVLD

SEQ ID NO: 4339 - protein, 388 aa, Burkholderia fungorum
PGLQFPLGEEIEMLRDSIAGFAAKEIAPRAAEIDRTDQFPMDLWRKFGDLGVLGMTVSEEYGGANMGYTAHMIAMEEISRASASVGLSYGAHSNLCVNQIHRNGTEAQKQKYLPKLVSGEHVGALAMSEPNAGSDVVSMKLRAEKKGAHYVLNGTKMWITNGPDCDTLVVYAKTDPEANSRGITAFIVEKGMKGFSVAQKLDKLGMRGSHTGELVFQDVEVPEENILGQLNGGAKVLMSGLDYERAVLAGGPTGIMVAVMDAVVPYIHDRKQFGQPIGEFQLIQGKVADLYTTLQACRAYLYAVGRQLDTLGKEHVRQVRKDCAGVILYTAEKATWMAGEAIQILGGNGYINEYPVGRLWRDAKLYEIGAGTSEIRRMLIGRELFAET

SEQ ID NO: 4340 - protein, 271 aa, Burkholderia fungorum
SRHALGIFGLNNGERPMSRIFITGSADGLGQMAARLLVDAGHQVVLHARSAARAEHALQAVPQAETALVADLSSIAATAELAQQVNRLGRFDAVIHNAAVGYQEPRRIATVDGLSHVFAVNTLAPYILSALIGKPKRLVYLSSALHRSGDASLDDLAWERRPWRGTAAYSDSKLHDALLAFALARRWPQVLSNALEPGWVATKMGGPGAPDDLLAAPKTQVWLAVSDEPAATVSGAYFYHMKPRETHPAVHNVAVQERLLEACAGFSGIRL

SEQ ID NO: 4341 - protein, 564 aa, Burkholderia fungorum
KKLINEVSAVVPDMLDGLAALNPHLSLLQGSTIIVRADAEAAAARGEVALISGGGSGHEPAHGGYVGPGMLSAAVAGEVFTSPSTDAVLDAIRAVAGAAGALLIVKNYTGDRFNFGLAAEIARAEGIPTEMVIVADDVALTASGDHAGRRGLAGTVLVHKIAGAAAASGRPLAEVAQIARDVAASLGTMGVALTACTVPAAGKPGFELADGEVEWGLGIHGEPGVERGALEPAAAVVDKLLEKIVGDLSLQAGERVALLVNNLGGTPSSELNIVAGAALRYLAERGIRTERAWAGTFLSALEMAGISLSLLRVDDQRLGWLDAAAQTSAWPALGGRIARTSARPAPAEPDRASGATLSREATLRRVIEAVCACLLKAEPTLTDMDQRVGDGDLGISLSRGARAIIQELDGYPAETTPGAVLRNMSATLRRVVGGTSGPLYAVMLLRAALALEQSGGATPKQWAAAFSAGVDGLMALGGAQPGDRTMVDALKPAADALQAALARSDALDAALKAAVDAATEGAAQTASMHPRRGRSSYVGERALGHADPGAHAVALWLAAIREAL

SEQ ID NO: 4342 - protein, 310 aa, Burkholderia fungorum
KVFVDGQEGTTGLKIFEYLSQRADVEILRIEEAKRKDLEERRRLINASDVTFLCLPDVASRESASLVENDRTVLIDASTAFRTSAEWAYGLPELARSQRERLRTAKRIAVPGCHASAFVLAMRPLVEAGVVAPEFAAHAYSITGYSGGGKKMIADYEAGGNDRLKSPRPYALGLTHKHLPEMAAHTGLKSAPVFTPIVGDFYKGLAVTSFFSPNQLAKKATPQDVQALFAEYYAGEAFVHVAPFNAEANLDSGFFDVQANNDTNRVDLFVFGNEERFVTVARLDNLGKGASGAAIQCMNLAIGANEESGL

SEQ ID NO: 4343 - protein, 356 aa, Burkholderia fungorum
WENPLGTDGFEFIEYTAPDPKALGKLFEQMGFTAIARHRHKDVTLYRQGEINFIVNAEPDSFAQRFARLHGPSICAIAFRVQDAAKAYQQALEKGAWGFDNKTGPMELNIPAIKGIGDSLIYFVDRWRGKNGAEPNSVGNIDIYDVDFEPIPGANPNPVGHGLTYIDHLTHNVHRGRMQEWAEFYERLFNFREVRYFDIEGKVTGVKSKAMTSPCGKIRIPINEEGSDTAGQIQEYLDAYRGEGIQHIALGTNDIYRTVDGLRAANISLLDTIDTYYELVDRRVPNHGEPLDELRKRKILIDGAPEDLLLQIFTENQIGPIFFEIIQRKGNQGFGEGNFKALFESIELDQIRRGVV

SEQ ID NO: 4344 - protein, 455 aa, Burkholderia fungorum
VLIANRGEVAVRIVRAAKSVGLQTVGIHTPEEANALHVRDSDIAVALAGVGTAAYLDIASIIAAAVRTNCSFIHPGYGFLSESAAFARACEQAGVTFIGPSPDTLDVFGDKASTRELAIRLDVPVLPATAGLADDASALSFMQSLAAPVIVKAVAGGGGRGMRIVTDPTDLPAALSRCRSEAERGFGRDDVYVERYLPRSRHIEVQVIGDGSSVVHLGTRDCSLQSRHQKVIEIAPAPWLPVEIEEALLEHALQLARAVQYRGAGTMEFLIDVDNPSHYYFIEGNPRLQVEHGITELVTGLDIVALQFAIARGRSLADEGITQDNVVTSGVAVEARVTLTTPGTIARFVSPGKGRVDSGAYDGLAVGSGFDPLLAKVMVHEPDYPRCICALADSLGELVVEGPATNRDGLLSLLADPRVRAGDITTTLIDDLPAASATALVSKVAGSVIAVLARP

SEQ ID NO: 4345 - protein, 489 aa, Burkholderia fungorum
TYSECVMRGDELARAFLGLGLERPARVALVLPNSAEFVISLYACARIGITAVPISTWSKPSELRRILRDARVDLVLARDAFPGHAIAESLQAACADDPSLDALQVYEWSRGQGAASPVSELLSHGSRCDDRRWSIESGTSAHTDADLVVLYTSGSTGAPKGVILPQSSVALNGVAIAGRMGFGGNDRIFSYFPLFFSGGLCNALTGAISCGAELVTQSRFDPAGALSLIRSRRCTGRNVWHDGLEPVAAVEGFRPGDFSRMRRGLHVDPELYRRLSLAVDEGINMYGMTETATAFTCGDWREPADVRQSTHGKPFDGSDLRICNPDETSPLGVGVEGEICVRGYNLMRGYTDGSHVERIDDDGFFHTGDIGFVDPAGYLHFVGRRKTLIKVKGLTVQPEEVEATLLRHPAISKAVVVGEGGGHESKGVVALIVLHEGDRWDMQALRTYCQEELSSYKVPRLLVVDANRFPLSASLKIDRIGAATLLKQI

SEQ ID NO: 4346 - protein, 458 aa, Burkholderia fungorum
IGVRDQRTVVLALPGSPLTIVLWLAIASNGAVVQAVDPDAGVLPLCAAIRATQPVLVIANPGNAEVLSKALVQSAVSATMIVVKDLSLASPMSGIDGLRSAGPQTPPSAFAESVAGMLQTSGTSGAPKLVELTHANYIASGERLARNSGHRASDCFYLCSPFSHTNAQLYCCMPAIVTGGTIAVVERFSASLYFDSARQMGATVSSMVAPPMRMALHKALERGSPVDAGSLRLIQYGMNMSDADWRAWDRLFPQIEMRQVYGQTESVSAVLGGAPWEIDDRRTIGRPFLGVDAVRLVGENGEPVKPGEQGELWVRGERGRTLMRGYYQNEAATAEAIDADGWLHTGDYMTQDANGRFAFVGRRMHIIRRGGENLSVYELELMMQSCPLIEEVAISAEKDALLDATLVVHVIPASGFSEQAFEQWCRDAIGRRGVPDSIRVHQAFPRTISGRVIIRELK

SEQ ID NO: 4347 - protein, 532 aa, Burkholderia fungorum
IGDLLVRAASRHPDRDAVVFPDDRYTYAEVLRRAMLVARGLLSLGVRPRDHVGILCTNGIEFIEGLFGVALAGAVAAPINARYKVNELKYIASNADLVAILTTGDADAYVDFPDVFVQAFPELSSSEALGLDLESAPRLRNVILLSGSERPGFISRERLLELAARVSEEDVHVARSRVRLRDIGLLLYTSGTTANPKGCLLSHEAVTRGPVERATIRFGLKVADVTWGAGPLFHIGSLSPFLGSIGAAGTYVTDAFFDAGRALDLLIREKPTVMFPWFPAIMQALMNHEKWDPAKLSSVRSILLIGPRPLLDKVQAALPQVELVASCGMTETAGIYAVSDVSETVEQRATGHGRPCSGIEARIVSLSDGSEVTDSTPGEILLRGYCVMEGYYRDPANTRKALDAEGWLHTGDLYSRTPDGRLMFHDRIKDMLKVGGENVAPAEIETFLCTHPSVVMASVVGIADARLDEVPVAFVELAAGNTLEAEFLISFCRGQLASFKIPRRIHFVDTGTWPMSTTKIDKRQLRERAAKM

SEQ ID NO: 4348 - protein, 410 aa, Burkholderia fungorum
AGKSDSDAKVRAIVESIIQHIEEKGDEAVREYSRKFDNWDPGDFRLSRPEIETARKQLSAREIEDIAFAQTQVRNFARIQRDSMRDVETETLPGVVLGHKHIPMNAVGCYIPGGKYPLLASAHMSVLTAKVAGVARVVSTAPPYQGKPHPAIVTAMDMAGADEILVLGGIQAVVAMAVGTPTVAPVDMLVGPGNMFVAEAKRQLYGRVGIDLFAGPTETLVIADESVDGELCAVDLLGQAEHGATSPSILLTNSEKLARDTLAEIERQLKILPTASIAAQSWADCGEVIVCDTYEEMLQVADDIASEHVQVMTEDPDFFLNNMTNYGALFLGPRTNVSFGDKVIGTNHTLPTNRSARYTGGLWVGKFLKTCTYQRVTTNEASAIIGEYCSRLCHMENFAGHGEQANIRVR

SEQ ID NO: 4349 - protein, 245 aa, Burkholderia fungorum
FGLASRRALVTGGSSGIGLAAAAALGRAGAHVTVAARRRAELEVACEALRATGVACEALVLDVTDSASVDREVNSRVPFDILVNSAGMNRPKPLTDLTDDDIDAVLRLNVKAAFYLARAVSRRLVDANLGGSIINISSQMGHVGSARRSLYCASKHAVEGMTKALAWELGAARIRVNSLCPTFIETPMTAPMFVQPGFREWVCERIALGRVGEMHEIMGPVVFLASDASSLMTGSALMLDGGWTA

SEQ ID NO: 4350 - protein, 503 aa, Burkholderia fungorum
SIETIGIVGTGAMGRGIAQIAALAGLTVRLYDTNPAAIGAARDYLAETFAKLTAKGKLDQARSLAALANVSGAQAIGELAGCDLVVEAIVEKLDVKQALFRELETVVSGRCILASNTSSLSITAIAAGCSDPSRVAGYHFFNPVPLMKVVEVIDGLRSDPAAGDALMDLARRMGHTPVRAKDMPGFIVNHAGRGMNTEGLRVAGEGVASFADIDCIMREQAGFRLGPFELLDLTALDVSHPVMESIYHQFYEEPRFTPSPITGTRLAGGLLGRKTGEGFYRYEDGKQQVPAEAPAPTGLPASVWVSKRYPQAHDAVVQLVEKAGVTLDNGITPESNSLIVVTPFGHDATTAAVDEALDATRVVALDALFPLVGAQRRTLMTTPATTRAARDMAHALFAADGVPVTVIRDSTGFVAQRVVATIVNIGCDIAQKQIATPEDIDLAVTLGLGYPRGPLALGDALGSTTILAILRNMFSVLGDPRYRPSPWLARRAQLGLPLTQRDA

SEQ ID NO: 4351 - protein, 379 aa, Burkholderia fungorum
EHIYPNEQAFYAEIARNRQNGNAWLPTELVEQLKQKARDAGLWNLFLPESVRGAGLTNLEYAPLCEIMGRVPWAPEVFNCNAPDTGNMETIERYGSDDNKREWLEPLLQGQIRSAFLMTEPEVASSDATNIQTSIVRDGDYYVINGHKWWSSGAGDPRCKIYIVMGKTDPDAPRHQQQSMILVPADATGITVHRPLTVFGYDDAPHGHMEITLENVRVPATNMLLGEGRGFEIAQGRLGPGRIHHCMRLIGLAERALELMSKRSLQRVAFGKPVAAQGVTQERIAEARCMIEQARLLTLKTAYMMDTVGNKGARGEIAMIKVVAPNMACQVIDWAIQAHGGGGVSDDFPLAYAYASARTLRFADGPDEVHRNAIAKLEL

SEQ ID NO: 4352 - protein, 373 aa, Burkholderia fungorum
MDFTFNEEQQQFADALRRYLDRSYGFEARQAIVRSEPGVSDAHWAAFAELGLTALPVPEAQGGFNGGPIDMLVVMQELGRALVVEPYWATAVGIEALRLAGSEQGEDASLLERAARGEIKLAVAFHEPHARYDLFSIETTASGQGGQHTLTGTKSVVLHGAQADHWIVPARLNGEIALFVVARHAAGVSVTDYRTIDGQRAATLEFNGTPARQLAGQHAGAAALEHIADYGTVLLCAEAIGALDALNLATVDYTKTRQQFGQPIARFQALQHRMVEMLIHAEQARSVTYLAAMRYTSTDVDERRRAVSAAKARVGQAARFVGQQAVQLHGGMGVTNEVAAAHLFKRLAIIETTLGDVDHHLARFAALPGFVTA

SEQ ID NO: 4353 - protein, 392 aa, Burkholderia fungorum
  unsure (1)..(392): unsure at all Xaa locations
DSAFRADIRAWLEANLPRELSDKVLNHKRLSRADFASWHKLLGMRGWSVVAWPKEYGGPDWDATQRHIWDEECARIGAPSVLPFGVSMVAPVLMKYGNEAQKRHYLPRILDGTDWWCQGYSEPGSGSDLASLRTRAERAGDHYVVNGQKTWTTLGQYADMMFCLVRTDSGAKKQEGISFLLIDMKTPGITVRPIITLDEDHEVNEVFFEDVKVPIENLVGEENRGWTYAKYLLGHERTGIARVGQSKRELVFLKRLALNQKKNGKPLLQDPVFAAKVANLEIELMALEVTVQRVVANETGGRGPGPEASMLKIKGTEVQQALTELMFEAVGPLAAPFDIPFLEGEREHSLAGDDDAAPLAAYYFNFRKTSIYGGSNEIQKNIIAQMILGLXG

SEQ ID NO: 4354 - protein, 386 aa, Burkholderia fungorum
  unsure (1)..(386): unsure at all Xaa locations
MHIENDSYQDIRDAIRDLCSQFPADYFRRIDEERGYPEQFVDALTRAGWLAALIPQEYGGSGLGLTEASVVMEEINRCGGNSGACHGQMYNMGTLLRHGSDEQKNRYLPRIASGDLRLQSMGVTEPTTGTDTTSIKTTAQRNGDRYVINGQKVWISRVQHSDLMILLARTXALAEVGRKSEGMSIFLVDLHEAIGHGMTVQPIRNMVNHETNELFFDNLEIPAETXSGEEGKGFRYILDGLNAERALIAAECIGDGYWFVDKVTEYTKQRVVFGRPIGQNQGVQFPIARAFVNIEAASLMRYKACERFDARQPCGAQANMAKLLAADASWEAANACLQFHGGFGFAAEYDVERKFRETRLYQVAPISTNLILSYVAEHILEFPRSF

SEQ ID NO: 4355 - protein, 331 aa, Burkholderia fungorum
TLIPGDGIGPEVTQATVRVLEALGAPFKWDIQQAGMAGIDECGDALPQATLDSIRETKLALKGPLTTPIGGGFRSANVRLREAFELHANIRPVRTIVPGRYDDIDIVLVRENIQGLYVAHEHYIPIGDDPRAVAVLTGMNTREGGRRIARCAFDYALRHGRRKITVVHKANVLKALTGIFLEAAREVAADYAGRVALDDRIVDACAMQLVLNPWQFDMLLCTNLFGDILSDQLAGLVGGLGLAPGANIGKDTALFEAVHGSAPDIAGRGIANPVSQLLAAGLMLDHVGLDEDAKRLRRAIADTLNEDKVRTPDLGGQATTRTFTDALIERL

SEQ ID NO: 4356 - protein, 479 aa, Burkholderia fungorum
KLKDPSLLRTQAYVDGRSQGGAQEFAVFDPATGAEIARVPNLAAAEARQAIDAANAALPAWRALTGKQRAAMLRRWYELIVAHAADLAAIMTAEQGKPLAEARAEALYGASFVEWFAEEAKRVSGDVLASPADDRKIVVIRQPIGVCVSITPWNFPLAMITRKVAPALAAGCTIVVKPAEQTPLSALALAELAHRAGLPAGVLNVLTGDAANAIEIGKVFCESEIVRHLSFTGSTPVGRLLMQQCAPTVKKVALELGGHAPFIVFDDADVDAAVQGAMVSKYRNAGQTCVCANRFYVHDAVYERFVRQFAEASRGVKVGNGFLEGVDQGPLIDDDAVAKVRQHVDDALAKGARQVMGGRIEGRFVEPVLLAEVTHDMLIAREETFGPVAAVFRFRDEAEVTRLANDTQFGLASYFYSRDIGRVWRVAEALEYGMVGINTGLISNEVAPFGGVKQSGLGREGSKYGIEEYLQIKYLCMGV

SEQ ID NO: 4357 - protein, 441 aa, Burkholderia fungorum
AARLDRLPNSGWHILVRCVVGATVFFDAFDALSIALVLPVLSTRWHLTSMSIGILIASGYVGQAIGALLFGSVAERIGRIKTISLTIVIFAFASLASAFAPNYAWLCAMRVIGGIGLGGEGPAALAYISEIAPVERRGAFILSFQFMYAAGFVAASLMGAWIVPRFGWQSIFIVGSLPIILLPVLRRLCPESPRWFASRGRLEESDAALWEIEKRVSKNGKVTLSDVAPTAGPVLNRDSSVRELFSPVYRKRTINLWILWAATYFVVYGMTNWLPTLLKTVYHLPLQETLNIALLSATLGLCGNIACVALIDRIGPKHWFIGAFAGAAALFSLWLAMGDGKLVPFLILGLAAFVLSVTVSFGLFLYTAEIYPTRMRGIGAGFASFWLRVASVLAPMVIGYLLPRHGISGVFAVFAGVSAIGFLASLIGMIKTKGLRLEDIA

SEQ ID NO: 4358 - protein, 253 aa, Burkholderia fungorum
STPVCVITGSASGIGAATALRFAQAGWSVAIGNFDDSTRDAASTVEALCRDAGAQTLIFDADVGKDADCRHAVDMVASRWQRIDALINCAGTTRVIPHNAFDQIDDFEFERVYRVNLIGLYQMTRAAVPLLRESASATRSTSVVNVSSLAGLNGTGSSIAYAASKGAVNTLTLSLARNLAPHIRVNALAPGMVDDGLLLRVLDAAAYDGVLSRMTESAPLKRVSRPAEIAELAWFLTAHAPAITGQVIAAENG

SEQ ID NO: 4359 - protein, 515 aa, Burkholderia fungorum
ALTAEPPPAQFNFAAHLFRLNETRAGKPAYIDDRGVTTYGQLEEKGRRFAAVLRTLGVHAEERVLLVMQDSVELPIAFLGALYAGVVPVVANTLLGAPDYVYMLTHSHARVIIASSAVLPAVEEALAVADHDGCQLIVAQTASSKTHVPLLSELIDAATPAPKAVASGCDDIAFWLYSSGSTGKPKGTVHTHANLYWTAELYAKAILGIVEQDVVFSAAKLFFAYGLGNGLTFPLSVGATAVLMAERPTPDAIFARLTRHKPTVFYGVPTLYASMLASPNVPAREDLALRICTSAGEALPREIGERFTARFGAEILDGIGSTEMLHIFLSNRAGSVEYGTTGTPVPGYEVELRDESGHAVADGEVGDLYIKGPSAALMYWSNREKSRATFLGEWIRSGDKYRRLPNGCYVYAGRSDDMLKVSGQYVSPVEVEMVLVQHDAVLEAAVVGVDHGGLVKTRAFVALKGEFVASDALADELKAFVKGRLAPHKYPRDIVFVDDLPKTATGKIQRFKLRE

SEQ ID NO: 4360 - protein, 520 aa, Burkholderia fungorum
LKNYVAGQWVAGNGEGSTLTDPVTGEALVRVSSQGLDLPRAFDFAREQGGAALRALTYAERAARLADIVRLLEAKRDDYYAIAIANSGTTRNDSAVDIDGGIFTLSYYAKLGATLGDVHALRDGPATSLSKDQSFSVQHVLAPTRGVALFINAFNFPSWGLWEKAAPALLSGVPVIVKPATATAWLTQRMVADVVEAGILPQGALSVICGSSAGLLDQVQAFDVVSFTGSAETAAILRAHAAFVQRGARLNVEADSLNSAILCADATPDTPAFELFIKEVVREMTVKSGQKCTAIRRAFVPEASLEAVLDALKAKLAKITVGNPRNDSVRMGSLVCREQYESVLAGIAALREEAVLAYDGSAVPPVDADPAIAACIAPHLFVVNDPDRATLLHDVEVFGPVATVAPYEPASDASELREAHAIALARRGRGSLVASVYSNDDAHLARVALELADTHGRVHAVSPSVQGSHTGHGNVMPMSLHGGPGRAGGGEELGGWRALAFYHRRAAIQASSTGIDVLTQ

SEQ ID NO: 4361 - protein, 462 aa, Burkholderia fungorum
RTSHAILFIDEIHTLIGAGAASGGTLDASNLLKPALSSGTLKCIGATTFTEYRGIFEKDAALSRRFQKVDVTEPTVEQTVAILRGLKSRFEEHHGVKYSSGALSAAAELSARFITDRHLPDKAIDVIDEAGAAQRILPKSKQKKTIGKNEIEEIISKIARVPPQSVSQDDRSKLQTLDRDLKSVVFGQDPAIDALSAAIKMARAGLGKLDKPIGAFLFSGPTGVGKTEVAKQLAFTLGIELIRFDMSEYMERHAVSRLIGAPPGYVGFDQGGLLTEAVTKKPHCVLLLDEIEKAHPDIYNVLLQVMDHGTLTDNNGRKADFRNVIIIMTTNAGAEAMGKSVIGFTNRRETGDEMVDIKRMFTPEFRNRLDAVISFRSLDEEIIMRVVDKFLMQLEDQLHEKKVDALFTDALRKHLAKHGFDPLMGARPMQRLIQDTIRRALADELLFGKLMNGGRVTVDVDA

SEQ ID NO: 4362 - protein, 523 aa, Burkholderia fungorum
EFDVAIVGSGLAGLSVALNLAETRRVAVVAKRSMTEGASDWAQGGIAAVLDSADSIENHVRDTLIAGGGLCDEAATRFIVEHGRAAIEWLIAQGVPFTKDDAAELGFHLTREGGHSHRRIIHAADATGHAVVATLSERVRRHPNITLLEDHYAIDLITSDRLGLPGRRCHGLYALDLQSGRTVTIEAPHTVLATGGAGKVYLYTTNPDTATGDGIAMAWRAGCRVSNMEFIQFHPTCLFHPYAKSFLISEAVRGEGGILKLPDGTRFMPNHDERAELAPRDIVARAIDFEIKKRGIDCVYLDISHQPPEFLREHFPTILARCLEFGIDITKEAIPVVPAAHYTCGGVVTDLAGRTDLAGLYAVGETSCTGLHGANRLASNSLLECIVIGRSAAQAIEEEGFSAAVHAPLPDWDESRVSDPDEEVVVAHNWDELRRLMWNYVGIVRTDKRLARAKHRLALLRDEIHEYYANFKVSRDLLELRNLVDVASLIVEGARSRRESRGLHFSRDWPATLPKALPTVLSP

SEQ ID NO: 4363 - protein, 510 aa, Burkholderia fungorum
TWRQLAIDVERHGAALQSLGIIAGAKVGILMPNGYEWVVWAYAAASIGAVVVPLNTRFLAAELAYQLATADIEILVLSPIIGDTDFLAIVAAMVPALSEAQPGAWRSETLPRLRHIVTTGTSTTFVGELSAGSLTASPIDPAAIIRVHEAAAKVKPDDPVLIQFTSGSTALPKGAMLSHQSTLRNAHDVAARLHITHADRIFVPGPFFHVGGLTLGMLLGLSTGAPIHTLARFDPAAVLATIAREQITVYSGVDSLFITLYKYPGFRREAIASVTKGWIASSPDIVRMVQTEMGLTGISNVFGISEASPNVTIGDLDEPPALRAATCGRPHPGCEVKIVDPATGETVPAGESGEILYRGYSLMLGYYNNPAATAKAIDVDGWLHTGDRGILRASGHLEYHGRIKDMLRVGGENLAPAEVEEALCRHPKVRQAAVIGLPDERLVEVPAAVVELKEGETCSAEEITAWCAARLAAFKVPRVIAFVEQMPMTGSGKIQKTRMKQEVFGISTSQ

SEQ ID NO: 4364 - protein, 225 aa, Burkholderia fungorum
KVAVFTAAGSGMGAAAARRFAADGFKVGILSSSGKGEALAAELGGLGVTGSNRSNDDLARLVELVISRWGRIDVLVNSAGHGPRAPVLALTDEDWHTGMETYLLNVIRPTRLVTPVMQKHGGVIVNISTAWAFEPSELFPTSAVFRAGLAAFTKIFSESHAKDNIRMNNVLPGWIDSLPATDERRQSVPLQRYGTSEEVAATIAFLASEGAAYITGQNIRVDGGV

SEQ ID NO: 4365 - protein, 260 aa, Burkholderia fungorum
ITGSTRLVGIVGSPVSQVASPANFNAHFATTGADIAMIPLDIDAEAIDAFTVLLRGWKNLLGCVVTVPYKQTLVPHLDALSARSAALGAVNVIRREADGRLIGDMTDGAGFLAAAQAHGFRAAGQTALIAGAGGAGSAIAYALCEARIGHLTLGDIDRARADLLAKRLGQAFPEVEIDVGLTGASHADLLVNATPAGMDGTTAFPVPAGLLKACAPHVLVADVVTSPVMTPLLLRAQELGCRIQTGIEMAAAQMQALGAF

SEQ ID NO: 4366 - protein, 472 aa, Burkholderia fungorum
EFDVVVIGAGPGGYIAAIRAAQLGKTVACIEKWKNPAGALKLGGTCLNVGCIPSKALLASSEEFENASHHLADHGISVENVKVDIAKMMARKEGIVEKMTKGIEFLFRKNKITWLKGHGKFTGKTDAGVQIEVSGEGETETVTAKNVIIATGSKARHLPNIPVDNRIVADNEGALSFESTPKKLAVIGAGVIGLELGSVWRRLGAEVTVLEALPEFLGAADQALAKEAAKQFKKQGLDIHVGVKVGEVKTTDSGVTIAYTDKDGNAQTLEADRLIVSIGRVPNTDNLGLEAIGLKANERGFIDVDEHCATAVPNVYAIGDVVRGPMLAHKAEDEGVLVAEIIDGQKPHIDYNCIPWVIYTEPEIAWVGKTEQQLKAEGREIKTGQFPFMANGRALGINKADGFVKMIADAKTDELLGVHIISANASDLIAEAVVAMEFKAASEDIGRICHPHPSLSEVMREAALAVDKRALN

SEQ ID NO: 4367 - protein, 427 aa, Burkholderia fungorum
MAIVEVKVPQLSESVSEATMLQWKKKPGEAVAQDEILIEIETDKVVLEVPAPSAGVLAQVIANDGDTVTADQVIAKIDTEGTASAAAVEAEVKPAPQAAPAPAAAPAPAAQAASATGANTAASPAAGKLMAEKGLGAGDVAGTGRDGRITKGDVLTAGAPAAKAAAPAPAAAPKAAKPSLPDVKAPASAEQWLKDRPEQRVPMSRLRARIAERLLESQQTNAILTTFNEVNMAPVMDLRNKYKDKFEKEHGVKLGFMSFFVKAAVHALKKFPLVNASIDGNDIVYHGYFDIGIAVGSPRGLVVPILRNADQLSLAEIEKKIAEFGQKAKDGKLSIEEMTGGTFSISNGGVFGSMLSTPIINPPQSAILGVHATKERAVVENGQIVIRPMNYLALSYDHRIIDGREAVLSLVAMKDALEDPARLLLDL

SEQ ID NO: 4368 - protein, 943 aa, Burkholderia fungorum
MMKQFQSNSYLFGGNAPYVEEMYEAYLDNPASVPENWRSYFDALQNVPASDGSNANDVAHGPIVESFAQRAKANAFIPRGAGGGEDLATARKQVYVQSLIGAYRFLGSQWANLDPLKRRERPAIPELEPAFYDFTEADMDQEFSATNLYFGFERASLREIVKALRDTYCGTIGAEYMYISDPEQKRWWKEKLESIRSTPNFSNEKKKHILNRLTAAEGLERFLHTKYVGQKRFSLEGGESFIASMDEVVRHGGANGVQEIVIGMAHRGRLNVLVNTLGKMPADLFAEFEGKHVDDLPAGDVKYHKGFSSDVSTEGGPVHLSLAFNPSHLEIVNPVVEGSAKARMDRRGDDSGLQVLPVQIHGDAAFAGQGVVMETLNLAQTRGYGTHGTLHIVINNQIGFTTSDPRDSRSTLYCSDVVKMIEAPVLHVNGDDPEAVVLATQLAIDFRMQFHKDVVVDIVCFRKLGHNEQDTPAVTQPLMYKTIAKHPGTRALYAEKLVQQGVITAADADEYVKAYRKAMDEGHHTVDPVLSNYKSKYAVDWVPFLNRKWTDAADTAVPLAELKRLAERITTIPENFKVHPLVERVINDRRAMGRGEAKLDWGMGEHLAFASLVASGYAVRLTGQDSGRGTFTHRHAVLHDQNRERWNDGTYVPLQNIAEGQAKFTVIDSVLSEEAVLGFEYGYSTAEPNTFVAWEAQFGDFVNGAQVVIDQFISSGEVKWGRVSGLTMLLPHGYEGQGPEHSSARIERFLQLCADHNMQVVQPTTPAQIFHLLRRQMIRLFRKPLIVATPKSLLRHKEAVSDLSELAKGAFQPILGEIDEAIDAKKVKRVVVCSGRVYYDLLAHRRESKSNDVAIIRIEQLYPFAHKQFEAEMKKYDNATEVVWVQDEPQNQGPWFYIEHHLKDGMKEGQKLAYSGRPASASPAVGYYAKHYEQQKALVEGAF

SEQ ID NO: 4369 - protein, 659 aa, Burkholderia fungorum
MRIDKLTTKFQEALADAQSLAVGHDNQYIEPVHVLSALVAQQDGSARSLLSRAGVHVQALQTALGDAITRLPQVQGTDGNVQIGRDLTGLLNQADKEAQKLNDTFIASEMFLLAVADDKGEAGRLARQHGLSRKSLESAIAAVRGGSQVHSQDAESQREALKKYTVDLTERARAGKLDPVIGRDDEIRRSIQILQRRTKNNPVLIGEPGVGKTAIVEGLAQRIVNGEVPETLKGKRVLSLDMAALLAGAKYRGEFEERLKAVLNDIAKDEGQTIVFIDEIHTMVGAGKAEGAMDAGNMLKPALSRGELHCVGATTLDEYRKYIEKDAALERRFQKVLVDEPTVEATIAILRGLQEKYELHHGVDITDPAIVAAAELSHRYITDRFLPDKAIDLIDEAASKIKMEIDSKPEEMDRLDRRLIQLKIEREAVKKEKDEASQKRLQLIEEEIERLNREYSDLDEIWTAEKAAVQGSAQLKEEIEKTRAEITRLQREGKLEKVAELQYGKLPGLEAQLKEVTKAEASEQNNPTRPRLLRTQVGAEEIAEVVSRATGIPVSRMMQGEREKLLQIEEKLHARVVGQDEAISAVADAIRRSRAGLSDPNRPYGSFLFLGPTGVGKTELCKALASFLFDSEDHLIRIDMSEFMEKHSVARLIGPPGYV

SEQ ID NO: 4370 - protein, 443 aa, Burkholderia fungorum
MEPIKVGLLGFGTVGSGTFTVLRRNQEEIKRRAGRGIEIARIAVRNPAKATAVLGAEAGTVALTDDFNAVVDDPSIDIVAEMIGGTGVARDLVLRAIRNRKHVVTANKALLAVHGTEIFEAARANGVMVSFEAAVAGGIPIIKALREGLTANRIQYIAGIINGTTNYILSEMRDRGLDFATALKAAQDLGYAEADPTFDIEGVDAAHKATIMSAIAFGVPVQFDKAYVEGISKLAAIDIRYAEELGYRIKLLGIARRTDKGIELRVHPTLIPEKRLLANVEGAMNAVVVHGDAVGTTLYYGKGAGAEPTASAVVADLVDVTRLHTADPEHRVPHLAFQPDSLSNTPILPIDEVTSGYYLRLRVADVTGVLADITRILADTGISIDALLQKESEQVDANGKGETDIILITHETVEKNVNAAIKTIEALKTVVSQVTKLRMEALN

SEQ ID NO: 4371 - protein, 340 aa, Burkholderia fungorum
MKALAKLERAPGLTLTDVKKPEVGHNDVMIRITRTAICGTDIHIWKWDDWAQKTIPVPMHVGHEYVGEIVEMGQEVRGFAIGDRVSGEGHITCGFCRNCRAGRRHLCRNTVGVGVNREGAFAEYLVIPAFNAFKIPPEISDDLAAIFDPFGNATHTALSFNLVGEDVLITGAGPIGIMAVAIAKHVGARNVVITDVNDYRLELARKMGATRAVNVSRESLRDVMADLHMAEGFDVGLEMSGVPSAFTGMLEAMNHGGKIALLGIPPAQTAIDWTQVIFKGLEIKGIYGREMFETWYKMVAMLQSGLDLSPILTHHFKVDDYREAFATMLSGESGKVILDW

SEQ ID NO: 4372 - protein, 399 aa, Burkholderia fungorum
MRDLYLAHLRDTLEQIRADGFYKNERVIASPQSADIRLADGAAVLNFCANNYLGLADDARLIDAAKQGLDSDGFGMASVRFICGTQTVHKELEQALAAFLQTDDCILYSSCFDANGGLFETLLDENDAIISDELNHASIIDGVRLSKAKRSRYKNNDLADLEARLIEAQAAGARFKLIATDGVFSMDGIIADLAGICDLADRYGALVMVDDSHAVGFVGEHGRGTPEHCGVLSRVDIITGTLGKALGGASGGYVAARKEIVELLRQRSRPYLFSNTLTPSIAAASLKVLELLASEEGAQLRARVRENGAHFRSKMSALGFTLVPGEHPIIPVMLGDAQLASKMADALLKEGVYVIGFSFPVVPKGRARIRTQMSAAHTPGQIDRAVDAFARVGRELGVI

SEQ ID NO: 4373 - protein, 392 aa, Burkholderia fungorum
MTDAVIVSTARTGLAKSWRGGFNMTHGATLGGHVTQAAVERAKLDPARVEDVIMGCANPEGATGMNIARQIALRAGLPVSVPGMTVNRFCSSGLQTIALAAQRVIAGEGDVYVAGGVESISCVQNEMNHHMLTEGWLSENKPEIYWSMLQTAENVAKRYSISKERQDEYGVRSQQRAAAALEAGRFKDEIVPLTVLAGVTDKAGGRLFTKEVTVSGDEGIRADTTLEGVSKIRTALPGGVITAGNASQFSDGASACVVMNAKVAEREGLQPLGIFRGFAVAGCEPDEMGIGPVFAVPKLLRQAGLKVEDIDLWELNEAFAVQVLYCADKLGIPQDRLNVNGGAIAVGHPYGVSGARLTGHALIEGKRRGAKLVVVTMCIGGGQGAAGLFEVV

SEQ ID NO: 4374 - protein, 201 aa, Burkholderia fungorum
RGKFITFEGIDGAGKTTHLSWFRERLEQKVASTGRSVVMTREPGGTPLGEQIREIVLHQKMDLETEALLMFALRRQHLAEVIEPALARGDWVLSDRFTDATFAYQGGGRGLPRDKLETLERWVQGGFQPDLTVLFDLDPEVASERRSAARDPDRFESESEAFFSRTRAEYLRRAEEAPYRFAIIDSAQSIAQIQRRLEELI

SEQ ID NO: 4375 - protein, 458 aa, Burkholderia fungorum
MGRLIVVSNRVATPTETKGSAGGLAVGVFGALKDAGGVWFGWSGDVVSETVANAGPTLEQDGAVTFATVGLTRKDYDQYYRGFSNATLWPVFHYRNDLARYEREEYTGYRRVNAWLAHKLIKLLEPDDVIWIHDYHLIPFAEALRNEGVTNRIGFFLHIPFPAPQILLNIPPHEELVKSLSCYDLLGFQTATDELAFKDYVTRHARGTVSADGLVEAFGRKLRTGVYRIGVFPDEIAEQAKRYESRQHVLDLKQSLEGRKLIMSVDRLDYSKGLVERFRAFEHLLERSPEWRGNVTLVQIAPPTRSDVATYQKIRQDLEYEAGRINGRYSGLDYTPIRYLNQQYDRWKLMSLFRESQIGFVTPLHDGMNLVAKEYVAAQNPDDPGVLVLSIFAGAAAELSGALLVNPHDAIGMCEALQRALQMPLDARQRRHEINMAALRKNDLGVWRDTFLHDLRSV

SEQ ID NO: 4376 - protein, 323 aa, Burkholderia fungorum
MKIAQIAPLTESVPPKLYGGTERVVSYITEALVDLGHDVTLFASGDSVTNAKLEAVWPRALRLDPGIRDRVAPHMLLMELVRRQAENFDVLHFHLDYYSFSVFKRQETPFVTTMHGRLDLPEQQPVFDTFNTAPVISISNAQRHPLPQARWLTTVYHGLPEQLYTPQPVEQKYLAFLGRISPEKRVDTAIRIAGRCGMPIRIAAKVDAADREYFERDIRPLLDLPYVEFIGEIADHQKAEFLSGAHALLFPIDWPEPFGLVMIEAMACGTPVIAFNRGSVPEVLEDGVTGFIVEDEIGAVAAVNRLHKMPRAGVRQRFEERFT

SEQ ID NO: 4377 - protein, 896 aa, Burkholderia fungorum
SRNSTAVPGKGKFYSLPQLGRALDIKIDRLPVSIRIVLESVLRNYDGKKIAEEHIEQLANWKPTASRVDEIPFVVSRVVLQDFTGVPLLADIAAMRGVAKHMGKDPKSIEPLVPVDLVVDHSVQIDHFREKNALDLNMKLEFQRNNERYQFMKWGMQAFDTFKVVPPGVGIVHQVNLEYLARGVHKKAEGADTVYYPDSLVGTDSHTTMINGIGVVGWGVGGIEAEAGMLGQPVYFLTPDVVGVNLKGKLREGVTATDLVLTITELLRKEKVVGKFVEFFGEGTRSLSLPDRATIGNMAPEYGATMGFFPVDEKTIDYFKGTGRTDAEISAFQNYFKAQNLFGIPKEGDIDYTKVVTLDLGSVAPSLAGPKRPQDRIEIGNVKATFSDLFSKPVAENGFAKKAEDLEAQYTTSNGVDVKNGDVLIAAITSCTNTSNPSVLLAAGLLAKKAVEAGLTVAPHIKTSLAPGSRIVTEYLTKTDLMKYLDKLGFTLAAYGCTTCIGNAGDLTPELNEAITKNDIVAAAVLSGNRNFEARIHPNIRANFLASPPLVVAYAIAGNITRDLMTEPVGKGKGGKDIYLGDIWPTSEEVNDLLKFALDPEAFRKNYSALTKKGDLWSKIEGEEGQVYDWPKSTYIAEPPFFGKDFSMTPADSIAAVTNARALGIFGDSVTTDHISPAGSIKEDSPAGKWLKENGVQKADFNSYGSRRGNHDVMMRGTFANVRIKNLMIPTKADGSRVEGGLTIHQPSGEQLSIYDAAMKYIEAGTPTIVFAGEEYGTGSSRDWAAKGTQLLGVKAVVARSFERIHRSNLVGMGVLPLQFKGSDSVQSLGITGEETYDIEGLGADFKPQQEVTLVIRGKDGKEKRVQVLLRIDTPIEVDYYKHGGILPFVLRSLLA

SEQ ID NO: 4378 - protein, 666 aa, Burkholderia fungorum
TPAPRPLRAIQPLPDQLISQIAAGEVVERPASVVKELLENALDAGAQSLRILLDEGGVKRISITDDGCGIPENELALALMRHATSKIRSLAELEAVATLGFRGEALASIASVAQMTITSRTADAAHAVRVDAQTGVLSPAAGTQGTTIEVRELYFNTPARRKFLKSEQTELGHCLEQIRRAALARPDVAISVLHNGKAVEHWNASEPPVRVAKILGDTFATAHLPLDESAGPLAVYGCAGLPTASRGRADQQYFFVNGRFVRDKLLTHAVRAAYEDVLHGERYPSYVLFLDLPPEAVDVNVHPSKIEVRFRDSRSIHQFVFHAVQRALARHAGASPETTAGGHAAHLAPSVSGPASFGATPLGGAGVGGVGFGAGNGAGGIGGGLGGASGGGFGSSSQQPGNTWMRQARMTQGTLPVAQPLAFYDALFGRKDTNAGTAEGATLFEARDSAAEAPSPYNASAPYPAPAFHAADEQPLGFALGQIHGIYVLAQNAHGLVIVDMHAAHERILYEQFKNALADRTIAVQPLLIPQSMQADPVEIGTVEEERDTLDALGFDLAVLSPTTLAIRAVPALLKDADLQALARAVLSDLHAFGGSRVLTERQHELLGTLACHHAVRANRRLTLDEMNALLRQMEATERADQCNHGRPTWYQLTLSDLDRLFMRGQ

SEQ ID NO: 4379 - protein, 246 aa, Burkholderia fungorum
VKLIGRTVLITGGSSGIGLELAKQLIARGNSVIVTGRNRARLEAARQAVLGLHAFQSDVSDPASIELLYQKVSASFPLLDTLVNNAGAMRNIKLDQQYQLNDLTAEINGNLNGTIWMVQTFLPLLLRQKGSLIVNVSSGLAFVPFPAAPIYSASKAAIHAYTRCLRAQLEGSFVSIVELAPPGTETPLFRGEFAEEMKGEKGMDVSVLVKHTIDGIEAGKQEVRPGLSNVLKIASRVAPQFMFRQM

SEQ ID NO: 4380 - protein, 246 aa, Burkholderia fungorum
MTQRIAYVTGGMGGIGTSICQRLHKEGFKVVAGCGPNSPRRVKWLDEHKALGFDFIASEGNVGDWESTRSAFDKVKAEVGEIDVLVNYAGITRDVVFRKMTHEDWTAVIDTNLTSLFNVTKQVIDGMVERGFGRIINISSVNGQKGQFGQTNYSTAKAGIHGFTMSLAQEVATKGVTVNTVSPGYIGTDMVKSIRPDVLEKIIATIPVRRLGQPQEIGSIVAWLASEESGFATGADFSLNGGLHMG

SEQ ID NO: 4381 - protein, 392 aa, Burkholderia fungorum
MTDVVIVSAARTAVGKFGGSLAKIAAPDLGAAVIRAVLERAGLKPEQVSEVILGQVLTAGSGQNPARQSLIKAGLPSAVPGMTINKVCGSGLKAVMLAANAIIAGDADIVIAGGQENMSAAPHVLPGSRDGFRMGDAKLVDSMIVDGLWDVYNQYHMGVTAENVAKEYGITREQQDAFAALSQNKAEAAQKSGRFDDEIVPIEIPQRKGEPLRFATDEFVRHGVTAESLAGLKPAFSKEGTVTAANASGLNDGAAAVLVMSAKKAEALGLTPLARIKAYANAGVDPKVMGMGPVPASRRCLERAGWTPADLDLMEINEAFAAQALAVHQQMGWDTSKVNVNGGAIAIGHPIGASGCRILVTLLHEMQKRDAKKGLASLCIGGGMGVALAVER

SEQ ID NO: 4382 - protein, 242 aa, Burkholderia fungorum
FTGKTALVTGGNSGIGFVTAKLLIAEGARVAITGRDRAKLDQAVAELGENALGVQANLDDEAAIGALFEQIKGAFGSLDIVFANAGISGPTPLGGTSAAAFEAILRTNLTAVFLTVQAALPLMSAGGAVVLNGSVMRELGSPGSAAYSATKAGITGMAKVFASELVQRGIRVNTVIPGGTRTPIWTRGAREGATLDGTEQAFAPRIPMARLARPEEVAAAVLFLASGDASGMTGAEIVVDGG

SEQ ID NO: 4383 - protein, 496 aa, Burkholderia fungorum
  unsure (1)..(496): unsure at all Xaa locations
LIDGEFVDSATTEWRDVVNPATQEVLARVPFTTVAEVDAAVRSAHAAFATWKNTAIGARLRIMLKFQALIREHMPRIAKTLTAEQGKTLPDAEGDIFRGLEVVEHACSIGTLQQGGFAENVAGGVDTYTLQQPIGVCAGITPFNFPAMIPLWMFPMAIVCGNTFVLKPSEQDPLSTMQLVELALEAGIPKGVLNVVHGGKEVVDAICSHPLVRAISFVGSTTVGTHVYRLGSEHGKRVQSMMGAKNHAVVLPDANREQTINALVGAGFGAAGQRCMATSVVVLVGASKDWVPELVEKAKTLKVNAGHEPRTDVGPVVSRAAKTRVLGLIESGVKQGATLALDGRDVKVPGYEDGNFVGPTIFTDVTTDMDIYTQEIFGPVLVVLAAATLDEAIAIVNANPFGNGVGLFTQSGAAARKFQSEIDIGQVGINIPIPVPVPYFSFTGSRGSKLGDLGPYGKQVVQFYTQTKTVTARWFDDATVNDGVNTTISLRXPASQ

SEQ ID NO: 4384 - protein, 377 aa, Burkholderia fungorum
MDEFYTDDQRMIRDAARDLSTGRLAPYAADWDREGSLPDEVVSQLGELGFLGMIVPPELGGSYTDYVAYALAIEEIAAGCASCATLVSVHNSVGCGPVLQYGSEAQKDRWLGKLASGEAIGAFCLTEPQAGSEANNLRTRAELHNGRWVLNGSKQFVTNAARAGVAIVFAVTDPTAGKRGLSAFIVPTDTPGFNVGPPEKKLGIRASDTCPVALENCAIPEANLLGSRGEGLKIALSNLEGGRIGIAAQALGIARAAFEVARSYAHERVQFGEPLVRHQSVANLLADMATRLNAARFLVHHAARLRTLGKPCLSEASQAKLYASEMAEEVCSHAIQIHGGYGYLNDYPVERHYRDARITQIYEGTSEVQRMVIARQL

SEQ ID NO: 4385 - protein, 503 aa, Burkholderia fungorum
DEMARGNDSPALWIVDDPASAGTRLTFAQMAERSSRVANFLREQGVARGDRLLLMLPNRVELWEVMLAAMKLGAVVLPATTQLSSDDVCERVEVGAVRFVIVDGSEVGKFDGIEATVKRIVVGTRAAVTQGWIDFALAYEASPAFKPDGPTNASDPLLLYFTSGTTSRPKLVEHTHQSYPVGHLSTMYWIGLRPGDVHWNISSPGWAKHAWSCFFAPWNAGACVFVYDYTRFVPKDTLNVLVQCGVTTLCAPPTVWRMLVQEPLASYPVKLREIVGAGEPLNPEIIERVRHAWGTTIRDGFGQTETTCQIGNSPGQPVVAGSMGRPLPGYRIELVDADDHAASEGEIALSLAHRPTGLMTGYANNPQATEYAMRNGLYHTSDVALRREDGYFVYVGRADDVFKSSDYRLSPFELESVLIEHEAIAEAAVVPSADAVRLSVPKAFVIVRHGYQIGPELAREVFRFSREKLAPYKRIRRLQFSDLPKTISGKIRRVELRRREMER

SEQ ID NO: 4386 - protein, 301 aa, Burkholderia fungorum
DAQAVRSWLQGLQTQIADTLGAFDGTPFATDAWQRAPGEKLRGGGYTRILEGGNFFERAGIGFSDVAGDALPASASAARPQLAGRGFEAMGVSLVLHPHNPHCPTVHMNVRLLIATKAGEEPVFWFGGGMDLTPFYGYEEDAQHFHRTCRDALQPYGADLYPSFKRWCDEYFFLRHRNEPRGIGGIFFDDFSAPGFDQSFAMLRSVGDAFLKAYLPIIEKRRNIPYGQAERDFQAYRRGRYVEFNLVFDRGTLFGLQSGGRTESILMSMPPVVNWRYNWQPEPGTPEARLYSDFLVPREWV

SEQ ID NO: 4387 - protein, 528 aa, Burkholderia fungorum
NSLPSWSSLQTHYEKIRDAHMRDWFAPENDPAPTRAERFAFAGGGLAADFSKNRITDETLKLLVQLAREAGVEKRRDAMFAGAVVNPTEGRAALHTALRATDPKAPFYDQVQAERARMAAFADQVRSGEWKGYTGKRIRYVVNIGIGGSDLGPKMVVHALHHLATPEITTHFVSNVDGADLYNVMQQIDPEETLAIIVSKTFTTLETMTNARSLRDWFVEKGCPESALAKHFVGVSANPAEVVKFGIAKENVFEMWDWVGGRYSLWSAVGLSIMIAVGPQQFGELLAGANEMDQHFRDAPLEKNLPVLLGMIGIWYRNFFGSQSYLVAPYSEALHFLPSYLQQLEMESNGKSARLDGVMVDYPTAAVTWGEPGTNGQHAFFQMLHQGPTIVPIDFIAVLTPEHPLVSHHPKLLANCFAQSEALMLGRTLEEAKKVAGADKPELAPHLVFPGNRPTSTLLVDALTARSLGALIALYEHKVLVQASVWDINPFDQWGVELGKILGKVVEADLTAPSVDEKKHDSSTSALI

SEQ ID NO: 4388 - protein, 209 aa, Burkholderia fungorum
EARERMVERQIARRGVVNPHVLAAMRRVPREEFVAADLREFAYEDTPLPIGNEQTISQPAIVAAMIDAAEVSPGERILDVGTGSGYAAAVAAAIAQHVDSIERHAGLVATAREVLRRLQISNVTIHLGDGTVGLAEHAPYDAIIAAAGGPHVPDAWRRQLAVGGRIVMPVGRDPHHQRLIKLVRRSEQDYDESWLGEVRFVPLVGEDAW

SEQ ID NO: 4389 - protein, 366 aa, Burkholderia fungorum
MTAMMKAAVFIEPGRIELADKPVPDVGANDALVRITTTTICGTDVHILKGEYPVAKGLTVGHEPVGVIEKLGSAVLGYQEGQRVVAGAICPNFNSYAAQDGVPSQDGSYLIARGLCGCHGYKATAGWRFGNMIDGTQAEYVLVPDAQANLAPVPDGLTDEQVLMCPDIMSTGFKGAENANIRIGDTVAVFAQGPIGLCATAGARLLGASTIIAVDGNDHRLEIARKMGADVTLNFKNCDVVDEILKLTGGRGVDSSIEALGTQSTFESALRILKPGGTLSSLGVYSSDLTIPLGAFAAGLGDHKINTALCPGGKERMRRLLNVVESGRVDLGALVTHHYKLDDIVAAYDLFANQRDGVLKVAIKPH

SEQ ID NO: 4390 - protein, 474 aa, Burkholderia fungorum
FANYIDGQWVDGASVSRNVNPSNLDDVIGEFAQADAEQTQRAIRAARNAFAQWSLSTPQQRFDLLDQAGSTILARKAELGRLLAREEGKTLPEAIGEVGRAGQIFKFFAGEALRIGGEIVPSVRPGMTVEVTREPLGVIGLITPWNFPIAIPAWKIAPALAYGNTVVVKPADLVPASTWELVRIIAEAGAPAGVINLVMGQGAVVGEALVSSPQVDAVSFTGSVATGRAIGAKCFASGKKFQLEMGGKNPMVVLDDADLDVAVEACINGGFYSTGQRCTASSRFIVTEGIHDRFIDAMKARMQALKVGDALADGTHIGPVVDDKQLQQDERYIAIAREEGGTIFGGERIERDTRGYFLAPALITDTTPDMRINREEVFGPVASVIKVKDYNEALAVANDTEFGLSAGICTTSLKYSSHFRRHVQAGMVMVNTATAGVDYHVPFGGRKGSSYGPREQGSYAREFYTTVKTAYVSP

SEQ ID NO: 4391 - protein, 267 aa, Burkholderia fungorum
CVWPVHAELGEGPLWQAGENAVYFVDIKGRQIHRLTVTTGQTQTWKAPGQPGFIAPLAGHGFVCGLPGGLYRFDAGSGQFSKLKDVEVHLPGNRLNDGFVDASGHLWFGSMDDGEEQPSGTLYRVNHAGEAVAQDDGYVITNGPASSPDARTLYHGDTMRRVVYAFDLGEDGTLSRKRIFAAISGDGYPDGMAVDADGFLWVALFGGWRIERFSPDGKRVEQVPFPCANVTKLAFGGDDLQTVYASTAWKGLSPVARQQQPDAGGLF

SEQ ID NO: 4392 - protein, 243 aa, Burkholderia fungorum
LSGKTVVITGGGSGIGAAMVEAFARQGARVFFLDVAEDDSLALQQSLSDAPHPPLFRRCDLRSVDAIHSAFAGIVEIAGPIEVLVNNAGNDDRHEVDAITPAYWDERMAVNLRHQFFCAQAAAAGMRKIGRGVILNLGSVSWHLALPNLAIYMSAKAGIEGLTRGLARDLGAAGIRVNCIIPGAVRTPRQMQLWQSPESEAKLVASQCLRLRIEPEHVARMALFLASDDASRCSGRDYFVDAG

SEQ ID NO: 4393 - protein, 705 aa, Burkholderia fungorum
  unsure (1)..(705): unsure at all Xaa locations
GLDVPVFILVERHLLQEIPVAVLGHVTGYIFIEEDTPEFVARNLVSHLHSYADSLKTPFFGAMVDYAEQANQMWTCPGHNGGVFYQKSPIGRAFVKHLGEAVFRNDLDNSVIELGDLLVHEGPALAAQKAAARIFGAERTYFVLNGTSTSNKIALTALVAPGDLVLFDRNNHKAAHHGALLLGGGLPVYLPTVRNVHGMIGPIDFETLDETRIRDSIRRNPLIKDPQAWQRKRPFRVAIIEQCTYDGTIYDVQMLVEKLGPLCEYIMFDEAWAGFMKFHPLFKGHFAMGLEALGADAPGIIAAQSTHKQLAGFSQASQIHVKDAHLDGQRRQVSHRRFNEMFMQHSSTSPFYPLFASLDVGAQMMRGRSGEVLWDDTIKLGIEMRKKIRALRREYEATETDVARQWFFDPFVPDVVQGQDRIERWEDIPTDELAASTRYWELAPGQKWHGYGALAPGYVMTDPNKLTLLTPGFNRETGEYAEHGIPAAVLAEFLREVRIVPEKNDLNSILFLLTPGLESSKAGTLLSALVRFKQLHDDNALLEDVIPSFVAAHRARYAGVGLRRLCAQMHDFYRERNVSRLQREQFRAAHFPEAAMPPQQAMHELVRNNVELLPIDQIRGRIAATLALVYPPGIGVIVPGERYDERALPMLDYFRMFEDGGNRFPGFENEIQGIYRKTESDGSMRLYTYVVTEXPISGEATMTLG

SEQ ID NO: 4394 - protein, 401 aa, Burkholderia fungorum
VHSEAGRLRTVMVCAPGLAHRRLTPANCGALLFDDVIWVDKAIEDHQTFTRLLRERGIEVLEFHHLLAEVCLNTTARDWILNRRIVEEEVGTGMLRELRLWLEDMPAQQLADVLIGGVAKAELPFDARGLFGGYLERSEFVIQPLVNLMFQRDPSAWIYGGVTLHPMFWPARRKETLLLAAVYAFHPRFAGKVRTWWGGPDTNFGVETLEGGDVMPIGNGVVLIGMGERSSPQAVTQVARALFAGNGARRVIACQLPKARSSMHLDTVFSFLDVDFVSVYPDVADDIRCTSLYPGDDLGQIRYERHEDKFLAVVSGALGVGSLRVLTTGGDTYETEREQWDDGNNVLALDRRVVLAYDRNTYTNRKMRQAGVEVIEIPGGELGRGRGGSHCLSCPIERDAI

SEQ ID NO: 4395 - protein, 332 aa, Burkholderia fungorum
IMFNVHNRSYLTLIEYTPRQIRYLLDLSRDLKRAKYAGTETPRLNGKNIALIFEKTSTRTRCAFEVAAHDQGAHVTYIDPNGSQIGHKESMKDTARVLGRMYDAIEYRGFGQEIVEELAKYAGVPVYNGLTDEFHPTQMLADVLTMHEFSDRPIHDIAYCYIGDAHNNTGNSLMIVGAKLGMDVRLCAPRCLWPHDELIEQCRAIAATTGARLTLTEKPEEAVKGVDFIYTDVWVSMGEPFEKWGARIEELLPYRVNAALLAASGNPRVKFMHCLPAFHDSNTHVGKQIADQYGLPNGVEVTDDVFESDASIVFEQAENRLHTIKAILVATL

SEQ ID NO: 4396 - protein, 257 aa, Burkholderia fungorum
MKIATWNVNSLKVRQQHVIDWLETSGTDVLCLQELKLPDEKFPRAELEEKGYRSWFAGQKTYNGVGILVRGGLTVDESSIVRNIPGFEDPQQRVIAATIDGVRIISAYFPNGQAPGTDKFAYKLRWLAALHDWIASEMALHPKLALLGDYNIAPEDRDVHDPKAWEGQNLVSPEERAAFVQLIGLGLVDAFRQFEQPEKIYSWWDYRMMAFRRNAGLRIDHILLSKALAEICSSCEVDKVPRKWDQPSDHAPVVAQL

SEQ ID NO: 4397 - protein, 692 aa, Burkholderia fungorum
DNPLLDFSDLPRFGQIRPEHVTPALDVLLADASAAVERAAQPITPASWADVVEPVERATEPLSRAWSVVGHLNAVADTPELRAVYGENLPRVTEFWSSVGQNLALYEKYKALHASSDFESLTGERKKILGNALRDFRLSGAELPEDQKPHFAELQERQAALSKAFSDHVLDATNAYAYIVEAGAEAQLAGLPEDVIEAAREATEREGKTGYKFTLHFPSYFPVMQYSENRPMREAMYRAYVTRASELGPQYGNGKPEWDNTAVLAEQLKLRAEEAHMLGYNNFAEVSLAPKMAESPAQVMSFLEDLATRARPHAEQDWKELREFAANELGMSELQPWDMTFAAERLRQKRYSFSENEVKQYFPEDTVFKGLFKVTETLFGVRIRRDKADVWHPDVRFFRVENQDGGLVAQFYLDLYAREGKRGGAWMDDARGRHRHTHGGVQTPVAYLTCNFSAPVGGKPACFTHDEVITLFHEFGHGLHHMLTRVDELGVSGINGVEWDAVELPSQFMENFCWEWDVLSDMTSHVETARPLPRELFDKMLAAKNFQSGLGTLRQIVFSMFDMQLHTDFDASGTKSVTELASEINERFHVVPQAPFSRWPNTFSHIFAGGYAAGYYSYKWAEVLSADAYAAFEEAAQSASGSVLDQATGMRYRKEILEVGGSRPAMESFKAFRGREPNIDALLRHNGMTPGA

SEQ ID NO: 4398 - protein, 279 aa, Burkholderia fungorum
MTAKLIDGLALSKTLRADVAARAAALTARGHQPGLAVVLVGDNPASEVYVRNKVKACHDNGLGSSFDRYPADLPEAELLARIDELNRDPRIHGILVQLPLPPHIDSHKVIEAIAPEKDVDGFHVANAGALMTGQPLFRPCTPYGVMKMLAAYEIPLQGANAVVIGRSNIVGKPMALLLLEAGATVTICHSKTRDLAAHTRNADVVVAATGLRNILTADMVKPGAAVIDVGMNRDEAGKLCGDVDFAGVKEVAGYITPVPGGVGPMTITMLLVNTIEAAE

SEQ ID NO: 4399 - protein, 288 aa, Burkholderia fungorum
  unsure (1)..(288): unsure at all Xaa locations
MSIQKVGVVGAGTMGNGIAQVCAVAGLQVAMIDISGAAVTDGLATIESSLERLVRKDKLSAADRAAALARVSGNTDYAALKGAGLIIEAATENPGIKLRILRQIDEAAEDDAIIATNTSSISITLLAAVLKQPERFIGMHFFNPVPMMALLEVIRGLQTSDETHAKTLAFAQTIGKTAITARNSPGFAVNRILVPMINEAIFTLQEGLATADDIDTGMRLGCNHPIGPLALADLIGLDTLLAVMQVFYEGFNDPKYRPAPLLREMVAAGRLGRKSGRGFHSYAXRAPL

SEQ ID NO: 4400 - protein, 377 aa, Burkholderia fungorum
MKRTCFDAGMEQFRDSARKFFAGEIAPHRERWREASVVDREAFRKAGEMGYLCMWIDECHGGLGLKDLRYEQILIEENIFHGDRGFFFWLHSRLVAPYLEHFGTDEQKQRYFPGIRSGEQILAIAMTEPDAGSDLAGMKTRAEETGDYWVLNGSKTYISNGLNADVVLVAARTHPTKAHGLTLFLVERGMEGFERGRNLRKMGLKSQDTAELFFHDVKIPKSHVLGQVHAGFQHLMRGLAEERLLAAIFNVASARLAMHLTCDFVRERKVFGKPLSSFQNTRFKLAALDTEIEVAQSWVDRLVAEHNADQLDAVDAARAKLFTSELNGRMVDEGVQQHGGAGYMDEYEICRLYQDERIHRILAGTSEIMKEIVARSI

SEQ ID NO: 4401 - protein, 400 aa, Burkholderia fungorum
MSSPFIYDHVRTPRGRGKPDGALHEATSVHLAATVLSALRERTGLDTRQVEDIVFGVVAPVGEQGQCLPRVAALQAGYAQEAAGVQINRFCGSGLEACNMAASKVHAGAEGFVIGGGAESMSRVPMFSDGGAWSVDPVTAFASNFIPQGISADLLATMWNYSREEVDGFAVRSHRLAAQAWAEGRFDRSVVPVRGVLNEVLLAKDETVRPNCTPADLAGLKPSFAELGRKGGFDALAIQRYPTVETIRHVHHAGNSSGIVDGACAVLIGSEAAGRAAGLTPRARIRAFAEIGSEPTIMLTAPSFAAERALRRAGMSASDIDLYEINEAFAAVALRFIDALGLDDGKVNVNGGAIAMGHPLGATGAMILGTALDELERTGKGTALVTLCIGAGMGVATIIE

SEQ ID NO: 4402 - protein, 487 aa, Burkholderia fungorum
AVVCGEERLTWRELDIRTNQVANAIRALGFDKGDKIALFMPNSLALFELFWGVVKAGCVVVCLNTMLEGSALARITNSSDARAMFAGGSSRTLVDEVRDRLEGIAPEHFYSVDSPGDGWNSAQTLFDAAPSTPPQVTILPSDSMTIIYSSGTTGVPKGIEHTHFGRLNYPHGFAMGLAINRYSVAVCATPIYASGTWITMFPTMYRGGTVVLLPQYSPEAFIDAVRRERGTHSFLVPTQYIGLLQQPLQNYDLGSLKALVTAGQSLLPATYAALLRAFPHAGIYEVYGMTEGFSTLAIPEDVARGKTGSVGKPSFLDDVRIIDEQGRELPPGETGEIVAYGPGMMKGYYNRPDMTEAATWISPAGRTYMRSGDLGQMDEDGFLYVNGRLKDMIKSGGINIYAADLEQVVIEHPAVHEVAVIGVPHEKWSETPVAVVLLKPGASAEPDVLMRWVNQRLSKYQRLSLLLIRDELPRAIYGKVQKQALRE

SEQ ID NO: 4403 - protein, 241 aa, Burkholderia fungorum
LKTRSAVVTGAAGAIGKAIAKRLLDSGAAVCLWDINEEAVKQSCAELTESGPVEWAVVDICDPLAVSVGLARVIENVGRIDILVNNAGVSGAQVPLEEYDLSEWRRVIESNLTGAFVCSQAVIGAMRAGGYGRIVNVASVAGKEGSPRLSAYSAAKAGMIAMTKSLGKELAMSPVLVNCVTPGPTRSRMTAETPKEQLALMLSKAPMQRMMEPHEVAAMVAWLCTEECSYTTGAVHDLSGG

SEQ ID NO: 4404 - protein, 238 aa, Burkholderia fungorum
NELTDTLIAITGGGSGLGEACAELLAPRVAELALIDRDPDSLASVRARLSGLCEISVHACDIANSDDVSTTFNRIERESRVVSTLINCAGMNVKDRHFGELTPDGWNQVIAVNLSGMYYCCQAVLSGMRRQQRGTIINVSSWAGRHAGFFTGPAYNASKRGVLALTESINLEEGINNVRATAVVPEAMATPMIRKIPNPPSEEAIAKMMRPLDVARMIDLIISLPQEMCVNEVVMSPT

SEQ ID NO: 4405 - protein, 512 aa, Burkholderia fungorum
TIPRLLRELVANHGNREALVGQGERMTYQQLGERVEALAARLIRTGVKRGEKVGVLMGNRPEWVISALAITSIGAVLVSLNSWATARELAYLLSHSGCRHLIATRRYLKYDYAVMLRDMDPAIRGRLATVIGVDADLPDGWLPFDDAADVARVEAGDAVRAAGEQVGSDDIAFLLYTSGSTSAPKGVQLAHGALIVNGWHIGERQRIVPGDRLWLAVSLFWALGCVNAMMNLLTHGGCIVLQEAFDAGEALHLIEAERCTVFYGTPNMAQALYDHPERERHDLGSLRTGGTLGSPEQIARVIKLGVSRVCNIYGLTETYGNSHVTSADDDEALRLVSCGQPLPGVEQRIVDANGIDLPPGEIGEIRVKGRVIDGYYGNEELTKASFDEQGYFRTGDLGYVDSQGYLYYRGRSKEMIKTGGINVSPADVESVLSAHPAIYLAYVVGVPDPVRDEEIGALVVLENGASMASDEILQYCSRISRYKVPRGLRFVSEGELPMTTTGKVQKNRLAEM

SEQ ID NO: 4406 - protein, 241 aa, Burkholderia fungorum
MSLKGKIAMVTGAATGIGATLAQALASSGAEVIGVDIAWDGAQQAGCVERAQCDVADPMSVKTCVANIEAAHGPVDILINNAALASELAPTPFEHIAPEEWLRVMTINTMAPFLCSQAVAPRMRERKWGRIVNLTSATIFIGMPPMLHYVASKGAVAIMTRGLARELGRDGITVNAIAPGLTMTEGVQRNEAYSDELIAQAIAAQSIPNREQPEDLIAACLYLVSDGAKMMTGQILAVDGG

SEQ ID NO: 4407 - protein, 815 aa, Burkholderia fungorum
KQTAAATAASAAGVVLPGVDALAASDSLTWSKAPCRFCGTGCGVSVGVKNGKVVATQGDPQAEVNRGLNCVKGYFLSKIMYGQDRLTTPLLRMKDGKYAKDGEFAPVSWDQAFDVMADHFKRTLKEKGPTAVGMFGSGQWTVWEGYAAVKLMKAGFRSNNLDPNARHCMASAVTGFMRTFGMDEPMGCYDDIEQADTFVLWGSNMSEMHPILWTRITDRRLSTPTTRVVVLSTFEHRSFDLADQTIIFTPQSDLAILNYIANYIIRNGNVNRDFVNRHTVFKQGNADIGYGLRPDNPLQKTARNAGDPNGSQPITFDEFAKFVSKYDAAYVTKLSGVPQNKLDQLARLYADPKVKVMSFWTMGFNQHTRGTWANNMVYNLHLLTGKIATPGNSPFSLTGQPSACGTAREVGTFSHRLPADMVVTNPKHREEAEHIWKLPAGTIPDKPGYHAVLQNRMLRDGKLNAYWVQVNNNVQAAANINGEALPGYRNPQAFVVVSDVYPTVTAVAADLILPSAMWVEKEGAYGNAERRTQFWHQLVDAPAGARSDLWQLVEFSKRFKVEEVWPADLLAKKPEYRGKTLYDVLYRNGQVDRFALTETDSHYRNDEAKAFGFYIQKGLFEEYASFGRGHGHDLAPFDAYHKARGLRWPVVNGKETRWRYKEGSDPYVKTGTGWQFYGNPDGRAVIYALPYEPPPEVPDKEYPFWLATGRVLEHWHSGSMTRRVPELYRAFPNAVCFMHPDDAKAMGVRRGVEVKVMSRRGYILTRVETRGRDKPPRGLVFVPWFDSSQLINKVTLDATDPISLQTDYKKCAVKI

SEQ ID NO: 4408 - protein, 343 aa, Burkholderia fungorum
AYAATDATAPLAPFEIQRRELRAHDVQMEVLFCGVCHSDLHQARNEWKNTVFPVVPGHEIVGRVTAVGPDVTKHKVGDLVGVGCLVDSCRTCASCEEGLEQYCENGFVGTYNGVDRVDGQITYGGYSTQLVVDEEFTLSVPDNLDPAGVAPLLCAGITTYSPLRTWGAGPGKKVGIVGLGGLGHMGVKLAHAMGAHVVLFTTSPSKIEDAKRLGAHEVVISKNAAEMEAHLNSFDFILNTVAAQHDLNPFLNLLKRDGTMTLVGAPEHDHPSPQVFNLIFKRRRLAGSLIGGIAETQEMLDFCGEHGITSDIEVIPMQGINEAYERMLKSDVKYRFVIDLDSL

SEQ ID NO: 4409 - protein, 910 aa, Burkholderia fungorum
DVKTTTCYMCACRCGIRVHLREGEVRYIDGNPEHPLNQGVICAKGASGIMKQYSPARLTQPLMRKPDAERGSAQFEPVSWEYAFDVLEKRLGAIRATDPKKFALFTGRDQMQALTGLFAKQFGTPNYAAHGGFCSANMAAGMIYTIGGSFWEFGGPDLDSAKLFFMIGTAEDHHSNPLKIAISKFKRAGGRFIAINPVRTGYAAIADEWVPIKPGTDGALFMAFLHELIAADAWDHEFVRRYTNAAELVDLDEASENFGLFVRDPERPVGNPLFPQNHLWWDADAARAVPHHTPGVNPALDGRFTLDDGTPVTPSFALLRERVADCTPEWAAAITGIAADTIRRLAGEMIQTSRDHRITLPIRWTDAWGETHETVTGNPVAFHAMRGLAAHSNGFQSIRALAVLMSLLGTIDRPGGFRHKSPFPRAVPPSAKPPNSPDAVKPNTPLATGPLGWPAAPEDLFIDDQGGPVRIDKAFSWEYPLAVHGVMHSVITNAWRGDPYPIDTLMIFMANMAWNSSMNTMKVREMLADRHANGEYKIPFLVVCDAFQSEMTAFADLILPDTTYLERHDAMSMLDRPISEFDGPVDSVRVPVVPPTGECKPFQEVLIELASRLKLPAFTTADGERRFRDYPDFVVNFTTTPDSGVGFLIGWRGKDGDKALVGEPNPKQWEQYAKNNCVFHYPLPETLQYMRNCNGPYLEWAVRNGFRKFGEPILIQLYSDVMQKFRLAAQGRTSGRQPPDHLRARVEKYFDPLPFWYAPLENTATDLVRFPLAAVTQRPMAMYHSWDSQNAWLRQIHGENYLYMNPLMAAENGIADGSWIYAESQWGRVRCMARFSETVEPGTVWTWNAIGKASGAWNLGPGANESQRGFLLNHLITDELPGRDDDAASRMSNSDPVTGQAAWYDVRVRI

SEQ ID NO: 4410 - protein, 287 aa, Burkholderia fungorum
MLKVTKAVFPVAGLGTRFLPATKASPKEMLPIVDKPLIQYAVEEAMAAGITEMIFVTGRSKRAIEDHFDKSYEVEAELEARGKDKLLQLVRSIKPSHVDCFYVRQPEALGLGHAVLCAEKLVGDSPFAVILADDLLYGSPPVMTQMIEVFDHYHSSVIGVEEIPAQDTKSYGIVDGKEWEQSIIKMSGIVEKPEPSAAPSNLGVVGRYVLKPRIFKHLRTIKPGAGGELQLTDAIESLLADEQVLAYKYRGTRFDCGSKIGYLKATVEFAVRHPEVGVEFREYLEEY

SEQ ID NO: 4411 - protein, 462 aa, Burkholderia fungorum
IDGKWIAPCGTGTIDVIDSGTEEIMGRIPEGVEADAESAIAAARVAFDAWAATPAAERGEYLRKVAANLKARTDELAGLIAGEVGMPLKLARAIQVGSPVYNWGAYAKLASEFQYEERVGNSLVVREPVGVVAAITPWNYPLNQVTLKVAAALAAGCTVVLKPSEIAPLTAFVLAEAIHEAGLPAGVFNLVSGYGPVVGEVLASHPSVDMVSFTGSTRAGKRVSELASATVKRVALELGGKSASVILDDADFAAAVKGTVSACFLNSGQTCSAHTRMLVPEARYDEARVLAKQAAETYVAGDPRNETSRLGPLASAAQQARVQQYIAKGIEEGAELVTGGVGLPDGLSKGFFVKPTVFGRVHPKATIAQEEIFGPVLSILTYKDEEEAVRIANDSPYGLGGAVWAGSDERAVGIARRIRTGQVDINGGTWNMAAPFGGFKQSGFGRENGVYGLEEYFELKSM

SEQ ID NO: 4412 - protein, 353 aa, Burkholderia fungorum
MPLVSMRQLLDHAAENGYGLPAFNVNNLEQVQAIMAAADKVNAPVIMQASAGARKYAGEAFLRHLIEAAVESYPHIPVVMHQDHGQSPAVCMAAIRSGFTSVMMDGSLEADGKTVASYEYNVDVSRRVVEAAHSIGITVEAELGVLGSLETMKGDKEDGHGAEGTMTREQLLTDPEQAADFVKLTQCDALAIAIGTSHGAYKFSKKPTGDILSIQRIKEIHQRIPNTHLVMHGSSSVPQELLAEIREFGGDMKETYGVPVEEIQEGIKNGVRKVNIDTDLRLAITGAIRRYMATNPGKFDPRDYLKPAREAAMKICIERYTQFGCEGQAGKIKPVTLDKIAEKYKSGELAQVV

SEQ ID NO: 4413 - protein, 861 aa, Burkholderia fungorum
MAISRQALFGKLGTTLYRSIESATAFCKLRGNPYIELVHWLHQLLQQPDSDLHRLVRHCGIERETLDRDMARALAALPAGASSISDFSHHVELAVERAWVLATLSFNDRRIRSAWLVAALVQTPELRRVLLSISPAFGKLSVVGLDEALPAYMENSPEAAEAPYDNSNFSTAVPGEASHALPAQSKGSPLEQFCTDLTVRAHSGEIDPVVGRELEIRTMIDVLLRRRQNNPLLTGEAGVGKTAVVEGLACAIATGNVPPRLVGVRLLSLDVGALLAGASMKGEFELRLRGVLEAALKSAVPVILFVDEIHTLIGAGGQAGTGDAANLLKPALARGAIRMIGATTWAEYKRHIEKDAALTRRFQVLQVRQPQEPAAIDMVRGLANTFSRHHGVVVRDQAIRAAVRLSHRYIPSRQLPDKAISLLDTACARVALSQHAPPRELQDARQRVLAARVESELLVAESRIGLDTASALAAARTRIGELVAVEERIEARWKAQLAAAQALLAARDAALGADHGAPHTGANSDACASPDSLKDLERALTQLQGDAPLVFPEVSEAIVAEVVSDWTGIPVGRMVTDEVAAVQSLPATLEARVIGQPDALRQIGERVQTARAGLTDPKKPLGVFLLAGPSGVGKTETALALAEALYGGEQNLITVNMSEYQEAHTVSGLKGAPPGYVGYGEGGVLTEAVRRRPYSVVLLDEIEKAHRDVHEMFFQVFDKGYMEDGDGRYIDFRNTTILLTSNAGSELIASLCADAPLPPDAEGLREALTPALLNAFPAAFLGRVTVVPYRPLAHESLARIVRLHLDRVVTRMAQVHDIALAYSGQVVDYIVGRCLVQETGARVLIGFIEQHVLPRLSALWL

SEQ ID NO: 4414 - protein, 246 aa, Burkholderia fungorum
MQKRVVLVTGAARGLGAALAARFHAAGYAVAIGDIAFDAAQALARDLSADGSSAFALHLDVTAKAAFTAARDAILQRWGRVDALVNNAGASKVVSVMDITAEQFDQVINVNLRSVLFGCQVFGQHFADTGMGRIVNIASLAGQNGGSATGAHYAAAKGGVITLTKVFARDLGAAGVTVNAISPGPMDLPIVHESVAADKLKAVIANIPAGRLGSADYVADVAVMLAAENAFFANGACWDVNGGLFM

SEQ ID NO: 4415 - protein, 326 aa, Burkholderia fungorum
YPHYRPRRMRRDDFSRRLMRENILTTNDLIYPVFIVEGTNVRQAVPSMPGVERVSVDLLMGVAEQCVELGVPVLSLFPAIEPSLKTPDGREATNPAGLIPRAVRELKKNFPELGVLTDVALDPYTSHGQDGVLDEAGYVINDETVEILVEQARAQAEAGVDIVAPSDMMDGRIGAIREMLESEDHVHTRIMAYAAKFASAFYGPFRDAVGSATNLGKSNKMTYQMDPANSNEALREVQADINEGADMVMVKPGMPYLDIVRRVKDEFQFPTYVYQVSGEYAMLKAAAQNGWLDHDKAMMESLLAFKRAGADGVLTYFALDAARILR

SEQ ID NO: 4416 - protein, 414 aa, Burkholderia fungorum
FDYVDGVLHAEGVSAVSLAEQFGTPLYVYSRAALTAAWNAYAGACAGRRASVHVAVKANSNLAVLNVFARLGAGFDIVSGGELARVLAAGGKAENTVFSGVGKNANEMREALAAGVKCFNVESIPELDRLNAVAAEMGKKAPVSLRVNPDVDAKTHPYISTGLKSNKFGVAFEDARATYQAAAGMANLEVVGIDCHIGSQITEAAPYLDAVDKVLELVEQIEQDGLKIRHIDVGGGLGITYDDETPPEIGEFVRTVLDRIEARGHGHREVYFEPGRSLVGNAGVLLTRVEFLKPGAEKNFAIVDAAMNDLARPAMYEAYHAIDPVVKRDVPAHVYDVVGPVCESGDWLGRERLLAVEPGDLLAIRSAGAYGFVMSSNYNTRPRAAEVMVDGTQVHVARAREEVRQLFVGETILP

SEQ ID NO: 4417 - protein, 143 aa, Burkholderia fungorum
MGAGKTTVGRAIARRLDRPFFDSDHEIEARTGARIPVIFELEGEAGFREREANVISELTARENIVLATGGGAVLRPENREALRNRGVVIYLRANPHDLWLRTRRDKNRPLLQTEDPKARLEALYEVRDPLYRECAHFVIETGR

SEQ ID NO: 4418 - protein, 343 aa, Burkholderia fungorum
MITVNVELGERAYPIHIGADLIGQTALFAPHIAGSSVTIVTNTTVDPLYGDKLRAVLAPLGKQVSTVVLPDGEAYKNLETLNLIFDALLGARADRKTTLIALGGGVIGDMTGFAAACYMRGVPFIQVPTTLLSQVDSSVGGKTGINHPLGKNMIGAFYQPQAVIADIGALHTLPARELAAGVAEVIKTGAIADAGFFNWIEANIEALNRCEPAALAEAVKRSCEIKASVVAQDEREGGLRAILNFGHTFGHAIEAGLGYGEWLHGEAVGCGMVMAADLSVRMGYLDEAARKRLVDVIVAAHLPTRAPALGDSRYVELMRVDKKAEAGAIKFILLKRFGETLIT

SEQ ID NO: 4419 - protein, 1261 aa, Burkholderia fungorum
MHLLRTTPGGFVDDTQGVIRIDQQPADIVVLSSADTTLSLLASVFPRLGEGFPSVRLANVTYLRQPASVDFYVEDVLQHARVVVVDHLGGEAYWPYGIEQVVALAGRKQQMLAMFSGDLQEDPNLLARSTAGADLCHQLWRYLREGGPQNAEAFLRCIAHRAFGWGREPAPPRALPAATLYHPGRDTPTIADWQTRWQQNAPVAAILFYKAHLQAANTAVFDALIDALESQGLNPLPIAITSLKDALSREVVQSLCAEHDVSLVLNTTAFAASAIDDPEPLALAGDAPVFQVILSGGNREDWIKDNQGLNSRDIAMHIALPEVDGRIITRAISFKGLAYRCPHTQVDVVRYQPDAERVGFLAELSRRWCRLRSLDNADKKLALILANYPMSEGRIGNGVGLDTPASVVGILSMLRDEGYRLADLPANGDALLQKLTEGVTNDPVVRDLRPALQSLALDDYLAHFNALPAEARQALNARWGTPEQDPTLRRGRFMIAGWRCGQVFVGIQPSRSREQGDYASYHDAELVPPHAYLAFYFWLRHQFGIDAIVHVGKHGNLEWLPGKSVALSNACWPDLILGPMPHLYPFIVNDPGEGSQAKRRAQAVIIDHLMPPLTRAESYGPLQDLERQVDEYYEALMVDPRRSKLLRRTILATIVEHRLHEELSLAEPDGQDAEDALLTRVDAWLCELKEAQIRDGLHTFGQSPGGVQRRDTLLALGRFPVGDGQGGKAGLIDALARDLRMDHLFDPLSVDWSAVWDGPRPDVLERVSDAPWRHCGDTRERLELLAASLLRGVCGDRPDASAMPVADGLPQTERVIGRLRADVLPRLDACGPQEMLQLKRGLEGRFVPPGPSGSPSRGRPDVLPTGRNFYSVDTRAIPTQAAWSLGLKSAQQLIERHLQEKGDYPRAIGLSVWGTATMRTGGDDIAQALALLGVRPKWAPGSHRVTDFEIMPIEVFDRPRIDVTLRVSGFFRDAFANVMHLFDAAVQAVAELDEPEDLNPIRARVLRERDALIARGMDAAEARKRAGWRVFSARPGAYGAGLQDMIDSQQWQTDADLANAYQAWGGYAYTQKSAGEEARHAFGARLAALDVVLQNQDNREHDLLDSNDYYQFQGGMVAAVRHLAGNQPSVYHADHSNPAAPRVRTLHEEIARVIRSRVVNPKWLDGVKRHGYKGAAEIAATVDYLYGYDATARVIADHQYALVTDAYLNDADTREFLQRHNPHALHSICERLLEAMQRGLWQAPGDYRAQVEQHLLASEQQ

SEQ ID NO: 4420 - protein, 628 aa, Burkholderia fungorum
LTRPMKRVGRKGEGRFEPIGWDEAFQLAARRLSEIAHRAPEAILPYSYAGTMGLIQGDSIAQRFFHKLGASQLDRTICAAAGTAGLKYTYGASLGMLTEFFDESELILIWGSNPIASNLHFWTRAQQAKRRGARLIAIDPYRSLTAEKCHQHIALKPGTDSALALGMINVLIRENLLDHAYIEAHTSGFEALKARALSYPPSRAAEICGIDERVIVDLARLYGGTRKAAIRMNYGLQRVRGGGNAVRAIACLPSLTGAWRERAGGVLLSSGGWAPVDSYALQRPDLMPGWPTRTSRVINMNGIGDALLHKGDAAFGPKVEAIVVYNSNPVAVAPDSERVAAGFAREDLFTIVLEHFQTDTADYADLLLPATTQLEHLDVHKSYGHTHVMVNLPAIAPVGEALPNTEIFRGIARHMGLDEPALFESDETVAQAAFRWQDRTLEGVDWETLKKTGWAKLNLPDAPFAEGGFQTPSGKCEFYSERLAQRGLDPLPDYLPPYESADGAPELAARYPLAMISPPARNFLNSTFVNIESLRSTEGEPHLDMHPADAQSRDIVDGDQVRIFNDRGSMQARVRVTDKAREGLVVGLSIWWKKLAPDGRNANQVTSQALTDLGGSATFYDCLVEVER

SEQ ID NO: 4421 - protein, 380 aa, Burkholderia fungorum
TRIVRAEDQLTPGFESFSMPVTRASTVVFPDLATMRALDWKNDAQWRYGLHATPTSLALAQRLATIEGGNHALLQPSGLSSISNVYFGLVKAGDDVLIPDNVYSPNRDHGDWLARDFGVSVRYYNPMIGAGIADLIRPNTRLIWLEAPGSVTMEVADVPAITAVARAHNVVTAIDNTWSAGLGFRPFDHGVDISVQALTKYQSGGGDVLMGATITVDRELHLKLKAARMRMGIGVSSDDCSLILRSLPTMQLRFEQHDRAALGLARWLKTRPEIATVLHPALPDCPGHEFFERDFTGAGGLFSVVFDGRYSPAQIDTFCESLELFSLGWSWGGAHSLAMPYDVASMRTAGQWPHRGTLVRFYIGLETEADLRADIEQSLA

SEQ ID NO: 4422 - protein, 278 aa, Burkholderia fungorum
VVGTGLMGVGIATQSALHGHRTIVHDVDSARLASVASKAQAVLDELIDAGRIDRAASEAALARIETHAQLDMMASAKFVIEAIPEVLELKHRLYAALTGLLADDAILASNTSGFPPDQLVAPLRAKERFVIAHFWNPPHMIPLVEVVPGTATAPEVTQQSAALMSAIGMEPVVLAKAIPGFVGNRLQFAVLREALNIVRSGAATPEVVDRVMKASLGRRWGIVGPFEGADMGGLDTFLDISSHLMPELAKDEGVLDLLRAQVDAGRVGVRSGAGFYEW

SEQ ID NO: 4423 - protein, 816 aa, Burkholderia fungorum
  unsure (1)..(816): unsure at all Xaa locations
CIGRFEATLQFTLDLPIMGRSILASXCGLMPPRALPAMTELATAPRPANTADAADISAHTAELDIGGMTCASCAMRVEKALAKVPGVVSASVNLATETATVDLNGAAAGPDALIAAVRKAGYEAALVAPPDTPASANESAPADRKRDQTRRELAAVLASAVLTLPLIGPMVGEWFGFHAMLSPWLQFALASVVQFVFGARFYRAAFRAVRAGAGNMDLLVALGTSAAYGISVYELATHPGDMMHLYFEASAVVITLVRFGKWLEARAKRQTTDAIRALNALRPDRARIRVGAGERDVPLAQVRVGTIVIVRPGERVPVDGTVLEGRTHIDESLITGESLPVPKQVADAVTAGSINGEGAIAVTTTAIGAETTLARIIRLVESAQAEKAPIQRLVDRVSEIFVPAILAIAALTLAGWLIAGAAGETAILNAVAVLVIACPCALGLATPAAIMAGTGVAARRGVLIKDAEALETAHRVTIVAFDKTGTLTLGQPSVTAFEPIGGISRDEALALAAAVQRNSDHPLARAVVKAYEAEAAATAAAAEAADMPAAIGEAVASPTRTRALHASAARAVAGRGVEADVDGRTLALGSGRWLGELGIELPPEFAARARELEAAGNTVSWLMQRAPLAPVALALIAFGDTVKPTARAAVERLAQMGITSVLVTGDNRGSAASVARALGIDEFHADVLPEDKARVIRDLKIRSAGIVAMAGDGINDAPALAAADIGIAMATGTDVAMHAAGITLMRGDPALVADAIDISRRTWRKIRQNLFWAFVYNLIGIPLAAFGLLNPMLAGAAMAFSSVSVVTNALLLRTWR

SEQ ID NO: 4424 - protein, 240 aa, Burkholderia fungorum
IRSLLLLIYFVLFTVPYATACFIAFPFMRADKRYWMAAGWCRATLHTVRWLNGIRYRIEGMENLPDGPAVLLSKHQSAWETLAFPALMPRPLCYVFKRELLYVPFFGWALGLLKMVHIDRKEGKYAFESVIKQGKARMAEGAWVIMFPEGTRTRTGTQGKYKTGGARFAIATGAPVVPIAHNAGRVWPRNSFLKYAGIVTVSIGKPIETTGLTPDEVNTRVERWIEAEMRRIDPTAYRAA

SEQ ID NO: 4425 - protein, 146 aa, Burkholderia fungorum
MSTEKINLDIHKILTLLPHRYPILLVDRVLELEPHKNIKALKNVSINEPYFQGHFPTRPVMPGVLILEALAQTAALLTFSEEPSDPSNTLYLFVGIDNARFKRVVEPGDQLILNCTFERHMRGIWKFKARAEVDGVVAAEADLMCA

SEQ ID NO: 4426 - protein, 784 aa, Burkholderia fungorum
VVPFEQLRMTDVEIVGGKNASLGEMISQLAEAGVRVPTGFATTALAFRDFLQHNNLTERIAKRLETLDVDDVKSLAEAGKEIRQWIVEAPLQPQLEADIRAGFDTLQNSSPEELSFAVRSSATAEDLPDASFAGQQESYLNVVGIDDVLDRMKHVFASLYNDRAISYRVHKGFTHAEVALSAGVQRMVRSDVGAAGVMFTLDTESGFKDAVFITSSYGLGETVVQGAVNPDEFYVYKTTLAQGKYPIIRRSIGSKLIKMEFTKAGEEGRVKTVDVSHEQRNRFSITDEDVIELAKYAVIIEKHYERPMDIEWGKDGRDGKIFILQARPETVKSQAAGKAEQRFKLKGQSNVLATGRAIGQKIGAGPVRVIHDPSEMDRVQPGDVLVADMTDPNWEPVMKRASAIVTNRGGRTCHAAIIARELGVPAVVGCGDATDVLKEGALVTVSCAEGDEGKIYDGLLETEITEVQRGELPPIPVKIMMNVGNPQLAFDFSQLPNAGVGLARLEFIINNNIGVHPKAILEYPNIDQDLKKAVESVARGHASPRAFYVDKLTEGIATIAAAFYPKPVIVRLSDFKSNEYKKLIGGSRYEPDEENPMLGFRGASRYIADDFAEAFQMECIALKKVREEMGLDNVEIMVPFVRTLKQAERVVGLLAKYGLKRGENGLRLIMMCEVPSNAILAEEFLQFFDGFSIGSNDLTQLTLGLDRDSGMELLAVDFDERDPAVKFLLKRAIDTCLRLDKYVGICGQGPSDHPDFAQWLTDEGIKSISLNPDTIIETWQQLAK

SEQ ID NO: 4427 - protein, 254 aa, Burkholderia fungorum
  unsure (1)..(254): unsure at all Xaa locations
LTGKRGLVVGIANEHSIATGCATLFRAAGAELAVTYLNDKAEPFVRPVAQTLQSPLVMPCDVRVPGQLEAVFERITKEWGRLDFVLHSIAFAPADDLHASLVDCSAEGFALAMDVSCHSFIRMTRLALPLMPDGGSLMTVSFLGAERAVDHYNVMGPVKAALESSVRYLAVDLAARRVHVHAISAGAVKTRAASGIDHFDALLDDVRSHTPAKHLVTIEEIGRVATVLASEAGMTLTGSTIYADAGFHITAXAD

SEQ ID NO: 4428 - protein, 240 aa, Burkholderia fungorum
MTRTALITGGVSGIGAATAKQLQSGGYSVIANYFGNDAEADAFHKETGIPIFGWNVADFDATQQAVAKIVAQSGPIDILVNNAGITRDSTLHKMTLEQWRSVIDVDLGGCFNTCRAVIESMRERRFGRIVNISSVNALSGQFGQTNYSAAKAGLIGFTKALALEGASRGITANVIAPGYTDTGMVHGVPDEILKTIVSGVPAGRLATPDEIARGVVFLVADEAAFINGATLSINGGKYMA

SEQ ID NO: 4429 - protein, 495 aa, Burkholderia fungorum
ASTILADLGIAHAAQAGDIAVHSPITGELIGRVASNTVAEVDTALAQAKQAYTAWRNVPAPRRGELVRLLGNRLREKKQALGSIITLETGKILQEGMGEVQEMIDICDFAVGLSRQLYGLTIASERPGHRMAETWHPVGTCVVISAFNFPAAVWSWNAALALVCGNAVIWKPSEKTPLTALAVNQILSEALQEFGDAPAGLTALINGGRDVGAKLVADPRASIVSATGSTEMGRTVGVEVAKRFGRSLLELGGNNAGIVTQTADHELAMRGILFSAVGTAGQRCTSLRRLFVHESVYDKTIERLKQLYSKVPIGNPLEKGTLMGPLIDKQSYGRMQEALQQATAEGGKVFGGERVEVKGYEGGYYVRPAIVEMPSQTSVVLKETFAPILYVLRYTDFADAVEANNAAVHGLSSCVFTTDLREAERFLSDSGSDCGIANVNIGPSGAEIGGAFGGEKETGGGRESGSDAWKAYMRRATNTVNYSSALPLAQGIDFN

SEQ ID NO: 4430 - protein, 376 aa, Burkholderia fungorum
IREAVRDLCQQFAGEYFRKIDEARGYPEEFVDALTKAGWLAALIPQDFGGSGLGLTEASVIMEEINRAGGNSGACHGQMYNMGTLLRHGSEEQKQKYLPKIACGDLRLQSMGVTEPSTGTDTTKIKTTAERRGDRYVINGQKVWISRVQHSDLMILLARTTPLAEVKKKSEGMSIFIVDLHEAIGHGMTVQPILNMVNHETNELFFDNLEIPAENLIGEEGQGFRYILDGLNAERTLIAAECIGDGYWFVDKVTEYAKERIVFGRPIGQNQGVQFPIARSFINVEAASLMRFEAARRFDAHQPCGAQANMAKLLAADASWEAANACLQFHGGFGFACEYDVERKFRETRLYQVAPISTNLILSYVAEHILGLPRSF

SEQ ID NO: 4431 - protein, 381 aa, Burkholderia fungorum
LMYITNRPEIVFTHGKGSWLYDNNGKRYLDFIQGWAVNSLGHCNDGMIEALNKQAQLLINPSPAFYNEPMAKLAGLLTQHSCFDKVFFANSGAEANEGAIKLARKWGKKFKDGAFEIITFDHSFHGRTLATMSASGKPGWDTIYAPQVPGFPKADLNDIASVEKLINAKTVAVMLEPIQGEGGVIPATREFMQQLRALTNKHNLLLIVDEVQSGCGRAGTLFAYELSGIEPDIMTLGKGIGGGVPLAALLSKADVAVFEAGDQGGTYNGNPLMTAVGYSVISQLTAPGFLESVRARGEYLRSKLLELSEERGFVGERGEGLLRALLLGKDIGNQIVEKARDMQPDGLLLNAARPNLLRFMPALNVSNEEIDQMMAMLRSIL

SEQ ID NO: 4432 - protein, 450 aa, Burkholderia fungorum
LNSAQQQDGLKRGLKNRHIQLIALGGAIGTGLFLGSASVLQAAGPSMILGYAIGGVIAFMIMRQLGEMVAQEPVAGSFSHFAYKYWGDFPGFLSGWNYWVLYVLVSMAELTAVGTYVHYWWPGVPTWVSALVCFAAINAINLANVKAYGETEFWFAIIKVAAVIGMIVFGGYLLISGHGGPQASISNLWAHGGFFPHGFHGLFMMLAVIMFSFGGLELIGITAAEADEPQKSIPKAVNQVIYRILIFYICSLTVLLSLYPWNEVAAGGSPFVMIFSQIGSTLTANVLNVVVLTAALSVYNSGVYANSRMLYGLAEQGNAPRALMKVDRRGVPYMAIGLSALATFTCVIVNYLIPAEALGLLMALVVAALVLNWALISITHLKSRKAMVAAGETLVFKSFWFPVSNWICLAFMALILVILAMTPGLSVSVWLVPAWLVVMWAGYVFKRRRA

SEQ ID NO: 4433 - protein, 357 aa, Burkholderia fungorum
LLNDTFLRALLRQPTDYTPIWLMRQAGRYLPEYNATRARAGSFLGLAKNPAFATEVTLQPLERYPLDAAILFSDILTVPDAMGLGLEFVTGEGPKFARPVRTEDDVARLAVPDIDATLRYVTDAVREIRTALTDAQGRQRVPLIGFSGSPWTLACYMVEGGGSADFRTVKSMLYARPDLMHRILDVNARAVAAYLNAQIEAGAQAVMIFDTWGGALADGVYQRFSLHYIQQVVSQLKRDHDGEKVPVITFTKGGGLWLDEIAETGVDAVGLDWTVNLSKARERVGGKVALQGNIDPSVLFAPPAAIRMEARAVLDSFGNHPGHVFNLGHGISQFTPPEHVAELVDEVHRHSRAIRSG

SEQ ID NO: 4434 - protein, 1231 aa, Burkholderia fungorum
FLDFAQNVQPQSVLRAAITAAYRRPEPECLPFLLGQARLPANLAGDVQTMAGKLVETLRTKSKGGGVEGLIHEFSLSSQEGVALMCLAEALLRIPDRATRDALIRDKISKGDWKSHMGQAPSMFVNAATWGLMITGKLVTTNSETSLSSALTRLIGKGGEPLIRKGVDMAMRLMGEQFVTGENISEALANSRKYEARGFRYSYDMLGEAATTEADAQRYYASYEQAIHAIGKAAGGRGIYEGPGISIKLSALHARYSRSQQERTMSELLPRVRSLAILARRYDIGLNIDAEEADRLEISLDLLEALCFDPELAGWNGIGFVVQAYQKRCPFVIEYLIDLARRSRHRIMVRLVKGAYWDTEIKRAQVDGLEGYPVYTRKIYTDVSYLACAKKLLSAPDAVYPQFATHNAHTLSAIYHLAGNNYYPGQYEFQCLHGMGEPLYEEVTGRDKLNRPCRVYAPVGTHETLLAYLVRRLLENGANTSFVNRIADETVAIKDLIADPVDEASKIVPLGAPHAKIPLPRNLYGSERLNSMGLDLSNEHRLASLSSALLASAHHPWRAAPMLEDNEIAVGLARDVRNPADHRDLVGTVVETTPEHVSAALAHAVAAAPIWQATPVDARADCLARAADLLEAQMHTLMGLVVREAGKSLANAVAEIREAIDFLRYYSTQIREEFSNDTHRPLGPVVCISPWNFPLAIFMGQVAAALAAGNTVLAKPAEQTPLIAAQAVRILREAGVPAGAVQLLPGNGETVGAALVADPRTRAVMFTGSTEVARLINKTLSSRLDPDGKPIPLIAETGGQNAMIVDSSALAEQVVADVLQSSFDSAGQRCSALRVLCLQDDVADRTLEMLTGAMRELAVGNPDRLSVDVGPVIDLDAKRGIDAHVAAMREKGRKVEQLPMPDGCAQGTFVPPTLIELDSIDELKREVFGPVLHVVRYRRSQLDKLLEQIRATGYGLTLGIHTRIDETIAHVISRAHVGNIYVNRNVIGAVVGVQPFGGEGLSGTGPKAGGALYLQRLLATRPAGLPKSLARALVVDVPRAAENGDNPSAVLTAYRDWLITEREPQLAARCDGYLSHVPAGATAVLSGPTGERNTYTLGARGTVLCIASTASGARVQFAAALATGNRALFEGAAGEQLVSQLPASLKSHASVKKSADTPFDAVLFEGDSDELLALVKEVAKRPGPIVSVQGVAARALESGDEDYALERLLTERSVSVNTAAAGGNANLMTIG

SEQ ID NO: 4435 - protein, 125 aa, Burkholderia fungorum
SIPADLKYTESHEWVRTEADGTLTVGITDHAQEALGDIVFFEVQELGKTVSAGDTVAVIESVKAASDIYAPVSGEIIEANSAVADTPDLVNSTPYESWLFKIKPAADAALDRLIDADAYSKSIGA

SEQ ID NO: 4436 - protein, 665 aa, Burkholderia fungorum
LNPAQNEAVRYLDGPCLVLAGAGSGKTRVITQKIAHLIEAKGFEPRHIAAVTFTNKAALEMRERVGKLLEGKTLTTPGKEGRKVPVNQLTVCTFHSLGVQILRQEAEHVGLKPQFSIMDSDDCFGMIQEQVGSTDKGFIRKIQSIISLWKNGMIMPEQAIAIAANEDEHQAAIVYRNYVATLHAYQAVDFDDLIRLPAELFAKNEQVRDRWQNKLRYLLIDEYQDTNACQYELVKLLAGKRAAFTAVGDDDQAIYGWRGATLENLGQLSKDFPKLHLIKLEQNYRSTVRILTAANNVIANNPKLFEKKLWSEHGMGDTITVTPCNDEEHEAESVVFRLSAHKFERRANFRDYAILYRGNFQARIFEQVLRRERIPYVLSGGQSFFDKAEIKDICAYLRLIANANDDPAFIRAITTPRRGVGNTTLEALGSFAGQAKVSLFEAVYMGGIEARLSPRQIEPMRVFCDFMQRLTDRAEKDAAGTLLDELMDAIHYEAYLYDAFDERQAQSKWQNVLEFMEWLKRKGTKAEPTGAAANEATGYDTADGLGDTGKSLLGLIQTVALMSMLEGREEDPDAVRLSTVHASKGLEYPHVFLVGVEEGIMPHRGGPDDEPIDDARIEEERRLMYVAITRAQRSLHLNWCKKRKRARETVVCEPSRFIPEMLLDD

SEQ ID NO: 4437 - protein, 240 aa, Burkholderia fungorum
ALPAVLSPGETAFFFDFDGTLVELAPTPDGVLVQPRVIDLLSELRSLTNGAVAVVSGRGIDSIDSFLGIPDLPIAGLHGAERRDANGDTQRIGFHDERLLRMEQVLAQVVNENPGMLLEIKGAAVALHYRNAPDREPVAREATSRLVADYAGAYVLQPGKMVYEIKPKDVDKGRALRAFLDEPPFVGRQPVFAGDDLTDEKGFAVVNERGGLSIKVGPGETMARTRIDSVPALLDWLASI

SEQ ID NO: 4438 - protein, 460 aa, Burkholderia fungorum
MGRLIIVSNRVAPISEGGPAAGGLAVGVYDALKETGGMWFGWSGDVLSSGQPQIKVEERGPVTFATIALMRRDYDQYYRGFSNATLWPAFHYRADLLQYDRHDFEGYWRVNAWLAQQLVPLLREDDVIWVHDYHLIPFAQALRAAGVKNRIGFFLHIPFPASQVLLAVPPHRELVEALCSFDLLGFQTAPDLRAFCDYIVNEANGTADPSASGPLTIHAFGRTLRAAAYPIGVYPDEIAELAKAGERGKPVRTMKATLHSRKLIMSVDRLDYSKGLVERFRAFERLLEHSTAQRNKVSFLQIAPPTRADMHAYQDIRLQLEGESGRINGRFAELDWTPILYIHKQYERSVLAALFRTAHVGYVTPLRDGMNLVAKEYVSAQDPENPGVLVLSRFAGAAQELDGALIVNPVDIDGMAEALARALDMPLAERQARHRDMMVQLRENNVSVWRDNFMRDLQGV

SEQ ID NO: 4439 - protein, 476 aa, Burkholderia fungorum
LFQYLSGHSPTYYSEKQPGMLASRITATSNAVYTAENTTAWNVLPPCIAVLGAIVMIIAVNPLMAGGLMLCSAILSVVLYKLAGRGSARHHHFATRAASVDGELVDVISNMGLVRAFGMTFREQQRFGATVKAEMDARQQSLLYLEKLRLLHAVITALLSAGLLGWALWLWDQGKATSGDIVLVSSLGFTILHGTRDLAVALVDVTQHVARLAEAVRTLLEPHGMPDRDDATELVPQGGRIDFESVTFAYPRRRPILDHFDLHIEPGQRVGLIGKSGAGKSTVLALLQRFYETQGGAIRIDGQDIGMVTQDSLRHAIAVVPQDISLFHRTVYENIAYGRPEATREEVLAAAREARCSDFIEAMPEGYDTIVGDRGVKLSGGQRQRIAIARAILKNAPILLLDEATSALDSASEEAIQKALDRLMVGRTVVAIAHRLSTLNNFDRIIVMSAGKVIDDGSPEELRQRPGLYRDLLSKQ

SEQ ID NO: 4440 - protein, 566 aa, Burkholderia fungorum
WRIVVITALVLLSALADVLTPMFAGHLVDAIASGAASNAVAWRAAVTAFCVLGALGLGATLLRQGVYFNIIRLTLRMMSEIAANAFHRVQRFSTDWHANSFAGSTVRKITRGMWALDLLNDTLLIALFPSLVMLVGATVLLGWRWPMMGAVVGIGSLLYIAVTAAMSLGFVAPAARLANAWDTRMGGALADAVSCNGVVKAFGAEDREEALLARVIGKWRHRTRRTWMRGTINGGVQGGMLVAIQAAILGAALLLWARGEASVGDITFALTMFFMLQGYLRDVGMHIRNLQRSVNDMEELVSLESQPLGIEDPPGAGPIAIGKGEIRFEHVTFHYGTNGQPLYDNFSVRIAPGERVGLVGHSGSGKTTFIKLIQRLYDISEGRITIDGQDIAKVRQASLRSQIAIVQQEPVLFHRSLAENIAYARPGASRAEIEHAARLASAHDFIAALPNGYDTLVGERGVKLSGGERQRVAIARAFLADAPILILDEATSSLDSESEVLIQQAMERLMMGRTTLVVAHRLSTVRALDRLLVLDKGKVIEEGSHEALIRLENGLYRRLFERQALE

SEQ ID NO: 4441 - protein, 259 aa, Burkholderia fungorum
LEYVPVPAFDDNYIWVVSDGHSAVVVDPGEAAPVQAYLAKRGWRLSAILLTHHHQDHVGGVADLLNGQAVPVYGPAGEAIEHLTHRLKNGDHVSIAAPALELSVLDVPGHTSGHIAYFQAADPRGTPHVFCGDTLFACGCGRLFEGTPKQMLASLDALAALPGATEVHCAHEYTLSNIRFALACEPANAELQAWRDKAGELRARGVPTLPTTIAHERAVNPFLRAGNPAVQASLREQLHEKVPDRLTAFTLMREWKNRF

SEQ ID NO: 4442 - protein, 376 aa, Burkholderia fungorum
VLPSFSPALLALADGTVFRGYSIGAPGHTIGEVVFNTAITGYQEILTDPSYARQIVTLTYPHIGNVGVNAEDVEAAKVHAAGLIIRDLPVLASNFRMERTLQQYLQDEGVVAIAGLDTRMLTRVLRDKGAQNGAILAGSDDEARAIELARSFPGLSGMDLAKVVSTKESYEWTQTEWRLGSGYGTQNAPKYRVVAFDYGVKYNILRMLAERGCHVTVLPAEASAADALALNPDGVFLSNGPGDPEPCDYAIRATKELIDRGIPTFGICLGHQIMGLAVGAKTMKMKTGHHGANHPVKDLDDGRVVITSQNHGFAVDADTLPANARVTHVSLFDGTLQGFTLTDKPAFCFQGHPEASPGPHDIAYLFDRFTALMDTK

SEQ ID NO: 4443 - protein, 1083 aa, Burkholderia fungorum
MPKRTDIKSILIIGAGPIIIGQACEFDYSGAQACKALREEGYKVILVNSNPATIMTDPNTADVTYIEPITWEVVERIIAKERPDAILPTMGGQTALNCALDLHAHGVLEKYKVELIGASPEAIDKAEDRQKFKDAMTRIGLGSAKSGTAHSMEEALAVQADIASQTGSGGYPVVIRPSFTLGGSGGGIAYNRDEFEEICKRGLDLSPTRELLIEESLLGWKEYEMEVVRDKKDNCIIVCSIENLDPMGIHTGDSITVAPAQTLTDKEYQVLRNASLAVLREIGVDTGGSNVQFSINPKDGRMIVIEMNPRVSRSSALASKATGFPIAKVAAKLAVGYTLDELKNEITGGQTPASFEPTIDYVVTKIPRFAFEKFREADSRLTTQMKSVGEVMAIGRTFQESFQKALRGLEVGVDGLDEKTDNRDEIIREIGEAGPDRIWYVGDAFRVGMTAEEIFEETSIDPWFLAQIEQIILKEKALAGRTLASLSKEELKYLKQSGFSDRRLAKLLGAKPAQVRQRRIELNVRPVYKRVDTCAAEFATKTAYMYSTYEEECEANPTNNKKIMVLGGGPNRIGQGIEFDYCCVHAALAMREDGYETIMVNCNPETVSTDYDTSDRLYFESLTLEDVLEIVDKEKPVGVIVQYGGQTPLKLALDLEANGVPIVGTSPDMIDAAEDRERFQKLLQDLGLRQPPNRTARAEDEALKLADEIGYPLVVRPSYVLGGRAMEIVHEPRDLERYMREAVKVSNDSPVLLDRFLNDAIECDVDCISDGEAVFIGGVMEHIEQAGVHSGDSACSLPPYSLSKETVAELKRQTGAMAKALNVIGLMNVQFAIQQVPQADGSKEDVIYVLEVNPRASRTVPYVSKATSLPLAKIAARAMVGQTLAQQGVTKEIDPPYFSVKEAVFPFVKFPAVDPVLGPEMRSTGEVMGVGQTFGEALFKSQLAAGSRLPESGTVLLTVMDADKPKAVEVARMLHELGYPLVATKGTAAAIEAAGVPVKVVNKVKDGRPHIVDMIKNGEIALVFTTVDETRAAIADSRSIRMSAQANKVTYYTTMSGARAAVEGLRYLKDLEVYDLQGLHARL

SEQ ID NO: 4444 - protein, 631 aa, Burkholderia fungorum
  unsure (1)..(631): unsure at all Xaa locations
NMFSKAAVWLVIALVLFTVFKQFDKPRVQEGVSYSQFMDDAKNGKVKNVIVQGRNLTVTPADGQKYQIVSPGDIWMVGDLMKYGVQVSGKADDEPNALVSALYYLGPTILIIGFWFYMMRQMQGGGKGGAFSFGKSRARLIDENNNAINFTDVAGCDEAKEEVSELVDFLRDPQKFQKLGGRIPRGVLLVGPPGTGKTLLARAIAGEAKVPFFSISGSDFVEMFVGVGAARVRDMFEQAKKHAPCIVFIDEIDAVGRHRGAGMGGGNDEREQTLNQMLVEMDGFEANSGVIVIAATNRSDVLDKALLRPGRFDRQVYVGLPDIRGREHIMKVHLRKVPISNDVDAAVIARGTPGFSGADLANLVNEAALFAARRGKRIVEMTDFEDAKDKIFMGPERKSAVIREESKRATAYHESGHAVIAKLLPKADPVHKVTIIPRGRALGVTWQLPEHDNETYSKDYLLDRLAILFGGRVAEELFLNLISTGASDDFNKATQTARAMVARFGMTDALGPMVYVDDENDATPFGRGFTRTISEATQQKVDAEIRRVLDEQYNLAKRLLDENRDKVEAMTAALMEWETIDADQINDIMAGRPPRSPKSSTPSATDASSGGSPGTEVKPGSATAPAXSATS

SEQ ID NO: 4445 - protein, 303 aa, Burkholderia fungorum
MPEAAIEFDKVKKSYGEKTVVDGLSFHVAPGECFGLLGPNGAGKTTTLRMLLGIAAPDAGTIRLCGEPIPRRARVARARVGVVPQFDNLDPDFTVRENLLVFGRYFGMSAAQCRAMVPPLLEFARLESKADARVSELSGGMKRRLTLARALVNDPDVLIMDEPTTGLDPQARHLIWERLRSLLARGKTILLTTHFMEEAERLCHRLCVIEEGRKIAEGAPSALIASEIGCDVIEIFGPDPVALRDELAPLVERTEISGETLFCYVIDAQPVHARLKQRADLRYLHRPANLEDVFLRLTGREMQ

SEQ ID NO: 4446 - protein, 350 aa, Burkholderia fungorum
MQYRSLGDSDVQVSLIGLGTMTWGEQNTEQEAHAQIDYALDHGVNLIDTAEMYPVPPIAETQGSTERFIGTWLAQHRSAREKIVLATKIAGPARQPHNPRHIRGEGNQFDRKNLTEALNDSLKRLQTEYVDLYQLHWPDRSTMTFGRASYPWVDDAYTVPIEETLSVLAEFVKAGKVRHIGVSNETPWGVAQFLRAAEKLGLPRIVSIQNPYSLVNRTYEAGLSEYAHRDNVGLLAYSPLAFGWLSGKYEGGARPAGARITRFDRFQRYSKPQAVQATTRYVELAKRHGLAPAQFALAFVNSRPFVTSNLIGATSLDQLKENIASVDVKLSPDVLAEIDALHELQPNPAP

SEQ ID NO: 4447 - protein, 177 aa, Burkholderia fungorum
WHGASLMSAARGAVIWMTGLSGAGKSTLANALHLRLKEAGQAAIVLDGDVLRRGLNADLGFTPEDRTENLRRVAHVAALFMQQGFVVIAAVISPEHRHRRAAREIVGEGFVEVFVNAPLQVCEARDAKGLYARARRGEIAHFTGISDPFEAPLAADLVIETDRMPVNEGVDRLLAHL

SEQ ID NO: 4448 - protein, 473 aa, Burkholderia fungorum
KNLIAGEWTESVSGKTFANINPADTRDVVGQFQASVVADAQAAIQAASSAFAQWRRTPVTARARIVNKAADWLESHADTFAQELTREEGKPLAQSRDEILRSAQVLRFYAVEAQSFTGETFPSDDPEQHVYTQREPLGVVTVITPWNFPISIPARKIAPALMAGNTVIFKPSSDAPLIGYRLAEAFAQAGIPAGVLNFITGRASDIGAAITESPVVRAISFTGSTAAGEHIHRSVPITTRTQMELGGKNPLIVMDDADLDRAVDLAVKGGLSLSGQACTGTSRILVMESVRETFTAKLVERVKSLKIGSGVTPGMDLGPLANRKQLESVLGYVASGKEQSTHLIGGEQLTGEGFEHGYYVTPAVFSDVPESARIYREEIFGPVLAITSVTGYDDAIAKANDTEYGLSAAIATSNPRYMHRFADEIEAGTVKINRTTTGNVINAPFGGLKRSSTSTFRESGRAGLEFYTQIKTV

SEQ ID NO: 4449 - protein, 758 aa, Burkholderia fungorum
FRFPVVIIDEDFRSENISGSGIRALAEAIEKEGAEVLGLTSYGDLTSFAQQSSRASCFILSIDDDELLPYVDNVVVEGETPELAAAIVALRAFVTEVRRRNADIPIFLYGETRTSRHLPNDILRELHGFIHMFEDTPEFVARHIIRETKVYLDSLAPPFFKELVQYAEEGSYSWHCPGHSGGVAFLKSPLGQMFHQFFGENMLRADVCNAVDELGQLLDHTGPVAASERNAARIFSADHVFFVTNGTSTSNKIVWHGTVAPGDIVLVDRNCHKSILHAITMTGAIPVFLTPTRNNFGIIGPIPRSEFEPENIKKKILANPFAREALAKNPDLKPRILTITQSTYDGVIYNVEMIKEMLGDWLDTLHFDEAWLPHAEFHEFYQDMHAIGAGRPRIGAMVFATHSTHKLLAGISQASQIVVQDSKNSRFDKHRFNEAYLMHTSTSPQYAIIASCDVAAAMMEAPGGTALVEESIAEALDFRRAMSKVDAEYGDDWFFKVWGPDQFAEEGIGSREDWMLRPNDPWHGFGPLADGFNMLDPIKATIVTPGLDMDGGFGESGIPAAIVTKYLAEHGIIVEKTGLYSFFIMFTIGITKGRWNSMVTELQQFKDDYDNNQPLWRVLPEFVSHHPMYERVGLRDLCEQIHSVYRANDIARLTTEMYLSSMEPAMKPSDAFAKLAHREIDRVPIDELEGRVTSILLTPYPPGIPLLIPGERFNRTIVNYLRFAREFNERFPGFHTDIHGLVGETINGRIEYFVDCVR

SEQ ID NO: 4450 - protein, 466 aa, Burkholderia fungorum
LLPLLLIGGMVWFMRREMRGGARLLDRAPALRFDDVIGASEAKAALADIRSYLSDPKQFTSMGVRAPCGILMVGGPGVGKTRLAQALAGECGANFISITGSYFSAKYYGVGIQKVKHLFELARKNAPTVIFIDEADGLAKRTDTGSGPVEAESNRIINQLLAEMDGFASNEGVIIVAATNHPDNLDEALRRPGRFDRTVQVRLPDREDRAKIFRFYAAKLKSKSADIDYDQLARLTTGLSPATVAMVVNQAGLVARKSGDTEIASKHFMEAIKIARIGDVSGAERALSEDERTRIAVHEAGHGLVAALLGTGVLEEVTILPRGGALGVALITKAQDKHLYRESEIRNEIQVLLGGRNAEIISFSEASSGAASDLQEASRISLDMVSKFGFNADGNLFSLAALPSQYAGLQMKGAIEHANVLLKELNESCHALLHAYEPVLRAIADELLEQETVPGETVYRLIREHK

SEQ ID NO: 4451 - protein, 858 aa, Burkholderia fungorum
MNTANRKRLPGTQLDFFDTRAAIEAIQPGAYDKLPYTSRVLAENLVRRCDPVTLVASLKQIIERKRELDFPWFPARVVCHDILGQTALVDLAGLRDAIAAQGGDPAMVNPVVPTQLVVDHSLAVECGGFDPDAFAKNRAIEDRRNEDRFDFINWTRRAFRNVDVIPPGNGILHQINLERMSPVVQVKDGVAFPDTLVGTDSHTPMVDALGVIAVGVGGLEAESVMLGRASYMRLPDIVGVELTGKPGEGITATDVVLSLTEFLRKEKVVGAYLEFFGAGTANLTLGDRATIANMSPEFGATAAMFYIDEQTIKYLKLTGRDDELVKLVETYAKETGLWADSLKHAEYERVLKFDLSTVVRTLAGPSNPHRRLPVSELAARGISGKVENEPGLMPDGAVIIAAITSCTNTNNPRNMIAAGLLARNANRRGLTRKPWAKTSLAPGSKAVTLYLEEAGLLHDLEQLGFGVVAYACTSCNGMSGALDPAIQKEIVDRDLYATAVLSGNRNFDGRIHPYAKQAFLASPPLVVAYAIAGTIRFDIEKDVLGIDADGHAVTLKDIWPSDAEIDAIVASSVKPEQFRKVYEPMFAVTVDTGEKASPLYDWRPMSTYIRRPPYWEGALAGERTLKGMRPLAVLGDNITTDHLSPSNAILPDSASGEYLAKMGLPEEDFNSYATHRGDHLTAQRATFANPTLKNEMVLEDGKVKAGSLARIEPEGKVTRMWEAIETYMERKQPLIVIAGADYGQGSSRDWAAKGVRLAGTEAIVAEGFERIHRTNLVGMGVLPLEFKPGVNRLTLGIDGTETFDVIGERKPRTDLTLVIHRKNGERVEVPVTCRLDTAEEVSIYEAGGVLQRFAQDFL

SEQ ID NO: 4452 - protein, 388 aa, Burkholderia fungorum
MSEADNSTPNTGAFKPKKSVALSGVTAGNTALCTVGKTGNDLHYRGYDILDIASACEFEEIAYLLVHEKLPTQAELTAYKTKLKALRGLPANVKAALEWIPAAAHPMDVMRTGVSVLGTVLPEKDDHNLPGARDIADRLMASLGSMLLYWYHYSHNGKRIEVETDDDSIGGHFLHLLHGVEPSNAWVDAMHVSLNLYAEHEFNASTFTGRVIAGTGSDIYSALTGAIGALRGPKHGGANEVAFEIQSRYQTPDEAEADIRRRVENKEVVIGFGHPVYTISDPRNKVIKEVAKKLSKEAGNTRLFSIAERLESVMWDAKKMFPNLDWFSAVSYHMMGVPTAMFTPLFVIARTAGWSAHIIEQRIDNKIIRPSANYTGPDDLPFVPLAKR

SEQ ID NO: 4453 - protein, 491 aa, Burkholderia fungorum
  unsure (1)..(491): unsure at all Xaa locations
ARXSTNRDRGDEMEKFLVGDEWRSGNGESFESINPIDGSVAATLAQASESDVDDAVRAARQALETPAWRDMKVHERGKLLHRFADLIDQNAETLAQIQTRDNGKTISESRFQSKSAADMFRYFAAVCETTESSVIPSRGNYFCFSSFEPVGVVAAIAPWNSPITLEAQKLAPALAAGNAIVLKSSEVTPCIGLQYGRLAMEAGFPPGILNVVTGFGASVGRALVAHPGVDMVTFTGGTKSGREIAKVAGERLIPCILELGGKSPNIVFDDADIEQAVTGMLFGIFSNAGQSCIAGSRILIQEGIYDAFVARLTSATRALKVGSPYDADTAVAPVSSFHHRDHIEHFVERALSQGAVALCGGSRPSGGILDKGAYVQPTLLEVTDERSSVAHEEIFGPVACVMKFQDEEDLYRIANNTAYGLACGIWTADYKKAFRAARRIKAGTVWVNTYKIAEVNVPFGGFKQSGLGRECGIEGMREYMLEKSTYLNLAD

SEQ ID NO: 4454 - protein, 430 aa, Burkholderia fungorum
TNELTYQTGFGNEFSTEAISGALPIGQNNPQKPAFGLYAEQLSGTSFTTARATNLRTWMYRIRPSVLQGTYRLIRKDSNALAPLDVAPLPEAQRWNPQPLPDTPVDFVDGLNTLAISGDPATLSGAAVHLYAATIDMDRKAFVNTDGEMLIIPQQGTLCLITELGMLTAKPREIAVIPRGLKFAVHLPDGPSRGYVCENHGSAFRLPDLGLIGASGLANRRDFLTPVARFEDSDAAHELIAKTGGQLWSTTLDHSPFDVVAWHGNVAPYKYDLDRFQSIGSISFDHPDPSIYTVLTSPSDTPGTANADFCALTTRWAVAEHTFRPPYFHRNVMSEFMGLICGAHDAKAGGFVPGGASIHNAFTPHGPDAETYRRARDTTLEPHKITESIAFMFETRLPLRLTAWAVQTPQRQHDYQQCWSALAKQFDGDR

SEQ ID NO: 4455 - protein, 498 aa, Burkholderia fungorum
RNKRMYPIDFLWRAVDRYPNRTAVFGPGGNLSFRELGTQVLDRAATLTQIDPVRGGRICVGASNGMDHLIAILAVLAAGKVWVPLNPRNGDPELRRILDFVEPSLVLADAEMQNRLSGTTAALRSLESLTQQAGDVGAVVMGPRSSGGVAMDKPQAIKFTGGTTGFPKGVIQPLRAWNTNIATQIHELGLKPDDRYLVAAPLSHGTSTYLLPLLGVGGALIIPPEQAKAAALLDAADAHGATILFAPPTLIVALAEEQRRSPRLLRRLRYLVYGGAPMRAEQIRDAQSVFGPVLCTTFGQTEAPQIITFLPPAEMNGDTLTSVGRPSLLTRVAIMNKDGEPVETGQQGEIAVRGDLVMSGYLKAEDETRKTLVDGWLRTGDAGVFDERGYLFLRDRIRDVIITGGFNVYPSDVEAVLSAHPAVADCSVVGVPDAKWGEAVHAAVQLRSGMQVDTADLVALVRRELGPVKTPRHVHLFESLPRSAVGKVLKTEVRNTIL

SEQ ID NO: 4456 - protein, 334 aa, Burkholderia fungorum
MNRWEIPSLGLDKLVRREVPRPVPKAGEIVVEVNAVSLNYRDAEVAENGMGNALSFPFTPASDMAGRIVAVGEGVTRFAVGDRVISAYIPGWIDGVPLSWTVAPTQGGPIPGVLAQYVAAPAEWCVRAPRTLSAVEASTLPVAALTAWMALVELGNLHAGQTVVVQGTGGVSLFAVQLAAAHGARVIVTSGSDEKIARAIALGARHGINRNTTPDWQHAVLELTGGRGADHILEMTGGDNVERSLQAVVQGGRISVIGLLDSDRLSLPILSLLASRASIVGIAVGPRRALEDLVRAVDLLGIRPVIDATYAYSQVPEAFVHLRRGAFGKIVVQL

SEQ ID NO: 4457 - protein, 458 aa, Burkholderia fungorum
VRMERDTFGEIAVPNARLWGAQTQRSLQNFRISTEKQSPELITALAVIKRAAAEVNLGLGVLDESKAKAIIEAADEIIAGKHPDEFPLAVWQTGSGTQTNMNLNEVIANRASELLGGERGEARKVHPNDDVNRGQSSNDVFPTAMHVAAAYAIVKHLLPALKTLRDTLDGKAKAFVDIVKIGRTHLQDATPLTLGQEFSGYVAQLDQGIRHVESALPHLYELAQGGTAVGTGLNAHPQFAGKVAAAIGKLTGLPFVSAPNKFEVMAAADALVFAHGALKTVAASLNKIANDIRWLASGPRCGLGELSIPENEPGSSIMPGKVNPTQSEALTMLCAQVFGNDVAVNIGGASGNFELNVFRPMIAHNVLQSVRLLADGAHSFNDNCAVGIEANHERIDTLLNESLMLVTALNPHIGYDKAAKIAKKAHKEGTTLKASALALGFVTEQQFDEWVRPKDMVG

SEQ ID NO: 4458 - protein, 538 aa, Burkholderia fungorum
  unsure (1)..(538): unsure at all Xaa locations
YDYIIVGAGSAGCVLANRLSESPSNKVLLVEAGAGDRHPYIGIPKGIAKLRMHPKYSWRLPTEPTLGRAQGEFWPRGRVIGGTSSINGMFYIRGQPEDYDEWETLGAKGWGWKDIAPCFRKMEDHELGETPLRGVGGPLHVTLPYHEHPPLNEAFLQAGEQIGLPRKEDLNQGDQAGIGYYPVNMWKNRRWSAADAHLRPALKRPNLTVLKGVHVDRVLFDGLRAVGIAARIGDARKEFRSRGEIILSAGTLKSPQILQLSGVGPGDVLRAAGVPIVADRADVGRNMLEHLSMTVVNRLVGTAGENREYRGWRLAKNALKYYVRRNGVLSYSTFPIGGFARSSPELERADIQFFLGGLSFEMGGLKSVAARVQTGKLPGLTCFAYFMKPESRGSVAISSADPDAPAVIRPNWLDTENDRQAAIRVVRFMRRIVHAPALKSYVGDEVMPGPATSDDDDALLAAYTRFGSTANHAVGTCRMGGDAASVVDGRLRVRGVENLRVVDCSVIPTPISGNTNGPVMALAWRAADLILQGERXRD

SEQ ID NO: 4459 - protein, 442 aa, Burkholderia fungorum
MQSTAYAASRLDRLPLSGFHWRLLCVIGFGLFLEFFDLYTGGAIVGVLLKQGWSTLQLNALFGTLTFAGLTVGAMMAGIIGDRYGRRLAYQINLVVFGIASFAAAVAPDMYWLSAIRFMMGLGIGAEAVISYGMLGEFVPPGFRGRMLAFLSVFGNSAVFVGSLVNLWVIPHLGWRYVFVIAGILAITLWIVRRSIPESPRWLETKGRIDEAEVVLQRIERSVARGGELPSYAHEVPAPTPQVSIGVLFTPPILVRTLVGSAILVCIGFSIYGLINWLPTFFIQQGFDIVKSLTWTTVITLGGPVGSLLGVAVSDRVGRRPAIIASCVVTAVCGLIYQQVDSAFALMGVGFLLVCSIYVLVAVGQGAYVPELFSTSYRLRGTGVCMTAGRLASAGCQFFILWLFTKGGVLMVVGSVVAAQLLLAFAVWAIRIETRGKRLEDL

SEQ ID NO: 4460 - protein, 273 aa, Burkholderia fungorum
  unsure (1)..(273): unsure at all Xaa locations
AARAHRRXLIKGRRSLLRFDNKVVMVSGCGSSLPGWGTGKAIAALLARQGAQVVGLDVNEQALADTRAVIEGEGGKLKALLCDVTDPASIDRVVRETIDAYGRIDVLVNNVGVSAPGGVVDMTEEIWDRQFDINLKSVFLMCKAVLPLMDRQRGGNVVNVSSLSALRYSGKPQIAYSASKAALIQFTRMAALMHSEHNVRLNCVIPGLITTPLVQRLAQQFGGGDYESYLKRRNAQVPLAQEGDAWDVANATAFLASDEARYITATEILVDGG

SEQ ID NO: 4461 - protein, 258 aa, Burkholderia fungorum
RLQGKVALVTGAGCIGPGWGNGRAIAVRFAEEGAHVIAVDRDLASMDATLELVRAAGGSVTPCLCDVTDSASVERLVADSVARCGRVDILVNNVGAPSPGGPVALDEAQWAMQLELNLTTAFLMCKYVLPVMEQQGGGAIVNIASTSGIRWTGAAQVGYAAAKAGMIQMGRVVAVEYAAKNVRVNSVVPGLLHTPMVDTKIAHNQAGGDVELLLRKRQARIPMPFMGDGRDTANAALFLASDEARFVTGTEIVVDGGM

SEQ ID NO: 4462 - protein, 594 aa, Burkholderia fungorum
YTAPIKDMLFVMKELAGLEHIATLPGFEDANLDTAQAVLEESAKLCSEVLAPLNVEGDRNPSSWKDGVVTATPGFREAFRQFGEGGWQGVQHPVHYEGQGLPKLIATACIEMLNASNLSFALCPLLTDGAIEALLTAGSEEQKQTYVPRLISGEWTGTMNLTEPQAGSDLALVRTRAEPQGDGSFKLFGTKIFITWGEHDMAKNIAHLVLARTPNAPEGVKGISLFIVPKFLVNEDGSLGERNDVHCVSIEHKLGIKASPTAVLQFGDHGGATGHLIGEENRGLEYMFIMMNAARFAVGMQGIGVSDRAYQKAVAYAKDRVQSRPVDGSAKQPVAIIQHPDVRRMLATMRGLTEASRALAYVAAAHCDIAHRHADEATRAQHQAIYEYLVPIVKGWSTELSIDVTSLGVQVHGGMGFIEETGAAQYYRDARILPIYEGTTAIQANDLIGRKTVRDGGKVAKSLLAGVAETVEALGAQQGPAFASMKKYLAQGHRSLSAVVEFVVANTKSDPNAVFAGSVPYLKLAGIVLGGWQMARALLVAAEKRDEDPSFYGAKIATAQFYAEHVLPLASALEASIVSAKGGESVLALSEDQF

SEQ ID NO: 4463 - protein, 275 aa, Burkholderia fungorum
RSSVTAGDGVQLPLYRWPAAAPTRATVALIHGLAEHAGRYAALAGRLNAAGIELVAIDLRGHGHAPGKRAYVRRFDDYLLDAQALLDAAAQSCAPLFLMGHSMGGAVAALYAIERLEASGRRLNGLILSSPALAPGRDVPRWMLKLSQVISRLYPSFPAMKIDAALLSRLQPVVNANRADPLVHHGAIPARTGAELLLAMARIERGRAGLRVPLLVYHGTADKLTEPEGSRDFGQHAGSPDKTLTLHEGSYHETMNDMDRDRVIGALIEWIEKRL

SEQ ID NO: 4464 - protein, 455 aa, Burkholderia fungorum
MKITIIGTGYVGLVTGACLAEIGHDVFCLDVDPRKIEILNNGGVPIHEPGLQEMIARTRAARRITFSTDVEAGVAHGDVQFIAVGTPPDEDGSADLQYVLEAARNIGRTMNGFKVIVDKSTVPVGTAQRVRAVVEEELAKRGLAGSAQHGFSVVSNPEFLKEGAAVDDFMRPDRIVIGLDEDEAGSRARELMKRLYAPFNRNHERTLYMDVRSAEFTKYAANAMLATRISFMNEMSNLADRVGADIEAVRRGIGSDPRIGYHFLYAGCGYGGSCFPKDVQALIRTASESGHNLRILEAVEEVNDRQKDVLVHKITSKLGNDLSGRTFAVWGLAFKPNTDDMREAPSRRLIAELLARGAHVRAYDPVAVTEARRVFAIDLHDAPEQFARLTFATTQDETLTGADALVIVTEWKEFKSPDFVHLKSVLKSPLIFDGRNLYEPDAMTELGIDYHSIGR

SEQ ID NO: 4465 - protein, 451 aa, Burkholderia fungorum
SPHSQSLADPFAPPADSSLWRKNFLLGAATASYQIEGAVNEDGRLPSIWDTFSAIPGKVLAGDTGAVACDHYHRWEADVDMLAGLGFEGYRLSIAWPRVMDTAGVPNRKGLEFYKRLLARLKEKGIATFVTLYHWDLPQHLEDRGGWLNRDTAYRFADYADLMSRELAGSVDGWMTLNEPWCSAYLGYGNGHHAPGLADARYATQAMHHLLLAHGLAMPVLRANDPASQKGVVANIGRGTANSGSAADQRAAHLFEVQHNAWILDPLLEGRYPRDLFELWPGTEPLVLDGDMQTVAAPLDFLGINYYFRTNVASDGAHGFREVPLQGVERTQMGWEVYPDGLRDLLIGFKATYRNLPPIYITENGMASDDKVIDGRVDDMQRISFLKRHLAAVDEAIKAGVEIRGYFLWSLMDNFEWAFGYERRFGVVHVDYATQKRTVKRSAELVSKFLK

SEQ ID NO: 4466 - protein, 480 aa, Burkholderia fungorum
HRQYIDGQAVAAMDTVATDIINPSNRKVVASVRQATPAQVQHAVASAHEAFTGVWQQTSAARRGELLNRLADLMQAHREELAQIESLSSGKLIGLSRAFEIDYSIAFLRYYAGWATKIHGQTMNLSLPSSNGEQYTGFTLRQPIGVVAGIVPWNFSIMIAVWKFGSALACGCTAVIKPSEFTPLTMLRVAELALEAGIPPGVLNIVNGNGRTVGTALIAHPKVAKVTFTGSVPTGVGVGVAAMQAGLKHVTLELGGKNPAGFLRDFPVERTVDGIIEAAYLHQGEVCASAERFYVHRSRIDDVLEALHHTLATLKIGSALDESAQFGPLANAAHFAKVMAFFEKARAQDGEIVHGGTVAPGDGFFVQPTAIPARSQADTIMTEETFGPVASFLAYDDEEEMLHYMNDTHFGLTASIWTNDLSKALRFVPRVEAGTVWVNMHNYIDPAMPFGGVKSSGIGREFGEAFIEYFTELKSVIVRY

SEQ ID NO: 4467 - protein, 538 aa, Burkholderia fungorum
IGAFLARRLTEAGVRHLFGVPGDFNLSFLEQIQEADGIEFVGNCNELNAAYAADGYARTSGIAALVTTFGVGDLGAIGGIAGAYAENVPVVHITGTPPLHAVNSRALVHHTLVNGDYDNIGRCMSEFTVAQTRITPANAAFEIDRVLRSCWLERRPVHLQLPSDVTHVVVEVPEAPLMLADPSSDPHQLREATRRIVEALASARFPAIVVDADADRFGVTELVQKLAEKCSIPCASLTPAKSALNETSRHYVGTYVGAASAEPVRSIVENADCLIGVGLRFTDTSTALFSQHFNPEAFIDLRRHDLSLGTTQIPGVTLRDVLARVVDDAQPVVRERATQALAAASDALPASSGNVPLTHAALWPRIRRFLKPRDVILGEAGTSHASLSAMKLPPGATYIAQPIWGAIGYTLPALFGSLVGTPSRRHLLFIGDGSFQLTAQELSSILRRDLKPVIFLLNNSGYTIERLILGEHSAYNDVANWHYAGLPHAFDRRERALSLVVETVADLEAALNRAESAEHLVFIELKLPMMDAPESLKK

SEQ ID NO: 4468 - protein, 292 aa, Burkholderia fungorum
MFKADTQAQLCFKLGDEIGSEGKNSAVFRARDLQLDAELAIKQVKKSSISDTADYFREASILYLGDHTNVVPIHYACEDADHVYLAMPYYPNGSLNRLIEQRFLTVREVVRYGIQFLSGLHNIHSKGLIHFDIKPDNILLSSRNEALLSDFGLARRMNADGTAEPPLSYWKNIPPEALATSEHTVGYDIYQVGLTLYRMCCGNDTFYEQLKQFKTFADFGAAVNKGLFPDRSTFPAHIPNALRTLVKKCINVDVDARYGAVIEVSNALGGIEGNELDWQYEVYPDGTREWTK

SEQ ID NO: 4469 - protein, 266 aa, Burkholderia fungorum
AAFTVVITRPAGQSNELIARLAAAGIATLDFPLIDVAPVTDEAPLRAALSSLERYALVVFVSPNAVDYAFARSDTIWPHALPIGVVGPGSVQALARHGVTSPAYNVISPPSGTDEETARFDSEGLFAAIDTALGATNLEGKRVLIVRGDGGREWLAERLREAGAEVETVAAYRRLVPEPSIGGWARVHELLAGAPHAWLLTSSEGVRNLHELAQDHLTADEISQLKRAALVTPHPRIAQTARALGFDSITVSGAGDERIVRTLLAA

SEQ ID NO: 4470 - protein, 307 aa, Burkholderia fungorum
PHTLVIASRESRLAMWQAEHVRCALHKLYPSCDVKILGMTTRGDQILDRTLSKVGGKGLFVKELEAALADGRADLAVHSLKDVPMALPEGFALSTIMEREDPRDALVSNTYDSLAALPEGAVVGTSSLRREAMLRMRYPHLEVRPLRGNLDTRLAKLDRGDYAAIILAAAGLKRLGLGERIRALLDPEDSLPAAGQGALGIEIRADRAELAAWLAPLHHEHTAAAVEAERMVSRALGGSCEVPLAAYATWHDGALHLRGIVATPDGQRVLSAQASAPATSVEQAIALGQEVAGALEQQGAMEIVRAL

SEQ ID NO: 4471 - protein, 817 aa, Burkholderia fungorum
VKTDKAVKAVRSDKTTQAATTAQAQKPAKAGSSKIKIVTAAPQAANASARQPASAQAPAPKANGRTREDKDHPLFQDIRYLGRLLGDVLREQEGDAVFDVVETIRQTAVRFRREDDSAAAQTLDKKLRSLSPEQTVSVVRAFSYFSHLANIAEDRHRNRRHRIHELAGSTSQPGTIAHSLERLVEAGAAATPVLQEFFNNALIVPVLTAHPTEVQRKSILDAQHDVARLLAERDQQLTDRERAHNEAMLRARVTSLWQTRMLRDSRLSVADEIENALSYYRATFLEEIPALYADIEEALAEHGLEARLPPFFQMGSWIGGDRDGNPNVTAETLENAITRQAAVIFEHYMEQVHKLGAELSVSNLLAGASDALKELAAVSPDQSPHRTDEPYRRALIGMYTRLAASARVRLGEGSVPVRSAGRGAAPVRAKPYADSAEFVRDLHVLIDSLAEHHGAPLAAPRLSPLARAAEVFGFHLASIDLRQSSDVHEAVITELLRRAGVEENYAELPEADKLNVLLSELAQPRPLRLPFAEYSDLVKSELGVLEEARVTREKFGARAVRNYIISHTETVSDLVEVMLLQKETGLLRGCLGNANDPAQAGLMVIPLFETIPDLRNAPHIMRDLIALPGVDALIEHQGNEQEVMLGYSDSNKDGGFLTSNWELYRAELALVSLFNERGVTLRLFHGRGGTVGRGGGPTYQAILSQPPGTVDGQIRLTEQGEVIASKFGNPEIGRRNLETVVAATLEASLLPHGIAPAQLPAFEETMQQLSDAAMASYRALVYETPGFKEYFFESTPISEIAELNIGSRPASRKLQDP

SEQ ID NO: 4472 - protein, 458 aa, Burkholderia fungorum
EAWSARFSEPMSELVKRYTSSVFFDKRLALVDIEGSLAHASMLAAQKIIAADDLTAIQRGMAQIKGEIERGEFEWQLDLEDVHLNIEARLTALIGDAGKRLHTGRSRNDQVATDIRLWLRGEIDRIGGLLTELRTALLDMAEKNAATIMPGFTHLQVAQPVTFGHHLLAYVEMFSRDAERMIDCRKRVNRLPLGAAALAGTSYPIDRYAVAKTLGFDGICANSLDAVSDRDFAIEFTAASALVMTHISRFSEELVLWMSPRVGFIDLADRFCTGSSIMPQKKNPDVPELARGKTGRVNGHLIALLTLMKGQPLAYNKDNQEDKEPLFDTVDTVADTLRIFAEMVAGISVKPQAMRDAALQGFSTATDLADYLVKRGLPFRDAHEAVALAVRVCADRGCDLADLTLEEMRKELSNVAHLIGEDVFSYLTLEGSVASRNHPGGTAPEQVLAAVKAAREAL

SEQ ID NO: 4473 - protein, 207 aa, Burkholderia fungorum
MSDEQQKKIALVTGATRGLGFETVRQLAASGVRVLLGARDTHAGEAKAAELRAEGLDVRPIAIDLNNAATFDQAAKEIDALFGRLDILVNNAGVMSDADGFPSVANPQAMRDVIEINFIATVIVTQNMLPLLRKSKHGRIVNVSSRVGSLWWNSDPDNPVPDNKWLGYAASKAAVNMLTVELAYELRDTPIKVNAICPGYVKTEMNK

SEQ ID NO: 4474 - protein, 240 aa, Burkholderia fungorum
KVAIVTGASRGIGASIAKRLAADGLTVVVNYSGSDAAAAAVVEQIEEASGRARSAKADISDAAAVRRMFEAAETAYGGVDVLVNNAGIIGLKPIASMDDETFDRIVKVNLKGTFNTLREAANRLRPGGRIVNFSTSVVGLYQPTYAIYAATKAGVEAMTHVLSKELRGRNITVNAVAPGPTATELFFDGKTPEVIDHLTRLAPLERLGQPEDIANAVAFLAGPDGAWINGQVLRANGGII

SEQ ID NO: 4475 - protein, 217 aa, Burkholderia fungorum
MNIKGCTALVTGANRGLGKVIVDQLAQAGAARIYAGMRNPAVIGHDVVTPVALDVTDADSVARTAEKCSDVDLVINNAGIMLATPMLADDSEQALRRELDVNAFGPLRIAKAFAPILARNGGGAIVNMLSVVSWYVYPFNATYCASKFTALAMTDAMRVELKAQGTHVMGVYAGFIDTDMAARVTGEKTSPVQVAERMLAGLRAGKDHVLADAAAEE

SEQ ID NO: 4476 - protein, 312 aa, Burkholderia fungorum
QQPMNSVWGERTTAQEVLEDLSGKTILITGGHSGIGLRSTRVLAAAGARIIVGARDIAKARTALAGTRAVELLGLDLSDPASITRFSTQVLKVHEKIDVLMNNAGIMALPKLIKDSRGYELQFSTNHLGHFQLTALLWDALKKAGGARVVTLSSYGHRYSPVDFDDPNFGSRRYDKWKAYGQSKTANAPFSVELGRLGQPFGIRAFPCIPGRTPSTALKRSLTFKELLAMPLLLFSKVYVKNIQEGAATQVWAALSSQLDGKDGVYCAGCDISPAVTPDSPLANTVRDYAVDPDLARKLWVLSEKLVGFAWP

SEQ ID NO: 4477 - protein, 280 aa, Burkholderia fungorum
DYARKLKVAADTYRDDLLIVMRVYFEKPRTTVGWKGYINDPRLDGSFRINEGLRLARQLLLDINGLGLSTATEFLDLLSPQYIADLIAWGAIGARTTESQSHRQLASGLSCPIGFKNGTDGGVQIAADAIVAARASHAFMGMTKMGMAAIFETRGNDDAHVILRGGKKGPNYDSASVDATCVALKSAGLREQVMIDCSHANSGKSHLRQLEVVQDIALQLSQRERRIIGVMLESHLEEGRQDLKPGVPLRHGVSITDACVSWAQTEPVLETLAEATRKRR

SEQ ID NO: 4478 - protein, 273 aa, Burkholderia fungorum
DVVVSGVPLDLATTFRSGARLGPAAVRAASVQLSELHPYPWGFNPFDDLAVTDYGDCWFDAHNPLTIKASIVEHARTILRSGAKMLTLGGDHYMTYPLLIAHAEKYGRPVSLIHFDAHCDTWADDSPDSLNHGSMFYKAVKDGLIDPETSVQIGIRTWNDDFMGINILDAAWVHEHGTRATVERIASIVGERPAYLTFDIDCLDPAFAPGTGTPVAGGLSSAQGLAIVRALGALNLVGADVVEVAPAYDQSEITAIAAAHIACDLLCLWRQRK

SEQ ID NO: 4479 - protein, 492 aa, Burkholderia fungorum
LAFWQDKAATLSIEGRAFIDGEYRDAEGGRTFDCLSPIDGKLLAKVADSGAADVDAAVSAARRAFDSGVWSGLNPRQRKAILLRWAASIREHMDELALLETLDAGKPIADTTSVDVPGAAYCVEWFAEAIDKVGGEVAPADHHLVGLVTREPIGVVAAVVPWNFPILMASWKFGPALAAGNSVVLKPSEKSPLTAIRLAQLALDAGIPAGVFNVVPGAGEPGKLLALHQDVDCLAFTGSTNVGKLIMQYAGQSNLKRVWLELGGKSPNIVMPDCPDMDRAANAAAGAIFYNMGEMCTAGSRLLVHRDIKDVFLDKLIAAARSYTPGNPLDPNTSMGAIVDKVQLERVLGYIEAGRAEAKLLLGGARVKEETGGFYIEPTIFEIPASGAKVAREEIFGPVLSVITFDTVEEAIRIANDSEYGLAAAVWTSNLTIAHEVSRKLRAGTVWVNCYDEGGDMNFPFGGYKQSGNGRDKSLHALEKYTELKSTLVRLR

SEQ ID NO: 4480 - protein, 445 aa, Burkholderia fungorum
TAEYRALDAAHHIHPFSDMGALNRTGSRVIVKAQGVYLWDSDGNKVIDGMAGLWCVNVGYGRKELADAAYRQMMELPYYNTFFKTTHPPVIELSALLAELAPEPFNHFFYCNSGSEGNDTVLRIVHHYWATQGKHAKKFVISRKNGYHGSTIAGGTLGGMGYMHEQMPSKVENIVHIDQPYFFGEAQGNLTPEEFALARAQQLEAKILEIGADNVAAFIGEPFQGAGGVIFPASTYWPEIQRICRKYDILLVADEVIGGFGRTGEWFAHQYFGFEPDLITLAKGLTSGYIPMGAVGLHDRVAKAIIENGDFNHGLTYSGHPVAAAVAVANLKLLRDEKIVERVKTDTGPYFQKKLRDTLGNHPIIGEISGAGLVAGLQLAQDPKTRKRFANGGDVGTICRDFCFNGNLIMRATGDRMLLSPPLVINKLEIDEIVSKAKKAIDATA

SEQ ID NO: 4481 - protein, 357 aa, Burkholderia fungorum
MKTYRIATIPGDGIGKEVVPAGRRVLEAIAARSDAFGFEFENFDWGGDYYREHGVMMPADGLDAIRHQDAILFGSAGDPHIPDHVTLWGLRLKICQGFDQYANVRPTRILPGIDAPLKRCGPQDLDWVIVRENSEGEYAGVGGRVHQGHPIEVATDVSMMTRAGVERILRFAFRLAQSRPRKLLTVITKSNAQRHAMVMWDEIAVQVSKEFPDVRWDKELVDAATARMVNRPATLDTIVATNLHADILSDLAAALAGSLGIAPTANLDPERRYPSMFEPIHGSAFDIMGKGLANPVGTFWSVVMMLDHLGEHAAARQLMAAIERVTADPSLHTGDLGGTATTAQVTDAVCAILAAGS

SEQ ID NO: 4482 - protein, 212 aa, Burkholderia fungorum
LECRGLSKTYGAGRIVLAHLDFTLAPGEFVAIMGDSGVGKSTLLNLVAGLDSADSGDVIIDGSVVSRLDDNAATRLRRQKLGFVFQAFHVLPHLTLAQNVALPLLLNDLPTAAALDMLAAVGLSGRGDDFPRQLSGGELQRVAIARALVHRPKLILADEPTGNLDPDTAHDVLALFRAQSKATGAATIMVTHSEAAAAVADRILILSDGGLH

SEQ ID NO: 4483 - protein, 184 aa, Burkholderia fungorum
RAKLVVGNWKMHGRLAENAVLLQAVAQGAGELPAQVRVGVCVPSPYLAQSQSLLEGSRVAWGVQDVSAFTHGAYTGEVAAPMAVDFGATLAIVGHSERRAYHRESAELVAVKTQRVLEAGLTPIVCVGETLEEREAGSTEQVVGMQLDEVLAKLSEQEAARIVVAYEPVWAIGTGKSASSEQAQ

SEQ ID NO: 4484 - protein, 260 aa, Burkholderia fungorum
  unsure (1)..(260): unsure at all Xaa locations
RNAVXLCPNHEVAMTKAVLITGGSRGIGRATARLLGARGWSVGVNYARNLAAAQDTAAEVERAGGRALTIAGDVASEADVLAMFDALQQKFGRLDALVNNAGIVAPSSQLADMDLARLKRMFDVNVLGAYLCAREAARRMSTDRGGAGGVIVNVSSAASRLGSPNEYVDYAGSKGAVDTMTLGLARELGPRGVRVNAVRPGLIDTEIHASGGKPERAAQLGGTTPLGRPGTAGEVAETIVWLLSDAASYVTGALLDVSGG

SEQ ID NO: 4485 - protein, 288 aa, Burkholderia fungorum
VILVTGAGTGIGKLTAQSLAEAGHIVYATMRDVEGRNKPRADEMRALAKAKGIQLHPLELDVLSQASADAAAATIVREQGRLDVVMQNAGHLVVGPSEAFTPEEMVKVFDTNLFGAQRVNRAVLPFLREQEAGLMLWISSTTTKGGFPPFLGPYGAAKAAMDSLAVSLAYEIARFGIETSIVVPGAFTRGTAHFPSAGKPADTERAAAYARYDGVTDQIGERLSGLTPENADPQAVADEIVRIVGLPSGERPMRSVIDFVGDGAREVLEVSERVRIDFARRIGMADLL

SEQ ID NO: 4486 - protein, 238 aa, Burkholderia fungorum
QVAIVTGASRGIGAAVAQRLANDGFAVAINYASSSTEADALVAKLTAAGAKAVAVKADVSNAGDVRRLFEITEQQLGKVDVLVNNAGVLKTTPLADTSDALYDQTFDINVRGTFNTLREAAARMNDGGRIVNFSSTTLALNMPGYAIYNATKAAVEAFTHVFAKELRGRNITVNAVAPGPIATSLFLDGKTEEQIQTFAKMPPLQRLGQPDDIASVVAFLAGPDAGWVNGQILRANGG

SEQ ID NO: 4487 - protein, 292 aa, Burkholderia fungorum
MAGMKEIRGKIKSVQNTRKITKAMEMVAASKMRRAQERMRAARPYADKVRDIAAHMSRANPEYRHPFMVSNEGAKTAGIILVTTDKGLCGGMNTNVLRASLQKFKELEGQGKTIEATAIGTKGLGFLNRLRAKVVSNVVHLGDTPHLEKLIGAVKVQLDLYSEGKVSAVYLAYTRFVNTMKQEPVIEQLLPLSADQFERKEEDGTTPSTQWDYIYEPDAQAVVDELLVRYVEALVYQAVAENMASEQSARMVAMKAASDNAKTVINELQLVYNKSRQAAITKELSEIVGGAA

SEQ ID NO: 4488 - protein, 518 aa, Burkholderia fungorum
  unsure (1)..(518): unsure at all Xaa locations
MQLNPSEISELIKSRIQGLEASADVRNQGTVISVTDGIVRIHGLSEVMQGEMLEFPGNTFGLALNLERDSVGAVILGEYEHISEGDVVKTTGRILEVPVGPELLGRVVDALGNPIDGKGPINAKKTDAIEKIAPGVIWRKSVSEPVQTGLKSIDAMVPVGRGQRELIIGDRQCGKTAVAVDTIINQKGKNLFCIYVAIGQKASSIMNVVRKLEETGALEYTIVVAASASESAAMQYLAPYAGCTMGEYFRDRGQDALIVYDDLTKQAWAYRQISLLLRRPPGREAYPGDVFYLHSRLLERAARVSEDYVEKFTNGEVKGKSGSLTALPVIETQAGDVTAFVPTNVISITDGQIFLETDLFNAGIRPAINAGVSVSRVGGAAQTKVVKKLSGGIRTDLAQYRELAAFAQFASDLDEATRKQLERGRRVTELLKQPQYQPLQVWELAVALFAANNGYLDDLEVAQVLPFEKGLRDYLKSKHADLIKRIEDTKELSKDDEALLHTALKDFKKSGAYXSASD

SEQ ID NO: 4489 - protein, 537 aa, Burkholderia fungorum
TARRLEGEFDYIIVGAGTAGCVLANRLSEDPDVQVLLLEAGGKDDYHWIHVPVGYLYCIGNPRTDWLYKTQAEAGLNGRALSYPRGRVLGGSSSINGMIYMRGQREDYDEWARVTNDSSWSWNSVLPVFRRSEDHYAGASESHGAGGPWRVEKQRLKWKILEEFSRAAQEAGIPATDDFNRGDNTGVGYFDVNQKRGIRWNASKAFLRPALKRPNLTVITGAHTQRVVFEGRRCTGVEYRGNDTDYLAKARCEVILSSGAVNSPQLLELSGIGNGARLQNLGIEVVNDLRGVGENLQDHLQLRMAYKVDGVRTLNTASAHWWGKLMIGLQYALFQSGPMSMSPSQLGAFARSDPNDRSLTRPDLEYHVQPLSLDRFGEPLHRFNAFTASVCQLRPTSRGSIHIESANASAPPLIAPNYLSTDYDRHVAANALRLTRRIAAAPALARYRPQEILPGTQYQTEEELQQAAGAVGTTIFHPVGTCRMGTTDDPGAVVDNRLRVIGVDGLRVVDASVMPTITSGNTNSPTLMIAERASDMI

SEQ ID NO: 4490 - protein, 478 aa, Burkholderia fungorum
LTHFINGKTVEGTSGRFGDVFNPAQGSVSARVPLASVAEVDAAVAAAKDAFAAWSETAPIKRARVLFRFKELLDRHHDELAELITREHGKVFSDAKGEVMRGIEIVEFACGIPNLLKTDFTDQIGGGIDNWNLRQPLGVVAGITPFNFPMMVPCWMFPVAIACGNTFVLKPSERDPSCSNRLAELLKEAGLPDGVFNVVHGDKVAVDALLVHPDVSALSFVGSTPIAEYIYTEGTKHGKRVQALGGAKNHLVVMPDANLDQAVDALIGAAYGSAGERCMAISVAVAVGHIADELVERLTPRVKSLKILNGMESDAEMGPLVTAVHREKVVGYIDSGVAAGATLVVDGRGHQVSGHEKGFFLGGTLFDNVSTDMKIYREEIFGPVLCVVRVPDFASAVELINANEFANGVSLFTSDGGVARAFSRQIQIGMVGINVPIPVPMAWHSFGGWKKSLFGDHHAYGEEGVRFYTRYKSIMQRW

SEQ ID NO: 4491 - protein, 589 aa, Burkholderia fungorum
RTSHTSRSTVAPQQFSLDVLLEKYAKGDEQSADDVFKRVARGVAEAEPPALRESVEALFVDNLRHGALGAGRIMSAAGTGIAATLINCFVQPVGDAIQGVDEEGLPGIYVALLQAAETMRRGGGVGYNFSAIRPKGARVHTTSSSASGPCSYMDVFDASCRTVESAGSRRGAQMAVLDCNHPDLLEFIEAKHSKGRWNNFNVSVGVTDEFMRAVEEDQPWQLVHRAEPSPAQRAADDVRQREDGLWVYSERPAREIWDRIMRSTYDVAEPGIVFISRMNEDNNLRAVETIRATNPCGEQPLPAYGCCNLGPLNLTRFVIDPFAQIKGRKPSFDWDGLAKRTRTQVRFLDNVLDVTLWPLPQQYEESRAKRRIGVGFTGLGDTLVMLGLRYNSQEGRDFAVGIAQLMRDEAYRASVELARERGAFPLFDAARYLETGTFASRLPEDIKQAIRRDGIRNSHLLSIAPTGTVSLAFADNASNGIEPAFSWTYTRMKVMADGSRESFDVEDYAYRLYRELGGDVNRLPDYFVSALEMSARDHLDMMAAVQPYVDTSISKTVNVPADYPFEAFESLYLDAWKNGLKGLATYRPN

SEQ ID NO: 4492 - protein, 403 aa, Burkholderia fungorum
EAHRKTDAALQRASAAAESANRAKSRYVTGLSHELRTPLNSILGYAQLLLQGTDELPPARRNAVATIYRSGEHLLALVDGLLDVARIEAGKLQLNVTEISLPDFVAQLAAMLEPQATDKGLQFEFQTSGRMADVVRIDEKRVRQILINLIGNAIRFTSHGSVKVRASYAWEAITFEITDTGPGMPASELERLFLPFERGAAAREHDHGAGLGLTICRLLTELMGGNLEVQSEVGKGTRFIVKLFAPEVRAPQLLASGPLNVKGYDGPRRTVLVVDDLAEQRRIVVQTLAPLGFNVVEAASGPEALQWLGTASADLIVMDVSMPDMDGFEASRLIRDNHLSAAPVLILSANAFADDRDKGAAAGCDDYLAKPLYIPLLLDKLAALLQLHWIVSRPKRRPPPPLR

SEQ ID NO: 4493 - protein, 401 aa, Burkholderia fungorum
LHPVAGVSLGWAEANIRKPNRKDVLVISVGEGATVGGVFTQNRFCAAPVTVCRENLDRVRAGGKPIRALVINTGNANAGTGEPGLVAARETCAELARLADITPEQVLPFSTGVILEPLPVDRLKAGLPAALANRKEANWYDAAQAIMTTDTLPKATSRQVTIEGHTVTLTGISKGAGMIRPNMATMLGFLAFDAAVAQPVLDALVRHVADRSFNCITIDGDTSTNDSFILIASGKSSLPAITSTDSPAYAALRDAVTEVAQTLAQLIVRDGEGATKFMTVHVEGGSSVGECRQIAYAIGHSPLVKTAFYASDPNLGRILAAIGYAGVDDLDVGKIDLYLDDVLVATAGGRNPAYREEDGQRVMKKSEIGIRVVLGRGDAQATIWTCDLSHDYVSINADYRS

SEQ ID NO: 4494 - protein, 313 aa, Burkholderia fungorum
IAEDMQQVNRVIRHRLASDVMLINQISEYIISAGGKRLRPALLLLVAGALGETTGHRHELAAVVEFIHTATLLHDDVVDESDLRRGRQTANALFGNAASVLVGDFLYSRSFQMMVGVGKMRVMEILSEATNIISEGEVLQLLNMHDADVDEARYMQVIRYKTAKLFEAAAQLGAVLAGSDAKTEAAAAEFGRRIGTAFQIMDDWLDYTGTAESMGKNAGDDLREGKPTLPLIYLIERGTPEQSALAREAIEQGGTDRFDTIFEAITRSGALDHTLECAKQEAQAAAAAISSFPDSIFKDSLLELCSYSTARQS

SEQ ID NO: 4495 - protein, 177 aa, Burkholderia fungorum
REEALHIFSHSEEIVSADDVNASISGMAAAIRDEMSEDFPLVLSVMGGAAVFTGMLLPHLDFPLEFDYIHLTRYRNTTKGGNEMQWRVAPAESVKDRVVLVLDDILDEGETMAAIRDRILAMGAKRFLSAVLCEKIIPKAKPLRPDYCGFEVPDRYVFGCGMDAKGYWRNLPTIRAL

SEQ ID NO: 4496 - protein, 924 aa, Burkholderia fungorum
SPTGQAFGQAQGAQALAPQATFADYKVIRRNGSVVSFEPSKIAIAVTKAFLAVNGGQGAASARVRELVEQLTQNVVRALVRSRPNGGTFHIEDIQDQVELALMRGGEHNVARAYVLYREKRTQARGHDDQIVANTPGLNVTDNGVTRPLDMAALRGIIELACSNLGDAVSADPIIAETVKNLYDGVPMSQVYDSAILAARTMIEKDPAYSQVTARILLHTIRREILEEEVTQTEMGERYAEYFPQFIKRGVQAELLDDKLLQFDLKRLGAALDNNRDLQFGYLGLQTLYDRYFLHHDGVRIEMPQAFFMRVAMGLSLNEIDREARAIEFYNVLSTFDFMSSTPTLFNSGTRRSQLSSCYLTTVDDDLDGIYEALKENALLSKFAGGLGNDWTRVRALGSHIKGTNGKSQGVVPFLKVVNDTAVAVNQGGKRKGAVCAYLETWHLDIEEFLELRKNTGDDRRRTHDMNTANWIPDLFMKRVMEGGDWTLFSPSTCPDLHDKFGAEFETAYTAYEDKVARGEIKLFKKIPAAQLWRKMLGMLFETGHPWITFKDPCNVRSPQQHVGVVHSSNLCTEITLNTSDAEIAVCNLGSVNLVAHLKEQADGTLVLDHDKLKRTVSVAMRMLDNVIDINYYAVAKARNSNLKHRPVGMGIMGFQDCLHLLRTPYASEEAVRFADTSMEAVCYYAYYASTELAQERGRYSSYRGSLWDRGILPQDSVKLLAEARGGYVEVDSSESMDWTELRSRIAQYGMRNSNCVAIAPTATISNIIGVSACIEPTFQNLYVKSNLSGEFTVVNDYLVRDLKARGLWDEVMVADLKYFDGTLSRIDRIPADLRAIYATAFEVDPKWLVEAASRRQKWIDQAQSLNIYMGGASGKKLDEIYKLAWVRGLKTTYYLRTMAATHVEKSTVAHGALNAVSSGGGEG

SEQ ID NO: 4497 - protein, 340 aa, Burkholderia fungorum
SEARVNVADKRIINGQTDVNQLVPFKYKWAWEKYLAGCANHWMPQEVNMSRDIALWKDPNGLTEDERRIVKRNLGFFVTADSLAANNIVLGTYRHITAPECRQFLLRQAFEEAIHTHAYQYIVESLGLDEGEIFNAYHEVSSIRAKDEFLIPYIHVLTDPAFKTGTLEADQTLLRSLIVFACVMEGLFFYVGFTQILALGRQNKMTGAAEQYQYILRDESMHCNFGIDLINQIKLENPQLWTAEFRAEIREIFQQAVELEYRYAEDTMPRGVLGLNASMFKSYLRFICNRRCQQIGLDPLYPNEENPFPWMSEMIDLKKERNFFETRVIEYQTGGALTWE

SEQ ID NO: 4498 - protein, 312 aa, Burkholderia fungorum
RTLALATLICGSLAYDNIMTFEGRFREHILPEQVHILNVSFLVPTMRREFGGCAGNIAYSLHLLGGDARIMGALGSVDAQLYMDRFRQLGLSTESVLVVPDAYSAQAMITTDLENNQITAFHPGAMMQSHLNRADQARGITLGIVAPDGYDGMIQHSEHLAAAGVPFIFDPGQGLPLFDGASLRRMIELATYVAVNDYEAKLVSNKTGWSIEEIAGKVEALIVTLGEQGAQIHHAGGVEDIPAVKAQQVLDPTGCGDAFRGGLLYGIGNKLGWATTGRLASLMGALKIEHQGPQNYAPSRAEINERFKQAFG

SEQ ID NO: 4499 - protein, 448 aa, Burkholderia fungorum
MFEKILIANRGEIALRIQRACRELGVKTVVVYSEADKEAKYVKLADEAVCIGPAPSNLSYLNMPALISAAEVTDAEAIHPGYGFLSENADFAERVEQSGFTFIGPRPETIRMMGDKVTAKQTMIKTGVPCVPGSEGALPEDPKEIVKIARQVGYPVIIKAAGGGGGRGMRVVHTEAALVNAVNMTREEAGRAFGNPQVYMEKFLENPRHIEIQVLADSFKNAVWLGERDCSMQRRHQKVIEEAPAPGIARRLIDRIGDRCADACKKMGYLGAGTFEFLYENGEFYFIEMNTRVQVEHPVTELITGVDIVQEQIRIAAGEKLAFRQRDIVFKGHAIECRINAEDPFKFIPSPGRLTSWHMPGGPGIRVDSHAYNGYFVPPNYDSMIGKLIAYGATREQAIKRMRIALSEMVVEGIQTNIPLHRELMLDAKFVEGGTSIHYLENRLAAKQ

SEQ ID NO: 4500 - protein, 144 aa, Burkholderia fungorum
MTRLLVLHGPNLNLLGTREPEVYGRVTLPQIDQALADRAADAGVELASFQSNHEGALVDRIQSARTENTDFILINPAAYTHTSVAIRDALAGVGIPFVEIHLSNVHRREPFRHHSYFSDQAEGVICGLGWKGYLYALEFALDRL

SEQ ID NO: 4501 - protein, 530 aa, Burkholderia fungorum
ASMTKTYDYIVVGGGSSGCVVATRLVEAGFEVLLLEAGPVDKDIYIHMPAGMRNAQKYSWNYMSEANPGSGVPPIHIHQGRVLGGGSSVNGMVYVRGSAHDYDDWDRIYGCTGWSHNDVLPYFIRSEGNEVVSGPKHGTDGNLWVSEHRYRHPLTMAYLRAAQELGYPYITDMSGATEQEGVGFWQCTIHEGKRGSTARAYLQRVIKSDLLTVVTGATARKVQIENGRACGVRYARNGNSVTDAVATREVILTAGAFETPKLLMLSGIGPAQHLNEFGIGTIADSPQVGKNFQDHLMVSITAETPGIPSFLREGEGLRKIANGLEWLTFNHDGVVSSNVLEGGGYFDINDDGRIDTQLFVFPFYEGKRDGNWTKADQIPDGMALKVGHVYPESRGEVLLGGPRPDDKIRLKGNYLSADGDLDLQVKAFKLGLKFFDAPSLKKITRNVAPKFSDDHEIADYVRKNCTTIFHPTSTCRMGNSPQSSVVDLTLRVWGIANLRIADASVMPHIVSGNTNAPTIMIAERAAEMII

SEQ ID NO: 4502 - protein, 476 aa, Burkholderia fungorum
PLKHPDKLYIDGQWVAASTGKEFSVISPDTESVYVRVGEASEADIEKAVSAARKAFDHGPWPRLSHAERGAYLRAMAEKLRARSHDMAAIWPHEMGVTYAFAQSFMPRIAGIYDFYANLGDTFAFEERHATSSGIGNGLLVREPVGVVGAIIPWNAPAMIIAYKLAPALIAGCTVILKSSPEAPGMALIIAEVAEEVGLPPGVVNVVTADRQASDALVRNAAVDKISFTGSSAVGKHIGSVLAQRVGRYTLELGGKSAAIVLDDYDLETAAKALATAASQMTCQVCASLTRIIVTKNRHDRLLEALASAYSSVKVGSPFDPATQMGPVATLRQRERVETYIAKGMQAGFTLAAGGKRPVHLPRGFYLEPTVFGNVSNRSELAQEEIFGPVLAVIPADSEEQAVEIANDSIYGLSGAVFTNDVDRAYSVARRVRTGSVAHNGFRNDFGIAFGGFKQSGIGREGGVEGLMPYLETKTV

SEQ ID NO: 4503 - protein, 240 aa, Burkholderia fungorum
RVALVTGAVRGIGAAIARELHVGGARVAVTDLDVASAEAVAKALDTHGETAFAFALDVREKRDFGHALDAVLGRWGKLDIVVNNAGYAKRTPLDEITPEEFDEIVNINMRSVFLSCQTFSKHMKSAGYGRIVNVTSLASHNGGTVASAHYSAAKGGAMTLTRYFARQLAGTGVTVNAVSPGPVSSAKERLAHLRDEISKQVPVGRFAEPEEIAAAVALLASERAGFMVGATIDVNGGLYM

SEQ ID NO: 4504 - protein, 259 aa, Burkholderia fungorum
LSEMKKKQTSLEGQVAVVSGGAHGIGLGIVERLLQLGAKVVASDIDRDGLAVSRERLAKSFGTSIAVQAADLSKERGAQALHRAVAKRFGPAQILVNCAGGGVIRPFLEHTPETLKATIDRNLWTVIWCSRVFLPDMIGAKYGRIVNIGADSVRNGLPAHAGYNAAKGGMHGLTTGLAREFALNGITVNTVAPCAVNTEVWAKVKKSNPRLAQAFVDVIPMGRVGEIEEVASMVGYLALPEAAFVTGQVISVNGGSAML

SEQ ID NO: 4505 - protein, 213 aa, Burkholderia fungorum
ALICDCDGVLIDSEAVAARMLVRELETRWPGTDVEPVVLPLLGLRIEKVLQGTAAQLGKSLTPDDIDAIRRAVEAAAMQAPMVEGIEAALAQVPLTKGCASNSFRPYVESVLARTGLVRFFGDRLFCADAVPNPKPAPDVYLAAARGLGLAPSRCLVVEDSVTGVTAASAAGMTVLGFIGGGHASDAQIDKLHAAGARHVFDDMQQLPELVAQ

SEQ ID NO: 4506 - protein, 478 aa, Burkholderia fungorum
MYLGIDLGTSEVKVLLLASNGRVIGTAGSPFTVSRQHQRWAEQNPEDWWAGTRAALAALRARYPDEFAQIRGIGLSGQMHGAVLLDAQDRVLRPAILWNDMRSDKECAELTERAPELHSVAGNLAMPGFTAPKLLWVARHEPDIFARTACVLLPKDYLRLQLTGGKVSDPSDAAGTLWLDVAKRDWSDSLLAACNMSRAQMPSLAEGSEPSGTLLPAVAREFGLSDGVIVAAGGGDNATSAIGIGATQPGDGFVSLGTSGVLCVVGDSFRPNPASAVHAFCHAIPDRWHQMSVVLSAASCLRWVCKLTSTDEPTLLAEIEALPADALNTAPLFLPYLSGERTPHNDPYAQGVFFGMNHATDRALLGYAVLEGVTLALTDGLDALRAAGTEAKALSLLGGGARSDYWAQLLADSLDTATRKHGGGETGAALGAARLGWLAAGGDPATVLTKPPIEKEFTPNPRRHAELRARLEAYRALY

SEQ ID NO: 4507 - protein, 292 aa, Burkholderia fungorum
CPFGHGSVASHAAAPAADSGDGWHDAQLDFSESMSYGDYLSLGTVLDAQHPLSPDHNEMLFIIQHQTSELWMKLALYELRAALQAVGRDELPPAFKMLARVSRIMEQLVQAWSVLATMTPSEYTAMRPYLGSSSGFQSYQYRQIEFLLGNKNELMLKPHAHRADVFAEVKASLEAPSFYDEVIRLLARRGFAISPSRLERDWTQPTVHDASVEAAWLEVYRNPSQYWELYEMAEELVDLEDAFRQWRFRHVTTVERIIGFKQGTGGTSGAPYLRKMLDVVLFPELWHVRTML

SEQ ID NO: 4508 - protein, 173 aa, Burkholderia fungorum
EVATLGGGCFWCLEAVYLGVEGVNAVESGYAGGEARHPTYEDVCDGETGHAEVVKVDFDPAKISYREILDIFFAIHDPTQLNRQGNDVGTQYRSVIFTHSDAQREIALQAIREIGEQQIYDGQIVTQVLPLNDNYWPAEDYHQNYFAHHPNQGYCSFVVAPKVAKFRQKFAHR

SEQ ID NO: 4509 - protein, 489 aa, Burkholderia fungorum
AARDPHHIALIEDARRLSSAQLLQAVDAATALLREWGVRGGDRVMIVAENSIAQIVLLFATARLDAWALVSNARLSAAELDSIRAHAQPRVVAYATESSTDAEQHARRHRATTAPAITPDIGNWSYAVDSAAVAEPVEAADHRQCAALIYTTGTTGAPKGVMLSHRNLLFIAAMSSRLRKVGPDDVVYAVLPISHVYGFASVCLGSLHAGATLRLVPRFAPEAVRRALAGERVSIFQGVPAMHAKLLEYLKTHGHPWSAPQLRFAYSGGSPLDAALKAQVERVYGLPLHNGYGMTESSPTVSHTMLDAPRSDCSVGEVIPGVEVRFVGLDGIDAAKGEIGELWVRGPNVMLGYYRSPEQTRTVVTEDGWLKTGDLARQDADGALHIVGRSKELIIRSGFNVYPAEVEHVLNAHPQVVQSAVVGRAVEGNEEVVAFVELIAGATVTPAELIDWCGERLAPYKRPAEVKVLAALPAASTGKILKHRLREFL

SEQ ID NO: 4510 - protein, 105 aa, Burkholderia fungorum
MKIRPLYDRVIVKRIEQQRTTASGIVIPDSAAEKPEQGEVIAVGDGRLLQDGTRRPLQLKVGDHVLFGKYSGQTVKVDGEELLVMREEDVMGVLESDAGAARKAA

SEQ ID NO: 4511 - protein, 536 aa, Burkholderia fungorum
MSAKDVKFHDSARSRIVKGVNVLADAVKVTLGPKGRNVLIERSFGAPTITKDGVSVAKEIELKDRFENMGAQVVKQVASKTADVAGDGTTTATVLAQSIVQEGMKHVAAGMNPMDLKRGIDKAVAAVLDELHRLSKPIKTSREIAQVGAISANADEAIGKIIADAMDKVGKEGVITVEDGKSLENELEVVEGMQFDRGYLSPYFINDPDKQVAHLDDPLILLHDKKISSIRDLLPVLEAAAKAGKPLLIIAEDVEGEALTTLVVNSMRGVLKVAAVKAPGFGDRRKALLEDIAILTGATVISEETGKQLEKATLEELGRAKRVEVQKENTIIIDGAGDQTRIDARVKAIRAQIEEATSDYDREKLQERVAKLAGGVAVIKVGAATEVEMKEKKDRVDDALHATRAAVEEGIVPGGGVALLRARSAISSLTGANADQDAGIRIVLRALEAPLRVIAANAGDEPSVVVAKVLSGKGNYGYNAATGEYGDLVETGVVDPTKVTRTALQNAASIAGLILTTDATVAEAPKEEKAVPAPAP

SEQ ID NO: 4512 - protein, 364 aa, Burkholderia fungorum
PGGLVAGSTRRCIMARKPLGVGIVGLQPGRSWAAIAHVPALRSLPDDYEIVGVANSSPASAKQAAQASDIPYAFADVAELVASPAVQIVTVTVKVPHHFELVKAAIDAGKHVYCEWPLGNGLQEAQALADMARARGVLAVVGTQARAAPEIEYLTGLIAGGYVGEVLSSTLVGSGRILGPHVNQVGAYILDVRNGANMLTIPLGHTLAAMRDVLGDVVELSASLIHRRTSATVAETQEVVPMTSHDQVLVNGTLHSGAPVSIHYRGGLSRGTNLLWEINGTEGDIQVSGPSGHTQMVQLSLKGARGEASSVEPIEVPPSFYEGWPKEPSPRNVARVYARMAADLRDGTTSAPTFDDALAVHQII

SEQ ID NO: 4513 - protein, 425 aa, Burkholderia fungorum
MSKNETLFERAQRTIPGGVNSPVRAFRSVGGTPRFIERAQGAYFWDADGQRYIDYIGSWGPMILGHVHPEVLEAVQRVLGNGFSFGAPTESEVEIAEEICKLVPSIEQVRMVSSGTEATMSALRLARGFTNRTRIVKFEGCYHGHADSLLVKAGSGLLTFGNPTSAGVPADIAKHTTVLEYNNVAELEEAFKAFGNEIASVIVEPVAGNMNLVRATPEFLQALRRLCSEYGSVLIFDEVMCGFRVALGGAQEVYGITPDLTCLGKVIGGGMPAAAFGGRRDIMAHLAPLGGVYQAGTLSGNPIAVAAGLKTLQLIQAPGFYDTLAARTTRLAQGLANVAREARVPFAADSLGGMFGLYFTESIPTSFAEVTQSDVPRFNAFFHKMLDAGVYFAPSAYEAGFVSIVHDDAIIDATIDAARGAFASL

SEQ ID NO: 4514 - protein, 389 aa, Burkholderia fungorum
REVVICNPVRTPIGAFGGSLKEVPATELGAIAVRETLRRSGLDAAALGSVVMGNVIQAGNRMNPARQASIGGGVPVSVPALTVNRVCGSGAQAIASAAQEILLGLGDVAVAGGMENMDRAPYLLDGGRWGYRMGNAQIHDSLLRDGLNDAFSGEHSGWHTEDLVAQFDITREAQDRWAARSQQRFSEAQARGDFDAELVAVETAGRKGPQHFTRDEQPRPDTTVETLAKLRPAFRPDGTITAGNAPGLNSGAAAMLVAGRGFAEAHGIEPFARLVAYGVAAVEPGMFGLGPVPAVEMALARAGWQLHDVERFEINEAFAAVPIAVARRLGIADELINVQGGAIAHGHPIGATGAVLTTRLLHSMRRDGLKRGIVTLCIGGGQGIALALE

SEQ ID NO: 4515 - protein, 256 aa, Burkholderia fungorum
MGEVPARRAAEIDALRCGIELGMTLIDTAEMYGDGATESLLGVALAGLRDKVFLVSKVYPHNASRRGVIAACEQSLKRLKTDQLDLYLLHWRGSVPLAETVEGFEALRRAGKIRHWGVSNFDTADMEELVATPGGDACATNQILYNVARRGPEFELLPWLAARKMPAMAYSPVDHARLPKRSPLDNIADARGVSVFQVALAWVLLAPGVFAIPKAGRAEHVRDNHRAAQLQLGADELAAIDAYFKPPRSKRPLEML

SEQ ID NO: 4516 - protein, 746 aa, Burkholderia fungorum
CPFNHAAGGGTTNRDWWPKQLRLDLLSQHSGKSNPLDGGFNYAEAFRSLDLAAVKKDLAALMTDSQDWWPADFGHYGPLFIRMAWHSAGTYRIGDGRGGAGRGQQRFAPLNSWPDNVSLDKARRLLWPIKQKYGQKISWADLLILTGNVALETMGFKTFGFAGGREDTWEPDLDVYWGNEKTWLGGDVRYGKGAAGDNDDGGVIVADEEKHGEEVSRDNSGRNLENPLGAVQMGLIYVNPEGPDGNPDPLAAAHDIRETFARMAMNDEETVALIAGGHTFGKTHGAGPADNVGPEPEAADLENQGLGWKNSFGTGKGADTITSGLEVTWTTTPTKWGNGFFENLFKYEWELTKSPAGAHQWVARDAGETIPHAHDPSKKLRPTMLTTDLSLRFDPVYEKISRRFLENPDQLADAFARAWFKLTHRDMGPRARYLGPEVPAEELNWQDPIPALDHPLVNEQDIASLKQKILASGLSVSQLVSTAWASASTFRGSDKRGGANGARIRLAPQKDWPVNQPEQLAKVLKVLEGIQSEFNGVQSGGKKISLADLIVLGGAAAIEQAAKSAGQQVSVPFSPGRMDASQEQTDVQSVAALEPLADGFRNYLKGKYRAPAEALLIDKAQLLTLTAPEMTVLLGGLRALNVHAGQDSHGVFTHRPQTLSNDFFRNLLDMGTEWKPLSPARDVFEGRDRKTGELKWTGTRVDLVFGSHAQLRALCEVYASEDAQEKFVRDFVAAWAKVMDLDRFEI

SEQ ID NO: 4517 - protein, 252 aa, Burkholderia fungorum
MEIRDNVFLITGGASGLGAATARLLVENGGKVVLADLNVDAGEALAKELGGVFVKCDVSREDDATQAVEAATKLGTLRGLVNCAGVAPAIKTIGKDGPHPLDSFTRTISINLIGTFNMIRLAAAAMSKNEPNANGERGVIINTASVAAYDGQIGQAAYAASKSGVVGMTLPIARDLSRNAIRVMTIAPGIFETPMLLGMPQEVQDALGAMVPFPPRLGKPAEYAMLAKQIFDNPMLNGEVIRLDGAIRMQPK

SEQ ID NO: 4518 - protein, 255 aa, Burkholderia fungorum
MLRVITANLNGIRSAAKKGFFDWFGEQKADVLCVQEIKCSQDDMTPEFMAPHDFTGYFQHAVKKGYSGAGVYTRHEPDEVVIGFGSEEFDPEGRYVELRFGKLSVISVYVPSGSSGDERQQAKYRFMDEFMPHLAELAQEREVIVCGDVNIVHKEIDIKNWKSNQKNSGCLPEERAWLTKLFDEVGYVDVFRTLDQRPEQYTWWSNRGQAYAKNVGWRIDYQIATPGIASKAKRTDVFRDIKFSDHAPLTVDYDH

SEQ ID NO: 4519 - protein, 287 aa, Burkholderia fungorum
IAPTLKAEILAEALPYIRQYHGKTVVIKYGGNAMTEERLKQGFARDVILLKLVGINPVIVHGGGPQIDQALKKIGKQGTFIQGMRVTDEETMEVVEWVLGGEVQQDIVTLINHFGGHAVGLTGKDGGLIHARKMLMPDRDNPGQYVDIGQVGEVEAINPAVVKALQDDAFIPVISPIGFGEDGLSYNINADLVAGKLAVVLNAEKLVMMTNIPGVMDKEGNLLTDLSAREIDGLFADGTISGGMLPKISSALDAAKSGVRSVHIIDGRIEHSVLLEILTEQPFGTMI

SEQ ID NO: 4520 - protein, 297 aa, Burkholderia fungorum
GVRLTCGRVTYNSVMKLKFTKMHGAGNDFVVLDGYTQPVNLTPAQVRALADRHFGVGADQLLLVEKPTVAGVDFRYRIFNCDGGEVEHCGNGARCFVKFVRERGLTDQRSVRVQVQKGTITLTMQENGEVLVDMGTPVFDPERVPFATKGLEGRREGADTLWPLDVSGTTRWISVVSMGNPHAVQVVGDVEAFPVLAEGPVIERHARFPQRVNAGFMQIVGRNEIRLRVYERGAGETLACGTGACAAVAAGIRRGLLDSPVRVHTHGGDLTISWDSTREGEPLLMAGPAVTVFEGEI

SEQ ID NO: 4521 - protein, 383 aa, Burkholderia fungorum
YLFTSESVSEGHPDKVADQISDAILDAILAQDKYSRVAAETLCNTGLVVLAGEITTTANVDYIQVARNTIKRIGYDNTDYGIDYRGCAVLVAYDKQSPDIAQGVDRAHDNNLDQGAGDQGLMFGYACEETPELMPLPIHLSHRLVERQANLRRDGRLPWLRPDAKSQVTVRYVDGKPHSIDTVVLSTQHSPDIDLGTLREAVIEEVIKPTLPADLIKGDIKFLVNPTGRFVIGGPQGDCGLTGRKIIVDTYGGAAPHGGGAFSGKDPSKVDRSAAYAGRYVAKNIVAAGLASRCLIQVSYAIGVAQPTSVMVNTFGTGRVSDAVITRLVQEHFDLRPKGIIQMLDLLRPIYEKSAAYGHFGREEPEFTWESTDKALALAEAAG

SEQ ID NO: 4522 - protein, 520 aa, Burkholderia fungorum
LKNHVAGQWIAGTGAGITLTDPVTGVALVRVSSEGLDLARAFSFAREDGGAALRALTYAQRAARLADIVKLLQAKRGDYYAIATANSGTTRNDSAVDIDGGIFTLSYYAKLGASLGEVHALRDGSAESLSKDRSFSAQHVLSPTRGVALFINAFNFPSWGLWEKAAPALLSGVPVIVKPATATAWLTQRMVADVVDAGILPPGALSIICGSSAGLLDQIRSFDVVSFTGSADTAATLRAHPAFVQRGARLNVEADSLNSAILCADATPDTPAFDLFIKEVVREMTVKSGQKCTAIRRAFVPEAALEPVLEALKAKLAKITVGNPRNDAVRMGSLVSREQYENVLAGIAALREEAVLAYDSSAVPLIDADANIAACVAPHLFVVNDPDNATLLHDVEVFGPVASVAPYRVTTDTNALPEAHAVALARRGQGSLVASIYSNDDAHLGRLALELADSHGRVHAISPSVQHSQTGHGNVMPMSLHGGPGRAGGGEELGGLRALAFYHRRSAIQAASAAIGTLTQ

SEQ ID NO: 4523 - protein, 516 aa, Burkholderia fungorum
AATVEAPPALFNFAAYLFRLNETRAGKTAYIDDTGSTTYGELEERARRFASALRTLGVHPEERILLVMLDTVALPVAFLGALYAGVVPVVANTLLTPADYVYMLTHSHARAVIASGALVQNVTQALESAEHDGCQLIVSQPRESEPRLAPLFEELIDAAAPAAKAAATGCDDIAFWLYSSGSTGKPKGTVHTHANLYWTAELYAKPILGIAENDVVFSAAKLFFAYGLGNGLTFPLSVGATAILMAERPTADAIFARLVEHRPTVFYGVPTLYANMLVSPNLPARADVAIRICTSAGEALPREIGERFTAHFGCEILDGIGSTEMLHIFLSNRAGAVEYGTTGRPVPGYEIELRDEAGHAVPDGEVGDLYIKGPSAAVMYWNNREKSRATFLGEWIRSGDKYCRLPNGCYVYAGRSDDMLKVSGQYVSPVEVEMVLVQHDAVLEAAVVGVDHGGLVKTRAFVVLKREFAPSEILAEELKAFVKDRLAPHKYPRDIVFVDDLPKTATGKIQRFKLRE

SEQ ID NO: 4524 - protein, 699 aa, Burkholderia fungorum
MTSRNRRDFLRSAAHAAGSATALSMLPLGIRNALAIPANNKTGTIRDVEHIVVLMQENRSFDHYFGTLKGVRGFGDTRAINLPNGKPVWYQPLAADIGYVLPFRPSAPNLGLQFLQDLAHDWTSTHAAWNGGRYDQWVPAKSATTMAYLTREDIPFHYQLADAFTICDAYHCSLMGPTDPNRYYMWSGWVGNDGSGGGPVIDNSELGYGWSTYPEVLQSAGISWKIYQDIGTGLDANGSWGWTQNPYIGNYGDNSLLYFNQYRNAQPGNPLYDNARTGTNAAKGDGYFDILKRDVQNNALPQVSWIVAPEAYSEHPNWPANYGAWYIDQVLQILTSNPEVWSKTVLLVNYDENDGFFDHMAPPFAPSSSANGLSTVDTTNEIYTGDAKTPSGPYGLGPRVPMLVVSPWSKGGYVCSELFDHTSVIRFIEKRFGHDHNLGESNITPWRRAVCGDLMSAFNFSNPNDAIPALPSTSGYVPADQNRHPDYVPLPPALQAVPKQEPGVRPARALPYELFVRVHGEGAANTLTMRFVNTGRAGAVFLVYAAHSLDAPRTYTVEAGKRLQDPLPLNADGSYDYTVYGPNGFLRRFAGKPVSRSWWHGSDIARPEVAEGYDVSNGNLQLRLENVGSARCQFTIVNAYDPGNAIKHSVRGGDTEQLYLDLRNAHGWYDLAITVDTDPLFARRFAGHVETGKSSMSDP

SEQ ID NO: 4525 - protein, 525 aa, Burkholderia fungorum
PARYNIGVDVCDKWADGSGRLALIYEDPEGTATRYTFDELKALSDRFANALLAAGAQRGDRIGIFLSQSVETAIAHLAAYKAGMVAVPLFALFGVDAIEHRLGDSGAVALITDHGGVQKVDEIRAALPSLRNVFSVDIDRDNGDPHAPVRSFWHALKSAPAGFTPVDTGADDPAVIIYTSGTTGKPKGALHGHRVLPGHLPGVEMSQQGFPAHATLIWTPADWAWIGGLFDVLLPSWHHGVPVLARRFAKFDGEAAFDLMARHAVSHTFLPPTALKMMRGVERPERWSLALRSVASGGESLGEELIGWGRKALGVTINEFYGQTECNVVVSSCAALFEPRFGAIGRAVPGHHVAIVDMDGNELPPGAIGDIAVAAPDPVMFLGYWGNEAATREKFRGKFLVTGDLGTCDADGFIRFVGRGDDVITSAGYRIGPASIEDSLLRHPAVSMAVVIGAPDRERTEIVMAFVVLNPGFAGDAALVREIQQHVKTRLAAHEYPREIRFVDSLPLTATGKVIRKALREGLEQ

SEQ ID NO: 4526 - protein, 290 aa, Burkholderia fungorum
YRSVFREGLFAGKVIIVTGAGSGLGRCTAHELASLGATLALVGRSEDKLKAVQAELAEDHQRTSAGHKTYSCDIRNEQQVRETIASIIADLGRVDGLFNCAGGQFPAKLEKISLNGWDAVVRNNLHGTFLMSRECYTQWMEHHGGTIVNMLADIWGGMPGMGHSGAARAGVWNFTETAACEWGHAGVRVNAVAPGWIASAGMDSYNEDYQALLRTLRHKVPLQRFGTESELAGAAVFLLSEASAFINGTVIRVDGGVPNARHSWPLPPAERTIEYNGFPRYQPPTGLQEQ

SEQ ID NO: 4527 - protein, 402 aa, Burkholderia fungorum
MDLNFTPEEEAFRADVQAFLRDRLPPRLADQGARRPPSDADDMAGWHAILNAQGWLANHWPKEYGGPGWNPVQKFIFENECALAGAPRVVPFGVNMLGPVLIKYGSEAQKRHWLPRILDGSDWWCQGYSEPGAGSDLASVKTSAVRGTDAQGEHYIVNGQKTWTTLGHYANMIFCLVRSATDVRKQEGISFLLIDMKTPGVEVCPIITLDGEHEVNEVFFTDVRVPVENLVGEENKGWTYAKYLLTYERTNIAGVGFSVAAFNRLRKIAAKQRRNGRPLAEDPAFAARMARVEIDLENMKTTNLRVIAAVAGGGVPGAESSMLKIRGTEIRQEISSLTRRAMGPYAQPFVEEALQDGFEGTPVGPDEAASAASLYFNNRKLSIFGGSNEIQKNIISKMILGL

SEQ ID NO: 4528 - protein, 349 aa, Burkholderia fungorum
MNFQHTEDRRMLADTLNRFVSEQYGFETRDRIARSAEGYSRDLWTRFAELGMIGALFDEADGGFGGGGFDIAVVFESLGRGLVVEPFLDTLIVGRAIARSGNEAQKAMLGELIDGSRVVALAHNEPDGHYELARVTTRAQRNGETWRLTGAKAVVQHGEHASLFLVSARTHGNDDEEAGVTLFLVPRDTAGVNVRGYRKIDGGRAAEVTFDNVALNDNALLGAAGAGFATLEYAVGCGVLALCAEAVGTMDVAKDHTLEYLRTRKQFGVPIGSFQALQHRMADLLLEIEQARSAVINAAAALGAERRLRERAVSAAKYSIGRIGARVAEECIQLHGGIGMTWELPLAHY

SEQ ID NO: 4529 - protein, 209 aa, Burkholderia fungorum
PLAVSVRGLQRRYGARVVIDALDLDIREGEFVTLLGESGCGKTTLLRALAGLDQPDAGQIRAPERPSVVFQEHRLLPWATLWENVVLGHETTIGRVGATRALAEVGLSGREDDWPRNLSGGQAQRVALARGLVRDPALLLLDEPFAALDALTRIKMHGLVKELVARHHPGVLLVTHDVDEALTLADRILVMRSGRIAASFHPKNHTPQA

SEQ ID NO: 4530 - protein, 493 aa, Burkholderia fungorum
VGFKAYNLLRMAELGLPVPPAFVLGTHYCRDARAREIATASTVWEPGLQELERTTGQRFGDPRQPLLLSVRSGAPVSMPGMMDTLLNVGLCDTTLAGMLRQTGNPRLVWDTYRRLVASYGELVAGVPSSIFEAEYAAFAGTRDEHGLDFTELRELTHRCLAAYERAAGQPFPQDPQVQLANAIGSVLASWQSDRACAYRKQCGISDAIGTAVTVQTMVFGNAGGRSGAGVGFTRDPVSGEPTLWVDFLFNAQGEDVVSGRRSARGHEELAQAMPAAWKALQDAATRLEHALGDMQDVEFTVQDARLYMLQTRNGKRTPQAAARIALDLLDEGVISAEVARERTAALKPAALTRTRIVASGDRPLTPLAHAASASNGVAAGEIAFDEARARMRHAAGASVVLVRRDAETDDIAALEVAAGLLTQRGARTSHAAVVARQLGKVCLVGCTGLRLDESARTLQLGDTVLHEGDEVTLDGNDGAIYAGTARTVIEPMA

SEQ ID NO: 4531 - protein, 280 aa, Burkholderia fungorum
FQLGDLPVTRMGYGAMQLAGPHVFGPPKDRGAAIAVLRAAIESGITHVDTSDFYGPHVTNQLIREALHPYPDALTIVTKVGASRGSDGSWNVASSAAELESAVHDNLRNLGLDALDVVNFRAMFNVAAPTEGDIEEPLTALAELQAKGLIRHIGLSNVTPTQVAQGRAITAIVCVQNMYNLAHRNDDALIDRLAEDGIAYVPFFPLGGFSPLQADALSDAANRCDAAPMQVALAWLLQRAPNILLIPGTSSVGHLEQNIESVNLQLPEDVLASLDTIGAE

SEQ ID NO: 4532 - protein, 252 aa, Burkholderia fungorum
ALNGKLALVTGASRGIGAAIAARLARDGASVIVHYASSAERADAVVKAIREAGGEAEAVAANLSTQDGVAVLIDSLNGVFGGRFAGRLDILVNNAGTVEYGPFLESSATSYDTHFNLNVRAPIELAKDAAKRMIATGWGRIINVGSAFGEAAPLPGVTLYIASKFAVRGFTRGLSRELGKFGVTVNAVQPGPIDTELAPQPGTEAHATMTRLASVGRFGKPEEIAAAVAYLASPEAGYTTGESLTVDGGWIA

SEQ ID NO: 4533 - protein, 433 aa, Burkholderia fungorum
VSLNNDAAFWRNARQHLIRYGGTFEPMIIERAQGSFVYDADGRAILDFTSGQMSAVLGHSHPDIVSVIKEYAGKLNHLFSGMLSRPVVDLATRLAEITPDGLDRALLLSTGAESNEAAIRMAKLVTGKYEIVGFAQSWHGMTGGAASATYSAGRKGVGPAAVGSFAIPAPFPYRPRFERDGQYDYLAELDYAFDLIDRQSSGNLAAFIAEPILSSGGIIELPEGYMAALKRKCEERGMLLILDEAQTGIGRTGTMFACQRDGVTPDILTLSKTLGAGLPLAAVVTSAQIEERAHELGYLFYTTHVSDPLPAAVGLRVLDVVEREGLVARANLMGERLRRGLLDLMERFECIGDIRGRGLLLGMEIVKDRRTKEPADGLGAKITRECMNLGLSMNIVQLPGMGGVFRIAPPLTVHENEIDLGLALLGQAIERSL

SEQ ID NO: 4534 - protein, 246 aa, Burkholderia fungorum
PLILITGGGRGVGAATARLAAAQGYDVAISFVSDESAALAVAADVEAAGRRALAVRADSADPEQVARLFAAIDRTFGRIDVLVNNAAIIAKQSRLEDLEFARMQRIFAVNSIGPILCAQQAVKRMSHRYNGRGGVVINISSASARLGSPNEYVDYAASKGALETFTTGFAKEVARDGIRVNCIRPGHIYTDMHASGGEPGRVDRVRDSIPMGRGGQPEEVARAILWLASAEASFITGTFLDVTGGK

SEQ ID NO: 4535 - protein, 251 aa, Burkholderia fungorum
SSIMPAHLPNLNDRVALVTGGSRGIGRAISIALAAAGASVAVNYRQRGNEAAGVVAEIERAGGRAIAVRADVSVADDVKAMFREVENHLGLIDVLVNNAGTGTIVDIDDLTEAEFDRTLAVNLKSAFLCTQAALPGMRARHWGRIVNLSSAAARGAGLLGVHYNASKAGVEGLTRGYAAKLAREGITVNAVAPGPIDTEMAGPLKAANVADKLPVGRLGEASEVAQAVLMVVGNAFITGQTIPVNGGVSFI

SEQ ID NO: 4536 - protein, 242 aa, Burkholderia fungorum
SPVALVTGSTSGIGAAIARRLSSEGFSVVLHSRSSAETGQALARELGSAIYVQADLADDADRIRLIREAVAAWGRLDVLVNNAGISRVIPHADLAAATPAVWAELHEVNVVAPFRLIAEAEPALRDAVQRVRPGCVINISSHAGVRPKGASIPYAATKAALNHMTRLLAVSLAPDIRVNAVAPGLVDTPLTADWTQAQELWKTRAPMRRSASPEDIAQAVMMLVASDYLTGEILLSDGGLNL

SEQ ID NO: 4537 - protein, 1169 aa, Burkholderia fungorum
VRLTSIKLAGFKSFVDPTHFQVPGQLVGVVGPNGCGKSNIIDAVRWVLGESRASELRGESMQDVIFNGSTARKPGSRASVELVFDNADGRAAGQWGQYAEIAVKRVLTRDGTSSYYINNLPARRRDIQDIFLGTGLGPRAYAIIGQGMIARLIEAKPEELRVFLEEAAGVSKYKERRRETENRLHDTRENLTRVEDIVRELGANLEKLEAQAVVATRYKELQADGEEKQRLLWLLRKNEAGGEQERQQRAIEQAQIDLEAHTAKLREVEAQLETLRVAHYSASDAMQGAQGALYEANSEVSRLEAEIKFIVESRNRVQAQIAALNAQREQWQSQAQKAQDDLADAEEQLAVAEEKATLVEDEAAAKHDAMPALEARWRDAQTELNAERGGIAQTEQALKLEAAHQRNADQQLQQLQARHERLKSEAGGLDAPDEAQLEDLRMQLAEHEEILHDAQTRLADAQETLPRLDGERRAAQERVQAESSQIHQLDARLAALKQLQENVQTEGKIQPWLEKHELNGLPRLWKKLHVEAGWEAALEAVLRERLAALEVSNLDWVKAFATDAPPAKLAFYAPPVAGQPAATPPALRPLLSLVRIDDAGIRAVLNDWLGLSFVADDLQQALAMRSQLPEGGSFVVKAGHVVTRVGVQLYAADSEQAGMLARQQEIENLARQVRAQALLADEAKAAAIRAEAAHTQAAQALTDVRQQAERATQRVHALQMDVLKLTQAHERYTQRSTQIREELAEITAQIEEQRAMRAESEANFERHDGELAELQARFEDHQLAFEALDEELTAARGQARDLDRAATDARFAARNMANRIDELKRSIQVAHEQSERVAASLEDARAELETINEQTAHTGLQDALDIRAVKEEALHAARLELDDLTAKLRAADETRLTAERALQPLRDRINELQLKEQAARLNGEQFIEQLAAAGVDEAQLQAKLTPDMKPSYLQGEVTRINNAITALGPVNMAALDELKAATERKSFLDAQSTDLNSAIETLEDAIRKIDAETRTLLQGTFDQVNQHFGELFPRLFGGGQAKLIMTGDEILDAGVQVMAQPPGKKNSTIHLLSGGEKALTATALVFAMFQLNPAPFCLLDEVDAPLDDANTERFANLVRAMSDKTQFLFISHNKIAMEMAQQLIGVTMQEQGVSRIVAVDMETAAGFAQ

SEQ ID NO: 4538 - protein, 401 aa, Burkholderia fungorum
VNPLLDSLQPYPFEKLRALFKDVTPNAGLAHISFGIGEPKHPTPALIRDAVVASLGGLSAYPATSGSPALRESIAKWVTQRYNLPPVDPATQVLPVSGSREALFSLAQTVLDPQKNAGGEPAIVLCPNPFYQIYEGAAILAGAQPYFVNSDPARNFACDYSAVPAEIWARTQLLYVCSPGNPTGAVLTLDDWRELFALSDRYGFVIASDECYSEIYFDEAKPPLGGLEAAHKLGRGFERLVMLSSLSKRSNVPGMRSGFVAGDAAILKDFLLYRTYHGAALSTVFQNASIAAWNDEAHVRENRAKYLQKFSTVTPMLAEVLDVRLPDAAFYLWADVSRTGLTDTVFAQRLYADYNVTVLPGSFLARTAHGVNPGRNFVRMALVADVDECTQGAQRIVDFCR

SEQ ID NO: 4539 - protein, 78 aa, Burkholderia fungorum
FTQAQEDVKQLPERPGNLTLLRLYALFKQASEGDVHGDKPGFTDIVGKYKYDAWAALKGTAQDAAKQQYVDLVESLKS

SEQ ID NO: 4540 - protein, 471 aa, Burkholderia fungorum
FASLGLSADVVSALTAAGYQNPTPVQQRAIPAGIAGRDLMVSSPTGSGKTAAFMLPAIERFSQLQKTQAGQPREPRPADGARTRRPQPVARPTMLVLTPTRELAMQVTTAAATYGKHLKRLRTVSILGGVAYGQQLMLLAKNPEILVATPGRLIDHLERGRIDLSQLQILVLDEADRMLDMGFIEDIETIVAATPATRQTMLFSATLDGKITSLTGRLLKDPERIEIVQRMEQRTNIAQTVHYVDDRDHKDRLLDHLLRDSGLDQAIVFTATKIDADQLAGRLADAGFESAALHGDLPQGARNRTIRALRERRVRVLVATDVAARGIDIPGITHVFNYDLPKFAEDYVHRIGRTGRAGRSGIAVSLVHHAEQGALKRIERFVRTPLAVNVVEGFEPRKSAPSGNGRPGFGGRGRPGGGNGGGRRFGSGSGKPAGNGGAARSGTGSNGGGWAGKSAGGGSREGRLRRRFARR

SEQ ID NO: 4541 - protein, 320 aa, Burkholderia fungorum
LDVITYGEAMAMFVAAETGRLAGVGQFAKRIAGADLNVAIGLSRLGFKVGWMSRVGNDSFGQYVRDTLTREGIDQRCVTTDERYPTGFQLKSRNDDGSDPAVEYFRRGSAASHLSLDDYAADYVLPARHLHLTGVAPAISASSRELAFHLAREMRAAGKTISFDPNLRPTLWPSRAAMVEGLNALAALADWVLPGIGEGEILTGYTQPDDIAKFYLDRGARGVIIKLGAQGAYFRTAADAALIAGQPVAKVVDTVGAGDGFAVGVVSALLEGKSLPQAVARGNRIGALAIQVIGDSEGLPGRAELDALESARRDIHRRGG

SEQ ID NO: 4542 - protein, 422 aa, Burkholderia fungorum
SKETPMTSSLAIRRWWTIMPIVFITYSLAYLDRANFGFASAAGINQDLGISKGLSSLIGALFFLGYFFFQIPGAIYAERRSVKKLVFWSLVLWGGCAALTGMVSNIPSLMVIRFVLGVVEAAVMPAMLIFISNWFTKSERSRANTFLILGNPVTVLWMSVVSGYLVHSFGWRHMFIAEGAPAIIWAVIWWFIVQDKPQQVSWLTQQQKDDLAETLRAEQAAIKPVRNYSEAFKTPAVIKLCAQYFCWSIGVYGFVLWLPSILKNGSTLGMVETGWLSALPYLAATIAMLAASWASDKLNRRKVFVWPFLLVGAVAFAASYALGSTHFWLSYALLVIAGAAMYAPYGPFFAIVPELLPKNVAGGAMALINSMGALGSFVGSYVVGYLNGATGSPAASYAFMSVALVAAVILTLVVKPQPQALN

SEQ ID NO: 4543 - protein, 460 aa, Burkholderia fungorum
ETIGATQVLTDPHDTAPYLTDWRRRYTGAACAVLCPATPDEVAALVKLAVEHRIALVPQGGNTGLAGGATPDASGAQAVISLRRLNRVRDIDPHNNTITVEAGVILAEVQKHAEEAGRLFPLSLAAEGSCTIGGNLATNAGGTGVLRYGNTRELCLGLEVVTPQGELWDGLRGLRKDNTGYDLRDLFIGAEGTLGIITAAVLKLHPQPAARVTALAALASPHAALDFLSLTQRVAGPLLTGFELMSDFCLRLVGRHFEQMRYPFAEPHAQVVLLELSDSESEEHARELFERLMETALEGGLVQDAVVAENLGQSRAFWNLREHIPLAQAEEGLNIKHDIAVPISRIGHFIEETDAAIAQAVPGARMVTFGHLGDGNLHYNVQAPEGVGAKAFLQQYQAAINQIVYDSVHRHRGSISAEHGLGQLKIDEAMHYKQDVEVQLMRAVKRALDPLNLMNPGKVL

SEQ ID NO: 4544 - protein, 422 aa, Burkholderia fungorum
RFDTLALHAGAAPDPTTGARATPIYQTTSFSFRDSDHAAALFNMERAGHVYSRISNPTVAVFEERVAALENGAGAIGTASGQAALHLAIATLMGAGSHIVASSALYGGSHNLLHYTLRRFGIETTFVKPGDLDAWRAALRPNTRLLFGETLGNPGLDVLDIAAVAQIAHEHRVPLLVDSTFTTPYLLKPFEHGADFVYHSATKFLGGHGTTIGGVLVDGGTFDFDASGRFPEFTEPYDGFHGMVFAEESTVAPFLLRARREGLRDFGACLHPQAAWQLLQGIETLPLRMERHVANTRRVVEFLAGHAAVGAVAYPELPTHPDHALAKRLLPRGAGAVFSFDLRGDRAAGRSFIEALSLFSHLANVGDARSLVIHPASTTHFRMDAAALAAAGIAEGTIRLSIGLEDPDDLIDDLKRALKAAQ

SEQ ID NO: 4545 - protein, 368 aa, Burkholderia fungorum
  unsure (1)..(368): unsure at all Xaa locations
MSGNTLGTLFTVTTFGESHGPAIGCVIDGCPPGLALNEADIQLELDRRKPGTSRHVTQRQEEDKVEILSGVFEGQTTGAPIALLIRNTDQRSKDYGNIADTFRPGHADYTYWQKYGIRDYRGGGRSSARLTAPTVAAGAVAKKWLREKFGTEIRGYMAALGEIDVPFVDWAHVRENPFFVPNQQIVPQLEAYMDALRKEGDSIGARINVVASGVPVGLGEPLFDRLDADIAHAMMGINAVKGVEIGAGFASVAQRGSVHGDELTPEGFVGNHAGGVLGGISTGQDITVSIAIKPTSSIRTPRRSIDKAGQPAVVETFGRHDPCVGIRATPIAESMLALVLIDHALRHRAQCGDVSVSTPKIAASAPXR

SEQ ID NO: 4546 - protein, 249 aa, Burkholderia fungorum
NLEGKVALITGASSGLGKRFAQVLSQAGAKVVLASRRTERLKELRAEIEASGGAAHVVSLDVTDYQSIKSAVAHAETEAGTIDILVNNSGVSTTQKLSEVTPADFEYVFDTNTRGAFFVAQEVAKRMIMRGNNAQNPSYRIINIASMAGLRVLPQIGLYSISKAAVVHMTKAMALEWGKHGINVNAICPGYIDTEINHHHWSTEQGQKLVSMLPRHRVGKPDDLDGLLLLLAADESQFINGSVIAADDG

SEQ ID NO: 4547 - protein, 334 aa, Burkholderia fungorum
LDQIVADAQKAFAEATDVTTLENEKARFLGKSGALTELLKGLGKLDPETRKTEGARINLVKQQVEAALTARRQALAEALLNQRLAAEAIDVTLPGRGTGAGSLHPVMRTWERVEQIFRTIGFDVADGPEIETDWYNFTSLNSPENHPARSMQDTFYVDGKDADGRQLLLRTHTSPMQVRYARTNTPPIKVIVPGRTYRVDSDATHSPMFNQVEGLWIDENISFADLKGVYTDFLEKFFERDDIQVRFRPSYFPFTEPSAEIDMLFETGKNAGKWLEISGSGQVHPTVIRNMGLDPERYIGFAFGSGLERLTMLRYGVQDLRLFFENDLRFLRQF

SEQ ID NO: 4548 - protein, 373 aa, Burkholderia fungorum
TPFFAYDRSAIDIRVRELRNLLPAGMHLHYSIKANPMPAVIHHLAQRVDGFDVASAQEMALALDAGTAPDAIGFAGPGKSHDDLRRAVASGINVHVESETQLRLVTALGWELGVQPSVAIRVNPDFQVGHSGMRMGGGAAPFGVDVDQVPALLRELEAREVALAGFHVFWGSQCLHAATIIKAQRQSADLILRLASGVPRPLRFVNLGGGFGIPYFPGETPLDVKAVCEAMQDWLPPLCERLPGTTPILELGRYLVGEAGIYVCRVIDRKVSRGRTFVVTDGGLHHHLAASGNFGQVLRRNFPVVIGNRPDGVPRERCHVVGCLCTPLDRLADEVELPEAHIGDFVVIMQSGAYGRSASPVRFLSHPEPVEML

SEQ ID NO: 4549 - protein, 581 aa, Burkholderia fungorum
  unsure (1)..(581): unsure at all Xaa locations
DPFINFHTAPRGEPGRTPCCFPADLPAALARWXSATDPEPDRYPAMRNLIDLIQSAARRTPDAESLVCGDVRLTYRQLLQSSRAFGQVLSSLGVAPGGRVAIFLDKRMETVVSMLGACAAGCVFVPVNPLLKPEQVAHVLRDSGARCLVTTALRVRALAAEGVAPVTDLILVDEPDQVTPDQPTAVRVHRWPDCISSPDDALVPAPAVTCIDTDLAALLYTSGSTGLAKGVMLSHRNLLEGAWSVAEYLRLDPSDRVLAVLPLSFDAGLSQLTSAWSAGATAVLLNYLTAHDAVLACEREHITAITGVPPLWMQLTGATWSDAARNTLRYFANTGGRLPLPVLQKLRALFPHATPFLMYGLTEAFRSTFLDPAEVDRRPDSIGKAVPNARVLVVREDGTPCNPDEAGELVHVGACVTLGYWNDAVRTAQRYRPSPEAKPGGAPRDMAVWSGDLVRCDSEGFLYFIARNDAQIKSSGYRISPEEIEETVHSSGLVVEAVALGVPDDELGEAVVLLVVLAGDSDIDELRNWCTQRLPRYMVPRHIASYPDIPRNANGKFDRAALRSTVASSGLASLKRGPEEK

SEQ ID NO: 4550 - protein, 301 aa, Burkholderia fungorum
DASLALALPGPGLAMPPVVALASTQQQARFFQRFQSGAPLWGAFAITEPDYGSDATAMRTRARKTGRGWVLNGTKCFITNGARADCVITFATINSQMGRYGIRAFLVDCNTPGFTVSRIERMAGLRATQLAALSYADCELTDDALLARGDEKPLDDAFSGAQRSWDYFRPLLSAVMVGACRRVRADLVAWLDAGGTPADRHRSVASVEASLLDIDRQIAAAWLLCHCTAWKADRGAATSMDSSMTKAFASRMAARVTRAAMDLAGIDGITAFPSLEQAYRDAKAFDIMEGTGDLQRLMIAR

SEQ ID NO: 4551 - protein, 421 aa, Burkholderia fungorum
NEALLQRKNNATPRGVGVMCPFYADTALNAELWDVEGRRYIDFAAGIAVLNTGHRHPKVMAAVREQLDRFTHTCWQVVPYPSYVELAEQLNRLAPGDFQKKASLFSTGAEAVENAIKIARAFTGRAAVIAFSGSFHGRTMMGMALTGKVAPYKVGFGPFPGEVYHAPYPNTLHGVTTTNALDSVRALFKTDVDPLRVAAIIFEPVQGEGGFYEAPADFVKGLRDICDQHGILLIADEVQTGFARTGKLFAMQHHAVAADLTTVAKSLAGGLPLSGVIGRADVMDAAAPGGLGGTYAGNPLSVAAALAVLDVIESENLCERATQLGNRLKSHLTSMRESLPHIAEIRGPGAMIAAEFFEPGTLIPDADFAKRFQARALELGLILLVCGVHSNVIRFLFPLTIEEAVFEEALVLIETAMKDAA

SEQ ID NO: 4552 - protein, 478 aa, Burkholderia fungorum
LQEPSLFRQECYIAGEWIESDPMARIDVVNPANGLKIGTVPRATLADVRTCIDAAERALPAWSGKTGKERAAILRRWYELMLQHQEDLAVIMTCEQGKPLAESRGEIVYAASFLEWFAEEAKRVYGDTIPTPASDRRIVVLKQPIGVCAAITPWNFPAAMLTRKIGPALAAGCTMVLKPASQTPFSALALCVLAERAGVPAGVLSCVTGKASMIGDEFCRNPAVRKLSFTGSTEIGKLLLQQCASTVKKTSMELGGNAPFIVFDDADLDAAVVGAIAAKFRNAGQTCVCVNRFLVQDTVHDAFVEKLSTAIAALKVGDGLDAGTRIGPLIDSKAVEKAREHVDDAIARGATVVTGGSGHALGGNYFEPTLLTGASKDMKIFREETFGPVAPVFRFRTEEEAIQLANDTEFGLASYFYGRDIGRVWRVAEALEYGMVGINEGLISTEVAPFGGVKESGLGREGSKYGIEDYLEVKYLCM

SEQ ID NO: 4553 - protein, 483 aa, Burkholderia fungorum
QVEVFSMYIDGEFVQAEGGRTLDSINPWSGSVWAKVPDATAADVNRAVEAAHRAFTSGPWPKMTPTERAVLLQKLADKLVEHKERLGYVETQDTGKLLKETTWQAGHTARAYTYFAGLADKLQGDIPPSGASMLNLVLHEPVGVVAAIIPWNSQLQLSAYKIAPALATGNTIVVKASEDASTPLLTLAKLVHEVGFPPGVINFVSGGANPCAITLTSHPLVRRIAFTGGADTARRLIPNSAHNIAKLSLELGGKSPVIVFDDADLDSCVNGIVAGIFGASGQSCAAGSRLLAHESIHDVLVERLVERCKTIRVGDPFDAATNMGPLATARQVDRIETLLASSVEQGARVVSGGKRIGGLPFNQCFEPTIALCDRSDYPIVQEELFGPVLSVLKFRDDDEAVALANDSKYAFAGGIFSRDFARAMRTARVVNAGRLWINTYRVTGVNVPFGGFKQSGYGREAGIDALKDYTETKAVMIEVGGEA

SEQ ID NO: 4554 - protein, 556 aa, Burkholderia fungorum
  unsure (1)..(556): unsure at all Xaa locations
YDYVVVGAGSAGCAVAARLAEDLSVTVALLEAGPHDHHMSVWVPIGLASTVQKAGPRNYAYYTERQPGLDGRPSFQPRGRGLGGSSSINGMVYIRGHRNDYDEWAGMGCTGWGFDDVLPYFRRSECNQRHAGRTDDPWHGGDGPLHVSDLRSPNPFSHRFVNAALQAGLPLNTDFNGAEQEGAGLYQVTQFNGERWNAARAYLHNGNAKDANLNGGRPNLDVLPDTQVLRLVVEDKRARGVRVVRAGIEQTVRARREVVLSCGAFNSPQLLMASGIGPAGHLRSHGIEVIQDLPGVGENLQDHLDVIVNKQVKSNDLYGYSAGGFLRLASGIWRYRRDRSGMVSSNFAEAGAFVKTRPDLAVPDVQLAFVLALLGNRTVAKRSKLGHGYSCHAYILRPQSRGHVRLRSADMRDAPSIDPRFLSAEADMDALVAGVRIVRRIFAQPALAEAGGQELLTDDFGPDDSNEEAIRAFVRSRADSVFHPVGTCKMGIDSMAVVDPSLRVRGIEGLRVADASIMPTLIGGNTNAPAIMIGEKAADLIRADNRXRAAPRAEPA

SEQ ID NO: 4555 - protein, 449 aa, Burkholderia fungorum
FYIGGHWVEPSAGSTQTDIVNPATETLTGHLAMGTAQDADRAIAAARAAFPAWSESSRAERVALLERIIECYRARLDDIAEAVRIEIGAPITLCKHLQAAIGLSQLEAALETLRHFEFETRHDKSYVRREAVGVAALITPWNWPLNQIAAKVAPALAAGCTIVLKPSEIAPLDAVIFAEIMHAAGTPPGVFNMIFGEGRVVGARLSSHPGVDMVSITGSTRAGVEVAVSAAPTVKRVAQELGGKSPLLILDDADLQQAVTSGVMQCMANSGQTCVAPTRMLVPRERYDDAIAIAAAVANGIVVGDPADPATRMGPISNRAQYEKVQHMIRAGIEEGARVIAGGPGRPEGLAQGFYARPTVFADVRNDMMIAREEIFGPVLVMIPYDGEEHAITIANDTQYGLAGYIATRDPERARRVAARLRVGSVRINGAMLDITVPFGGYKTSGNGR

SEQ ID NO: 4556 - protein, 375 aa, Burkholderia fungorum
RTVFRDDHEMLRTTVRRFLERECTPKQAEWDKAGRVDRETWLKAGREGLLCLTLPTEYGGGGGDFGHAAILNEEVNRAGLSGLGFGVHSDVIAPYIARIGNEEQKQKWLPKTCTGESILAIGMTEPGTGSDLKAIRTTALRDGDEYVINGSKTFISNGLNADLIILVCKTDPSAGSKGVSLIVVEATREGFRRGRKLDKVGMHSQDTAELFFDNVRVPVSNRLGEEGKGFAYLMGELPQERLSIAIGAAAKLEACLEHTINYVKDRRAFNQTVWDFQNTKFKLADIKAQATAVRVLVDHYLAEHVRRRLTLEEAAIAKLFATESLGKALDDMVQLHGGYGYMLEYPVARAFADARVNRIYGGTSEVMRDLISRKL

SEQ ID NO: 4557 - protein, 399 aa, Burkholderia fungorum
SISRSSDMTRNVFVAGVGMIPFKKPGTSDPYDVMGAGAVREALIDAGIDYADVQQAYAGYVYGDSTCGQKALYHVGMTGIPIINVNNNCATGSSALFLARQAVQSGAVDCALAVGFEFMQPGALSSKWSDRAPALERALSVVNELVDRTDLPSAIRQFSGAGRAHMEKYGTKLETFAKIRAKASQHAARNPLAVFRTVVTPEEVLASPMIWEGVLTRLMACPPTCGAAAAIVVSEEFARKRGLRTDVLIAAQSLTTDLPSTYDSRDMIRVVGFDMTRAGAKLAYEQAGVGPEDIDVIELHDCFAQNELLTYEGLGLCAEGEAEKLVNDGDNTYGGKWVVNPSGGLLSKGHPLGATGLAQCYELTHQLRGTADQRQVEGAKVALAHNLGLGGACVTTVYK

SEQ ID NO: 4558 - protein, 292 aa, Burkholderia fungorum
PRRRRDRPCNPHQSRRQEMGKLDGKVALVTGSGRGIGRAIAEKLASEGARLVINDLDADPAHETVEALKKMGAEAVACVGNVGAPDFADRFINTAMSTYKGIDIIVNNAGYTWDDVIQKMTDEQWYAIIDCHMTAPFRILRAAYPHVKALHAADKEAGRDVYRKIVNISSTSALNGNAGQMNYSSAKAGVIGMTRALSREWGRFNVNVNCVAFGLIHTRMTTADAHAGATVKIEGRDIRVGLNPELLKTHAQRNPLGRGGTPEEAAGGVYLFCSPESNYITGQTIAVAGNLQ

SEQ ID NO: 4559 - protein, 500 aa, Burkholderia fungorum
LHRSLQQNPDRVAISFKGRTRTFREFADRVARLAAALREIGMTADDRVGMLALNSDRYLEYVMGVWWGGGVLNPVNIRWSAAEIAYSLDDCDTRILIVDDHFADIAREVCALARTAPLLIHAGDGAAPTGMLSFDTLIAAAAPMPDAGRGGADLACIMYTGGTTGFPKGVMQTHLNIWSSCIMRIAESAPLPDTAVLHAAPFFHVAGLGRALVQFIAGEAHVVIPAFDAGAVLKAIGEERVSDTLLVPTMIQAVLNHPDFARTDLTSLKRLTYGASPIPETLLDRLIEALPGIQLAHSYGMTEACPSISANSPSNHDEAGRRSGLYRSIGRGLPGLMVKVVDSDGAEVPRGTVGEIVVRGPNVMAGYWKKPEETAQAVRDGWLHTGDGAYMDAQGYLYIVDRIKDMIVSGGENVYSRRVESVIARHPAVAACAVIGIPHDTWGEAVHAVVVCKPGATLAEEEIREHCRQVIAGYKCPKSVEFRVQLPLSGAGKVLKREIR

SEQ ID NO: 4560 - protein, 496 aa, Burkholderia fungorum
PDKAAAINSTSGEVLTYRELDERSNRFAQCLYAAGLRRGDHIAMVLENNMRCFEVCWAALRSGLMITPVNRYLTAAEAAAIIEDSHAQVVVSSYAMRELAAGLTGMMPTCRLRLMVDGTISGWDSYEALTGRYPATRLADEWLGAMMIYSSGTTGRPKGIIRAQPQGRVTEGSGSARRPQFERYGFDAQTVYLSPAPLYHTAPLGYGIETQFGGGTVVFMEKFEPLEALQAIERYRVTHSQWVPTMLIRLLKLGPAVRNAFDLSSHRVAIHAAAPCPQEVKRQMIDWWGPIIEEYYSSTEGNGVTTLNTEEWLAHPGSVGRALLGVIHICDDDGNELPVGETGTVYFERDQLPFRYHNDPDKTRAAQHPRHPAWTAVGDIGHVDADGYLYLTDRKAFMIISGGVNIYPQAIEDALAVHPDVQDAAVIGVPDAEMGEQVKAIVEPAPGVAPSDALAERLLAYLRTRVARYMVPRSIDFIDAMPRLPTGKLYKRALRE

SEQ ID NO: 4561 - protein, 282 aa, Burkholderia fungorum
RVVVITGAGRGLGREYALEFARQGAKVVVNDLGGKGDGSGAASGPALDVVAEIEALGGEAVANFDDVADWNGAKNMIDTAISAFGGLDVLVNNAGILRDRTLANMSEEDWDSVIRVHMRGTFAPSRHAAAYWRDEAKAGRERVARLINTSSSSGLYCNPGQANYGAAKAGIAAMSVIAARELERYGVTVNAIYPTAMSRLTEDIFAKRRDEFTAGAAPGFDPLDAGNVAPLVAWLGSSASSGITGRVFGVRGGRITVAEGWHAGPRIEKDGRWDVAELGALI

SEQ ID NO: 4562 - protein, 389 aa, Burkholderia fungorum
KVLVAGVGMIQFAKPGASQSYTEMGAEATRRALADAGIAYDLVQQAFAGYVYGDSTCGQTAIYEVGMTGIPIVNVNNNCSTGSTALYLARQAIATGDADCVLALGFEQMQAGALKSHWDDRPVTRARFVPIMHGLTADLAHLPQALRTFGGAGREHMQRYGTRMETFAAVRAKASRHAANNPLALFRKQVTTEDVMNDTVLMPGVMTRLMACPPTCGGAAAILVSEKFAKKHGLRTGVQIVAQSLTTDPPASFDPPSMLNYVGTHMTRSAANKVYEKAGIGPEDIDVCELHDCFAHNEVICYESLGFCPEGGAEKFVSDGDNTYGGKVVVNPSGGLLSKGHPLGATGLAQCYELTHQLRGTADQRQVQGAKLALQHNLGLGGACVVTLY

SEQ ID NO: 4563 - protein, 417 aa, Burkholderia fungorum
LYGGRLAPHPRHAQCVHGSSRPITRSALPTHSIDEERAVEVKRNVYREDHEMLRETARRFFERECLPRQAQWDEAGCVDRETWLKAGREGLLCVTVPEEYGGGGGDFGHSAIVAEELHRAGVSGFSYSVHSDITAPYIVRLGTEEQKRNWLPPICRGEKILAIAMTEPGTGSDLKSIRTTAVRDGDDYVINGSKTFISNGLNCDMVVVVCKTDPSAGAKGVSLIMVETDRAGFRRGRKLEKVGQAAADTAELFFDNVRVPATNLIGNENGGFIHLMEELPQERLIIAVYCAAKLERQLELTLQYVKDRRAFNQTVWDFQNTKFKLADVKAQAVAVRTLVDYYIREHMERKLTLQEAAIAKLFATEAMWKCIDEMVQLHGGYGYMLEYPIARAFADMRVTRIFGGTSEVLRDLISRKL

SEQ ID NO: 4564 - protein, 702 aa, Burkholderia fungorum
DCGAACLAMICRHYSIPMTLGKLRELANVTTQGATLDSLARAGESLGFTARGVQCTFDSLRGFDLPFIVHWEGYHYVVVYGLSKDYVWVADPAVGFRKMTVEDFERGWSGTCLLFTGGPNLLQMSAARSPWIRFVGYLTPYKKILGHLFLATFVIQVLGVIPPLIIQNILDGVIVHQNVSLLHLLIGGLIIANVFSQLMSSIRAYLANFMVRNMDFAMMSQFFKHTLSLPFSFFAKRKTGDIFARFQENQTIRAFLTESTVTTALNLLMVFIYFTIMFVYNVKMTLVLIAFIIPIMALTAIATPKIKGYAREVFTASTESKSFLMEALAGVETIKGMGIERPVRLRWEKKYAKALEVQYRAHAFNILVGLGSQLLNAATTIAILWVGANLVLAREMTIGQLIAFNAFMGSVLGPLMGLVGLWSMLNDAGVAMERLGDVLDIEPEQKPQDLPSRVMLPELQGEISLSGVYFRYGENDSAYVLENISFDIKPGELVAIVGRSGSGKTTLAKLLVGFYTPTEGKMTIDGYDLGVVDKAYYRAQIGYVMQSNLLFSGTIAENIASGDDAPDRRRIEEVAKMADAHAFISKMPLGYEQIVGERGIGLSGGQIQRLCIARALYHDPRLLVFDEATSALDSQSESNILGNMHDILKGRTAVIIAHRLSTIMRADKILVLYEGAIVEQGRHEELIQRGGMYYQLVQKQLS

SEQ ID NO: 4565 - protein, 670 aa, Burkholderia fungorum
RTLFDKLWDSHTIANLPGGADLLQVDRNLMHELTGVEAVRVLEARHLPVSNPELTFATLDHVISTRPGREAGDADWSTTMVDTLREQAAQHAIPLFDIGTEGRQGIVHVIGPELGLSLPGTLIVCADSHTCTHGALGALAFGIGSTELVHVLATQTVRQKKPKTMRIRFKGSVAEGVTAKDMILYVIGALGAGAGTGYAVEFAGEAVEALSMEARLTLCNLTIELGAKFGLVAPDETTFAYLRGRPYAPQGASFEAALEDWRRLPTDDGAHFEREVEIDAAAIAVQVTWGTSPEHVIAIDAAVPDPGNESDPARREALQRALDYMGVHAGQHLDELAVDRVFIGSCTNSRIEDLQAAARIVAGHHVAEGVTAWVVPGSLSVAREAEAQGLAQIFRTAGFEWREPGCSMCVGANGDVVGRGERCVSTSNRNFVGRQGPGARTHLASPAVAAASALAGHIAAAGVVRGSRIMKAFTMVKGPAASLPRNNVDTDLIIRIERISQLVRGQLGPWLFETLRYREGGPEQGEREDFVLNQPAFRHACILLGGVNFGCGSSREMAVWALEEFGIRCVIAPSFGDIFFANCLQNGLLPICLDAASIGTLAAVAADGTPLEVDLRTLQIRADGLEPMPFEFDAARRAVLLEGLDEVDQTLRLADDIDAFRRTDRAKRAW

SEQ ID NO: 4566 - protein, 223 aa, Burkholderia fungorum
LTDVTRIYQGSQGKPPFHALGPVSLELRVGEFFSVVGPSGCGKSTLLDVLAGLNPASGGTVTFEGKPVGAEVPDGVAVVFQEDASFPWLNVFDNAAFAARQAGVAETEVRERVDHALSFMGLKSFARAYPAQLSGGMRQRVCIARAMVVRPRLMLLDEPFGALDQQTRLLMGDETLKLWRDTGATVLLITHSIDEAVLLSDRIGVMSACPGRFIRTIETGWPR

SEQ ID NO: 4567 - protein, 258 aa, Burkholderia fungorum
MAYENILVETRGRVGLVTLNRPKALNALNDALMDELGAALREFDADDAIGAIVVTGSEKAFAAGADVGMMSTYTYMDVYKGDYITRNWETVRSIRKPIIAAVAGFALGGGCELAMMCDIIFAADTAKFGQPEIKLGIMPGAGGTQRLPRAVSKAKAMDLCLTARFMDAAEAERAGLVSRVIPAASLVDEAVAAAATIAEFPLPAVMMVKESVNRAYETTLAEGVHFERRLFHSLFATEDQKEGMAAFVEKRKPVFKHR

SEQ ID NO: 4568 - protein, 400 aa, Burkholderia fungorum
MNDAFICDAIRTPIGRYGGALKDVRADDLGAVPIRALIDRNPGVDWRALDDVIYGCANQAGEDNRNVARMSALLAGLPTEAPGATINRLCGSGMDAVGTAARAIKAGEARLMIAGGVESMTRAPFVMGKATGAFSRQAEIYDTTIGWRFINPLMKRQYGVDSMPETAENVAVEFSVSRADQDMFALASQQKAARAQQDGTLAQEIVGVEIAQKKGDPVRVLLDEHPRETSLESLGKLKGVVRPDGSVTAGNASGVNDGACALLLANQQAADQYGLRRRARVVGMATAGVGPRIMGIGPAPATQKLLKQLGMTLEQFDVIELNEAFASQGLAVLRTLGLRDDDPRVNPNGGAIALGHPLGASGARLITTALYQLERINGRFALCTMCIGVGQGIALVIERL

SEQ ID NO: 4569 - protein, 208 aa, Burkholderia fungorum
AAIIDLDGTMIDTADDFTAGLNGMLAQLDAQETSREEVVGYVGKGSEHLIRSVLAPRFETEHAQDRFDEALAIYQAEYAKINGTHTRLYPDVEAGLIAMRNAGLKLACVTNKPHRFAVELLQQYGLAQYFSVVLGGDSLAKKKPDPLPMLTAAAQLGVEPQATVAIGDSENDALAGRAAGMATLTVPYGYNHGQAIQTIKSDGIVASL

SEQ ID NO: 4570 - protein, 198 aa, Burkholderia fungorum
RFVDGERAAGKTVYPADVFRALRLTSPDEVKVVILGQDPYHGEDRGTPQAHGLAFSVAPNVRTPPSLRNIFKEIAASLGHETPRHGCLDTWAKQGVLLLNTVLTVERDSAASHAKRGWEKCTDTLIHELAMRHDGLVFMLWGAHAQAKRALLGGKSHCVLEAPHPSPLSAHRGFLGCGHFAKANEYLAQHGREPIDWR

SEQ ID NO: 4571 - protein, 410 aa, Burkholderia fungorum
MQLLTIGINHHTAPVALRERVAFPLEQIKPALDTFKSIWLGPSARTAPEAAILSTCNRTELYCATDDQAAREAAIQWLSRYHNLPIGELAPHVYALPQSEAVRHAFRVASGLDSMVLGETQIVGQMKDAVRTASEAGALGTYLNQLFQRTFAVAKEVRSTTEIGAQSVSMAAAAVRLAQRIFDKVANQRVLFIGAGEMIELCATHFAAQQPKELVVANRTAERGTRLAERFNGRAIPLSELPSRMHEFDIIVSCTASTLPIIGLGAVERAVKARRHRPIFMVDLAVPRDIEPEVGQLEDVFLYTVDDLGAIVREGNASRQAAVAQAEAIIETRVQNFMQWLDARSIVPVIRHMHTQADVLRRAEVERAQKMLARGDDPAAVLEALSQALTNKLIHGPTHALNRASSENRD

SEQ ID NO: 4572 - protein, 525 aa, Burkholderia fungorum
SSIQRNIGPFALMLTGLGSIIGSGWLFGAWKAAKIAGPAAICAWVIGAVVILAIALTYAELGAMFPESGGMVRYARYSHGALVGFISAWANWIAIVSVIPIEAEASIQYMSTWPYPWAHALFVDGSLTTHGLLLSAALVIIYFLLNYWGVKLFARANSAITIFKFLIPGATILGLMLTGFHKENFGEVSTFAPYGWSAVLTAVATSGIVFAFNGFQSPINLAGEARNPARSVPFAVIGSILLALVIYVLLQIAYIGAVNPSDVMKGWSHFNFASPFAELAIALNLNWLAILLYVDAFVSPSGTGTTYMATTSRMIYAMERNNTMPKMFGNVHPFYGVPRPAMWFNLLVSFIFLFFFRGWSSLAAVISVATVISYLTGPISLMSLRRAATDLERPLHIPGMKIIAPFAFVCASLILYWAKWPLTGEIILLMVVALPVYFYFQAKSGFAGWGRDLKAAWWLVAYLPVMAILSLIGSKQFGGHDLIPYGWDMLVVIAFSLVFYYWGVNSGYRSEYLDERQEHDEVLEG

SEQ ID NO: 4573 - protein, 380 aa, Burkholderia fungorum
MAKRDYYEVLGVAKNASDDEIKKAYRKLAMKHHPDRNPGNKDAEGHFKEVKEAYEMLSDSQKRAAYDQYGHAGVDPNMGGAGAQGFGGFADAFGDIFGDIFGQAAGGAARGGGGRAGPQVYRGADLRYSMEITLEQAAHGYDTQIRVPSWVSCEVCHGSGAKPGTKPETCPTCSGSGSVRMSQGFFSIQQTCPKCHGTGTYIPDPCGHCHGAGKVKETKTLEVKIPAGIDDGMRIRSAGNGEPGINGGPSGDLYVEIHIKQHSVFERDGDDLHCQMPIPFTTAALGGEIEVPTLAGRASFTVPEGTQSGKTFRLRGKGIKGLRSSIAGDLYVHVQVETPVKLTEPQRDLLKQFEKALVEGGSRHSPQSKSWFDRVKSFFD

SEQ ID NO: 4574 - protein, 651 aa, Burkholderia fungorum
MGKIIGIDLGTTNSCVAIMEGNSVKVIENSEGARTTPSIIAYMEDGEILVGAPAKRQSVTNPKNTLYAVKRLIGRRFEEKEVQKDIGLMPYKIIKADNGDAWVEVRDQKLAPPQISAEVLRKMKKTAEDYLGEPVTEAVITVPAYFNDSQRQATKDAGRIAGLEVKRIINEPTAAALAFGLDKNEKGDRKIAVYDLGGGTFDVSIIEIADVDGEKQFEVLSTNGDTFLGGEDFDQRIIDYIIGEFKKEQGVDLSKDVLALQRLKESAEKAKIELSSSQQTEINLPYITADASGPKHLNLKITRAKLEALVEELIERTIEPCRVAIKDAGVKVGEIDDVILVGGMTRMPKVQEKVKEFFGKDPRRDVNPDEAVAVGAAIQGQVLSGDRKDVLLLDVTPLSLGIETLGGVMTKMINKNTTIPTKHSQVYSTADDNQGAVTIKVFQGEREMAAGNKLLGEFNLEGIPPAPRGTPQIEVSFDIDANGILHVGAKDKATGKENRITIKANSGLSEAEIEKMVKDAEANAEEDHKLRELADARNQGDALVHSTKKALTEYGDKLEAGEKEKIESALKDLEETLKSGSSDKAAIEAKIEVVATASQKMGEKMYADMQAAQGAEAAAAGAAGAGGAGASAGGASQQQDDVVDAEFKEVK

SEQ ID NO: 4575 - protein, 348 aa, Burkholderia fungorum
LPLLPMRFDLERPSQNATSHRVAVLLINLGTPDAPTPRAVRRYLAQFLSDPRVVEIPALLWQIILRLLILPFRGSASAKKYAAVWMPEGSPLRVYTEKQVEGLRHLLQLNDYTVLVDYAMRYGTPGIPAMLNQLKLAGAERVLLMPMYPQYSSSTTATAFDDAFSALKRMRNQPEIRTVRQYADHPAYIAALAAQVHQYWHQHGRPDFAAGDKLVLSFHGVPKRTLDLGDPYHEQCQQTGALLMQALELTPVECRITFQSRFGKAEWLQPYTAPTLKELGAAGVRRADVFCPGFTADCLETIEEIGMEVRDEFLHAGGKDFHRIPCLNASQAWIAALGEIVAQNLQGW

SEQ ID NO: 4576 - protein, 347 aa, Burkholderia fungorum
HNTDDVRIRELKELTPPAHLIREFACDETVSDVIYNSRTSMHRILHGMEDRLIVIIGPCSIHDTKAAMEYAGRLVEQRKRFAGELEIVMRVYFEKPRTTVGWKGLINDPYMDNSFKINEGLRTARELLLRINELGLPAGTEYLDMISPQYIADLISWGAIGARTTESQVHRELASGLSCPVGFKNGTDGNVKIAVDAIKAASQPHHFLSVTKGGHSAIVSTAGNEDCHIILRGGKTPNYDADSVNAACADIGKAGLAARLMIDASHANSSKKHENQIPVCADIGRQIASGDERIVGVMVESNLVAGRQDLQEGCALTYGQSITDACIGWDESVAVLEGLADAVKQRR

SEQ ID NO: 4577 - protein, 408 aa, Burkholderia fungorum
RTTEDVQNVVKLCGQYNVPVIPYGNGSSLEGHLLAVQGGVSIDLSEMNRVLSINAEDLTVTVEPGISRKQLNEALRDTGLFFPIDPGADASIGGMSATRASGTNAVRYGTMRENVLGLTVVLADGRVIKTGTRARKSSAGYDLTRLFVGSEGTLGVITEITVRLYPQPEAVSAAVCTFPSMGDAVRAVIETIQIGVPIARVEFVDSLAIRSINRHSNLTLREAPTLFFEFHGTEAGVKEQAELVQEVAAQNAGEGFEWATRPEDRSRLWNARHNAYFAMLQLKPGCRAVTTDVCVPISRLAECVEETEQDLKASPLPCPIVGHVGDGNFHVAILIDPNKPEELVEAERLNHRIVERALRMDGTCTGEHGVGLHKMGFLLEEHGEVAVDTMRSIKHALDPHNLMNPGKI

SEQ ID NO: 4578 - protein, 471 aa, Burkholderia fungorum
LPTHCLLYREEDTVAYECDGLAAYRRLPLAVALPETESQVQRIVQICHRLDVPIVPRGAGTGLSGGAMPIRHGVVVSLARLRKIVEVDSYARTATVQPGVRNLSISEAAAPYGLYYAPDPSSQIACTIGGNVSENSGGVHCLKYGLTVHNVLRVRAVTMEGEIVEFGSLAPDAPGLDLLAVLIGSEGMFAIVTEVTVKLIPKPQTAQVIMASFDDVVKGGDAVAGIIAAGIIPAGLEMMDKPATRAVEEFVNAGYDLDAAAILLCESDGTPDEVADEIVRMTAVLREHGATRIQISRSENERLRFWSGRKNAFPAAGRISPDYYCMDGTVPRRSIGPLLTRIEAMEKIYNLRCINVFHAGDGNMHPLILFNGNDRDEWHRAEAFGCDILEACVELGGTVTGEHGVGIEKINSMCVQFSPEERDAFHAVKRAFDAPGLLNPDKGIPTRARCAEYGKMHVRGGLLPHPDLPRF

SEQ ID NO: 4579 - protein, 269 aa, Burkholderia fungorum
KIAFIGGGNMAAALIGGLIKRGVAAADLYAIDPNEEARKRNEQQFGIRTGAAADAALAAYDAVVLAVKPQILKSVAEAVAPHLNASQLVVSIVAGIRMGDMSRWLNGHSRIVRVMPNTPALIGMGVTGLVATGSVDEAGRALASQLLGAVGETVWFDDEAKIDAVTAISGSGPAYVFYFIEALQEAARQLGMDEAQGRALAVATFTGAAQLAANSDEPPGVLRERVTSKGGTTAAALASFDASGIKDAIVRGALAANARAREMGDEFGK

SEQ ID NO: 4580 - protein, 475 aa, Burkholderia fungorum
MSEHKLTNAAGAPVADNQNSMTAGARGPVVLQDVWLLEKLAHFDREVIPERRVHAKGSGAFGTLKVTHDISRYTKAKVFAQAGKETPLFMRFSTVAGERGAADAERDVRGFSIKFYTEEGNWDVVGNNTPVFFIRDPLKFPDFIHTQKRDPYTNMRSNVAAWDFWSRHPESLHQVTILMSDRGIPQNFRQMHGFGSHTYSFINANNERFWVKFHFKSMQGVENFTDAEAAQVVAQDRESAQRDLLTNIDQGNFPKWRFAIQVMPEAEAATYRFNPFDITKVWSQKDYPLIDVGTIELNRNAANYFADVEQAAFTPANVVPGIGFSPDRLLQGRLFSYGDTQRYRLGVNHHQIPVNASRVASPHSFHRDGAMRTDGNLGGNVNYEPNRFGDFAQDANASEPPLAAGAVDRYDHRLDDDYYTQPGMLFALFDAAQRERLFGNIARHINGVPQEIVARQIEHFRRADPAYAEGVIAAI

SEQ ID NO: 4581 - protein, 264 aa, Burkholderia fungorum
MNSGRLRDRVALVTGAGCIGPGWGNGRAIAVRFAEEGAHVVAIDRNLASMDETLELIRQAGGKVTPYECDVTDSAAVERLVADIVARSGRIDVLVNNVGAPAPGGPVQLSEAQWGEQLELNLTTTFLMCHHVLPVMEGQAGGSIVNIASTSGIRWTGAAQVGYAAAKAGVIQFARVVAVEYASKNIRANSVVPGLLYTPMVDTTIARNQTGGDLELLLRKRKARIPLPFMGDGRDTANAALFLASDEARFITGTEIVVDGGMSA

SEQ ID NO: 4582 - protein, 154 aa, Burkholderia fungorum
RVVLVAAMAANRVIGLGNDIPWRIPGEQKRFRELTMNQLVVMGRRTFESIGKPLPGRDLLVLSSGTSRLGTVRTVKSFAEVTAAVNNDPREAIFVGGGQQVYAMLMPYADVVYLTEIDLRPPGDAFFPEIPERFSLPDSVDFPGEIRYTFNTYA

SEQ ID NO: 4583 - protein, 441 aa, Burkholderia fungorum
MSVFTSKVVRNLFGTDAMRTIFSDDTRVANYLKIEVALAKVEAGLGVIPQDAWRDIEQKSHSFEIDWERFRIDVEAVGYPVMPFVTQLAEHCGESGEYLHWGSTTRDITDTSFVLQLREALGVLAADLDKVRRKLREMTARHRSTLMIARTHGKHALPSTFGFRCAVWYSEVERQCERLAALRAEPFVGQFGGAIGTLAAVGPRGLEVQSALMAELGLGTAEIAWFASRDRVSEVVFRIASIAQSMASIAKSLVIMTRDELAEASEGGGEQRGTSSAMPHKHNTVVPELVIVHGKMATQQVAIVMESMVQDFERDWQGHFETIAVPQTFQHAHAAVTQMHTVLSGLILHEDRMRANLDVTRGQVMAESVMMALAPKLGRKNAHHAISRLCNQALAEDRPLGEVLRADPQVAQYLGEHELADALDPAGYIGLATQVVDNVLK

SEQ ID NO: 4584 - protein, 378 aa, Burkholderia fungorum
MFELTDAQRQLQQSARRLALEAIAPHAAQTDRSEQYPWHTVEALREQRLMGMTLPPEYGGKGASYFDTVLVIEELSKVCAASGRIMVESNMGAIGAIMKYGSDAQKQLAARLVLAGDKPAICITEPQAGSAASDMQTRAERRGDTWHLSGCKHWITGGGVSKLHFVFARAIEDGKDTGIAGFIVVGPDVPGMTIQRIPAMGIRGVPEARIEFDDMRVRHDMKVTPPGRTEAGFAGLMNAYNAQRVGAATVALGIAQGAFDLALDYAKRREQFGRPIAEFQGLQWMLADMSIQLEAARLMVWKAAASGSEFPSMFAAAQAKIAAGEAAIKVTNDALQIHGAVGYGRDLPLERMVRDARMFTISGGTAQILRTQVAGTLL

SEQ ID NO: 4585 - protein, 469 aa, Burkholderia fungorum
PEALALSDSGTSLNYAQLGSRIEATAGWLHTLGIQAGDRVMLVGENSVALATLILGAHRAGVTVVLENARRAPAETDTVHAHCAAHAMLFVLDRSPDAAAHAKRLGATEAIDAPAGRVAVRLEATARGEPADEASAAAIIYTTGTTGKPKGVMLSSRALSFIGQQMRVLRHVTPRDTVYGVLPITHVMGLASVLFGTLASGAHLHLVSRFSAAECVACIGRLHVSMLQGAPAMFARLVDHCQANGITRIEGVRFIGSGGAPIDPTIKKDAQRLFDTPLHNGYGLTEAASTCWTRFEDDNSDDTVGRPLPGVELRIAAPPGSDIGELWVRGPHVMNGYFRDPLRTSEVLTGDGWFNTQDLARQSADGRIYIVGRTRDIIIRSGFNVYPLEIELALATHPDVLHCAVLGRPVKGNEEIIAFVELTQNACVKPETLLAWLSERLSPYKRPAQIVVMATLPVAANGKVLKSAL

SEQ ID NO: 4586 - protein, 247 aa, Burkholderia fungorum
VVLITGAGSGIGAALARRIAAPRSALMLHARGADHEARERLAHVAADCSANGARCATVYGDLAERGAAEHVIHQTLASFGALDQLVANAGHAQRQTLGGLDPDAFSAAFAAMPAAFAALVKRATPALETSKRGRVIALSSFVAHRYRADAPFAATAAAKAALESLAKTAAAELAPHGVTVNCVAPGYTRKDRGPSADNAAVWTRAAEATPLGHVAEPADIAALIAFLLSDEARHITGQVIHIDGGLT

SEQ ID NO: 4587 - protein, 297 aa, Burkholderia fungorum
AIEIRNVKKRYKDLQALKGVSLTVEEGEFFGLLGPNGAGKTTLISILAGLARADEGSIAVRGHDVVSDFRAARRALGVVPQELVFDPFFTVRETLRIQSGYYGLRNNDAWIDEIMANLDLTDKADANMRALSGGMKRRVLVAQALVHRPPVIVLDEPTAGVDVELRQTLWKFISRLNREGHTIVLTTHYLEEAESLCDRIAMLRRGEVVALERTSTLLQRFAGMQLFLRFSQGVLPADLRVLEVESGTGNGNGRQHLLRLASYDDVEKILAQCRAAGCTFEEIEVRKADLEDVFVQV

SEQ ID NO: 4588 - protein, 433 aa, Burkholderia fungorum
IRKLDSTAPDFQKSLHAVLAFEASEDEAIERSVAQILNDVKARGDAAVLEYTSRFDRVEAKSVDALELPMSELEAALEGLEPKRRAALEAAAARVRGYHEKQKIECGSHSWRYTEADGTVLGQKVTPLDRAGIYVPGGKAAYPSSVLMNAIPARVAGVREIVMVVPTPDGVKNPLVLAAALLGGVDRVFTIGGAQAVGALAYGTATIPAVDKICGPGNAYVASAKRRVFGTVGIDMIAGPSEILVLCDGTTDPRWVAMDLFSQAEHDELAQSILLCPDDAFIGRVKDAIDELLPTMPRRDVISASLEGRGALIKVRDMAEACAIANDIAPEHLEISALEPQQWGQLIRHAGAIFLGRYTSESLGDYCAGPNHVLPTSRTARFSSPLGVYDFFKRSSVIEVSAEGAQTLGEIAAELAYGEGLQAHARSAEYRMR

SEQ ID NO: 4589 - protein, 352 aa, Burkholderia fungorum
MTTPQDIIRRDVLAMTSYPVPDATGYIKLDAMENPFPLPPVLAAHLGEHLAGVALNRYPAPRPDALIEKIKRVMQVPPGCDVLLGNGSDEIISMVSVACAQPGAKVLAPVPGFVMYQMSAKLANLEFVGVPLKADFTLDTEAMLAAIAEHQPAIIYLAYPNNPTGTLFDDADMERIIAAASKSLVVIDEAYQPFAQQSWLPRADAFDNVVVMRTVSKLGLAGIRLGYLVGKPGWLTEFDKVRPPYNTNVLTQAAADFLLDHVDVLDSQAAQLREERTKLAHAIAQLPGAEVFPSAGNFLLVRVPDASVLFETLLAARVLIKNVSKMHPLLANCVRLTVGSPEENAQLLAALK

SEQ ID NO: 4590 - protein, 194 aa, Burkholderia fungorum
RLAEVVRNTSETQIRVKINLDGTGQQKLATGVPFLDHMLDQIARHGLFDLEIEAHGDLHIDDHHTVEDTGITLGQAVAKAIGDKKGIRRYGHSYVPLDEALSRVVIDFSGRPGLEFHVPFTRARIGTFDVDLSIEFFRGFVNHAGVTLHIDNLRGLNAHHQMETVFKAFGRALRMATELDERAAGQIPSTKGSL

SEQ ID NO: 4591 - protein, 257 aa, Burkholderia fungorum
MALAKRIIPCLDVTAGRVVKGVNFVELRDAGDPVEIARRYDDQGADELTFLDITATSDQRDLILPIIEAVASQVFIPLTVGGGVRAVEDVRRLLNAGADKISMNSSAVANPQLVKDATDKYGSQCIVVAIDAKRVSAEGEVPRWEVFTHGGRKATGLDAVEWARKMAELGAGEILLTSMDRDGTKSGFDLALTRAVSDAVPIPVIASGGVGNLQHLADGIKEGHADAVLAASIFHYGEHTVGEAKRFMADQGISVRL

SEQ ID NO: 4592 - protein, 236 aa, Burkholderia fungorum
  unsure (1)..(236): unsure at all Xaa locations
LDKVRWDANGLVPVIAQEASTNDVLMFAWMNREALAKTVETGRAVYFSRSRQRLWFKGEESGHVQHVHEVRLDCDEDVVLLKVEQVSGIACHTGRHSCFFQKFEGSVEDGDWVAVDAVLKDPEQIYKXRNPRKPRRPTPRPPTDTLLRLAAIIDSRKGGDPEVSYVSRLFHKGDDAVLKKIGEEATEVVLAAKDARHGGAPKALVGEVADLWFHCLVMLSHFDLSPADVLAELERR

SEQ ID NO: 4593 - protein, 625 aa, Burkholderia fungorum
QETMSFQAEVKQLLHLMIHSLYSNKEIFLRELISNASDAADKLRFEAIENSALYENDPNLRIRVSYDKDARTITIDDNGIGMSRDEAIANLGTIARSGTKEFFGKLSGDQQKDAALIGQFGVGFYSGFIVADRITVETRRAGLPASEGVRWESAGEGDFAVEQIERAARGTTITLHLRADEDELLSSHRLKSIIQKYSDHVALPILMKKEEWDAEKSAMVTKDEDETVNQASALWTRSKSDITDEQYKQFYQHLSHDHQDPLTWTHNRVEGRSEYTQLLYVPTHAPFDMFNRDHRGGLKLYVKRVFIMDDAEQLLPAYLRFVKGVVDSADLPLNVSREILQESRDVKAIREGVTKRVLSMLEDLANSDNEADKEKYAGFWKEFGQVLKEGIGEDFANRERIAKLLRFASTHTDTPEQTVSLADYVARMKPEQTKIYYVTADTWQAATHSPHLEVFRKKGVEVLLLTDRVDEWILSFLTEFEGKPLQSVARGDLDLGALNDEEKEAQEKVSEEFKPLVEKMKEALKDKAKDVRLTFRLTDSPSCLVADDGEMSGYLQRMLKAAGQQAPSFHPILEVNPEHALVKGLHADSANFDDWCHLLFDQALLAEGGALEDPASFVKRTNALL

SEQ ID NO: 4594 - protein, 311 aa, Burkholderia fungorum
TALDQLKQYTTVVADTGDFQQLAQYKPQDATTNPSLILKAVQKDDYKPLLEKTVKAHASKPVGAIIDQLLIAFGTEILKIIPGRVSTEVDARLSFDTEGSIAKGRELIALYKEHGIGRERVLIKLASTWEGIRAAEVLQKEGIHCNMTLLFSLAQAAACAEAGAQLISPFVGRIYDWYKKNAGSAWDEAKDGGANDPGVKSVRRIYAYYKKFGYKTEVMGASFRTPGQILELAGCDLLTISPDLLQKLHESTEKVERKLSPDIAKESDIERVPVDESSFRFLVNDEAMATEKLAEGIRAFAADAIKLEKLI

SEQ ID NO: 4595 - protein, 399 aa, Burkholderia fungorum
MQIGQRIGTPLSESATRVMLLGAGELGKEVIIALQRLGVEVIAVDRYPNAPGHQVAHRAHVIDMTDRAALRALVEQERPHLIVPEIEAIATDELAAIESAGLAEVIPTARATQLTMNREGIRRLAAEELGLPTSPYAFADSLDELRAGIAKVGYPCVVKPVMSSSGKGQSVLRGDADVEPAWQYAMAGGRVNHGRVIVEGFIDFEYEITQLTVRAINPASGEVSTYFCDPIGHVQVAGDYVESWQPQPMSPLALERSREVAHKVTAALGGRGLFGVELFVRGDDVWFSEVSPRPHDTGLVTLCSQRFSEFELHARAILGLPVDTSLRAPGASAVIYGGLDEAGIAFEGVAAALAVPNADLRLFGKPESFVKRRMGVALATGETTDEARSRAKQAAAAVR

SEQ ID NO: 4596 - protein, 473 aa, Burkholderia fungorum
LQKTYPYYLANVAVAANTDLEVTDKFSGEVATRVAMADAAAIDQAIGHAVDAMPALRAFPPFKRQAVLEHCVKRFRERYDELALALCIEAGKPINDSKGEVTRLIDTFKVAAEEAVRIDGEIVNLEISPRAKGYHGYVKRVPIGPCSFISPFNFPLNLTAHKVAPAIAAGVPFVLKPASRTPVGALIMGEILAETDLPKGAFSILPAHRDGADLFTTDERFKLLSFTGSPAVGWELKKKAGKKKVILELGGNAAAIVDGDQGEKLDYVVDRLAFGAFYQSGQSCIGVQRILVHAKVYDALREKLIARTKSLVMGDPKDEKTFVGPMISESESRRLAGWMESAVQAGAKIVAGGKVEGAMFEATLLEGVQRDTDLYRKEAFGPVAILERFDDFGAALATVNDSDFGLQAGVFTDSLAHAHRAWDELEVGGVVINDVPSFRVDNMPYGGVKDSGLGREGVRYAIEDMTEMRLMVM

SEQ ID NO: 4597 - protein, 465 aa, Burkholderia fungorum
TFDQFGLAPDILKAVKESGYTIPTPIQEQAIPVVLAGRDMMGAAQTGTGKTASFSLPIIQRLLPQASTSASPARHPVRALILTPTRELADQVAANVQAYAKHTALRSAVVFGGVDMNPQSEQLRRGVEILIATPGRLLDHVQQKTANLGQVQILVLDEADRMLDMGFLPDLQRILNLLPKERQTLLFSATFSGEIKKLAATYLRDPQTIEVARSNSTATNVRQIVYEVAEGDKTGAVVQLIRERGLKQVIVFCNSKIGASRLSRSLERDGVIATAIHGDRSQNERMQALDAFKRGEIEALVATDVAARGLDIAELPAVINFDLPFNAEDYVHRIGRTGRAGASGDALSLCSPNERKQLADIEKLIKRPLEVQRLTVEAPVRHHHEERAPRRERSSEGREDRGGRRRSGASSSGSFDRPHHHRAQPVDDFFLKPYEPSPASVRKVEEADAASAAPQKPASKQPLAA

SEQ ID NO: 4598 - protein, 639 aa, Burkholderia fungorum
LDTAITRATDAILAAQKPDGHWVYELEADATIPAEYVLLVHYLGETPNVELEQKIARYLRRIQLPDGGWPLFTDGAPDVSASVKAYFALKMIGDPADAEHMVRAREAILANGGAEAVNVFTRILLALFGVVSWRAVPMMPVEIMLLPMWFPFHLSKVSYWARTVIVPLLVLNAKRPLARNPRRVRIDELFRGAPVNTGPRDRAPHQHAGWFRFFSGVDMLLRAVDGLFPKATRERAVRAAVAFVDERLNGEDGLGAIFPAMANSVMMYDVLGYPADHPNRAIARQSIEKLLVIKDDEAYCQPCLSPVWDTSLVAHALLETGEARAEQAAERGLAWLRPLQILDVRGDWISRRPNVRPGGWAFQYNNDYYPDVDDTAVVVMAMHRSAALTHSEVDREAIARAREWVVGMQSSDGGWGAFEPENTQYYLNNIPFSDHGALLDPPTADVSGRCLSMLAQLGELPQGSEPAQRAFAYMLKEQEPDGSWYGRWGLNYIYGTWTALCSLNAAGMPHDDPRMKRAAKWLLSIQNEDGGWGEGGESYKLDYHGYERAPSTASQTAWALMGLMAAGEVNHEAVARGVAYLQREQREHGLWDETRFTATGFPRVFYLRYHGYRKFFPLWALARFRHLKRHGLTRVAVGM

SEQ ID NO: 4599 - protein, 79 aa, Burkholderia fungorum
YVRVRGTVQGVGFRHATVRQAHALGIKGWVANLDDGSVEAMLQGSANQVDRMLSWLRHGPPAARVTEVSGEERSTEKRY

SEQ ID NO: 4600 - protein, 275 aa, Burkholderia fungorum
MFSGIWLPIVTPLRNGEVDIDALQRLADYYSRTEIAGIVALSTTGEAALLQDAERLTVLQALSDVVRSRLPMLIGVGGSSTRDVLHDIQRYERWDCAGYLVSAPSYICPDQAGVRWHFEQVAGATGRPVVLYNVPHRTGVSIAPDTVARLVECGNIVAIKECVKEHFSPLSALPINVLCGTDEALDDCLHHGGTGGILASAHVCADLLVAFQDLLQAGRDVDARNLFASLLPVLRLLFAAPNPSAIKAMLAFDHSLSDETRMPVSRASAQLVERL

SEQ ID NO: 4601 - protein, 400 aa, Burkholderia fungorum
YVAGGVVGFLVKTGWANMHSAAMFVSASVAGMALGTWLAGVLGDRFGRRFTYQFNLLLFGLASFAAAVVSSMDQLIVARFVMGIGLGAEVVVSYGTLVEYIPPAHRGRWSSGLSLCGNAALFVAALVGYFVIPDLGWRWLFGGVGVAALIIWYMRKAVPESPRWLESQGRFEEADRILDDIEQELAYVGQPGEAAVPAYAVVPDLPRRMLVPRFIIGIMMSVAGNAAFYGLIVWLPTFFFRQGFTVGSSLGYSMVMSAGGPAGALVGMAIADRVRRKRAIIVLSIVAALLGLVYPLCKTPLSVLVTGFLLVSALYAFVAVAWASYLPELFPTRIRLRASAVCNVTGRLAAIAMPFAVVQLYAKFGVFGVVGALGGILLAQAAVIALLGIDTNNVSLEELT

SEQ ID NO: 4602 - protein, 377 aa, Burkholderia fungorum
MPDSFTDEQRMIRDAARDFATQCLAPHAAKWDRDGDIPQNIVSQLGELGLMGMTVPAEWGGTYTDYVAYALAVEEIAAGCAACATMMSVHNSVGCSPILNFGTDEQKSLYLADLASGRAIGAFCLTEPQAGSEAHNLRTRAVLRDGTWVLNGSKQFVTNGRRAAVAIVFAVTDPDAGKRGISAFIVPTHTPGFKVGKPEKKLGIRASDTCPVTLEDCAVPESTLLGRRGEGLKIALSNLEGGRIGIAAQAIGIARAAFDAARSYAAQRIQFGKPIREHQSVANMLADMITRLNAARLLVHHAARLRSAGLPCLSEASQAKLYASEVAEEVCSQAIQIHGGYGYLEDYPVERHYRDARITQIYEGTSEVQRMVIARQL

SEQ ID NO: 4603 - protein, 588 aa, Burkholderia fungorum
  unsure (1)..(588): unsure at all Xaa locations
YRSRGCSAVAWHDDCDRAARARXRQSALRGGLYGRAGDRRVDLHAVDACRVRSSGDLLAVTISRCLREGGNAXGSPSVFLFRSLSGPATKLREXTMNAVTRESSGNIGTARLLIAGEFVESKTTEWRDIVNPATQEVLARVPFATAEEVDAAIRSAHAAFATWKNTPIGARMRIMLKYQALIREHMPRIAKTLSAEQGKTIPDAEGDIFRGLEVVEHAASIGTLQQGEFAENVAGGVDTYTLRQPIGVCVGITPFNFPAMIPLWMFPMAIVCGNTFVLKPSEQDPLSTMQLVELALEAGVPKGVLNVVHGGKDVVDALCTHELVKAISFVGSTAVGTHVYRLGSEHGKRVQSMMGAKNHAVVLPDANREQTLNALAGAGFGAAGQRCMATSVVVLVGAAQQWLPDLVAKAKTLKVNAGNEPNTDIGPVVSRAAKQRILDLIETGVKEGATLALDGRDVKVAGYEQGNFIGPTVFTDVTTDMEIYRQEIFGPVLVVLNAATLDDAIALVNRNPFGNGVGLFTQSGAAARKFQSEIDIGQVGINIPIPVPVPFFSFTGSRGSKLGDLGPYGKQVVQFYTQTKTVTARWFD

SEQ ID NO: 4604 - protein, 175 aa, Burkholderia fungorum
  unsure (1)..(175): unsure at all Xaa locations
RNTMSTEKINLDIHKILTLLPHRYPILLVDRVLELEPHKRIKALKNVSINEPYFMGHFPSRPVMPGVLILEALAQAAALLTFSEEPHDPGNTLYLFVGIDNARFKRVVEPGDQLILNATFERHMRGIWKFRACAEVDNVVAASADLICTVRNTDADARXLARRCTVMRPVSPQAG

SEQ ID NO: 4605 - protein, 329 aa, Burkholderia fungorum
MARKITFSQAINEALSQEMARDETVIVMGEDNAGGAGSPGEQDAWGGVLGVTKGLFHKYPGRVLDTPLSEGGYIGAAVGAAACGMRPVAELMFIDFMGVCFDQIFNQAAKFRYMFGGKAVTPVVIRAMQGAGLRAAAQHSQMLTSLFTHIPGLKVVCPSTPYDAKGLLIQAIRDNDPVIFCEHKLLYSREGDVPEESYAIPFGEANVVRDGDDATIVTYGRMVHYATEAAEKLAKDGIEVEVIDLRTTSPLDEDTILESANRTGRVVVVDEANPRCSMATDISALIAQRAFRSLKAPIEMVTAPHTPTPFAGVLEDMYIPSARQIADAV

SEQ ID NO: 4606 - protein, 323 aa, Burkholderia fungorum
TELSKDELLKAYRMMRTIREFEERLHVEFATGEIPGFVHLYAGEEASAVGTMLHLNDADYVATTHRGHGHCIAKGVDVRGMMAEIYGRKTGVCHGKGGSMHIADLSKGMLGANGIVGAGGPLICGAALAAKYKKSGGVGVCFFGDGASNQGVIFESMNLASVWRLPAIFVAENNGYAEATSSTWSVATDNIADRASGFGMPGVIVDGFDFFAVHEALGEAIERARHGGGPTLVEVKFSRYFGHFEGDAQTYRAPGEVQKLRDEKDCLKRFEERVVRAGMLSADQLRGVDAEVKTLIDTAVTEAKAAPLPTAEDLLSDVYVSYP

SEQ ID NO: 4607 - protein, 559 aa, Burkholderia fungorum
LAMSVAVAVSLVFGSAAAADDYPAVTYERLTAAQSDPGWLTYYRTYNGQAHSPLKQIDTANVKNLKQVWSYKFPADLQQGFEATPIVNGRYLFVTTPKDNVYAFDAATGKQLWKFEPKLGAESFKTACCDVINRGVALYGKNVYVAMLSGDVVALDAQTGALAWRKQMFEPGLGYAFSLAPLALDGALVVGSAGGEYGARGFIAALNPDNGNVLWKRFTVPAAGEKGADTWPNGMQEHGGAPAWLTGTYDAASKTLYWGVGNPGPWLADLRPGDNLYSDSLLALDPKTGDLKWHYQYTKHDTWDYDGVNTPVLATIRYQDKEYDAIIHADRNGFFHAIDRGTGKLIYAKPFVTATSVTGYTADGAPIQDASKYPKAGTTIETCPSFLGGKNWWSISYDPDKHIAVVPALHACMSLSGKSVNYMEGLPYLGEGFEIKPEPGSKGYGELQAINVDTGKKVWSHWSKLPWNGGVATTAGGLAFSGSLDGHLYAFDETTGKVLWQSPKLASGIVAQPSVFEVDGKEYVAILAGYGGANPIWGGPMAKAAEKVPRGGTLYVFAL

SEQ ID NO: 4608 - protein, 493 aa, Burkholderia fungorum
PYARQYGNFIGGEWVPPVRGEYFDNVSPITGEPFTSIPRSTEEDIELALDAAHRARKAWADTAPALRANVLNRIADRMEQNLSRIAFSESIDNGKPIRETLAADIPLAIDHFRYFASCIRAQEGTLSEIDHDTVAYHFHEPLGVVGQIIPWNFPILMAVWKLAPALAAGNCVVLKPAEQTPASILVLIELIQDLLPPGVLNVVNGFGLEAGKPLASSKRIAKIAFTGETSTGRLIMQYASQNIIPVTLELGGKSPNIFFADVVDQDDGYFDKALEGFAMFALNQGEVCTCPSRVLIDEKIYDRFMERALKRVAAIAQGHPLDPRTMIGAQASQEQLEKILSYVDLGKQEGAECLIGGERNTLGGELSKGYYVKPTVFRGNNKMRIFQEEIFGPVVSVTTFRTEEEALEIANDSLYGLGAGVWTRDGTRAYRFGRQIQAGRVWTNCYHAYPAHAAFGGYKQSGIGRETHKMMLDHYQQTKNLLVSYSEQPLGFF

SEQ ID NO: 4609 - protein, 472 aa, Burkholderia fungorum
ARSRILNLHSDSLIPEPVMLHAAQFYIDGGWVEPTSPVWFDIVDPSTETPFEKLALGNAQDVDRAVAAARRAFASWSATSVADRVALLKRIVTIYERRYDEFAELMRREMGAPITFARNGQAARGPAHLNALIDVLERFEFEEQRGSTRIVLEPIGVCGLITPWNWPVNQIVVKIAPALAAGCTMVLKPSEYSPLSALLFADVLDEAGVPAGVFNLVNGDGPGVGSAIASHPDIDMVSFTGSTRAGVLVAQSAAETVKRVAQELGGKSANILLDDVDLDQAVTRGVAACFTNSGQSCSIPTRMLVPRHLMNDAAQIAKRAAQAYRLGPTDDPATQLGPLVNANQFKRVQALIQIGIDEGARLVTGGTGRPDGIDTGYYARPTVFADVTPQMTIAREEIFGPVLSMIPYDSEEQAIDIANGTDYGLAAYVQSADLARARKVGRALRAGGVHLNYPPADFGAPFGGYKRSGNGR

SEQ ID NO: 4610 - protein, 223 aa, Burkholderia fungorum
LVVLRHGQSIWNRANRFTGWSDVGLSVQGVADAQRVGERLREAGFRFDLAVTSALLRATDTLAHVLRTLEQPPPRTVRSWRLNDRHYGMLTGMEKDEAALAYGAERVRQWRRGFDLAPPALDADLHAALVRALHDDAMPHADALPRTESLRDTLRRVLPLWDECVAPALTRGQSVLMVGHGNSLRALFKQLDNIGDDAIASVEVAHAEPLVMKFDATLSVISR

SEQ ID NO: 4611 - protein, 476 aa, Burkholderia fungorum
MKRYQLFIDNEWVDPHSGAWFETDDPFTGEPWAEIPRADPTDADRAVRAAEKALEGPWSTLSASERGMLMYKLGALIERDAEHLATIESRDNGKLFRDVLGQMKYMAKYYYYFGGLADKIQGAVVPIDKPGIFNFIRYEPMGVVLSITPWNSSLPLTTWKMAPALCAGNTIVCKPSEFTSASLFELAKLFVEAGFPRGVFNVVTGFGPEIGASLVSHPGVARIAFTGGDEAGRKIYAAAAQHLKRVSLELGGKSPNIVFDDADLDQAVNGVISGIFSATGQTCVAGSRVLLQESIHDAFVERVAKLTRAAKVGNPLDPASEIGPITTKPQFEKILGYIDIATREGARCVAGGRALSGPGYGAGRFVEPTVFVDVTNDMRIAQEEVFGPVLSIIRFKDEEDAIRIGNDIKFGLAAGVWTNSLHRAMLMSQRLKAGTVWINNYRSSSFTTPFGGFKQSGIGREGGIESVKEFMEAKSV

SEQ ID NO: 4612 - protein, 248 aa, Burkholderia fungorum
LAGKVALVTGAGRGIGAAIAYAFAREGAAVVLAELDIETAQQTAEHIRSQTGARVLAVHTDVTQAASVQHAVSEAERAFGALDVLVNNAGINVFCDPLTMTDDDWRRCFAVDLDGVWNGCRAVLPRMVERGAGSIVNIASTHSFKIIPGCFPYPVAKHGVIGLTRALGIEYAPRNVRVNAIAPGYIETQLTHDWWNEQADPAAAQQATLDLQPMKRIGRPEEVAMTAVFLASDEAPFINATCITVDGG

SEQ ID NO: 4613 - protein, 244 aa, Burkholderia fungorum
SLVDRTVLITGGATGIGASFVEHFAAQGARVAFFDIDTSAGEALADELGDSKHKPLFLPCDLTDIDALQKAIADVKAALGPIQVLVNNAANDKRHTIGEVTRESFDAGIAVNIRHQFFAAQAVMDDMKAANGGSIINLGSISWMLKNGGYPVYVMSKAAVQGLTRGLARDLGQFNIRVNTLVPGWVMTGKQKRLWLDDAGRRSIKEGQCIDAELEPADLARMALFLAADDSRMITAQDLIVDGG

SEQ ID NO: 4614 - protein, 506 aa, Burkholderia fungorum
MNHAEMQFLTTEFPYKKQYANFIGGEWVKPVGGEYFDNVSPITGEAFTSIPRSREADVELALDAAHRAKTAWGKTSAADRANILNRIADRMEANLQRLAVAETIDNGKPLRETTAADIPLAIDHFRYFAGAVRAQEGSLSEIDHDTVAYHFHEPLGVVGQIIPWNFPILMAVWKLAPALAAGNCVVLKPAEQTPASILVLVELIQDLLPPGVLNVVNGFGLEAGKPLASSKRIAKIAFTGETTTGRLIMQYASQNIIPVTLELGGKSPNIFFADVMNEDDSFFDKALEGFAMFALNQGEVCTCPSRVLIDEKIYDRFMERALKRVAAITQGHPLDTKTMIGAQASQEQLEKILSYVDLGKQEGAECLIGGERNALGGELSKGYYVKPTVFRGNNKMRIFQEEIFGPVVSVTTFRNEEEALEIANDTLYGLGAGVWTRDGTRAYRFGRQIQAGRVWTNCYHAYPAHAAFGGYKQSGIGRENHKMMLDHYQQTKNLLVSYSDKPLGFF

SEQ ID NO: 4615 - protein, 454 aa, Burkholderia fungorum
FSQLSLPPATLANLTQLGYVEMTPIQAASLPIALAGHDLIAQAKTGSGKTAAFSLALLARLDVRNFAVQAMVLCPTRELADQVTQEIRRLARAEENIKVLTLCGGTPMRPQTASLEHGAHIVVGTPGRIMDHLERGSLPLQSLNTLVLDEADRMLDMGFFDDIATVVKQCPKERQTLLFSATYPEGIVKLSQQFLRNPKEVKLAERHDNTKIRQRFYEVTEDERLHAVGLLLNHYRPVSTLAFCNTKQQCRDLLDVLRAQGFHALALHGELDQRERDQVLIQFANRSCSVLVATDVAARGLDIAQLEAVINVDVTPDPEVHVHRIGRTGRADQEGWALSLASMNEMGRVGSLEQAQKRDVEWHKLSELTATSNEPLLPPMETLQILGGRKEKIRPGDVLGALTGEAGFAGSQIGKINVTEMSTYVAVERSVAREAVRKLSAGKVKGKKVKVRLM

SEQ ID NO: 4616 - protein, 385 aa, Burkholderia fungorum
LMQSAMQARSKLPDVGTTIFTVIGQLAAQYDALNLSQGAPNFAPDASLIDGVAQAMRAGHNQYAPMAGIAALREALADKVATLYGVHYDPASEVTVIASASEGLYSTISALVHPGDEVIYFEPSFDSYGPIVRLQGATPVAIKLSLNDFRVDWDEVAAAITPKTRMIIINTPHNPTATVFSEADVARLKAITRNTDIVILADEVYEHVVFDGAKHQSMACHAELAERSVIVSSFGKSYHVTGWRVGYCLAPAALMDEIRKVHQFMVFSADTPMQYAFVDALARRESYLGLSAFYQKKRDLLTDALRDSRFELLPSEGSFFMLARFRGFSEESDSDFVLRLIRDARVATIPLSAFYTDGTDSGLIRLSFSKDDATLIEGARRLCQI

SEQ ID NO: 4617 - protein, 530 aa, Burkholderia fungorum
MADRFDFVVVGAGSAGCVLANRLSEGGRYSVCLLEAGPADRFMWIHIPIGYGKTMFHPVYNWGFYTDPDPNMHNRRLYWPRGRTLGGSSSINGLIYVRGQKDDYDHWARLGNRGWGWQDCLPYFRRLEHNELGEGPTRGVDGPLWASTIKQRHELVDAFIAASNSLGVETVEDFNTGDQEGVGYYQLTTRRGFRCSTAVAYLKPARQRRNLRVETDAMASKILFEGTRACGVQYRQHGELREVRADREVILTAGALQSPQLLQLSGVGPAALLREFGIPVVANRAGVGENLQDHLQIRLIYEVTKPITTNDLLRSWTGRARMGLQWALMRGGPLAVGINQGGMFCRALPEESATPDIQFHFSTLSADSAGGNVHDFPGCTYSICQLRPQSRGVVRIRSVDPREAPSIQPNYLDTDLDRRTTIAGVRFARRVAAAEPMAALMKRELRPGAHAQTDDELLDFCREYGQTIFHPSGTAKMGTAGDPLAVVDERLRVYGTQGLRVVDCSIMPTLVSGNTNVPIVMVAEKASDMI

SEQ ID NO: 4618 - protein, 524 aa, Burkholderia fungorum
ASDDDEPAAPDRRATVLTFRELRDDCRVLEARFRQAGLQPGDVVSVFMGNGIQTARLLLAAMYSGLVANPLNLLCQPSQVRYIVDHSDTRMIFAARDTQAVIDTAVAELRDAGLSREIALIGTEPAQAAPPVLTKREPALAEAGARIASGSAAAAAAHAFAMRGARHEEDTAPTHEPAADDVALLMYTSGTTGTPKGVLLTHRNLVANARNISAEHRLTADDRVLASLPLYHINGLVVTLLAPLFHGGSAVMTSRFSARTFWRDVALHACTWINVVPTIVAYLLNADETCTYDLSALKFCRSASAALPADHHRAFEARFGIGVIETMGMTETAAPVFSNPYEMNRRRVGSVGLPSGGEARVIDREGRECAANECGELVLRGEQVMGGYYKRPEETAAAFTADGWLRTGDLGYRDADGYFYINGRAKELIIKGGENIAPREIDEALLRHPDVLDAAAVGVPDPAYGQEIVAFVVPRLSDGRAAPDPADLREHCMRELGRYKTPKEFRFVDELPRGPSGKVQRLKL

SEQ ID NO: 4619 - protein, 402 aa, Burkholderia fungorum
KTRHIILAVMCLMYFISYIDRVNIAVAGPLIRHEMGLTTVQLGLVFSAFAYPYAAMQIIGGWLADKFGPKLVLTVLSLIWGVATLATGFAGSVTMLVLMRFALGVGEGGAFPTATRAFTYWMPVAERGFAQGITHSFARLGGAVTPPLVLAVVATGGWRDAFILLGIASLAWTVLYLFVFTNSPEQNRRITPEETAEIGYRAGDCDRAKHAATPWRKLVRRMWLVTFVDFCYGWLLWVYLTWLPSYLRESRGFDLKQLALFTALPLLAGVVGDTLGGVVSDKLYKITGRLRFARCAVLVVGMGGSLVFLLPMVSATDPLTAVWFLSASFFFLEITNPVLWTLPLDIAGKYAGTAGGMMNTGFGVAGMISPVAFGFLIEKTGSYNVPFNISAGLLAVGIVAAL

SEQ ID NO: 4620 - protein, 675 aa, Burkholderia fungorum
IFQNEVAECGYACLAMVLSHLGRATEVRELSAFRPISANGLSLMDLYDVATEFGLAVQAYRFDVADLPSVKRGSILHFGGAHFVVFEKCGHGYVQVVDPASGRRRVSMDTFVASVSGYLLECSATPAMPRIRAKSQVPGALARVRALNPALRKQLAKVMFVALGSQFAILAMPYLGNLVLDYVVSADNMNLLGVLVLTFAGIFAVGALSQYVETRLVELLHQLTQINMTEGLLGHLLRNPMSWFEKRHVGDVFARIKAQDEISVHATRTVTSMCIDIAVGSLALVLMLVQSRMLTAVAVGMFVVYSCGRAGYVRPHRDNHALVLETSARCDDALIETIRAASLIKLAQGETRRTALFMIKYKEYVSALLASNRLTSARDAILKLVQYADTIAITWFAARLMLAGTVSVGVFYSFLIYKSLMSERFAHAVNGAFAYFMLSVPTARVADIVECEEERYTPLADCNRVTEMRKFERVEVRNVTFRYGVSDQPVLRDVSIDIRHGDKIAITGPSGAGKSTLFKLLSASEPLQEGQIALNGIAWPNLTVDEIRRHAAHMRQGDLILHGSIAENITLFAASIDEDRVHALLEDVGLLQDVMRLPMRTRTVISDTIANISAGQRQRLLLARALYQGRSLLLLDEPTSNLDPASVQHVAALLRRLDCTVVVITHDRSLAAAFD

SEQ ID NO: 4621 - protein, 483 aa, Burkholderia fungorum
IDHLINGKSGAAKDYFETVNPATQEVLAEVARGGAEEVDAAVRAAKDAFPAWAARPAAERAKLVRKLGELIAKNVPEISETETKDTGQTISQTRKQLVPRAADNFSYFAEMCTRVDGHTYPTDTHLNYTLFHPVGVCALISPWNVPFMTATWKVAPCLAFGNTAVLKMSELSPLTAAMLGNLALEAGIPAGVLNVVHGFGKETGEPLVAHPDVHAVSFTGSTATGNRIVQTAGLKKFSMELGGKSPFVIFDDADFERALDAAVFMIFSNNGERCTAGSRILVQRGIYARFAERFIERAKRLSVGDPLSDSTIVGPMISQGHLAKVRSYIELGPKEGATLACGGLDLPELPDALRKGNFVQPTVFVDVDNRMRIAQEEIFGPVACLIPFDDEADAIELANDISYGLSSYIWTENTGRALRVAAAVAAGMCFVNSQNVRDLRQPFGGTKASGVGREGGTWSYEVFLEPKNVCVSLGSHHIPRWGV

SEQ ID NO: 4622 - protein, 479 aa, Burkholderia fungorum
LGHYIGGAPAAPTSGRFKDVFNPATGKVTGSVALASVEEVDAAVQAAKAAFPAWSETAPLKRARILFRFKELLNQHHDELAMLITREHGKVFTDAQGEVVRGIEVVEFACGIPNLLKTDFTDQIGGGIDNWNLRQALGVVAGITPFNFPVMVPMWMFPVALACGNTFVLKPSERDPSASLRIAELLKEAGLPDGVFNVVNGDKVAVDALIDHPDVAALSFVGSTPIAEYIHTEASKRGKRVQALGGAKNHLVVMPDADLDQAVDALIGAAYGSAGERCMAISVAVAVGNVADQLIEKLVPRVKSLVIRNGENLDAEMGPLVTAEHKAKVAGYIASGEAEGAKLIVDGRAHPVASEEGFFIGGTLFDNVGTQMKIYKEEIFGPVLAVVRVPDFASAVELINAHEFGNGVSLFTSDGGVARAFGRQIQVGMVGINVPIPVPMAWHSFGGWKRSLFGDHHAYGEEGVRFYTRYKSIMQRWPD

SEQ ID NO: 4623 - protein, 360 aa, Burkholderia fungorum
EFIAMLGHELRNPMAPIDSAVGAAKQLCADNARAVEVLTIAQRQMRHLRTLVDDLLDAARLRHGKLAIKHSDTSLNEIAFDAVTAVKHHIQSRRHSLTLTGLETPVPVRADHVRLSQVLGNLLSNAAKYTPVGGAIELAVRVAEDGQEPERKEVVVIEVKDNGIGIDNSIQPRVFDLFAQSARGNARAEGRLGIGLAVAKRMVELHDGTISLRSEGTGKGTLVTLKLPILRSGDELQARVETPPSPGLGPVRLLLVDDNVDALQSLGILMELEGHQVTMCDSGREAVRLIRENLPEVAIIDVGMPDMDGFDVAHAVRSDSGLADVMLVALTGYAAESDKSRALAAGFDYHLTKPLSLDKL

SEQ ID NO: 4624 - protein, 257 aa, Burkholderia fungorum
MADHSIKGKVALIAGGAKNLGGLIARDLAAQGARAIAIHYNSAGSRAQADATVEAIRAAGAEAVAFQADLTRAGAVEKLFADAAAAIGKPDIAINTVGKVLKKPFVEISEAEYDEMTAVNSKTAFFFLKEAGKHVNDNGKIVTLVTSLLGAFTPFYAAYAGTKAPVEHYTRAAAREYGTRGISVTAVGPGPMDTPFFYPAEGEDAVAYHKTAAALSSFSRTGLTDIQDVVPFIRHLVSDGWWITGQTILVNGGYTTK

SEQ ID NO: 4625 - protein, 303 aa, Burkholderia fungorum
KGRVVILGIYVTDLTFRAGRMPQIGETIAGSAFAMGPGGKGSNQAVAAARAGADVVFCTRIGNDAFGAIARATWAAEGITARASVIEGVSTGAAHIFVDDNTGMNAIIVASGAAGTMEPADVDAIEADIAAARVFVTQLEQPLEAARRGLEVARRHGVITVFNPAPALPLDDGIFPLCDYITPNETEATALTGVPIANADDARRAADVLLAKGVGTVIVTLGEGGALLHSAAQSILVPAYHCGRVVETAGAGDGFTGGFAAALARGDDAMTALRFGCALAGISVTRPGTAPSMPTLDEVNQVL

SEQ ID NO: 4626 - protein, 477 aa, Burkholderia fungorum
SMEYGPAPEDDQPARAWLAQHEERFGHFIGGAWHAPAAGERFASHAPATGERLADIAQGDAADIDAAVAAARAAQPGWFALGGAGRARHLYALARMVQRHSRLFAVLEALDNGKPIRETRDIDVPLVARHFLHHAGWAQLQESEFADYAPLGVVGQIVPWNFPLLMLAWKIAPAIATGNCVVLKPAEYTPLTALLFAELAHRAGLPAGVLNVVTGDGRTGAALVEHPQVDKIAFTGSTEVGRLIRSATAGSGKSLTLELGGKSPFIVFDDADLDGAVEGVVDAIWFNQGQVCCAGSRLLVQEGVEARFIAKLKRRMATLRVGTSLDKSIDLGAIVDPVQLERIQSLVETGRREGCSVWQSPETTMPSGGCFYPPTLVTGVAPASTLAQEEIFGPVLVTMSFRTPDEAIALANNSRYGLAASVWSETIGRALDVAPRLACGVVWINATNLFDAAVGFGGYRESGYGREGGREGIYEYL

SEQ ID NO: 4627 - protein, 306 aa, Burkholderia fungorum
LPIVDVSGLFSDDIDRRLATARELDRAAREAGFFYVTGHQVSRGQQGALIEQAKRFFAAGHDWKMRYYIGNSSAHRGYVPEGEEVFAGGKRDRKEAFDTGRELPADDPDVIAGTPMLGSNSWPEQPGFREAVGGYYEASFELGRALFRGFSLALGLPEQHFERYLRKPPSQLRLIHYPLDPSAEDRPGIGAHTDYECFTILLPTAPGLEVMNGRGEWIDAPPVGNAFVVNIGDMLEVWTGGTYVATSHRVRKVREERYSFPLFFACDYHTVVAPLPQFATPEAVAKYPPVSAGDHLYAQTAQSFTY

SEQ ID NO: 4628 - protein, 212 aa, Burkholderia fungorum
MSLRLGDIAPDFEQQSSVGPIRFHEWLGDSWGVLFSHPADFTPVCTTELGLTAKLASEFEKRNVKTIALSVDSAESHKEWIKDINETQAANVGFPILADGDRKVSELYDMIHPNANETLTVRSLFVIDPKKKVRLIITYPASTGRNFDEVLRVIDSLQLTDSHSVATPGNWKQGDDVVIVPSLKDEEIIKQKFPKGYKALRPYLRMTPQPNK

SEQ ID NO: 4629 - protein, 396 aa, Burkholderia fungorum
MAEAAQFHWEDPLLLDQQLTEDERMVRDAAAAYAQDKLQPRVLEAFRHEKTDIEIFREMGELGLLGPTIPEQYGGPGLNYVAYGLIAREVERVDSGYRSMMSVQSSLVMVPIHAFGSEAQKQKYLPKLATGEWIGCFGLTEPNHGSDPGSMVTRAKKVDGGYSLSGSKMWITNSPIADVFVVWAKLEENGKDAIRGFILEKGWRGLSAPTIHSKVGLRASITGEIVLDEVFVPEENRFPEVSGLRGPFTCLNSARYGIAWGALGAAEACWHTARQYVLDRKQFGRPLAANQLIQKKLADMQTEITLGLQGVLRLGRMKDEGTAAVEITSIMKRNSCGKALDIARLARDMLGGNGISDEFGVARHLVNLEVVNTYEGTHDIHALILGRAQTGIQAFF

SEQ ID NO: 4630 - protein, 428 aa, Burkholderia fungorum
YQSGFANEFATEALPGALPEGRNSPQRVAYGLYAEQVSGTAFTAPRAHNRRSWLYRIRPAAVHKPFTPLPSERLVANFAEVPPTPPNQLRWDPLPMPAEPTDFIDGWVTMAGNGAAESMSGCAIHLYAANRSMQDRFFYSADGELLIVPQEGRLDIATEMGRLEVEPFEIVVIPRGVRFAVSLPDGAARGYICENFGALLRLPDLGPIGSNGLANPRDFLTPHAAYEDREGDFELVAKLNGNLWRADIGHSPLDVVAWHGNYAPYKYDLRRFNTIGSISFDHPDPSIFLVLQSQSDTPGVDAIDFVIFPPRWLAAEDTFRPPWFHRNVASEFMGLVHGVYDAKAEGFVPGGGSLHNCMSGHGPDADTFEKASHIDTSKPAKVGDTMAFMFETRTLIKPTRFALETAQLQAHYYECWQGLKKHFNPEQR

SEQ ID NO: 4631 - protein, 502 aa, Burkholderia fungorum
LADKAQRIPDRTFLIWQDRRYTYAELETITNRYANGFIAHGIGYGDHVAVMLPNCPEFFWVVWGLSKIGAVAVPINTAAKGELMRYFLDKSDSVCFVVDEEWSERVAAIRSEVPQIRQYFIHGGNGVPSLPDNAESTVHALSELESDDASQPPLDRVAYDDTQLIMFTSGTTGPSKGVQCPHSQGHAVGRALTVDFGYREDDVLYTCLPLFHGNAAYYSCYAALWADAAIALAPRFSATRFWDDIRRTGATQFNTLGAMTNIIWKLPPGPHERETKLRLCMAVPVPKEIYSEFQERFGVVLTSVFAMTENFAMTRFTPSDPAEKAGSAGKPRGECELRIVADDGTDLPAGGVGEIYMLPLKPGSMMKGYYRMPKETAREFDNGWFKTGDRGYLDEDGYLFFMDRKKEAIRRRGENISAYEVELILCRHPAIHEVAAIPVASELSEDDVMVYVVLKPGESMTHADVVHFSAEHMSYFMVPRFVEFIDKLPKTASEKLEKYKLK

SEQ ID NO: 4632 - protein, 661 aa, Burkholderia fungorum
ESILIANRGEIACRIARTSRRLGIRVIAVYSDADRGARHVREADVAVRIGPADATRSYLDADAIIRAALETGASAIHPGYGFLSESTQLVNRCAEHGIAWIGPRGDVIERMGSKIESKRIAADAGVPCVPGYHGDNQKLEHLLEQARAIGAPLLIKASAGGGGKGMRRVDDLDDFAAQLSMAKQEALRAFGDDRVLIEKLILRPRHLEVQLAGDRHGNLVHLFERECSIQRNYQKVFEEAPAPRLAPAVREKLLDAALKLGNAIGYDSLGTVEFVLAEDADTPYFLEMNTRLQVEHPVTEMVTGLDLVELQIRIAAGEPLPMQQDAVAVTGWAVEARINCEDPAHGHRPEFGTVARYSEPALAGVRVDSGIESGSEIAPHYDSMIAKVIGYGATRTQAVERLRAGLGAFEAAGIGTNQSLLCAIADHSLFRAGRLTTGFLAEAFPGGWHDDPADFRYAVCAAVLHRLAARAAPGPDYWHRQSGHRFMAAAGRRAAARMRVALDGDEQPVSVERDGEHWLVKTGDEAALDLQVRALAEDQLLLLPMHGVPRRYTLTADGAHLFVNHVGTRWRVLVVSEVEALARVAAQAGVQGSEVASEMPGAVTAIHVAPGDQVAAGDVLVVMEAMKLIFPLVAPRDGTIAVVRCALNEIVPRGHVLVQLE

SEQ ID NO: 4633 - protein, 376 aa, Burkholderia fungorum
YFSEEHSMLRDVIRRFIAKEVLPFADQWEINGYVPRELLRKMGEQGFLGIRQSEAFGGAAMNVLGTVVLAEELGRSTFGGFAITVLVHTDMASPHLQHAGNPAQLERLMPDLVAGRKIAAVAMTEAGAGSDLASMRTTARLDGDHYVLNGAKMFITNGVHGDIYFVAAKTGGPGRSHGGISMFIVEKGMPGFSVARPLSKQGWLSSDTAELVFDECRVPVQNLLGEENKGFYSLVRNLQNERITLGAQALGEASRAIEITLDYVTQRTAFGQTLWEKQAIRQKMAMLLAKVEAARQLLYNTAWRDAQGQTVVAEVSMIKALCGELVNEVMYACQQFHGGFGYMREAPIERMVRDARVQSIGGGATEVMLEEVAKRM

SEQ ID NO: 4634 - protein, 588 aa, Burkholderia fungorum
YWEWVAKKFRWMRPWESVRDGNFPEFKYFAGGMLNVCDNCVDRYAEDPHYASRPAITWEGEPGDCATLSYAQLRTATARFANGLRSLGVGQGDVVAIYLPNMLESFVAIQACNRIGAIYTVLFAGFSADAAALRLQTSRAKVLVTADASYRRGKQVPLLENARKARRSAPRLEHIVVIDRTGAAPALHDGETGYKELVAAQSDDCPCVPLEANAPAFLIFTSGTESKPKGVVHSVAGFLLGTWANVQWQVGPAKDDVYWCAADVGWLTFPIQAVIGGLAHGASLVCYEGALDTPGKDRFYQIANRHHVTKILIAPTALRMLRALGDEVAKANRIDGLRLITTQGEPLDPETYHWTSNTLGDQLPIVNAYGQTETGSTWTYPVYGVEPLKAGSCGTPVPGHAYRVLLEDGSTAPVGTKGALVLTAPFPTLARTVWDDHQRYLNTYFGRYPGVYNTSDEAVVDSTGQLWVLGRGDDVINVAAHRLSTMEIESVVASQPGIADAAVVGVSDAVKGTVPVAFVTLVAGAPVESTIGQICAAASDAIGTIARLEQVFVCKALPKTRAGKTVRRLLREIVETGEAKSDLTGIED

SEQ ID NO: 4635 - protein, 426 aa, Burkholderia fungorum
VRRVAIIGGNRIPFARSNTAYATASNQDMLTFTLQGLIDRYNLHGERLGEVAAGAVIKHSRDFNLTRESVLSTTLAKETPAYDVQQACGTGLEAAILVANKIALGQIEVGIAGGVDTTSDAPIGVNERMRKILLEANRGRSTGQRVGALSKLRPGMFFKPLLPRNGEPRTGLSMGEHCELMAKRWNISREAQDVLAYDSHRKLTAAYARGFVNDLMTPYRGLAQDNNLRADLTLEKLASLKPVFDRDAGTLTAGNSTPLTDGASAVLLASEDWAARHGLPVLAYLSWSETAAVDFFDRKEGLLMAPVYAVPRMLARAGLTLQDFDLYEIHEAFAAQVLCTLAAWQDDEYCRTQLGLPGAPGAIDRAKLNVNGSSLATGHPFAATGGRIVAGLAKMLAQLDKPAGTARGLISICAAGGQGVVAILER

SEQ ID NO: 4636 - protein, 561 aa, Burkholderia fungorum
DGIWYASYPADVPHDIDVAQYESVVQFFDECIARFRERVAYVSVGANMTYGELGRKASAFAAYLQSLGVKPGERVAIMLPNTFQYPVSLFGVLKAGGVVVNVNPLYTVRELAHQLKDSGAQTIIMFENFAKTVEDALPGTKVQNVIVTGLGDLLADGLNLKGRLLNFMLRHVKKMVPAYNLPKAVPLLEALSIGYSRPLTPVRPTHADIAFLQYTGGTTGVAKGAMLTHKNIIANLLQAKAWSEGQLTGDVETVLTPLPLYHIYSLTVNALIFMGLGGRNILIANPRDMKRVMMIIRHEKFTGMTAVNTLYNAFLENEEFCKRDFSDLKLAMAGGMATQKSVAERFKAVTGKPIIEGYGLTECSPIVSMNPVDLANMRDFEGSIGLPAPSTHVRFRKDDGSWANIGEAGELCVKGPQVMKGYWNRPEETAKVIDGDGWLATGDIGVMDSRGFIRLIDRKKDMILVSGFNVYPNEVEDVIATHPDVREVAAIGVPDAAQGERVKVFIVRRNPSLTAEQVIAHCRKNLTGYKVPKLVEFRDELPQTNVGKILRRALRDEELAK

SEQ ID NO: 4637 - protein, 313 aa, Burkholderia fungorum
RRKLIDIYRTMVLVREVELSLSRLFADSEVPGFIHLSLGQEAVSAGVASVLEVQDTLATTHRGHGHVLARGIDVGGFFKEIMGRVGGLCKGRGGSMHVADLALGVLGANGIVGAGIPIALGSAVAHHVRKTRGVAVAFFGDGAMAEGVLHETMNMAALWKAPLLLVCENNGWSEFSPTERQFAARLEALAGAFGIAYKRVDGDDAVAVSEASGIAAAAARSGAGPFVLECVTHRVRGHYEGDPQKYRDPTELDGLAGKDPLKRMHTHLESAGVSASEIDQIGRAVLTRVEAAIEAARADALPDFDEASRDVYT

SEQ ID NO: 4638 - protein, 309 aa, Burkholderia fungorum
IRYAQAVAQALHDSLRDDESVMVMGEDIAAAGGSFKATRGLLDAFGPQRVRDTPISEASIVSAAVGAALTGMRPVVEIMFMDFITLAMDALVNQASKARFMFGGQGSVPMVLRTPHGGGMNAGPQHSQCLEAWLAHVPGLKVVCPSTPQDAYSLLRAAIADPDPVIVVEHKGLYARKGVVEPVVGRIGEASIVRAGRDLTLVSYGATVAACLDAARTLGAEGVEAEVIDLRSIQPWDKAAVLASLARTHRAVIVHEAVSAFGVGAEIAATLSDEGFDDLDAPVRRVGAPFMPVPFASSLEKGYAVDAEK

SEQ ID NO: 4639 - protein, 424 aa, Burkholderia fungorum
ELLVPKLGLTMTEGTLIEWMISPGDRFDADQGLYVIESDKAANEVSAEGSGVLLEVTAELGMPLSVGSVIGYWDDDPQAATNHAVRAEPSAHAAAASASSPDSNAANAAPSAQTSRPPAAMNGQSGQSGQSGARGISTPLARRLARERGIDLTNLAGSGPRGRIRARDVELAPANSPASAPDVPLPATASRAAQVAQAATVRAATSIEKTIARRLVTSKQTIPHFYLSVEAEISAVQRLRSQLNDAQSNRRFTVNHFVVAAVGRALALVPEANRVWDDSGITSFAATDVGVAVHTERGLLVPVLRDVGRQALGEVARHASEAIGRAQAGQLNAAEMAGGAITVSNAGMHDVTLMTSIINPGQSMILGVGSVRQVFRPDAHGQPALKNEVGLVLSVDHRVLDGVTALKFLRQVVAAIERPASLLV

SEQ ID NO: 4640 - protein, 463 aa, Burkholderia fungorum
DHYDVIVIGGGPGGYVAALRAAQLGRRTALCERDQLGGICLNWGCIPTKALLHTADTLRTVRKAAHLGIGIDDPVVDFTRVMARSREVAQKLNRGVSHLLRKAGVTVLAGTAAFAADRSVRVHGADGALRTLQARHTIVATGAAARQLPALPWDGERIWTYREALAATAVPKSLLVVGAGAIGMEFAGFYAAMGTEVTVVEVAPRILPASDADVSEFVARACERDGIRLRTGCSVVHSAAHAEGVRVMFRSENAEEQREFERVLVAVGLDGNTEGLGLEHTRVAFERGLIIADAAGATSDPVVHAVGDVTGAPMLAHKASHQAIACVERIAEVNRGERHASPKIPGCVYSHPQTASVGLTEDEARRTGRALRVGRFPLDANGKAIALGDPSGFVKTIFDAASGELLGAHIVGPEAPELIHGFTLAATLEATESELIETVFPHPTLSEAMHESVLAAFGRPLHI

SEQ ID NO: 4641 - protein, 390 aa, Burkholderia fungorum
MDFRFDESQRMMIDTARQIGQRFGLEYWRKQDAARSFPAEYWRTVCEAGLCGVALPEEYGGSGLGMMEMSLIVENLAATGGGSTVGQLFMINPIFGGVSIARFGPEAMRKELLPGIISGEINCCMALTEPDAGTNTLEIRTFASADGDGWRLNGRKIWITGVQSANKMLIVARTKKVADSTSRTDGLSMFMIDVQREGLSFTPIDKLGTCTLDSSSVFFDDVAIEPTELIGTLHQGWRELLDVLNTERIVTTAGLVGTGELAIQLAVDYANDRKVFGNTPISAYQGLQFPLAQCHVEVQAARLLNYKAATQFDMGLPYGSEANAAKLLAAQAVSRATERAMQTMGGMGYSKEFHVERLWRDCRLFRFAPVSEEMILNYVANHDLKMPRSY

SEQ ID NO: 4642 - protein, 484 aa, Burkholderia fungorum
RTNPSRTALMYGNQSISYGDLQRRVEATAGMLKGTRIRRGDIVALLMKNSAAFVEIMLAVSQAGAVILPINYRLGPDEVAYILQHSGAKLLFHDEEFEVPPGLVHSQAVTGAAQSDTSVLAAGHEPCTEAYPSRPDDLYRLMYTSGTTDRPKGVMHSYGNVAWKSFDHIAALGITKDDRLLVVGPLYHVGACDLPGLAVLAQGGMLRIMRDFDAQAVLEAIERERLTGAWLAPVMLSRILALPERYRFDLGSLRWVVGGGERTPEQRIREFGSLFTGARYIDAYGLTESCSGDTLMEQGRELDKIGSTGRALAHVQLAIMSDDGRMLAPGMQGEICVRGPKVTQGYWKDPEKTARSFVDGWFRTGDVGYMDEEGFLYLTDRKKDMIISGGENIASSEVERVIYQLAEVAEAAVIGAPDPRWGEQVTAVVVLRAGATLTLDALRTHCEGRLGGFKTPRQLILRDALPRNPSGKVLKRVLRDELLK

SEQ ID NO: 4643 - protein, 234 aa, Burkholderia fungorum
AVVTGAGSGIGRACAELLSRSGANVIVADRDIEAATRVARATGGKTLVLDVGEDASVTAAANEVRARYGVADVLVNCAGVLQRTLPPGELAQREWDVVSRIDLRGTYLCCAAFGAPMADRRRGSIVNIASVAGMRSGPLHAYGPAKAGVISLTETLAGEWGPKGVRVNCVSPGFTQTPALERGFTTHTLKADVLRDAAALGHIVSANEIAEAVVFLASERASAITGVNLPVDAG

SEQ ID NO: 4644 - protein, 469 aa, Burkholderia fungorum
  unsure (1)..(469): unsure at all Xaa locations
MSRLVVVSNRTVDPRKTAAGGLAVAVRESLQRTGGLWFGWSGKIYDESDEMTSRRGVHVQTLGNVTLATVDLSQQDHDNYYLGYANGVLWPVFHYRLDLADFDTRFAAGYRRVNQLFAEKLLPLLRPDDIIWVHDYHLIPLAAELRAIGCGNRIGFFLHIPMPPPMIMAAIPEHEWLMRSLFAYDLVGFQGQIDVEHFTHYAESEANARQVGPQQLRAFNRTLRLGAYPIGIDVEEFVSLANGKEAREMFTRMRDEYSRRRLLLGVDRLDYSKGLPQRIHAFRELLAHYPENRDSATLIQIASPSRESVAAYDDLRRQMDSLCGAINGDYGELDWMPVRYIHRHVARKRLPGLYRASKVALVTPLRDGMNLVAKEFIAAQDPSDPGMLVLSRFAGAAEQLKEALLVNPYDTQGTAHAIQRALTMPLDERRNRHAALMKRIREHDVHWWSSSFLDTLQDIPXAKKIRKAD

SEQ ID NO: 4645 - protein, 380 aa, Burkholderia fungorum
MTEERRLIQASARQFAREVVLPLANRLDPLKEDIPMSLRERMAGLGYFGILIPEEYGGLGLGVSEYCLITEELSRAWMSVGSIIRNLGLMVVQGMTDGQRQRWLPRMACGEFLGALAMSEPNAGSDVAALTTRAIPDGDGWRITGSKCWCTFADGADYIVVIARTARVTDVARRHQGLSAFLIEKPRGALPAGVIGSPMPKIGYYGWKTWELSFDDVYVGPETLIGEPGRAFYYVAHGLETARAHTAARSIGLAQGALEDALDYATQRVQFGHPIGDFQALRFRLADMATRVETARQLLRSVCEQIDSGVRCEKEAAMAKYYAAEISETVTSDALQIHGGAGYTTHFAVERYWRDARLTKIFEGTSEIQLRIISDHLLGK

SEQ ID NO: 4646 - protein, 245 aa, Burkholderia fungorum
KFALVTGGARGLGLEIAQQLATLGAHVIIGARDTAKAEAVATELRNLGHAVSALKLDVTSDEDRQAAYAEIDRAHGRLDILINNAGILLDSPDGGTPATRQPSEALPNVVRDTFEANFFAPVFLTQTLLPLIRRSSAGRIVNVSSIRGSLAHLSDPCSPVYPIRALGYDTSKAALNAFTILIAAELRDTPIKINAVHPGWLRTSMGGERANMSAEDGAHAVVKYASLGEDGPTGGFFFLDERLPW

SEQ ID NO: 4647 - protein, 245 aa, Burkholderia fungorum
LAGKVALVTGGSRGLGAATAAALADQGADIAISYVASGEKALAVIESIKAKGVRAIAIKADQGDPAAAEPMVREVLSKLGKLDILVNNAAVALQGKTIDDPAIDNAAMDRQWAINTFGVIANIRAAAKVLPEGGRIISIGSGLGTRIAFPGTADYAATKAAVVGYSKGAARDLGGRNITVNVVQAGMMDTDMAAGSKGKLPPIIMESHAIHRFAELSEVAAAVVFLAGPDAGFITGSVIDVNGGF

SEQ ID NO: 4648 - protein, 241 aa, Burkholderia fungorum
KVVVLTGAGGGIASAIVDRFARSGSRIVLLELRTSSLADAEQRLAAAGIESVSIECDVADESSVKNAAGRTVEHFGRCDVLINNAATLAPATSIEKLLVADWDRTLAINLRGVFLTTKYLGALMLNQGSGSIVNIASIAATAPNASPQYGASKAAVLAFTRHTAVEWGPRGIRANAVSPGFIRTPLSESNYAEPEMLARRSNMVPSRRLGLPGDIAEAVAFLAGDGASFINGQELAVDGGF

SEQ ID NO: 4649 - protein, 450 aa, Burkholderia fungorum
  unsure (1)..(450): unsure at all Xaa locations
DWIARSLRAVWHPCTQMKHHERLPLVPVARGQGAWLYDRAGHRYLDAISSWWVNLFGHANPRINAALKDQLDTLEHAMLAGCTHEPAIELAERLSALTGNTLGHAFFASDGASAVEIALKMSFHSWRNRGFADKQEFVCIANSYHGETIGALGVTDVALFKDAYDPLIRHAHVVASPDARLAQAGETAADVARRALDHVRSLFEARATKIAALIVEPLVQCAAGMAMHDASYIAGLRTLCDQYGVHLIADEIAVGCGRTGTFFACEQAGIWPDFICLSKGISGGYLPLSIVLSRDEIFEAFYHDDTARGFLHSHSYTGNPLACRAALATLDLFAADNVIAVNAQKSAKLKAALAPLAEHEQVRNLRQCGTIFAFDALIDDAQQARTFSRRFFENALRRELLLRPIGTTVYLMPPYILDDEELALLASRTRETFDATLAETRXCICSTHSP

SEQ ID NO: 4650 - protein, 371 aa, Burkholderia fungorum
ARGLRRRRRTADTPCAAHMTVDGRAIIGFASNDYLGLAAHPQLIAAIAEGAQRYGAGSGGSHLLGGHSRAHAQLEDDLAEFVGGFVENARALYFSTGYMANLATLTALAGRGTTLFSDALNHASLIDGARLSRADVQIYPHCDTDALSAMLEASDADVKVIVSDTVFSMDGDIAPLPRLLELAEQHGAWLIVDDAHGFGVLGPQGRGAIAQAALRSPNLISIGTLGKAAGVSGAFVAAHETVIEWLVQRARPYIFTTASVPAAAHAVSASLRIIGGEEGDARRAHLQQLIGRTRAMLKATPWLPVDSHTAVQPLIIGANDATLEIAATLDRAGLWVPAIRPPTVPTGTSRLRISLSAAHSQADLDRLEAGL

SEQ ID NO: 4651 - protein, 297 aa, Burkholderia fungorum
SEFPLFVSAGDILTDLVRTGPSQWLSRPGGAGWNVARCVARLGLPTACAGSLGVDNFSDELWNASVAAGLDMRFMQRVERPPLLAIVHQTHPPAYFFMGENGADLAFDPARLPAGWASHVKWAHFGCISLVRQPLGNTLAALAAQLRSQGVKISFDPNYRNLMEHGYEPTLRKMAALADLIKVSDEDLRLLFKTDDEASALAQLRAMNPAATVLVTRGPETAVLIDGAVVTEARPPRVEVVDTVGAGDASIGGLLFSLMTAPQRAWPEHLAFALAAGAAACRHAGAHAPSLDEVVAL

SEQ ID NO: 4652 - protein, 480 aa, Burkholderia fungorum
LIRTDNFINGQWIAAASGRRFAVTDPATGNLIADVADSGPADARAATDAAAKALPAWRALLASERAAILHRWHALIVANRDALGALISLEQGKPLTEGRGEVGYGASYVAWFADEATRIYGDLIPQQQRGKRMSAVKEPIGVVAAITPWNFPLAMIARKIAPALAAGCTVVAKPAEDTPLTAIALVMLAHEAGVPDGVLNLISASRAAAAETVGDWLADSRVRKITFTGSTPVGKHLARESAGTLKKLSLELGGNAPFIVFDDADLDAAVNGLLAAKFRNGGQTCVCPNRVYVQHGVYEHFAALLRARVAELRVGPASDPTSQIGPMINVRAVDKIARHVDDAVEHGAVVLTGGRRLTELGPHYYAPTVLGNASASMALCGEETFGPVVPLFPFDTEQDAVQAANDTPFGLASYFYSENMRRIERVSRALEAGIVGINEGALASEAAPFGGVKESGYGREGSKYGLDDYLSIKYLCQGGL

SEQ ID NO: 4653 - protein, 356 aa, Burkholderia fungorum
YRIAVIPGDGIGNEVMPEGLRVLDAACRRFDIGIEYRQIGWASCDYYAQHGQMMPDNWKEQLQDCDAILFGAVGWPEKVPDHISLWGSLLKFRREFDQYVNLRPARLFEGVPCPLANRKPGDIDFMIVRENTEGEYSSVGGTMFEGTEREVVMQQSIFTRHGTERVMKFAFDLAQRRAKKITVATKSNGIAISMPWWDARADEMAARYPDVKMDRQHIDILCARVVLNPDRFDVVVASNLFGDILSDLGPACTGTIGIAPSGNLNPDRRFPSLFEPVHGSAPDIAGKGIANPVATIWSTAMMLEFLGNGARVERDAHDAIVAAITEVLKDGPHTGDLGGRASTTEVGAAIAARVAQ

SEQ ID NO: 4654 - protein, 471 aa, Burkholderia fungorum
FIGGAYYSTGEAQIAVHRPSDGALLGHVPDATDATVDHAVSNALAAWKTSGWGTRSPRERAKVLRRWADLIDRDAVSLAQLETVSSTRPVAESYASDVPFTAEAIRFFAELADKLGGDIAATRRDSLGFVASEPYGVIGAITPWNFPLSMCSWKCGPALAAGNAVVLKPSEMTPFSTLRLAELAIEAGMPPGIFNVVNGRGATTGAALTRHPGISKMSFTGSTRTGAAIMSDAAMHGTKPVTLELGGKSPQLVFEHVRDLDFTAGCIARGFTANGGQACVAGTRLIVHKRIAEPLVGAIQRQLQSIKPGPLWDSRTTYSPIISPAQARRIETLIDQSRDSGAEVIFGGGFFDGTDEGFFHRPTLLANVTDATPAVREELFGPVLTVQTFDDEDEGIALAGHPIYGLAAGIHSSDIGQALRAMRRIAAGTIWINRYGRSGDMIIPTGGFGQSGIGKDLGREAMVASMRHKSV

SEQ ID NO: 4655 - protein, 459 aa, Burkholderia fungorum
MSKTSLIAADRKHLIHPVINYRAHEARGATVLESGQGAYLRDIDGNELLDAFSGLWCVNVGYGQQSIVEAATRQMTKLPYATTYFHFSSEPAIELADKLVALAPASLQHVYFTLGGSDAVDSAIRFITHYFNATGRPSKKQMIALERGYHGSSSVGAGLTALPAFHRNFDLPLPHQHHLPSPYAYRQTHGDDAQALIAASVAALEAKVAALGTDNVAAFFCEPIQGSGGVIVPPVGWLKAMRDACRRLDILFVADEVITGFGRTGPLFACEAEQVEPDLMTVAKGLTSGYAPMGAVLMSDEIYQGIAGDARDTAIVGHGQTYSAHPVSAAIGLEVLRLYQEGGLLANGQAQAPRFAAGLDALLGHPLVGDSRHRGLLGALELVADKDSRARFDPALKLPDRIAAAAYRNRLVFRAFGDSILGFAPALCFGEAEFEQMFGRLKRTLDEVLDETEVRAALR

SEQ ID NO: 4656 - protein, 262 aa, Burkholderia fungorum
MKERLASKVAVITGAAQGIGASVARSFAQNGCFVYVTDINDELGRTVATSIGDCAAYLPLDVREEGDWQRVTTHVLEKHGRLDVLVNNAGITGFEARVVPHDPEHASLEEWRAVHRTNLDGVFLGCKYAIRAMRRHGQGSIINISSRSGLVGIPGAAAYASSKAAVRNHTKTVALYCAGQNLEVRCNSIHPAAILTPIWEPMLGTDAGREERMAALVRDTPLRRFGTPEEVAALALLLASDEATYITGSEFNIDGGLLAGSA

SEQ ID NO: 4657 - protein, 331 aa, Burkholderia fungorum
YPLVRAQLFRMDAEDAHHLTLRILGAAGRTGLAGALAPRVPDAPRTVMGLTFRNPVGLAAGLDKDGACIDGLAALGFGFIEVGTVTPRAQPGNPRPRMFRLPQANAVINRMGFNNAGVDQFVKNVQAARYRGILGLNIGKNADTPIERAAEDYLYCLDRVYPFASYVTVNISSPNTKNLRQLQGAGELDALLAALKDKQQRLADMHGKLVPLALKIAPDLDDEQIKSIADTLLRHRFEGVIATNTTLSRTAVAGMQYGDEAGGLSGKPVFDASNAVIRKLRAEVGETVPIIGVGGIFSGEDARAKMAAGASLVQLYTGFIYRGPALVAECV

SEQ ID NO: 4658 - protein, 633 aa, Burkholderia fungorum
ASIDGMEAYRALVAEASQDHEAFWARLAREHLTWRRPFTKVLNDADAPFYRWFEDGELNASYNCLDRNLANGLAEKTAIVFESDDGNVTHVTYQALYHRVCRLANALRARGVKKGDRVAIYMPMSVEGVVAMLACARIGAPHSVVFGGFSAKSLHERIVDIGACAIITADEQVRGGKTLPLKTIVDEALAMAGTAGIRTVAIYRRTGGQIPWIAGRDTWLHELEAAQPDTCEPEWVGAEHPLFVLYTSGSTGTPKGVQHSTGGYLLWAAVTMKWTFDIKPADVFWCTADIGWITGHTYICYGPTAVGATQVIFEGVPTYPNAGRFWDMIQRHKVSIFYTAPTAIRSLIKSADADHSVHPDSFDLSSLRLLGTVGEPINPSAWTWYAQHVGGGRCPVLDTFWQTETGGHMISPLPGVTPLVPGSCTLPLPGIDAAIVDETGQEVPNGNGGVLVIRKPWPSMIRTIWGNPERFRQGYFPEELGGKLYLAGDGAIRDRDTGYFTITGRIDDVLNVSGHRLGTMEIESALAAHPLVAEAAVVGRPDETAGEAIVAFVVLKAERPSGADAKRVADELRAWVGKEIGPIAKPKDIRFGDAMPKTRSGKVVRRLLRSVAKGEVIVQDTSTVENPAVISQF

SEQ ID NO: 4659 - protein, 340 aa, Burkholderia fungorum
MAQLMKAAVVHEFGAPLRIEEVPVPQVGRGQILVNIKASGVCHTDLHAADGDWPVKPTLPFIPGHEGVGYVAAVGEGVKHVKEGDRVGVPWLYTACGHCEHCLGGWETLCQEQQNTGYSVNGAYAEYVVADPNFVGHLPAAVSFEDIAPILCAGVTVYKGIRMTDARPGQWITISGIGGLGHVAVQYAIAMGLRVVAVDISEDKLALARELGATLAFNASECDPAAAIQKEIGGTHGVLVTAVSRSAFAQALGMVRRGGTVALNGLPPGDFPLPIFSTVLNGITVRGSIVGTRQDLQESLEFAAQGRVRARIHLDRLDNINHVLAELKSGKVDGRIVLNL

SEQ ID NO: 4660 - protein, 332 aa, Burkholderia fungorum
MAFNLRNRSLLNMQDFAPRDIRFLLDLASELKRAKYAGNEVPRLNGKNVALIFEKTSTRTRCAFEVAVHDQGGHVTYIDSASSQLGRKESLKDTARVLGRLYDGIEYRGFHQSVVEDLATYSHVPVWNGLTDEFHPTQVLADLLTMQEFGEKPLHELSFCYLGDARFNMGNSLLIGGVQMGMDVRIAAPRELWPHDELVAQMRLLAERTGASVTIVEDPHEAVSGVDFVYTDVWVSMGEPVEAWGPRIDLLRPYQVNAALMKATGNPRTRFMHCLPAYHNLDTDTGRMVHEHFGMSELEVSDEVFESDASIVFSQAENRMHTIKAVLVATLA

SEQ ID NO: 4661 - protein, 403 aa, Burkholderia fungorum
FGVYSEIGTLRKVMVCRPGLAQARLTPANCRDLLFDDVLWVSQAKNDHYAFVSTMQEHGVDVLEMHDLLADILQGREARDWVLEHKLAPGTVDAELAAQLRPWLQEMEPGELATRLIGGIVRAELPFEADGLLAQCTPPSGFILPPLPNTLFTRDSSCWINDGVVLGSMYWPARRQETLLATAIYRFHPLFSSGTRVWWGGPETDHGGATLEGGDVMPLSRDVVLIGMGERSSPQGVAQLARALFAGESVKQVIAAQLPRSRGAMHLDTVFTFCDRDLVTIFPEVVDAIRCTSLRPGKQPGQLDVRAESAPFLDVVAQALGIGTLRTVATGGDTWESEREQWDDGNNVIALAPGIVVAYNRNVYTNTLLRKAGVEVITIPSGELGRGRGGGHCMTCPIERAPL

SEQ ID NO: 4662 - protein, 459 aa, Burkholderia fungorum
DAWLAAQRKVLARTAPAPYADTLGRVERIGDGIAFVSGLADAALDELLRFESGASGFVHTLEADLMSVVLLDDGATVEAGARVTRTGAVIEVPVGEGLLGRVIDPLGRPLDRDEPVATVKRMPIERPAPAIIDRDLVSEPVETGVLIVDALFAVGRGQRELIIGDRATGKTALALDAIVNQKHSDMICIYVAIGQRSTAVQQVIESVRRYGAPERCVFVVAPAASAAGLQWIAPFAGVTIAEYFRDRGQHALVVIDDLTKHAATHRELALLTREPPGREAYPGDIFYVHARLLERAAKLSAKLGGGSLTALPIAETDAGNLSAYIPTNLISITDGQIVLDAALFAANQRPAVDVGLSVSRVGGKAQHPALREVSGRLRLDYAQFLELEMFSRFGGLTDAHVAGKIARGERIRALIAQPRFRPLRTVDEIALLAALAEGVFDAAPPAIATEARAQLAEQL

SEQ ID NO: 4663 - protein, 810 aa, Burkholderia fungorum
SDQAKEILQRAAERAVQFGRHEVDTEHVLYELVESEAVQRILSALKISASDLQKHIEANAPKGHATSKAPQGEISVSPRLKSALERAVIASREFGQNYVGPEHILTGLAEVTDSFAGDLLMKYGLSSHQLRQQTLKQAGQEEAAQAPSNTPQLDKYSRDVTRLAREGKLDPVIGRSKETETLVEVLARRKKNNPVLIGEPGVGKTAIVEGLAQRMISGDVPETLREKRLIELNVNSLVAGSKYRGEFEERVRQVMDEIAAHKDQLVLFVDEVHTIVGAGQGGGEGGLDIANVFKPPMARGELNLIGATTLAEYQKYIEKDAALERRFQPVLVGEPSVEQTIGILRGLRDRLEAHHKVTILDEACVAAAELSDRYVTGRFLPDKAVDLIDQAAAREHLSSTSRPAEVLELESEIAQIRREQEYAASHKQFERATALGEQLSGKQTRLDDATQAWKRRVSTSTAEVTRTLVAEIVAKMTGIPVADLTQEEKTRLLQMEDRLHRRVIGQEEAISAVSDAVRRSRAGLQARHQPLAVFLFLGPTGVGKTELAKALAEVVFGDEDAIVRIDMSEYMERHAVARLIGAPPGYVGYDEGGQLTERVRRRPHSVILLDEIEKAHPDVYNVLLQVFDDGRLTDGKGRVIDFANTLIIATSNLASDVIMGTPRKRPGFIAADNDLAADKGARKDRQPDGVREGVMTVLRSHFRPEFLNRIDEIIIFESLNADQIRSIVRLQLDKVAHIAKSQDIDIVFDDSIVDQLAKEAYRPEYGARELRRRIRQVIENPLAKQMLDGAVREGNRVVCRFDPLADDTVF

SEQ ID NO: 4664 - protein, 609 aa, Burkholderia fungorum
LVARQLDNLEIGSDQITGSVRMPGAAPLLPASAASGLAANGEPWRFLTVRVSDDHLIEDLANSGVRYTGVADRIGLAAVLGWIVPILMLAAVWSVFMRRGGGGLRDFSGIGKSRPRVYVAQDTDVTFDDIAGIDEAKAELKQIVEFLRNAERYRRLGGKIPKGVLIVGAPGTGKTLLAKAVAGEAGVPFFSISGSAFVEMFVGVGAARVRDLFEQAQKKAPCIVFIDELDALGKVRGAGVTSGNDEREQTLNQLLVEMDGFQPNSGVIILAATNRPEILDPALLRPGRFDRHIAIDRPDLNGRRQILQVHVKKVTLAADVDLAEIASRTPGFAGADLANVVNEAALHAAELDKSAVGMVDFDEAIDRAMTGMERRSRVMNEQEKITIAYHEAGHALVALSRPHCDPVKKVSIIPRGVAALGYTQQVPTEDRYVLRKSELLDRLDAYLGGRVAEEIVFGDVSTGAENDLDRATALVRHMVTRYGMSERLGLFTFDSSDPGVGYPSAGGRGERFSESTAKLVDDEVRRELAEAHERVTRTLADSRAQLDRIARRLLECEVLDQATLLQLMTGDAAPPTALQQNATAAASAAGTGASGPAAPEANAAGTPSP

SEQ ID NO: 4665 - protein, 285 aa, Burkholderia fungorum
  unsure (1)..(285): unsure at all Xaa locations
MSGRLAEIEARTATARQLDAVIGAMRGIAAARSREAQRRLPGIRSSAATVGAAIGAVLAYGRGAQAPSAEPDHGVRIVIALCSEQGFVGSFNEQVLDYVRTRVDSARCELLLVGTRGEMAASERRLALAWSSPAVSHADEVPSLANRITDALYARLGLRAVDQVSIIHALPGGGAASGKMVEHRLIPFDFSRFQVARRAVPPLLTLPVERLLPGLVEEYVFVEICEALMLSFAAENEARVNAMLAARTNVRDTLEELTQSYRRVRQDEITDDIAELAAATTQPVX

SEQ ID NO: 4666 - protein, 539 aa, Burkholderia fungorum
  unsure (1)..(539): unsure at all Xaa locations
LERREANYIPVTPIDFIVRAAEVYGDRLAVVHGEIRRNWRETYERSRRLASALQRAGIERGDTVAALLPNIPPMIEAHFGVPMAGAVLNTLNTRLDISSLLFMLRHGEAKALIVDTEYGEFAHRASLEFPDLRVISVADAMPANADQFIRATDYEAFLQSGDPEFAWTMPADEWDAIALNYTSGTTGDPKGVVYHHRGAYLNAVSNILEWDMPKHAVYLWTLPLFHCNGWCFPWTVAARAGVNVCLRKFDAKTVFDLIRNEGITHYCGAPIVQSALANAPAEWRDGINHRVSTMVAGAAPAPAVIAKMKEIGFDLTHVYGLTETYGPAAVCAKQEAWETLDDSARAELNARQGVRYHLQAAVTVLDPQTLALVPNDGETIGEIMFRGNICMKGYLKNERATEAAFEGGWFHTGDLGVRMPDGYIRIRDRSKDIIISGGENISSIELEDTLYRHPAVAVAAVVAMADPKWGEVPCAFVELKEGAQVSAEEIIAHCRLFLAGYKLPKAVRFGELPKTSTGKIQKFELRARIKTEENQXRSR

SEQ ID NO: 4667 - protein, 212 aa, Burkholderia fungorum
MSLRLGDIAPDFERQSSVGPIRFHEWLGDSWGVLFSHPADFTPVCTTELGLTAKLAGEFEKRNVKTIALSVDSAESHKEWIKDINETQAANVGFPILADGDRKVSELYDMIHPNANETLTVRSLFVIDPKKKVRLIITYPASTGRNFDEVLRVIDSLQLTDSHSVATPGNWKQGDDVVIVPSLKDEEIIKQKFPKGYKALRPYLRMTPQPNK

SEQ ID NO: 4668 - protein, 204 aa, Burkholderia fungorum
PFLYEPAPDFEARSTMGMVSSADYRGKWLLFFSHPADFTPVCTSELIAFARIAPRFKELGCELLALSIDGLYSHLAWLRSIQERFNMDIPFPVVEDPSMAVAKAYGMLPPKAVSSSTVRGMFLIDPEGIIKAISWYPISTGRSVEEAFRLFQAVRMTWQENLYAPADWQPGSPCVVPPPKTIEDASKRLSEGDVLDWYYQTRQI

SEQ ID NO: 4669 - protein, 616 aa, Burkholderia fungorum
YDLLKTIDDPAALRRLDRRQLQPLADELRAFVLDSVSQTGGHLSSNLGTVELTIALHYVFDTPHDRIVWDVGHQTYPHKILTGRRDQMHTLRQLGGISGFPKRDESEYDTFGTAHSSTSISAALGMAVASKLKGDNRMGIAVIGDGAMTAGMAFEAMNNAGVEDDVPLLVILNDNDMSISPPVGALNRHLARLMSGRFYAAARAGVERVLRVAPPMLDLARKLEEHAKGMIVPATLFEEFGFNYIGPIDGHDLDSLIPTLQNIKELRGPQFLHVVTKKGQGYKLAEADPVLYHGPGKFNPAEGIKPAATPSKKTYTQVFGEWLCDAAELDARVIGITPAMREGSGMVEFEKRFPDRYFDVGIAEQHAVTFAGGLAAEGMKPVVAIYSTFLQRAYDQLIHDVALQNLPVVFAIDRAGLVGADGATHAGAYDLAFLRCIPNMTVMAASDENECRQMLYTALQQPNPTAVRYPRGAGTGVATIKQMTALPLGKGEIRRETSQPAGKRIAILAFGTMVAPSLAAAEQLDATVANMRFVKPLDADLVRQLAETHDAIVTVEEGCVMGGAGSACVEALLASGVTRPVLQLGLPDRFIDHGDPAKLLAACGLDAVGITKSIRE

SEQ ID NO: 4670 - protein, 294 aa, Burkholderia fungorum
GRPMTFEQWMRSVLERVETALDHYLPGEATEPATLHEAMRYAVLGGGKRVRPLLCHAAGELTGARAECLDAAAAALEMIHVYSLVHDDMPCMDDDALRRGKPTVHVKYDEATALLVGDALQSQAFVALTSDVLAPAQQAALVRELALASGSVGMCGGQAIDLASVGHTLTRTQLETMHRMKTGALLRAAVRMGALAGETPDAAAMRSLDAYSAAVGLAFQVVDDILDVTTDSATLGKTAGKDAKDGKPTYVSIIGLDASRALAAQLRSDAHAALAPFGARAQRLAELADLVVNR

SEQ ID NO: 4671 - protein, 278 aa, Burkholderia fungorum
LISAANLAERLAAAPGSVFVIDCRFDLADPEAGEKAYLAGHLPGAHYLHLDRDLSGPKNGQNGRHPLPDRARLVETLESRGLKQGQQVVAYDAQGGMYAARAWWLLRWLGHDAVALLDGGLQAWEAGGYPLTQDAPAQNTGDFKAGAPLSVTVDAQTVERNLGSKERVVVDARAADRYRGENETLDRVGGHIPGALNRFFKDNLTADNRFKPAHTLREEFHALLAGTPPEHVILQCGSGVTACVNALAMEVAGLHGAALYAGSWSEWSSDPKRPVATG

SEQ ID NO: 4672 - protein, 243 aa, Burkholderia fungorum
RLAGKTALITAAGQGIGLATAELFAREGARVIATDIRIDGLAGKPVDARKLDVRDNAAINALAAELGAIDVLFNCAGFVHAGNILECSEEDWDFAFDLNAKAMYRTIRAFLPAMLDNGGGSIINMSSAASSVKGVPNRFAYSASKAAVIGLTKSVAADFITRGVRCNAICPGTVASPSLEQRIVAQAQAQGATLDAVQAAFVARQPMGRIGKPEEIAALALYLASDESSFTTGHAHVIDGGWS

SEQ ID NO: 4673 - protein, 264 aa, Burkholderia fungorum
VNIDLSGKTAIVSASTAGIGFAIATGIAASGARTIINGRKQDAVDHAIEAVRKSAPQAELQGFAGDLGTPQGCDALIKAVPQADILVNNLGVFGPGDIFSTADDDWERYFQVNVMSGVRLTRHYLKGMMERKWGRVVFISSESALNIPPDMLAYGFSKTAQLSIARGIAKHAAGSGVTVNAVLPGPTLSDGLRAMVEETARQQGKTVEQVATEFVREHRGSSIIQRAATTEEVANMVVYVCSPQASATTGAALRVDGGVIDTIA

SEQ ID NO: 4674 - protein, 695 aa, Burkholderia fungorum
PDRLLPGSPYPLGASWDGLGVNFAVFSANAQKIELCLFDPTGRKELRRFTLPECTDEVWHGYLPNAHPGTAYGFRAHGPYQPQHGHRFNPHKLLLDPYARKLVGQFRWSDALFGYRVHSNRADLSIDRRDSAPAMPKCVVIDEAFDWSHDKRPNVPWGETIVYETHVRGASMLRADLRQHERGTFAALASPEFIDHLLKLGVTAVELLPVHAFLNDRFLVERGLRNYWGYNSAAFFAPEPSYLSTHRLDEMRIAVRQLHAAGIEVILDVVYNHTCEGNEMGPTVSWRGLDNASYYRLIPGDERHHINDTGCGNTVNLPHPRVLQMVMDSLRYWSTAFNMDGFRFDLGVTLGREQHGFDPGSGFFDALRQDPILSQRKLISEPWDIGPGGYQLGNHPPGFGEWNDRFRDTVRRFWRGDAGLRPDLAARLTGSADLFNRRFRKPWASVNFVTSHDGFTLADVTAYEQKHNEANREDNNDGHNENCSRNWGVEGESDDPAILATRKRVARSLIATLLMALGTPMVLAGDESLRTQHGNNNAYCQDNELSWLDWARAESPDGRQMTAFVARVIALRKQHPLLRETRFLFGDREVLPGLFDVGWFDERGDPLTIEAWQDPEGRAFTLRRAGPGLNGETEVLLMMLNANEKTLRFTPPAPHLEWHVLLDTAEPENAPHRLAVPEIEVAAHGLVMLAAQPVG

SEQ ID NO: 4675 - protein, 393 aa, Burkholderia fungorum
DSLNFDTLAVRSGTVRSDFNEHSEAIFLTSSFVFASAADAAEKFRNSEDNYTYSRFTNPTVSMFQDRLAALEGGEACMATASGMAAIMSVVMSALQAGDHLVSSQALFGSTLGMFSQIFSKFGITTTFVDPTDLDAWKNAVRPETKMFFLETPSNPLTEVADIEAIGKIAKASNALFVVDNCFCSPALQQPLKLGADVVMHSATKFLDGQGRVLGGALVGSKQFIMEKVFPFVRSAGPTLSAFNAWVLLKGMETLSLRVEKQSANALEIARWLETHPAVNRVFYPGLESHPQHALAMRQQKAGGAILSFELKGDTPEQMRANAWRVIDNTKICSITGNLGDTRTTITHPATTTHGRVTSEARAAAGISEGLIRLAVGLENAGDIRGDLERGLA

SEQ ID NO: 4676 - protein, 215 aa, Burkholderia fungorum
RTRIKLCGLSKPEDVAHAIDLGADAIGLVFYPPSPRSVSVAQAVELVRDVPPFVSVVGLFVNATPDWIREVVSNVGLTLLQFHGDETAGQCESLAGVAGLPWLRALRVAADTQPADLVKSALSYSAASGLLFDTHVEGYGGGGKVFDWSLIPAGLARRAVLSGGLSAQNVSDAIHCVRPYAVDVSSGIESPGAKGVKDHARMAAFVRAVRAADAE

SEQ ID NO: 4677 - protein, 371 aa, Burkholderia fungorum
VGLVGWRGMVGSVLMQRMQQEGDFDLIEPVFFSTSNAGGNAPSFAKNETKLKDATSIEDLKKCEAIISCQGGDYTNEVFPKLRAAGWNGYWIDAASSLRMKDDAVIILDPVNLDVIKNALVKGQKNFIGGNCTVSLMLMALGGLFRENLVDWMTAMTYQAASGAGAQNMRELLQQMGTLYGAAKEDLADPSSAILDIDRRVLSAMNSDRMPTGNFGVPLAGSLIPWIDKDLGNGMSKEEWKGGAETNKILGKPAMGTPGSIPVDGLCVRIGAMRCHSQALTIKLNKDVPLDEVNSILASGNDWVKVVPNEREASMRDLSPAVVTGTLTVPVGRVRKLAMGGEYLSAFTVGDQLLWGAAEPLRRMLRIVLDK

SEQ ID NO: 4678 - protein, 729 aa, Burkholderia fungorum
  unsure (1)..(729): unsure at all Xaa locations
TTSAFEAEAAERPVWRISANLALSDHNVPTTDRSHGIADPISRLQVDTLDSNCDAYGITQFKMNDLRQGIVHIIGPEQGATLPGMTIVCGDSHTSTHGAFGALAHGIGTSEVEHVLATQTLLQKKSKNMLVKVEGALPRGCTAKDIVLAIIGKIGTAGGTGYAIEFGGSTIRALSMEGRMTVCNMAIEAGARAGMVAVDDTTIEYLKGRPFSPEGVEWNHAVEYWKQFKSDDGAQFDRVVELNAAEIVPQVTWGTSPEMVTAVDGRVPDPDREKDPVKRDALERALKYMALEPNAPIESIKPDKIFIGSCTNARIEDIRAAAYVVKKLGRRVAPNIRLAMVVPGSGLVKAQAEREGLDKVFTDAGFEWREPGCSMCLAMNADRLEPGERCASTSNRNFEGRQGAGGRTHLVSPAMAAAAAIEGHFVDIRKLGXTRMMKNMNRTTLLRRFALGSLAGLLLGLAGCNTVARIRRGHVAPRQFDQQSRXXISGFXFLPAMRKAAFFSRCAHRPGLETGASVMEKFIVHTGVVAPLDRENVDTDAIIPKQFLKSIKRTGFGPNAFDEWRYLDHGEPGQDNSQRPLNPDFVLNQPRYQGASVLLARKNFGCGSSREHAPWALEQYGFRALIAPSFADIFYNNCFKNGVLPIVLTEQQVDHLFNETYAFNGFKLTVDLEAQVVRTADGGTEYPFEVAAFRKYCLLNGFDDIGLTLRHADKIRQFEAERIAKQPWL

SEQ ID NO: 4679 - protein, 553 aa, Burkholderia fungorum
NISPLAGKRLPDAMLVNVPRLVTAYYTDKPDAAIPAHRVAFGTSGHRGSAFARSFNEWHVLAITQAICYYRKQQAIDGPLFIGIDTHALSEPAYASALEVLAANGVEVMIAQNGEYTPTPAVSHAILAYNRGRSAGLADGIVMTPSHNPPESGGFKYNPPNGGPADETVTGWIERAANGLLESRLDGVLRICLSKALRATTTHRHDFLNAYVGDLVNVLDMDVVRGAPIRLGVDPLGGAGVHYWGPIAERYNLNLSVVNDEVDPTFRFVSVDWDGRIRMDPSSPYAMQTLIDQKDRFDVAFACDTDHDRHGIVTRHAGLLPPNHYLAVLVHYLYANRPQWRAHVAVGKTIVSSQMIDRVTEKLGRTLYEVPVGFKWFVDGLLDGSLGFAGEESAGASCLRLDGTAWSTDKDGIVPALLAAEMTTRTGRDPAEIYRDLTQRLGEPVERRVQAAATAPQRALLARLSPAQFPHTELAGEKIEQVLDRAPGNGAAIGGIKVVTKSGWFAARPSGTEDVYKIYAESFRGEAHLTRIVGEAQAMVDSVFEAQVATDDG

SEQ ID NO: 4680 - protein, 336 aa, Burkholderia fungorum
MQAAVVEQFGKPLVLKELAIPTPGPGQVLVKTEACGVCHTDLHATNGDWPLKPGLPFTPGHEGIGIVAALGAGVTAVKEGDRIGVPWLYSACGHCEYCLAAREPVCAEAQFGGYTKNGGFAEYIVADPNYVAHIPAGLAAREAAPLICAGITSYKGIKETQARPGEWVVISGVGGLGHLGIQYAKAMGLQVCAVDIDDGKLAHAKRLGADAVVNANDGDPIAAVIRATGGGAHGVLITAPSLGAFKQGVGMTRKCGTCVLVGLPPGEFPTPLFDVVANCITIRGSFVGNRRDMAEALAFAADGKVRADIELQPLSAINNVFQRLGHGDVPSRVVLE

SEQ ID NO: 4681 - protein, 440 aa, Burkholderia fungorum
MTYQSVNPNTGKTLKSFDELNDQQLEKALSTAQSCFHVWKKTSYAQRAAIISRAAGLMRANVDEFAKLATLEMGKRIDEARGEVNFSADILDYYARHAEAFLAPTKLHPKVGEAHMETSPFGVLFCVEPWNFPYYQLARVAGPQLMAGNVLVVKHAGCVPQCAIAFEKLLIDAGAPVGAYTNLLISHKQAERIIDDPRIQGVALTGSVAAGRSIAARAGQNLKKTSMELGGSDAFIVLDDADLEKTIPWAVWGRMYNAGQTCCAAKRFIVLDSIADRFLEKFKAALNELKPGDPMDEKTTHGPLSTEAALTQLLKQVDDAVAKGATLVMGGKRIDRPGSFMQTTILTDIKPDNPAFRDEFFGPVVSFFRVKDEAAAIALANDSDFGLGGSVFTADAARGKRVASGVDTGMMFINNIDWSDAELPFGGIKYSGYGRELGNM

SEQ ID NO: 4682 - protein, 386 aa, Burkholderia fungorum
  unsure (1)..(386): unsure at all Xaa locations
LRERAERLAQADRRKNEFLAMLGHELRNPLAALCSSGDLLASETIDPRQKSWAVGVIQRQGRSMTQLVNEMLDLTRITSGSIELRRQAVTLKAVIQSAVEVCQPIIDERHHTLSVSLPDEPVLMYVDPTRLSQVVENIVINAARYTEPGGHISLTATRTGRRLSLRVKDNGRGIPASMLSTLFDMFVQGPVPYGQLHNGLGVGLSVVRRLVELHGGSVRAISDGRTGSEFIVDLPLGMIPPGVEQAGTPQEPVNAGPRKILIIDDNADASEALAMLLAAEGHVVETRLDGPGGLEAASTFRPDVVLLDIGLPGMDGYEVAKQLRDSVATYDTMLIAVTGYGQPGDQLRSAEAGLDYHLVKPVDINALTRLLAVQVKPRGRXIKRLD

SEQ ID NO: 4683 - protein, 443 aa, Burkholderia fungorum
AVVCGDDRLNWREFHLRTNKVANALVRAGLQKGDRVCFFMQNSMAAFELIWGTIKAGGVVSPLNVMMAADSLPAMIDNAAPRFIFVDSELAGAVDAVRGAVRNKPDIFYAESGAVEGWQSYVELVEAGSEAEYFPDLKLSDTMTVLYSSGTTGVPKGSEHTHAARHFYSLGCGPALRMDPYSVALCATPLYTNGTWITLLPALYLGGTVVLARKLTPQAWLELVARERITHAFLVPTQCIGIVERASPEYDVSSLQGILYGGAPMTSQTAAAMAKTFPNTRMYEIYGMSEGWCTLAYPEDRAHGRSSTVGKPVFGGDICVIDPEGRELPPGEQGELAGWSAGLMKGYLGDPQRTADIVWKGPHGRTYLRSGDIGYMDTEGFFFVNGRVKDMIISGGINVFASDIEEVFMQHPAVAEAAAIGIPHDKWGETPIVMVILRQGHQI

SEQ ID NO: 4684 - protein, 386 aa, Burkholderia fungorum
NSNLIETSAEHQQIYDSVAKITRAYGHAAFAKAGRRGEEARELWQNLAEAGYLGISVPEEYGGSGQGVEELAIVLEATAAQGCPMTSFVVLPIIVFVLSKHATEAQKREILPAIATGEKRLAFAITEPDAGTNTHNLKTNAVRTANGGWRLSGSKYYITEAEVADALLVVARTGVDEATGRGKLSLFLVPKHLKGVTLQNLPTELIVPERQASVFFDDVELPADALIGAEGEGLRNVFAGLNPERIAVAALCNGLTTYALTKACEYAKVRKVWKTPIGAHQAVAHPLAEAYARLQLSKMATQRAAQLYDAGRDAGDASNIAKLTASDTAVFALDRAIQTHGGNGFSQEFGLGDLWFVARVQQTAPVSREMVLNHIAQHNLGLPRSY

SEQ ID NO: 4685 - protein, 436 aa, Burkholderia fungorum
GRNVVVVGTQWGDEGKGKIVDWLTDHAQGVVRFQGGHNAGHTLIIGGKKTILRLIPSGIMHPGVACYIGNGVVLSPEALFKEIGELEAAGVDVQNRLFISEATTLILPYHIAIDQGREARRGAGKIGTTGRGIGPAYEDKVARRGLRVQDLFEPEIFAERLRENLDYHNFVLTQYLGVAAVDFQQTLDTMLSYADRLRPMVTDVSRRLYDVNAAGSNLLFEGAQGTLLDIDHGTYPFVTSSNCVAGAATAGAGVGPQKLNYILGITKAYCTRVGSGPFPSELYDADNAARQEAIGLELATVGKEFGSVTGRPRRTGWLDAAALRRSIQINGVSGLCMTKLDVLDGLDEVKLCVGYKVDGKNVDLLPRGASEVARCEPVYETFAGWKESTVGIKEWDKLPANARAYLSRVQEVAGIPIDMVSTGPDRDETILLRHPF

SEQ ID NO: 4686 - protein, 141 aa, Burkholderia fungorum
MAIERTLSIIKPDAVAKNVIGQIYTRFENAGLKIVASRMVHLSRADAEKFYAVHAARPFFKDLVDFMISGPVVVQALEGENAILKHRDLMGATDPKKAEKGTIRADFADSIDANAVHGSDAPETAAVEIAFFFPQVNVYSR

SEQ ID NO: 4687 - protein, 290 aa, Burkholderia fungorum
IRGSIPAIITPMLEDGSLDLPAFRKLIDWHVAEGTNALVVVGTSGESATLSVEEHVLMVKTAVEHTAGRIPVIAGSGGNSTTEAIELTQRAKEVGADATLQVVPYYNKPTQEGIYRHFAKIAETVDLPVILYNVPGRTVADMSNETILRLAQVPGIIGVKEATGNIDRAAHLIKFAPSHFGIYSGDDPTAIALMLLGGHGNISVTANVVPRAMSELCKAALAADVKTAREIHLKLLSLHKNLFVESNPIPAKWALQQLGRVQGGIRLPLTPLDPQYHEVVRGALREAGLL

SEQ ID NO: 4688 - protein, 426 aa, Burkholderia fungorum
MSAIVDIIGREILDSRGNPTVECDVLLESGTMGRAAVPSGASTGSREAIELRDGEAGRYGGKGVLKAVEHINTEISEAIMGLDASEQAFLDKTLLELDGTDNKSRLGANAMLAVSMAVAKAAAEEAGLPLYRYFGGSGAMQLPVPMMNIVNGGAHANNSLDIQEFMIVPVSQPTFREALRCGAEVFHALKKILSDRGMSTAVGDEGGFAPNFGSNDECLSTILQAIEKAGYRAGEDVLLALDCAASEFYHDGKYQLAGEGLQLSSTEFTDYLANLADKFPIVSIEDGMHESDWAGWKTLTDKLGKKVQLVGDDLFVTNTRILKEGIEKGIANSILIKINQIGTLTETFAAIEMAKRAGYTAVISHRSGETEDSTIADIAVGLNAGQIKTGSLSRSDRISKYNQLLRIEEDLGDIASYPGKSAFYNL

SEQ ID NO: 4689 - protein, 623 aa, Burkholderia fungorum
MALLQISEPGMAPAPHQRRLAVGIDLGTTNSLVAAVRSGVPDVLPDEDGHALLPSVVRYLEKGGRRIGRTAKAEAASDPRNTIVSVKRFMGRGKAEVEGAENAPYDFVDAPGMVQIRTVDGVKSPVEVSAEILATLRQRAEDTLGDELVGAVITVPAYFDEAQRQATKDAARLAGLNVLRLLNEPTAAAIAYGLDNGSEGLYAVYDLGGGTFDLSILKLTKGVFEVLAAGGDSALGGDDFDHALYRHVLEQVGIAPQTLAPEDVRLLLDSVREAKEALSDAPSVKLRTRLSNGTEIDLTIGEATFEAITQALVQRTLGPTKKALRDARVTTKEIKGVVLVGGATRMPVIRRAVESFFGQPPLINLDPDQVVALGAAIQADLLAGNRGADGDDWLLLDVIPLSLGVETMGGLTEKIIPRNSTIPVARAQDFTTFKDGQTAMAIHVVQGERELVSDCRSLARFELRGIPPMAAGAARIRVTYQVDADGLLSVFAREQGSGVEASVVVKPSYGLADDDIARMLEDSFSTAEIDMRARALREAQVEAQRLVEATDAALAADAELLDDSERAELDKLLDALRKVAQSDDVDAIEAATKTVAEGTDEFAARRMNKGIRRALAGRKLDEI

SEQ ID NO: 4690 - protein, 383 aa, Burkholderia fungorum
LRGQVAVVGVGESEYYRAGHAPDPEFRLLLKAVLAACRDADIDPADIDGFASFADDRNDAVRIATALGVKRLRSTTMQWGGGGGGCAAAVANGAAAIMSGMAQCVLVYRGLAQGQFGRFGQAAPRASISGEMAYQMPYGVLAPPQKFAMKVQRFMHEHGVRREALRAIALASYQHAQANPRAVMHGKPLTAEAYDASRWIVEPFRLFDCCMENDGAGALLLVAAERAKDFPHRPVYLLGAASGGDWRAAASPHNAPHYASANYSGVSGDLYRMARVSPADVGVVQSYENFTGGVAMALSEHGFFHPDEANDFLTPENLVAPSGKLPLNTSGGNLGECYVHGFELVIEAARQVRGESTSQAARHDVALVIGGPMVTPASSLLFG

SEQ ID NO: 4691 - protein, 484 aa, Burkholderia fungorum
PTPVDVRPARTIQMRHGAVKSRTLTLEDKNMAYASINPNSGETLKRFDPLTDAQLEQSLASAQACSQTWKQTTYAQRAGILNKAAALLRTHVDEFAKLATLEMGKRINEARGEVNFSADILAYYAKHAEAFLAPIRLEPKIGEAHMESSPFGVLFCVEPWNFPYYQLARVAGPQLMAGNVLVVKHAACVPQCAIAFEKLLIDAGAPKGAYTNLLISHEQAQRVIDDPRIKGVALTGSAAAGKSVAARAGQNLKKTSMELGGSDAFIVLDDADLEKTIPWAVWGRMYNGGQTCCAAKRFIVLDSIADRFLEKFKAALSELRPGDPMDEKTTHGPLSSESALVQLLKQVDDAVANGATLLMGGKRIDRPGSFMEITILTDIKPDNPAFRDEFFGPVVSFFRVKDEAAAIALANDSDFGLGGSVFTEDIVRGKRVASSVETGMMFINNIDWSDAELPFGGIKDSGYGRELGNMGIQEFVNKKLVRTA

SEQ ID NO: 4692 - protein, 318 aa, Burkholderia fungorum
LHVGEMPMPKAVPGHVVIRVRASSFNYHDVFTVKGMPGIKVPLPVVIGLDMAGEITEVGDNVENWSVGARVLVNPLNKKKGLMGEMLDGGMAQYCLVSADQLIAMPEGVTFEEAASLPVAYGTAHRMLVTHNTIKPGDRVVILGASGGVGTGCVTLAKMLGAEVIAAAGSADKAERLKAMGADHVINYRDTDFSKWVIEKYGKPQRRSYEGGADVVINFTGGDTWVPSLKCIKRGGSLLVCGATAGHDPKEDLRYIWSFEIRVIGSNSFYDDNLSALMELIRTKKIAVQIDKVLPLEQAAEGLRMIRDREVLGKIVVT

SEQ ID NO: 4693 - protein, 482 aa, Burkholderia fungorum
KLAVIALGEPDETGCAWHDTRMTYGELDALADGVARALVRRGLKVGERVAILAANRAEYVAALLGIMRAGMVAVPVNFRFPPALSTFVIRDSGARLVFCDAARLADCPDDLPTVVFDSTGEDSFASFVERGPFETFVPTPDTPAMFLYTSGSTGKPKGVMLSHGSHLWVARTRARAQPPEAHRFLVAAPMYHMNALTLVLMSLYGHGTVVLLPQFTARMYITAIERYRVTWLTSVPPMIAMMLREKELLERTDLSSARFIRMGSAPVSESLLAQIGEVLPNAKLTNVYGTTEGGPIVFGPHPQGIEPPLLSVGYPHPEVSVKLLDAPPTGVATGVLAVKSPAVMLGYHNRPDLPLPVTADGFYITGDVFHRDEQGFYAFVGRADDMFVSGGENIFPGEVEQMLETHPDIVQACVVPVADDIKGTKPVAFVVRRAGASLTEEEAKQYALTHAPAYQHPRRVWFVDALPLASTNKIDRAALKAI

SEQ ID NO: 4694 - protein, 310 aa, Burkholderia fungorum
MKYKDYYEILGLERSASQDDIKRSYRKLARKYHPDVSKHADAEERFKELGEAYEVLKDPEKRAAYDRMGSDWRNGQDFQPPPNWDEGFEFSGAGSGPGEQADFHDIFEKMFGGARGAHPHARQRSFDARGEDHHAKVLIDLEDAYRGAQRAISLQMPVVDAQGHVSLETRTLNVTIPKGIRAGQHLRLSGQGAAGATPETAGDLYLEIAFRDHPRFQVDGRDVSLELPVAPWEAALGAKVTVPTPDGSVEMTVPAGSASGRRLRLKGKGIPANPPGDLYVILNIVLPPADTESAKAAYDAMRQAFNFDPR

SEQ ID NO: 4695 - protein, 905 aa, Burkholderia fungorum
YAKTIALDNLTLDFPAGRMTGLIGPDGVGKSSLLALAAGARAVQEGTVEVLGGDMRSRRHRALVCPRIAYMPQGLGKNLYPTLTVEENLQFFARLFGHDAAERRRRIDSLTRSTGLKPFLARPAGKLSGGMKQKLALCCALIHDPDLLILDEPTTGVDPLARAQFWNLIASIRKGRPGMSVIVATAYMDEAQRFDSLVAMDAGRILATGEPRALLEQTNSDTLEAAFIALLPEERRRDHRPVVVEPLPADAAADLAIEARDLTMRFGDFVAVDHVSFRIRSGEIFGFLGSNGCGKSTTMKMLTGLLPASEGSAKLFGREVDPNDIDTRTRVGYMSQAFSLYGELTVQQNLVLHAQLFHVPPQQIAARVDEMVSRFGLGEVRDALPDSLPLGMRQRLSLAVAMVHKPELLILDEPTSGVDPVARDNFWQLMIELARRDRVTIFISTHFMNEAERCDRISLMHAGRVLATEAPAELVRLRGTATLEEAFIGYLIEAGADKAEDGGAEATIEAPASTNDSGTGTLDQSPNRSRPRAFSPSRALTYIWREALELRRDPVRATLALLGSLVLMFVMGYGVSLDVESLSYAVLDRDQTELSHDYALNMSGSRYFVEQAPLSDYADLDKRMRGGQLSLAIEIPPNFARDLQRGAPVQLGVWIDGAMPQRAETIRGYVLGLHQAWLTDQSIHRLGLTPAAQVNIETRFRYNPDVKSAPAMVPAIIPLLLLMLPAMLTALAVVRERELGSIINLYVTPVTRSEFLLGKQVPYVVLALLNFLLMTMLARIVFGVPVKGNFLTLLAAVLIYSIVATGMGMLASTFTRSQIAAIFLTMIGTLIPAIQFSGLINPLSSMEGSGRLIGSIYPATYMFTISRGVINKALGFTDLQGQFWPLLAAIPVVLGLTTALLKKQE

SEQ ID NO: 4696 - protein, 271 aa, Burkholderia fungorum
ILTRKLEGRVAIVTGSSSGNGRAIALALAREGAHVVCSDLKKSALKGGYEKDIETDTDAVIAQQGGKTAFIAADASKAADVQKIVDHAVSTFGRLDIIVNNAGVFTGLHSIIDETEEQYDFTMNVNAKGVWLGCKYAITQFMKQEPLTTSTGVQVRGRIVNIASIGGLVGLALEPAYCASKGAVVNLTRELALDFAPERINVNAICPGFLATAMVRSFLENDDTNKLLHDLTPWPRVGTAEDVAKAALFLASDDAEWMTGSMLTVDGAFTA

SEQ ID NO: 4697 - protein, 254 aa, Burkholderia fungorum
LKGKVAIVTGASSGFGRGIAMAYATEGASVVVSDIHEAPNQGGFEGNPQLTTAAAITGAGGKAQYVACDVTRLDQVANLVKETVRLYGGLDVMVNNAGIYRAGKLAHEFSVEDLDACFDVNVKGTWFGCQEAIKVFLKQARGGNIINIVSTAGLQGHPKQSVYNISKGAAANLTRCLAIEYGRDRIRVNGICPTYAKTSLTRALFDDKDFDKVFTEAIPLKRWGEVEDIANLAVFLASDESSYIHGDLIRIDGG

SEQ ID NO: 4698 - protein, 502 aa, Burkholderia fungorum
DFAIVGTGAGGGTLACRLAELGFRVVAFDAGAWWRPLEEFASDETHQAKLFWTDERICDGENPLQLGNNNSGKAVGGSTVHFAMVSLRFRPEWFKSRSALGYGADWPLDWREMWRYYAQVEDALKISGPVNYPWGPPRPRYPYRAHELNAAALVLARGAEAMGIPWTPTPLATLSAPRGLAHPCVYRGFCVSGCATNAKQSALVTWIPRALRAGAEIRDLAMVGRIATNALGRVNGVEYLREGRWQFQRAKHVVVAGYAIETPRLLLMSATSQYPDGLANRSGLVGKNLMAQSNQAVYGTMEEEIRWYKGPPSLAITEHWNYTDEGKDFFGGYSYMSQGPLPEVWAGAQNKRGLWGDALAREMRNYNHQAGLKIVGEMLPQERNRVTLADEKDQYGLPVARVTYSWGDNDKRLIAHSLDFMQQALAAAGGRDIWRETDDTCHLNGTARMGSDPATSVVDADCRSWDIPNLWICDGSVFPTVGGVNPSLTIQAIACRTAARIA

SEQ ID NO: 4699 - protein, 598 aa, Burkholderia fungorum
MSQTVGDFIIDRLHAWGVRRIYGYPGDGINGVFGALNRAHGKIEFVQVRHEEMAAFMASAHAKFTGELGVCIATSGPGASHLLTGLYDARLDHMPVLAIAGQQARAALGGHYQQELDLVSMFKDVAGAFVEQASVPSQVRHLVDRAVRTALAERKVTALVLPNDLQDLAYEAPARKHGTLHSGVGYRRPRLVPYPDDLQQAAEVLNAGKRVAILVGAGALHATDEVIAVADKLGAGAAKALLGKAALPDDLPWVTGSIGLLGTKPSYDLMTECDTLLVIGSGFPYAEFLPKEGAARGVQIDLKADMLSLRYPMEVNLVGDSVETLRALLPLLEQKQDRGWREKIEGWTADWWKTLDKRAHEAGRKGMNPQRSVWELSPRLPANAIVTSDSGSCANWYARDLKVQRGMMCSLSGGLASMGAAVPYAIAAKFSHPERPVIALVGDGAMQMNNMAELITVAKYWKQWASPRWICMVLNNSDLNQVTWEQRVMEGDPKFEASQDIPSVPYHRFAELIGLKGIYVEDPERMGAAWDEALAADRPVVIEVKADPDIPPLPPHITLAQAKAFASTLIKRDPNEGSVIIETAKQVLGAVLPGHRDK

SEQ ID NO: 4700 - protein, 310 aa, Burkholderia fungorum
MGTIVSIGSINLDLQMRVDHPVGSAETQRAHDFSRLAGGKAANVAYLARRFGHDAQLLGMVGDDRFADEAVAPLRDLGIDVSRVRTAAGQPTAVSMIFVPDNGKKTIVLASNANDAWQRADIDAALEAIDAAPAHSVLAVDCEMSVDACAAVLAAAQRRALCVVLDPAPPQRAQSGALRALWRAVHALTPNEEEAAALTGIEIADQAGAVRAARALHREGFELVCVKRSDGGCIAVSRDGVLAVQVKPVEALDTTGAGDAFTGALAVSLVERRAFADAVRLATAAANLTVMAWGSQTALPDRARADAFAA

SEQ ID NO: 4701 - protein, 210 aa, Burkholderia fungorum
AREWMVERQIVRRGVRDPHLLAAMRRVPRDAFVPAELREFAYDDTPLPLENEQSISQPVIVAKMLEAAQLHPGDHVLDIGTGSGYAAAVAGEIAARVDSIERDAALADTAQDRLARLGYTNVVVHHGDGTAGLAEHAPYDAIIAAAGGPRVPHALCSQLAPGGRLIMPVGPEPNRQRLVKIVRRGEQDYEERVLGDVRFVPLVGDDGWPE

SEQ ID NO: 4702 - protein, 477 aa, Burkholderia fungorum
SMEYGPAPESDQAARAWLAQHEARFGHFIGGAWREPGAGERFASHAPASGEPLAQIAHGDAGDIDAAVCAARAAQPAWLALGGAGRARHLYALARMVQRHSRLFAVLEALDNGKPIRETRDIDVPLVARHFLHHAGWAQLQESEFAAYAPLGVIGQIVPWNFPLLMLAWKIAPAIAMGNCVVLKPAEYTPLTALLFAELAHRAGLPAGVLNVVTGDGRTGAALVEHPQIDKIAFTGSTEVGKAIRAVTAGSGKSLTLELGGKSPFIVFDDADLDGAVEGVVDAIWFNQGQVCCAGSRLLVQEGIEARFIARLKRRMETLRIGSSLDKSIDIGAIVDPVQLERIRSLVETGRREGCAVWQSPGTVLPAQGCFYPPTLVTGVAPASTLAQQEIFGPVLVAMSFRTPDEAIALANNSRYGLAASVWSETIGRALDIAPRLACGVVWINATNLFDAAVGFGGYRESGYGREGGREGIYEYL

SEQ ID NO: 4703 - protein, 335 aa, Burkholderia fungorum
MKVYRFDQAGSLDHLTLHDEPTPEPQRGEVLIRVRASSLNYRDIAMVHGTYLRAQRAGLIPLSDAAGEIVAVGEDVVDFKVGERVINTFHPRWYGGNPPPTLGSEGYGSHRDGWLSEYKVVSQEAIVAAPPGLSFEEAATLPCAALTAWTSLSGLRPLRPGQTVLTQGSGGVSVFAVQLAKLLGARVIATTSSAEKAARLKALGADEVINYVETPAWGERVRELTEGRGVDRVLEVGGPGTLEQSIKAVASRGEVALIGFLASGDSGVGFNDLFRSGGVFYRISVGDRSGLLELVRAVTSSGLKPVIDTVFPFERALDAWHHFDDRAFFGKVVIS

SEQ ID NO: 4704 - protein, 248 aa, Burkholderia fungorum
TMRLTGKTAIVTGGGSGFGEGIAKTYAREGANVVVNDLNGPAAERVASEIALAGGKAIAVTGNVAQREDWQKLREAALEDFGSVQIVVNNAGTTHRNKPVMEVTEAEFDRVYAVNVKSIYWSVQEFVPYFREQGGGCFINIASTAGVRPRPGLVWYNGSKGAVIIASKSLAVELGPDRIRVNCVNPVIGETALLSEFMGVEDTPENRQRFLAGIPLGRFSTPQDIANAALYLASDEAEFITGVCLEVD

SEQ ID NO: 4705 - protein, 474 aa, Burkholderia fungorum
MEEARHFIGGEWSAASGGETIAVLDPSDGQPFTQLARGTAADIDAAVHAARRAFEGAWGEASAAERGRVLYRLSMLVAARQEELALLEARDTGKPLKQARADSAALARYFEFYAGAADKLHGETLPYQTGYTVLTIRDPHGVTGHIVPWNYPMQIFGRSVGAALAAGNACVVKPAEDACLSVLRVAELAAEAGLPAGALNIVTGYGHEAGAALARHPGIDHISFTGSPETGKLVTQMAAENHVPVTLELGGKSPQIVFADADLDAALPVLVSAIVQNAGQTCSAGSRVLIDRSIYEPLLDRLSGAFHALRVGPSHADLDCGPLISAKQQRRVWDFLSDAQHDGIPMAAHGEVIPEAPESGFYQAPTLLRDVPASHRLARDEVFGPVLAAMSFSGEDEALALANGTPFGLVAGIWTRDGARQMRLARRLRSGQVFINNYGAGGGVELPFGGVKHSGHGREKGFEALYGFTVLKTI

SEQ ID NO: 4706 - protein, 453 aa, Burkholderia fungorum
MSRLIVVSNRVAPTQEGRPAAGGLAIGVLDALKETGGVWFGWSGETVSEPSAPVIEKQGNVTYATVGLTKRDYDQYYRGFSNATLWPTFHYRNDLSRYDRQEYAGYQRVNATLAKQLKELLKPDDIIWVHDYHLLPFARCLRELGVKNPIGFFLHIPFPVPEVLRTIPPHEELVKAMCSYDVIGFQTDADRQSFVDFIERGQHGTSSEDGMVHAYNRFLKVGAYPIGIYPDAIAKAAEQFTDRKPVRSLRDGMRGRKLIMSVDRLDYSKGLVERFQAFERLLLNAPGWHGRVSLVQIAPPTRADVQTYQRIRQTLEGEAGRINGRFAQLDWTPIQYLNRKYERNLLMALFRQSQVGYVTPLRDGMNLVAKEYVASQDPADPGVLVLSQFAGAAEQLPGALVVNPFDLSQMAEALERALSMPLAERQARHADMMAPMRENNLSVWRDTFLADLR

SEQ ID NO: 4707 - protein, 241 aa, Burkholderia fungorum
KVAIVTGAGGGIGAAVCARLAAGGWAVVLADRSAGTTAEAEARCRALDAPADTFAGDVTDADYVRELVAFALRRHGRLDAFVGNAGIAGQVKPLADYPDDAFDLVMNVNVRGMFLCLKHGIPALRERGGSFVATASTSAIRGRANLSAYVASKHAVLGLVRSAALECMGSGVRVNAVLPGPIQTPMIDAINDMAAQHGGVARAAHAAYGRPEDVANTVAFLLSPDASHMNGAALVVDAGST

SEQ ID NO: 4708 - protein, 419 aa, Burkholderia fungorum
  unsure (1)..(419): unsure at all Xaa locations
KKALVAACVGNFIEYYDFVIYGYFASVIARLFFPADNEAASLLLTFAVFAISYASRPLGGLIFGHLGDRYGRKTPLAVAVMLIACSTTVIGLLPTYSAIGIASPIILTAARLVQGISVGGEYGGATSFIAEYAPPGRRGFYTGWQTFTIGLALLVGGAVASIITGALSAEDLRAWGWRLPFFAGLPLGFVGLYLRLKLEETPHFSSVQQTAEIERTPLVTGLRREWKAILIGMGLIAAPSACIYIYYIYSPTYLSVVLGFKLADAQRANLYSLIFYCALLPVFAHLSDVVGRRPLMLVSSLAIMLVTYPAFHLLDPHDFGKTVAALCLMSLAFAPHSATALCAMAEIMPTRLRYTGLSVSLNIPVTLLGGTAPFIATYLVSRTGDLYSPAWFVIGAGLCTLVAAYAYKETLHSGLRXSA

SEQ ID NO: 4709 - protein, 211 aa, Burkholderia fungorum
LQLYSLPTPNGVKVSIMLEETGLPYEPHLVRFDTNDQMTPEFLSLNPNNKIPAIIDPDGPDGKPLPLFESGAILIYLADKSGRFIPQDAAGRYEAIQWVMFQMGGIGPMFGQLGFFHKFAGKEYEDKRPRDRYIAESKRLLGVLDRQLEGRDWILGDTYSIADIATFPWVRNLIGFYEAGDLVGIQDFPNVTRVLAAFVARPAVARGLEIP

SEQ ID NO: 4710 - protein, 647 aa, Burkholderia fungorum
  unsure (1)..(647): unsure at all Xaa locations
MSLYTITGAQLAFGHVALLDHADFSLEAGERVGLIGRNGAGKSSLLKIVADLTRPDDGLVTRQQNLTTVYVPQEPEFDTDDTVFDAVAAGLTHARALLDEYDAVANQLADEPEGAEHDALMSRMNTLQSSLDAVDAWNWSTRVSTTLQQIGLNGEARVGSLSGGMQKRVALARALVVQPDVLLLDEPTNHLDFEGIRWLEDLLVSLRAGLLFITHDRAFLDRVATRIVELDRGRLLSYPGNFSAYQTRKAQQLEVEQVEAAKFDKLLAQEEVWIRKGVEARRTRSVGRIARLVEMRNQRAERRNVQGNVKLDVGQGEKSGKIVAELTDVTKRYGSRTVVDNFTATVMRGDKIGFVGPNGAGKTTLLKLILGELAPDEGTVRIGTNLQVAYFDQMRAQLDLEKSLADTISPGSEWVEVNGQKKHVMSYLGDFLFAPERARSPVKSLSGGERNRLLLARLFARPANVLVLDEPTNDLDIPTLELLEELLTEYDGTVLLVSHDRAFLDNVATSVIASEGGGKWREYVGGFTDWQIQRDRSQQMALDAQKEAGKDAGKDAAPGKDGSAGRNTQRAAKLSFKEQRELEALPGKIAALEAEQKTIGAQLEDGSVFAKDAQEGTRLTERYAAIDEELLVALERWDELENRRKXG

SEQ ID NO: 4711 - protein, 333 aa, Burkholderia fungorum
TQGARIAGVVSCVPSKQVDNDYFVERFDASAVRDVVKMIGVNRRRWADAQTSAGDLCRKAGEKLLAGLGWQADSIDALIFVSQTPNYRLPATAFVLQAELDLPASCLALDINLGCSGYPQALWLGMNLIQTGAAKRVLLAVGDTISKMIDPTDRSTSLLFGDAGTMTALETSNGDAAAHFIIGADGKGARNLIVPSGGFKPYDAAADERMAGKSPECLFMDGGEIFNFTLNAVPKLVSRTLDIAGRDKDSYDAFLFHQANLFMLKHLAKKAGLPAERVPVNIGEYGNTSCASIPLLITTELKDRLKEETLQLGMFGFGVGYSWASAALAVGPL

SEQ ID NO: 4712 - protein, 340 aa, Burkholderia fungorum
SDRVQARILDIAGFLPEQVLTNEQLAALYPEWPADKILAKTGIQQRHIAAAGQTAADLAYEAARNLFAQGSVNAQDVDFVILCTQAPDYVLPTSACLLQDRLGISTHAGALDVNLGCSGYVYGLSLARGLVETGAARCVLLLTADTYSKYVHPLDKSVRTLFGDGATATAITASTNGDASIGPFVFGTDGRGAQNLIVKAGLFREPKNAQSALETQDASGNVRTDEHLYMNGAEVMAFSLAEVPKAATSLLEKAGMDREEIDFFVLHQANRFMLEALRKKMKVPEAKFPILMEQCGNTVSSTVPLALKQMKDDGLLQHGSRLMLLGFGVGYSWAGCLVTY

SEQ ID NO: 4713 - protein, 655 aa, Burkholderia fungorum
MSNLINLGLSGLNAAQWGLTTTGQNISNASTPGYTIETPVYAESGGQYTGSGYLPQGVSTTTVTRQYSQYLTTELNNAQSSSSSLSTYNTLISQLNNLIGSPTAGIASAITSYFTGLQNVSNNASSLATRQTAMSGAQTLVNQINAAGQQYDALRQSVNTQLTNTVSQINSYSQQIAQLNGQIAQASTQGQPPNQLLDQRDLAVSNLSQLIGVNVVNSNGSYSVFMSNGQPLVSSTNSYNLGTAPSTGDTSELSVQYLGQAGANPAATPQNLPDSKIDGGTLGGLLAFRSQTLDPGEAQLGAIAVSFSAQVNAQNGLGITLAGAKGGALFSVGGPTVYANTQNTGNASLNVSFADATQPTTGDYTLAYNGTTYTLTDNSTGTVVGSATNLSQPINGLNFSTTGTMNAGDSFTVEPTRGALNSFATATTDASAIAAAAPVLAAAAASNTGTATITQGTVTAGYTMPNSTTTLSYDGTGLSGFPAGSTVTVAGTPPTTYTIASAATVVPYSSATGATLTINNATAGQMNNVSVTISNAPAAGDKFTIGPNTGATNDGRNALALSNLSTAKAMSGGTVTLTGAYANYVNNIGNQTNQIQTSSTAQSSLVTQITTAQQSVSGVNINEEAANLLQYQQLYQANSKVIQTAQTLFQTILGI

SEQ ID NO: 4714 - protein, 250 aa, Burkholderia fungorum
TLTGQHAVVTGGGSGIGAAVAQALLHAGARVTLMGRNAERLDAQREKCQTLGEVACISVDVTQEDSVESAFREAGAVDILINNAGQAQAAPFTHTDLALWQRMLDVNLTGVFLGTRAVLPGMLERGHGRIVNVASTAGQIGYAYVAAYCAAKHGVIGLTRSLALEVATKGVTVNAVCPGYTETELLHASLEQITSKTSRTEQQARETLLRSNPQHRFVSPDQVANAVLWLCQPGSDAVTGQSISISGGEV

SEQ ID NO: 4715 - protein, 320 aa, Burkholderia fungorum
YGGHGDTIDTRAVCLLRETLAKHSGLADFALAMQGLGSGAISLGGTHEQKTRYLPRVANGTAIAAFALSEPEAGSDVAAMTLSAREDGDAYVLDGDKTWISNGGIADFYVVFARTGEAPGARGISAFVVDADTPGLEIAERIDVIAPHPLARLHFAGARVPRSQMLGAPGEGFKLAMRTLDIFRTSVAAASLGFARHAMAEGVARAASRKMFGQTLGDFQLTQAKLAQMALTIDSSALLVYRAAWLRDQGENVTREAAMAKWHASEGAQQVIDAAVQLYGGMGVQSGTAVEMLYREIRALRIYEGATEVQQLIVGRDLLK

SEQ ID NO: 4716 - protein, 359 aa, Burkholderia fungorum
DTLAINKPDHFTACDTAADDVCLIAFTSGTTGAPKGCMHFHRDVLAMCDLFPRYVLKPTSSDIFCGTPPLAFTFGLGGLLCFPLRVGASTVLIEKLTPETLLQTVERFFATIVFTAPTFYRQMAPLVAHHDISTLKKTVSAGEALPDSTRRLWRDASGIDMIDGIGGTELIHIFISAQGDEIRPHAIGRAVPGYAVQAVDDDMRPVAPGTIGKLAVRGPTGCRYLADERQQKFVRDGWNLPGDSVYLDADGYVFYQARADDMIVSAGYNISGPEVESVLLQHDAVSECGVIGAPDETRGQIVKAFVVVNPGYVADDKLIAQLQDFVKNSVAPYKYPREIVFVDTLPRTETGKLKRFELR

SEQ ID NO: 4717 - protein, 158 aa, Burkholderia fungorum
LTIHIRPARAADAALILRFITELAVYEKAEHEVVASVKDIEASLFSASASAKALICEMNGEPIGFCVYFFSYSTWLGKQGLYLEDLYVSPASRGSGAGKQMLRHLARIACDTGCGRFEWSVLDWNEPAIGFYESIGASAQSEWVRYRLAGDALKKFAE

SEQ ID NO: 4718 - protein, 575 aa, Burkholderia fungorum
FTLHGIPVSRGIAIGRAYLIAPAALDVDHYLIEPAQIDGEVERFRAAQQHVHRELDALRADLAADAPSEMGAFINVHSMILNDAMLVQETIDLIRTRRYNVEWALTEQLERLSRHFDDIEDEYLRERKADIEQVVERVLKALAGASVALVDGVHGACDEMIVVAHDIAPADMMQFKTQTFQGFVTDLGGRTSHTAIVARSLGIPAAVGVQHASALIRQDDLIIVDGDHGIVIVDPAPIVLEEYSYRQSEKALEQRKLQRLKFSPTQTLCGTRIELCANIELPEDARAALEAGAMGVGLFRSEFLFMNHKDRLPEEEEQFAAYRRAVELMNGLPVTIRTIDVGADKPLDSMGGGDGYETAANPALGLRAIRWSLSEPQMFLTQLRAILRASAFGTVKILIPMLAHAQEIDQTLDLIREAKRQLDDAGIAYDPNVQVGAMIEIPAAAIALPLFLKRLDFLSIGTNDLIQYTLAIDRADNAVAHLYDPLHPAVLHLIAFTLREAKRAGVPVSVCGEMAGDPALTRLLLGMGLTEFSMHPSQLLVVKQEVLRAHLKTLEKPVADVLASFEPEEVQAALK

SEQ ID NO: 4719 - protein, 245 aa, Burkholderia fungorum
KLVLIRHGESTWNKENRFTGWVDVDLTEQGNNEAQQAGVLLKDSGYTFDIAYTSVLKRAIRTLWHVQDKMDLMYLPVVHSWRLNERHYGALSGLNKAETAARFGDEQVLVWRRSYDTPPPALEPTDERAPYNDPRYAKVPREQLPLTECLKDTVARVLPLWNESIAPAIKSGRQVLIAAHGNSIRALVKYLDDISDNDIVGLNIPNGVPLVYELDENLRPIKHYYLGDQEAIAKAQAAVARQGKA

SEQ ID NO: 4720 - protein, 101 aa, Burkholderia fungorum
LSAAEATQLINRRNAAVIDLRPSADFAKGHLPAARHLEFAELQAKVAQLVKNKTNPVLLVCQTGQQSNKAARIVQDAGYAEVHVLEGGVDAWQKAGMPVVK

SEQ ID NO: 4721 - protein, 309 aa, Burkholderia fungorum
TQCCGARQPALIADLRASHENARYLAGVALPPALRYETDLNAALDHALADNALCVVATPVAGLRGLFRAMRDAGKVPAHVVWLCKGFEADSQLMPHQVVAAELPEHGSNGVLSGPSFAREVGQGLPVALTIASASAACRERTVAAFHHGAMRIYTGDDVVGVEVGGAVKNVLAIATGIADGLGLGLNARAALITRGLAEMSRLGVTLGGRAETFTGLTGLGDLILTATGDLSRNRTVGLQLAAGRTLDDILGGLGHVAEGVRCAQAVLAIARAHAIEMPITQAVCAVLFDGVAPRDAVSALLRRDSKAE

SEQ ID NO: 4722 - protein, 337 aa, Burkholderia fungorum
SNMLKEALASAETVAAQLMDTSRVEALAAKLAQQPRHVALTVARGSSDHAASYFASLTMSRLGVPVASLPMSVATLQQAPLQVCDQLALAFSQSGKSPDLVGTMEALRKAGALTVAAVNVSGSPLADACEFELPLVAGPELSVAATKSYIAMLSISAQLVAHWQKDAELLAALKTLPEALRAAGKLDWSNAVEELRGVERMIVIGRGLGLAIAQEAALKLKETSGIQAEAFSSAEVRHGPMELIDRDYPLLVFAPRGPEQAGLLQLARDMQARGARVLLAAPADVPEATLPLAITAHAALDPIAAILSFYVMAAGLAAARGRNPDAPRHLNKVTETH

SEQ ID NO: 4723 - protein, 847 aa, Burkholderia fungorum
HIVLLAPMTGPVVPLANVPDPVFSGGMFGDGIGIDPLEGRLVAPCDGTVTHLARTGHAVTLATAEGAEILLHIGIDTVALNGKGFAPMVAQGAHVRAGQVLIEFDQDQVALNAPSLVSVVAIANSDAFEIVERVQGGLLKAGETPLLVLRARGGAAAEASRQASATNVAEEARQQVTLVHAGGLHARPAARAREAARGFDARVEVRYEGRKAAIESVVGLLGLGAGEGATVELLGIGPQARAAIEAIAHELTREAQGEAEEKPARESSPAPQAVGHAADEALAPNTLAGVCAAPGVAVGKLVRWDDADIDPPEKAAGTSAAESRLLDKAIATVDADLGTTVRDASQRGAVGEAGIFAVHRVLLEDPTLLDAARDLISLGKSAGFAWRAAIRAQIAILAKIEDALLAERAADLRDIEKRVLRALGYTNAASRTLPEEAVLAAEEFTPSDLSTLDRSRVTALVMARGGATSHAAILARQAGIPALVAVGDALHAIPEGTQVVVNATTGRLEFAPTELDVERARLERSRLAGVREANRRTSQQAAVTSDGRAIEVAANIATLDDAKTAVENGADSVGLLRTELLFIHRAAAPTTDEHRQSYQAIVDALSGRTAIIRTLDVGADKEVDYLTLPPEPNPALGLRGIRLAQVRPDLLDDQLRGLLAVRPLGAVRILLPMVTDVGELIRIRKRIDEFARESGRTEPIEVGVMIEVPSAALLADQLAQHADFLSIGTNDLTQYTLAMDRCQADLAAQADGLHPAVLRLIAATVQGAGKHGKWVGVCGALAGDPLAMPLLIGLGVTELSVDPVSVPGIKARVRNLDYQLCRQRAQDALALESAQAVRAASRETWPL

SEQ ID NO: 4724 - protein, 531 aa, Burkholderia fungorum
  unsure (1)..(531): unsure at all Xaa locations
IHVRDLVRSFGAVQAVRGVSLDIERGEIFGLVGPDGAGKTTIMRMLAGVLRPDAGEISLENIDVIAKPELAKAALSYMPQRFGLYEDLTVAENIFFYGELFGVSRKTNRTRSGELLEAAGLVPFRDRLAGQLSGGMKQKLGLVCALIHTPRVLLLDEPTTGVDPVSRRDFWAILYNLRESGVTIVLSTAYMDEAERCSRLALLHTGQIRQCDTPSRLKQTMPGALFAVVAADPRAVHDALVDAPGVLSALLMGDRVHVRVDDAARRLPELQARLAARSIANATVSSIEPGIEDVFVALVGSGSATXSAAAPVVEAVGLTKRFGAFTAVDGLNLSIAQGEVVGFIGPNGAGKSTTIRMLCGLLSPSAGRACVAGFDVGTQAEALRSHIGYMSQKFSLYGDLTCAKTCLFLRHLPGSPARNRRAYPLAISTAGLEGREDTLVRTLAGGWKQRLALGCANLHHPPVLFLDEPTSGVEPEARRRFWDLIHGLAAGGVTVLVSTHYMDEAEYCHRIALIDAGHLVAIGSPSELREQ

SEQ ID NO: 4725 - protein, 572 aa, Burkholderia fungorum
  unsure (1)..(572): unsure at all Xaa locations
MTPSEAFVETLAANGVTDMFGIMGSAFMDAMDIFAPAGIRLIPVVHEQGAGHMADGYSRVSGRHGVVIGQNGPGISNCVTAIAAAYWAHSPVVIVTPEAGTMGIGLGGFQEAKQLPMFQEFTKYQGHVTHPARMAEFTGRCFDRAMAEMGPTQLNIPRDYFYGQVKVEIPQPQRLDRGAGGEQRLNEAAELLAQARFPVIISGGGVVMADAIEECKALAERLNAPVVNSYLHNDSFPANHPLWCGPLGYQGSKAAMKLLSRADVVIALGSRLGPFGTLPQHGLDYWPTNAKIIQIDADHKMLGLVKKISVGICGDAKAAAVALTERLAGRTIASDATREERGAQIAAEKAAWEKELDEWTHERDAYSLDMIEEQKHERTPGGGAYLHPRQVLRELEKAMPEDVMVSTDIGNINSVANSYLRFNKPRSFFAAMSWGNCGYAFPTIIGAKVAAPHRPAVSYAGDGAWGMSLMETMTCVRHNIPVTAVVFHNRQWGAEKKNQVDFYNRRFVAGELDNQSFAAIARAMGAEGVVVDRLEDVGPALKRAIDAQMNRGKTTIIEIHVHPXTGRSVPPG

SEQ ID NO: 4726 - protein, 443 aa, Burkholderia fungorum
LKAGLKQRHMTMIALGGVIGAGLFVGSGVVVQQAGPAAVLSFLITGALVVLVMRMLGEMACAMPAVGSFYEYARLAFGGKRACGNLAGFLTGWMYWYFWVIVVAVEAVAGAKLVQFWLPDVPAWAISLVLLVTLTATNLVSVGSYGEFEFWFASIKVAAIMVFLFLGSMYVLGLWPASKHVTEVLPTLFSHGGLMPKGIGPVLSGAVAATGFYFGAEIVTIAAAEAQEPAKAVARATNSVITRVLVFYVGSILLVVALVPWNSPKMATPYVSALDAMGIPAAASVMNAIVLTAVLSALNSGLYAASRMIFALTRHGDAPAALARVNRRGVPVRAILIGTVFGYASVVMSYVSPDTVFAFLVNSYGTVAIFVYVLIAISQLKLRARIERDAPQTLRVRMWCYPYLTWVSIIGMVGILVAMAFIPEQRQPLWFGVASLGVLLLAY

SEQ ID NO: 4727 - protein, 519 aa, Burkholderia fungorum
IGVDVGTGSARAGLFDLAGHMVASAKRDITLFHASGSIVEQSSGEIWIAVCDAVKDALSQAAVSPDQVAGIGFDATCSLVVLGAGGRPLPVGPSEQAERDIIVWMDHRAVAQAERINATGHEVLNYVGGKISPEMETPKLLWLLENRPAVFAAARQFFDLTDFLTWRATGDLSRSTCTVTCKWTYLAHERRWDESYFRSVGLGVLADEAFARIGQTVVDPGTPLGSGLTADAAAQLGLRTGTPVATGVIDAHAGGIGTVGADGDPEACLAYVFGTSSCTMTTTRSPVFVPGVWGPYFSAMVPDAWLNEGGQSVAGAAIERLLAMHPAAADAKRRAEHEGQSLPAMLAALAVQAADSLSEAAVLADGLHVVPEFLGNRAPLADPHARAVIAGLGMEDDLDSLVALYIAGICSVGYGLRQIIEAQANAGAPIARVVISGGAGRLDLVRQLLADATGKPVLATQAEEPVLLGAAMLGSVAGGQFGDVRSAMARMSQISKTYQPDTGKIAGLHEARYRAFLKL

SEQ ID NO: 4728 - protein, 433 aa, Burkholderia fungorum
DLSSFWMPFTANRQFKAAPRLLESAKGMYYRSTDGREVLDGCAGLWCVNAGHGREEIIAAITQQLSTLDFAPTFQMGHPLAFEAATKVAELMPEGLDRIFFTNSGSESVDTALKIALAYHRSRGEGQRTRLIGRERGYHGVGFGGISVGGIAPNRKTFSGALLPAVDHLPHTHNLEQNAFSKGQPAWGAHLAEELERIVTLHDASTIAAVIVEPVAGSTGVLIPPQGYLQKLREICTKHGILLIFDEVITGFGRVGKATASEYFGVTPDLITMAKAINNAAIPMGAVAASRTVHDTIVNSGAQGAIELFHGYTYSAHPAATAAAIATLDLYRREGLFERAATLAPTFEAAAHSLRGAKHVKDVRNIGLIAGVELESRDGAPGARAYEAFVKCFEAGVLVRFTGDILAFSPPLIINEEQIAHIFKTVGDVLATV

SEQ ID NO: 4729 - protein, 183 aa, Burkholderia fungorum
SREEAEAAVRVLLRWAGDDPAREGLIDTPARVVRSYEEFYAGYQVDPREILARTFSEVDGYDEMIVLKDIRFESYCEHHMVPIIGRAHVAYLPEHRVVGISKLARLVDAFAKRLQIQEKMTVQIADTLNEVLQPAGVGVILEAAHQCMSTRGVHKAGVTMVTSRMLGTFRTDPSTRREFLSIV

SEQ ID NO: 4730 - protein, 676 aa, Burkholderia fungorum
ALDQLCINTIRTLSMDAVQKANSGHPGTPMALAPVAYHLWQNHLRYDPDEPLWPDRDRFVLSVGHASMLLYSLLHLANVKAVDDDGNPTDGPAVSLDDIEHFRQMGSKTPGHPEYRMTTGVETTTGPLGQGLGNSVGMAMAARWYESHFNKPDAPLFDYRVYALCGDGDMMEGISHEAASLAGHLKLSNLIWIYDSNRVTIEGHTDLAYSDDVETRFRGYNWHTLHVSDANDAAALEAAFVEAKSITDRPTLIVVHSIIGWGAPHKQDTSAAHGEPLGVEEVALAKKAYGWPEDKFFYVPDGVHERFAAGIGARGKAAREEWQAKYDAYSRKYPELAREFAQIEAHELPAGWDSDIPTFDADPKGVASRESSGKVLNAIAARVPWMIGGAADLSPSTKTNLKFEGAGSFEYDNYGGCNLHFGIREHAMGAAVNGLALSNLRPFGSTFLIFSDYMKPPIRLSAIMEVPAIYVFTHDSIGVGEDGPTHQPIEQLASLRGVPGLTVLRPGDANEVAEAWRVALADPRRPSCIVVSRQPLPTLDRSRYAAAKGTQKGAYVLADAADGQKPQVILIATGSELSVCVDVYEKLTSEGIAARVVSMPSWDIFERQDEAYQDSVLPPDVDARVAVEQAASLGWDRYVGRLGAQVVMHTFGASAPLAELKKKFGFTPEHVYEAAK

SEQ ID NO: 4731 - protein, 284 aa, Burkholderia fungorum
MSDTQRPTPPFPKQQQNHTPGHTAEMQPQPDHGERSYRGSGRLAGKAAIVTGGDSGIGRAVAIAFAREGADVLISYLDEDDDARETARWIEEAGRKAVLLPGDITNPAHCKAIVERAIEAFGRLDVLVNNAAYQMSYPSLDAISDQEWDKTFDTNIGAMFRITRAAVKHMKPGAAIVNTTSINADHPNPGLIAYAATKGAIQNFTGGLAQLLAEKGIRANCVAPGPIWTPLIPSTMPPEKVEQFGAQVPMKRPGQPAELAAAYVMLASDEASYISGATIAVTGG

SEQ ID NO: 4732 - protein, 742 aa, Burkholderia fungorum
  unsure (1)..(742): unsure at all Xaa locations
IAEGTPFPLGATWNGSGVNFALFSAHATKVELCLFDETGENEIERIELPEYTDEVWHVFVPNLKPGAVYGYRVHGPYEPEKGHRFNPNKLLLDPYAKAHIGELKWAPEIFGYTLDSEEGDLSFDERDSAPFVPKCKVVDANFSWSHPERNALPWERVIFYEAHVRGFTKRHPEVPENLRGTFAGLGQQVVLDYIKNLGVTSVELMPIQTFVNDSYLLDKGLTNYWGYNTIGFFAADPRFFASSIDSVGEFKEMVDRFHNANLEVILDVVYNHTAEGNERGPTISFKGIDNASYYRLMPDEPRYYINDTGTGNTLNLSHPRVLQMVTDSLRYWVTEMKVDGFRFDLATILGRELHGFDEGGGFLDSCRQDPVLSSVRLVAEPWDCGPGGYQVGGFPPGWAEWNDRFRDTVREYWKGDEGKVPDLATRLTGSGDKFNHRGRRPWASVNFIAAHDGFTLNDLVSYNDKHNEANGEDNKDGHSDNKSWNMGVEGPTDDPDIRQQRERQKRNLLATLLLSQGTPMILAGDEFGRTQKGNNNAYCQDNEISWVDWEAIDDDGRALIEFVRNLTTLRHRLPVLRRGRFLTGEYNEALDVTDARWISPDGKDLSQEQWDDASMRCFGLVIDGRAQASGIRRPASDATLLLVLNAHHDVVNFTLPDIPEGQRWTCLLDTNMPVRSELPHFAAGDAYQVTARSLLLLALEAPSRATQRVFDRLEEQLTTEDSEPPAQAXRTGTKTVVKQALP

SEQ ID NO: 4733 - protein, 328 aa, Burkholderia fungorum
ELQATIKAMVQPGKGLLAADESGPTIAKRFKTIGLESSEENRRAYRNLLLTTPGLGEFVSGVILYEETLGQKADDGTPFPQLAAKNGIVPGIKVDLGKIALALAPGDEITEGLDGLARRFVDYKRQGARFAKWRAVYNITASLPSRLAIEANADSLARYAAISQEAGIVPIVEPEVLMDGEHTIERSAEVTEAVLHAVFHALHRHRVVLEHILLKPSMVIAGSEHAQQSSTADIAAYTVRVLKRTVPSAVPGIVFLSGGQSPEEATANLDAMNRLGALPWNLSFSYGRALQEPPLQAWKGERSHVEQAQQALLKRARLNSAAALGKYE

SEQ ID NO: 4734 - protein, 337 aa, Burkholderia fungorum
MQLGMIGLGRMGADMVRRLTKGGQQCIAYDVQPAAVEKLKQDGVAGAASLEDLVAQLDKPRAVWLMVPAAVVDMTLEKLVPLLEPGDIVIDGGNSYYHDDIRRGAELAKRQLHYVDVGTSGGVAGRERGYCLMIGGEPEVVKRLEPVFSTLAPGAGTAPATPGRVSGSSTADQGFLHCGPLGAGHFVKMVHNGIEYGMMAAYAEGLNILRHANAGKHAREADAETTPLRRPELYQYELNLADVTEVWRRGSVIGSWLLDLIAGSLVSDADLKNYAGRVSDSGEGRWTVAAAIDEGVPTPVLSAALFARFSSRGEADFANRVLSAMRHDFGGHVEKAA

SEQ ID NO: 4735 - protein, 152 aa, Burkholderia fungorum
IDPELLELAQQVFDLARRGDAAMLAAVIEKGVPPNLRNDKGDSLVMLASYHGHVDAVRTLLERGADPDLRNDNGQTPIAGAAFKGFDSVIETLLAHGADVEGASPDGRTALMIAAMFNRTAIMELLIAHGANPKARDANGVTAMDAAGRMGA

SEQ ID NO: 4736 - protein, 651 aa, Burkholderia fungorum
SVLQERRVFPPSAETVAAATISGMDAYRALAAEAERDYEGFWGRLARETLSWNTPFTKVLDESKAPFYTWFEDGRLNASYNSIDRHVEAGNGARVAIIFEADDGTVTNVTYQDLLQRVSRFANALKKRGVKKGDRVVIYMPMSIEGIVAMQACARIGATHSVVFGGFSSKSLNERLVDVGAVALITSDEQMRGGKALPLKNIADEALAMGGCEAVRSVIVFQRTGGKIAWNADRDLWMHELTQAEPDQCAPEWVGAEHPLFILYTSGSTGKPKGVQHSTGGYLLWAAQTMKWTFDWKPTDVFWCTADIGWITGHSYITYGPLTLGGTQVVFEGVPTYPNAGRFWDMIARHKVSLFYTAPTAIRSLIKAADADAKVHPKSYDLSTLRIIGTVGEPINPEAWVWYYENVGGSHCPIVDTWWQTETGGHMITPLPGATPLVPGSCTLPLPGIMAAVVDETGQDVPNGQGGILVVKRPWPSMLRNVWGDPDRYRKSYFPEELGGKLYLAGDGAVRDKETGYFTIMGRIDDVLNVSGHRLGTMEIESALVSNPLVAEAAVVGRPDATTGEAVCAFVVLKRSRPEGEEAVKLANELRNWVGKEIGPIAKPKDIRFGENLPKTRSGKIMRRLLRSLAKGEEITQDVSTLENPAILDQL

SEQ ID NO: 4737 - protein, 416 aa, Burkholderia fungorum
LRGRVVEARGVIARVVGVSLRIGEKVRLVRPDTLEAQYGEVVGFTHDGALVMPLAGLNGLSDITEVQGCGSAWGTFDAAGLLGRVVDGLGNPLDGGPVPRPLASAAAQAGEGTLNPLERPVIATPFATGVRAIDGLLTCGVGQRTGIFAPAGGGKSTIMGMIANGASTDAIVVALIGERGREVAEFIHDHLERRRASTIVIAATSDRPAAERIKAAELASQVAVGLRASGRNVLLLFDSLTRYARALRELGLAVGEPPLRGGFPPSVFAQLPRLIEAAGVTAQGSITAFYTVLADEADLSDPVAEEARSLLDGHIQLSSKLGAAGHYPAIDILRSRSRLMTRVAAAVHQADANRVRDWLARYEDVELLLQIGEYQRGNDADTDQAIDRRAAIVSFLRQRYDTRCGWDDTRRQLHAL

SEQ ID NO: 4738 - protein, 398 aa, Burkholderia fungorum
MSLFSAVELAPRDPILGLNEAFNADTRTTKVNLGVGVYFNEEGKIPLLRAVRDAEKARVDAALPRGYLPIEGIAAYDAAVQKLLLGNDSPLIAAGRVVTAQALGGTGALKIGADFLKRLNPNAKVAISDPSWENHRALFEGAGFEVVSYPYYDAHTHGVNFDAMLSALNSYAAGTIVVLHACCHNPTGVDLNIEQWKQVVEVVKARNLVPFLDIAYQGFGDNIEADAAAVRLFAAAELNVFVSSSFSKSFSLYGERVGALSIITASKEEAARVLSQLKRVIRTNYSNPPTHGGSVVAAVLASPELRATWETELAEMRDRIRAMRNGLVERLKASGVDRDFSFVNAQRGMFSYSGLTAPQVDRLREEFGIYAVSTGRICVAALNTRNLDAVANAIAHVL

SEQ ID NO: 4739 - protein, 255 aa, Burkholderia fungorum
KVAVVTGAASGIGKQIALTLSAAGAAVAIADLNQDGANAVAEEIRKGGGKAIGVAMDVTNEDAVNQGIDKVAAELGSVDILISNAGIQIVNPIENYSFSDWKKMQAIHVDGAFLTTKAALKHMYKDDRGGIVIYMGSVHSHEASPLKSAYVTAKHALLGLSRVLAKEGAKHNVRSHVVCPGFVRTPLVDKQIPEQAKELGISEEDVVKRVMLGGTVDGVFTTVEDVAQTVLFLSTFPTAALTGQSFIVSHGWYMQ

SEQ ID NO: 4740 - protein, 414 aa, Burkholderia fungorum
HKVLYVQVIVAIIIGIGLGHFYPDLAVDMKPLGDGFIKLIKMVIGPIIFCTVVTGIAGMEDMKKVGRVGGKALLYFEIVSTFALVLGLIATHVLKPGVGFNIDPATLDGKAVASYAAKAHGQTTVDFLMHIIPDTLVSAFAQGEILQILLIALLFGAVLATAGEKGKVVTGFIDGLSHVLFGIVRIITKLAPIGAFGAMAFTIGKYGIGSLLPMLKLIGTFYLTSVVFVVVVLGIIARAVGFNILRFVAYIKEEMLIVLGTSSSEAALPQLMLKLERLGCSRSVVGLVVPTGYSFNLDGTNIYMTMAVLFIAQATNTDLTWTQQLTLLAVTMLTSKGASGVTGAGFITLAATLAVVPTIPLSGMVLILGIDRFMSECRALTNIVGNGVATVVVSAWEKELDRSKLNAALRGDVA

SEQ ID NO: 4741 - protein, 387 aa, Burkholderia fungorum
IVIVGVARTPMAAFQGDFATLSAPQLGSVAIQAAVQRAGLKPEQIDEVVMGCVLPAGLGQAPARQAALGAGLPLATGSTTVNKMCGSGMRAAMFAHDMLAAGSVDVIVAGGMESMTNAPYLLPKARAGMRMGHGQVIDHMFYDGLEDAYEKGRLMGSFAEECAASFDFTREAQDAFAVESLARAKRANEDGSFAWEIAPVKVESRKGEVTIDRDEQPFKANIEKIPTLKPAFSKTGTVTAANSSSISDGAAALVMMRESTAKRLGVQPIARVVGHSTLAQEPAKFTTAPVGAIRKLFEKNGWRADEVDLFEVNEAFAVVTMAAMKEHHLPHEKVNVNGGACALGHPIGASGARILVTLIGALKKRGGKRGVATLCIGGGEATAMGIE

SEQ ID NO: 4742 - protein, 330 aa, Burkholderia fungorum
RTTLTKYLIEQQRETNNLPADLRLLIEVVARACKAISYHVSKGALGDALGTAGSENVQGEVQKKLDILSNEILLEANEWGGNLAGMASEEMEQFFPIPANYPKGEYLLVFDPLDGSSNIDVNVSIGTIFSVLRCPDGQQPTEQSFLQPGTQQVAAGYAVYGPQTVLVLTTGNGVNCFTLDRELGSWVLTQSDMRIPVETREYAINASNERHWYPPVQQYIGELKDGKEGSRQSDFNMRWIASMVADVHRILNRGGIFMYPADKRTPDKPGKLRLMYEANPMAFIVEQAGGAATNGEKRILDIQPKSLHERVAVFLGSKNEVDRVTRYHLE

SEQ ID NO: 4743 - protein, 506 aa, Burkholderia fungorum
VVIGGRKLTIEEVVAIARHRAPVALSADPAWRARIQRGADFLRRHLAAGATVYGVNTGYGDACVVDVPMELVEALPLQLTRYHGCGMGQYLDEAQTLAVIAARLNSLAYGFSGVRPVLLERLADLVNHRVLPRIPSEGSVGASGDLTPLSYVAAALAGERDVMFEGQLRNVREVWTELGQTPLTLAPKEGLALMNGTAVMTGLACLAFARADHLTRLTARLTALCTVALDGRAAHFDAMLFEVKPHAGQAEAAAWIRDDLAGRDDTPGHRLQDRYSIRCAPHVIGVARDALSWVRRDIENELNSANDNPLIDPDNERVLHGGNFYGGHIAFAMDSLKVAVANLADLMDRQLALLVDVNFNNGLPRNLSGATSARAAINHGFKAVQISSSAWTAEALKNTMPASVFSRSTEAHNQDKVSMGTIAARDCLRVLELTEQVAAAHTLATVQAARLRLKIDSGTPVPAPLRTFMESVSAQSPFVDEDRALEHELRALTARIAACDLLRDYR

SEQ ID NO: 4744 - protein, 388 aa, Burkholderia fungorum
VYLHALGMINALGGDLDSIVPALAAGRSPGMANAHTGIGEAFVGSVLAPLELAPRAELARYDCRNNRLLLAALAQIAPAVEAARERYGAHRVGVVLGTSTSGIEAAEAAFVYQAQAGDLPANFNYRQMEIGTAAPFAAAALGLHGPAFTISTACTSSAKAFASARRLLQLQLCDAVVVGGVDSLCELTVQGFASLESTSNVRSNPMSRNRCGINVGEGAAVFLMSRDEAMVRVAGVGESSDAHHISSPDPQGVGGELALRAALADAGVESAAIGYVNLHATATRKNDEMEAHLMSRVFPGGVPTSGTKPLTGHQLGAAGATELGFAWLTLARENVPLPRHLWDGEADPALPPLDLVESERFLPQGGAQYAMSNSFAFGGSNVSLILAR

SEQ ID NO: 4745 - protein, 240 aa, Burkholderia fungorum
MSRRVLVTGASRGIGRAIAYKLAADGFAVSVHCRTGRSEADAVATGIAAQGGTARVLQFDVRERAVCREVLEADVAANGPYYGIVCSAGVTRDAAFPALSGEDWDVVIETGLDSFYNVVHPLTMPMVRARQGGRIVTIASVSGVMGNRGQVNYSAAKAGLIGATKALAVELATRNITVNCVAPGLIETGMLDELPLEQVLKTVPMNRVGQPAEVASVVSFLMSDAASYVTRQVIGVNGGM

SEQ ID NO: 4746 - protein, 407 aa, Burkholderia fungorum
LMKRVVITGMGGVTALGDSWDVIETRLRSGVNAVRRMPEWDYFESLHTRLACPLPGFTMPAHYPRKKTRSMGPVSMYSVRASELALADAGLADDATIKDGRMGVAYGSSSGSVQPIRAFGTMLETGSMSDVTSNSYVQMMPHTTAVNVSLFWDLKGRIIPTSCACASGSQAIGYAYEAIQTGKQTLMLAGGAEELSGPAVAVFDTLYATSTRNDEPHLTPRPFDAARDGLVVGEGAATLVLEEYGHAVARGARIHAEIVGFGCNSDGAHMTQPTAETMALAMQLALRDAQLAPEAIAYVNAHGTSTDRGDIAESHATAQTFGAHMPISSLKSYVGHTLGACGALEAWWTIEMMKRNWYAPTLNLTRVDPACAPLDYIAGTGRQIDAEYVMSNNFAFGGINTSLIFRR

SEQ ID NO: 4747 - protein, 407 aa, Burkholderia fungorum
LQRVVVTGMGIVSCLGNTLDEVASALRAGRSRIQRIDAWRERGFASQVAGVASVAHEPPFERKLERFMGDTARFACHAARNAISDAGLDAAALRSPRAGTVIGSGVGTMSTYDAAMATAHARGVDKVPPYTVPHAMSSTASANVAQVFGLEGVSYSPSSACTTSALAIGQAMQLIQTGRQQIVLAGGSESLHDNMTLMFDAMGALSRRFNDTPQRASRPYDTERDGFVIASGGGVLVLESLEYALARGARIYAELTGFGDCTDSAGMVAPRAAGIARAMRGALHEAGKRPDYVNTHAPSTPLGDTEELRALSEVFGAAFDRRVPAFSSTKGMTGHPLGACGAHEAIYTLLMMRDGFIAGTAGIDTPEPAVDGMPLVRVTREARIDTAMSVSFGFGGSCASLVFEAWQ

SEQ ID NO: 4748 - protein, 929 aa, Burkholderia fungorum
SFFDDTDYGTPERHADIDVTLEIDGQSVTVPAGTSVMRAAVEAGVNVPKLCATDSLEPFGSCRLCLVEIEGKRGYPASCTTPVEAGMKVRTQTDRLQSLRRNVMELYISDHPLDCLTCPANGDCELQDMAGVTGLREVRYGFDGANHLKDKKDESNPYFTYDASKCIVCNRCVRACEETQGTFALTIAGRGFESRVAASENVPFMESECVSCGACVAACPTATLQEKTVIMLGQAEHSVVTTCAYCGVGCSFKAEMKGNQVVRMVPHKNGQANEGHACVKGRFAWGYATHKDRITRPMIRAKITDPWREVSWEEALTYAASEFRRIQAKHGRDSIGGITSSRCTNEETYLVQKLVRAAFGNNNVDTCARVCHSPTGYGLKTTLGESAGTQTFASVDKADVIMVIGANPTDGHPVFGSRLKRRVREGAKLIVVDPRRIDIVDTPHVKASHHLQLRPGTNVAVVNALAHVIVTEGLVNEAFVAERCETRAFEQWRDFVALPENAPEATEAATGVPAQAVREAARIYATGGNAAIYYGLGVTEHAQGSTMVMGIANLAMATGNIGREGVGVNPLRGQNNVQGSCDMGSFPHELPGYRHISDTVTRTLFEEAWNVTLQPEPGLRIPNMFDAAVHGTFKGLYCQGEDIVQSDPNTHHVSAALSAMECIVVQDIFLNETAKYAHVLLPGSSFLEKDGTFTNAERRISRVRKVMPPVPGYADWEVTVLLARALGYEMDYTHPSQIMDEIARLTPTFHGVSYKKLDELGSIQWPCNENAPDGTPTMHIDTFVRGKGKFVITKFIATPEKVTRKFPLLLTTGRILSQYNVGAQTRRTENSRWHDEDRLEIHPHDAEERGIRTDDWVGIESRAGQTVLRAKVTERMQPGVVYTTFHFPESGANVITTDSSDWATNCPEYKVTAVQVMPVEQPSQWQRDY

SEQ ID NO: 4749 - protein, 452 aa, Burkholderia fungorum
SISARLDRLPATRSIWKLVVLLSLGFFFELYDLLYSGYVAPGLVKSGLLTATTHGLFGSTGVASFIAALFSGLFIGTIACGFLADRFGRRAVFTYSLLWYTAANIVMAFQETATGLNFWRFLAGIGIGVELVTIGTYISELVPKQIRGRAFACEQAVGFTAVPVVAFLSYLLVPRTLLGLDGWRWVVLIGAHGALFVWWIRRALPESPRWLAQQGRLAEADRVMTELEAKVRREYGRELPPPAPPVPVAPRGSFRDMWVPPYRSRTLMMTIFNIFQTVGFYGFANWVPTLLIKQGITITTSLMYSSVIALAAPLGPVIGLFIGDRFERKTVIVVMAGVNIVCGLWFSQAAGAVLLVSLGVGLTLAGNIISYSFHAYQAELFPTSIRARAVGFVYSWSRFSAIFTAFLIAAVLKHFGTGGVFVFIAGAMLIVMLAIGLMGPRTNGIELEKISK

SEQ ID NO: 4750 - protein, 260 aa, Burkholderia fungorum
SSNKRFTEKVVIVTGAAQGIGRGVALRAAAEGAIVVLADRAELVHEVEAEIAALGSPSLAVIADLETYAGACKLMRAALDAFGKIDVLINNVGGTIWAKPYEEYEEAQIEAEVRRSLFPTLWSCRAVLPAMIAQRRGAIVNVSSIATRSIYRVPYAASKGGVNALTASLAFEHADDGIRVNAVATGGTEAPPRKVPRNTAPQSEQEARWYRGIVDQTIASSLMRRYGTIDEQVGAILFLASDEASYITGTVLPAGGGDLG

SEQ ID NO: 4751 - protein, 436 aa, Burkholderia fungorum
AASTVRRSNARYKILTLLALGTMINYLDRTVLGIAAPQLTKELGINAALMGLLFSVFSWSYVASQIPGGLFLDRFGSKLTYFLSMTFWSLCTLAQGLVHGIGALFAFRLGLGVSEAPCFPTNSRVVATWFPQSERAMATGTYTVGEYIGLAFFSPFLFMLMGAFGWRSLFYVVGGIGLVFGGIWWIFYREPRDHPAANQAELDYIEAGGGLTNAKKNADAQGTAAGASTSGFEWRTIGRLLKHRQLAGICLGQFAGNSTLVFFLTWFPTYLATERHMAWLKIGFFAIMPFIAASIGVMLGGIFSDWLLRRGKSPNVARKLPIIAGLLLASTIVLANYVESNVVVIAILSVAFFAQGMAALGWTLVSDIAPEGLLGVTGGIFNFAANLAGIVTPLVVGFIVAASGSFVGALVFIGAIALVGALSYIFVVGDIKRIVL

SEQ ID NO: 4752 - protein, 281 aa, Burkholderia fungorum
ATPHSYLVGLIGSGIGGSLTPAMHEEEGSQLGLHYVYRRIDLEALKLDIAALPDLLIAAERMGFNGLNITYPCKQAVIPLLDELSGDARALGAVNTVLFKDGKRIGHNTDWSGFARAFQRGLPDVSLERVVQLGAGGAGAAVAHAALTLGAKSLTLFDVDASRAASLARELQKRFPAAAISAGSSLAGSLTAANGLIHATPTGMAKLPGLPLPVELLHRDLWVADIVYFPIRTALLQAAESLGCRTLSGGGMAVYQAVDAMRIFTGLEPDAERVYRHFQSL

SEQ ID NO: 4753 - protein, 145 aa, Burkholderia fungorum
SVLVLNGPNLNLLGTREPAIYGSETLDDIAKLCGDAAERLNLSIDFCQSNAEHQLIDWLHAARTKVDGIVINPAAYTHTSVAIADALSAIEKPVIEVHISNVHRREAFRHHSYVSAAADGVIVGCGTQGYVLALERMAAILEHRA

SEQ ID NO: 4754 - protein, 297 aa, Burkholderia fungorum
WEGVLPAVTTKFNADFSIDRAWTGKNIEAQIAAGVDGIIVCGSLGEASTLSLDEKLQVLDVAVEASRGRVPVLLTIAENSTLDACRQAEAGSRHGAAGYMVLPGLRYLSDRRETLHHFRSVADASALPLMIYNNPLAYGVDMTPDMFAEIADEKKVVAIKESCGDVRRVTDLINAVGDRFAILCGVDNLAMEAILMGAHGWVAGLVCAFPRETVVIYKLLKAGRFEEARAIYRWFAPLLALDVSAKLVQNIKLAEAIVGLGTEPVRPPRLPLAGDERKAVEALIRKALETRPALPQI

SEQ ID NO: 4755 - protein, 367 aa, Burkholderia fungorum
SAAQRDLEGGHAAQEKQWIADAGLLTLAVPREFGGLGARWPDIYETVRKIAQVDSALAHLLGFTCLQVVSVNVWGNPEQRARFLSGTVENRWWWGNAVNPLDTRLIATASGDGGYLLDGQKGFCSGTRGSQMMTVSAQDPVTGKPVFGVLPTTREGITVHEDWNPIGQRQTDSGSVSFVRVKLEPHEVMERPDTPHASLRTLISQLVLTNLFVGIAQGALDEARAYVTQHGKAWIYSGVDKATDDPYLIQRFGEMRLQAVSAEALATRAAWLLDDAWQRGAALSPETRAQVALATSEAKIVAHRAALDVSEQLFDACGARATHAPLALDRFWRNARVHTLHDPLDYRVRDVGRYALTGTLPEVSLYT

SEQ ID NO: 4756 - protein, 501 aa, Burkholderia fungorum
TMMNLKPGHLTLPQLRQIAREHVALQLDPASHAAIDACAQAVADIAAKGEPAYGINTGFGRLASTHIPHDQLELLQRNLVLSHAVGVGEPMSRPVVRLLIALKLSSLGRGHSGIRREVMDALITLYNADVLPVIPVKGSVGASGDLAPLAHMSAALLGVGEVFAKGERMPATEGLALVGLKPLTLQAKEGLALLNGTQASTALALYNMFAIEDLYRTALVSGALSVDAAMGSVKPFDARIHELRGHQGQIDAAAAYRSLLEGSAINVSHADCDKVQDPYSLRCQPQVMGACLDQMRHAANVLLLEANAVSDNPLIFPDTGEVLSGGNFHAEPVAFAADNLALAAAEIGALAERRIALLIDATLSGLPPFLVRDGGVNSGFMIAHVTAAALASENKTLAHPASVDSLPTSANQEDHVSMATFAARKLGDIAENTANILSIELLAAAQGVDLRAPHKTSPSLQKAMDTVRKDVAHYELDHYFAPDIAAVTRLVQNGTIAKLSP

SEQ ID NO: 4757 - protein, 483 aa, Burkholderia fungorum
IRALHVASELYPLLKTGGLADVAGALPPALIERGADVRVLLPGFPAVVAGLTELAPVAQLGRQFDAPGVTLERGTLASSGLIVYVIRASTLYDRPGNPYLNDEHVPYGDNAQRFALLGWVAAQLAQHLDPAWSPQIVHAHDWHAGLAPAYLKAAERQHGRSFARSVFTVHNLAYQGVFPAPQFGQLGLPADYFSMHGVEFYGQLSFLKAGLYFSDRITTVSPTYAREIQTLAQGGGLDGLLRHRSHDLSGILNGVDYTVWNPASDALLEDHYSATRLAGKLACKEALQKRFGLAQKSDALLFGVVSRLTEQKGLDLLLEAVPEIIKHGGQLVVFGTGDPALENGLKRVAHAHPEAVAVELGFDEKLAHTIVAGSDVIAVPSRFEPCGLTQLYALAYGSLPLVHCVGGLADTVVDASLENLADDLATGFMFERFELKGIGAAIRRAFALRERRTEWKATQRRAMRQDFGWGASAERYLALYREL

SEQ ID NO: 4758 - protein, 425 aa, Burkholderia fungorum
SIKETDMDTPARLNDLQRTTLAIVLAGGRGTRLGPLTNKRVKPAVHFGGKYRIIDFALSNCLNSGIRRIAVVTQYKAHSLLRHLQRGWSFLRGEFGEFIDLWPAQQRVEGAHWYRGTADAVFQNLDIIRSIRPKYVVVLAGDHIYKMDYTRMIADHAESGADCTVGCIEVPRMDAVAFGVMHVDENRRVTGFVEKPADPPAIPGRPDTALASMGIYVFSADYLYSLLEENISSVDTDHDFGKDILPRVVTQGTAIAHPFSMSCVSSDPNVEPYWRDVGTIDAYWAANLDLASTIPTLDLYDRSWPIWTYQEQLPPAKFVRDMKGLQGSGNNLIVCGGCVISGSQISRSVLSSNVKVSSFCNINEAVLLPQVTVGASCRLQKVVIDRGCAIPDGTVIGEDPVSDAERFYRTDDGVVLVTPEALRQM

SEQ ID NO: 4759 - protein, 390 aa, Burkholderia fungorum
MVPVFSPAAFVPDRGLGSRVWDTQGRDYIDFAGGIAVTALGHGHPELLKVLHEQGAKLWHIGNGYTNEPVLRLAKRLEELTFADRAFFANSGAEANEAALKLARRVAFERHGADKFEIVSFTQSFHGRTFFTVSVGGQPKYSEGFGPVPAGITHLPYNDIEAAKKAIGAQTCAVIVEPVQGEGGVIPADPAFLAALREACDQHGALLIFDEVQTGVGRSGYFYAYQETGVTPDILTTAKALGNGFPIGAMLTTNELAAYFKVGVHGTTYGGNPLGAAIAEKVVELISDPKLLEGVRSLSEALKGHLAKLNDRFGLFTEVRGRGLLIGAELTDAFKGRAKDFVTAAGQHGVIMLMAGPDVLRFVPSLIMPLDDMNEGFARLASAIEGIVGA

SEQ ID NO: 4760 - protein, 488 aa, Burkholderia fungorum
IMSELFIGGEWAAGTGPAFASRNPGTGAAVWEGNSASADDVDRAVRSARRAFAAWSASSVDERCAVVRRFAALVTERKEALAEAIGRETGKPLWEARTEAASMAAKVEISIQAYNERTGEKRSAMADGTAVLRHRPHGVVAVFGPYNFPGHLPNGHIVPALIAGNAVVFKPSELAPGVAALTVQIWRDAGLPAGVLNLVQGEKDTGIALANHRQIDGLFFTGSSDTGTLLHKQFGGRPEIVLALEMGGNNPLVIGPVADVDAAVHHTIQSAFLSAGQRCTCARRIFVPNDAAGDRFLERFTEVTSRITVGEYNADPQPFMGAVISVRAASRLVAAQERLLADGAKALLKMEQRDPKLGFVTPAILDVTNVANRPDEEHFGPLAQIIRYGSFNEALEQANDTEFGLSAGLLADDEALWAHFQRTIRAGIVNWNRPTNGASSGAPFGGPGRSGNHRPSAYYAADYCAFPMASVESAQLQMPASVSPGLQF

SEQ ID NO: 4761 - protein, 187 aa, Burkholderia fungorum
IPAPMQDEKAAATHSETAVFAGGCFWGVQGVFEHVRGVKEVASGYSGGAASTAQYETVSEGDTGHAESVRITYDPTQITYGRLLQIFFSVAHNPTELNYQGPDHGTQYRSAIFPVNAMQRGIAQSYIAQLDNAHVFSAPVVTRVENFKGFYPAENYHQNFLALHPDYPYIAINDLPKVADLKRMFPD

SEQ ID NO: 4762 - protein, 215 aa, Burkholderia fungorum
IQTSFLFDLDGTLVDSVYQHVLAWKEALDSEGIPLSVWRIHRKIGMSGGLFTHQLLRETHGEISAERVERLRHAHAAAYQRLRAQVCPLPGARALLDALTQAGTPWAVATSGRMETAALNLEALGVDPAKVVVVTRDDVKYAKPDPDLFVAAAGRLGVPVENTVVVGDSIWDMLAARRCRALGVGLLSGGYGTEELERAGALRVYDDPADLLEHL

SEQ ID NO: 4763 - protein, 481 aa, Burkholderia fungorum
LTLKDPSLLKTHAYIAGEWQGADDGSTFEVKNPATGEIIATVPRMGTAETRRAIDTANAAWPAWRATTAKQRAVILRKWHDLMMENADDLAKILTTEQGKPLAEAKGEIQYAASFLEWFAEEGKRVNGDTIPTPANDKRIVVTKEPIGVCAAITPWNFPAAMITRKVGPALAAGCPIIVKPAEATPLSALALAVLAERAGVPRGVFNVVTGEPKAIGAEMTGNPVVRKLSFTGSTPVGRLLMAQCAPTVKKVSLELGGNAPFIVFDDADLDAAVAGAIASKYRNSGQTCVCTNRFYVHDKVYDAFAEKLRVAVEQLKVGRGTEDGVTQGPLINEAAVLKVESHIEDALAKGARIVTGGKRHVLGHGFFEPTVLADVTPAMKVARDETFGPLAPLFRFSSDEEVIRLANDTEFGLASYFYSRDIGRVWRVAEALEYGMVGINTGLISNEVAPFGGVKQSGLGREGSHYGIDDYVVIKYLCVG

SEQ ID NO: 4764 - protein, 421 aa, Burkholderia fungorum
MKNAELKSRKDAATPRGVGVMCDFYAERAENAELWDIEGRRFIDFAAGIAVCNTGHRHPKIVAAIRDQLDHFTHTAYQIVPYASYVELAEKLNERAPGDYPKKTAFFTTGAEAVENAIKIARAATGRPGVIAFTGAFHGRTLMGMALTGKVAPYKIGFGPFPSDVFHAPFPNPLHGVTTADSLKAIEFLFKADIDPKRVAAIIFEPVQGEGGFYPAPAEFVRALRKLCNEHGILLIADEVQTGFARTGKLFAMNHYDVVPDLMTVAKSLAGGMPLSGVIGRADVMDAAAPGGLGGTYAGNPLAVAAAHAVLDIIDEEKLCERATLLGDRIKAKLIALQSDVPQIADVRGPGGMVAVEFCKAGTTEPDAEFTKRVQSRALERGLLLLVCGVYSNVVRFLFPLTIQEAVFDEALAILEDVIKD

SEQ ID NO: 4765 - protein, 248 aa, Burkholderia fungorum
IRIERLSKTFSNGRKALDEIDLRIEPGEMVALIGASGSGKSTLLRHIAGFTASDAQPSQIEILGRPIQQNGRIVREVRSIRRDIGFVFQQFNLVNRLSVETNVLIGALARLPWWRRLSGRFPRAERALSIAALNEVGIGEHARERAANLSGGQQQRAALARALVQRARIVLADEPIASLDPESSRRVMDMLRTLNIEHRLTVLVSLHQVEIAMQYCPRTIALRRGKVVYDGPSAALTPALLKTLYGDE

SEQ ID NO: 4766 - protein, 309 aa, Burkholderia fungorum
LCLGCMSYGVPSRGPHPWTLGDEAARPFIKQALDHGINFFDTANVYSDGTSEEIVGRALKDFAMRDEIVLATKVHGRMHPGPNGAGLSRKVIMAEIDNSLRRLGTDYVDLYQIHRWDYGTPIEETMEALHDVVKAGKARYIGASSMYAWQFAKALHVAERNGWTRFATMQNYVNLLYREEEREMLPLCESEGIGVIPWSPLARGRLTRDWNTGSARSETDEFGRTLYAQTEDADRRIVERVSEIAKERGVPRAQVALAWVLQKKPITAPIVGATKLHHLDDAVAALSLNLSADEIGRLEELYVPHAVTG

SEQ ID NO: 4767 - protein, 160 aa, Burkholderia fungorum
DDWQQVLSTNLTAQFLTAQAPVKEFRRRGPRPASRALGKIICMSSVHEVIPWAGHVNYAASKGGVQMFMKSLAQEVAPERIRVNSIAPGAIRTPINKDAWDTDAALQKLLKLIPYRRVGESQDIGKAAVWLASDESDYVVGTTLFVDGGMTLYPGFDDNG

SEQ ID NO: 4768 - protein, 254 aa, Burkholderia fungorum
RTVLVTGACGGIGSVLCKRFVEQGDTVLALDIDAAALNALTAQLGEAHVTPVAVDLGDAAAVQRAVAAAVEVRGPVDVLVANAGAAQGLTLATTDAASWQRDIHLNLNGTYHTVEAVRASMIERQRGVLVLIGSVNGMAALGHPAYSAAKAGLIGYTKALALELGRYGIRANIVCPGTVKTQAWQARVEKNPQVFEDLKKWYPLRDFATPDDIADAVLFLASPMARVITGVALPVDGGLMAGNRLMAEELTLES

SEQ ID NO: 4769 - protein, 541 aa, Burkholderia fungorum
SGDKHMDLFGQMMYAPLLLSSLLQQAARHSSKVEIVSRRVEGDIHRYTYRDCHIRAMQLANALTAHGIEAGDRIGTLAWNGYRHMELYYGVSGIGAVCHTINPRLFTEQIAFIINHAQDRFICFDMSFAPLVEQIAHQCPLVEKWIMLCDESALPETFPVPLVSYETLIGAQPQEFDWPRFDEQRAAVLCYTSGTTGNPKGVLYSHRSLSLMAYASALPDTLCLSSTDTVAPVVPMFHVNAWGLPFSAPLVGAKLVLPGAKLDGESLWTLFEQEGVTFSAGVPTIWLGLVDYMRRAGKRSAHFRRAIVGGSACPPQLASSLRELGIKAVHAWGMTELSPLGTVCSPSHDYADKTTEEQKCIDAKQGRVVPGIDLKIVGSGGAELPWDGKSAGDLMARGHWVLDRYYGAGQTALEDGWFSTGDVATIDPDGYMQITDRSKDVIKSGGEWISSIELEHVAMSHPEVESAACIGCEHPKWDERPVLIVVKRPGSTLSAQQLLAFYEGKVAKWWIPDDVVFVPEMPLTATGKLQKLVLKQRFGRY

SEQ ID NO: 4770 - protein, 594 aa, Burkholderia fungorum
YSAPIKDMLFVMKELAGLEHIATLPGFEDANLDTAQAVLEESAKLCSEVLAPLNVEGDRNPSSWKDGVVTATPGFSEAFRQFGEGGWQGVQHPVHYEGQGLPKLIATACIEMLNASNLSFALCPLLTDGAIEALLTAGSEEQKQTYVPRLISGEWTGTMNLTEPQAGSDLALVRTRAEPQGDGSFKLFGTKIFITWGEHDMAKNIAHLVLARTPNAPEGVKGISLFIVPKFLVNKDGSLGERNDVHCVSIEHKLGIKASPTAVLQFGDHGGATGHLIGEENRGLEYMFIMMNAARFAVGMQGVGVSDRAYQKAVAYAKDRVQSRPVDGSAKQPVAIIQHPDVRRMLATMRGLTEASRALAYVAAAHCDIAHRHADEATRAEHQAIYEYLVPIVKGWSTELSIDVTSLGVQVHGGMGFIEETGAAQYYRDARILPIYEGTTAIQANDLIGRKTVRDGGKVAKSLLAGVAETVEALGAQQGPAFASMKKYLAQGHRSLSAVVEFVVANTKSDPNAVFAGSVPYLKLAGIVLGGWQMARALLVAAEKRDEDPSFYGAKIATAQFYAEHVLPLASALEASIVSAKGGESVLALSEDQF

SEQ ID NO: 4771 - protein, 389 aa, Burkholderia fungorum
EVVVVSGVRTAIGKFGGSLKDVAPTELGALVVREVLARAGVAGDKVGQVVFGNVIATEPKDFYLARVAALNGGVGQTTPAFNVNRLCGSGLQAIVSAAQSILLGDADIAIGGGVENMSRAPYIAPDARFGARMGDARLIDMMLGALSDPFHTVPMGVTAENVAKKYGITREQQDALAVESHRRAAHAIAEGRFKDQILPVTRTVKGRPVVFDTDEHVRLQLDPAEISGLRPVFQKENGTVTAGNASGINDAAAAVLLMSREAADASGVKPLARLVSYAHAGVDPLYMGIGPVPATRLALQRAGLGIGDLDVIEANEAFAAQACAVAQELEFDPRKVNPNGSGISLGHPIGATGALITVKALYELQRIKGRYALVTMCIGGGQGIAAIFE

SEQ ID NO: 4772 - protein, 280 aa, Burkholderia fungorum
INTVGIIGAGTMGNGIAQVVAVAGLKVVLIDVTEAALAKGIATLTGSLDRLVAKGKLEAAVKEAALSRIETSTDYQRLAAVDIVIEAATENTDLKIRILRQIESVARPDAIIASNTSSISITALGAALTDASRFIGMHFFNPVPLLPLVEIIRGVQTSTATIEAVRELTVKLDKSPISVKNAPGFVVNRILVPMINEAFFVLAEGIATAEEIDLGMRLGANHPIGPLALADLIGLDVCLSVLDVFLKDFGDSKYRASPLLRELVAAGRLGRKVGQGVYRY

SEQ ID NO: 4773 - protein, 627 aa, Burkholderia fungorum
YRDFHRRSIEHPEAFWRDEARRIHWQTPFDTVLDRSNPPFARWFVGGRTNLCHNAVDRHLAERAQQNALVYVSTETGIERRYTYAELHAEINRMAAVMRSLGVKRGDVVLLYLPMIPEALFAMLACARLGAIHSVVFGGFAAPNLAARIDDAKPVLIVTADAGARGGKVIDYTPLVDEALARATHKTPRVLLIDRQLAPERLNASYLVAYEPLREQFFDAHVPCEWLESNEPSYVLYTSGTTGKPKGVQRDVGGYAVALAASMEHIFQGKPGDVMFTASDVGWVVGHSYIVYAPLLAGLTTVMYEGTPIRPDGGIWWRLVEHHGINLMFTAPTALRVLKKQDPAFLKQADLSSLRTLFLAGEPLDEPTAAWITDALGKPVIDNYWQTETGWPMLAIPRGVEALPTRLGSPGVPSAGFNLTLRNELTGEPCPPGEKGVLTLGYPLPPGCMSTVWGDDRRFVSTYWSSIPNQQVYSTFDWGVQDEDGYVTILGRTDDVINVAGHRLGTREIEEALSSHAAVAEVAVVGVTDALKGQAAMAFVVLRDAQAHAHADATRRGKLEAELMATVDRQLGAIARPARVVVVSMLPKTRSGKLLRRAIAALAEGRDPGDLPTIEDPAALQQVSDAL

SEQ ID NO: 4774 - protein, 786 aa, Burkholderia fungorum
PSRQMPDLLANLNPEQHAAVTLPNEPALILAGAGSGKTRVLITRIAWLIQHGLASPATILAVTFTNKAAREMMSRLSALLPIDTRGMWIGTFHGLCNRMLRAHHRDAGLPATFQILDTADQLSAIKRLMKGLNIDDEKYPAKNLQYFINNAKEQGLRPKDVDATDNFNRKFVELYEAYDQQCQREGVVDFPELLLRCYELLAHNPPLRAHYQARFRHILVDEFQDTNKLQYAWLKLLAGEANSIFAVGDDDQSIYAFRGANVGNMRDFEHEFNVRHLIKLEQNYRSHGHILDAANQLIANNSRRLGKNLRTDAGHGEPVRVYESATDSQEAGWIVEEIKALISTGTSRSEIAILYRSNAQSRTIEHTLVNAGIAYRVYGGLRFFERQEVKHALAYLRLIDNPNDDTAFARVVNFPTRGIGARSIEQLADAARQYNCSMAAAIPYVAGKAGSSLAGFANLIGKMRAETQQMSLPETVEYVVRASGLSEFYQNEREGQDRLENLQELVNAAAAFVSEEGYGMDTPARSIPLRPGATAAPELAVATDDPNTIVFDAPGIADPAQNPDTMTPLAGFLSHASLEAGDNQAQAGQEAVQLMTVHAAKGLEFTAVFITGLEEGLFPHENSAMESDGLEEERRLMYVAITRAKERLYLSFAQSRMLHGQTRYNIRSRFFDELPQETLKWLTPKIEPGARWGGRSDNAGYGRDWFARPGYTGAASSTPAPLPAFANEQRAAETGFRVGQQVFHTKFGEGTITALEGGGTDAKAQVKFKRHGEKWLALAVAKLQAV

SEQ ID NO: 4775 - protein, 291 aa, Burkholderia fungorum
MLKVTKAVFPVAGLGTRFLPATKASPKEMLPIVDKPLIQYAVEEAMAAGITEMIFVTGRSKRAIEDHFDKSYEIEAELQARGKDKLLELVRSIKPSHVDCFYVRQPEALGLGHAVLCAEKLVGDNPFAVILADDLLYGTPPVMAQMIEVFDHYHSSVIGVEEIPAQETKSYGIVDGKEWEDSIIKMSGIVEKPEPNVAPSNLGVVGRYVLKPRIFEHLRALKPGAGGELQLTDAIQSLLADEQVLAYKYHGTRFDCGSKLGYLKATVEFALRHPEVAADFEEYLRTRSPVL

SEQ ID NO: 4776 - protein, 328 aa, Burkholderia fungorum
SRDIVCLGRLAVDLYAQQVGARLEDVSSFAKYLGGSSANIAFGCARLGLASSMLARVGNDHMGRFLTETLTKEGCDVSHVRIDRERLTALVLLGLKDRDTFPLIFYRENCADMAVDEADFDEAFIASSKALLITGTHFSTEQVNRTSRRALDYARRNQVRTVLDIDYRPVLWGLTGKADGETRFVASEGVTAHLQRILPLFDLVIGTEEEFRIAGGKTELVDALAMVRAVTPATLVLKRGPLGCQIIDGQVPASLDNVPIHGGVEVEVLNVLGAGDAFASGFLSGWLRDQPLEACARAANASGALVVSRHGCAPAMPTPAELDYFLRE

SEQ ID NO: 4777 - protein, 382 aa, Burkholderia fungorum
MAYIFYLTHIHLGYDALSQLSSECGRVGIKRPLIITDKGVVAAGLAQRALDALKSGAVPVFDDTPSNPTEAMVLAAAQAYRGEGCDGLIAVGGGSSIDLAKGVAIAATHAGALTQYATIEGGSPKITAAAAPLIAVPTTAGTGSEVARGAIVILNDGRKLGFHSWHLLPKSALCDPALTLGLPPGLTAATGMDAIAHCIETFLAPAFNPPADGIALDGLERAWANIERATADGSDRDARLNMMSASMQGAMAFQKGLGCVHSLSHPLGGLTVNGKTSLHHGTLNAVVLPAVLRFNETADSVVAERRYARMRRVMTLPDNADLAQALFDMTARLGLPTGLRQMGVDESMFDKVIQGALADHCHRTNPREATADDYRRMLTESL

SEQ ID NO: 4778 - protein, 573 aa, Burkholderia fungorum
PDRLSPSRMNTERNDAPAASNFIRNIIDEDNRTGKWGQRVETRFPPEPNGYLHIGHAKSICLNFGVARSYGGVCHLRFDDTNPEKESVEYVDSIIDAVRWLGFEWEKDGKEQLYYASDYYDKLYEFAELLIQRGKAYVDSQSAEEMRANRGSATEVGTPSPFRERSVQENLDLFRRMKAGEFKEGEHVLRAKIDMSSPNFNMRDPVIYRIRFAHHYRTGDKWCVYPMYDYTHCISDALENITHSLCTLEFEDHRPLYDWILNELAEAGIFTRPLPQQIEFSRLNLTYAITSKRKLLQLVTEGHVDGWDDPRMPTIVGVRRRGFTPESIQLFCERIGITKVDSWIDMSVFEGALRDDLDEKAPRTAAVLDPVKLIIDNFPEGVTEPCNAPVHPHHPEMGVREFPISRELWIERDDYNETPPKGYFRLFPGNKVRLRYGYVIECIGADKDENGNIVAVHCNYFPDSKSGTEGANNYKVKGNIHWVSAAAACPAEVRIYDRLFKEPQPDAGGRDFLEALNPDSKRVVNAYLEPGAREALPEQRYQFERHGYFVADRVDSKPGKPVFNRIVSLRDSW

SEQ ID NO: 4779 - protein, 374 aa, Burkholderia fungorum
  unsure (1)..(374): unsure at all Xaa locations
DFIATLGHELRNPLGPIDSALAAAQKLAAGNPSVLSALALANRQVRQLKRLVSDLLDASRIRHGKLSVRHAYGLLGDIVKDAMAAVTDEAERRHQQLQVTLPEYPVTVFADAARLTQVVSNLLSNAVKYTPSGGEIRLRVDAPDPNTIPAHDSTPRDAIVTLRDNGMGIAPGMLPHVFDMFAQSPSARTRSDGGLGIGLSVVRYLVNAHRGEIAVVSEGEGNGTEVTVRLPIVCRSQLDHAAATTHGMSPARILLVDDNADATEALAMLLTLDGHEVRRAQSGPEALSIVESFTPDIALIDINMPGMDGHELARRLREHAQCSSTRLVALTGYAGTMPDSTAIESGFDHRLIKPPSLEDLAYVLRGXLDHQCRS

SEQ ID NO: 4780 - protein, 242 aa, Burkholderia fungorum
MAGELQGKVAVVTGAASGIGLASTQAMLTAGARVVLVDRDEAALTSICGEHGDAAFPLVVDLLDPAACSALVPHVLDIAGQIDILHANAGTYVGGELVEADTAAIDRMLNLNVNVVMKNVHDVLPHMIARRTGDIVVTSSLAAHFPTPWEPVYASSKWAINCFVQTVRRQVFKHGIRVGSVSPGPVISALLADWPEEKLKEAKESGSLLEASEVADAIMFMLTRQRGLTIRDVVLMPTNFDL

SEQ ID NO: 4781 - protein, 484 aa, Burkholderia fungorum
MFLGIDLGTTELKVLLLSSDGSVVGTARHSLEISRPRHRWSEQDPDDWWRATRIALSTLRNSHPDAFARVQAIGMSGQMHGAVLLGANDEPLRSAILWNDMRSASECAELEARAPRLREIAGNCAMPGLTAPKLLWLARHEPECFRRVSCVVLPKDYVRLRLTGIKLTDASDASGTLWLDVGRRQWSDELLHACDMTQMQVPRIVEGCQATGVVLASVASELGLSPNVLVAAGGGDTATSALGVGATEPGEGFLSLGTSGVLSVVTERFRPSPELGLHALCHAIPDRWHRTSVVLSAASCIRWLCKLTSADETALLAEVEGVSASGRTKAPLFLPYLSGERTPHNDPYAQGVFCGLNQSTDRATLAYSVIEGVTFALSDGLDALRTDGTQETLVNLIGGGARSTFWAQLLVDVLGIVLRRPFDTHYIAALGAARLGWLAAGGDFPVVVRTQSLSQEFFPDDERRQILSERLASYRFLYRQMRPL

SEQ ID NO: 4782 - protein, 605 aa, Burkholderia fungorum
MCGIVGAVAQRNIVPVLIEGLRRLEYRGYDSCGVAVLGSDGPRRARSVARVADLDEQVRESHLEGITGIAHTRWATHGAPVTDNAHPIFSKDALALVHNGIIENYETLRDMLRGKGYTFVSQTDTEVIAHLIHSLYHGDLFAAVREAVGQLHGAYAIAVLHKDQPHTVVGARQGSPLVVGLGEGENFLASDALALAGSTERFIFLEEGDVCELTLEGVRIADRDGYEAQREVRQVAAYGGAVELGPYRHFMQKEIFEQPRAITDTIPQADSFDPSLFGEGAGKVFAEIDSLLILACGTSYYSGLTAKYWLESIAKIPTQVEIASEYRYRESVPNPKSLVVVISQSGETADTLAALKHAQELGHKHTLAICNVGTSAMVRQTELAFLTHAGREIGVASTKAFTTQLVGLFVLAATLGKLRGRVSEEQEGEYLKQLRHLPAALNSVLALEPQIIAWSEEFSRKEHALFLGRGLHYPIALEGALKLKEISYIHAEAYPAGELKHGPLALVTEAMPVVTVAPNDALLEKLKSNIQEVRARGGQLYVFADADTKIVNDEGLHVIRMPEHYGLLSPILHVVPLQLLAYHTACARGTDVDKPRNLAKSVTVE

SEQ ID NO: 4783 - protein, 461 aa, Burkholderia fungorum
DFIVADMSLADWGRKELNIAETEMPGLVQTREEYKVQQPLKGARIAGSLHMTIQTGVLIETLTALGADVRWASCNIFSTQDHAAAAIAKAGTPVFAFKGESLDEYWEFSHRIFEWPNGEFANMILDDGGDATLLLILGSKAEKDRSVISKPTNEEEVALYKSIERHLDADPTWYSTRLAHIKGVTEETTTGVHRLYQMEKEGRLPFPAINVNDSVTKSKFDNLYGCRESLVDGIKRATDVMIAGKIAVVAGYGDVGKGCAQSLRGLGATVWVTEIDPICALQAAMEGYRVVTMEYAADKADIFVTATGNYHVIGHDHMKAMRHNAIVCNIGHFDSEIDVASTRQYQWDNIKPQVDHIIFPDGKRVILLAEGRLVNLGCATGHPSFVMSNSFTNQTLAQIELFTQGNKYENKVYVLPKHLDEKVARLHLARIGANLTVLSDEQAGYIGVDKNGPFKPNHYRY

SEQ ID NO: 4784 - protein, 524 aa, Burkholderia fungorum
YDYIIVGAGSGGCSLASRLADNCPDATIALIEAGPHTDRNLFVNMPVGVAAVVPHKLKTNYGYLTTPQPGLGGRQGYQPRGRGFGGSSAINAMIYTRGHPLDYDEWAELGCEGWSWAEVLPYFRRAEGNERGADAWHGDSGPLTVSDLRYQNPFSRRFVQAAMEAGYKPNSDFNGAEQEGIGFYQVTQRDGRRCSVARAYIYDRARPNLHTIADATVLRVAFKGKRASGVEIVRGGRRETLEARAEVVLAAGAFNSPQLLMCSGIGPAAHLRSFGIPVLHDAPEVGQNLIDHVDFTINKRVSSIEPTGFSIRGIARMLPQFVTFMRHGRGMLSSNVAEAGGFLKSSPTLERPDLQLHFCAAIVDDHNRHMHWGHGYSLHVCVLRPHSRGTVTLASADARTAPVIDPRFFSDSRDLDLLVEGAQMARRILDAPSLALHGGRELYTHPGQSEAELRRTIAEHADTIYHPVATCRMGGDVRSVVDPQLRVRGVTGLRIVDASVMPTLIGGNTNSPTVMIGERAAELI

SEQ ID NO: 4785 - protein, 466 aa, Burkholderia fungorum
PEVAALEALLRDQRHAYLRAPYPSWETRAAHLKALRKVMLDNRDALADAMNVDFGNRAKQEVLLAEFLLVKEEIDAALRHGKRWMKSQRRSTSKWLLPARAKVVPQPLGVVGIIVPWNYPVLLAVGPLISALTAGNRAIIKMSELTPRTSALFEQLIGQTFARDHVAVVNGDAALAAAFSAQPFDHLLFTGSTRVGHEVMRAAAEHLTPVTLELGGKSPAIIGAHARFDNAVDNLVAGKTLNAGQTCVAPDYVLVPRGKEQAFVERARARMARMYPNFANNPDYTTIISARHFARLERLADEAQAAGAQLHPLTDSSPDAASRRFPLIAVTNAPDACALMQEEIFGPLLPIVPYDTLDDAIAWINARPRPLALYLYADDAATIGRVTHETIAGGMAVNETLMHLACESLPFGGVGASGMGAYHGYEGFVTFSKMKPVLTQARLNARGWISPPYGKRVNALLKLMMR

SEQ ID NO: 4786 - protein, 430 aa, Burkholderia fungorum
GRLTRAAGLVLEAVGLRLSVGAEVMIELPQGSSLPMAEAEVVGFSGDKLFLMPTTEVMGLLPGARVFPLESAPIADPMAGAKRLPVGWELLGRVLDASGRPLDGLGPLGAHADAPLSAPVINPLNREPIHKVLDVGVRAINALLTVGRGQRMGLFAGSGVGKSVLLGTMARYTSAEVIVIGLIGERGREVKEFIEQILGEEGLARSVVIAAPADVSPLLRMQAASYSTSLAEYFRDQGKHVLLLMDSLTRYAMAQREIALAVGEPPATKGYPPSVFAKLPALVERTGNGPAGGGSITAFYTVLTEGDDQQDPIADSARAILDGHIVLSRSLAEAGHYPAIDIEASISRAMTALIDDNHLEKTRMFKQMLSRYQRNRDLINVGAYSSGRDALLDRAIALYPRMEAFLQQGFRECANFEPSLEMLDALFAQG

SEQ ID NO: 4787 - protein, 271 aa, Burkholderia fungorum
TERGRRYLARIAAIEGGCSEGIPAFNVNRRCGSGLRPVISASQSIVPGDTEIAIGGGAENMSRTPYIAAAARWGARMGDSTMIDMMPGALHDPFHGIHMCVTLEDMMRLKPAFVMENGTVTAGNASGINDAAAALVLMEHIAAEERGTKPLARLVAYAHAGVDPRYMGMGSVPLTRLALQRAGLAVDGLDVIETHEAFAAQACAVTRALGLDPAKVNPNDSEIPLGHPVGATGAVITIKALHELLRTGGRYALVTMCIGDGPGIAAVFENL

SEQ ID NO: 4788 - protein, 226 aa, Burkholderia fungorum
LAHRTIIVTGGLGALGRSVGAVLAARGARVVLIDRAEPTAVAGVAAVVGKVDLGERESTAHAFADVARQLGGFNALVNVAGGFAWETLEGGSVETWDRLYAMNLRSAVVASREALPHLLRQPPGRIVNVGALAAQKAGAGMGAYAASKAGIARLTEALADELKDRNINVNAVLPNVLDTPANRADMPDADATRWVSTEALAAVIAFLLSDDAGAVTGACLPVAGRM

SEQ ID NO: 4789 - protein, 249 aa, Burkholderia fungorum
IDGRRAIVCASSRGLGKACALALAREGCEVFINGRDEARLGQAAREIEQASGRRPTPVVADLDSDAGRAALLAACPQPDILVNNNAGPAPGELEQWDHAAWLAALEANLLAPILLMSAVVPGMRTRKFGRVVNITSAVVKSPRLGMSLSTTARTGLTAFAKGLSREAVADNVTINNLLPQHIDTDRQEYMARRIMEDRGITFAQARSLQVKSVRARRLGRPEEFGDACAFLCSAQASFISGQNLQLDGG

SEQ ID NO: 4790 - protein, 247 aa, Burkholderia fungorum
LLEQRVALVTGAGGGIGRGVARSFGNEGAAVIIAEINESTGRQVEQEIREMGGRSLFVKTDVTSKASIEAAVRSAVEQFGSLDILVNNAFVPTPNVLLEEKTDEMLEQTLTTSLWATWWAMRAAFVPMRERRWGRIVNFYSIDTETGAWLHGDYNTAKAGIVGLTRSAASEWGRFNITVNAIAPTAMGATFFELAAKNPEFAERSAAARPLGRSGDPEQDIGPAAVFFASEMSRFVTGETLHVDGGL

SEQ ID NO: 4791 - protein, 497 aa, Burkholderia fungorum
VAAHPDRVLLDFSGDLYTYAQVDGLSTRLANSLAELGVTAGQTVVTMLDNNLDAVITWLAINKLCAVSVPINTALRGEFLRHQLDDASARLVICEGDYVERIAAIADQLKEATRVLHRGATTVRKCGALALAPLDQHRGSDDTPLSRKPNPWDLASLIYTSGTTGPSKGCMISYNFMCNLARQQLRAGPATANDITITPLPLFHMNALAVGVLSNILVGARVAIVPRFSVSKFWSEVERSGATIASILGGMGGLLANAPDDEAAKRCYGQIHTVRGNPFTEATKQIWRERFGARQVGGNGYGLTEACVITSLPAGEYAAPGSSGKRIPEFDVRIVDELDRELPANQAGEIVCRPLHPDVMFMGYWHRPEDTLKLMRNLWFHTGDIGKFDDDGFFYFVDRKKDYLRRRGENISSFEMESAFSRHPDIAEVAVHAVPSDKGEDDVKVTAVLNPDAALTAEALFHWATDAVPYYALPRYIEFRDTLPKNPQGRILKYQLR

SEQ ID NO: 4792 - protein, 278 aa, Burkholderia fungorum
KVVVAGAGLMGTGIAHAFVSSGFSTVLVDTDDNALEHARQAIGKILDDGVRLGKVQAADAQAALSRLSIELELKKGAAGARLLVETVTEKLPVKQAVLAEAAAVMADEALYATNTSALSVTEIATAVTKPERVIGMHFFNPVHKMKLVELVRGLATSDETVAGAREYSDALGKTSIIVNEAPGLTTSRMSALLGNEAMWMLQDGTASAEDIDTALRLGFNHPMGPLELGDLTGWDTRLSVLKYLHQTLGEKFRPCPLVIKMVAAGRLGRKTGHGVYRY

SEQ ID NO: 4793 - protein, 386 aa, Burkholderia fungorum
RDVVIVDAVRTPIGKFRGALAGVRADHLGALVIDELIRRAGVKPQAVNDVVFGCVTQIGEQSANIARTSVLGAGWPETIPGLTIDRKCGSGEEAVHIAAGLIAFGAADVIVAGGAESMSRVPMGSNRDLHGEAFGWMASERFELTSQGEAAERLCDCWALTRAQLDAYSVESHRRAAAAAAEGWFAREIVPVPVGQVREKSLEGEAALFAADETIRPGTNADKLATLKSSFRSDGRLTAGNSSQISDGAAALLLMSSDKARELGVKARARVRAVTTVGSDPTLMLTGPILATCQVLEKAGLGLSDIDLFEINEAFAPVPLVWMKEFGVPHAKLNVNGGAIALGHPLGASGARIMTSMLHELERRGARYGLQAICCAGGMGTATLIE

SEQ ID NO: 4794 - protein, 379 aa, Burkholderia fungorum
RRITDMRTVFREDHELFRQQARRFIENEIVPHLHEWEHAGIVPKELWRKAGEIGLLCSTVPEEYGGSGGDFGHSAVMIEELARVNATAVGFTTHSEIVAPYIVAYGTEEQKRRWLPRMAAGELVGVIAMSEPGIGSDLRSMRTTAQREGNDYIVNGQKTFITNGGNAGLVVTATKLDPQSRDLTLICVEEDMPGFSRGKLLEKIGLKGQDTAELFFDNVRVPAGFRLGEENNGFRYLTHQLAWERTIIGIRAAASIDSLLDETVGYTRDRQVFGKRLFDFQNTRFKLAEVKAQATMLRAFVDDCLGKAMSGELTAEVGAMCKLVGSELQGKLLDELLQLHGGYGFMSEYRISRAWVDARVARIYGGTSEIMKEIIGRSL

SEQ ID NO: 4795 - protein, 263 aa, Burkholderia fungorum
FLIVEHEGAVLSARLNSPQTRNALSEPAQMDELVELCNRVRRDRTVKAVVLSGEGSAFCAGGNVKDMRERGGIFAGSPHDLRESYRNTIQRIPLALYELDVPVIAAINGPAIGAGLDLACMCDIRIASDKALFAESFVKVGIVPGDGGAWLLPRAIGMQRASLMAFTGETIDAAKALEWGLVAEVVPADRLITHALGLAQRIAGNASHALRLTKRLLREGQHMRLDSLLEMSAAYQALAHHTHDHLEAVNAFLEKRAPQFTDR

SEQ ID NO: 4796 - protein, 252 aa, Burkholderia fungorum
LRNKRVIVTGASRGIGRAIARAFAAEGARVAICARTAADLEAAGADLQSRGAGDVIARAVDVTDTAGVRQFVEDIAARWGGVDVLINNAGQGRGGNLETLTPEQILEHANVLQMGHFRFVQAVVPHMRQQRWGRIVEINALAGVVPTPDGIPSVVNRAACIAMSKSLGMSLAKDNILVNTLNMGWIDTGQWDRHYREMPAGCSREEFDQMVLKVVPLGRFGKPEDVAGMALFLASDYASFISAASIDIAGGM

SEQ ID NO: 4797 - protein, 242 aa, Burkholderia fungorum
NELDFSGKTVLVVGGSSGIGNGIARAFLERGATVHVWGTRRSASDYADSPDSSLTDLHYAQLDVSDAASVERCVLPFASLDVLVQAQGTVLYDRQEFKAPAFRKVLDVNLTSLMACADRCFEALKAARGAMIIVSSAAAFHSTRGNPAYNASKTGAFGLTRTLAEAWARDGIRVNGIAPGLVDTKLTRVTTADPKRLDAALRRIPLGRLGTAADMAGGALFLASPLSAYMLGQTLLLDGGML

SEQ ID NO: 4798 - protein, 348 aa, Burkholderia fungorum
LVKPLQQRVKERRLWACHLGPELGGPGYGQVKLALMNEILGRALFAPIVFGCQAPDSGNAEILAHYGTEAQKERFLKPLLAGDIVSCFAMTEPQGGADPKVFTTRAVRDGDAWVINGRKWFASNARYADFFIVMAITDPEVSAYKGMSMFIVPANTPGLSIIRNVGMADEPEATHAYLAFDDVRVADEQMLGAPGDAFVVAQVRLGGGRVHHAMRTIGLAQKALDALCERALSRHTQGGALADKQMVQEKIADSWLELEQFRLLVMRTAWRIDRYQDYQKVRKDIAAVKAAMPRVLHDIAARALHVHGSIGASSEMPFAGMISRAFQMGLADGPTEVHKVTVAKQLLR

SEQ ID NO: 4799 - protein, 253 aa, Burkholderia fungorum
LEGKRVIVTGCASGIGASAVKALVRAGAEVAALDLSDEAGRAVAADASAAGPGVAHYFSCDVSRKDQVDEVFRSAVTRLGGLDALINIAGVERKAPAEAVTQDDWDLMFDVNARGTLNTNQAAFAWLREHGGRIVNFASAAGVMGVPGLAHYSASKAAVLGWTRTAAKEWGKYGIAVNAVAPAMWTPMYEKFRARLDSAQLAAHDAMMAQQVPLGGRLGDPDKSMAPVLVFLVSDGANFITGQTLAVDGGLMI

SEQ ID NO: 4800 - protein, 234 aa, Burkholderia fungorum
DKVVMITGASSGIGEATARRLAQQGAKLVLAARRSERLSRLAAQLGGADRVLWDATDVTKPEALQQLAATARERFGHLDVLVNNAGIMPVSLIAQGRVDDWNRMIDVNIKGVLYGIHAVLGAMLERGVGHIINISSVAGLSVGPGGAVYSATKFAVRAISEGLRQECAGKVRVTSICPGLVASELPDSITVPAFRERAQKLFEGAMPADAVADAIVYALTQPEQVAVNEIVVRP

SEQ ID NO: 4801 - protein, 512 aa, Burkholderia fungorum
THDVVIVGGGHNGLSAGCYLAAAGKKVLVLEALEKVGGMASSGYLLPEAPEHLIHPCALDMMSMRVHSRVPRELELERHGFRQVEMTPGYVYLHPDGTSLVFWRDPGKTAQEIRRYSPKDAESFLAFIKVVFAFLDLALPMMRVDPAERNLGARFESLRAALRNRKLKPELMALLTGSAYQAALEHFEHPVTISAMCSLTGLAGPITADGSGIYYALLGFLHRFGVGRVVGGMQALSNAMAARLRELGGEVLTSARVEEIVADERALRGVRLADGRTFGARAVIASCHPQVALELVSPGRIDQRLLTRIRHAPANAHGASPLKLDMALRGQISLARFEAKRGDGLDLRKTCLLIGTAEAVLENFRASARGEVPTLPYLSLAAPGAIDPSQAPAGQDTVYIYPPAMPAHPREGWDAIRERVAQQVIDQASEYVDGLKEFEIARRMEAAPDFTRRLNTVNGCVVHIDTTTMRSSKLRPAYGLGGATLPVPGLYFGGAGIHPGGGVNGMPGRIAA

SEQ ID NO: 4802 - protein, 251 aa, Burkholderia fungorum
MGRLEGKVALISGTGGGQGRAAALRFAREGAKVFGCDVDAAAQQETVALARAGGLEVAGGGSVDLGDAQAARAWVEEAVAAYGRIDILYNNASAARFGAVGDMSVDDWRWTIRNELDLVFYSTHYAWRHLAERGGVIVNISSVAAWGASGTTGIGAHSAAKAGVVALTRQLAVEGARHRIRAVSISPGVVATPGTRPFLDNPATRAALLAGVPVERAAEPEEIVAVALFAASDEASYLTGADIVVDGGMLS

SEQ ID NO: 4803 - protein, 252 aa, Burkholderia fungorum
KLENKVAIVTGAGAGLGAACARALAQHGARVAVVDINGEAAAAVAADIGERAMSVRTDVSSEAQVKAMVSAVLEHFGRIDILHNNAAVLDDAQRAGDRDVINMSVEVWDRAMAVNLRGAMLCCKHAIPAMLRGGGGSIIHSSSGFGAQGDFTMSAYAASKAGLAMLSKSVAAQYGKERIRSNTIQIGLVVADHPLPEDIKGVILDGHLTPYLGDPKHVADVVCFLASDEAAFITGDTLAVDGGFSSHAPTLA

SEQ ID NO: 4804 - protein, 449 aa, Burkholderia fungorum
YRTRRERVLAALRAAGGGVAIVPTAPEALRNRDADYPYRHDSYFYYLTGFTEPEALLVLDASAAPGEPASVLFCREKNVERETWEGFRFGPDGARAAFGFDAAFAIGEIDTQLPRLLADKPSLHYALGTSPQLDERVRGWLDAVRAQARGGVAAPAAAHDLIPLLDDMRLIKDDHELAIMRRAGQISAEAHRRAMAACRPGMREYELEAELLYTFRKFGAQAPAYTSIVAAGANACVLHYPAGNAIARDGDLILIDAACELDGYASDITRTFPASGRFTPAQRELYDIVLAAQQAAIDATRAGATFDDPHQAAVRVLSQGLLDTGIIERAKFASVDDVIAERAYVPFYMHRTGHWLGMDVHDVGDYRERGAPRDEAGALPWRTLQASMTLTIEPGLYIRPTEGVPERYWNIGIRIEDDAIVTPDGCELITRGVPVAADEIEALMLEARA

SEQ ID NO: 4805 - protein, 214 aa, Burkholderia fungorum
IDHLICDCDGVLVDSEIIADRVMLETLSATFPGLDFEPVVKTAFGQQTSRFLESIEKSFDITLPANFFDTIEHNVELALAASLSPINGVRDALQRVTLPAAVVSNSRMTRVNASVRRAGLQQIFGERIFSAEQVARPKPYPDVYLFAAKTLGVEPSRCVVVEDSVAGLNAARAAGMKTIAFVGASHIPDGYAEALRKMGMTRIMQHMDELPALV

SEQ ID NO: 4806 - protein, 474 aa, Burkholderia fungorum
QYILALDQGTTSSRAMLFDRLGNIVSTAQKEFQQIYPRPGWVEHDPQEIWSTQAGVAAEAVTRAGMNGTSIAAIGITNQRETTIVWDRETGHPIYNAIVWQDRRTADFCDQLKEQGLEEKVRAKTGLPIDSYFSATKIRWILDNVEGAREKAKQGRLAFGTVDSWLVWNFTKGGLHITDVTNASRTMLFNIHSLKWDDELLEALDIPRSMLPEVRASSETYGPTKTTVFASKIPLAGIAGDQHAALFGQMCTESGMVKNTYGTGCFLVMNTGDKPIESKNNLVTTIAWQIGDQINYALEGSIFIGGAVVQWLRDGLGIIRNAAEIETLARSVPHCDGVYLVPAFAGLGAPHWNARARGTLFGVTRGTSSAHIARAALDSIAYQSVDVLKAMEADSGIRIGELRVDGGACANNLLMQFQADILGVDAVRPKVSETTALGAAYLAGLAVGYWKDVDELQSQWKLDRRFTPALPHAE

SEQ ID NO: 4807 - protein, 479 aa, Burkholderia fungorum
YDLLVVGGGINGAGIARDAAGRGLSVLLCEQDDLAAHTSSASTKLIHGGLRYLEYREFGLVRKALQERETLLRAAPHIMWPLRFVMPHMPDLRPAWLIRAGLFLYDHLAKRELLPGSRGIVMRNHPAGAPLVDSIKRGFVYSDGWVNDARLVVLNALDAKERGAKILTRTKLLSAVRAGGEWRAQLKREDGTILDVRAASIANAAGPWVGELLQGALGRAASHSVRLVKGSHIVTRRLFEHDHAYIFQNPDKRIIFAIPYEHDYTLIGTTDLEYRGDPSQVAINAEETQYLCDSINRYFKQKISPADVRWTYSGVRPLLEEEGADNPSAVTRDYSLELDAPAGEAPLLSVFGGKITTFRKLAEEAVDQLAHALHHDTSSWTAGAPLPGGDIPGANFERFLSEFRQQHAWLPAGLAHRLARAYGTRVEHVIGNARSVAELGRAFAPGLYEAELTYLRDTEWARSAQDVLWRRSKLGLHVE

SEQ ID NO: 4808 - protein, 450 aa, Burkholderia fungorum
MSFDSLGLSEPLVRAVHELGYTTPTPIQTQAIPAVLNGGDLLAGAQTGTGKTAGFTLPILQRLNSSPAVANGSGKRAVRALILTPTRELAAQVEESVRAYGKYLKLKSTVMFGGVGINPQIGALRSGVDIVVATPGRLLDHMQQKTIDLSHLEILVLDEADRMLDMGFIHDIKRVLAKLPPKRQNLLFSATFSDEIKTLADNLLDSPALIEVARRNTTAETVAQKIHPVDRDKKRELLTHLIKQHNWFQVLVFTRTKHGANRLAEQLTKDGISALAIHGNKSQSARTRALAEFKDGTLQVLVATDIAARGIDIDQLPHVVNYDLPNVPEDYVHRIGRTGRAGATGEAVSLVCVDELQLLKDIEKLIKRPVPQEVVAGFEPDPTAKPEPILRRGQGGGGGGGGRSPRQGQGAPKRDDARRDGAGSAKPAQRSGQRPANGQQQRSRRGAKPA

SEQ ID NO: 4809 - protein, 707 aa, Burkholderia fungorum
MTSLDRRTFLRSAAGAAALGLFPPAIRRALAIPANNTTGTINDVQHVVIFMQENRSFDHYFGTLPGVRGFSDRFTIPQPGGTTVFQQNDGTRTVLPFHLDSTQGNALLAGGPHSWSDAHQAWDSGRMTQWPKAKGDVSMGYLNQADVPFHVALANAFTICDAYHCSLHGGTNSNRIFLWTGTNGASAGANPVVNNDGWDGLGASATGLTWTTYPERLQAAGVSWKVYQNMPDNYTDNSLAGFATYRKVNETLPGSPLLPYTQSLEAVAPLYKGIGNTMPDGGFLQALKDDIAAGQMPQVSWIVSPQAYCEHPGASTPGQGAYYLQLLLDTLTANPDVWSKTVLFVNYDENDCFFDHMPPPDAPSKNADGTFAGKSTVDTQYEYFTKTNPPGDSSPIVPDGQCFGPGPRVPMFVVSPWSTGGWVNSQVFDHTSVLRFLEQRFGVTETNISPWRRAVCGDLTSAFNFRNPNDVPPASLPAAPSKAQADAQNTQQSALGAVPVPSAASQQMPQQVLMSRPSRALPYLLHVSANADVQDGLIWLVFSNTGTAGAVFHVYDQLHLDRVPRRYTVEAGKELSDSWSALADDQGNYSLWVLGPNGFHRSFQGNVATVATGPNPEVRVCYDVVNNAVYLTIMNTGNAVANVTVTSNAYRGDGPWTYAVPAGMQVEPYWSTGAVGGWYDFTLSAAGGFSRRFAGRIETGKDSVSDP

SEQ ID NO: 4810 - protein, 383 aa, Burkholderia fungorum
MKIHEYQGKEILRKFGVAVPRGKPVFSVDDAVKAAEELGGPVWVVKAQIHAGGRGKGGGVKVAKSLEQVREYANQILGMQLVTHQTGPEGQKVNRLLIEEGADIKKELYVGLVIDRVSQKIVVMASSEGGMDVEEVAEKTPELIHKIAVDPATGLKDAEADELATKIGVPAASLPQARAILQGLYKAFWETDASLAEINPLILTGDGKVIALDAKFNFDSNALFRHPEIVAYRDLDEEDPAEVEASKFDLAYISLDGNIGCLVNGAGLAMATMDTIKLFGGEPANFLDVGGGATTEKVTEAFKIMLKNPNLTAILVNIFGGIMRCDVIAEGVIAASKAVSLKVPLVVRMKGTNEDLGKKMLAESGLPIIAADSMEEAAQKVVA

SEQ ID NO: 4811 - protein, 302 aa, Burkholderia fungorum
  unsure (1)..(302): unsure at all Xaa locations
MSILINKDTKVITQGITGKTGQFHTRACREYANGREAYVAGVNPKRAGEDFEGIPIYASVAEAKAETGATVSVIYVPPAGAAAAIWEAVEADLDLAICITEGIPVRDMIELKARMRAENRKTLLLGPNCPGTITPDELKIGIMPGHIHRKGRIGVVSRSGTLTYEAVGQLTAIGLGQSSAVGIGGDPINGLKHIDVMKMFNDDPETDAVIMIGEIGGPDEANAAYWIKDNMKKPVVGFIAGVTAPPGKRMGHAGALISGGADTAEAKLEIMDACGITVTKNPSEMARLLKAMLXIEIHAQSR

SEQ ID NO: 4812 - protein, 400 aa, Burkholderia fungorum
HTPMNKVLRLSDLIAEGKLSGKRVFIRADLNVPQDDQGNITEDTRIRASVPAIKAALDAGAAVMVTSHLGRPTEGDFKPEDSLAPVAKRLAELLGREVPLVANWVENGVNVAPGSVVLLENCRVNKGEKKDSDELAQKMAKLCDIYVNDAFGTAHRAEATTHGIARYAPVACAGPLLAAELEALGKALGAPKRPLVAIVAGSKVSTKLTILKSLADKVDQLIVGGGIANTFMLAAGLKIGKSLAEADLVNEAKAIIDAAKARGASVPIPTDVVTAKEFSPTAKAEVKAVADVQDDDLILDIGPETAKVLAAQLEKAGTIVWNGPVGVFEFDQFGNGTKTLAEAIAKSSAFSIAGGGDTLAAIAKYGIHDKVSYISTGGGAFLEFLEGKKLPAVEVLESRA

SEQ ID NO: 4813 - protein, 470 aa, Burkholderia fungorum
RATKIVATIGPASNTPEILLQMIQAGLDVVRLNFSHGTADDHRQRAGFVREAARQAGREVAIMADLQGPKIRVGKFENGKIMLVAGEPFVLDADCELGNEQRAGLDYKDLPRDLKPGDVLLLNDGLIVLNVSRVIGNEIHTVVKIGGELSNNKGINRQGGGLSAPALTAKDMEDIRTAMSLGVDYVAVSFPKNATDMEMARQLANIAGAPFGVKPKMIAKIERAEAIPALQGILDASDGIMVARGDLAVEVGNAAVPALQKRMIRMARESNKFVITATQMMESMIHAPVPTRAEVSDVANAVLDGTDAVMLSAESAAGKYPVQTIETMAAICIEAEKSEQSELDKDFLDRTFTRIDQSIAMGALFTAFHLGAKAIVALTESGSTALWMSRHWTHVPIFALTPRVGSERAMALYRNVTSLHLDTNTDRDTALQQALETVVSKGYASRGDMVVLTVGEPMGQAGGTNTLKIV

SEQ ID NO: 4814 - protein, 290 aa, Burkholderia fungorum
RKGIILAGGSGTRLYPITRSVSKQLLPVYDKPMIYYPLSTLMLAGIRDILVISTAEDTPRFAEMLGDGSAWGIDLQYAVQPSPDGLAQAFIIGREFIGSDPCTLILGDNIFHGHDLVRQLTRAGQSEQGATVFAYHVHDPERYGVVEFDENFHALSLEEKPLKPRSNYAVTGLYFYDNQVCDIAADVKPSARGELEITDVNKRYLEIAQLDVEIMGRGYAWLDTGTHDSLLEAASFIATLQSRQGLMVACPEEIAYRSHWISAEQVERLAGPLAKNRYGQYLKQIISEAV

SEQ ID NO: 4815 - protein, 288 aa, Burkholderia fungorum
VTGASGFTGRYLVDNLLGRGHTVIETVAGRDEPETPTRVRLDITSPDACRRAIEIARPDYIVHLAAISFVGHNDPLDFYRVNVIGTLNLLEACAAVGHTPRKLLIASSANVYGNVTSEAIDESFPVTPVNHYAASKAAMETMVRTWFDRLPILIVRPFNYTGRGQASNFLVPKIVGHFARREASIELGNIDVARDFSDVRYVASAYEALLDSEAAAETVNVCTGTPFTLREILAAASDLTGHELEIQINPAFVRQTDVKMLAGSPARLRTLVPTVEAIPFMDTLRWML

SEQ ID NO: 4816 - protein, 317 aa, Burkholderia fungorum
  unsure (1)..(317): unsure at all Xaa locations
QLTKNGELKHLLSIEGLPKAIVNHILDTADQFVSVTDREVKKVPLLRGKSVFNLFFENSTRTRTTFEIAATRLSADVLNLNINASSTSKGESLLDTINNLSAMHADMFVVRHASSGAPYLIAQHCAPHVHVINAGDGRHAHPTQGLLDMYTIRHYKKDFTKLRVAIVGDILHSRVARSDIHALTTLGVPEVRAIGPRTLLPGGLEQMGVRVFHNLDEGLKDVDVIIMLRLQNERMSGALLPSAQEYFKSWGLTPERLALAAPEAIVMHPGPMNRGVEIDSQVADGPQSVILNQVTFGIAVRMAVMGIVAGNHDXSRR

SEQ ID NO: 4817 - protein, 760 aa, Burkholderia fungorum
MTTRREVPGIRPYDGPAGGWGALRATAQAVRTQMENIEAPITLMRTNQPDGFDCPGCAWPDKEHKSTFQFCENGAKAVTWEATTRRVGPEFFENNTVSSLLQRSDFELEDLGRLTHPLVYDRATDKFRAVEWEDAFARIGEVLRGLSSPDEAEFYTSGRASNEAAYLFQLLAREYGTNNFPDCSNMCHEPTSVGLPQSIGIGKGTVSLDDFDSTELILSIGHNPGTNHPRMMGTLHECSRRNVPIIVFNPLRERALERFADPQSVVEMATFGSTRIASTYFQVDAGGDAAALKGIMKALLVMDAEQGKTVLDHEFIATHTQGFEAFAADLEATSWDDIEKASGLTREDLEEVAIAYAKSNATIVTYGMGVTQHNKGTANVRLIADLLLLRGNIGKPGAGICPLRGHSNVQGNRTVGITEKPSEAFLKQIENVLGFKPPAAHGHDAVQAMQAMIAGTARVLICLGGNFAVALPDSGQSFPAMSKLDLSVHLGTKLNRSHLLVAKETYVLPVLGRTELDIQANGRQSITVEDSMSMVHASSGKLKPASEHLRSEPAIIAGIATAALPNSKVAWSELVADYDRIRDLIEQTVPGFEAFNARIRVPGGFRMPLPPTERAWPTPSGKAMFSVYGGVREDADVLGADNVLRLITIRSHDQYNTTIYALDDRYRGVFGRRDVLFMNEDDLAERGLEHGDLVDIETVLAGRQLRLKKITAIAYNIAPGSVAAYYPEANVLVPLDFIDKESGTPSYKSVPVHVMRSAET

SEQ ID NO: 4818 - protein, 362 aa, Burkholderia fungorum
KVALITGITGQDGSYLAELLLAKDYDVHGIKRRSSLFNTDRIDHLYRDPHDPDQRLFLHHADLTDSTSILRVIQRVEPDEIYNLAAQSHVAVSFEEPEYTANADGLGALRILEAIRILGLQEKTRFYQASTSELYGLVQQVPQSETTPFYPRSPYAVAKLFAYWTTVNYREAYGLYACNGILFNHESPVRGETFVTRKITRAVARIAVGMQKTLYLGNLSALRDWGHARDYVEMQWRMLQQEQPEDYVIATGVQYSVRQFVQHAAAELGVTVRFEGTGVDEIGIVEKVEGREIKMSPGDVIVRVDPRYFRPAEVETLLGDPSKAHAKLGWQPTTSFASLVKEMVRADYQIARRDALVTLAGF

SEQ ID NO: 4819 - protein, 896 aa, Burkholderia fungorum
PPITYPEALPVSGRREEIARAIVQNQVVIVCGETGSGKTTQLPKICLELGRGLGAGGSGLIGHTQPRRIAASATGRRIAEELGTPFGEVVGYKVRFTDNLSPGASVKLMTDGILLAETQTDPLLKAYDTLIIDEAHERSLNIDFLLGYLKEILVKRPDLKLIVTSATIDADRFARHFGSEDKPAPVIEVSGRLYPVEVRYRPVAEDSPAVKAAQGDGPAAQRGGDRPKTQRETDRDLMEAIVDAVDELCREGPGDVLVFLPGEREIRDAAEALRKHHPPHTEILPLFARLSAAEQERVFRTSNARRIVLATNVAETSLTVPGIRYVVDTGLARVKRYSYRNKVEQLQVESISQAAANQRAGRCGRVADGICIRLYEESDYQGRVRFTDPEILRSSLASVILRMKSLHLTAIETFPFIEPPPGRAIADGYQLLNELGAVDDDNQLTPLGRELARLPLDPRVGRMILAARDQQALKEVLIIASALSVQDPRDRPIEAQEQADQAHRRFADERSEFLQWLKIWNWFEEAITHKKSNRQLHEECRKNFLSQLRLREWRDVHSQLLTVVREHGWRLNEAEATFEQIHLALLTGLLGNIGLKADDEPYYLGARGIKFYLWPGSALVKKAGKWVMAAELVETSRLYARCIAKIEPEWIEKIGPHLLKKSLSEPHWEKRAAQVSAFERAVLYGLPIYHRRRVSFGKQDPARARELFIRGALVEGEFDTKLAFFAHNRKLLADIEQLEHKSRRQDVLVDDELIFAYYDQALPKGIYTGASFERWYRDEVKKSGQPEDRLRLLYLSRDDLMRHEAAGVTTDLFPKRMTMAGVDMALTYHFEPGSPRDGVTLGVPLYALNQVDARRCEWLVPGMLKEKTQLLLKSLPQKLRRHCVPVPEYAAGFVDR

SEQ ID NO: 4820 - protein, 437 aa, Burkholderia fungorum
QHAQFVDWMRSVAPYIHAFRNKTFVVGFGGEVVHQGLLNALVSDIALLQAMGIQIVLVHGSRPQVEEQMSLHGVESEFSHGMRITDARALESAKEAAGEVRLDIEAAISQGLPNTPMAHAHISVVSGNFVTARPVGILDGVDFAHTGVVRKIDADSIRHSLASRKLVLLSPLGFSPTGEAFNLAMEDVASAAAIALRADKIVFLTETPGLMQAGEDGPELVRELSLDDAYKLHESGEVTGDAGFYLKHSIRACRGGVARAHIIPYALDGSLLLELFLHDGVGTMISYENLESLREATPDDVGGILALIEPLESDGTLVRRGRHQIERDIDHFSVIEHDGVLFGCAALYPYTQERIGEMACLTVAPEAQGTGDGERLLKRIEQRARARGLTRIFVLTTRTEHWFLKRGFVKVTVDDLPEDRRRLYNWQRKSLVLMKQL

SEQ ID NO: 4821 - protein, 804 aa, Burkholderia fungorum
SASPGFIAVITLLFTALTALYLLIGGAWLLSLGGSAYYVVVGFVLLGVTWLLYRRSPAALTLYALVLVGTAVWALWESGPDFWALAPRSGVLVVFGVWLLLLVSWRLDAPRKLGVTSLVGALVIWAGVLVYASFNDPQTINGTLSSVAATPAANPNGIDPSDWPAYGRTQEGTRYAPLQQITPENVKNLQVAWTFRTGDMKGPNDPVEITNEVTPIKIGNLLYLCSPHQILFALDAKTGEQKWKFDPKLRPDPSFQHVTCRGVSYVDLSASAATAQPNAPAAPASDTAPAASAASAASGACLRRIYLPVNDGHLYALDAQTGERCAGFGNNGDLDLQHAQPVTTPGMYEPTSPPIVTNTTIIVAGAVEDNFSTREPSGVIRGFDVRTGQLQWAFDPGAQDPNRIPGAGEHYTIGSPNSWAPSAYDAKLDIIYLPMGVTTPDIWGGNRTPEQERYASGLLALHASTGKLAWFYQTAHHDLWDMDQPSQPTLADITGKDGKTVPVVYAPAKTGNLFVLDRRTGTPVVPAPEMPVPQGAAPGDHVSPTQPFSDLTFRPKNLLTDADMWGATMYDQLVCRVMFHKLRYEGTFTPPSLQGTLVFPGNLGMFEWGGIAVDTDRQIAIANPIALPFVSRLIPRGPGNPMQPEPGAKGSGTEAGIQPQYGVPYGVTLNAFLSPLGLPCKQPAWGYISAVDLKTNEIVWKKRIGTVRDSSPIPLPFRMGMPMLGGPIVTAGGVVFIGATADNYIRAFDVNNGKELWRARLPAGGQATPMSYSIDGRQYIVIAAGGHGSFGTKLGDYVMAYALP

SEQ ID NO: 4822 - protein, 459 aa, Burkholderia fungorum
FNAVVIGTGQGGSPLAVRLGQSGRKTAVIERAAFGGTCVNVGCTPTKSYVASARAAHVARHCAELGVQVSGAISVDLAAVKARKDRIIGQSRDGVEKWLRGAQNVSVFNGHARFTGAHTLAISGPDGTVLEEISADEIFINTGTRAVVPPLEGIGRIRYYTNSNLLELTELPDHLVIVGGSYIALEFAQIFRRFGSRVTVLVRGERVLTREDADFAESVRKVLAREGVEFRFGVQPSRVEPHPHHPDEVCIGFEQNIPALEASHLLFATGREPNTDDLGLAAAGITTDRHGTIPVDGQLRTNVPGVWAIGDVNGRGAFTHTSYDDFQIVAANLLDGGARSVDTRIMAYAVFVDPPLARVGASEAEVRKAGRPALIATMPMSRVGRARERGETDGFMKVMVDRESRQILGAAIHGIEGDEAIHTFIDIMAAGAPYPTLQYAMHIHPTISELVPTLLDGLK

SEQ ID NO: 4823 - protein, 249 aa, Burkholderia fungorum
MTRFQNKSVLVTGGSSGIGFAAAKAFVDEGARVVITGRDAAALEAARTALGANAVAVRNAAGSVASAHELAAAVRAAGIRLDAVFVNAGTAKFAPFADVDEAFWDAMFDTNVKGAYFQIQALLPLLNRGASIVINGSINAHIGMPASSVYAASKAALISLAKTLSAELLPQGVRVNVVSPGPVQTPLYGKLGLDAAALEATAAQILGQVPVGRFGTPEEIASTVLHLAAPESAFIVGTEIIADGGMSQL

SEQ ID NO: 4824 - protein, 482 aa, Burkholderia fungorum
LTLVPGQVTLGQLRRIIEARPMVQIERASLERVEKSKDIVSRIVADGKIVYGVNTGFGRLANTTIPAGRIAELQKNLVLSHSVGTGELMEDRVVGLIMALKAISLARGHSGVRPQVVLAIISMLNAGVYPCIPSKGSVGASGDLAPLAHLAAAMLGVGHVRIDGKRVPAAEGLSVAGLEALKLGPKEGLALLNGTQASTALALSGLFAAERVFASAMVTGALSLEAVKGSTVPFDPRIHVARGQRGQIDVAGRLAALLDGSGIIASHGNGTRVQDPYSIRCQPQVMGACLDHIRYVAGILTIEANAASDNPLVFDNGDVLSGGNFHAEPVALAADALAVAISEIGAISERRTALLLDSHMSGLPAFLVKESGINSGFMIAQVTSAALASENKSLAHPASVDSLPTSANQEDHVSMATFAARRLKDMADNTAVIVGIEGMAAAQGMDFHRPLRSSELLEEQHVQIRARVSFYTKDRYLADDIE

SEQ ID NO: 4825 - protein, 338 aa, Burkholderia fungorum
MNLQRFPRYPLTFGPTPIQPLARLSKHLGGKVHLYAKREDCNSGLAFGGNKTRKLEYLIPEVLAQGCDTLVSIGGIQSNQTRQVAAVAAHLGMKCVLVQENWVNYSDAVYDRVGNIQMSRILGADVRLVPDGFDIGFRKSWEEALESVRAAGGKPYAIPAGCSDHPLGGLGFVGFAEEVRQQEAELGFKFDYVVVCSVTGSTQAGMVVGFAADGRADRVIGIDASAKPAQTREQITRIARQTAEKVGLGRDITSEDVVLDERFAGPEYGLPNDGTLEAIRLCARMEGVLTDPVYEGKSMHGMIEMVRNGEFPEGSRVLYAHLGGVPALNGYSFIFRNG

SEQ ID NO: 4826 - protein, 699 aa, Burkholderia fungorum
KPAAKNAQASGPQSDPKAKDLEQFRVSPEGEALRTNQGVKISDNQNTLRAGPRGPSLLEDFIMREKITHFDHERIPERIVHARGSAAHGVFQVYESMQEYTKAAFLQDPAVQTPVYVRFSTVQGPRGSADTVRDVRGFAVKFYTQEGNYDLVGNNMPVFFIQDAIKFPDFVHAVKPEAPNEMPTGGSAHDTFWDFVSLVPESAHMVLWTMSDRAIPRSLRTMEGFGIHTFRFVNAQGKGRFVKFHWRPVLGSYSLLWDEAQKLAGKDPDFHRRDLWESIERGDFPEFELGVQIIEEADEHKFDFDLLDPTKLIPEEQVPVKIIGKMTLNRNPDNFFAETEQVAFHPGHVVPGIDFSNDPLLQGRLFSYTDTQISRLGGPNFHEIPINRPVCPFNNNQRDAMHRQTINVGQASYEPNSLSGGWPKETDPAPSDGGFETYQERVEGTKIRVRSESFADHFSQAALFYNSMSPPEKDHIAAAYQFELGKVTKPEIRARVVNEILANFDAGLAAQVAEGLGLPAPKKGTAKLTGPKESPALSLLNRVKPGIKTRKIALLAAPGSDGAAIKKLQQALQGEGATPMLIAPTLAAIDGMAPDATIAGLPSIMFDAVIVVGGDQGAKALAQSGDARHFVLEAFKHLKAIAAIGAGRDVLAAAHLPHNADGVATGDDKQAAEVLKAFIEAAGQHRVWSRAQQAETVPA

SEQ ID NO: 4827 - protein, 396 aa, Burkholderia fungorum
MFDHIPAYPGDPILGLNEDFQLDPRTNKVNLSIGIYFDDAGKLPVMNAVRRAETALLDSIGPRSYLPMAGLPLYRDAAQALVFGADSEARKAGRIATLQTIGGSGALKVGADFLKRYFPGSQVWISDPSWENHRVVFEGAGLTVNTYPYYDAQTGGLRFAEMLDAIGRLPEQSVVLLHACCHNPTGVDLSPAQWAGLVPVLQRRKLIAFVDMAYQGFGAGLEEDAACVRLLADAGIPLIAANSFSKNFSLYGERVGALSVVCKSAEEAGRVLGQLMSTVRANYSNPPTHGARLVANVLADASLRASWEAELATMRERILAMRGTIHAGLAGRVDEVMRARYVAQRGMFTYTGLSESQVERLRSEHAVYVLRSGRMCVAGLNARNAEYVAASIAAVV

SEQ ID NO: 4828 - protein, 785 aa, Burkholderia fungorum
  unsure (1)..(785): unsure at all Xaa locations
MARTHIPGFPRIGAQRELKFAQESFWRGESGEPHLRGVARELRARHWQLQQDAGLDFVTVGDFAYYDQMLNLSALLGALPQRFGFEPKTLSLAEYYELARGNAAQPAMEMTKWFDTNYHYLVPELGPQTSFDGGVEWLFEEIDEALALNLPVKPVLIGPITYLWLSKSHVAGFDRLSLLPKLVIRYARLLDKLRQSGIEWVQLDEPALCVDLPAEWLDAFSAAYEVLGTSGVKVLLATYFESAAEHAPRVAALPVAGVHLDLVRAPQQLDAWRAALPAHAVLSAGVIDGRNIWRADLGEIVESLQSLQAEFGERLWIAPSCSLLHVPVSLDAEKKLDADLKSWLAFATEKLAEVATLALALRDPAAAEPALAATDRALEARRRSSAVVNALVQKRVAAVSSAMAERQSPFAERNRLQREALGLPLLPTTTIGSFPQTAAIRQARAAYKRGELRALDYLQRMRTEIEIAVRKQEELGLDVLVHGEAERNDMVEYFGEQLWGYAFTENGWVQSYGSRCVKPPIIYGDVYRPEPMTVETTRYAQSLTQRLMKGMLTGPVTMLQWSFVRDDQPRSTTALQLALAIRDEVVDLEKAGIRIIQIDEPAFREGLPLRRADWAAYLEWATRAFRISAAGVADQTQIHTHMCYSEFNDILPSIAAMDADVITIETSRSAMELLDGFGAFAYPNEIGPGVYDIHSPRVPGADAMQRLLERACEVIPAERLWVNPDCGLKTRGWPETEAALANMVRAAKALRAKLAARQADELDRVMXSAIEPASKAPXRAISCRA

SEQ ID NO: 4829 - protein, 207 aa, Burkholderia fungorum
LKLYHSASSPNSRRVRIFLAEKGVPVTLVAVDLGKGEQHGDTYRAINPRRVVPTLVLEDGTSIGEVPAIQRYVEETHPDAPLFGTTPKDKALITMWERRAEQEGFASVMEAIRNIAPGLKGRAIAGPHDYEQIPALAERSRQRAANFLADLDDRLKDSAFVAGERYSVADITALVTIDFAAKAIDLQVPADLESLKRWYDTVSSRPS

SEQ ID NO: 4830 - protein, 237 aa, Burkholderia fungorum
LITGALTGIGRATAIAFAEIGARLVVSGRREAEGKAFEKELRELGADAHFIQADVRRDEEVASLVDQTVARFGRIDAVNNAGTEGQPGAITSQTVESYSATFDTNVLGTLLSMKHELRVMSAQKSGSVVNVSSTYGHEGAAFASVYAGSKHAVEGMTRSAALEVASTGVRVNAVAPGPTDTGMLDRFTGTPENKAALAAQVPLGRIGKPDDVARAIVFLASDAASFVTGQIVTVDGG

SEQ ID NO: 4831 - protein, 481 aa, Burkholderia fungorum
LNVLLVASEALPLAKSGGLGDMVSAYAAALRDAGVDVSILMPAYPAALERAVDVTPVARMTGLPGGDARLLRGHMPDTGVPVLLLQMDHLFAREGLYRDPQGRDYLDNLTRFASLAAAAARVARGVRNVKRPDIVHAHDWHAGLTPLYLRLAGVAARSVFTIHNLAFQGNHPLAMGGWIGVPPELLAPALSDERSIEFYGSLSMMKAGIVHADRVTTVSRRYAREILTPRFGHGMEGVLQAQAAKLSGIVNGIDSAVWNPATDKHIARPYSVDDTAGKQACKRDLQQAFGLTRDPFAPLVAIGSRLTEQKLADVVVHTLPALLERHPRLQFAILGQGEQGIEQALQGIAAAWPGRVGVQIGYDERRAHMLHAGADILLHGSRFEPCGLTQLYAMRYGTIPVASRVGGLADTIVDYLPHDPRGDRKATGFLFDGETPDDVMHALGRALDAFVEPSSWHVLQRNAMSRDFGWATSTSNYLSLY

SEQ ID NO: 4832 - protein, 336 aa, Burkholderia fungorum
  unsure (1)..(336): unsure at all Xaa locations
MGYVMALSSQNAAKLSGRRRFLRTTGGSAIGLSAALAFPRLASSQTPGPSRTESTTPLPRMAQRVIPATGERLPVVGCGTWRTFDVGDDPAARAQLAEVLRILFEAGGSVIDSSPMYGSSEAVAGALLTQLGAHGKAFVATKVWTEGREAGIAQMEESLRRFQQPRIDLMQVHNLLDWRTQLATLRDWKARGRIRYIGITHYTSSAFDEVAAVMRSDKPDFVQINYAADDRAAEARILPLAAQLGIGVVINQPFGGGGLLARVGKTPLPGWAAEIGCASWAQVLLKFVLAQPAVTVVIPGTGRPQYMADNVRAGSGPLPDKAMCARIAEAVNGRAX

SEQ ID NO: 4833 - protein, 299 aa, Burkholderia fungorum
DPSIRVFDPRFKPLILASASVECLYQGARWSEGPVWFGDGRYLLWSDIPNDRILRWDEPGGTVSTFRQSSNNANGHTRDRQGHLVSCEHLTRRVTRTEYDGSITVLADHYRGKRFNSPNDVVVKSDGSIWFSDPTFGIDGFYEGKQQESELPACVYRVDSQSGEVSVVADDVLGPNGLAFSPDESVLYIVESRGEPRKIRAFDVGGNGTALANNRVLIDAGPGTPDGFRVDVQGNLWCGWGMGTDELDGVRVFTPQGEPLGHIALPERCANVCFGGRHRNRLFMAASHGLYSLYVNTQG

SEQ ID NO: 4834 - protein, 252 aa, Burkholderia fungorum
MAGRLSGKRIIITGAIGNIGKEAARGFIAEGARVVIGDIAEEAGRAVAAELGAAAHFVQVDVTSEASVANLIARGVEWLGGLDALAQNAGLQRSGAIAGFEQANWDALFAVNARAHFFGAKHAIPHLQRSGKGSIINMSSLAGKRGGPGLVAYSASKGAVIAFTTALALELAPDNIRVNAICPGWVDTAFNQPAIDFMGGADAQQKKIASLVPLGRQASATEIAPLFVYLASDESAYVTAQSFGIDGGVYNG

SEQ ID NO: 4835 - protein, 472 aa, Burkholderia fungorum
LMNHYDVVVIGCGAGGYNTAIRASQLGLSVACVERASNIGGTGMRTGCIPSRLLLHTSEIYDLANKGKNAALGIGCAPTLDLTQMMAYKASTVEKMSNSIHKLLRKQGVTLIHGDALLAAAGQVIVRKTGGVQQTLSGTALVIATGSVPIPLPFAAFDHMRILDSADALSLGKVPRHLAIIGAGAVGVELGSIWQRLGSRITLIERCDRICHWLDRDVTATLERSLRQRGIDIRVSSDVVGLDKHSDSVSVQLRAAASGKITHIDADRVLVAIGRRPSTAGMNLASVGMQTGYKSTLSQQGPATPVTSMTNGSGIWVIGDAGPGPMLMSKAEEEAIACAERIAGLPGFVSYPSIPYVLHTSPEVAMIGRTEDELRGTGAAYRVGYYPLAANPRAAICGTSEGFVKLLVDADTNLIAGAHLIGPGAADLISQVAIAMEASMICEDFARICHPYPVWSEALRQAAMAAGGWMMH

SEQ ID NO: 4836 - protein, 303 aa, Burkholderia fungorum
QGRVLVVGSINTDLVARAPHLPRPGETIGGHEFSQVAGGKGANQAVAAARIGARVAMIGCVGSDANGAQRVKDLEVEGIDCSGVEVHPTQPTGVAMVTVSDDGQNTIVVVAGSNGELTPQSVARHEAAIKACDVVVCQLETPWDSVHATLALARRLGKITVLNPAPATGPLPAEWLPLVDYLVPNEVEAAILAGLPVESQSGARRAATELQQGGAHNVIVTLGAQGAYLLVEGGEGRHFPAPQVHAVDTTAAGDTFIGVFAAQLASRQPLEGAINLAQRAAAISVTRAGAQPSIPTRAEVDNA

SEQ ID NO: 4837 - protein, 167 aa, Burkholderia fungorum
MTTQTETALLAGGCFWGMQDLLRRYPGVLSTRVGYTGGDVPNATYRNHGTHAEALEVVFDPRQISYRQILEFFFQIHDPTTKNRQGNDVGTSYRSAIFYLDDEQKRVAENTVADVEASDLWPGKVVTEIAPAGPFWEAEPEHQDYLERIPNGYTCHFVRPDWKLPKR

SEQ ID NO: 4838 - protein, 451 aa, Burkholderia fungorum
IRSAPATGPLSTTVTTTLEQLRAGQLAGVRRLKLACGLSEFPREIFDLADTLEVLDLSGNALSTLPDDLPRLVKLRILFASDNPFTELPEVLGQCPQLSMVGFKANRIRRVSGKALPLQLRWLILTDNEIEALPADIGNCTQLQKLMLAGNRLRALPEELAACSRLELLRLAANRLGGLPAWLLRLPRLSWLAYAGNPFSEALEAAALIDAPTAAIAWHELKLERQLGEGASGVIYRAELAGRRDASRAVAVKLFKGAVTSDGLPDCEMAACIRAGDHSNLIPVIGKVKDHPAGTHGLVMELIDPQFGNLAGPPSLESCTRDIYGADTRFDAASALGVAYGMASTARHLHEQGIMHGDLYAHNILYGGQGRALLGDFGAASFYAPEDGSTALALQRLEVRAYGCLLEELLERCDWPHSQADAAALLVELKDNCLSETIESRPLFDEITARL

SEQ ID NO: 4839 - protein, 160 aa, Burkholderia fungorum
YKLMDSPVGQLKLVANGERLAAILWQNDKPNRVRLGELIEANDRPVLIDTERQLNEYFAGTRREFDLPLAFQGTEFQKQVWAALLTIPFGQTRSYAEIAVQIGNVNAVRAAGAANGRNPISIVAPCHRVIGASGDLTGFAGGLANKMFLLSLEAGQTSLE

SEQ ID NO: 4840 - protein, 254 aa, Burkholderia fungorum
LISTRRSFTMNNLTGKTALVTGASRGIGRASALALAEAGAQVLVHYSSGEKEADAVVAEIRAAGGNAQKVAANLREADGPHKLAAQVRAVIGHRLDILVANAGISKAASIEDTTVEDFDDLFAVNVRAPYFLVQQLLPVMCKGSSVVLLSSLAARAAVGTLPAYAATKGAVDTLVKHFAAALGERDIRVNAVAPGVVETDMSNFTKTDAGREVTLGMQALKRVAQPDDIGGAVAFLASDAARWITGETLHVDGG

SEQ ID NO: 4841 - protein, 322 aa, Burkholderia fungorum
MQYRKFGRTGLTVSRLCLGTMTFGLQTEEDVSHRILDTAADAGVNFIDTANVYPLGGGESIAGRTEEIVGRWLKGKRDRFILATKAVGKMGPSAWDQGASRKHLLDAIDASLQRLGTDYVDLYQLHSDDANTPLDETLEALDVIVRSGKARYIGVSNFLAYRLARALGRADVLRVARFVSVQPRYNLLFRQIERELLPLAGEEQLAVMPYNPLAGGLLTGKHQLDVTPASGRFTEAVGKAGAMYQQRYWHKREFETIEQLKAIAAPTGESLTRVSLAWVLANPLITSAIIGASRAEQLSDTLAAADFVLDPQIRTQLDEASM

SEQ ID NO: 4842 - protein, 491 aa, Burkholderia fungorum
KRPAPPCTLVIFGAGGDLTKRLLMPALYNLAVDSLLDDGMKIIGVNHGARETSEWRDDLHKSLEQFAADKASTFHAGKLDDQAWDWVAQRLEYMAGEFETDDTFAQIKQKLEQTPGGNVIFYLAVSSRFFEPIVERLGNAGLLKEGDVGGFRRLVIEKPFGSDLASARDLNAHILSFAKETQVYRIDHFLGKDTVQSILAVRFANALFEPIWRREYIDSVQITASETIGVEGRGKFYEQTGAFRDMVPNHLFQLLGMVAMEPPNSFDAEAVRDRKAEIFDAIKPLTPDDVVFGQYEKGPAGVGYREEPDVAPDSTTETYAAARVFVENWRWAGVPFYLRTGKRLAGRRTEISVQLKPVPFRLFRDTPVDALTPNVLTLRIDPAHGTSFDFNVKTPGPVMQIGAVQSSFDYGDFFAERANVGYETLLYDCMLGDETLFQRADSIETSWCAVDDVLHPESGGAMPVHGYPAGSEGPAEADALLARGGHAWRPL

SEQ ID NO: 4843 - protein, 707 aa, Burkholderia fungorum
MTSTSRRRFLQTVASSAGAAAALTALPESIRNALAVPAFSRTGTIRDVEHIVVFMQENRSFDHYFGHLRGVRGYNDRFPIPLSSGKPVWYQPSKENPAQPVLPFHLDTATTSAQCVGDLDHSWYKTHAAIDGGRYDQWPANKTDMTMGYHLRSDIPFHYALADAFTVCDAYFCSLPGPTHPNRAYLMTGMVDPSGTLGGPLLDNNDFVDGDGPPNYQLLSWTTYPERLQAAGISWQVYQQGLTGSDPLNGNYGTNILQNFTNFINAQPGSPLYERAQTVRTIDDLKADVLANKLPQVSWLCPPAAYSEHPSYTPAYGAEYTSQILDALTSNPEVWSKTVLFIMYDENDGFFDHLVPPQPATTAAQGQSTVSTEGEIHNVVNPLRGGSYTADGLPYGLGPRVPMTIVSPWSKGGFVCSQVFDHTSVIRFIEARFGVYEPNITAWRRAVCGDLTTAFDFRTPDSKVPPLPDTSNYKSIADNQCATQPKPTVPATPGAIDPQESGIRFARALPYELHVNGHADAKKNTFELSIGNTGDQGAHFYVYSTNRTDGPWRYTVEAGKSLSETFDLTVTSGAYTFEVFGPNGFVRKFAGNTQQPKAHNAPFGGGHGNNKPAEPEVKVQYDVANGNVFLKFSNKGGGIARLTVTDNAYGARPRPVLVPAGAQIEEAWVLASSHHWYDLTVTSNDDASFSRRLAGHVENGRPSISDP

SEQ ID NO: 4844 - protein, 549 aa, Burkholderia fungorum
MPSIIGIDLGTTHSLAAIWRDSHAVLIPNALGETLTPSCVSIDDDGSILVGRPAHDRLHTHPERTAANFKRYMGTSRTVSLGAQTLRPEELSSLVLKSLKADAEAFLGEAVSDAVIAVPAYFSDAQRKATRIAGELAGLNVLRLVNEPTAASLAYGVHQRDSERKFLIFDLGGGTFDVSVLDFFEGVMEVRASTGDNFLGGEDFTEALAGLFCQRNGLKIRALAPVAAQRLHQQAERAKRQFTQNGVESVTLQLTIDGNEYVLELDAASAERTCEHLLQRLRKPVERALRDSKIAVAALDEIILVGGASRMPMVRKLVSKMFGRLPTAHLNPDEVVALGAAVQAGLVGRDAGLDEMVLTDVAPYSLGIDTAMQIGPSQFVPGHFLPIIERNTIVPVSRMQRIFTVRDRQPILSIKVFQGEARLTADNVSLGEFTLDVPPKPAGEAGADVRFTYDINGVLEVEATAFPDGRKRAMVIEENPGVMTPEEIRERLVALSALKIHPRDQLENRTLLTRADRVYEETLGDHRQYLAAHIARFQAVIERQNADEI

SEQ ID NO: 4845 - protein, 447 aa, Burkholderia fungorum
PVTRGSIIARLERLPRNAMQVRARILIGLATFFDGFDVIAIAATLPILIAKWHLTPWEIGFLIGSGSVGQLIGAFVFPWYAERGGRVKAIALSSGIIGITSIACGFAPTFAAFVVLRVIQGLGLGGELPVAATYINEISRAHGRGRFVLLYEIVFPVGLLASNALGAWIVPRFGWQAMYFIGGMPLILFFVLRKLVPESPRWLAERERMADADTAVHAFERAVKGPLPPVTHSAEFEAMANRHPKRRMSDLFGPAYLKRTLAVAMLWITCGFIQYGLSTWLPTIYRTIYHAPLQLALNLAVAASVLGVVGSLTCALLVDKVGRKPIINLSFVACALSLLLAGVFHDSSVYVVATFCAFSLGFLACGFITAYVYTPELYPTSIRAMGCGVGGAWLKVAAIFAPAIVSKTMIGGNLQVAFYILAAVPFLAAVTVHFLGIETKGKVLEQL

SEQ ID NO: 4846 - protein, 464 aa, Burkholderia fungorum
WRQGRGNPYTSLYPADQSVNMEISTANADDARDAVEAADIAWRRADWSGLKPHQRALILYRIADLIMARHEALAQLQRRDNGKPIGETRVLVASAANTFRYFAACLETLDEEVTPSRGDYLTMSIYEPIGVIAAITPWNSPIASDAQKLAPALAGGNAVVLKPAEVTPLVSLALARICEEAGVPKGVLSVLPGKGSVIGDVLVRHPLVKKVSFTGGTEVGRGIARIAADKLMPVSLELGGKSPTIVFDDADLDHAVNGVLYGIFSSSGEACIAGSRLFVQRSIYDTFMKRLADGARKLRVGDPSRSETQMGPLITAAHRETVERYVALGLEEGGRLLCGGERPVGDGREAGTYFQPTILEGLTNNARICQEEIFGPVLVAMPFDDEASLLKEANNSVFGLAAGIWTRDYKRAYRIARALEAGTIWINTYKLFSISTPFSGWKESGMGREKGRLGIREYMQQKSL

SEQ ID NO: 4847 - protein, 267 aa, Burkholderia fungorum
GALMIQIDLTGQVAVVTGGSSGIGLATAELFLRAGASVAICGRDTERLAQAEAALKAQFPQAQLLARRCNVLDADDVKAFAEAVQSRFGRTGMLINNAGQGRVSTFADTTDEAWREELDLKYFSVIRPTRAFLPMLRDASASNSNAAIVCVNSLLALQPEPHMVATSSARAGVQNLLKSLAVELAPQRIRVNSILIGIVESGQWRRRYAKEAQPGQSWEDWTAELARKKNIPLGRFGRPEEAAQALFYLATTLSSYTTGSHIDVSGG

SEQ ID NO: 4848 - protein, 245 aa, Burkholderia fungorum
LNGRRVLVTGGARGLGAAFVRSLVQAGARVVFGDVLHEEGEALAAALAEPGHAVTYVPLDLADPASIRQFAEQGAAQLGGIDALINNAAITNSGGKFADELSVETWDAVMNVNVRGTWLMSTAALPYLRDSGRGSIVNIASDTAMWGAPKLLAYVASKGAVISMTRSLAREFGAHQVTVNAIAPGLTEVEATAYVPAERHQYYLQGRALTRAQVPDDVTGPVLFLLSDAARFVTGQLLPVNGGFV

SEQ ID NO: 4849 - protein, 597 aa, Burkholderia fungorum
LPCVTHAAGIVADGGTATTVVSAANGGQTVNIAPAVSGVSQNTYSSFNVGVAGATLNNVGINARTIVNQVTSSNPSLIEGQISVTGSRANVILANPNGITVNGGSFVNTGHVALTTGQVSFDDLQIAPGIFQRNVVLNTTGGAIVIGPQGLSSALVDLDLIAKTIQINGPVANTFTSATAITRAVAGTSAVTLNTGLSPSDNANDWLTLQTGQPLATANSFALDITAAGSVTSGRVEIIVTDKGPGVRSAGPLDASLGDFTLSSNGSVQISNTTVTANGNINFQVQDGISLTDTRVTSGTATLDASGAITLTGSSILTNGGATLSANGITLTPDSAQTGSTLASATAGVVLDSTADITNLGSLIQGQAATSGDAQSLGAVTLDASGNILNQSLPGTPLGILFGVKGDVVVSAGGNIVNQNARILSNENVTIAAGGDVDNIIDHTSGVDNGVASSYSSDGWSFLFLEHHSSGISVNYGELSDPTALSYITADAGNVTITGNNINNVGGSILSNDGAISITARNSLLDQGVFTGQAQFHESCFIFCHSSASSDVQLYGGDIEAGTSISLKAGTQILNTGGTVLAEGALTLNAPHVVAQG

SEQ ID NO: 4850 - protein, 416 aa, Burkholderia fungorum
LNKDDLGPWGNYLRQVDRVAPYLGSLSRWLETLKRPKRILIVDVPIELDNGTVAHFEGYRVQHNVSRGPGKGGVRYHQDVTLSEVMALSAWMSVKNAAVNVPYGGAKGGIRVDPRTLSRGELERVTRRYTSEIGIIIGPNTDIPAPDVNTNEQIMAWMMDTYSMNQGQTATGVVTGKPITLGGSLGRREATGRGVFVVASEAARRIGVDIEGARIAVQGFGNVGGIAARLFQEAGSKLVAVQDHTGSLYKSTGIDAVALLEHVAKHGGVGGFPEADAVSNEEFWTVESDILIPAALENQITEKNAAKIRTKIVVEGANGPTTTAADDILHDRGILVIPDVVANAGGVTVSYFEWVQDFSSFFWTEDEINQRLERVMREAFAAVWQVSSEQKVSVRTAAFIVACKRILEARELRGLY

SEQ ID NO: 4851 - protein, 153 aa, Burkholderia fungorum
MGVSGAGKTRIGEMLAERLHCAFTDGDAFHSAANKEKMHHGIPLTDEDRWPWLKTIRAAIEEKQTAGETAVFTCSSLKRSYRDVLRDGDKDVCFVYLKGSREVLEQRLTTRTGHFFDPSLLQSQLDTLEEPGADEAITVSIELSPEEIVDSVL

SEQ ID NO: 4852 - protein, 424 aa, Burkholderia fungorum
ISMDIDQYMTDLGRRARQASRAMARASTAAKNAALAAVAEAIERDAASLKEANARDVAKAREKGHDAAFIDRLTLSDKALKTMVEGLRQVAALADPIGEISNLKYRPSGIQVGQMRVPLGVIGIIYESRPNVTIDAAALCLKSGNATILRGGSEALECNTALAKLIGEGLEAAGLPQDAVQVVATSDRAAVGKLITMTEYVDVIVPRGGKSLIERLMNEARVPMIKHLDGICHVYVDDRADLTKALTVCDNAKTHRYGTCNTMETLLVARGIAAEVLPPLGKLYRDKQVELRVDAAARAVLADAGVGPLGDATEEDWRTEYLAPVLAIKVVDDLDAAIEHINEYSSQHTDAIVTEDHDRAMRFLREVDSASVMVNASTRFADGFEFGLGAEIGISNDKLHARGPVGLEGLTSLKYVVLGHGEGR

SEQ ID NO: 4853 - protein, 263 aa, Burkholderia fungorum
KIAIAGASGRMGRMLIETVLNDSDATLSGALDRVGSPQLGQDAGAFLGKQTGVVLTDDIERVFAESDYLIDFTRPEGTLVHLEAAQRHNVKMVIGTTGFDNEQKAQLRAAADRIAIMFASNMSVGVNVTLKLLEYAAKHFATGYDIEIIEAHHRHKVDAPSGTALTMGEVIAHALGRNLDDCAVYSREGVTGERDPSTIGFSAIRGGDIVGDHTVLFAGIGERIEITHKSASRLSYAQGALRAVRFLEGHATGFFDMQDVLGL

SEQ ID NO: 4854 - protein, 418 aa, Burkholderia fungorum
SLFGRVVIALVAGIVIGAVYPHFAQSLRPLGDGFLKLIKMVIGPIVFCVVVSGMAHAGDLRKVGRVGLKAVIYFEVMTTIALVIGAILAYVTQPGVGMNIDLRSLDPSSLSTYTENAKSLKDTAGFLLKIIPDTAINAFATGDILQILVFSVLFGSALSLLGGKAQRVSSLIDELSQVFFRVMGFIIKLAPLGVLGAIAFTTGTYGVESLKQLGMLVLVFYVSCFVFVAVVLGVVMRLAGFSIFKLIRYLREELSIVLGTASSDAVLPQIMRKLEWMGVKDSTVGLVIPTGYSFNLDGFSIYLTLAVIFIAQATNTPLSVHDLIVVVLVSLVTSKGAHGIPGSAIVILAATLSAIPAIPVLGLVLILPVDWFVGIARALTNLIGNCVATVVVAVWENDIDRARAHRVLNRDEALRYVP

SEQ ID NO: 4855 - protein, 329 aa, Burkholderia fungorum
MTIRVAINGYGRIGRNTLRAFYENGKKHDIEIVAINDLGDARTNAHLTQYDTAHGKFPGEVSVDGDYLVVNGDKIRVLANRNPAELPWGELNVDVVMECTGFFTTKEKASAHIKGGAKKVIISAPGGKDVDATIVYGVNHHVLKASDTVISNASCTTNCLAPLVKPLNDKIGLVNGLMTTIHAYTNDQVLTDVYHEDLRRARSATHSQIPTKTGAASAVGLVLPELNGKLDGYAIRVPTINVSIVDLSFIAARDTTVEEVNAIMKEASEGSLKGILGYNQAPLVSIDFNHNPASSTFDATLTKVSGRLVKVSSWYDNEWGFSNRMLDTA

SEQ ID NO: 4856 - protein, 660 aa, Burkholderia fungorum
ANAIRALSMDAVQKANSGHPGMPMGMAEIGVALWSRHLRHNPKNPQWADRDRFVLSNGHGSMLLYSLLHLTGYDLPIEELKNFRQMHSKTPGHPEYGITPGVETTTGPLGQGLANAVGMALAESLLATEFNKPDATIVDHHTYVFVGDGCLMEGISHEACSLAGVLKLNKLIAFYDDNGISIDGEVVHWFHDDTPKRFEAYGWNVIPNVVGHDVEAVDAAIKQAKQSDKPTLICCKTVIGEGSPNKAGSHDSHGAALGDKEVAATREKIGWKWEPFVIPQEVYAAWDATEAGARNESEWDKAFAAYAAKYPQEAAEFKRRNAKQLPADWKEKAKAIIAGANERAETVATRKASQQAIEALSAVLPELLGGSADLTGSNLTNWKAAKPVRVNAEGKAAGNYVNYGVREFGMSAAINGVALHGGFKAFGGTFLTFSDYSRNALRVAALMKAPSIFVFTHDSIGLGEDGPTHQSIEHVASLRLIPHLQVWRPADTVETAVAWTHAVEHHGPSCLIFSRQNLPFSERTDAQIANIEKGGYVLRDWNDEIVARKIILIATGSEVELALNAVEPLAREGIAARVVSMPSTTVFDKQDAEYRERVLPQGVRRVAIEAGVTDFWRKYVGLEGGVVGIDTFGESAPAGVLFKHFGFTVEHVVETAKAAL

SEQ ID NO: 4857 - protein, 275 aa, Burkholderia fungorum
MAKVWLVTGSARGLGREIVEAALQAGEQVIATARDPRQLEDLLARHGERIRTVALDVTDPQAARQAVQAALDAFGRLDVVVNNAGFGHLVPFEQTSEDDFRAQIDTNFYGVVNVTRAALPVLRQQRAGHIIQISSVGGRVGIAGLSAYQAAKWAVGGFTEVLRQELAPFGVHVTALEPGGMKTGWGDQAAGATPELLADYVPSVGAVSDMLSQYIGHEASDPAKVAQVVLKLAYHDALPAHLLLGSDALHYCGAGDKARAADAQAWQAVSVSTDF

SEQ ID NO: 4858 - protein, 289 aa, Burkholderia fungorum
STEFRGIISYPVTPFDLHDGSVDVPTLNRLIDRLVDSGSHGIAPLGSTGESAYLSDDEWDTVAEASVRRVAKRLPVIVGISDLTTRNAVRRAKFAESVGADAVMVLPVSYWKLNEAEIFRHYATIAEAISVPIMVYNNPATSGIDMQPELIVKLAREIDNVTMIKESTGDIQRMHRIAQLSDGRVPFFNGSNPLALGAFAAGAAGWCTAAPNLVPQWPVKLYEACEKGDMELARAVFYRLLPFLQCIMKGGLPTTVKAGLALRGFSVGAPRRPLQPLAEPAVRELAAVL

SEQ ID NO: 4859 - protein, 216 aa, Burkholderia fungorum
GKDSFGGYLALPKGGKGPAVIIIQEIFGVNSHIRSVADQYAQDGYIALAPDVFWRVQPRVELTYEGADREKGIELMQKTNVDQAVADIGAAAAALRAMPEVTGKIAAIGYCFGGRLAYLAAAQGTLDAAVAYYGGGIQNQLDEAAKIKVPMQFHYGELDAHIPVSAIGQIQERFAGRTDAEFHIYPNADHGFNCSDRASYNQRAAALAHGRTLTFL

SEQ ID NO: 4860 - protein, 461 aa, Burkholderia fungorum
SLFRKKSVEHMIAASAQNAGLKKALGALDLTFLGVGAIIGTGIFVLTGTGAVQAGPALMISFLIAALACGFAALAYAEFASTIPVAGSIYTYSYATLGELAAWIIGWDLMLEYGLATSAVSVGWSGYLQSLLSGFGVSLPVALTAAPGALPGHDTLFNLPAFLVMMAITALLSFGVRESARINNIMVAIKVIVVLLVICVGVFHVTPANWHPFMPNGWNGVFGAAAVMFFAFIGFDSVSSAAEEVKNPKRDLPIGIIASLGVCAVLYVAVAAVVTGIVPSAQFANISHPVSYALQVAGQKWVAGFIDLGAVLGMLTVILVMAYGQTRVIFAMSRDGLLPARLSRVHPRFATPFFTTWLVGIFFGLIGAVVPLNVLAELINIGTLAAFSMVSIAVLVLRKTHPELPRAFRCPGVPVVPVLAVASCLFLMINLQAVTWVAFVVWLLVGMVVYFGYSRRHSRLS

SEQ ID NO: 4861 - protein, 421 aa, Burkholderia fungorum
LRFITAGSVDDGKSTLIGRLLYDSKAVLSDQLSALSRAKNKRTVGDEIDLSLLTDGLEAEREQGITIDVAYRYFATAKRKFIIADTPGHEQYTRNMVTGASTAHAAIILVDATRVTFVDGVAQLLPQTKRHSAIVKLLGLQHAIVAINKMDLVDYSEQRFNEIRDAYVELARQLGLNDVRFVPVSALKGDNIVTASESMPWYAGEPLLDLLEALPVEVPTGQALRFPVQWVARQDGSQADDFRGYMGRVEAGEVKLGDTIVVLPANREATVAEIIAPVPGGTAAVDRAFAGQTVTIRLAEDVDVSRGDTFVLREAAPEPAKKLEADLCWFDDTPLSTQRKYLLKQTTNTVFARIGAIKEVLDVHTLSQATDRKELTMNDIGRVALTLQKPLVCDVYDSHQGTGAFVLIDEATHHTVAAGMI

SEQ ID NO: 4862 - protein, 553 aa, Burkholderia fungorum
MYQYDQYDQTIVDERVAQYADQVRRRLSGELSEEEFRPLRLQNGLYMQRHAYMHRIAIPYGNLRSNQMRVLAQIAREHDRGYGHFSTRSNIQYNWIKLEETPEILRKLAAVQMHGIQTSGNCIRNITADQFAGVAPDEVVDPRPWAEILRQWSTFHPEFAWLPRKFKIAVSGSKEDRAAVQIHDMGVYLKKNEQGELVADILAGGGMGRTPIIGAIIRKDLPWQHLLTYCEAVLRVYNRYGRRDNIYKARIKILVKALSPEKFSAQSRRRMAAPEGRSFTLTQAEVDRVSQYFQPPVYEKLADTDASYEKHLLENRAFARWVERNVRPHKVSGYASVTLSLKPTTIAPGDATDAQMEAVADWADEYSLGEIRVSHEQNLILANVKKRDLFALWEKAKAQGFATPNIGLLTDIIACPGGDFCSLANAKSIPIALAIQERFNDLDYVYDLGDVSLNISGCINACGHHHIGNIGILGVDKDGSEWYQVTLGGEQGTGASGAQLGRVIGPSFSAEEMPDVMSKVIDTFVENRHEGERFIETYNRIGITPFKERVYAS

SEQ ID NO: 4863 - protein, 452 aa, Burkholderia fungorum
ISKSIFKAYDIRGVIGKTLDADAARSIGRAFGSEVRAQGGDAVVVARDGRLSGPELIQALSDGLRAAGVDVVNVGMVPTPVGYFAASVPLKLEGGERRVDSCIVVTGSHNPPDYNGFKMVLRGAAIYGEQILALHQRIVDENFSAGSGTYTEYDIAEAYLDRIASDIKLARPIKIVVDTGNGVAGGLAPKLFKKLGCELVELFTEIDGNFPNHHPDPAHPENLQDVIRALKETDAEIGFAFDGDGDRLGVVTKDGQIIYPDRQLMLFAEEVLSRNKGAQIIYDVKCTRNLAKWVKDKGGEPLMWKTGHSLVKAKLRETGAPLAGEMSGHVFFKDRWYGFDDGLYTGARLLEILTRVADPSQLLNSLPNSNSTPELQLKLEEGENFELIARLQQNAKFTGADDVVKIDGLRVEYPDGFGLARSSNTTPVVVMRFEADNDAALKRIQEDFRRVI

SEQ ID NO: 4864 - protein, 309 aa, Burkholderia fungorum
LPSSIPCSPIVSVTNLSKTYASGFHALKNINLAINRGEIFALLGPNGAGKTTLISIICGIVNASEGSVTVDGRDIATDYRAARSLIGLVPQELTTDAFETVWATVSFSRGLFGKPKNPAYVEKVLRDLSLWEKRDSKIITLSGGMKRRVLIAKALSHEPRVLFLDEPTAGVDVELRRDMWKLVRSLAQSGVTIILTTHYIDEAEEMADRIGVINAGEIMLVEEKTELMRKLGKKQLTLQLESPLAQVPVSLGGYGLAVAKGGNELIYTYESEGGRTDIIALLKALDDAGIRFKDLQTTQSSLEDIFVSL

SEQ ID NO: 4865 - protein, 474 aa, Burkholderia fungorum
RHDLLIDGKRLPPGTGEYSVDIDPATEEPIALVAQGSAADVDAAVHAARAALKVWNAIRSAERGRILMRLAGLMRANLEELAALESLDAGKPIAAVMRQDIPAAIDTLEYYAGWCDKINGQVVPVRPDALTYTLREPVGVVAAIVPWNFPLMIGMWKIAPALACGCTLIVKPAEITPLSALRIGELALEAGVPPGVLNIVTGKGRVVGDALVAHPGVDKVTFTGSPSVGRGILQGAAGNFKRVTLELGGKSANLIFPDANLDNAVRAAAAGIFFNTGQVCSAGSRILAHRDVYDEVVERLAARARSIKVGDPSSRETSMGPLISAAQMKTVLGYVETGRAEGASLVTGGARVGERGFFVEPTVFADVEHEMRISQEEIFGPVVSVIRFDDEADAIRIANGTLYSLAAGVWSADIGRVHRVARDLRAGTVWINTYGYTDVRLPWGGSGDSGFGREHGDVAIENFTEPKAVWLAID

SEQ ID NO: 4866 - protein, 411 aa, Burkholderia fungorum
EMDFETVSVVGLGYIGLPTAAAFAARRKRVIGVDVSQHAVDTINRGAIHIVEPELDMLVHAAVTQGYLRATITPEPADAFLIAVPTPFSDGYKPDLRFIEAASQAIAPVLKKGDLVVLESTSPVGTTEQMAAWMAQLRPDLTFPQQAGEQSDIRIAHCPERVLPGHVIRELVENDRVIGGMTPRCSELARELYQSFVRGECILTDARTAEMCKLTENSFRDVNIAFANELSIICDKLDINVWELIRLANRHPRVSILQPGPGVGGHCIAVDPWFIVDSAPEQARLIRTARTVNDSKPGYVIDRVERAARRFKDPVIACLGLAFKADIDDLRESPAVEIADELAERFAGQVVVVEPNVRTLPAALDGKVRLCELNEALLEADIIVILVDHAQFRRVDPVRFQAKVVIDTRGV

SEQ ID NO: 4867 - protein, 263 aa, Burkholderia fungorum
LRIATFNINGIRSRLPALLQWLEREAPDIVCLQELKAADSAFPVEQLRDAGYGAIWQGQSAWNGVAILSKGEAPLESRRGLPGFEDDTHSRYLEAAVGGIVVACLYLPNGNPQPGPKFDYKLAWFDHLIRHAAKLYRSGHPVVLAGDFNVVPTDEDIYNPRSWLKDALLQPESRERYRQLLAQGWTDALRTRFGNERVYTFWDYFRRHWETNSGLRIDHLLLSADLAPRLRDAGVDRWVRGEPHASDHAPTWVELEMGAGRRK

SEQ ID NO: 4868 - protein, 468 aa, Burkholderia fungorum
MSKQAIGVVGLAVMGRNLALNIESRGHAVSVFNRSREKTDELIAEYPDRKLVPAFTLEEFVESLEKPRRILLMVKAGEGTDATINQLKPLLDKGDILIDGGNTHFTDTIRRNQDLAKSGLHFIGTGVSGGEEGALKGPSIMPGGQRDAYDLVAPILTEIAAKAPDGEPCVAYMGPDGAGHFVKMVHNGIEYGDMQLIAESYAVLKQVVGLSNEELGKVYTEWNQGELDSYLIEITSKIFSKKDEETGKDLVDVILDRAAQKGTGKWTSQNALDLGAPLPLITEAVFARVLSSLKTQRVAASKVLEGPAARPLGAEREAFIESVRRALYFSKVISYAQGFAQLRAASEEYKWDLDYGTIAKIFRAGCIIRARFLQKITDAYTKDKAIANLLLDPYFRDIAKNYQSALREVVIAAINAGVPVPAFASAIAYFDAYRSERLPANLVQAQRDFFGAHTFERIDKPGSFHANW

SEQ ID NO: 4869 - protein, 803 aa, Burkholderia fungorum
TVDALRRSISNRMMYGVGKDAVTAHPHDWLHAAALAVRDRLVARWMKTTRLQYEQDVKRVYYLSMEFLIGRTFTNALLALGIHDQMKEALASLGVDMQMLTDIEPDAALGNGGLGRLAACFLDSMATLGIPGFGYGIRYEYGMFRQQIVNGEQVEAPDYWLRAGNPWEFPRPEVTYMVHFGGRTVQRGDHVEWIDTEHVNATAYDTVIPGYDTDATNTLRLWSARATEELDLGAFNRGDYRNAVDTKNMSENVSRLLYPDDSTPAGRELRLRQEYFFVSATMQDLIRRYQRTHSTFGRFSEKVAVHLNDTHPVLAIPELMRLLVDVHRLQWDKAWNHVTQIFSYTNHTLMPEALETWDVEMLARLLPRHLEIIFEINAQFLKHVSEQSDHDGEMIRRISLVDEYGQRRVRMAYLAIVASQKVNGVSKLHSQLMTRDIFADFARIYPDRFTNVTNGITPRRWLAQASPSLSSLIDQKIGRHWRTNLFELEQLRELRNDSGFIDAFREAKRQNKLRLVHRLAHHTKLHFDPDALFDLQVKRIHEYKRQLLNVLHVIVRYNQIRANPERDWVPRVVLFAGKAASAYRMAKSIIKLIGDVSQKVNHDPLIGDRMKVVFVPNYGVSVAELIIPAADLSEQISMAGTEASGTGNMKLALNGALTIGTMDGANIEICDAVGRENMFIFGYTADEVDRLRATGYRPRQIYEENPELRMALDQIRSGFFSPDDPLRFADIFHTLVDWGDHYMVLADFAAFAKAQDEVDARFVDKRAWTESAIENVAGMGQFSSDRTIGEYARNIWHVSPLNI

SEQ ID NO: 4870 - protein, 218 aa, Burkholderia fungorum
QTIEIETAPNPEFAVILLHGLGADANDFVPLVPELRLANGPAVRFVFPNAPEIAVTANNGYVMRAWYDIRSFQSIERQVDEAGIEASCATVRQLIAGQNARGIPTTRIFLAGFSQGGAMTYSAGLTHPATLGGLIVMSGYLPSRAFIESRLAPANHGTPIFAAHGEYDQVLPIQLGEAARDFALAQGSKVEWHAYAMEHSVCGEEVAALRAWLGARIA

SEQ ID NO: 4871 - protein, 285 aa, Burkholderia fungorum
MLKVTKAVFPVAGLGTRFLPATKASPKEMLPIVDKPLIQYAVEEAIAAGITEMIFVTGRSKRAIEDHFDKSYEIEAELEARNKQKLLDLVRSIKPANVDCFYVRQAEALGLGHAVLCAEKLVGDSPFAVILADDLLHSSKPVMSQLVDTFNHYHSSVIGVETIAREDSRSYGVVDGREWEDNVIKLSGIVEKPAPDKAPSNLGVVGRYVLMPTIFKHIRALKPGAGGELQLTDAVQSLLTEEQVLAYRYFGTRFDCGSKLGYLKATVEFALRHPEVKAEFEAYLQ

SEQ ID NO: 4872 - protein, 499 aa, Burkholderia fungorum
MSYQYDERVDGPLATHDKATVVAQLQALIPDLPLLHEQEDLRPFECDGLAAYRATPMMVALPDKVEQVEALLKFANAHKIPVVARGAGTGLSGGALPLDKGILLVMARFNRILEVDPEACVARVQPGVRNLAISQAAAPHGLYYAPDPSSQIACSIGGNVAENAGGVHCLKYGLTVNNILKLEILTIDGERITLGSDALDAPGFDLLALFTGSEGMLGIVTEVTVKLLTKPQSAKVLLASFDDVEKAGAAVAQIIGAGVIPGGLEMMDNLAIRAAEDFIHAGYPVDAEAILLCEVDGVESDVREDVACVEALLRAAGATDIRLAKDEAERQRFWAGRKNAFPAVGRISPDYYCMDGTIPRRELPRVLKGIEDLSKEYGLQVANVFHAGDGNMHPLILFDANAPGETERAEAIGARILELCVAVGGSITGEHGVGREKINQMCAQFNSDELTFFHALKAAFDPQGLLNPGKNVPTLHRCAEFGSMHVHHGALPFPELERF

SEQ ID NO: 4873 - protein, 718 aa, Burkholderia fungorum
STSVKTVCPYCGVGCGMVLHVEDGQVVKISGDKEHPANFGRLCTKGQSAHVALRKSGRLEGAFVRHARGRDPAPLPMTQAISATAARLRGLLDEHGPDALSFYVSGQMSIEAQYLVNKLAKGFVGTNNIESNSRLCMASAGSGYKLSLGADGPPGSYEDIDHADLFFVIGANMADCHPILFLRMMDRVKAGAKLIVVDPRRNTTAEKADLFMQIKPGTDLALLNGLLHLLHENGHTDAAFIAEATEGWEAMPAFLADYTPEKAAQITGLAVEDIRAAAQMIGSANEWISCWTMGLNQSTHGTWHTNAICNLHLATGKICRRGSGPFSLTGQPNAMGGREMGYMGPGLPGQRSVLVEEDRAFIEDLWRIPKGTLKPEAGNGTIDMFTRMAAGEIKACWIICTNPVASVANRQNAIDGLRAAQLVIAQDAFLDTETNRYADVLLPGALWAEAEGVMINSERNLTLMQKGVEPPGAALPDWQIIARIACEMGYAEGFTYASAEEVFAEITRVSNPKTGYDLRGASHRRLKETPLQWPLASDESAERNPVRYLNDGVSQTLKELADGSRPRLVFPTASCKAVFFARAYAAPAELPDREFPIVLNTGRLQHQWHTMTKTGKVAMLNKLNPAPFVEIHPEDATTLGIKAQDPVEIRSRRGRAVLPAVVTERVSAGSCFAPMHWNDVFGDDLCINAVTSDAVDPISQQPELKFCAVALSPVAADS

SEQ ID NO: 4874 - protein, 592 aa, Burkholderia fungorum
NAPFDTTSRLYVDGLLAGLYSRSAMVPAASAPTLAVSHAETSHASGVRIVRARPKVTLLWASQTGNTESLTEGYATRLMESGFEIRTSCMADYPASALAKAQYVLLMTSTFGDGDPPDNAQSFWTQLSGEGAPRLDGVRFAVLALGDRNYDQFCGHGRRLDERLAGQGAQRLMDRVDCDSEYQASADAWLERIIVRIKEEDAALYAVPAGGMVNAVVPGTVPTKTRPAASRLVSNLRLNKQGAAKDTRYVSLHTGDSGLEYEAGDALGVWPSNCPELVDELIGLSGLHADAAVNVAGAGEMRLADALGKHYEIARPNPDLLAFVAARSNNGALRDLLAPDRKADLKQWLWGQQIADVLHEFPVSLTASELTGMLKRLQPRLYSIASSPKAHAGEVHLTVAAVRYSNGRRHRKGVSSTFLADRAGDVNVPVFVQKSAHFRPPHGSETPMIMVGPGTGVAPFRGFLHERRARGDTGRNWLFFGEQHAASDFYYRDELESMRDSGVLTRLDVAFSRDQADKVYVQDRMREQGAQLWAWLEDGAHFYVCGDANRMAKDVDAALKEVVARHGGMSDDKALEYVSRLAQEKRYARDVY

SEQ ID NO: 4875 - protein, 325 aa, Burkholderia fungorum
RLETTVMGFGAAPIGNIFRPVSEEDSAALIKAAWDAGVRYFDTAPMYGHGLSEVRCGQGLRWYPRDQYVLSTKVGRLLKPRRRAEIDFAPWVDGLPFEPVFDYSYDGTMRSIEDSLQRLALEHIDIALIHDIDVFTHGERQPEMFEAAMAGASKALLKLRDEGVVKAVGLGVNEWQVAHEAIRRQDFDCLLLAGRYTLLEQDALDGFLPLCEKKQVSVILGGGYNSGILATGAVPGAKYNYAPAPEAILERVRKMEQVCREFSVPLKAASLQFVLGHPAIPTNIPGVRTVAQLEDNLQTFRAEIPAEFWAELKRRELIRDDAPTP

SEQ ID NO: 4876 - protein, 411 aa, Burkholderia fungorum
MSFALLGLIDPLLRNVQDLNYQTPTPVQVKAIPAVLGGRDVMAAAQTGTGKTAGFALPLLQRLVQHGPAVSSNRARVLVLVPTRELAEQVLQSFIDYGKGLDLRFLAAYGGVSINPQMMKLRKGVDVLVATPGRLLDLNRQNAVQLDQVQTLVLDEADRMLDLGFARELNAVFAALPVRRQTLLFSATFTDDIRAMAAGILRDPVNISVSPPNATASKIRQWVVTVDKKNKPDLFMHLVAGNNWRHALVFVKTRNGVDYLAAMLDAAGYAVDTIHGDKPQPARLRALERFKTGEVQMLVATDVAARGLDIDDLPLVINVDLPIVAQDYVHRIGRTGRAGASGVAVSLVCADEAPQLAAIEALIRQTLRREEEPGFEAEHRVPQTSATGEIIRKPKKPKKSKVPQAAPREMQ

SEQ ID NO: 4877 - protein, 178 aa, Burkholderia fungorum
SRLIEITPATHGVDIDLVYATGRNLTGKPIYKEAHCLLLEPAEAGLRNAIGIARDAGLRLRIFDAYRPPQAQQVLWDFLPDSTYVAEPERGSNHSRGTAIDLTLLDAGGHELDMGTGFDAMTIESEHFHPGLPVHVQRNRLLLLGIMHAAGFAHIKNEWWHYELPGSRALPLIDDSES

SEQ ID NO: 4878 - protein, 792 aa, Burkholderia fungorum
RVAHLLSVLFASLSGVYLLVGGIWLAATGGSLYYVFAGIVMLVTAVLIYRRSPLALGLYALLLLCTIVWSLWEVGTDFWALAPRLDVLVVFGIWLLLPYVYRAFEPSAKTHGLALGATLIVSVAVLVFAVFNDPQEINGTLASAPAQAAATPAGERVAEGDWPAYGRTQHGTRYSPLKQINADNVKDLKVAWIFRTGDMKRSTDPGEITNEVTPIKVGDMLYLCSPHQILFALDAATGQEKWRFDPKLKTDPSFQHVTCRGVSYHDSTASGSNNDSPDQAPATAPAICARRVYLPVNNGHLYALDAQTGQLCPDFANHGDLDLQVGQPVTTAGQYEPTSPPVITGKVIVIAGSVEDNYSTREPSGVIRGFDVNTGKLLWAFDPGAKNPEAVLGAGQHYSVNSPNSWAPAVYDAKLDLVYLPMGVSTPDIWGGYRTPEQERFASGLLALNATTGKLAWFYQTVHHDLWDMDLPAQPTLADITDRSGNLVPAVYAPAKTGNIFVLDRRTGTPIVPAPEKPVPQGAAQGDHVSPTQPFSALTFRPDRKLTGADMWGATMFDQLVCRVMFQRLNYDGTFTPPSVKGTLVFPGNLGMFEWGGIAVDTDRQIAIANPIALPFVSRLMPRGPGNPIEPAAGGTGGSGTESGIQPQYGVPFGVTLNAFMSPLGLPCKQPAWGYISAVDLKTNQIVWKKRIGTVRDSSPLPLPFKMGMPMLGGPMTTAGDVFFIGATADNYIRAFDTNTGKQLWQARLPAGGQATPMTYEAKGKQYVVIAAGGHGSFGTRLGDYVMAYALP

SEQ ID NO: 4879 - protein, 556 aa, Burkholderia fungorum
NLLEVRDLRVSFGAHEAVRGLNFEVAQGETLALVGESGCGKSATALSLMRLVPAPAQVTGSVCFDGRELLDLSAPEIRAVRGRQISMIFQEPMTSLNPVLSIGAQIVETLRQHERLSKAAAWKRAIELLELVRIPEPQRRVFDYPHELSGGQRQRVMIAMAVACRPRLLIADEPTTALDVTIQARILELLDGLRRELSMSLLLITHDLGVVAQHADRVAVMLAGELVEEAPVEQLFTRPGHAYTQGLLGASLNLADDLHYQGWKLPEIRHGIADDGKPTFAVVPRSARTGQYVTQTAVRSAAHDDAPLLALHDVRIDYPHRHGKSTLRAVDGVSLQIARGETVGLVGESGCGKSTLSKAILRLIPATRGQIRLRGTDLVPLRERELRPLRRHVQMVFQDPYASLNPRRTVGEILNTVLVVNGVDDARQRQLRIAAILDRVGLPGSALGRFPHEFSGGQRQRIGIARALVLEPDLLICDEPVSALDVSIQAQILNLLVELKRDLGLAYLFISHDLSVVRYIADRVHVMQAGRIVESGDHREIWRAPQHAYTRTLLEA

SEQ ID NO: 4880 - protein, 854 aa, Burkholderia fungorum
WHAETAESTIERFGTDATRGLDTAEAARRRAVYGRNEIIETERRRIITMLIEQFKDFMILVLLAAAIVSGLVGDLEDALVIVTIVVLNGTIGFFQDFRAEHAMAELKRLAAFHASVVRDGHPLTIAAAEVVPGDIVLLEAGGAVPADLRVIEAPQLRVSEATLTGEAAPVDKHPQPLTGDATLPIADRTNMVYKGTVVTYGRARGVAVATGMNTELGKIAALLESAPALQTPLQQRLSRFGKQLAIAILAICALIFVFGVSSGEPPILMLLTALSLAVAAIPEALPAVVTMMLALGARSMAQRAALVRRLPAVETLGSVSFICTDKTGTLTLNAMRVVEVCPAGTQRLQTANMGVDDITGQLLRAVSLCNDATYDASGKLAGDPTEVALWEVAADAGIDRSALDRSMPRCTEMPFDSVRKRMTTVHRAEDSFIAYTKGAPETVIERCTSVVGQDGTPFDTTTLTSMAGAMAADGLRVLAVAMRRWPQKPPADTDELECDLTLLGFIGMLDPPRPEAAGAVALCRQAGITVVMITGDHPITALAIARSVGIASDEAQVMTGYTLGKLSDEALLEATQRIRVYARVDPSQKIRIVKAMQSTGHYVAMTGDGVNDAPALAAANIGVAMGKVGTDVAREAASVVLLDDNFATIVAAVREGRRVYDNVRKFIRYVLTGNLAELCAIALAPLFGLPIPLLPIQILWINLLTDGLPGLALAAEPAEPTIMQRPPRPPDDSLFAHGLWQYIVRIGIAIAAVTMGTQWFAMGLDDAHWRTMTFTVLALSQMGHVLAIRSGQTSIFTQGLLSNRPLAAAVALTVVLQLAAIYVPVLNNILDTAPLSAPELGFCILVSALIFVLV

SEQ ID NO: 4881 - protein, 287 aa, Burkholderia fungorum
IFSGIWVPLITPFADGAVDHAALRALVRRYAGAGMAGLVALGTTGEPAALDAAEQDAVLATILDEAQAAARHSHDARALPVLVGVAGNHTASMRERIGQLNPLPIAGVLMAAPYYIRPSQAGIVDHFTALADASAKPVVLYDIPYRTGVRLELDTLLALAAHPRIQAVKDCAGSLDTTLALIRDGRLQVLAGEDINIFNTLCLGGSGAIAASAHVRPERFVALYRALAAGRLDEGRRIFHALAPLIQTLFAEPNPAPVKALLAAQGLIRDELRMPMTRAGDALRERL

SEQ ID NO: 4882 - protein, 416 aa, Burkholderia fungorum
  unsure (1)..(416): unsure at all Xaa locations
YTQSVHRDHPPSSRQVPPXAPATSLPTRRDAPPEHDARHVREPHRRVAPGARYLAPAGDSQESRAMPEIVERFVSEIVVHGEPGEKHTQSVDSQSLASQMLFEGKPQLLSVDQFSRDSVEALFRVADIMQPIARRRKISRVLEGAVLGNLFFEASTRTRVSFGAAFCRLGGSVCDTTGFTFSSMAKGESIYDTSRVMSGYVDALVIRHPEQGSVAEFARATNVPVINGGDGPGEHPSQALLDLYTIQREFSRLGKIVDGAHIALVGDLKYGRTVHSLVKLLALYRGIKFTLISPPMLEMPGYIIEQISRNDHVIEQTHDLSTGLRGADVVYATRIQKERFTDESFEGYTPDFQINQALVDSVCGVDTLIMHPLPRDSRPGANDLSVDLNHDSRLAIFRQTDNGIPVRMAIFAVLLG

SEQ ID NO: 4883 - protein, 434 aa, Burkholderia fungorum
DWRGHLHGRSLAVVCPSRVEDVGETIRIARRHQISIVPQGGNTGLAGGATPDSTGRQLVLCTRRLNRIRGVDLLGNFITVDAGCILQNVQDAAQSHDRLFPLSLAAQGSCTIGGNLATNAGGNAVLRYGNMRELCVGIEAVDAQGRLIGDLKCVRKNNTGYSLRDLLIGSEGTLGIITGAALRLFPRPFAYATALVKCADIDHALQVLGILRAHCADFLSGVEWMSNGSLSNVSKQFLDTRIPPGFDESCLCLVELSGSTPPGLLDDILASALDQAITSGFAADAALASNLAERDAFWALRERLPLAEARCRSLKHDVSLPAGNMSEFVAHLEGYLSSMTLRCAWAGFGHLGDGNLHANVLIPDTMPDALCDCIDEFVYSEVLRLEGSISAEHGIGSRKNDLLHRALDVASLQAMQAVRNALDPHNLFNPGKLL

SEQ ID NO: 4884 - protein, 267 aa, Burkholderia fungorum
VWLITGCSTGFGRELAAAVLARGWRTVVTARDPASIADLVEGRETHALAARLDVTSASDIETVVARTLDAYGQIDFLVNNAGYGYLAAVEEGEDAEMRAMFEVNFFGAVNMVKAVLPSMRARRSGHIVNVTSVGGFVGNPSSGYYAATKFALEGLSESLARETAELGIRVTAVEPGPFRTDWAGRSLKQTGTPIDDYASIAGKRRTQVVERSGRQPGSPERAAEAIIAAVTDREPPEHLVLGSAGLAMVRSKLARVAADLDAWESTT

SEQ ID NO: 4885 - protein, 280 aa, Burkholderia fungorum
ETTDILGECPLWSEAEQALYWIDIRRPGIQRWHPASDALRYWPMPDLVGSIALCRDNRLLVASRSLFYLDTRTGEMTRFAPQRAEDAALRFNDGKCDRQGRFWVGTMNDRTREPVGELFRVDERGAVSIEADIRVPNGTCFSPDGRTMYFADSDLQTIFTYALDPGTGALGERREFAKTTLPAVPDGATVDEQGHIWVAEYGGWCIKRYAPDGSVDRVFDMPVQNPTSCTFGGRNLDTLYITTASQRLTPDELAKQPFAGALLAFQPGVRGLPEPLFRGN

SEQ ID NO: 4886 - protein, 474 aa, Burkholderia fungorum
LTSSSVSLLPEVARFLDAGPLGGVIDGRDEQAADGATFETLDPGTGEHLATVAAMGPADVDRAVDAARRAFARSGWATMHPNDRAIWLHRLADEVERRKAIIGQIEALDAGKIEQQAQGDVQSFVDTLRYFNELALNTERRSALPVSGYEAWTTRQPWGACGFIVPWNFPMVLIGWNISPALAAGNTVVIKPAEDTPLSAIYLARLAREIGFPDGVINVVTGLGEIAGAALSRHPGLRRMSFTGSPEVGRMVAEACGRNLVPCKLELGGKGAAVIFDDVNIEETADKLARAITFHTGQVCCDATRWLVHESIFERFVDASVAALQRTKIGYQLDPGAEMGPVVSAKQRERVLGYLERGQRDGARAVLKGGAVDVAGHDGFYVSPALLAGSLENVAAREEIFGPVAFLAPFRDEAQAVELANDTDYGLANSVWSHDPRRASRVAEAMVAGNSWINAHNLFPLGVPYAGVNRSGMG

SEQ ID NO: 4887 - protein, 249 aa, Burkholderia fungorum
MDLELRGRTALVTGASTGIGTGIARALASEGVRLAITARRDALLEEVAASIVAEGGVRPIVIVGDLTAPGHIERILAQATDALGQIDILVNNAGASRPAPLDSGEDVWEEAFALNFTAARRMTHAVLPAMRSRKWGRVINISGSMEPRGLNPSGPAKAALHLWAKSLSREIAADGITINTIPPGRIHSEQIEKRLHPTEESKQAFIARNVPIGYFGDPLDIGYLAAFLASPRARYITGDVIPVDGGMHF

SEQ ID NO: 4888 - protein, 398 aa, Burkholderia fungorum
EAFLCDAIRTPIGRYAGALSSVRADDLGAVPLKALMERNKEVDWNAIDDVIYGCANQAGEDNRNVARMSLLLAGLPQGVPGTTVNRLCGSGMDAVGIAARAIKSGEAALMVAGGVESMSRAPFVTGKATSAFSRQAEIYDTTIGWRFVNPLMKKLYGVDSMPETGENVATDYNISRADQDAFALRSQQKAARAQRDGTLAQEIVGVTIAQKKGDPVTVSQDEHPRETSLDALAKLKGVVRPDGTVTAGNASGVNDGAAALLLANEETARRFGLTPRARVLGIATAGVAPRVMGIGPAPATQKLLARLNMSLDQFDVIELNEAFASQGIAVLRALGVADDDTRVNPNGGAIALGHPLGMSGARLVTTAMYQLHRTQGRFALCTMCIGVGQGIAIAIERV

SEQ ID NO: 4889 - protein, 302 aa, Burkholderia fungorum
FPGQGAQTDGFLHRLPRHRAVRDTLEEASQVLGADVLTLDTPDALRSTVAVQIGLTVAGVAITRALADEQLVAEISAGLSVGAYAAAVGCGAIHFADALKMVRRRAELMETAYPSGYGLAAISGLTEYQVETLAARHADENRQHVYIGNVNAPRQIVVAGANDALDAFAARALAAGARKAARLAVSVPSHCELLAQATDGLVAYAKEIPFHAPHSTYVGNRGGRPLYTADAIRDDLATNMRYTVRWFDALAVMQEMGARVLIEAPPGQVLTDIAREYFPDSTALAASTFPFDRLVATARRRL

SEQ ID NO: 4890 - protein, 255 aa, Burkholderia fungorum
LENYFARIGYDGPRAATLEVLHTLHRLHPRAIPFENLNPFTRRPVKLDLDAVERKLVTGRRGGYCFEQNALFADVLLQLGFAVTPLLGRVLWGRESDAVPPRTHMVLRIDLNDEAWIADVGFGSVTLTAPLRLTAGLAQPTELGTFRLADASRDALFLEVQARDESWARVYRFDLHPVEWIDYETSNWYTSTSPEAIFASTLIVCRVLPEARLALLNDQLSERAADGRLISERQLRSAAELAACLRDQFGLNTGE

SEQ ID NO: 4891 - protein, 317 aa, Burkholderia fungorum
RIPIIDLAGVRAGDPQALQRVAQEIREACTTIGFFYIVNHGVPQALIDAAAQAARRFFAFPVETKRRAAVNHRHRGFNALGDATMYQAKRPDYKEFFSIGLELPEDDPDVLAGQALRGPNNWPDFMPELRPALYGYYEAVGACGADLLRAVAVSLGVEEQFFAPRYTKRMQRTQMVYYPPQPPQSDEDQFGVAPHTDYGCITLLWQDQVGGLQVREIANDTWVDAPPVEGSFVVNVGDLLARWTNDRFRSTLHRVINASGRERYSIATFYDPTYGARVDPRDLGTNETDLKYQPVAAGDYILGRINDSMGYRKKRAA

SEQ ID NO: 4892 - protein, 435 aa, Burkholderia fungorum
SERAMTDWTRHEPTRPAALLLPRTTEQVSRALAICHAAHQPVVPQGGMTGLAGGAIARATDIALSLERLDGVEEVDAASATLTVRAGTTLQAAQEAAAEAGFELALDLGARGSCQIGGNLATNAGGNRVIQSGTARDQVLGLEVVLANGDVLTSLGKMVKNNTGYDLKHWFIGSEGTLGVITRAVLRLHPPRAARHTALVALDGYDAAVNLLRRLSTRFGNDIGAFEIMWPDFYDFGVKLTGTRSPFADAHPLYALIEHASFDSDDDGERFSAALTEALEAGAIRDAVIAQSVADVRALWAIRECTAEFPVRLDAINFDVSLPIGAIGAFVDRCRAALDQRWPGNASYFFGHIGDSNLHVTVDGHSIPGVNHHAVYAFVYDMLGPLHGSVSAEHGIGLLKREFLPISRSPAELAAMAAIKHALDPHGILNPGKLF

SEQ ID NO: 4893 - protein, 583 aa, Burkholderia fungorum
  unsure (1)..(583): unsure at all Xaa locations
YDVVVVGSGYGGAIAACRMARAGRRVCVLERGREFMAGEFPRTPFQGAAQVQYNTAAAHIGSPLALLEVHVNEDVNAVVGCGLGGTSLINANVALEADPRLWDDARWPAALRADKAARDKGYALARAMLQPSPVPKDYPVLPKLQALEKSAQALGMEDRFTRPDITVTFEDRVNAAGVAQKACVGCGDCNSGCNYDAKNSTHMNYLPDAVAHGAQIFTGTAVHSVRRDATTRKWIVGYQLVSLGRESYGAPDLFVSADIVIVSAGTIGSTALLLRSRNQGLSVSGMLGKHFTGNGDVLAFAYNTEPVINGVGWGSHEPGDIPPVGPTITGLIDHRNTANVRDGYVIEEGSLAGPVGAALVGLLGAAAPLEGVDVAPRSLPEQIAYDARMVRELSARPLSRRAQSHAKLPRHGAXRRRRPDRRGRHRPAAHRVGKRRQAADLSGGRGGAQAGHRAARRQIPAQSDLHRIIGNRTVTVHPLGGCGMGEDAEHGVVDHMGRVFSGATGNAVHDGLYVMDGAVMPMSLGVNPLLTISALAERNCELLLATHPVTAAPADGAAATPSLPPAPTPELASSSLTPSSPQK

SEQ ID NO: 4894 - protein, 523 aa, Burkholderia fungorum
MFITGEMLIGRKAVRGEEKPLHAFNPATGSDIAEPVFGSGSVAHVGEACELARQAFDPYRQLPLTVRAEFLDRIADGITALGDALIERAHQESGLPKARLEGERGRTTGQLKLFAQVVRAGQWLAATLDSPLPERKPLPRSDLRMQKIPLGPVAVFGASNFPLAFSVAGGDTAAALAAGCPVVVKAHGAHLGTSEMVGRVIQRVAQEMDLPEGVFSLIVGAGNSVGEALVAHPAIKAVGFTGSRAGGTSLMRVAAARAEPIPVYAEMSSINPVFLLPNALAQRGESIARGFVDSLVLGAGQFCTNPGLAIAIDSDALKGFVATASGALSGKPAQTMLTSGIHAAYEEGEGKLAATKGVEAVAHGVEASGPTQARAALFVTDAQTFLATPALEDEVFGPASTIVRCRDEQEMLAVAEHFAGQLTATVQMDSADLPAAKKLVPILERKAGRLLVNGFPTGVEVSHAMVHGGPFPATSDSRATSVGTTSIERFLRPVCYQDFPADLLPEALADSNPLNLWRRRDGE

SEQ ID NO: 4895 - protein, 442 aa, Burkholderia fungorum
ASAAHVAKRTRVRYAILLLIFLITTFNYADRATLSVTGSAMRAEFGLDAIRMGYIFSAFSWAYVLSQLPAGWLLDRFGARRVYAASIFFWSLFTLLQSSIGLLGSAAAAVTALFALRFAMGAAESPAFPANAKVVASWFPTNERGTASAIFNSAQYFAAVVFTPLMAWLTHAFGWHMVYVVMGVMGLLLALTWLKVMKNPADHPRVSRAELEYIEQGGGVVNGQKKARAIDRIENTGGWSLVRQLLSNRMLLGVYLAQYCINVLTYFFLTWFPIYLVQARGMTILQAGLVASLPAICGFSGGVLGGILSDGLIRRGHSLTIARKAPIVGGMLLSVCIIGCNYVSTDWVVVALMSLAFFGKGIGALGWAVVADTSPKEALGLSGAIFNMFGNVAGIVTPIVIGYLVAKTGSFNGALVFVGINALLTVFSYLVIVKDIKRVELR

SEQ ID NO: 4896 - protein, 302 aa, Burkholderia fungorum
PQELKQIVSEGLLSFPVTDFDEQGDFRADTYAERLEWLAPYGASALFVAGGTGEFFSLTHTDYSDVVRTAAEVCKGKVPILAGAGGPTRVAIAYAQEAERHGANGILLMPHYLTEACQEGIAAHAEEVCKSVPNMGVIIYNRANSRLNADMLEGLAERCPNLIGFKDGVGEIENMVSIRRRLGDRFSYLGGLPTAEVYAAAYKALGVPVYSSAVFNFIPKTAMDFYRAIAADDHATVGKLIDEFFLPYLAIRNRRAGYAVSIVKAGAKLVGHSAGPVRAPLTDLTEEEMATLDALIKTLGPQ

SEQ ID NO: 4897 - protein, 295 aa, Burkholderia fungorum
EVAGQAPASVGESPVWRIAEQALYWVDIPAQKIVRLRIDSGERSEWRMPEKVACIAFDHRGTVLAGCETGLFAVTLAGATATGEAVQVTGRKLAAPDFACDDMRFNDGRCDRQGRFWSGTMVQDMAAARPAGALYRFDARGVLSAPVVDGLITQNGLAWSPDGATMYLSDSHPLRRQIWAFDYDGETGEPRNRRVFADLNHHAGRPDGAAVDADGCYWICANDAGLLLRFTPLGKLDRQIAVPAIKPAMCAFGGRDLDTLFVTSIRPAANASEHDGHLFAVRPGVTGLPEPEFAG

SEQ ID NO: 4898 - protein, 208 aa, Burkholderia fungorum
MITIWGRTNSVNVQKVLWCCDELVLPYERIDAGLQFGRNDEPAYLAMNPTGKIPTLVDDDFVLWESNSILRYLVLNYGESSLLYPSEPKARASIDRWLDWSLSTLQPAERPVFWALVRTPAAARDTAKLASDFDAVALLWRMLDSHLQGRFFLEGEKFTLADIVIGAYAKRWFGVEGVERPPLPNLERWYSRIATRTGFKKYVDFPLT

SEQ ID NO: 4899 - protein, 480 aa, Burkholderia fungorum
LDMIIFGGTGDLSFRKLLPALYMAHLHCNLPPDTRILTIGRKPWSREEYINEFMEQKAKPFIEKKAFDAAAWDKFLALFEYVRMDVDSVEDYQRLKEASREGVRRVFYLATSPDLFTNICDNLAAAGLVDGNSRVVLEKPLGHDLASAQEINTAVGKHFSEAQIYRIDHYLGKETVQNLMVLRFGNPIFGPLWQAPYIKSVQITVAETVGVGSRAGFYDKTGALRDMVQNHLLQLLCIVAMEPPVSLDPDAVRDEKLKVLRSLRPMTPEDIARDTVRGQYTAGAVDGEAVKGYLEEDNVPAGSRAETFVALRAHINNWRWAHVPFFLRTGKRMQKKVSEIVIEFSELPFSIIPNGNSGRNYGNRLVIQLQPEESIQLQVLAKEPGSGMHMLPVNLNLDLQQAFTERRAEAYERLLIDVIRGRLTHFMRRDELEAAWAWAEPILAGWSKSGEKPRGYTAGTFGPAASTALMARENAVWAEE

SEQ ID NO: 4900 - protein, 172 aa, Burkholderia fungorum
IKSHIRTVPDWPEPGVQFRDITPLLQEPKSLRVLIDLFVQRYIDAKLDYIAGLDARGFIIGPILAYELNLGFIPIRKAGKLPYNRLAQSYELEYGCATVEIHEDACKPGDRVVIIDDLIATGGTMMAGKILLERLGAVVVEGAAIIDLPELGGSKLLRDSGLALYTVTGFEG

SEQ ID NO: 4901 - protein, 406 aa, Burkholderia fungorum
MFTGTTGRVFLLICAMYFIEYVDRVNLSIAAPLLKSEMHLSNTQLGIALSAFGYCYAIFQVVNGYLGDRIGPRRMLAFSGILWALGTLATGVTGGLATLVLSRALVGLGEAGTIPNATRAMANWVPLAKRGFAQGFTHSAARAAATVTPPLIVLLIPLLGWRGAFIALGCVSAIWVVVWALYFRDDPRTHPSITAGEVDTLPPYAGPRHRTAVPWWALIRRILPVTLVFFCHAWTLWLYLSWLPSFFVGVYGIDLKSTALFTSGVFLAGVVGDTAGGLLTDAIYRRTGNLNTARRNVIIMGFAGSLLFLTCVLFVRDRTVIALCLAAALFCLESTEGPIWAVPMDIAPAFAGVASGFISTAAGLAAVVSPVAFGLITDMTGSYRLPFVMSIALLLVGIGLSFWIRP

SEQ ID NO: 4902 - protein, 241 aa, Burkholderia fungorum
AVVTGAARNIGREIALQLAAAGNAVIVNARSSAAEAAEVVREIEAAGGRAAAHLADVSEPAGARSLMEAAIDHFGQIDILVNNAAVRREVPFAELDFARWREVMSVILDGAYLCAHAALPYLRQSKAGAIVNIGGMSAHAGSAGRAHVIAAKAGLVGLTRALAHDLGPDGITVNCVVPGLIATVRGGSAGNTEPAHHAERTTLLGRRGQPDEVASLVQFLCGPTARYLTGQAIHANGGAFL

SEQ ID NO: 4903 - protein, 456 aa, Burkholderia fungorum
SVSARLDRLPPTRYFSGLVARIAIGGWFEFYEMFMAAYISLGLISSGLYRATTAGLFDVDGFASFLGSFFAGMFVGTVALGGFTDRFGRRAVFTCAMLIYSVATFAAAFQHSPQAMDLWRFVAGLGIGVQLITVDTYISELTPHHTRGRYSAFSILVILTSVPTVAVLSFLLVPHTILGLEGWRWVMIIGSAGAVLIWFMRRGLPESPRWLESKGRLDEARAIVDAIEARVVAETGRALQAPAQRAPQPLTGEHGGSWSEMWKGRYLSRTIMLSFFNFFQTFGVYGFGAWVPVLLYTKGITITHSLLYTMVIAFATPLGALGAMACAERIQRKWQLVGCAIVVAVAGVLFGMVREPLLILLFGSAVTIANNWLIGIFHTYQAELYPTRIRARAVGFVFSWSRLSSIFVGFWVAALLKHSGVPAVFVLISSAMFVIVVMVGLLGPKTNGIRLEELSQ

SEQ ID NO: 4904 - protein, 437 aa, Burkholderia fungorum
GARLDRLPIASFHWKILGLISAGAFLDAFDIYLAAGALGAMVKAGFSDLKLNALFISVTFLGMLIGAGFAGYLGDRFGRRSSYQTNLLIFGIASIAACFVPNMMWLIVLRLIMGVGLGAELVVAAGTLCEFIPPASRGRWTALLALIINSGLLVSTAVGYVVIPHLGWRYMFAIAGVGAIIVWVLRHRMPESPRWLESVGRSDEAEATVSAIEHEVQRQKGSLPPVERIENLEVPKAPFSALFSHAMLGRTLVAILTAVAVNISVYGFVAWLPTFFVKEGLTIVQSLGFTTLMAFGAPGGALIGFLCADRVGRARGLVIFAIATIVVGFIYPNMHAGWAISSVGFVLVTCIYTVTTLGLFAYIPELFPTELRLRGTGTAGVCGRAASMTTPYLAVVLYNSFGVSGVLAMVSGVLALLVLGILLLRVETNQHALERIS

SEQ ID NO: 4905 - protein, 346 aa, Burkholderia fungorum
ENDQLILDMLDRFLETEVRPYVHKFDHDDIYPAEIVEKMKEMGLFGCIIDPEYGGLGLSTRTYAQIIARISRVWMSVSGIINSHLILAMLVQRNGTPEQKSKYLPKFATGEWRGGIGLTEPDCGTDLQAIRTTAKRVGDEYVVNGNKTWITNSKHGNTLALLVKTDTTAQPRHRGMSLLLVQKGPGFEVSRQLEKLGYKGIDTCELSFNGYHVSTDALIGGVEGKGLQQILGGLELGRINVAARGVGVAQAALDESVSYSQQRKTFGKPICEHQAIQLKLGEMATRVEAGRLLVDAAAQKYDRGERCDMEAGMAKYFATEAALENSIEAMRIHGAYGYSKEYNVER

SEQ ID NO: 4906 - protein, 485 aa, Burkholderia fungorum
MRFLRFLKIFFTVIRFGLDEMMLSRVNDRRVRLLLRITTIGRKFDAPPGVRLRLALESLGPIFVKFGQVLSTRRDLLPVDIANELAKLQDQVPPFDSAVAIGLVEKSLGAPVDVLFDDFERVPVASASIAQVHFATVKAGQHAGKAVAVKVLRPNMLPVIDSDLALLRDIAVWAERLWADGKRLKPREVVAEFDKYLHDELDLMREAANGSQLRRNFAGLDLLLVPEMYWEFCTPTVLVMERMVGVPISQVETLRAAGVDIPKLAREGVEIFFTQVFRDGFFHADMHPGNIQVSLDPAHFGRYIALDFGIIGALSDFDKNYLAQNFLAFFKRDYHRVATLHLESGWVPPTTRVEELESAIRAVCEPYFDRALKDISLGQVLMRLFSTSRRFNVEIQPQLVLLQKTMLNVEGLGRSLDPELDLWKTAKPYLERWMNEQIGLRGWYERLKIEAPQWSKTLPQLPRLIHHALAERHDHTRGANDEMIR

SEQ ID NO: 4907 - protein, 393 aa, Burkholderia fungorum
LQDAYIVAASRTPIGKAPRGMFRNTRPDELLVHAIRSAVAQVPGLDTKVIEDAIIGCAIPEAEQGLNVARMGALLAGLPNTVGGVTVNRFCASGLTALAMAADRIRVGESDAMIAGGCESMSMVPMMGNKPSMSPHIFDRNEDIGIAYGMGLTAEKVAERWKISREAQDAFSVESHRRAIAAQQAGEFNDEIAAYTITERFPDLATGEVRVKTREVSLDEGPRAETSLEGLAKLRAVFANKGSVTAGNSSQTSDGAGALIVVSEKMLKEFNLTPLARFVSFAVRGVPPEIMGIGPKEAIPAALKAAGLKIDDLDWIELNEAFAAQSLAVIQDLGLDPAKINPLGGAIALGHPLGATGAIRASTVVHGLRRRNYKYGMVTMCVGTGMGAAGIIE

SEQ ID NO: 4908 - protein, 495 aa, Burkholderia fungorum
LALKVFRHLHALSLRFHLERQTGGMSRDIERGTRGITQLISYSLYSILPTLVEVGLVLGFFVVKYEAYYAVVTFIALAVYIVFTVKVTEWRTHFRRTMNDLDSKANSRAIDSLLNYETVKYFGNEEWEASRYDENLKRYRTAAIKSQRSLSALNFGQQAIIGTGLVFILWRATQGVMAGRLTLGDLVLINTFMLQLYIPLNFLGVVYRELKQSLTDMDRMFTLLGAAQEVPDLEGAPALRVSGAQVRFEHVNFAYEPARQILHDVSFTIAAGTTTAVVGHSGSGKSTLARLMFRFYDLDRATGGAITIDGQDIRDVTQDSLRASIGIVPQDTVLFNDSIYYNIAYGRPSATREEVIAAARAAHIHEFIEGLPKGYDTPVGERGLKLSGGEKQRVAIARTILKNPPILLFDEATSALDSRSERAIQHELDQIARERTTLIIAHRLSTVVHAQQIIVMDKGRIVERGTHAELLRANGLFAQMWALQQQRTTEAPESA

SEQ ID NO: 4909 - protein, 502 aa, Burkholderia fungorum
TIRSVGIVGSGAMGRGIAQIAALAGLNVHLYDIRQDAVEAARHHLRDTFATLATKGKIAVNAATDAVARIRSATSVDALKNCDLVIEAIAENLDAKRDLFTRLDAVVREDCILASNTSSLSITAISTACSKPSRVAGFHFFNPVPLMKVAEVIDGLHGVRETGDRLMELARRMGHTPVRVKDMPGFIVNHAGRGMNTEGLRIVSEGVADFVDIDRIVREQAGFRLGPFELMDLTSLDVSHPVMESIYHQFYEEPRFRPSPVTAVRLAGGLVGRKAGEGFYRYPGGRKEIPDEGLVHAALPERVWISSRSIDAHRQVTDLVAPTGVTIESGERPSESALILVMPYGKDATTAALEEGLDASRVVAIDCLFPLSASRRRTLMTTPLTNPSFRDGARALCSHGGAAVTVIRDSAGFVAQRIVAMIVNIGCDIAQQRIASPDDIDLAVTLGLGYPNGPLAMGDAVGAARILEILRNMTALLGDPRYRPSPWLARRAQLGMSLTQAD

SEQ ID NO: 4910 - protein, 284 aa, Burkholderia fungorum
VKTVAVAGSGTMGTGIAIVAARAGFRTIVFDTRQDALDRARGQTEAFLRKSVARGKLSVEDLDAILGRWSSTTKLEDLASGDVVIEAVFEDLRVKHELFSALDRVCAADTIFASNTSTISITEIAGGSGRPDRFVGMHFCLPAQLMKLIEMSPGLETSDDTWQRAWEFALQMGQQPVKTKDTPGFILNYFLIPYNNDAIRLVEAGVAEPAEIDRAIRTALGYPMGPLELLDLVGMDTQRLLCEAMHGLTNEDRAACPPLVKRMIAAKRLGKKTGHGFHRYTDTK

SEQ ID NO: 4911 - protein, 459 aa, Burkholderia fungorum
  unsure (1)..(459): unsure at all Xaa locations
MKVTIVGTGYVGLVTGACLAELGNDVLCLDVDAAKIEELNNGGVAIYEPGLSEVIARNRDAARLTFSTDIAKGVAHGDIQFIAVGTPPNEDGSADLKYVLAAARSIGQHMDSFKVVVDKSTVPVGTADKVRETISRELAARGHGAQFAVVSNPEFLKEGAAVEDFMRPDRIVLGYDPDVAGLRAKSLMEQLYAPFNRNHQRTLCMDVRSAEFTKYAANAMLATRISFINELANLADRVGADIEHVRRGIGSDPRIGYSFLYAGCGYGGSCFPKDVQALMHTANENGMELNILASVEYVNTLQKTVLFDKIKQHFNNALNGKHFAVWGLAFKPNTDDMRAATSRQLIAALIRGGASVSVYDPVALDQARRSLAADLGPDNFEHVTFAKERDMALQNADALVILTEWKEFRSPDFEQMNEALNDAVIFDGRNLYDPTAMRDSGWKYYTIGRDAAHSTSRXR

SEQ ID NO: 4912 - protein, 363 aa, Burkholderia fungorum
KVALITGVTGQDGSYLAELLLSKGYEVHGIKRRSSLFNTERIDHLYQEPHASDRRFVLHHGDLTDSTSLVRIIQRAQPDEIYNLGAQSHVAVSFEEPEYTANVDGVGALRILEAIRILGLEKKTRFYQASTSELYGLVQEIPQKETTPFYPRSPYAVAKLYAYWITVNYREAYGIYACNGILFNHESPVRGETFVTRKITRAISRIATGLQECLYLGNMSALRDWGHARDYVEMQWLMLQQEQPEDFVIATGVQYSVRQFVEQAAAELGIHLRFEGSGVDEVGIVERVVGGDTKVVRGDVIVRVDPRYFRPAEVETLLGDPTRAHEKLGWKPATSFESLVTEMVRADYQVAKRDALVTLAGFK

SEQ ID NO: 4913 - protein, 291 aa, Burkholderia fungorum
MLKVTKAVFPVAGLGTRFLPATKASPKEMLPIVDKPLIQYAVEEAMAAGITEMIFVTGRSKRAIEDHFDKSYEIEAELEARGKDKLLELVRSIKPSHVDCFYVRQSEALGLGHAVLCAEKLVGDNPFAVILADDLLHGTPPVMRQMIEAFDHYHSSMIGVEEIPSQDTGSYGVIDGSEWGDSIIRMAGIVEKPEPNVAPSNLGVVGRYVLKPRIFKHLRAIKAGAGGELQLTDAIQSLLADEQVLAYKYHGTRFDCGSKLGYLKATVEFALRHPEVRSEFRAYLEKHLSLL

SEQ ID NO: 4914 - protein, 447 aa, Burkholderia fungorum
IHATKGNTMTSIAVRNPRTGELDYQIDDMDAAHIGAAVAAARKAQRAWEQGGLAHRTTALLAWANELEKNGAEVVAALSIDTARHRISAEELGAVIHFIHGFCEHAPAVLATPFRKLEAHPDVVFKVTYAAYPVVGVISPWNFPLVLSFIDAIPALVAGAAVIIKPSEVTPRFIEPLRRSIEAVPALANIITLVTGGAETGAAIVAQSDAVVFTGSVPTGQKIAIAAAQAFIPAFLELGGKDAAVVLAGADVERAATSILRSALYNSGQVCYAIERVYAHDSLYDALVEELRAQAGALKRSNAAGDGGHYGPMIFEKQATIIDAQLDDAVNKGASIVLGGKSERVNGAVWIDPTIVTNVDHTMTLMTDETFGPIVPVMRFSDDTEAERLMNDSLFGLSGAVFGPDTHIAGDFATKMEAGGVSINDTELPRVMMFDGEKTAFKKSGMG

SEQ ID NO: 4915 - protein, 367 aa, Burkholderia fungorum
VNVPVVRASTVRFERDAERATLHRRREAGEAVSTYGRHGMATHRALEAALGELEGASDVLLAPSGLAAISLVFIALLSPGDHVLVQDSVYGPVRERIEPLLTRLGVSFSYFGASDGVPAALLRPQTRLIYVESPSSFLYEVVDLPALAAFAREHGVLLAADNTWGAGLLYRPLALGADISVQATTKYPGGHSDLMQGAVSTADAKLARRLRDTHDALGLSVGADDAYLALRGLRTLAVRLAQHGRNALEVARFLQTGTRVVARVFHPALPDHSGHALWQRDFTGANGLVSFAFRHAQPADASAFVDALRLFGIGASWGGYESLALIAPSARLREHSYWRGDVPVVRLHIGLEDPADLIDDLSQAFRR

SEQ ID NO: 4916 - protein, 684 aa, Burkholderia fungorum
MLQTQAAECGLVCVGMIANYFGHDMDLASLRRRFTTSLKGATLNDIMQMSNQLGLTPRALRLDLNDLAKLNRPCILHWEMNHFVVLKEVSRDKITVHDPARGIRDIPMDEVSRGFTGVALELMPSASFQPVAEKQSISMLKLIGGVIGIRSAFVQVLLISAALEVCGIISPFYMQWVMDQVLVSADVDLLTLLGIGFLMLVVFQNAIAALRSWVVTWFSSLLSVQWTASVCSHLLKLPMSYFEQRHMGDIVSRFGSVGTIQSMLTSRFISTLLDGVMASITLVMLFVYSPMLTWLVLGLFAVYALIRWIAYRPLRRANEDQIAYSARAQSQLLESIRGVQTIKLGNKQEARVATYTNSVVDMTNRGIAIQRLSISFSTLQGVISGIGRVVLIWLAARQVLQNEFSAGMLVAFISFADQFTSRASGLIDTVIDIRMLRLHGERLADIVLTEPESNMEGSVTRANLVEEAKDRAPGIEVSNLRFRYADTEPWVIKDCSFTVEPGESVALIGPSGQGKTTMAKLLLGLLMPQKGEIRVDGVDIKKLGMLGYRDMIGSVMQDDILFAGSIADNISFFDTHPDYAQVERVARIAQIHDEITAMPMGYQSLVGDMGSSLSGGQAQRVLLARALYRNPSILILDEATSHLDVDRERLINDAIRNMEVTRIIIAHRPETIRSADRIIAMQQG

SEQ ID NO: 4917 - protein, 473 aa, Burkholderia fungorum
MYIGGEWVEPASGEYFETVDPFTAKPWALIPRGNAEDADRAIRAADKAFRDGPWRAMHPSERGLVLQRFGQLIGQHADELAGIEVRDNGRLLAEMRHQIRGIPKWYYYYGGLADKIEGAVHPVEQPALSFTRHEPLGVCVGIVPWNAPLLLLSLKAAPALAAGNTIVLKPAEFTSASALKLMELVEQAGFPPGVVNVVTGFGKEVGEPLVAHPLTRHLGFTGSTATGSHLYALAAKDVKRASLELGGKSANLVFNDADLNNAVRGVVGGIFGAVGQTCIAGSRLLVQRRIHDEFVDKLAAFTKTARIGDPRKPETQIGPIANRMQYNKILGYIDIAREEGAELVMGGARPDIAECGEGFFIEPTIYTGIRNDMRIAREEVFGPVLATIPFDDPEEAIAIANDSDFGLGAGVWTSDMRLALRMSERLEAGSVWINTYRDISYTTPFGGYKKSGIGRENGIEGIREYLQTKAVWI

SEQ ID NO: 4918 - protein, 388 aa, Burkholderia fungorum
AALQTSVAPPTLLPHPLLETIGARAAGYDRENRFFAGDLEDLQRVGFLRASVPVELGGLGLTLPQLLREQVRLATRAPATALALNMHLYWIGAALHLYRRGDASARWILTEAAAGKVFAAGHGEPGNDLGLAHSFVKATPLGDGGYRFDGRKILTSLAPAWDWLGVHGLDDSDPAAPKIVHAFIHRDAAGHRTVETWDALGLRATRSDDTYLEGAIAQHQHVIRVLPAGIPDDPFVDGILGAVLPGLAAVYYGIAKRALELAIATAKTRTSQALAGKTYAYKPLTQLSVAQAAIELDSIEALVERVAAQWWQGYPDGEPWIARLLASKQHAVDGALRVVNLALKIAGAGALSKNNELERLYRDVRAGAFHPPNADATHEVIGQAWLGV

SEQ ID NO: 4919 - protein, 732 aa, Burkholderia fungorum
IQEKAPVETSRVLVHQNKPDGFMCVSCSWAKPAHPHTFEFCESGAKATAWDLTSRRVNPEFFQQHTLAELEQWHDQALEDAGRLCAPMRWDAALDKYVEVTWEHAFAEIGRELRAIKPDEAVFYTSGRASLETAYMYQLFARMYGTNNLPDSSNMCHESTSVGLKQAIGVGVGTITLEDFKHTDLMFFFGQNVGTNSPRMLHDLQEARERGVPIITFNPIREPGLVSFVNPQSPTQMLKPGATQISTQYHQLKAGGDSAAIVGICKAVIEADDRAQATGAARIVDAGFIAEHTSGFDDFARYVRNARWDELERICGLTRAALTAAADEYMRAKAVIIHYGMGLTQHRMGVQNVRMIVNLLLLRGNIGKPGAGPSPIRGHSNVQGQRTVGVTEKPELAPLDKLAEQYHFTPPRKEGMATVDACKGVIDGKVRAVFQLGGNLVRSVPDRYAIEPAWRKLRLTVSIATKLNRSHLVHGEVSYLLPCLSRIEIDERMGNAQAVAMEDSTGCMHGSHGVAQPASDQLLSEPAIVAGIAKAALDSTSVDWDAWSNDYALVRDAIAETYPEIFHDFNARMWTPGGFHRPLPARERKWETKSGKAEFMVPQTLNEDPDMPERQPDDLRLFTLRSDSQFNTTIYTLDDRFRGVRGTRMVLLMNRRDIERHGLEADAEVSLEAVSPDGIPRRVDGFRIMEFDLPAGCVAGYYPECNPLIPLSHHAKESKVPAAKAIPVRIVA

SEQ ID NO: 4920 - protein, 362 aa, Burkholderia fungorum
KALVYEGPRKVTVKEMPDAKIERPTDVLVKITTTNICGSDLHMYEGRTNMETGRILGHENLGVVVEVGAGVERIKVGDRVCLPFNIGCGFCKNCERGLTGFCLTTNPGMAGAAYGFAGMGPYSGGQAEYLRVPFGDFNCLVLPPDAEEKENDYVMLSDIFPTGYHATVLAGVEPGDSVVIYGAGPVGLMAALSASIKGASKIMVVDSHPDRLKLAEKIGAIPVDDTDGSSAERILEMTGGEGADRGCECVGYQCSCKGHEVPNLTMNNLIKAVRPTGGIGVVGVFVAEDPKAGDELAKKGQLALDFGQLWMKGQHIATGQANVKAYNRKLRDLIAAGKARPSQIISHELPLDKAPDGYKHFD

SEQ ID NO: 4921 - protein, 359 aa, Burkholderia fungorum
EFIAMLGHELRNPMAPIDSAVGAAKQLCSDNEKAVEVLTIAQRQMRHLRTLVDDLLDAARLKHGKLAIKHSNTSLNEIAFDAVTAVRHHIESRRHSLKVTGLDEQVPVRADHVRLSQVLGNLLSNAAKYTPTGGTIELTVKVAADEEPAQPDLVVIEVKDNGIGIDSSVQPHVFELFAQSARGNARAEGGLGIGLAVAKRMVELHDGTISLQSDGSGRGTSVTLRLPILRSRDDSPATVDTAQPRELRPVRLLLVDDNADALQSLGMLLELEGHQVTMSASGREAVQLIRQTLPEVAIIDVGMPDMDGFDVATAVRSDSRLDDVTLVALTGYAAESDKSRALAAGFDYHLTKPLSLEKL

SEQ ID NO: 4922 - protein, 425 aa, Burkholderia fungorum
IVTGAQGIRIEDHQGKSYIDAFAGLYCVNIGYGRTEVAEAIYEQAKKLAYYHTYVGHSTDTIIELSSRIIEWAPQGMKKVYYGMSGSDANETQIKLVWYYNNVKGRPDKKKIISRQRGYHGSGIVTGSLTGLASFHQYFDLPIGRVKHTVCPHWYRHAPAGMNEAQFVAYCVEELEKLIAQEGADTIAAFIAEPVMGTGGILPPPAGYWPAIQQVLKKHDILLICDEVVCGFGRLGSKMGAQHYGIAPDLITVAKGLTSAYAPLSGVIVSEGVWDVIDKASQEFGAMGHGWTYSGHPICAAAALANLDILERENLTQNAAQTGAYLLEQLHAAFDSHPLVGEVRGAGMLAALEFMADKDGRQPFDAALKVGPRVSAAALQRGLIARAMPHGDILGFAPPLITSRSEVDEIVKLAREAVDEVASAV

SEQ ID NO: 4923 - protein, 481 aa, Burkholderia fungorum
MLLGHPVLFKSLCYVDGRWVHSASAASVAVHNPADQQVLGHVPMLDAAQITEAVGAAQRAFSTWRWLPVSQRSALLLRWHELILRHQHDLAAILSLEQGKPLAEARGEIAYGASFVEWFAHEVRRLNGRTIPTHIDGAHLGTMIEPVGVAALITPWNFPCAMITRKAAAALAAGCTVVVKPAHETPFSALALAQLAEEAGFPAGVFNVVLGEPQMAMERLVGDSRVRSVSFTGSTRVGALVMQAAARAGIKKTALELGGNAPFIVTGDADLDQAVRVAVAAKFQTSGQDCCAANRIFVARPLYEAFVAQYSDAVKALKVGAAFEANVDVGPLMHQAAFDSTAQRVADAKARGARITAGGGAHERGGWFFEPTVVADAAPGMRIYDEENFAPISAVSPFDSLDEVVERANDTEYGLAAYVCARDLNTVFQLIRRLDFAMVSVNGAKFTGAPIPFGGIKSSGLGREGGAEGFEPFVETRYFCL

SEQ ID NO: 4924 - protein, 251 aa, Burkholderia fungorum
LSGKRGLVVGIANEHSIAAGCARMFRAIGAEIAVTYLNDKAEPYVRAVAETLPASLVMPCDVTVPGQLEAVFARISREWGKLDFVLHSIAFAPAVDLHASLVDCSAEGFALAMDVSCHSFIRMTRLALPLMAEGGSLMTVSFYGAERAVDHYNLMGPVKAALESSVRYLAVDLAPRRVHVHAISAGAVKTRAASGLDHFDVLLDEVRARTPARHLVTIDEIGRIAAVLASDAGMTLTGSTLYADAGFHVVA

SEQ ID NO: 4925 - protein, 487 aa, Burkholderia fungorum
RATLAKAQPGARAEAVGRVEHVADGIALVSGLPDVRLNELLRFEGDRFGFALTLDADTIGAVLLDDADAITAGSIVTGTGQVVQVPVGPGLTGRVVDPLGRPLDGRGAVHADARMPIERPAPSIIERDLVAEPLATGILLIDALFAIGRGQRELIIGDRATGKTAIAIDAIVNQKNSDVICVYVAIGQRASAVERVIAAVREHGAPERCVFVFASSAASAGLQWIAPFSAMTIAEYFRDRGQHALVVIDDLTRHAATHRELALLTREPPGREAYPGDIFYLHARLLERAAKLSPERGGGSLTALPIAETDAGNLSAYIPTNLISITDGQIVLDTGLFAANQRPAIDVGLSVSRVGGKAQMPALRNVSGRLRLDYSQFLELEMFSRFGGLTEARVKAQVVRGERIRALITQPRFTPLRPVDEVALLGALAEGVFDALPVDLLPAIRTRVAAHLDAHGGNAGAVLEDTGTLDATAQALLVAAVRTLAQD

SEQ ID NO: 4926 - protein, 272 aa, Burkholderia fungorum
EVQGRISSVHELESVVSAMRGIAAARSREAQSRIEAIRACARTVGNAIGDALMFEQHDEPQAPPGHAAGNEVVIVLCAEQGFVGTFNEHVIEATARRVASRSTEFFLIGARGIAVAAEHGLTIGWSAPMVAHADEVPALADRITAALYERLNAGQATRVTLLHAVPNPSVTIEVVKTALWPFDFTRFKQALRANPPLITLTPEILLAKLAEEYIFAQLCEAIMLSFAAENEARMRAMVAARTNVHDTLDELIGESRRLRQDEITSEIVELSS

SEQ ID NO: 4927 - protein, 379 aa, Burkholderia fungorum
SRPALPAFVTSRVERYYRERVQETWGGGHIMRGRIAGPDALHLSSNDYLAIARHPDIIGSMAATLLENGNGLLMSGIFLHGDCPQLQFENRLATFMQAEAGVLCQSGYAANTGLIQSIASEQTPVYIDMMAHMSLWEGVRSAGAVPVAFRHNDAAHLEQQIGRYGQGIVLVDSVYSTTGSVCRLVSLADVCERHACVFVVDESHSLGTHGPRGAGLVVELGLQSRVAFRTASLAKAFAGRAGFISCPVDFQEYFKFESNPAIFSSTLLPHEISGLDATLSVIECADRRRTRLASSAAWLRQRLTELGYNLNGSRSQIIALEAGTEQRTIVLRDALESRGIFGSVFCAPATARNRALIRLSIHAALSDAQVEKIASVCRD

SEQ ID NO: 4928 - protein, 245 aa, Burkholderia fungorum
LILITGGGRGIGAATARLAAAQGYDVAISFVSNESAALAVAADVEAVGRRALPMRADSADPEQVAQLFAALDRQFGRLDVLVNNAAIIAQQSRLEDLGFERLQRIFAVNSIGPILCAQQAVKRMSRRHNGRGGAVINISSASAQLGSPNEYVDYAASKGALETFTTGFAKEVARDGIRVNCIRAGHIYTDMHASGGEPGRVDRVKDSIPMGRGGQPEEVARAILWLAGAEASFITGTFLDVTGGK

SEQ ID NO: 4929 - protein, 683 aa, Burkholderia fungorum
LLAIAFGLPAAYAADEVQNSSTTTSSPVPSTLQPVSQEQLDRAATTSNDWLLSNGSYAQTRYYRGAQINKTNVSKLRPAFIFQTAVNESMETAPIVSNGVMFITTSFNHVYAVDAVTGKEFWHYKHKMGAVTTFCCGPNNRGVAIAGDRLYMGTLDAKLVALDAKTGSVLWQTQIADPDEGYSETMAPTVVDGKVLIGTNGGEYGIRGFLKAFDANSGQLLWTFYTIPETGQEGVWATKDATGRDGKRDIDAEKKQLAEKGGDFYKTLGGGVWMAPAIDRQTHTVFFVVGNPSPDLYGAIRPGDNLYTDSLVAIDLDTGKYKWHYQYVPHDVWDLDAVSPPMLIDVRDNNGRMIPGVVHGGKTGHVYVHDRATGRLIRYSQAMIPQENMWTLPTAAGARMLPGANGGVEWSPMAFDPHTRLVYAANLHQPMTYQVEDAAYPGGSKLWLGGAFKTIASEQQWGKLSAVNVDTGKVAWDYKTEQPLIGGVLTTAGGLVFNGEGNGLFRAFDSATGKKLWEFQCGAGVNAPAVSYMVHGKQYIAVAAGGQYAARLQARQHRARLCVAMTMPMLRGTPGRARRSWTAVLCGWFAAAWLPLNAHADAEAGKAKAQVCVACHGPMGNSTNPDYPILAGQTARYIYLELKDFKEGRRSDPRMSPMAANLSREDMQDLADYFAAQKAASVP

SEQ ID NO: 4930 - protein, 601 aa, Burkholderia fungorum
MNLRTTVLGLAILASAALSSFVAQADSQLDGLMKNPSNWAAQAGDYANHRYSPLKQINENNVGKLQVAWTMSTGVLRGHEGAPLVIGDTMYIHSPFPNKVIAINLKDQTFIWQYLPKQDDQVVSVMCCDTVNRGLAYGDGKIFLQQADTKLVALNAKTGDVVWTAQNGNPKAGETNTNAPHVFGDKVLTGISGGEFGVRGRLIAYDIKTGKPAWTAYSTGPDKDMLIDPDKTTTYADGKMVPVGADSSLKSWKGDQWKLGGGTTWGWYAWDPKLNLVYYGTGNPGTWNPTQRPGDNKWSMSIFARDLNTGQARWVYQMTPHDEWDYDGVNEMILSDLSIDGKKVPAIVHFDRNGFGYTLNRETGQLLVAQKFDPAVNWADHVDMKSGKPIRNAAYSTQAAGSDHNVKGICPAALGSKDQQPAAYDPGSSLFLVPTNHVCMDYEPFDVDYVSGQPYVGATLSMYPGPNDNNSMGNFIAWDASKGKIVWSKPERFSVWSGVLATAGGVAFYGTLEGYIKAVRIKDGKELWRFKTPSGIIGNVFTYEYQGKQFIGVYSGIGGWAGIGMAAGLEKSTEGLGAVGGYRELAKYTALGGTLFVFAIP

SEQ ID NO: 4931 - protein, 344 aa, Burkholderia fungorum
MAFIALRQLLDHAAEHGYGVPAFNVNNMEQIHAIMQAAEATSSPVILQASAGARKYAGEPYLRHLVLAALEAHPDIPLVLHQDHGASPAVCQQAIRSGFTSVMMDGSLLPDQKTPAAYEYNVDVSRRVVEAAHAVGVSVEGELGCLGSLETGTAGDEDGVGAEGQLSRDDLLTDPREAQIFVEATGVDALAIAIGTSHGAYKFSRQPTGDILAIDRIVEIHERIPNTHLVMHGSSSVPQEWLAVIREYGGEIPTTYGVPVEEIQRGIAHGVRKVNIDTDIRLAMSGAMRKSMANARAEFDPRAALKAATAAASAICVERFEAFGCAGQASRIKPLPLDAMARRY

SEQ ID NO: 4932 - protein, 660 aa, Burkholderia fungorum
MADALRMLAIDAVEAAKSGHPGMPLGMAEIAVALWDRHLKHNPRNPAWPDRDRFVLSNGHGAMLLYGLLHLTGYDLPIDELRRFRQLYSRTPGHPEVGVTPGVETTTGPLGQGLANAVGMALAEALLAREFNRPGHSIVDHRTYVFVGDGCMMEGISHEAASLAGTLKLDKLTVLYDDNGISIDGHVSQWFSDDTPARFAAYGWHVVREVDGHDVDAVDRALSRARAAGRPTLICCRTVIGKGSPSKAGTHDVHGAPLGADEVANTRRALGWPHAPFAMPAEVRTLWDASERGAATEADWNTRFEAYRKHYPHEAAEFERRTQRTLPVQWRDTVRAMVSDADHAGESIATRKASQQAIAVLARALPELLGGSADLTGSNLTNWKTAVDVHADDSGLQGGNYLHFGVREFGMSAVMNGIALHRGHIPFGGTFLTFSDYSRSALRMAALMKTRAIFVFTHDSIGLGEDGPTHQSVEHAASLRLIPGLDVWRPCDTVETAQAWASAVERDGPSCLLLSRQNLPFAARSAEQIDAIERGGYVLRDWPAERAQTRIVLIATGSEVSLALDAVAPLAQAGIAARVVSMPSTSVFDRQPAAWRDAVLPPRVPRVAVEAGVRAFWRQYVGLEGGVVGIDTFGESAPAAALFEHFGLTARAVVDEARRV

SEQ ID NO: 4933 - protein, 346 aa, Burkholderia fungorum
TLSKFLIDTLDRQPCSTETARNAGLSALLIDVAAAIKSISAMLTKGALGGNYGSAQSINTHGEEQKKLDVATNEIFVQQCEWDGLLAAMVSEEMESVYAIPPGYPRGDYLLAFDPLDGSSNIDINGVVGSIFSVLRNGEGNGNANEKNGSDPRGTVGESAFLRPGCEQVAAGYAVYGPSTMLVLSVGNGTHGFTLEREIGNFVLTHSNIRIPEDTVEFAINASNERFWEPPVRRYVQECKDGRSGCRASDFNMRWIASMVAEVHRILMRGGVFMYPRDSKTPAMEGRLRLLYEANPMSFLVEQAGGLSITGRERILDVVPRALHGRVPVILGSKHEVERIGRYHGE

SEQ ID NO: 4934 - protein, 389 aa, Burkholderia fungorum
MRALRWHGKHDIRCDTVPDPIIEEGRDAIIKVSTCAICGSDLHLFDGFMPTMESGDIMGHEFMGEVVEVGKDNKALSVGDRVVIPFTIFCGECDQCKRGNFSVCERSNRNKEKADKVFGHATAGLFGYSHLTGGYAGGQAEYVRVPMADTTHVKIPDGLTDEQVLFLGDIFPTGWQAAVNCDIQPEDTVAIWGAGPVGQMAIRSAVLLGARQVVVIDRVPERLVMARAGGAITINFDEESVLDRLKELTNGKGPEKCIDAVGMESHATRSFDAMYDRVKQAVMLETDRPHVLREMIYVCRPAGILSVPGVYGGLIDKIPFGASMNKGLTWKMGQTHVNRWTDDLLHRIQEGQIDPSFVITHTVSLEQGPDMYKTFRDKEDGCIKVVMKP

SEQ ID NO: 4935 - protein, 464 aa, Burkholderia fungorum
QLLIDGKWVDGESAQSLTDKYHGNEYGRMAVASAAQVTQAVDGALAGFRASTLSPYERFRILMEAARIVESRMPMLIDLMRDEAGFTHADGENEVRRCVQTFELSAEEGKHLAGELVPMEAAAGVRNRMGFTIRVPRGVVCAITPFNSPLNTLAHKVGPAIAGGNAVVIKPSNVTPLSAVELCKVLIDAGLPANLLALVHGSGSAIGRQLLADPRIAFYAFTGSTQVGREIQQAAGLRGMQLELGSIASTIVCEDADIDLAIPKIVNAGFRKAGQVCTSVQRLFVARGIADEFIPRFVAAVKATPYGDPADPKTILGPMISVQHAQRAAAWVREALDGGARLLTGGKCEGALFEPTVLHGVDATMKVVCQEVFAPVVSIIEFDDIGEAVAGANASDFGLAAGLFTSDLKTAFRTARELAFGGVHINEASSARIDVMPFGGVKDSGFGREGPAYAIREMTEERLI

SEQ ID NO: 4936 - protein, 453 aa, Burkholderia fungorum
YPTFHASCDAIARGFVARGYGKGTRIGIFCSNRLEFLEVFYGAMRAGVIPVPMGILLPKDTIEWIIRDAELKLVFCDSELRAKLPSNTPHIVVESEEYEAFKVPGPFEAIVPTGDDVAFQPYTSGSTGRPKGVVLSHRAHVWVAETISKDRGFCRTDRMIVAAPLYHKHAMNAIKSVFVGGSTVVLMKKFEPRAYLDAVSRYRVSVLSGVPTIFAMILQQRDLIEGKDFSFVRLATMGGAPASDELIDAVAKILPNADIISIFGITETSAALFGSHPGNLTRPRHSVGWPIAGNEFKLIGGPDENFGVLHVRGPGMMNGYHNNPVEMERRLKDGWFNTGDVLRKDADGWYYFIGRSDDMFVCSGNNIYPGEVELMLERHPDIEQAVIVPVPDEIRHQIPYAYVVRRKGSALSEKDVKEHALTNAPPYQYPRKVIFVDQLLLNGVGKIDRKALQ

SEQ ID NO: 4937 - protein, 504 aa, Burkholderia fungorum
LPESLGQFVREQAALHGERIAAVWFDRGISMTYAQIDSMASQLADSLVKRGIRKGCHVALMLKNAPEFVITWIALGRIGAVMVPVNTSYTQDELVFVLTDADAQYLVIDAEFLPRLAAAPALPGLLAWERVIVCGESEHPLRWAALLEAGSADFTAPSAVSRHDLLNLQYTSGTTGFPKGCMLSHDYWMIHCHGAARHRRGPEAGIENVLIWAPFFYMDPMWQFLMTMKLGGTAYIAERMSLTRFMSWLIDYRIHYCIFPEPALSQHPRGPRDAEVHLKYISIYGWTRSAREEVQARFGVIAREGFGMTEVGTGALVPAWAHDKALERTCGLPAPFRELQIRREDGSVAEVDEVGELWIRGRGILWGYYKRPEANAESFDGDWFRTGDLFRRDAQGFYFIVGRIKEMIKRAGENVSATEVETVLRGMDAIDEAAVVAVPDPLRREEVKAYLKLREGLTQGDVPPAAVFEHCARHLAPFKVPRYLQYIEGDFPRTPSRKIAKKRL

SEQ ID NO: 4938 - protein, 517 aa, Burkholderia fungorum
YDAVIIGAGHNGLVCGAYLARKGFKVCLLERRELAGGAAVSEAVWPGYRVSTASYTMALLQPRIIDELELAKYGYEIVVPPPMLHLYGDGRSLLFRPEGERLSADIARFSEADADAYGKYRAHMARLGKMVAGMLWETPPDPADSTLSARSRLLGFAWRFRDMGEQFYDLYDVLTLSARDYLARWFESDEMIAALGFYASCGGAATSICSPGSAYVLLRGFIRDHTTSAGPAGFVRGGMGSISEAIAASGKAYGMEVRCNAPVASVEISGERATGVRLSSGELIEAGCVISNVATKVLFQQLVGAQNVPPEFLARVRQIRDRSTAFKVNLALRRLPTFKDFDARSAGFAYPAQVRLAPSVEYLERAWDAAKYGEISPRPPLVVLTPSAVDPGVAPKGKHLMSIFGQHAPYALRDGPWDDAQRERLYQITLDTLAAYAPDIRECIDDAQVLSPADLERIFALPGGHVHHGELSADQIFFRRPVQGAADYCTPVKGLYQCGASVHPGGGVTGVPGYNAA

SEQ ID NO: 4939 - protein, 487 aa, Burkholderia fungorum
WRARAQEIRPEGRAFIDGNYVGALSGRTFATVNPATGQVIAQVAECGEEDVNLAVASARKAFESGVWSRRAPAERKAVMLRFAQLMMEHREELALLESLDVGKPVANAYNGDIVSSATCIQWYGEAIDKLYGETAPAAPDMTTMIVREPLGVVAAVVPWNYPLSMASWKLGPALAAGNSVVLKPAEQSPLSAIRIAALAMEAGLPAGVLNVLPGYGETAGRALGLHMDVDAVGFTGSTAVGKLFMQYSGQSNIKRVGLECGGKSPHIVLDDCADLDAAARAVAAGIFGNSGQVCNAGSRLIVQAAVRDELLEKVAAIARELVPGDPLDPATKMGAIVSDVQHASIMSYIDAGRADGARVVAGGRAARPESGGYFIEPTVFDGVNNDMRIAREEIFGPVLSAITVDSPEEAVRVANDTIYGLAAAVWTSNVTRAQQVSRQLKAGVVWVNCFDRGTMSSPFGGFKQSGFGRDKSMHAFDKYMDWKAIWI

SEQ ID NO: 4940 - protein, 1019 aa, Burkholderia fungorum
  unsure (1)..(1019): unsure at all Xaa locations
HMSRRQFLKVSATTLAGSSLALMGFSPTPALAEVRQYKLSRTTETRNTCPYCSVGCGILMYGLGDNAKNAKSSIIHIEGDPDHPVNRGTLCPKGASLIDFIHSPSRLKYPEYRAAGSNEWKRISWEDALDRIAKLMKEDRDANFVETTEDGKKVNRWLTTGMLAASAGSNEVGYLTHKAVRSLGMLAFDNQARVXHGPTVAGLAPTFGRGAMTNHWVDIKNADVILVMGGNAAEAHPCGFKWVTEAKAHRKARLIVVDPRFTRTASVADYYAQIRTGSDIVFLGGVINYLLTNDKIQHEYVKNYTDMPFIVREDFSFTDGLYSGYNADKRKYDQSSWDYERGDDGFAKVDPTLQHPRCVYQLMKQHYSRYTPEQVEKACGTPKEKFLKVCEMLASTAVPGRAGTVLYALGWTHHSIGAQIIRTGAMVQLLLGNIGIAGGGMNALRGHSNIQGLTDLGLMSNLLPGYMTLPLEAEQDFDAFIKKRASQPLRPNQLSYWRNYRAFHVSFMKSWWGDNATAENNFGFDYLPKLDKSYDMLQVFELMNQGKMTGYIAQGFNPLAAAPNKAKIGAGLAKLKWLVVMDPLATETSEFWKNFGEFNDVDPASIQTEVFRLPTTCFAEERGSLVSSSRVLQWHWQGADGPGESRSDLEIMSGLWLRIREAYRKNGGKYPDPILNMSWPYANPESPTPEEIAMEFNGKALADVTDATDKTKVLAKKGEQLASFAQLRDDGSTASGCWIFCGSWTQAGNQMGRRDNSDPTGIGNTLNWAWAWPANRRILYNRASCDVSGKPFDPTRKLIAWNGKAWAGADIPDFKVDEPPENGMNPFIMNPEGVARFFSRDGLVEGPFPEHYEPFETPIGYNPLHPDNKLVVSSPAARVFPDDRAAFGTHENFPHTATTYRLTEHFHYWTKHARLNAIVQPQQFVEIGEDLAKEVGVVAGDRVKVSSNRGHIIAVALVTKRIKPLMIEGKKVQTVGLPLHWGFKGLTKPGYLVNTLTPSVGDGNSQTPEFKSFLVKVEK

SEQ ID NO: 4941 - protein, 383 aa, Burkholderia fungorum
MKYSNLVERLQGRRTSAWEIHRVAQQAAANGEDVIVLSVGDPDFATPAPIVERAVEALRGGDTHYSAVSGREPVRAAIAEEHARTTGCAVSAANVILTAGAQNGVFASSLCLLEAGDEVIVPEPMYLTYEACVRAAGATLVAVPVDRARAFHVDCEALEAAVTSRTKAIFFATPCNPTGVVMPRADLERIARIACEHDLWVLSDEVYAELTFERGHLSIAALPGMAERTVTLGSLSKSHAMAGWRVGWAIGPAELIEHMGRLALAMLYGLPGFIQQAALTALQNKAQIAAGMREIYRRRRDVVFERLQRVPGLRCVLPEAGMFMMVDVSGTGLDTVDFTWQLFRAQGVSLLDASAFGETANGFVRLGFVVEEARLIDACERIA

SEQ ID NO: 4942 - protein, 415 aa, Burkholderia fungorum
LPVAVAGEGIEIIDSTGKRYIDASGGAAVSCLGHSNQRVIDAIKRQSQQLPYAHTSFFTTEPAEALADRLVASAPQGLEHVYFVSGGSEAIEAALKLARQYFVEKGEPRRRHFIARRQSYHGNTLGALAIGGNAWRREPFLPILIEAHHVSPCYAYREQRADETEEAFAQRLADELERKILELGADTVAAFIAETVVGATAGAVPPVREYFRKIRAVCDRYGVLLILDEIMSGMGRTGYLYACEEDGVAPDILTIAKGLGAGYQPIGATLVSERIYQAIVGGSGFFQHGHTYIGHATACAAALEVQRVIEEDNLLPNVLARGEQLRVRLREHYAQHPHIGDVRGRGLFVGVELVRDRAGKTPFDAALKLHAAIRREAFARGLMVYPMGGTVDGKIGDHVLLAPPFICTARDIDEI

SEQ ID NO: 4943 - protein, 428 aa, Burkholderia fungorum
THATLSFSDSDQTIDLPIYQGALGPDVIDIRKLYGQTGKFTYDPGFMSTAACNSAITYIDGDKGELLYRGYPIDNLAQNADFLETCYLLLKGELPNAQQKEEFVKTVTQHTMVHDQMHFFFRGFRRDAHPMAILVAAVGALSAFYHDSLDISNPEHREISAIRMIAKLPTLVAMAYKYTVGQPFVYPKNDLSYSANFMRMMFANPAEEYKVNDVLVRALDRILILHADHEQNASTSTVRLAGSSGANPFACIAAGIACLWGPAHGGANEAALNMLEEIGSVDNIPEFIAQVKDKNSGVKLMGFGHRVYKNYDPRAKLMRETCHEVLEELGLHDDPLFKLAMALEKIALEDDYFVSRKLYPNVDFYSGIVQRALGIPTAMFTCIFAMARTVGWIAQWNEMIADPEQKIGRPRQLFVGETQREAKPLAKR

SEQ ID NO: 4944 - protein, 479 aa, Burkholderia fungorum
  unsure (1)..(479): unsure at all Xaa locations
ARLAMPEXPASRGQYHATKGNTMTSIAVRNPRTGELDYQIDDMDAAHIGAFVSAAREAQHAWAQGGLAHRTKALLAWADELEKNGAEVVAALSVDTARHRISAEELGAVIHFIHGFCEHAPTVLATPFRKLEAHPDVVFKVTYAAYPVVGVISPWNFPLVLSFIDAIPALVAGAAVIIKPSEVTPRFIEPLRRTIEAVPALANIITLVTGGAQTGAAIVAQSDAVVFTGSVPTGQKIATAAAQAFIPAFLELGGKDAAVVLAGADVVRAATSILRSALYNSGQVCYAIERVYAHDSLHDALVEELRTQAAALKRSNAAGDGGHYGPMIFERQAAIIDAQLDDAVSKGASIVLGGKSERINGAVWIDPTVVTNVDHTMTLMTEETFGPIVPVMRFNDDAEAERLMNDSMFGLSGAVFGPDTHTAGDFATKMEAGGVSINDTELPRVMMFDGEKTAFKKSGMGGSRYGATSIMRYVRKRAL

SEQ ID NO: 4945 - protein, 244 aa, Burkholderia fungorum
MTRLNGKTAVITGGATGIGRAAARRFIEEGAFVFIYGRRQEALDAAVAELGPNARAVKGSVSDEADLDRLYAAVKAERGTLDIVFANAGAGSPLALGKITAQHIDETFDTNVKGTIFTVQKALPLMGQGGSIILTGSSAGTTGAPGMSAYSASKAAVRNLARTWAEDLKGTGIRVNVLSPGATATELAKAALGEEGQKVYAAMTPLQRMADPSEIGAVAAFLASSDSSFMTASEVAVDGGLAQL

SEQ ID NO: 4946 - protein, 476 aa, Burkholderia fungorum
LINGEFVESKTTEWRDIVNPATQQVLARVPFATTDEVNEAIRSAHAAFKTWKDTPIGARMRIMLKYQALIREHMPRIAKTLSAEQGKTIPDAEGDIFRGLEVVEHACSIGTLQQGEFAENVAGGVDTYTLRQPIGVCAGITPFNFPAMIPLWMFPMAIVCGNTFVLKPSEQDPLSTMQLVELALEAGVPKGVLNVVHGGKEVVDALCTHELVKAISFVGSTAVGTHVYRLGSEHGKRVQSMMGAKNHAVVLPDANREQTLNALAGAGFGAAGQRCMATSVVVLVGAAQQWLPELVAKAKTLKVNAGNEPNTDIGPVVSRAAKQRILGLIETGVKEGATLALDGRDVKVPGYEQGNFIGPTLFTDVTTEMEIYRQEIFGPVLVVLSVATLDDAIELVNRNPFGNGVGLFTQSGAAARKFQSEIDIGQVGINIPIPVPVPFFSFTGSRGSKLGDLGPYGKQVVQFYTQTKTVTARWFD

SEQ ID NO: 4947 - protein, 532 aa, Burkholderia fungorum
DARDLLLRHRTDYDRAYREFAWPALGEFNWALDYFDVIARNNDNPALWIVDDPAGDGLRLSYAQMSERSARMANFLRGVGVGRGDRLLLMLPNRVELWDVMLAAMKLGAIVLPATTQLSADDVRDRVQIGGAKFVVVDSAELAKFDTLETPLTRLSVGAPREGWIDLSAAYDASPQFTPQGVTHATDPMLLYFTSGTTSKPKLVEHTHQSYPVGHLSTMYWIGLQPNDIHWNISSPGWAKHAWSCFFAPWNAQACVFVFNFPRFVAKDTLNVLVRFNVTTLCAPPTVWRMLVQEHLTDYPVRLREIVGAGEPLNPEIIERVKHAWGITIRDGFGQTETTCQIGNSPGQPVVPGSMGRPLPGYRIELLDADDQPVTEGEIALPLAERPLGLMTGYANNANATAQAMRNGFYRTSDVALRRDDGYYVYVGRADDVFKSSDYRLSPFELESVLIEHEAIGEAAVVPSADALRLSVPKAFVTVRQGYEAGPELARAVFAFSREKLAPYKRIRRLQFSELPKTISGKIRRVELRRRE

SEQ ID NO: 4948 - protein, 375 aa, Burkholderia fungorum
MDSFYTDEQRMIRDAARDFATERLAPYAGQWDRDAQLPAEVVTQMGELGFLGMIVPAEWGGSYTDYVAYALALEEIAAGCASCATLMSVHNSVGCGPILNFGSAAQKDRYLHDLATGRRIGAFCLTEPQAGSEANNLRTRAVLRDGKWILNGSKQFVTNGARAHVAIVFAVTDPDRGKRGLSAFIVPTDTPGFNVGKPEHKLGIRASDTCPISLDDCAVPEANLLGEPGEGLRIALSNLEGGRIGIAAQALGIARAAFDAARLYASERIQFGKALKEHQTIANMLADMATRLNAARLLVHHAARLRTEGKPCLSEASQAKLFASELAEEICSNAIQIHGGYGYLEDYAVERHYRDARITQIYEGTSEVQRMVIAR

SEQ ID NO: 4949 - protein, 330 aa, Burkholderia fungorum
AVQVAQAGGPLELVERDVPEPGAGQVLIKIQACGICHSDVLTKEGQWPGLEYPRVPGHEIAGVIDTVGAGVEEWQAGQRVGVGWHGGHCGHCEHCRRGDFVLCQRALVPGISYDGGYAEFMLAPVEALARIPDDLADVDAAPLLCAGITTFNALRNSGARAGDVVAILGIGGLGHLGVQFARKMGFVTVAIARGQDKASLAKQLGAHHYIDSTAANVAQALQALGGARVILATVTSGKAMSAVVGGLGLNGKLIMVGLSDEPVEVPVAQFIMGRNSVQGWPSGTSADSQDTLAFSALSGIKPMIEEFPLTKAAEAYERMMSGAARFRVVL

SEQ ID NO: 4950 - protein, 254 aa, Burkholderia fungorum
LLKDKVVIVTGASRGIGRAIAVACATEGADVAINYWGDNDASYGRRSAVAEVVGEIEALGRRVIAIEGNVAARETGQQLVRHTVEAFGKVDVLASNAGICPFHAFLDMPPEVLESTVAVNLNGAFYVTQAAAQQMKAQGTGGAIVATSSISALVGGGMQTHYTPTKAGVHSLMQSCAVALGPYGIRCNSVMPGTIATDLNAQDLADEAKKAYFEKRIPLGRLGRPEDVADCVTFLASDRARYVTGAALLVDGGL

SEQ ID NO: 4951 - protein, 241 aa, Burkholderia fungorum
LEGRVVAITGGARGIGYAVAQRALNSGASVALWDVDAERLARSQRELSELGKVTAVAVELTQEAAVAQAVAQTVADHGAIDVLINCAGITGGNGTTWELEPDIWRRVIDVNLIGPYLTCRAVVPQMLRQGYGRIVNIASVAGKEGNPNASHYSASKAGLIGLTKSLGKELATKNILVNAVTPAAAKTEIFDSMSQQHIDYMLSKIPMNRFLLPEEAASLILWLSSEDCAFSTGSVFDLSGG

SEQ ID NO: 4952 - protein, 429 aa, Burkholderia fungorum
HRTIFIIIAIAFFFDSVDLGTMTFVLGSIRTEFGLSSATAGLVASASFFGMVIGAAIAGLLADRFGRRPVFQWSMVLWGLASYLCSTAQSVEALIFYRVLLGFGMGMEFPIAQTLLSEFVPAASRGRLIALMDGFWPLGFIAAGVVSYFVLPTFGWRTEFALLAIPAVFVLIVRRMVPESPRWLEHRGRFGEADKILAEVEVKVMKAAGLSQLRPPAMLAEPPAAQGTGAFREIWSIAYRRRTIMVWTLWFFALLGFYGLTSWLGALMQQAGFAVTKSVLYTVLISLGGIPGFICAAWLVERWGRKPTCIASLAGSAVMAYVYGQTALHAQTPTLLICAGLAMQFFLFAMWAVLYTYTPELYGTGARATGSGFASAIGRVGSLIGPYVVGVVLPVFGQGGVFSLGAMCFVIAAAAVWILGIETRGLALE

SEQ ID NO: 4953 - protein, 552 aa, Burkholderia fungorum
ANEYDYIIVGAGSAGNVLASRLAEDADVTVLLLEAGGPDYRFDFRTQMPAALAYPLQGRRYNWAYETDPEPHMNNRRMECGRGKGLGGSSLINGMCYIRGNALDYDGWAAHAGLENWTYLDCLPYFRKAETRDIGANAYHGGDGPVHVTTSKPGNNPLFAAMVEAGVQAGFPRTDDLNGYQQEGFGPMDRTVTANGRRASTARGYLDRAKARPNLTIVTHAVTDRVLFSGKRAVGVSYLHHGNVLNAQARREVLVCSGAIASPQLLQRSGVGRSTWLRELDVPLVHDLPGVGENLQDHLEMYIQYECKEPVSLYPALQWWNQPAIGLEWMLNGTGIGASNQFEAGGFIRTRDDDPWPNIQYHFLPVAINYNGSNAIRMHGFQAHVGSMRSPSRGRVKLTSRDPNAHPGILFNYMADPLDWREFRDGIRITREIMRQPALDRYRGRELNPGAELTTDEQLDSFVRMRAETAFHPSCSCKMGYDDMAVVDNEGRVHGMQGLRVVDASIMPRITTGNLNAPTIMLAEKIADRIRGREALARVDTPYFVANGVASR

SEQ ID NO: 4954 - protein, 489 aa, Burkholderia fungorum
MAVFAIQRLYIGGAYVDATSGETFDTLDPATGETLASVQQASAADVERAVQSAREGQREWAALTAMQRSRVLRRAVEILRERNDELAALETRDTGKPIAETLAVDIATGADVIEYYAGLATAIEGQQIPLRPTSFVYTRREPLGVCAGIGAWNYPIQIACWKSAPALAAGNAMIFKPSEITPLSALKLAEIYTEAGVPAGVFNVVQGDGRVGAMLAAHPDIEKISFTGGVETGKKVMSLAGASSLKEVTMELGGKSPLLVFDDADLERAADIAMSANFFSSGQVCTNGTRVFVQRGVLERFEALVLERVKRIRVGAPTNAATNFGPLASAAQLQKVLGYIESGKQEGARLMAGGKRLTEGHFGNGQYVEPTVFTGCHDDMRIVREEIFGPVMSILVFDDEDEAIARANRTAYGLAAGVVTGNLARAHRVIHRLEAGICWINTWGESPAEMPVGGYKQSGVGRENGLTTLEHYTRIKSVQVELGPYQPVF

SEQ ID NO: 4955 - protein, 318 aa, Burkholderia fungorum
LHDNSIIIDGLNISKFEHSVFEDMRKGGVTAVNCTVSVWESFQKTVDNIAEMKQQIREHSEILTVVRTTDDIFRAKKENKTGIIFGFQNAHAFEDNLGYIEAFKDLGVNVVQLCYNTQNLVGTGCYERDGGLSGYGREVIQEMNRVGIMVDLSHVGGKTSSEAIAASNKPVCYSHCCPSALKEHPRNKSDEQLKEIADAGGFVGVTMFAPFLKRGPDATVEDYIEAIEYVVNLIGEDQVGIGTDFTQGYSTEFFDWITHDKGRYRQLTNFGKVVNPEGIRTIGEFPNLTAAMERAGWSETRIKKIMGENWVRVFGEVW

SEQ ID NO: 4956 - protein, 510 aa, Burkholderia fungorum
LETKKNILILMADQMTPFALAAYGHRLTKTPNLDRLAKQGVVFESAYCASPLCAPSRFSFLSGKLPSAIGAYDNAAEFPSQTLTFAHYLRAEGYRTILSGKMHFCGADQLHGFEERLTTDIYPADFGWTPDWEHFETRPTWYHNMSSVIDAGPCVRTNQLDFDDEVTFTTRQKLFDIARERHAGKDARPFCLVASLTHPHDPYAIPQKYWDMYRDEEIDMPAFRDSFEDADPHSKRLRHVCETDRTPPTDQQIRNARRAYYGAISYVDDQFGAILEALEQSGLAKDTVIVVTSDHGEMLGERGLWYKMTFFEGGCRVPLIVHAPQQFDAHRVEASVSHLDLLPTLVELARGEQPAVWPDSLDGQSLVPHLMSGQGGQGGHDEAIGEYLAEGAIAPIVMLRRGRFKFIHTPADPDQLYDVAADPLERENLAARSEYASQVTAFREEIAQRWDLAALHHEVLQSQRRRHFHFASTTQGVVASWDWQPHVDASQRYMRNHIDLDSLEAMARFP

SEQ ID NO: 4957 - protein, 383 aa, Burkholderia fungorum
IADDAQALLAARRLAEAFAPDAALRDRERRLPWAELDAFVASGLWGITVPREFGGAGVSNGTLAEVTATIAAADGSLGQIPQNHFYALEVLRVGGSVEQQRFFYGRVLAGERFGNALAEIGHKDFKRRTRLTREAAGWHIDGRKFYCTGALYAHWIPTLVVAEEQGRDVTYLAFVPRDTPGVTVTDDWDGFGQRVTGSGSVQFDYVRVEPEWVVPFQASFERPTTIGPLAQIIHAAIDLGQARGAFEAGLKFVRERSRPWIDAKVERAADDPLTLAQFGDISVRLRAAEALLRRAGRFVDAAQAQLTEQSVAQASIAVAEARALTTTASLDAGSRLFELAGTAATLDGLGLDRFWRNARTHTLHDPVRWKYHAVGNFYLNDKL

SEQ ID NO: 4958 - protein, 255 aa, Burkholderia fungorum
SPVCVVTGSASGIGAATALRFAQAGWSVAIGNFDDSTREAALAVEAACRDAGASTLVFDADVGNDAHCRRAMDTVASRWQRADALINCAGTTRVIAHNAFDEIDAVEFERVYRVNLIGLYQMTRAAVPLLRESAGLSAVKRSTSVVNISSLAGLNGTGSSIAYAASKGAVNTLTLSLARSLAPYVRVNAIAPGMVDDGLLLHVLDPQAYDGVLARMTEQAPLKRVSMPAEIADLAWFLATQAPAITGQVIATENG

SEQ ID NO: 4959 - protein, 382 aa, Burkholderia fungorum
RELTDRSLSNTQLRERAERLAQADRRKNEFLAMLGHELRNPLAALCSAGDLLASESVDARQKVWAVGVIQRQGQAMTQLVNEMLDLTRIASGSIKLNRQAVTLETVVQSALEVCRPIVEERHHTLSVALPEEPVLMFVDPTRLSQVIENIVINAAKYTEPGGKIDLSATRTGRRLSLRVRDNGAGIAPSMLNTLFDMFVQGPLPHGQLHNGLGVGLSVVRRLVELHGGTVEAVSDGKTGSEFIVDLPLGLIPASPDQAGSPQNPGKAPPRRVLIIDDNADASEALAMILASEGHVVATRLDGQQGLEASTTFRPDVVLLDIGLPGMDGYEVAQKLRGSAATRDTLLVAVTGYGQPGDQLRSAAAGFDHHLVKPVDIEALKGL

SEQ ID NO: 4960 - protein, 539 aa, Burkholderia fungorum
AGKPLPPALLVNVPRLVASYYTGTPDPSLAAERVKFGTSGHRGSSLQRSFNEWHVLAITQAICRYRKLQGIDGPLFLGIDTHALSEPASASALEVLAANGVEVMIAPDGEYTPTPAISHAILTYNRGRSSGLADGIVITPSHNPPGDGGFKYNPPSGGPADETVTGWIEVAANSLLENRLDGVMRMPLANALRASTTHYHDFLRIYVADLDSVIDMSVLRGAPIRLGVDPLGGAGVHYWAAIAERYRLNLTVTDEDVDPTFRFMSADWDGQIRMDPSSPYAMQTLIGKADRFDTAFACDTDHDRHGIVTPTAGLLPPNHYLAVMIDYLCAHRPDWPAHAAIGKTMVSSRLIDHVAAKHGRALYEVPVGFKWFVGGLLDGSLGFAGEESAGATCLRLDGRAWTTDKDGMVPALLSAEIATRTGRDVAEHYRALTERLGEPRERRVQAAASASQRALLGRLSPAQFAHTELAGEKIDSVLDRAPANQAPLGGIKVSTKSGWFAARPSGTENIYKIYAESFLGDDHLARIVGEAQSMVDNAL

SEQ ID NO: 4961 - protein, 556 aa, Burkholderia fungorum
DYLILGGGSAGCVLAARLSEDEGSTVCLVEAGRNISRTDMPAAVRSRYPGRAYLDTANIWQHLKARMNTSAATRRYEQARLLGGGSAINALMANRGAPADYDEWHARGAHGWNWAACLPYFRKLETDCDFGGALHGASGPVRIQRTPWARISPFVRAVLATLDARGHTRRDDQNGEWQDGTFIGSIAVSEAGERIPTSVCYLDDTVRARPNLTIRTQTLVEHVLFDGGRAIGARVVGENGASETLHARQVIVCAGAIHSPALLMRSGIGPASELAALGIEVVADRGGVGGNLMEHPSIAVSAVLPRAARALYPDEHHEQAIVRFSSGVSGAVPGDMHGAILSRSGWHSVGYRLGTLFFWVNKSYSRGRVSLTSASPHDEPAVDFNMLSDARDLERLKLALRFGARTLADPMMAQHRTTLLPSSYSPRVASVAVPGVWNALQRGLLSALLDIAGPLRGWLVRRVVTQGVTLDELLADDHALTRFVTRSAGGTWHPCGTCCMGAADDPLAVCDARGAVYGVSGLYVGDASLMPSIPCANTNVPTIMIAERIADMLRGR

SEQ ID NO: 4962 - protein, 475 aa, Burkholderia fungorum
IGGEYVEAGGRRIEVARPSDGVVYATVPLADAGMVDRAVENAWQAFRHSGWARMAPRERAKILRRFAELVEADAPTLGRLEALGSTRPIAQAIGWDVPFTAEGIRFYAEFADKLGGDVAATDHDHLGMTIAEPYGVIGAIAPWNFPLVMASWKIAPALAAGNAVVLKPSEMTPFSVLRLAELAVQAGVPAGIFNVIQGDGRVTGDELVRHPKISKVTFTGSTRTGASIMAACANSGTRPVTLELGGKSPQIVFADAPRLDDVARRIAGAITGNAGQVCVAGSRLLVERSLAEPLAERIGKIFAELKPGATWAAGTTLSPIISAPQAARIEGIVGRTLEAGATLRYGGVRADVGSNGAFYTPTLLTNVTAHSEAVREEIFGPVLTLQTFDTEEEALALAQHPEYGLAAGVHTADLGRALRFVRGLEAGTVWVNRYGRTSDFMIPTGGYKRSGIGKDLGRQAYEANLRFKSVLIDLR

SEQ ID NO: 4963 - protein, 433 aa, Burkholderia fungorum
HLIHPVINYRVHEARGVTVLESASGAFLRDAAGNELLDAFSGLWCVNVGYGQQSIVEAATAQMQKLPYATGYFHFGSEPAIELAQKLVEVSPASLQHVYFTLGGSDAVDSALRFITHYFNATGRPSKKHVIALQRGYHGSSSTGAGITALPAFHRNFDLPLPNQHHLPSPYAYRSHFPDDAALIAASVAALEAKVAELGANNVAAFFCEPIQGSGGVIVPPAGWLKAMRESCRKLGILFVADEVITGFGRTGPLFACQGENVEPDLMTVAKGLTAGYAPMGAVLMSDEIYQGIADGDAEAVVGHGHTYSAHPVSAAIGLEVLRLYHEGGLLANGVARAPRFARGLDALLAHPLVGDSRHRGLLGALELVADKDSKAGFDPALKLSDRIAAAAYENRLIFRAFGDNILGFAPALSYTEGEFDLMFERLEKTLDD

SEQ ID NO: 4964 - protein, 360 aa, Burkholderia fungorum
  unsure (1)..(360): unsure at all Xaa locations
KKYRIAVIPGDGIGVEVMPEAIRVLEAVKARFGIELEYQHIEWASCEYYAKHGKMMPDDWKAQLLSADAILFGAVGWPDTVPDHISLWGSLLKFRREFDQYINLRPARLFAGVPSPLAGRKAGDIDFWIVRENTEGEYSSVGGVMFEGTEREFVLQESVFTRHGSERVLKFAFDLAQRRARKKITVATKSNGIAISMPWWDKVAAGIAAQYPDVTWDKQHIDILCARFVLNPDRFDVVVATNLFGDILSDLGPACTGTIGLAPSGNLNPDRKFPSLFEPVHGSAPDIAGKNIANPIAMIWSAAMMLDFLGNHAGKEREAHDAILAAIEATLIEGPHTGDLGGKANTTEVGQAIAKKLAXS

SEQ ID NO: 4965 - protein, 476 aa, Burkholderia fungorum
LIRSDNFIDGAWTPAQDNLRFAVTNPASGEIIAEVADSSPADARAATDAAARALPAWRARLPKERAAVLHRWHALIMANLDALGALISLEQGKPLAEGKGEVAYGASYVAWFAEEATRIYGDLIPQQQRGKRMTAVKEPVGVVAAITPWNFPLAMIARKIAPALAAGCTVVAKPAEDTPLTASALVLLAHEAGVPPGVLNLITASRDHAVAAVAEWLHDARVRKITFTGSTPVGKYLARESAETLKKLSLELGGNAPFIVFDDADLEAAVAGLMAAKFRNGGQTCVCPNRVYVQAGVYERFGALLAERVGALKVAPATDPAAQIGPMINSRALDKIARHVDDAVAHGARVLTGGKRLAELGPHYYAPTVLADATAAMQLNSEETFGPIVPLFRFEDEAEAVNAANDTPFGLAAYFYSEGVKRIDRVARALEAGIVGINEGAVASEAAPFGGVKESGYGREGSKYGLDDYLSIKYLC

SEQ ID NO: 4966 - protein, 519 aa, Burkholderia fungorum
MPQSADRILDHELLFREPEYQEIFRTKKENFEFNHPDEQVSQIVEWTKTEDYKQKNFARDSLTVNPAKACQPLGAVYVANGFHKTLSFVHGSQGCVAYYRSHFSRHFKEPTSCVSSSMTEDAAVFGGMNNMIDGLANAYNLYKPEMIAVSTTCMAEVIGDDLDAFIKNSKQKGSVPEDYDVPFAHTPAFVGSHVTGYDNALLGILKHFWDGKAGTAAPLERVADESVNFIGGFDGYVVGNMKEIRRIFDLFGVQVNILCDPSETWNTPTDGEFRMYEGGTTKDEVERALNAKATFVFQEYCCEKTSKFIAEHGQEVVVLNAPVGVAGTDQFLMEISRVAGKPIPAQLEKERGQLVDAMADSQAHLHGKRFALYGDPDQMLGYTQFLLELGAEPAHVLATNGGETWAAKVQALFDASPYGAGCKVYPKRDLWHMRSLLFTEPVDFLIGNTYGKYLERDTKTPLIRMVFPIFDRHHYHRFPTWGYEGALRVLVTLLDEFFEALDANTIVAAKTDYSYDIIR

SEQ ID NO: 4967 - protein, 116 aa, Burkholderia fungorum
LMRAARHGEDAVVEALLAFGARADALDDDGNHALWFACLRGGPATILRLIEAGSPIDHANDDDITCLMQAAASGRLDVLRMLLAQGASAELCAPDGRSALDMAADLGLQLLRAARQ

SEQ ID NO: 4968 - protein, 623 aa, Burkholderia fungorum
MALLQIAEPGQSAAPHQHRLAAGIDLGTTNSLVATVQSAVARALPDEDGACLLPSVVRYTRAAEPEVGRPAQARQAEDPVNTIASVKRFMGRRLADLPEAASLPYRFIDQTGMVGLATAAGERSPVQVSADILRTLRVRAEASLGGELAGVIITVPAYFDDAQRQATRDAAHLAGLTVLRLLNEPTAAAIAYGLDRAAEGVFAIYDLGGGTFDISILRLSKGVFEVLATGGDSALGGDDFDRAIAQWFCNGHGVEGLAMLAPSAQRSLMMAARAAKETLSHAGSAVIALAHADRSIWQAALSRAQFAELGAALVARTLAATRRALRDAKLGTGDIDGVVLVGGSTRMPLVRHAVQEFFGREPLADIDPDQVVALGAAIQADVLAGNRNGDGWLLLDVCPLSLGIETMGGLVEKIIPRNSTLPTARAQEFTTFKDGQTAMSLHVVQGERESVADCRSLARLELRGIPPAVAGAARVRVSFQIDTDGLLAVTAREQTTGVETHVEVKPSYGLTDVEIAAMLQQAIDASLPDMQLRTLREAQIDARRLLDATEAALDSDAALLSADELAAVRRAMFQVGEALETDACVDLLKAAATDLAGATETFAARRMNASIRNALAGRNLDTL

SEQ ID NO: 4969 - protein, 431 aa, Burkholderia fungorum
QFDAIVVGAGPSGNAAAYTMARAGLKVLQIERGEYPGSKNVQGAILYAKALEEIIPDFRDDAPLERHIIEQRIWMLDDTSFVGTHMRSEEYNKPPYNRYTIIRAQFDKWFSSKVREAGALLICETTVKQLIMDGDQVVGVQCDREHGDVYADVVVLADGVNSTLARKAGFHGEIEAGNVALAVKEILFMPEETIRQRFNIGEDDGVVIEMVGRITDGMTGTGFLYTNKESLTIGVGCMLGDFKKNPNRTSPYVLLEKMKQHPSIAPLIAGGEMKEYCAHLIPEGGFHAIPRVYGNGWMIVGDSGGFVNAAHREGSNLAMTTGRLAAETVIHAKAAGLGYRAATLKAYKAALDQSFVMKDLHKYRDMPAVLHQNPQFFTTYPDLVARAARTMLTVDGKDKKSKEREIFSSFRKARSLAGMVGDAYKLLRAFR

SEQ ID NO: 4970 - protein, 548 aa, Caenorhabditis elegans
MGGFLSKHHHLTAVHDATCGPIKGVGYEQEDGSVVEGFLGIPYAEPPIGALRFKKPVAHRKWTEPLDCVRFGPRSPQNDELLGQFVNTVGKSEEHCLSLNVFTPKWESNEWPDGFPVMVFIHGGGFAVHSSSNYGCASIARNLCTKDVVVVTINYRLGVLGFFTTGDEVCRGNLGLWDQTAALEWVQENIQSFRGDPDNVTIFGQSAGGASVDLLCLSPHSRGLFNRAIPMAGNGECDFAMRTSEQQAQLSREFARYLGWEGDDNDSEDLLQFIDQQPLYKIEMGINPKRGFKHSQAGSLYFVPNFDGDFFPKPLNQLRKEAPKMQIMTGTTKYEGLFFIALGALSKNPEGIKKFMGRIFKECDYGERADDVLQMVYDFYFKGVHPKDHEKNMHQIVKFIGDYSINYGTYRLANIMTDLQHDVYFYQFDYHNSAGFGVFRWLLPFLGSTHCTEMRYVLGKGIISKFRPNDNDKKMLHVMTTYFTNFAKYGNPNGENQETGEWQKHDSAHPFRHFKIDLDDSEMVEDYQERRAELWDKLRALNVSRAQM

SEQ ID NO: 4971 - protein, 211 aa, Caenorhabditis elegans
MGSRDDEYDYLFKVVLIGDSGVGKSNLLSRFTRNEFNLESKSTIGVEFATRSISVEGKTVKAQIWDTAGQERYRAITSAYYRGAVGALLVYDIAKHVTYENVERWLKELRDHADQNIVIMLVGNKSDLRHLRAVPTDEAKIYAERNQLSFIETSALDSTNVEAAFTNILTEIYKSVSNKHVGTDRQGYGGGSGTIIPSPASDPPKKQCCIP

SEQ ID NO: 4972 - protein, 245 aa, Caenorhabditis elegans
MPPHRAFSVMSCALVIGATSTLGKAVVRRLAFTGYKVAAAADCPNSVGKVAEDNIKVGGDVTAFSLDVANAEHRKELITKVAEKLGGLDTLIIVPPQNEVLGEIIETSGEDFDKLFANNLTTPFRLSQAAMSTLAKSQNGSIIYLTSCFGFTPSIDMGLYSVASSSVLSLTKSVAQSAAKQGVRVNSVVSGMIEGDGTGAVWDHASGEEARQIKQHLESMIPLGRLGRPSDVASYVEFLASTKAR

SEQ ID NO: 4973 - protein, 631 aa, Caenorhabditis elegans
MNSTVASRFSWGLILASIDFLACLLFACLHDGTFKFANFTSQFGDFSFFTSTIDLFLLQFFRFALWMVPAAIHVANKADTLTMWKEPIFCSALLICAASPTKLLLLTEKLKPDEFLTFGDTAFLVWNFISAIILNSSWTRYFSRTPSSYIILEDEDLEVAPKQTFELIFRLLQYCKREWLWHISGFSWLFIYSITRIFVPYYTGQVIATVVATKSYPALSNAVYIMTIISLVSAVAAGFRGGSFEYAYARIQRAIRYDLFHGLVKQDVAFYDAHKTGEVTSRLAADCQTMSDTVALNVNVFLRNCVMLLGSMIFMMKLSWRLSLVTFILVPIIFVASKIFGTYYDLLSERTQDTIAESNDVAEEVLSTMRTVRSFSCENVEADRFYGKLTHTLDVTRTKAIAYIGFLWVSELFQSFIIVSVLWYGGHLVLTQKMKGDLLVSFLLYQMQLGDNLRQMGEVWTGLMQSVGASRKVFEYIDREPQIQHNGEYMPENVVGKIEFRNVHFSYPTRSDQPILKDLSFTVEPGETVALVGPSGSGKSSCISLLENFYVPNAGQVLVDGVPLEEFEHHYIHKKVRWRQFRFDKSFAGLPAILIFGKLPICRKCLECFFIRRKHLKLCPFLNFCAGWRFA

SEQ ID NO: 4974 - protein, 1846 aa, Caenorhabditis elegans
MSFDSISAGATGCFPRRAHTINATDDAHTHTVAVYMHSFNPDCENDTVHLEVHKRCTTEELIEKVLAGRAELEGQSVQDFDLFEMMGTPDGQTYKERRLDPGEYPVAVQAIWSRLPVVVDSATPKNRFVFRHRGYRAATGGTRFGSAEVASSIDAFLTKFLVQPQDREYADLCNLPELTEQTLLDNLRERFANGHIYTYIGPILVAVNPFCFFPIYNPKYARLYFQSKRLGSLPPHIFAIADVCYHNMLRIKENQCVVISGESGSGKTESTNHLMSHLISLSQKGSTGCSTEQTLLSAGPVLEAFGNAVTLTNNNSSRFGKFIKINYRENGMVSGANVEIYLLEKSRIIFQTKGERNYHVFYYLLEGADEEERKKYFLLKPHDYKYLNQNEPFALEGVNERNEFDRLRHAMSSVGFCAKTQQTIFGIISAVLLLGNITYIKRHGYHSDESGYIENEEVVDLVANLLHIKTDTLMQALTMKRHVMKTETVVLRYSVSEATNTRDAMAKCIYNSLFHYIVLRINQALLKKDFSAGKGYYIGILDIFGFEDVGSQCNSFEQLCINYANEKLQSYFNQHIFQFEQEEYLKEGISWTNIEYTDNTECVQLFQNNEYYETPQKKEPAFIVAHYAGKVKYQITGFREKNKDLMRQDVLNALKSSTSSVMKTLLGIDPVAVHRWNVLRSVFRAMNAFKQSTRKLQKKSAGHLRVMDSIVTSPRRGSDSALSAFLRGELRCEVPDFCDTSMFNTIRNQARRTPAGKSDDKMSLLKSLQILKEAIGGRRLAKKPSSVSKQFEYSLTRLMSTLANATPYFIRCIKSNNDKIANHFDDNIILRQLRYTGMLETVRIRRAGYSVRIEYPSFVQQYRILLRNGRDSTVDDVKEYIHSHASIDNDNIQYGTNKIFMRDAEKLILDDHLHRTIMQSIDTLQRWFRTMLARKRYLRMKEGIIKIQALIRGSFARAEVRKKALAAQTIQCNWKKYKQRQKYLSIRESVIALQSAYRGASVRKRVGEIPKGNGALNVKKSPFRVRKVHAVNLTKFDLSDPSSLAAFALSDDDSDSDKSTQDGLDDDISEESDAFQDDDAVDVDATFILEDTKLKLIEGADLSHHRRQSLAPTASTTKLKMLRRANSTESNNFSMSRCDDSFTLSPTHSKKKGGAGKLGFQKAKKNLKALFGRNEDEDEPSPGPSFASELTPDVFVAKDHQFKMSRLHRQEICALCNRHLTNFISQAHKCQRCKMCLHKECFVFASSIPCNPTSPVRSPTRLHSPKRPWDLMPHKQRQSSSPIPSTGTFSLTKTKQQIDPGNMLVESTDDLRQFSIFIFNKTRHLNESNAKRDTVVDAVFKKSLRAFHMELLGYEAVLSVEQSVLKYRDVITMFEGLLTKVCLEESVSFPTTLGVNAFRGFLNEYVHVQSKKKRGKEKSSMIKKVGKKRVKSDVAAVHAGHRFRAEAVHVPTYCEVCNQLIWHHEKLYTCVACRISCHKKCQPKVTHPCQMTGKAIDPKTNGGRFFGASLVSIVDDDHTVPTLLDRLFFAIETRALFVEGVYRKSGSLPQVRSIRKVIESTADADSVNLEDIGVHVLTTLVKAFFRELAEPIIIFDLYENFLNVSEVEDMGERVRCLSVMIELLPKPNRAVLDRLMYHLARVADQEAVNKMGCNNLALIFGPCVLRRQDSAHAQEQLNDVARQTGCVQTLIEEKLKQYKATIHNIVELEDASQKVSANLRKIEEHRRNSEPSKFSPNIGTAKQLFEEQLEFLGKQKERLLQELPPLAPVASSEDLSSSDENAIHASSSLSVEEYALDLDAPPVFCLLRYPTKLRPPGPAHRRRPDLDLRRKAFANSRGIVSFYSPV

SEQ ID NO: 4975 - protein, 667 aa, Caenorhabditis elegans
MSYNTSLLIFLCFSAVSLSTQSFAVYRLLPKSQTDFQAIQRLYKNATDHDLNFWKTGKDKHGFWDVMVDMKNSKYFLDFLQVNDISYIKTIDDVEGLITKHENNKTLSNMFPRLWDDSSSAHYDFHTYGSYQRMTDWMKQLVVKYPKMVQYISIGKTTEGRNIDGVEIGGDSRTKKIFWIDGGIHAREWAAPHTALFFIHQVCDPAPSEKSVFRLVPLGLHKCWQRQKKGKLDNKWLTSRANEPGIKKLLNEITFVVVPCLNPDGYEFTRSSTNPHVRLWRKNRSKMQCRKDIWGRNRCCRGVDLNRNFDFHFRESGTSDDPCSEIYQGPSPFSEPEAKAVRDALLSQRYKGRTDAYITLHTYSQIWIHPYGHKKDAYPGDIKDLYEVGKKAAQALKRVYGTKYVVGSGADTLYPASGGSEDWAKHEAKVKFVYLLELRPDEKNWDGFILDEKELIPTARETWEGVRVVAEAVLDRIVAGKSTAPRGHQFFLGLRYFLGYQLFLGHQLFLGHRFFSRPLIFDGHRNFFGHRYFSRPLIFFSVTDTFSATNIFSATEIFRGHLYFLGLSHRYFSGPSSFFLAAKPQKLADSDSATAPKDHVSMSDTRANDGFRNGRSCAGRCQFSCARTVPTLAISVDFFGVPLLFFCTYIHFVFYIHIYMYMKCLKT

SEQ ID NO: 4976 - protein, 528 aa, Caenorhabditis elegans
MTKCQILASLLTWSFWVFRHVLATTDGRAFRKKSSATTPPNQKTSSFKLIRINPETEGSVKYLRSLYEDPSPYELDFWQPPTNIGAIVDLTVAPADAPRFVKDLESKKISYIVAVNDLSKAIENERGSDKFYNPVAGFAYDKYNSLEEIQTEMKRLKKEYPTMITLIDIGQSHENRTLLVMKITGKRNPLGSKISMWIDAGIHAREWIAPATAMYIAHELLLGYENDATVAKLMDHIDFYILPVMNPDGYEYSREKNRMWRKNRSPAKCARQTFSTVCCSGVDLNRNFDWFWASTGSSSDPCHDTYHGSAAFSEPESQAVRDFLEQNTPEAFISLHSYSQMWLIPYGHRKQSYPQDYHTGLRPLALRATKALYELYGTKYQVGTGADLMYEASGGSHDWAKGQLKVPYAYLIELRPKNTMMGHGFLLPEREIVPTGLETFESIKVVADELVAQFVEPVIRAKLTTTTKPAIPPYRRGSSNHRGAHHHYYGGTYNYHNDRGAYRSPNRTQSDYCRGHRGFYNTRSFHIL

SEQ ID NO: 4977 - protein, 378 aa, Caenorhabditis elegans
MSTVPLNKNSPSMPPPPSSNTVADFTHLRRRRPRSAHYDPNTITLPAKEEVTPQDVNDLYKRIDKLGEGSYATVYKCESKLDGSIVALKEIKLQFQEGLPFTAIREASLLRNLRHANIVSLHDIFYQHHQLTFVFEYMKMDLSKYLEQNVYGLDSIDIKLLLFQLLRGLDFCHRKKILHRDLKPQNLLLDEDGVLKLADFGLARAKSVPSRTYSHEVVTLWYRPPDVLMGSTDYSTSLDMWGVGCIFAEICTGAALFPGSKDSHYPGTKDQLDMIFSIRGTPDEKKWPEVKTLPGYTPELFPRYRELSFIAVNPMFTKILKTGQELLGMLLQLRPESRVSAASAMLHPYFASFPREVHLLAPSQSIFRLKELKDLRSL

SEQ ID NO: 4978 - protein, 385 aa, Caenorhabditis elegans
MRLMGCVGAGADAEGREARKVNKQIEEQLAKDKQVMRATHRLLLLGAGESGKSTIVKQMRILHINGFNEAEKREKITDIRRNVRDAMQVSEKDSRVILRAMDEIVPKVSLDDPSTAISRDYILRITNDPEDNYPSEFYDHILTCWKDKGVMACYERSSEYQLIDCAQYFLDKVDVVRQNNYDPSEQDILRCRVMTTGIFETKFEVDKVRFHMFDVGGQRDERRKWIQCFNDVTAIIFVCASSSYNLVLWEDNTQNRLRESLALFKNIWNNRWLKTISVILFLNKQDLLSEKIKAKRYLLESFFPEFEGYNLPNDAVFDNQEDKDVVRAKYFIRGEFLRISTANSDGRHHCYPHFTCAVDTENIRRVFNDCRDIIQRIHLRQYELL

SEQ ID NO: 4979 - protein, 391 aa, Caenorhabditis elegans
MGNCSQKQSGSAVGSTGTSFFSNLFHKAHIDPHALAQTCPPPHGGEMPLGECAVLRDRPAMRFDSRLVCKYEVLAVVGKGSFSQVLRVQHRVTRKYFAVKVVNGDCGAVNNELNILSRLSHPFVIRLEEVFKSSSKLFIVMQMASGGEMYDRVVAKGRYSEEEARNALKMLLTGLTYLHSIRVTHRDLKPENLLYADSRPEARLLITDFGLAYQATKPNETMTETCGTPEYIAPELLLRVPYTQKVDMWAVGVIAYILMSGIMPFDDDCRSRLYTHIITANYVYYPQFWSGSELAKQFVDSLLETNSVERLSSSAAMKHEWLTGERPSTTQSRPPTRPTSEYNSMQRTKSTRSIRSVTRSDHGHRVDPREVDELANDLKRVAQTTKNYGVF

SEQ ID NO: 4980 - protein, 1219 aa, Caenorhabditis elegans
MDSSTHSTADFGRLVWISDEAEGFVAARITDIAENGFTLATEKTSETVNRRYEDTWACEEDPQKSVEDNCALVHLNEATLLNNCRLRYANGKIYTYVANILISINPYQLIDGLYSPETIKEYRGKSLGQMEPHIFAIADKAYREMRRIKTSQSIIVSGESGAGKTESQKAVLKYLCENWGTDAGPIQQRLLETNPILEAFGNAKTLRNNNSSRFGKFVQIHFSDNGTVAGGFVSHYLLETSRVCRQAAGERNYHIFYQLIAGSSPDLYKKLRLAPASSFNYLKHGATLFFVNSKSSLKTDASRFSETNSSVSDSIISDIDDFAKLERALALSGVSDDEKMFIWSTVAGILHLGNIEFEENASDSRGGCMITSGTENSLMAAAELLGLEPEEMKLGLCARIMQTTKGGVKGTLIRVPLKAHEASAGRDALAKAIYSKLFDWLVAQINKSIPFEKSTGYIGVLDVAGFEYFAVNSFEQFCINFCNEKLQHFFNERILKQEQEMYEAEGLNIQKIEFTDNLDCIELFEKKASGLFDLLDEEAKLPRATFQHFTQRAHESNKNHFRLDAPRKSKVKSHREMRDDEGLLIRHYAGTVCYETRYFVEKNNDQLHNSLEMLIEQSSFPLVVSLFTSEATGAVKTGGRLKAVSVGAKFKSQLSSLLDKLNNTGTHFVRCVKPNSQMKAWHFDGSAILGQLQCAGMASVLRLMQEGFPSRTSFADLYAMYEKNLPPSLARLDPRLFSKCLFHALGLDQNDFQFGNTKVFFTAGKFAEFDQMMKQDPETVMELISKVTDWLVKARWRKVQYGAWSVIKLKNKILYRAEKIKKIQAWIRGYLVRKRFHKRLAIFRKACALLENSREMTDILARMNESSQDKWREAADSTTGELDELVKTIKNDDLNTEIDRAVKCYEDCVKRVDSIIADLKLQLENDELAEVERARKEAEDKERREAEEKAAAEQEKILRRKMEEEREKAQKEYELQLEMQKQKLAAEAEEEVKRRNKEERDRLDAAVSSRLASSDGVALVAQEASAAPPKQQSKYDLGNWKYADLRDAINTSNDMELLVACKEEFHRRLRIYNEWKSKNSANRDVPPTRAPLTVYNQQKPSSSSMMVSRVQAAPHLNPALTQQRYFKVSFATDNKKKNGGSQSGMWYAHFNGQYIRRQLTIRPSQKPQLLVAGKDDLQMCELPLEQTGLLRKKGAEISSNDFETMWYHYGGKPIQEWTP

SEQ ID NO: 4981 - protein, 426 aa, Caenorhabditis elegans
MRVLTPCAATVTFPGEHIDYHDYGVFPMAIDAATTILAAKNDTNSIVFSNFDSKYESWSSPIPCPWKGCTSPKWFDYLLCGWRGIMNREDGQEQFGMSFLLYGTIPPSSGLSSSSSLVCASALATLSLIVDNDPFEHISRILGPKKNSLFEMAEFAKLGHFGKDFAHLCIESEPLIGTLSGGMDQAAEVLASEGTALRIDFNPLRSKNIQLPSDAVFVVVHSNTELNKGATSHYNERVIEGRIVAQIFKQKFNITSGSFRLKEIQTLSGKSFKEILKIVEELPDEVNKEQVIDLIGADKLEECLTENTRSFQKFKLRPRARHVFSEAYRVEQFESACAQKNIQEMGRLMNESHRSCAIDYECSCRELDEICRLYLDHGALGARLTGAGWGGCAVVLMAADDVDRVVAELPSLFVSKPAQGIRLQRF

SEQ ID NO: 4982 - protein, 355 aa, Caenorhabditis elegans
MACCLSEEAREQKRINQEIEKQLQRDKRNARRELKLLLLGTGESGKSTFIKQMRIIHGQGYSEEDKRAHIRLVYQNVFMAIQSMIRAMDTLDIKFGNESEELQEKAAVVREVDFESVTSFEEPYVSYIKELWEDSGIQECYDRRREYQLTDSAKYYLSDLRRLAVPDYLPTEQDILRVRVPTTGIIEYPFDLEQIIFRMVDVGGQRSERRKWIHCFENVTSIMFLVALSEYDQVLVECDNENRMEESKALFRTIITYPWFTNSSVILFLNKKDLLEEKILYSHLADYFPEYDGPPRDPIAAREFILKMFVDLNPDADKIIYSHFTCATDTENIRFVFAAVKDTILQHNLKEYNLV

SEQ ID NO: 4983 - protein, 385 aa, Caenorhabditis elegans
MWRELWRVVEKSDIIVQIVDARNPLLFRSKDLDDYVKEVDPAKQILLLVNKADLLKPEQQASWREYFEKENIKVIFWSAIDEVLDPIDEDAVETSNPSTSTHMFVTNKDELIAKFKELGHVSDEPSAKPVMVGMVGYPNVGKSSTINKLAGGKKVSVSATPGKTRHFQTIHIDSQLCLCDCPGLVMPSFSFGRSEMFLNGILPVDQMRDHFGPTSLLLSRVPVHVIEATYSIMLPEMQSPSAINLLNSLAFMRGFMASSGIPDCSRAARLMFKDVVSGKLIWAAAPPGVEQEEFDRISYPDKKTRDIGRVQMEKLAKLQLLEGDELKGSQFDSQHFVGSIGVAHVRDSKALPQTLGTVIPTAPTENNGKKHYKGKKDKLRRIYNE

SEQ ID NO: 4984 - protein, 1447 aa, Caenorhabditis elegans
MDSKSNPFSRDKPLIDLKYITFGFSFLQGSWPSLEQKSKSQKLSESIDRAIMSELTNQTDANLGVYAQQEPYPCTVKDTFNVALFMPLFLLISFIFPSALLVKNIVYEKEQKIKEQMRAMGLGDAVHFISWGLISLVLNFISVLIISIISKVAKIFDYTDYTLLLFVLILFLFSSIAMSIFFSTLFTNANIATAATCVLWFVFFIPFQLLRTDRISSPTFNRISLILPPTAMGHCFKLLESFNAMERATWSDLWEMNNPVLGISVELCMIMLVVDTAVFLILAWYISAVAPGDFGVRQPLWFPFTLKYWAPGLYKNRVEFVDDEHFDTIPNSDSFDSEPTNLTLALDCLNLRLYEGQITGLLGHNGAGKTTTMSILCGLYAPSSGTAKIYQRDIRTDLRRVRDVLGICPQHNVLFSHLTVSEQLRLFAALKGVPDSELTSQVDEILASVSLTEKANKLASTLSGGMKRRLCIGIAFIGGSRFVILDEPTAGVDVTARKDIWKLLQRNKEGRTILLSTHHMDEADVLSDRIAILSQDFEKPDLLDGKRLIFQHFYALLVCRINYTLKSKRTFLFQVIIPLFLLALAELFVLLQVSTARPDLMVSMPPLPLETSIMGNHSDFYVNSWDTAENSTANDILHAMFSSPGTGPRCAKDVPNDLLDTMRRELMFRNRYGFGRNKPAPGVDKDSVDNEYQCQNIQGEFDYTEDISNATYNAPIYCGCEDFGWNCTLEDWKWNETNWLRLNTTDRIFDLTGRNLTQFRLITRFAQLANTTAPFFLGGFSLGHVNQRAQSQADIDTSKRGWLETIKDIAQSMRIINLNTTGIEPATPKVLDPFAQNITLNQVVNDLLQNLDVRENVKVWFNNKIWPGFPIASNILSNALLRQEDYAIDPEDLGILTMNHPMNKTISQTLDQNALKFTQALAVFRITILLLVLSMIPAGFTVYLVEDRICEALHLQLVGGLRKVTYWVTSYLYDMVGGIHPRHHCNNAHLPVLPCLRLYRRRRNILRLPPSILRARNVDDSLRLCIPKSLFCGGSLFCPNCNWFLLRRHSLCLDSYHARVAYGSEQMNRPDMINQLPLPSLLAFDQMGIHIMCLFIHVIIATICLIFSQMDEFGFVRKRERNLTDAMMLREPSTCDDEDVVKERQRVDAIPMDSSDNHALIVRNLAKAYNPELLAVKGISFAVEPGECFGLLGLNGAGKTTTFAMLTAKIRPGHGSIEMQNTRINTGSFSDVRNFQQLGYCPQFDALNMKLSTRENLKFYARIRGIVPTQIDSIIDRLLIALHLRPYANTQTSSLSGGNRRKLSVAVALVSQPSLIFLDEPSAGMDPGSQQFLWKVIERLCKSGKAVVLTSHSMEECEALCTRIAIMDRGRIRCLGGKQHLKSKYGKGSMLTMKMGKDENAKEIAGIMRSKLGDGSRVEAIHCSTIFIHIEQGTASVARVLEIVNQV

SEQ ID NO: 4985 - protein, 499 aa, Caenorhabditis elegans
MASTMMPSSTYNSVRSLPSPIPPLWTLQSIRFQTALLISAACVVFGLMRTCFGMAMVDIVRSCRWPRKSMIKPPTGNGTFHPDLHMEWSGDEQANIHTSFYIGAFIAVFPSEFLAKKLGPKNLLSFALLLNIFGSLLTPFSAIYLRSYFPVAAIRLIMGFGYGFVIPAGSVLISSWFPLSEKSTAMAIFTTGNQIGIAVSMFLTAKLCQLHFFEGWPLVFIVYGLIGAVFLVIWHVRLADKPRESKYITATELTYIKGGKQRRNRAETIVRATPYMKIILNGCVCAICACSFAQSFVLVALVTYLPKYNQIAFKMNLTHNGIWSSLPFFIQMITKLLFAIIADKVKQRKVNATAVTKVSNAIASFASAIFIVIAAYGPFDSAELVQLSIIVSMAAFSAYVPGYNTSIVTVAPQFTAFISSYAQLYAQIASTLAPIVIGRITSHGTIYEWKCAFYSLAGVLAVTGLIFQIFGHGTEGGTQRSTQRCTQRSTQRSTQRDTQ

SEQ ID NO: 4986 - protein, 594 aa, Caenorhabditis elegans
MCLFHFLAVIVTTFAQDEGSFVEKCTKPRLTPAAILDVIMANYSRSLPGNPVGVQVEVTVQDVMELSVLSNSFTADIWFSSIWYDPRLAYSHLDNCRQNLSFDDRFEKVCAKNYTTTQNKFFAAKLKFSKKKHLAEISNFIKHFWRKHFLWSEIKLLSTEHTCNNNHLYFQLIWSPNVCIVNTKSAHVHRSPKPNVLLMLLPNGTIWLNYRILDFLFFGPNLKRKKNFIAQLQIRVQSPCSMDLARFPIDTQYCQLVFESYSYNTASVSVNWMANPVTVLPEISLADFDLSRYRTSRHTEVFSSKDKRPRRHSIYIQNCEFLKIYSKTLVRKFQTSKFWFQVFRLKIFKFFLQKFHFSLTQFYPKFFLYVPTYISLFISWIAFCIDTKALPARIVLGVNSLMSLTFQFGNIIRSLPPVSYVKAIDLWMCTCVGFIFASLLELAFVAYQDKKLILKSGKSNAAISTLVSYLKHFEPYHDVSSPPPPAPLDEKKSMSRTTSTGTNRSRSELDGLDTKDLEEEIAEYRKLAYARKKWRLLDFGANVDRISFIVFPLSQRSMWFTGHITFKTCGYPLGPDFNFFFFVIFVLTCSRISQ

SEQ ID NO: 4987 - protein, 417 aa, Caenorhabditis elegans
MVDKDIHSEHWYHGLLPREDIKAMLRKNGDFLVRSTEPKAGEPRQYVLSAMQSEELEDAGVKHYVMRLNSSNQIFLEAKGFETIASLVNYYMSSKEPIKKLTVLKTPILKQPWEIEHSQVELTKKLGEGAFGEVWKGKLTLKNGNVENCAIKTAKLESLNKEQIKEIMREARLMRNLDHPNVVKFYGVGASQEPLYVIMELADCGALDSYLQKNPNLVPDKKMEMIYQAACGISYMHEKKLLHRDIAARNCLYGGGQVKIADFGLSREGISYVMDLTKKVPIRWLAPETLKAGIYSPKTDVFAFGIMAWEITENGKEPYPDMRVADVVGKVRNGYRMRFDPVFVDFRFGDYVTKHCWAENPADRVSMADVLRYLQTTFGMKPVVLSILSSNRSTEEEMKTMKPPMFSVKRNNKKKPK

SEQ ID NO: 4988 - protein, 344 aa, Caenorhabditis elegans
MSDDGGNGNGQRFINITEDIIPDKIDYVKLISKIWTYIREYTPDGPRPQFYPEVLKKLLQKSCEVLKQDEMVVKVTGPAVIFGPVYGEGDSMISLMSLAKKVPPEQTYVMLGCYLGRGFAQIECLVFLLAYKILHPEKVVLLKGHHEESISIEMLKVKEWLMARGIERDVDLEECMIEMKRACSMMSAAAVIDSKILCMPGGPGPTIREKGLQKLVGLKKGVQAIADKKLLMEASWSVLLLDDAQKDMHGMPFFTPQQATDFCKANNLKCIVRGRQMVDEGYLNKPREVVTLISAVAYLDNFRNHAAVLQVDNDKGKVIRYKMEEGEQLSLELVKPGMGRNAVS

SEQ ID NO: 4989 - protein, 427 aa, Caenorhabditis elegans
MASEANKNVPGQSQAFHVFSNFKNQIQKIFVSAEVKLKNNHRTLNVHECWEIRFFPKRKGNCSNRPFFFSPSVNQVECHQQTQNVDYLFFLVINLKSPDKKLTLLFSSHLVSVDTLLLRREMRTFVLLLALCAICILASSAYGKVRKYSNRNRYNLKGCYKQTGRVFEHKRYDRIYETEDFDSEDLPKTWDWRDANGINYASADRNQHIPQYCGSCWAFGATSALADRINIKRKNAWPQAYLSVQEVIDCSGAGTCVMGGEPGGVYKYAHEHGIPHETCNNYQARDGKCDPYNRCGSCWPGECFSIKNYTLYKVSEYGTVHGYEKMKAEIYHKGPIACGIAATKAFETYAGGIYKEVTDEDIDHIISVHGWGVDHESGVEYWIGRNSWGEPWGEHGWFKIVTSQYKNAGSKYNLKIEEDCVWADPIV

SEQ ID NO: 4990 - protein, 348 aa, Caenorhabditis elegans
MKKAQIGYYRRSSRLKFDSSHSTLRLVEMASQFLRSTNSRYVAGVLAALGAGSAVYTLTPQQLQAKSEVDAATIKKIEEAYAKLNGPEGAKCKSLLKKHLTKEVVEKLKTKRTKVGATLYDCIRSGVYNLDAGVGVYAPDAEAYTLFAPLFDKIIEDYHGFSPKQKQPPVDLGEGKTKEFPPLDPKGKYIKSTRIRCGRSLKGYPFNPCLTQDNYLEMEGKVKKAFSEYSDKELKGKYYPLDGMGKDTQKQLIADHFLFKEGDRHLQYANACNFWPKGRGIFHNNDKTFLIWVNEEDHMRIISMQEGSDVGAVLDRLIKGVRGIEKQVPFSRDDRLGWLTFCPTNLGS

SEQ ID NO: 4991 - protein, 399 aa, Caenorhabditis elegans
MASQFLRSTNSRYVAGVLAALGAGSAVYTLTPQQLQAKSEVDAATIKKIEEAYAKLNGPEGAKCKSLLKKHLTKDVVEKLKTKRTKLGATLYDCIRSGVYNLDAGVGVYAPDAEAYTLFAPLFDKIIEDYHGFSPKQKQPPVDLGEGKTKEFPPLDPKGKYIKSTRIRCGRSLKGYPFNPCLTQDNYLEMEGKVKKAFSEYSDKELKGKYYPLDGMGKDTQKQLIADHFLFKEGDRHLQYANACNFWPKGRGIFHNNDKTFLIWVNEEDHMRIISMQEGSDVGAVLDRLIKGVRGIEKQVPFSRDDRLGWLTFCPTNLGSTVRASVHIALPKLAARKDFIEICEKLNLQVRGIHGEHSESVGGVYDISNKARLGLSEYQAVKQMYDGVKKLIEMEEKQK

SEQ ID NO: 4992 - protein, 364 aa, Caenorhabditis elegans
MTSSNEKLPKINHDNEVFALLYKILSSEVQTIKGEDNEKVNQLRVDITISEISQLTDKMKKAFLEQPALLEISNEPITVVADMHGQSIHLLRIFLTNEAPPNQKYLFLGDYVDRGSQSVVVMCLLFCMKHRYPQHVFLLRGNHEDVNTTLNYGFYDECLEQWKNDEGEKVWRMFIDTFNCMPLAAVIGGKVFCAHGGISPWLESLEDINSIERPLVVPPYGLACDLLWSDPAQPERNGWGLSHRGISFTYGKSVVEEFCAKNDIALVIRGHQLFKEMYPQGCVLRFGGRLISLFSALNYEGHKNNSSVLKLEFVGQRVKVKQVLYRCRHYAPLRSNEYLGFRDMKSSSGKNEKRKKGRLESLLG

SEQ ID NO: 4993 - protein, 412 aa, Caenorhabditis elegans
MIFFQNFDHTKLKIPKNQFLSKFQLFPTHFPFFDSKTVLFSEEMTLEEKEEVSTSTSQSPQSSSFENVFCAICGDRATGKHYGAMSCDGCKGFFRRTIRKRHSYVCRFGEKCQVDKAKRNSCRKCRFDVCLRKGMRRDAVQTERDRIRPANPLSNGSNGGIVPDDPLLDTLIRAEASTRGLRTTVITKTAEARKQATTNDVTDSMNQQLTLMVEWAKVLEGFQRVDNITQVALLRHFSAQHLVMCAAFRSIHLSDAVWLTNETCLHKDSPKIPDMNRVAERIIDQVTNPMRSLHMNEIEYIALKAIAFFDPLAKGITSESYSDVEEMRQRILESFERHVRYVSPYKDMPLRFANLLLLLPPMLAISRDLVEDVQLAKLFGLASIDNLMLELMLPNEGKNTTDKTSPPIMCHQ

SEQ ID NO: 4994 - protein, 532 aa, Caenorhabditis elegans
MYKSWPYCRLNHYWGTTFDGAKVSAFLGVPYAKPPIGSRRFKMAEMIDRWSGELEARTLAKTCYLTIDSAFPQFPGAEMWNPPGAISEDCLNMNIWVPEDHDGSVMVWIYGGGFFSGTPSLDLYSGSVFAAKEHTIVVNVNYRLGPFGFLYFGDDSPIQGNMGLMDQQLALRWVHENIGAFGGDRSRVTLFGESAGSASTTAHLFAPNSHKYFRNIIAKSGSIINSWASATPPTMLDLSFRLAKKVNCSSPDMNAIVKCLRSVPAHLVQAEADNISGDIGPPMTFAYVPVSSDANFFQGDVFQKLANKQFKKDVNIIFGSVKDEGTYWLPYYMSLPKYGFAFNHTISAEDPHNRALITRDHYEESMRAFMPYFAGSKLVLNAFMNSYEHVSTSNVPEERYRDGVARFLGDLFFTCSLIDFADLISDNIFGNVYMYYFTYRSSANPWPKWMGVMHGYEIEYAFGQPYWRPHLYDQTHLEDEKRLSSIIMQIWANFANTGLVFEYSQELSGADKLVPADILAVFRYSQHLILPV

SEQ ID NO: 4995 - protein, 384 aa, Caenorhabditis elegans
MSREIRSLESIISDARENTHEKMLIRKQRDMTTDIAPERDLQGRFCSLRRIGEGTYGVVFKAIHVRDNVKCALKMIRTDRDEEGIPSTCLREISCIKDLQHDNIVTLFDIIYASHFLNYNNIFFEKFSSNSKLYMVFEFIDRDLKNLLEMLEPTNSVLPPNYVKSFMWQLLSALSYCHLRRIVHRDLKPQNILVSDSGVIKIADFGLARNFSFPSRNYTHEVVTLWYRPPEILLGSQRYSTSLDMWSLGCIFSEIASNKPLFPGECEISQLFKIFEIVGTPNIKSWPGVDSFPHYKAVFPQWPVNLKKLEETSCLTGNGLDVLREILRYPPERRLTAKGALSHRYFLQNGFTQNRPSVTDLMKDIRAQNRTPPLLNNHQEKSIF

SEQ ID NO: 4996 - protein, 676 aa, Caenorhabditis elegans
MHPTTTISEFLPLYQICRIYHCPNRIHDKLSPYTPPLPPLVFATNQVSLYASLFTVSRALSYGANEKLVILHKLPGEYVLLGGRNHVYNISISSMLEIARYEWTSSDEARTNCAAISQTPASCENFIRTYFELTNDTLILCGTHALQPTCAEFRKGNAKPQRLISAVGMSPIDADSTAPFIRSNENIITVNVAELSSSEPLLVRRNVIKMWKGIENDVILRTPRGLSSFEQANFLSMHKVKKVRGVEEVLFFFSESPMETEGCGLHKVARVGRVCEDDPGGRLSYNKEWSSYEKARIECSIEETDTDTFYFNQFAGVAESPTSFYGAFRSQLAGIGASAICKYSKKVISGSFASGYKESTPDTCSRANDIEELSRIRLKPLIKQKISANPIYIFHGKDRFVHVLAQEDTRDLSNRAYDILYVATNLGNILKIVVPSTDKTGRHAVTLKVLPTNSKIVDMSLYSKNNLEELIVITEQSVLKVPTATCHLASNCAECLAHGDPHCAWADGVDCIDIRTDQRKSASQDSGTCDVVSFENHKPVMIAPLKNKESAKIPVCLCETEKQKKPCATEVIQKEIVLTGGSEFWKYILVFAVGVLTGSIFHYCYFYFSRHIGDKASSSSRSSSSMTRPITTSSSARLPIDAFTTSSIADEMFSSTLSSANRFNSVSMHSSIRTYC

SEQ ID NO: 4997 - protein, 224 aa, Caenorhabditis elegans
MAKTYDYLFKLLLIGDSGVGKTCVLFRFSDDSFNNSFISTIGIDFKIRTIELDGKKIKLQIWDTAGQERFRTITTAYYRGAMGIILVYDITNERSFENIKNWIRNIEEHAASDVERMIIGNKCDIEERREVSRDRGEQLAIEYGTKFLETSAKANLNIDEAFFTLARDIKSKMEQNEMRAATGAAICFKFIALSPCSALFEVDCDSIQFNFNSVPYLFSYFLSV

SEQ ID NO: 4998 - protein, 468 aa, Caenorhabditis elegans
MPRERSLSNLGRKVMFRYRSKSNDRGKRQNSKDRARADHMAFDYDLSVITWLQNLRFLISRYCRSENVCNHLEALMNAARYGNTDLLYKLYIHHIDLRMTDETGNTAMHVAVMNNQQKIVRMLVVLCAPCQIWKIKNNNGLTSTELCTDKKISEDFKSLDNPPSPSPGAFVDVDSEYNNVLASEKKQWKPEERVLLALDGGGIRAVITIQMLIHIDYLLGGKLVEKLDDIAGTSCGGVITLLLSTNNRNIEETRKLLLDMRDRVFIRGADKAVPKYSSNGMEYIARHVTTWEDSKMSSIKRHRAIVTVADTRMVPPQLLLFRSYRPEMPEEACEHYKFLDPTKVELWKTLRCTTAAPYFFESFNGLSDGGLIANNPTLALISDFFLTNKLEKSFAKSSSERENRGNWKIGCVISLGTGVFPTEKIDGIDLIVAHAVSTPFYTSFYEKFARAPHIFFSAGFKLNLKHNS

SEQ ID NO: 4999 - protein, 849 aa, Caenorhabditis elegans
MSGGKDEASDKALLKILKSKSPNTIAIFSRGEYFSVYGDDATFVATNIFKSDVCVKTFTLSTDNSQQMKYISVNRGQYEKVVRETIVLLRCSVELYSSEQGEWKMTKRGSPGNTVDFEQEIGVSDQAPILAIYIHPGDDDNRVTLCAWDAGNVRIVISEYIDTPSFSQTEQCIFGLCPTEYILVNEGSVAPKAKKIASMFTRMEVHNKQQLKPKSQWSDVIESVHLDYKDEAEKQNENIKECLQILHSNAADEYSISEKYSIFNYGTHGNMLIDSCAVEALELFQLNYNYLEKSNNLTLYNVLNKCKTLPGEKLLRDWLSRPLCQIDHINERLDIVEALFENQTIRQKLRDSILARMPDCSQLARRLMRKCTLQDLNRFYQAATLLETVEMQLIQLSEAEQFAPSINRLLKSEITEILKKVERFQVLCDEFFDFDYEKENKEIRVRVDFVPEIQEISEKLEQMERVAEKLRKKYSAKFECDNLKLDKNSQYGFYFRVTLKEEKSIRKKDVHILETTKGSGVKFSVGELSDINDEFLEFHLKYTRAEEEVISMLCKKAEEFIPLIPAMAQLIATLDVFVSLSTFAATSSGIYTRPNLLPLGSKRLELKQCRHPVIEGNSEKPFIPNDVVLDKCRLIILTGANMGGKSTYLRSAALSILLAQIGSFVPCSSATISVVDGIFTRVGASDKQSQGISTFMAEMLDCSAILQRATKNSFVVIDELGRGTSTFDGFGIASAIAQDILNRIQCLSIFATHFHEMGKLAEQPGAVALQMGVQIENNEIHMLYKVFEGVAQCSFGLQVAKMVGIDENVINKAAQLLEGLEKKLVIDSKKKKELLESADIRQAILSLVK

SEQ ID NO: 5000 - protein, 417 aa, Caenorhabditis elegans
MMRNFGREFLEETSIFENKTCLIWRDREISFKEFHEYIGKWKNVLDEQKTKTTNPLRIALFCTNSPDILAIIVAGQLSGVTVIPLNPSYKKYEIDEYISKSIANFIIVSDDVDLDKFEEREVNLISELFTSNVTPSSTASTPENQGVIVFFSSGTTGPPKQFEYTQRILCSQIDQIKAIRSDPRFFSPSTDDICYGVLPFFHAGGLITILSMIFSGCTVLINERWNEHEFLANCQNYKVSVLFLVPPVLNFFANHPLVSSYDLSALKTIYVGAAASPPENFAKVAERLPELENLIQLYGTSECGVLLCSTGKGKASGKTVGWPFPFVELKINPENNEIFVKSATAMEEGFMETGDLGCLSFKTIELMIVGRSKEMMKIRGWQVNPNEVEDVIRKVEGVLDCAVYQVNLRVKCCTLGK

SEQ ID NO: 5001 - protein, 214 aa, Caenorhabditis elegans
MSYAYLFKYIIIGDTGVGKSCLLLQFTDKRFQPVHDLTIGVEFGARMVTIDGKQIKLQIWDTAGQESFRSITRSYYRGAAGALLVYDITRRDTFNHLTSWLEDARQHSNSNMVIMLIGNKSDLEARREVKREEGEAFAREHGLVFMETSAKTAANVEEAFIDTAKEIYRKIQEGVFDINNEANGIKLGPQHSPSSPNSPGGNATGGLGGGSGCC

SEQ ID NO: 5002 - protein, 477 aa, Caenorhabditis elegans
MVRHRLPSSTYYTPAGEPEWSREMFGEQSIAVLSGAYRNPIEMARHVAARCGSYQPFFVMDVAAIERRLEALRVMLPRVRPNYAVACNADPVLARVLSNNIDVNFEVSNTAELELVSMNVEPSRAVFCSQLMTRKAIKNAVLAGCSTFVVESEKQVTDVMNASPEAEIILAVCLPYSTGEVPFGCSVDEIEEILDMAHLLGANVTGIYLELGLRATLEDYITSVHDARSIFETADQKFLTLRRVCFGNLSVPTGADGAVNNEFMSFCNSLNNVIDDLFESNIDFSASIGRFLVTNAFTLCTNVIGKRAMDAKFITNDDFDDGVGFVYQTNDGVYGSFGCKQMDIKPLCKPLDVENDSEEQLHFGTILGPTLDGTDVAQRLMKSRQLRVGEWLVWEQMGAFTIPVDSEHSVPPVYYYSGKECWQKLIHKDEQRRSPSPSVSDNEDIGSDGEGGYASSCEDSEAEMALEPLIEDLNEFF

SEQ ID NO: 5003 - protein, 305 aa, Caenorhabditis elegans
MTATIDVDNLMSRLLNVGMSGGRLTTSVNEQELQTCCAVAKSVFASQASLLEVEPPIIVCGDIHGQYSDLLRIFDKNGFPPDINFLFLGDYVDRGRQNIETICLMFCFKIKYPENFFMLRGNHECPAINRVYGFYEECNRRYKSTRLWSIFQDTFNWMPLCGLIGSRILCMHGGLSPHLQTLDQLRQLPRPQDPPNPSIGIDLLWADPDQWVKGWQANTRGVSYVFGQDVVADVCSRLDIDLVARAHQVVQDGYEFFASKKMVTIFSAPHYCGQFDNSAATMKVDENMVCTFVMYKPTPKSLRKG

SEQ ID NO: 5004 - protein, 1313 aa, Caenorhabditis elegans
MTSDEWSIFLFLRGLNSPGDEKAKLYLMQYVEASEKKNEKLKLSDVHDEWMKFIQMHQQSKIVSVKPSKSSQQVDVNKVDTNRSKKKKKPIPRKPEKSSQDSKKKGEIPTCFYCNKKGHYATNCRSNPKTGNQGGNKGKSKGCDSVHVDGLDVKTEHQAKHRMSVEVCGKDVAFQLDTGSMITLISFKCWEKVGSPPLEKVPHRFSCANGTPMAVKGRCLVKFKLKGIEYTEYVYVCDRQTNLLGTSWLNLCPQMRSALAQIVNQVSTSETEASRLEVMLKNDFPEVFKDGLGLCTKEKAEFRTEENAVPVFKRARPVPYGSLEAVEKELDRLQEMGVIVPITYAKWAAPIVVIKKKGTGKIRVCADFKCSGLNAALKDEFHPLPTSEDIFSRLKGTVYSQIDLKDAYLQVELDEEAQKLAVINTHRGIFKYLRMTFGLKPAPASFQKIMDKMVSGLTGVAVYLDDIIISASSIEEHEKILRELFERIKEYGFRVSAEKCAFAQKQVTFLGFIVDEHGRRPDPKKTEVIRSMKAPTDQKQLASFLGAVSFYSRFVPKMSKLRGPLDSLMKRDVKWNWTDIHQEAFNTLKNAVADSTMLSHFNESWPIIIAADASQYGIGGVLLHQTPEGHEVPVAHFARALTDTEKRYSQIEKEAVALVYTVKKAHKFIFGRKFLLQTDHKPLLAIFGPKKDLPVHSQNRLVRWATTLMTYNFELSYVSTSKIFKADWLSRMMQDHQQNADDVVIAEIYDDDDDEDDSIIQKLNPVTETDIRFESQKDHEVSSVIKLVRNDSWKPKPSTEIEKHWIRYRDRLKLIHDCLLLDDRVIVSKSLQQIVLKQLHEGHPGIVQMKQKARAFVFWRGLDSDIEKMVRHCNNCQENSKMPRVVPLNPWPVPETPWKRIHIDFAGPLNGYYLLVVVDAKTKYAEVKLTRSISAVTTIDLLEEIFSIHGYPETIISDNGTQLTSHLFAQMCQSHGIEHKTSAVYYPRSNGAAERFVDTLKRGIAKIKGEGSVNQQILNKFLISYRNTPHSALNGSTPAECHFGRKIRTTMSLLMPTDRVLKVPKLTQYQQNMKHHYDLRNGARAKAFQVNQKVYVQVHHGNKSQWKHGVIRRKFGGVLYEVQVGDRIQKSHVNQIRTRYGSSVNPRLSSDSFGFVGESGGDEMSRNDDPVVTSNGSSTDVNRGSRITSELKKKESNAVRGQPRGSCSPTNNDVSAPGYASRSHPTTDPSHSVRRSSRIRRVPDRYGSSVEHPSTSTGTPRGSTSTQLGQASTRNGSRYTASGRNPSSQGNRYSSIRGEGVTARRERVRTTWR

SEQ ID NO: 5005 - protein, 417 aa, Caenorhabditis elegans
MSSLNKLAIDQLNLAGKRVLIRVDFNVPLKDGKITNNQRIAAAVPTIQHALSNGAKSVVLMSHLGRPDGRRQDKYTLKPVAEELKALLKKDVLFLDDCVGSEVEAACADPAPGSVILLENLRYHLEEEGKGVDASGAKVKADSAAVKKFRESLTKLGDIYVNDAFGTAHRAHSSMVGVEHSQRASGFLLKNELSYFSKALDNPARPFLAILGGAKVADKIQLIKNLLDKVNEMIIGGGMAYTFLKVAQGVKIGNSLYDEEGAKIVNELLEAAKAKGVQIHLPVDFVIADKFAEDATSKTVTAEEGVPDGHMGLDVGPESSKIFAAAIQRAKTIVWNGPAGVFEFDKFATGTKSLMDEVVKATAAGAITIIGGGDTATAAKKYNTEDKVSHVSTGGGASLELLEGKVLPGVDALSPAQ

SEQ ID NO: 5006 - protein, 280 aa, Caenorhabditis elegans
MWPRCLTLFRAAVNFQTAESICATLSGHLVSIHNAIDNAFVSSQAQKYMDGGAWIGAQASAPDVTNPLNWYWTDGSNFDYQNYKVGQPTPPGSTACMQLETGTAKWQTANCTNKLPFICSAAATVVPTCPTITIPSHCPSGYTWFETTDFCYKTTVQFTNFNDARSACQADGGDLASIHSIAENAFLVGLSKAGITNKDKDWNDDVWIGLVYQNSKWQWTDGSVVNYVNWGDGEPNNMNKEWWTALVADPHEGKNSEGTRWNNVPQDDQRAFLCKIAPLH

SEQ ID NO: 5007 - protein, 264 aa, Caenorhabditis elegans
MRVILLCLIVAAYCFAAEEQKLQWKDEDGLEIKIIRPIKAEKCPIKSQDGDVLDQWYKLSDKDGKEIGSNFNKKPYTFTLGKGQVIPGMERAMTGMCKGEKRKVVIPGNLGFGDKGRERDNIKEDQTLYYTVQLVDLFRAVPGEKWTTDEGIVIEQTHKIDEDKCKKSKSGDTIHQQYVLHLEDGTFVDSSFSRNAPFIFKLNNNEVIKGMDIAMTGMCEGERRQVVIPSDFGYGDDGRAPAIPGKARLYFDITLEKLIQRDEL

SEQ ID NO: 5008 - protein, 202 aa, Caenorhabditis elegans
MAGMHFLVGISTENYVILAADKATFAYGAILADSENDKEYRLGKKLTMMCIGEEGDVAQFGDWTKRNLQLYSVRNGYEVSPSCAHHFVRRSIAEGLRSQDHYTVDVLIGGYDDKEDKAFLGSVDYLANGLGQQPYLFRGFCGRFCYAIMDREYKKDMTEAEGLALMNKCIGEAKRRFVANIPGYKVVIIDKKGYRKLDDVLF

SEQ ID NO: 5009 - protein, 2180 aa, Caenorhabditis elegans
MFDDEDTKYCSTRVCRPGYFNCGNGLCIPEQKVCNRINDCANFADESNCTCNENEFRCQSGACIPSKARCNHMQDCNDASDEIGCPFRNCSALNEFGMTGLINCATTSQCIHPSWKCDGTNDCYDGSDEKDCFVEFDATGGSVSAPRSCDAKTQFACLATRTCMPKHWQCDGQPDCADGSDEKNCDAKKCTSFEFSCESSKKCIPLEQKCDGRRDCPDGEDEHQCETECDSKGGNATFRCTNHRCIPMAWRCDGTDDCMDNAKSLGSDEVDCAAGRTSFHVPSRCADETCVVACELTAVLCDGIQDCSDGFDEKNCASLDRQCKPNEWMCDSGQCIDSGRLCDASVDCVDGSDEWVEICSLSEPPRRGCPSGWSCLLTNGTIGCLQEQQLCDGRRDCMSGIDEQCDNPQGNCSSTRNSCDQTWNCQRHAGFESCSCDDGYHLSPYDKKTCLRSPSCPKANCSHFCIDRRDVGHQCFCAPGYILSENQKDCRRNDTIEAEILMVYGHRLKLFTIDGHAKATLLSNLTNGVALDYDVKSDLVYWTDVAHDGNKAGITSMSNQPNTYRVINSLPTKGIDGIAVDWLGRNIYYTDRNHDAIAVCDMRGRFNRILLKGTPLNDPRAIVLDPLQALVFWTDWGASAHIGRMNMDGSNEQVILQDRTIRWPNALAVDAPAQRLYFGDAHRDYIASCNYDGSKRRMVLRGSVRHIFALAVFEDYVYWSDWHNHTIERVHKITGTNRKVLIQDKQYRPMGFKIVHPSLQSMGSLKTARHPCSQPARCDNLCIPANTPDLTTSSDNFTCMCAQGFRSEGRSCVSECKPNDFVCTKTYKCISSWWRCDGQDDCGDGEDEGYFVEGVCPPFPCIAGQFVCGRTAQNATAQCLYASKLCDGVKDCSGGDDEEPAFCENFECTEAQFKCGDKKKCIPLTSVCDKEKDCDDGSDELNCEITSCKPDFFACFNGTAISKCIPKEFYCDGEDDCPEGQDEPDSCFGIGECTHEQFQCTSGKCIPKRRQCDGTLDCRDGSDEKGCKKECAIVCDNSCVHADDLCDGKKKCNDGSDEDEEACVIKQLLEKENRKCGGFACDGIVDCEDGSDEKGCPDLECHLASNKSLICDGTIDCSSGKDENNCHNNGESNFFQCSMQTIKEWQVCDGRWDCADGLDESPEMCASRKARCFRIGYCDDKKQCLDVSTALCDGIRDCFDGSDENPIHCKDMCKGKYRCTNGRCIDVSARCDGRDDCGDGSDEDTCGAECHHFGVCAQKCWMAFNHTARCHCAPGYARTKNDENECEPLSKSAEMFITNGNRLHLMSLENSQVSVLRPVFNIKMNLIPGGIDFGYDVFRTTLMYTVGIGNSRVDIRSKKWSDGLIGSWGEEESTAGLITYDFMHNNVYFTESSEQNRGVLFDRQANIYVAKAKDTSTRTLIVNSTGTINSLAVDPIKRLIFWTTSAPVPRILSANLDGKPIAQPFKTGSQPHKALVERNIFEPTSMVLDFSNERLYWIDVLKRTIETVSFDGRDRRTVRKFELGDTPVTMDVLGGYIYLITRQGSIHRMHKFTGKTNKYVQKIREVSPRIQIRVAHPAKHTVSHITHQKNPCQSDYCPSNTVCVPDQDKNGILIPKCLCGPGRFFEVSTKKCMQLREKDQEASQCGDYFCYNNAGCSPQKTCVCPPGFYGRQCELYFTSKYDVFKASTNVLRLAGMARHVQFKNSDQQQMLSVTAPQTTLNPAAQQTFVKDFCECDKGWTGPHCRHKADAKVCYGHCFSGGACDGEGPLNLRCSCGDGLTGNRCQNCVGHECLNGGFCSYANSNRSLPHCICPSGFTGDHCEEYLCKDACPFGSKCTYDITKPMDPITCSCEQNAAAHNTDCSPICQKQPNWCHNGGRCLDTPGYPGKCKCLPRFAGPRCDVPVQCDDYCTNNSKCTITNGTHFECDCKPGFKGLRCEQETKCSECSNEAKCIKKPSGTVICQCPQGLGGEYCEKITATSCHQLECKNGGYCLKPDPSANRTSPTCLCSPGFKGLLCSSNACENFCLHDGNCTLDEYFEPQCECYQAFIGDRCQYRIHQHAVIFSDDDSGWIKSFVVLAIILVTIVIVVGIFANRSNRFAVFRQFRHNPLQNQGAPVDQFSNPAYLIDEGGIELVTQNTSLVSSHDRGSFNNPVFEQEMVPIYNDTVENHELLPNNRSSN

SEQ ID NO: 5010 - protein, 2643 aa, Caenorhabditis elegans
MLSARYLVILLVALQGFSLVQSDETSAEETQPHYPECVAPMRECDAKSPGGPKCYPEQWYCDGFPDCQDSSDEPSTCKRTCLENEFVCKTGKCLPRGYLCDSQYDCGRLPNGDRDLSDEAPELCNQPLHCDYNEYACSKSAQCVPLFKFCDGKRDCSDGSDEHSMCHVEDPKTADSCEYGAAMTIDGIKCYCPKNKFLNEQGKCEFVNHCERTKNGLPPVCSQDCTDNKNGTFTCSCFDPRLTVVNGTHCVADKDQTIPSVAILTKKKLFVLQKNKMSSYSSMPRPLGKPGAMTLVIQHPDFPEATVPILCLSESPSANDSYITCGNVEGSEPATKTYAIDFDLSSIHIIRFDNIGNNWIFTDASYYVFICKHNSVRISSCRTVTAGDMGTIQDMKYDGLNGQLLVSEVDVLQQGIWRIDVASGQRYRLSYQPITSPALAIDPFTETLYFVDIGARSIKAVDYNANYSRTIVSGRIAKEVKMIDYAEGRLFLTLKDNRVFAMNALDSNSDMKIWQEVTPQRKQGNENIQILEVLHFRRNEHAWKNKGKNICKAAMCDDMCIGHINQTSSCFCRDGYIQNNTKCSASKDLKDEELFVLAQLRPSRIKILGFDKNYRTEIIGVSDLLNVKRPSAMTFDPKGEQLLMYDLRRHSLVVQKIGSTNYTVHGLTGIMNCEGMAYDFTSDNLYMTDQRRKIITVQRLSNLSIQKVVVSGNMSNPRAIAIHIAKSYLFWGSWNEDNNDDEKIPAMIERSKLDGSERKTLVSKNAMWINGLTLDLKNDYLYWCDAYRNVIERIRWNGADREVVVHGADKISHPYGLAFFDNHIFYTEFKKGAVKRVNVDFPDDVQEVFQYSATVFELLVFKNSNPETTSPCSTSSNICEHFCFASSCKGSVGCEPVKCGCADGMKVLKNGKCVKDEEWVDPNACDNEIEFTCLNSKKCVPKSNLCDGDDDCGDGSDEDANGICKDYKCVGNKFQCDGTTCLPMEFICDGKSDCYDGTDELEKICKKAPIVKCSVSQFQCSKTKCIIKSKRCNGVQECDNGADEEDCPRSKLCDPDEFRCGTGLCIKQSQVCDGKMQCLDGLDEEHCNEEEKCLQGRQFRCANGKSTCLDLIFRCDGVADCEDSSDESDEFCKGNSSSTCGKMNQFMCADGKCLRSFQLCDGFPDCLTGEDETECPPSMCDSTTHLSCLNGQKCISKQLECDGVDDCGDNSDEKHCTEIRLDEAALRCQSPMYQCDGPNFKCISDKHLCDGTNDCEEGDDEGLWCTFNCTDADDLGCSHTCRPTPVGPICSCPDDHYLDKNGVTCSKKDPCRFGQCSQYCSPHGSSHFCYCEDSFKLGADRSSCISDDPRKPFLIYSNRHEIRMIQSKYPGSLPMITNLVNAIALDFKYHQNGSVSIYWTDLSADKIYTGLVDQRTILYQRTIVSYGVFNAEGIAVDWISGNIYWIDSFLDTIQVVSEDGTKRATVINQNMGNARSLAIDVEEGFMFWTDWEESNPRIERASLAGNNRAIIWKISNIAQAGWPNGIALDTIAKRVYWADAKSDSIHTITYDGRDHVIVFRDPERLGHCFGIDVYEGHVYFSDWRTNTISKVDKWFGSNVSIIERVATQPFSLKIVHRSKQKMQIKNSCDGFKCNGICLNNGKNKATCQCTNLQSTTDDGCVDIQQVLLVATKNGVRGFSTDPPHPHAFPLVSGKQYENIRAVGSFNNRLQVLDDYTTHIATVNLTGTADDGVLATGSDLYGVSGMAVDPVVGSTYITLSIDGVGSVEVISADGKSRRVLAESSSSNPMKLPRDILFMNTKLFWFEDSTSPPSIFSMSAAGDDLKKLKVNSTLLNKFYNPTVDRFYSKIYWISQGKVIQFDPKSEVVQEIQIPGGDGNVSSIAVDMTNGDILIGEFIRIANQTTIRRLGMKGTKAIQRGSVMLVPLHSSIKFFLSTVDITAKNVPDECKKCPSLCLRSSDKKFQCVCSQGFELVNGKCRSPDKRVFFATDDGSLHSVGWYKNSKTGDLIQKYRAHSLHSDIGKKRILKLVADAKNDLVYVVTRQNEVWKCATNGSFAHIVYSTNSHRIAAITLDRVTGYLLVSARESISPKGFIVLIDPDRHSEAIHQVIVEDEDKIPYEIAVDPPKGKLFWASSSCIKSSNYYGTEAKCIVSKSSISAIAIDENRSRLCFVDSEKAAVDCVDYNGNNEQRNVAMFKAQPMGDIVSLVFNGDEMYFFDKFNSSGSIVRGLVQQDGSVVLKDSLVKVHPRQKIRVIDFDVMDVKSSVLFTACSNNNGGCEHLCITTPSENSPTVRKECLCVHSTRLDNGSCGSSDSFIAFTRFTSIEFLSTKPGDLTSPNKQITSNGCVMSKIGAVTADATRGRIYFADYDKFRITAVNFDGTGCVVIAEDVGVVPSMAYDEVHTELYFVRANPASIWRINVADNNLESYPTEPKIVLTLTVRDRPRHIAIHPCRMLLFFTNNAITGSVIERVYFSGFKRDQIVQEDLHDLRGLTIDLDSEKLYFSDSKDFKISRCDFDGSHRELVVSNTDIPSIHPFELSIYDDEIIFTDWVRRSVVGVNKITGSDNRNINRATDVPVGLVVVDTKREYCTSDACADNELKCEDYCRLMANGQASCACNGERRLNSDNRTCTGGKFQEASTNKQ

SEQ ID NO: 5011 - protein, 130 aa, Caenorhabditis elegans
MGAINLIEAVNYDTNPVVVHCSAGVGRSGTIVGISLIMDKMIQGINCKDMKKLVEEIRNQRHYAIQTEAQYMYIHRVLLEYFLELHKETYEGLLLTKNYEEKYAKWLDDYNTYAEANDRTQAAKAARAAL

SEQ ID NO: 5012 - protein, 142 aa, Caenorhabditis elegans
MANRTTAGGIGFAVRQKQDSKFIDKEATLLLEWIKKLSGENISTSGERDNFHNLLKDGTLLCKAANGIEAGSIKKVQKPISTFACMENINAFVEFAKKQGVPNEETFQSVELVEGRDLFSVCVTLLSLGRVLQKAGKTNPFA

SEQ ID NO: 5013 - protein, 6642 aa, Caenorhabditis elegans
MASRRQKQFDRKYSSYRKFTATEDVNYSTHSSRSSYRSESLTSRTDGRGRSTSSEIIAGSESRSYPVYIAIQDYTPDKEDVEAIPLEQGQIVEVLDKKNSVRWLVRTKARPPRSGWVPGSYFETPTEFYKQRRRTREIENVSLSDEQAALVKRDQVYHELLRSEEEFVSSLRTCVDDYIKVLDDPEVPEAVKKNREELTLNIPELYNFHANVMLKGLNYYSDDPGKVGQTFVRLEKDFESHVEFYKQYADTLKLLEEPEIKRFFEGLSAKNDAGASSFVDHVKEIADRMVQYQNYFKEFVKYSARAHGSSKSIQKALELVTTIPQRVHDLEFTNNLKQHPGDTGKLGRIIRHDAFQVWEGDEPPKLRYVFLFRNKIMFTEQDASTSPPSYTHYSSIRLDKYNIRQHTTDEDTIVLQPQEPGLPSFRIKPKDFETSEYVRKAWLRDIAEEQEKYAAERDAISMTATSEMTASSVDFDMNASDQQSEFSEWSGSRKSSLFPGPEEGGPPRKKVKSPPVISPTGSSTSIYSGGSSSIDWTTTGTTLEMQGTRVTRTQYGFRTLQESSAKMCLKVTGYPLPDITWYKDDVQLHEDERHTFYSDEDGFFAMTIDPVQVTDTGRYTCMATNEYGQASTSAFFRVLKVEKEAAPPAFVTKLRDKECKEGDVIDFECEVEGWPEPELVWLVDDQPLRPSHDFRLQYDGQTAKLEIRDAQPDDTGVYTVKIQNEFGSIESKAELFVQADPDKNHVAPEFQATIEYVECDEGEEVRFKSVITGDPNPEIIWFINGKPLSESEKVKFISEDGICILTIKDVTRHFDGMVTCQGSNRLGSASCDGRLKVRVPPAPPTFNKPLEDKTVQEKSTVVFEVDVSGWPEPTLTFTLCGKELKNGEEGVEIVGHDGFYRISIPNTSMDKHDGEIVAKAQNEHGTAESRARLTVEQEEEESRSAPTFLKDIEDQTVKTGEFAVFETTVRGNPNPEVTWFINGHKMDQGSPGVKIEAHNHDHKLTIDSAQYAGTVLCRAENAVGRFETKARLVVLAPEKQKKPPKFVEILVDKTETVDNTVVFEVRVEGEPKPTVTWYLKGEELKQSDRVEIREFDGSIKISIKNIKIEDAGEIRAVATNSEGSDETKAKLTVQKKPFAPEFDLRPVSLTVEKGSEAVFSAHAFGIPLPTYEWSVNGRKVRDGQEGARVTRDESTVDGASILTIDTATYYSEVNHLTISVVAENTLGAEETGAQLTIEPKKESVVVEKQDLSSSEVQKEIAQQVKEASPEATTTITMETSLTSTKTTTMSTTEVTSTVGGVTVETKESESESATTVIGGGSGGVTEGSISVSKIEVVSKTDSQTDVREGTPKRRVSFAEEELPKEVIDSDRKKKKSPSPDKKEKSPEKTEEKPASPTKKTGEEVKSPKEKSPASPTKKEKSPAAEEVKSPTKKEKSPSSPTKKEKSPSSPTKKTGDEVKEKSPPKSPTKKEKSPEKPEDVKSPVKKEKSPDATNIVEVSSETTIEKTETTMTTEMTHESEESRTSVKKEKTPEKVDEKPKSPTKKDKSPEKSITEEIKSPVKKEKSPEKVEEKPASPTKKEKSPEKPASPTKKSENEVKSPTKKEKSPEKSVVEELKSPKEKSPEKADDKPKSPTKKEKSPEKSATEDVKSPTKKEKSPEKVEEKPTSPTKKESSPTKKTDDEVKSPTKKEKSPQTVEEKPASPTKKEKSPEKSVVEEVKSPKEKSPEKAEEKPKSPTKKEKSPEKSAAEEVKSPTKKEKSPEKSAEEKPKSPTKKESSPVKMADDEVKSPTKKEKSPEKVEEKPASPTKKEKTPEKSAAEELKSPTKKEKSPSSPTKKTGDESKEKSPEKPEEKPKSPTPKKSPPGSPKKKKSKSPEAEKPPAPKLTRDLKLQTVNKTDLAHFEVVVEHATECKWFLDGKEITTAQGVTVSKDDQFEFRCSIDTTMFGSGTVSVVASNAAGSVETKTELKVLETPKETKKPEFTDKLRDMEVTKGDTVQMDVIALHSPLYKWYQNGNLLEDGKNGVTIKNEENKSSLIIPNAQDSGKITVEASNEVGSSESSAQLTVNPPSTTPIVVDGPKSVTIKETETAEFKATISGFPAPTVKWTINEKIVEESRTITTIKTEDVYTLKISNAKIEQTGTVKVTAQNSAGQDSKQADLKVEPNVKAPKFKSQLTDKVADEGEPLRWNLELDGPSPGTEVSWLLNGQPLTKSDTVQVVDHGDGTYHVTIAEAKPEMSGTLTAKAKNAAGECETSAKVTVNGGNKKPEFVQAPQNHETTLEESVKFSAIVTGKPMPNVTWYLNNKKLIQSEEVKVKYVHETGKTSIRIQKPLMEHNGTIRVEAENVSGKVQATAQLKVDKKTEVPKFTTNMDDRQVKEGEDVKFTANVEGYPEPSVAWTLNGEPVSKHPNITVTDKDGEHTIEISAVTPEQAGELSCEATNPVGSKKRDVQLAVKKVGDAPTFAKNLEDRLITEGELTLMDAKLNIVKPKPKITWLKDGVEITSDGHYKIVEEEDGSLKLSILQTKLEDKGRITIKAESEFGVAECSASLGVVKGRPMAKPAFQSDIAPINLTEGDTLECKLLITGDPTPFVKWYIGTQLVCATEDTEISNANGVYTMKIHGVTADMTGKIKCVAYNKAGEVSTEGPLKVVAPIPVEFETSLCDATCREGDTLKLRAVLLGEPEPVVSWYVNGKKLEESQNIKIHSEKGTYTVTIKDITCDYSGQVVCEAINEYGKATSEATLLVLPRGEPPDFLEWLSNVRARTGTKVVHKVVFTGDPKPSLTWYINNKEILNSDLYTIVTDDKTSTLTINSFNPDVHVGEIICKAENDAGEVSCTANMITYTSDMFSESESEAQAEEFVGDDLTEDESLREEMHRTPTPVMAPKFITKIKDTKAKKGHSAVFECVVPDTKGVCCKWLKDGKEIELIARIRVQTRTGPEGHITQELVLDNVTPEDAGKYTCIVENTAGKDTCEATLTVIESLEKKSEKKAPEFIVALQDKTTKTSEKVVLECKVIGEPKPKVSWLHDNVSREKNPNSEKTITQESITVESVEGVERVTITSSELSHQGKYTCIAENTEGTSKTEAFLTVQGEAPVFTKELQNKELSIGEKLVLSCSVKGSPQPHVDFYSFSETTKVETKITSSSRIAIEHDQTNTHWRMVISQITKEDIVSYKAIATNSIGTATSTSKITTKVEAPVFEQGLKKTSVKEKEEIKMEVKVGGSAPDVEWFKDDKPVSEDGNHEMKKNPETGVFTLVVKQAATTDAGKYTAKASNPAGTAESSAEAEVTQSLEKPTFVRELVTTEVKINETATLSVTVKGVPDPSVEWLKDGQPVQTDSSHVIAKVEGSGSYSITIKDARLEDSGKYACRATNPAGEAKTEANFAVVKNLVPPEFVEKLSPLEVKEKESTTLSVKVVGTPEPSVEWFKDDTPISIDNVHVIQKQTAVGSFSLTINDARQGDVGIYSCRARNEAGEALTTANFGIIRDSIPPEFTQKLRPLEVREQETLDLKVTVIGTPVPNVEWFKDDKPINIDNSHIFAKDEGSGHHTLTIKQARGEDVGVYTCKATNEAGEAKTTANMAVQEEIEAPLFVQGLKPYEVEQGKPAELVVRVEGKPEPEVKWFKDGVPIAIDNQHVIEKKGENGSHTLVIKDTNNADFGKYTCQATNKAGKDETVGELKIPKYSFEKQTAEEVKPLFIEPLKETFAVEGDTVVLECKVNKESHPQIKFFKNDQPVEIGQHMQLEVLEDGNIKLTIQNAKKEDVGAYRCEAVNVAGKANTNADLKIQFAAKVEEHVTDESGQLEEIGQFETVGDTASSKTDTGRGAPEFVELLRSCTVTEKQQAILKCKVKGEPRPKIKWTKEGKEVEMSARVRAEHKDDGTLTLTFDNVTQADAGEYRCEAENEYGSAWTEGPIIVTLEGAPKIDGEAPDFLQPVKPAVVTVGETAVLEGKISGKPKPSVKWYKNGEELKPSDRVKIENLDDGTQRLTVTNAKLDDMDEYRCEASNEFGDVWSDVTLTVKEPAQVAPGFFKELSAIQVKETETAKFECKVSGTKPDVKWFKDGTPLKEDKRVHFESTDDGTQRLVIEDSKTDDQGNYRIEVSNDAGVANSKVPLTVVPSETLKIKKGLTDVNVTQGTKILLSVEVEGKPKTVKWYKGTETVTSSQTTKIVQVTESEYKLEIESAEMSDTGAYRVVLSTDSFSVESSATVTVTKAAEKISLPSFKKGLADQSVPKGTPLVLEVEIEGKPKDVKWYKNGDEIKDGKVEDLGNGKYRLTIPDFQEKDVGEYSVTAANEAGEIESKAKVNVSAKPEIVSGLVPTTVKQGETATFNVKVKGPVKGVKWYKNGKEIPDAKTKDNGDGSYSLEIPNAQVEDAADYKVVVSNDAGDADSSAALTVKLADDGKDKVKPEIVSGLIPTTVKQGETATFNVKVKGPVKQVKWYKNGKEIPNAKAKDNGDGSYSLEIPNAQLDDTADYKVVVSNDAGDADSSAALTVKLPGIAIVKGLEDAEVPKGKKAVLQVETNKKPKEIKWYKNGKEITPSDKAQPGSDGDNKPQLVIPDAGDDDAAEYKVVLTDEDGNTADSSCALTVKLPAKEPKIIKGLEDQVVSIGSPIKLEIETSGSPKTVKWYKNGKELPGAAAKTIKIQKIDDNKYVLEIPSSVVEDTGDYKVEVANEAGSANSSGKITVEPKITFLKPLKDQSITEGENAEFSVETNTKPRIVKWYKNGQEIKPNSRFIIEQKTDTKYQLVIKNAVRDDADTYKIVLENTAGEAESSAQLTVKKAKAGLCKIVKGLEDQVVAKGAKMVFEVKIQGEPEDVRWLRDANVISAGANAIIEKIDDTTYRLIIPSADLKDAGEYTVEVINESGKAKSDAKGEVDEKPEIVRGLENIEIPEGDDDVFKVEVSAPVRQVKWYKNDQEIKPNSHLEAKKIGPKKYELAINRAQLDDGADYKVVLSNAAGDCDSSAALTVVKPNVLKIVDGLKDVDVEEPQPVELKVKVEGIPKVIKWYKNGQELKPDADGFKFEEKPESGEFSLTIPSSKKSDGGAYRVVLGNDKGEVYSGSVVHVKSAKSSEPTSGANFLSPLKDTEVEEGDMLTLQCTIAGEPFPEVIWEKDGVVLQKDDRITMRVALDGTATLRIRSAKKSDIGQYRVTAKNEAGSATSDCKVTVTEQGEQPSKPKFVIPLKTGAALPGDKKEFNVKVRGLPKPTLQWFLNGIPIKFDDRITLDDMADGNYCLTIRDVREEDFGTLKCIAKNENGTDETVCEFQQGAGHDDGSRDDLRYPPRFNVPLWDRRIPVGDPMFIECHVDANPTAEVEWFKDGKKIEHTAHTEIRNTVDGACRIKIIPFEESDIGVYMCVAVNELGQAETQATYQVEILEHVEEEKRREYAPKINPPLEDKTVNGGQPIRLSCKVDAIPRASVVWYKDGLPLRADSRTSIQYEEDGTATLAINDSTEEDIGAYRCVATNAHGTINTSCSVNVKVPKQEVKKEGEEPFFTKGLVDLWADRGDSFTLKCAVTGDPFPEIKWYRNGQLLRNGPRTVIETSPDGSCSLTVNESTMSDEGIYRCEAENAHGKAKTQATAHVQMALGKTEKPKMDEGKPPKFILELSDMSVSLGNVIDLECKVTGLPNPSVKWSKDGGPLIEDSRFEWSNEASKGVYQLRIKNATVHDEGTYRCVATNENGSATTKSFVRMDDGLGSGVVTASQPPRFTLKMGDVRTTEGQPLKLECKVDASPLPEMVWYKDGAIVTPSDRIQISLSPDGVATLLIPSCVYDDDGIYRVIATNPSGTAQDKGTATVKKLPRDSGARRSADRDVFDANKAPKLMEPLENIRIPEKQSFRLRCKFSGDPKPTIKWFKDGERVFPYGRLQLIESPDGVCELVVDSATRQDAGGYRCVAENTYGSARTSCDVNVIRGDRKPRDIDSSIREGKAPGFTTPLTIRRAKPGDSVTFECLPFGNPFPSIKWLKDGLELFSDEKIKMEAAADGTQRLILSDVTFLSEGYFRCVATNEHGTASTKAELVIEGDRTIGSRPLPEVNGEPEECKPRIRRGLYNMSIHEGNVVEMIVCATGIPTPTVKWYKDGQEIVGDGPDGKRVIFTDERGIHHLVIVNASPDDEGEYSLEATNKLGSAKTEGSLNIIRPRHIADADERGGMPFPPGFVRQLKNKHVFNHMPTIFDCLVVGHPAPEVEWFHNGKKIVPGGRIKIQSCGGGSHALIILDTTLEDAGEYVATAKNSHGSASSSAVLDVTVPFLDSIKFNGEIDVTPYLTEEYGFKKLNTASLPTPPDRGPFIKEVTGHYLTLSWIPTKRAPPRYPQVTYVIEIRELPEKQWSLLEYNIPEPVCKVRNLELGKSYQFRVRAENIYGISDPSPASPPSRLMAPPQPVFDRRTNKVIPLLDPYAEKALDMRYSEQYACAPWFSPGVVEKRYCAENDTLTIVLNVSGFPDPDIKWKFRGWDIDTSSPTSKCKVYTYGGSETTLAITGFSKENVGQYQCFAKNDYGDAQQNIMVDLATRPNFIQPLVNKTFSSAQPMRMDVRVDGEPFPELKWMKEWRPIVESSRIKFVQDGPYLCSLIINDPMWRDSGIYSCVAVNDAGQATTSCTVTVEAEGDYNDVELPRRRVTIESRRVRELYEISEKDEK

SEQ ID NO: 5014 - protein, 1398 aa, Caenorhabditis elegans
MAEQYEQKQRTLYANSTIDGLSSLAHPGVEIAEPKGVNRETCVRVFVRQLLLALKHMHDLRIAHLDLRPETILLQDDKLKLADFGQARRLLRGLITGEIKGSPEFVSPEIVRSYPLTLATDMWSTGVLTYVLLTGLSPFHGDNDNETLANVDSCQFDSSPLGNFSYDAGDFVKKLLTEIPVSRLTVDEALDHPWINDEKLKTEPLSADTLREFKYQHKWLERRVFVQQTPSEQILEAILGPATAQAQQNAPVAPEGRRPAEIYDYLRIQPKKPPPTVEYVPQPRKEHPPFIDEFGQLIDGDAFDRPEGTGFEGPHRQPPQIPPQPQRPNQAAHDSRRHEQQPQHQGQPQRIPVDQYGRPLVDPRYLNDPSHRPSSLDDAPFYVDKYGNPVHFDKYGRPMAPQNLEKRKLIPQDKGETPSHSKKEKTQHPVATPILASPGGDQQQQKIPMRMIRGERREIEEEIANRILSDISEEGSIAGSLASLEDFEIPKDFQVEASEPSTPTLTPEVTIRETIPKPTPSPTSPQKSPVPQPQGLLIPAKVTYSDSILAGLPAADKKVLEDAENDPSIPVGAPLFLEGLHGSDLTIDTTSASGLIKVTSPAINLSPNPKSPRRSTPGTKSPVVLSPRQEHSMEVLIATKRGKPGFLPPGELAEDIDDEDAFMDDRKKQVKPKDHDGENDFKDEKERLEKDKNRRTVNLDDLDKYRPSAFYKDDSDFGHPGYDIDATPWDSHYQIGPDTYLMAARGAAFNSRVRNYREELFGMGAPTVKQGFLGVRNRDITVRERRRYTDILRETTQGLEPKSHEQSTALLQKAPSATAIERIKADIEKVTPCATKKNDDGTFAPIFTARLRDVYLRKNQPAIFECAVSASPAPKVTWDFQGKILESNDRVTIEQDNNVARLILNHAAPYDLGEYVCTAINEYGTDKSSCRLISGETPSRPGRPEAELSSDTEIFIQWEAPEGPTYLEGITYRLEYRVAGPNDHGDPWITVSEKIDDESVIVKHLSPLGIYQFRVTAQNGFGLGLPSLSSRIVQTHGKGAPKLQIDVLKSEIRLNVVSMPQKSTNQLGGISEESEEDSEARTANEDMKSNLQLQTDDPTGRFQIGGLKFKGRFSVIRDAVDSTTEGHAHCAVKIRHPSSEAISEYESLRDGQHENVQRLIAAFNNSNFLYLLSERLYEDVFSRFVFNDYYTEEQVALTMRQVTSALHFLHFKGIAHLDVNPHNIMFQSKRSWVVKLVDFGRAQKVSGAVKPVDFDTKWASPEFHIPETPVTVQSDMWGMGVVTFCLLAGFHPFTSEYDREEEIKENVINVKCDPNLIPVNASQECLSFATWALKKSPVRRMRTDEALSHKFLSSDPSMVRRRESIKYSASRLRKLAAMIRQPTFSQPISEELESKYGK

SEQ ID NO: 5015 - protein, 362 aa, Caenorhabditis elegans
MAPTNKDGDVATVKAVDVLKQKAGAHHCLGNVHANLPVNKVTVHPLVLLSVVDHFNRVSKTQSVKRVVGVLLGSMKKDKTLDIGNSFAVPFDEDDKDKSTWFLDMDYLESMYGMFYKVAAKEKIVGWYHTGPKLHKNDIAINEQLKRFCPNPVLVIIDAEPKNIGLPTEAYIEVQEVHDDGTPPIKTFEHVPSDIGAEEAEEVGVEHLLRDIKDQTAGTLSQRITDQLMGLRGLQSQLESIEKYLHDIVRGTLPVNHHVIYYVQEVLNLLPDVTHPDYIVSQNVQTNDQLMCVYMGSLVRSVVALHNLIDNKISLQKAEKEQETGEAEKKKDEKDKKDKKDEKKDEKKEKDSKSSTPNTPKK

SEQ ID NO: 5016 - protein, 483 aa, Caenorhabditis elegans
MDPSVVSRLENVANRTENILLKYDSNKKETPVDATPQIINLYDDAICENLVSFYDLSAKIGGDLNRLGCMTRSLFFTHRYFLWIACGRKKADNDEFATLVNDLSKEIVAFSDFKEKNRKSEFYNHICGLEAAVGGENLPLIPNIYVKNSSLFYIFQLEIACFGWVAEPKTPAPFIKDAIDTSVFYLNRILMEHKGKNDFHSEWAKSIKELMLSLHEYVRQHHTTGLVWNSDPGATPMCNRKSGGAPTPPPPPPPPISLIAPSKPSGVGALLESLNTGLSATSRLKKVTPEMQTHKNPVLREVNGQMNRKTEERKVSENKKPEKIHESSIFWDGKIWKVDHQVGNKNAVVEVTDKKESIYIYKCNDSIIKIKGKANAITLDGCRKTSVVFDGLVAQCEIINCQSIQIQTLGELPTVSIQKTDGCHIYLSRDALNAQIVASKSSEMNISAMLEDGDDEYTEMALPEQFMTKIVGKKLVTVASEIV

SEQ ID NO: 5017 - protein, 372 aa, Caenorhabditis elegans
MAMVIPARNQMASQFLELPKRTSSLMKIEKTATLVRITKNCNFSTQKNKFQAPTMVLQGHGGEIYTSQFSSDGSFLASAGYDQQIFLWNVFGECENFAVLKGHKGAIMEVKFNADSSHLVSAGTDKTVRVWDMETGSCIRNFKSHTDIVNSVDVNRRGPQMICSASDDGTVMVHDMRSKEAAKKFICKYQQTAVTFNDAADNVICGGIDNQIKVWDMLRNDVRYVLSGHRDTITSLSVSHNGNFLLSNSMDCSLMSWDIRPFVPAQRLVARYQGASHNFEKNLLKCGWSPRDNYITAGSADRFVYVWNAKSRACVYKLPGHLGSVNCTALHPTQQIREFFFDIFKMVKTMKLLEKYGKIISSNAVCRFTQLV

SEQ ID NO: 5018 - protein, 518 aa, Caenorhabditis elegans
MSSKSGSTRKSQRARDFEESEETEKPSLTRRKSSRLSTQSVPIEKKKTPSSKTTKRVPVSERVFHEEVESSSEDELLPQTKMASEEKRKLLLSPGSSLADRVEKLEISSPRARGRPRKATNLKSQLTTPRTPEKQSRSRSGSQGTPEKKSRKESSSESDSEEIISTSSEGALKGRREEFDSLKLWIMKSKETNTSLSIYVSGQPGTGKTATTMRVLKSLGKSVRSCIVNCASTNTKSALFKTIFESLDLDGKPNEEIFEKHVKQFKTPLVLVLDEIDHLANRKNAALYAAFQWPETLSRKIIILGIANSIDLTERLLPKLMLAKPPKRLVFEPYTKDDIVEILNDKMKNEETSIDAKAIELTARKVAAMSGDLRTALHIFKQQKSRMIPDDSKVPGTPVNGCREVLGIINNVYSSPLARARLPLQPRILLAVSLTLSANKKCTFDRNSLLRAYYKACEALRMPALDDDELHSAFQTLESQSFVRQLNGGKLVLQVDAPTAKSAISDNAMLDQIGLLQF

SEQ ID NO: 5019 - protein, 4464 aa, Caenorhabditis elegans
MTDRGQAMMFVKQSNVIEAEKKIATQVSAFPLNGGSAWEQLHFLMSRLLNPYCKSFIGQSGRGERDGDKLAPTVQKCFTEAEAALLHLQQNIDIPEINLVVNQHILDAIEQAGKENRRAKIEDLGDLVEDANFLNALQSGCNRWVKEIRKVTQLERDPSSGTSLQEMTFWLNLERALLKISQKRDGEEVTLTLEALKCGKRFHATVGFDSDNGLKQKLAVVQDYNTLMKEFPLSELVSATDVPKLMHAVVGIFLHLRKLRSTKYPLQRALRLVEAISRDLNSQLLKVLSSYNLMRTPIAEFNEIMSQCQALFSKWDDEYDKFIALLRDINKKKRDDPSKLSWKVTAVHKRLETRLMQILQFRKQHEQFRTVIERVLRPVGNGSREREQLMIDSSEGEKSPDEQVDIAYEFLKNVDFLDVDSPAWENAFKRYEDQIGVVETAITTRLKSQLESSRNSNEMFSIFSRYNALFIRPRIRGAIYEYQTRLINRVKEDINELQARFTKARGEQGVKIMQTVGLPPFSAKIMWIRNYERQLQRYMKRVEDVLGKQWENHVDGRQLKADGDNFKVKLNTQPMFDEWVESVQSQNWTLPNKILTVDRVQVDGRMQLQLKINYHSDSSVLYKEVSHLKSMGFRVPLKIVNWAHQANQMRPSATSLIEAARTFASVNAALASVQGVDSLLASYKKDIQNQLIEGATLGWDSYKVDQYQLKLAETVNTYQERCEELLNVVRIVNADLNVLKSCRYDKETIENLLTSIQKGVDQLSLGNYSNLAQWVNTLDRQIETILARRVEDAIRVWTLVFSQSEEVEELRERQVVLPTVKNVVVDLCMTAQTLYISPSTRETREKILEQLYEWHSVCTAQMRISGKRFQMVMNEEIEPETYHNILNVMPEGQACLEKAYDCVNGIMSDLEEYLSEWLSYQSLWVLQAEQLFEMLGTSLSKWMKTLMEIRKGRLVFDTQDTRKVIFPVSVEYGKAQQKILFKYDYWHKEMLVKFGAVVGDEMQKFFNSVSKWRNVLETQSVDGGSTSDTIGLISFVQSLKKQTKSGQDAVDLYRSSQRLLNQQRYQFPAQWLYSENVEGEWSAFTEILSLRDASIQTQMMNLQTKFAQEDELVEKRTVETLTEWNKSKPVEGAQRPQEALNVITAFEAKLNKLTEERNKMRKARVALDLSDSAHAPSEGDKLTVATEELAAMKDVWKALQPVYTGIDEAKEKTWLSVQPRKIRQSLDELMNQLKQLPVKCRTYKSYEHVKQMLHTYGKMNMLVAELKSEALKERHWHQMMKEMRVNWNLSDLTLGQVWDADILRHEHTIKKILLVAQGEMALEEFLREMREYWQNYEVELVNYQNKTRLIKGWDDLFNKLKEHQNSLSAMKLSPYYKQFEESAQSWDEKLNKINAMFDVWIDVQRRWVYLEGLFSGSAEISTLLPFESSRFATITTDVLALMKKVAASPRILDVVNMQGAQRLLERLADMLAKIQKALGEYLERERSSFPRFYFVGDEDLLEIMGNSKDITRIQKHLKKMFAGITAIDINEEDRSITAFHSREGEKVDLVKIVSTKDVRINDWLQALEAEMKHTLARQLAASLTHFSKMNIQTMTTDDYVEWLDKFPAQVITLTAEIWWCDEMEKTLADGKGAENVEQAVVKTLELLADSVLKEQPPIRRKKMEALITELVHKRDTCRKLVSMKIRAANDFGWLQCMRFYFDPKQVDPVRCCVVKMANSQFFYGFEYLGIQERLVRTPLTDRCYLTMTQALHSRLGGSPFGPAGTGKTESVKALGHQLGRFVLVFNCDETFDFQAMGRILVGLCQVGAWGCFDEFNRLEERMLSAVSQQIQTIQEAVRAGGDMSVDLVGKRLNVNSNIGIFITMNPGYSGRSNLPDNLKQLFRSLAMTQPDRQLIAQVMLFSQGFRTAETLANKIVPLFILCKEQLSDQCHYDFGLRALKYVLVSAGNIKRDKLDKMGSAALEDVAEQQMLIQSVCETLVPKLVNEDIALLFSLLSDVFPGIHYTANQMRELRQQLSTVCDEHLLIYSDVQGEMGSMWLDKVLQLYQITNLNHGLMLVGSSGSGKTMAWKVLLKALERWENVEGVAHVIDAKAMSKDSLYGVMDPNTREWTDGLFTSVIRKIIDNVRGEADRRQWIIFDGDVDPEWVENLNSVLDDNKLLTLPNGERLSIPPNVRIIFEVADLKYATLATVSRCGMVWFSEEVVTSEMLFERYLSIIRRVPLDSDSAISFSSSSAPVNLIGEDAKPTRSIEIQRTAALALQTHFSPDGIVPGSLKYAVSELEHIMPPTPQRLLSSFFSMMSYSIRKIVSHDEGLIDDSVEIDQIQSFVLRSMLTNLVWAFSGDGKWKSREMMSDFIRQATTISLPPNQQACLIDYEVQLSGDWQPWLSKVPTMEIESHRVAAADLVVPTIDTVRHEMLLAAWLAEHKPLVLCGPPGSGKTMTLLAALRSQQEMEVVNVNFSSSTTPELLLRTFDHYCEYRRTPNGVVLAPVQLSQWLVIFCDEINLPAPDKYGTQRVISFLRQLVELNGFYRTSDHSWVSLERIQFVGACNPPTDPGRHPMTSRFLRHVPIVYVDYPGQTSLQQIYGTFNRAMLKMTPAVRGLADQLTNAMVDVYLASQEHFTQDDQPHYVYSPRELTRWVRGISEAITPLESLSAEQLVRLWAHEAIRLFQDRLVTEEEREWTDKLVDTTAERYFGNACRLDEALKRPLLYSCWLSRNYVPVTREELQDYVSARLKGFYEEELDVKLVLFDQMLDHVLRIDRIYRQSQGHLLLIGTAGAGKTTLSRFVAWLNGLSVFQLKVHSKYTAADFDEDMRTVLRRAGCRNEKLCFIMDESNMLDTGFLERLNTLLANGEVPGLFEGDEHTTLMTQIKEGAQRQGLILDSHDELYKWFTQQVMRNLHVVFTMNPSGSGLRERASTSPALFNRCVLNWFGDWSENALYQVGSELTRTMDLDRTDYEGSVRLTPSCELVPSQPTYRDAVVNTLCLVHKTVQKFNEMETKKGHRVMACTPRHFLDFIKQFMSLFHEKRSDLEEEKIHLNIGLNKISETEEQVKELQKSLKLKSNELQEKKEAANLKLKEMLGDQQKAEEEKKFSEQLQKELAEQLKQMAEKKTFVENDLAQVEPAVAEAQTAVQGIKKSQLVEVKSMSSPPVTVKLTLEAICILLGENVGTDWKAIRQVMMKDDFMTRILQFDTELLTPEILKQMEKYIQNPDWEFDKVNRASVACGPMVKWARAQLLYSTMLHKVEPLRNELKRLEQEAAKKTQEGKVVDVRITELEESIGKYKEEYAQLIGQAENIKQDLLSVQEKVNRSTELLSSLRSERDRWSSGSAGFSQQMDSLVGDALLSSAFLAYAGYYDQMLRDEIFHKWFNHVVNAGLHFRHDLARIEYLSTVDDRLQWQLNSLPVDDLCTENAIMLHRFNRYPLIIDPSGQAVEYIMKQFAGKNIQKTSFLDESFRKNLESALRFGNSLLVQDVEAYDPILNPVLNREVKRAGGRVLITIGDQDIDLSPSFQIFMITRDSTVEFSPDICSRVTFVNFTVTSSSLASQCLNQVLRSERPDVDKKRNDLLKLQGEFAVRLRHLEKALLAALNESKGKILDDNSVIETLEKLKNEAAEVAQKSAETDKVMAEVDAVSAQYQRLSTACSHIYHTLQQLNEIHFLYHYSLDFLVEIFTHVLKTPELSSTTDYAKRLRIITTSLFQTVFRRVSRGMLHTDKVLLALLLMRIHIRSNPSAPAYEQHFDLLLGRSDFVAKNDEADSTIPGGLDFLTVENKKSIAKARKVVGFENVFAHLQHNSAAVTSWLTNDNPESNVPVVWDDADGKLSPLCIAMNSLIVVHALRPDRLMASAHRVVSTAFDDHFMQQDKVVDILSIVDNEVSPSEPVLLCSATGYDASGKIEDLAVETNRQLTSIAIGSAEGFNQADSALGTATKSGRWVLLKNVHLAPSWLAQLEKRLHSMKPHAQFRLFLTAEIHPKLPSSILRASRVVVFEPATGLKANLLRSLSSIPPQRLTKAPTERSRLYLLVCWLHALVQERLRYTPLGWSTAYEFSDADLRVACDTLDAAVDAVAQGRPNVEPERLPWTTLRTLLSQCIYGGKIDNQFDQVLLDCVLENLFTAKSFEQDHVLIPKYDGDDSLFTPNMSKKDQMIGWVEELKNEQLPAWLGLPNNAEKVLLTKRGESMLRNMLKVTDEELAFNEDGKEEVKPQWMAQLGELAKQWLQLLPKEIVKMRRTVENIKDPLFRFFEREVNLGSQLLKDIRRDLNEISAVCRAEKKQNNETRALAASLQKGEVPTGWKRYTVPREVTVMDWMTDLNERLKQLIRIGGADNLKRETFWLGGTFSPEAYITATRQQVAQANTWSLEQLNLHIHIGRTDSTDVFRISGIDIRGAKSVGGNKLELCELVKSECDIVEFSWKQDVADGTRLPLYLYGDRRQLISPLAFHLSSATVFYQRGVALVANSTL

SEQ ID NO: 5020 - protein, 418 aa, Caenorhabditis elegans
DPILGVTEAFKKDTNPNKINLGVGAYRDDQGKPFVLRAVREAEQQIIDAKMDKEYSTITGVPEFAPLAAKLAFGDNSEVIRDGRVFTTQSISGTGALRIGGQFVEKFIPSKTLFYPTPTWANHLPVFRENRRTILFDFLIFRKAKNQNFHALVVFFPLNSGLSIQPYRYYNQETLGFDVEGALEDISKMPEGSVILLHACAHNPTGVDPTKEQWKKLSQVLKERKILPFFDMAYQGFASGDVDDDAFALRHFIEQGHNVLVAQSFAKNMGLYGERVGAFSIVCDSAEEAIRVGSQMRIIIRPMISMPPLHGARIASRILSNPELKKSWLEDVKLMADRIKSMRTALKDGLKAEGSTLNWDHITNQIGMFCFTGINEKQVQKLIKEHSVYLTNDGRISISGINTGNVAYLAKALHDVTK

SEQ ID NO: 5021 - protein, 86 aa, Caenorhabditis elegans
MTLSFDDAAATVKTLKTSPSNDELLKLYALFKQGTVGDNTTDKPGMFDLKGKAKWSAWDEKKGLAKDDAQKAYVALVEELIAKYGA

SEQ ID NO: 5022 - protein, 126 aa, Caenorhabditis elegans
MFRMPIVTMERVDSFSAAHRLHSEKLSDAENKETFGKCNNSNGHGHNYVWKVKLRGEVDPTSGMVYDLAKLKKEMSLVLDTTTVSTSENVAIYMFEKLKSVMSNPSVLYKVTIEETPKNIFTYKGC

SEQ ID NO: 5023 - protein, 305 aa, Caenorhabditis elegans
MTAPMDVDNLMSRLLNVGMSGGRLTTSVNEQELQTCCAVAKSVFASQASLLEVEPPIIVCGDIHGQYSDLLRIFDKNGFPPDVNFLFLGDYVDRGRQNIETICLMLCFKIKYPENFFMLRGNHECPAINRVYGFYEECNRRYKSTRLWSIFQDTFNWMPLCGLIGSRILCMHGGLSPHLQTLDQLRQLPRPQDPPNPSIGIDLLWADPDQWVKGWQANTRGVSYVFGQDVVADVCSRLDIDLVARAHQVVQDGYEFFASKKMVTIFSAPHYCGQFDNSAATMKVDENMVCTFVMYKPTPKSMRRG

SEQ ID NO: 5024 - protein, 429 aa, Caenorhabditis elegans
MFQNHNENVFQEVVEEKGGKIAWLTIRELGRGAFGTVYHVSNKSTKQEAALKIEKMTAGDNLLKFEREIMVAMQHEPTAIHIYDDGIYKDYRYIVMTLCGPDLQKIAELMNNNFNQDTIIRVCIRTLLAIKTMHEYTYIHRDLKPCNFAVDFNPNSLHVYLFDYGMARKYATKDSGNKWQLRRPRNPAQFRGTVRYCSLNMHKRKELSRVDDLWSWFFMLMEMYAPLPWTSSNIPERIEALKEDHLNEYLSKDSFLSSFLPLVEYLNSVQYADRPDYMKIYDILYAKLTEINGKLSGPMKYDVARINALVAELGETARPKELSRMDDESTIQKYLLASFGRAGVPGGNNLIMAELVDFFAKDVPLKKAREEKTDDNKKQKNAKVKNKMLGKPKQPGSGGANSGDAKTAQSKLGSKMSTHKKAKVSKRNK

SEQ ID NO: 5025 - protein, 1173 aa, Caenorhabditis elegans
MEQDELRDQLVDPKSPINIESLLDTITALVNDCKIPVLMRMKSVDNFISRYERVVESLAALRMKAADFRQLKVIGRGAFGEVHLVRHTRTNTVYAMKMLNKDDMIKRADSAFFWEERDIMAHANSEWIVRLQYAFQDPRHLYMVMEYMPGGDLVNLMTSYEVSEKWTRFYTAEIVEALAALHSMGYIHRDVKPDNMLISISGHIKLADFGTCVKMNANGVVRCSTAVGTPDYISPEVLRNQGQDAEFGKEVDWWSVGVFIYEMLVGETPFYAEALVSTYTNIMNHKTSLKFPDEPLISTQAKDIIKKFLSAAPDRLGRNSVDDIRNHKFFVNDEWTFATLREASPPVIPSLKSDDDTTHFEEIETRDRDNAGDFQLPKTFNGNQLPFIGFTYSNEYSPVKNLLKGHGAGSKQNGIEQHKPQTVVEQPLTNGHASGVPEEKYEAVKMELDSKNREFELLKDSIARNEIRAKMIENEKNSLSTKISDLERELKDNKDKLRHGADSDAKVNELAVELRMSKEYNSEMESELSKFRDKCEQLKEDLRKKSGELAQEKNETQRVFQQKKDADEAFAEIKRDYELLQTRENEKSVQLKKALDERKENGAYQQSVAKATDAEWERKMQFYEKQLEHANDERKREEQKRTAAEFDQSRVARKLAGIEANYELLQNDYKSMKEARKDLERDLQDVITEKRRLEIRVEQLMDSRNTDERVLSLCQDELVESQEEAKYKEDGLRGKIDGFKHELENEKMKTQTLEENLLVADKERGMLKMEVQELMQRHKWEITNKDQTLKHLETQLDEIKQQSKIESSEQESNDKQTIADLRKKLDLEKAHKKAVINKLEEEMAKRQPLKKGEKGVTKSALIKKEREIMALEQERDTMSKRIAALFYENDKQAEHFNIAIQDMQTTQDALRDELKECKEELANRNVNTRYEDKRSLDSREGIPSSLSNQHIQMEGWLSLRDNTKKSRKPKWTNCFVALNEYSFTIYVDEKAVSVILLIEAGAMAHVRHVTAADLRNVDDSQLPKIFHIMYDDASCNSSRHASNSDLSMIESFREESWKRHDFQELSYHIRTFCDVCNKKLSDIIRPTPAFECKNCHFKTHKDHVAQGSLPMCRYNTGLSRELVLMAPQTDNCNKWVSQLRRFIESSRSAAVSVSRVSSRRHAPGSSNSSTIYQ

SEQ ID NO: 5026 - protein, 401 aa, Caenorhabditis elegans
MTTINCSRSVPPDVTVNDSVLSIVFTYLALFILAFVGNVTMFLILCRNQLVKVRRVHSLLLHMNIAHLLVTLVVMPKEILHNYMVAWFAGDVMCRICKFFDVFAISLSMNVLICITLDRFYSIFFPLYAMRARKSVQRMVSFAWTISFVTSAPQLYLFKTATHPCFDWYTQCVSKNFIGELSNDVVFFFSIVNIIQVYIAPLFVTVVCYSLILWRISRKSKLVGEKESEKSSELLLRRNGQNNLEKAKSRTLKMTFVIVLAFIFCWTPYSILMFLHFLRHTDWIPKDIRKFIYAFAVLNSAISPYLYGYFSFDIRKELQLLFACSKATAADRHLSCSANVSRNQVTERMRKRSASACNFDGGKTNNTLSPRPPRGHSLRHKPSSSGIDKRNHNVQLEIIDF

SEQ ID NO: 5027 - protein, 465 aa, Caenorhabditis elegans
MGYVKQEKHPLEYEYLQPEHLKGFDSYKYNCVDNSPLSVYVSHPFWNWLVVVSFQILEIKNSYQKFYPRTWVPNVLTLVGWGFVMAGFFIEAYLDYSIDRNSDGSTNPIPDWFWFAAAACTFLGHTLDGTDGKQSRRIGASGPTGELSNFQNEQYPKNISKPIQIKKNICSSVKNHKKIPVDHGLDSWSTVPFTITIFSIFGRGRFSISSVELLCVLISTQIVFFTTHWEKYNTGIMFLSWAYDVSQFGLVIVYLWTYIVGYQWFHFDVLGGIVNFAFTFEIGFYMCCLMSLIASAYNVHKAEKLKQPTILAGIRPAWPVVILFGSSIYWAVHSPTNVIDADPRFFFFCMGTVFSNITCRLIIAQMASTVCDIYNLTLGIYLSTIAPEVGGRAGSAIHGWFIYKIFDMKHPLSFYNPSNELPILRVSTLVITALHLHYGICVVRQLCRHFKIYAFDVSYLQNRSK

SEQ ID NO: 5028 - protein, 434 aa, Caenorhabditis elegans
MTTPSSFSILLLLLLMPVVTNGEYSMQSEQEILNALLKNYDMRVRPPPANSSTEGAVNVRVNIMIRMLSKIDVVNMEYSIQLTFREQWIDPRLAYENLGFYNPPAFLTVPHVKKSLWIPDTFFPTEKAAHRHLIDMENMFLRIYPDGKILYSSRISLTSSCPMRLQLYPLDYQSCNFDLVSYAHTMNDIMYEWDPSTPVQLKPGVGSDLPNFILKNYTTNADCTSHTNTGSYGCLRMQLLFKRQFSYYLVQLYAPTTMIVIVSWVSFWIDLHSTAGRVALGVTTLLTMTTMQSAINAKLPPVSYVKVVDVWLGACQTFVFGALLEYAFVSYQDSVRQNDRSREKAARKAQRRREKLEMVDAEVYQPPCTCHTFEARETFRDKVRRYFTKPDYLPAKIDFYARFVVPLAFLAFNVIYWVSCLIMSANASTPESLV

SEQ ID NO: 5029 - protein, 534 aa, Caenorhabditis elegans
MRSFWLFLLLLLFCISFIKLTEGNEDAKRLYDDLMVNYNRHRRPSTSPNKPLTIKLKLRLSQIIDVHEIDQIMTCSVWLKQTWIDRKLSWDPVNYGGVNVLYVPYEMIWVPDIVLYNNADSNYNITISTKATLHYTGEVTWEPPAIFKSMCQIDVRWFPFDEQQCHLKFGSWTFSENLLSVELNEPSLRYEEEIDEKGIIDNVTVAEDGIDLSDYYPSVEWDIMSRVAKRRAKNYPSCCPQSAYIDVTKHEKLQSLNKKLQPNFARIEKYIYYLQLRRKPLFYTVNLVFPCVGISFLTILVFYLPSDSGEKVTLCISILVALTIFFLLLTEIIPATSITLPLIGKYLLFTMVMVTLSVVVTVISLNLHFRTPTTHLMPNWVKKVFLKWLPKLLFMRRPIDDYEEKFDDKKKPKDGKIALSVHAHRVSNVGNNIRNATIDDTIQKMYYSPPVVKAFENICFIAELLKKKDRDDKIDEDWKYVAMVLDRLFLLIFSIACFVGTVIILLRAPTLYDTRQPIDLQYRPANLSANPISF

SEQ ID NO: 5030 - protein, 440 aa, Caenorhabditis elegans
MSVTVEQEAYEMPADNKKVMLKIEEVHLHSCGVFSNVYKGILREPYEKKIAIKKSWPEKGERNFEFIFLTGRERAKHKNVIHMIFAFSHSYDTKVCESYVFDFMPNTLAEVIRQKLTDLDIRLYTWQIFSGLKYLEEHKVVHRDLKPVNILVDHDTAFLKISDFGSAKIIVKGKANNFYQVTRFYRPPELLMKAMEYNSTVDVWSAGCIMAEMVKRHVVFPGRDSAHQLKLYCRCFGAPNEQDISAMKGEKLEKEYWKFTKGFGLQRLVNDISPDQLQFIKRILVYAPEKRLRGKQLLQDDFFRPLFKAGAVRHNGQKISDVITAADYKRAAENEESSACRLAQLVKTDNKDLGIPYCEKSNSYENVYARRSTLIPKEQKMARDNKSKEDSSDDRRVAPSSGEAPSAPGKRSESNKTAAIAKKSTMKSVMNAPPPRQKPE

SEQ ID NO: 5031 - protein, 1310 aa, Caenorhabditis elegans
MGKFLNVFLTAEQVSSVERVRFYRFSQLIMRGGSSLDSFPGKGTLHTLEIENFKSYKGKHTIGPFTRFTAIIGPNGSGKSNLMDAISFVLGEKPSSLRVRKYADLIHGAPINKPVAKKCRVTMNYKYSDGKVKAFTRGVNNGTSEHLLDGQTVTSAAYSQEMESINIFIKARNFLVYQGAIENIAMKTPKERTQLFEELSRSHEFQAEYERLKVEMTKAEDDTQHNMNKRRGIAQEKREAKMEKDEAEKYQTMKNELAAKSTMLFLHQLFHCERTIDESKEEINAQKKTIASLEATRSKEEAKIAAVHQEHRKALREVQKMTRKLDQKETDLAEKQQNMLTLKVSVAHEHKKLEIAKKMLAAAESKAENNSTQLADLKKSKKELEKKKAAYEAEIQDMMQRGELNLSDEQVREYGQLKDQAQRESAMVQRELLMAEQVFEGDKSSLNHELRRQKEHQERVKAKEGDVRRIETQIATLAQRIKETEEETKILKADLKKIENDVVIDKSAAAEYNKELVAVVRQLSEASGDSAEGERNQRRTEALEGLKKNFPESVYGRLVDLCQPSHKRFNIATTKILQKHMNSIVCDTEETAAKAIVYLKDHRYPPETFLPNDALVVNPLNEKLREIKKPAGVKLVFDVINPQHQAARKALQFVCGNALVCESQEDAKQLAYGGGELKDRFKAVSMDGTLFQQSGVMSGGSADLRQKSKKWDEKVVKQLREKRNQLNEKIADLQKHRRRELEVESVRSKINGNEQRLAMMKRDLKNMREMQLERLQNELEGMTAEMNMLPPRISNCQEKLERSESTLKSLQTKSNEVADRIFADFCTRVGIASIRDYENREMRIKQEMEDKLRSFDDDIQKLAYEIDFVTEQDGNRKVEVEKEKVSQIDRQYKDMKKKEKTAAAALKEHTESMEQDKEVLEEKKALSHKLETEWNEVKKIAQVAMKDFTKAEKELLRLESLLTKKQYERHSLLHSVKLGQIALPLKSGSMADVEYEEDDGDIYFIIFVSLFPFKFQLISDDTASQSSQSATDGPSVSEEQIQREQHIKINYDSLPREYKDVDDDDGVRQMSNRLNVEIDELQKNVSKMNAPNLKANQRMAEVKEREAESTEELENARKKAKRIRQQFEKVKTDRYRRFQDFFDPVANTIDDIYKQLSRNTSAQAFLGADNMEEPYLDGIQYNCVAPGKRFRPMDNLSGGEKTIAALALLFAVHGRNPAPFFVLDEIDAALDNTNIGKVASYICESAREHMQIIVISLKEEFYNKADSLIGIFPYPAACTTSGVLTFDLTRFKQIGLNEMTENPPTPSIAT

SEQ ID NO: 5032 - protein, 488 aa, Caenorhabditis elegans
MTTNRPKIKVASVINRKYLAFRKLGEGGCGVIYEVAMVKCPGRRFACKAETTVFDEDPTLPMEHKIISKLNEKNSIHCVELIDKGQSDNYQFIVMTLLGPSLDAIRATLPTNKFSTFSTLVMGIQALDSIKEIHDIGFVHRDVKPANFAIGALGTPKQRLVHVLDFGISRQYLVKDGENGGLRIRKPRRIVPFRGTLRYCSVAAQERKEQGRHDDLWSLFYMIVEFVKGSLPWTGIMEEEKVIVMKEDVTELFNGLESECAMFAQHLSVLRYQTNPDYALLRDLLMNIFVRRNFNAQMKVDWEKGGRYESHFEKKTSTLPVVIEKDMTEVDLSKLLNVPQNERNITMEEIIAAGKTTEEEGLNTAQDDTIVEDENGFLGKQEAKPATPSARSETSKKVKRRYIARTPSAHKIEQIEKNWKKKEEEANKEKLLKNARAARRAKEDFIVPEDNTVQKRKLESTQLSSAVSTKSTRSIGKKILPPKSFELH

SEQ ID NO: 5033 - protein, 649 aa, Caenorhabditis elegans
MWFEESSWSNLRLTDLVEEWRDLWPSKIEFIVSAMAYLFAMTNFLNLPKLILENGGVAFAAAYAIVVGVLCMPTMVMEMSIGQVTGRAPVLAFYHLFPVFRAIANRKTFSGIGVSQILFTMVVLACMTKFLSTLCLFLYYYFWTFHAGRSGLPWLNCKAFPEFVSQPCREAGSITNITQINNRLNTIQAESSMMQFLTTLERPSESIADFKDFQYPILIAQGAIWIAIFVAICFGVRFVGKTVAFVLMLAFSSLLVFFLRSATLGGVTEILEIYWKATDWEKLADYQVWRLAIEQAILGTGIGYGAFITMSSYMKRSNNLFFKQKYLKYLEVLKLSNFKIIQFFSDSIFLSVWHLIISFVQTMSIICIVGYLSMKLGIHPTELLETGEDQMWYMLAYVSYLPKLWSGVLLTICICTMFSVITILALSVLSTFEDAFGENWSKCCRRFFLALFVCLFCFGLTVYFATNAGRHAYELATRSIKYCTIYFILTAELFATAWFYCAHKLGKDLHNMMRSRCCSCFGHFFLYFTYLLPILPAGVAFLNALDYKFSSFSAPIHEWKYSEYVGIAIAMVPLIPIPLYFFMTILCACCCKGKDHAKTCKRIRTVFAARLQNHHHRDEKAQPIPRYTSNAPGYLLLPQAPLAEPEIYA

SEQ ID NO: 5034 - protein, 384 aa, Caenorhabditis elegans
MGGYLSSPQILTRKMPGQFKVGCMDLMIEEAAGSGLFMRLFFPTDSEITGPSSLPVWIPRPEYAYGVGEYLGHSPHQMDLISSLVIGDKRVDCIDNAQLSTKSDKWPVLVFSHGLGGSRTFYSTYCTSLASHGYVVAAVEHRDSSACWTYKLVEKNGTLVEKPMKIKLVDRNDKDQFKIRNEQVGKRAEECAKAVKILEQLDSGNVKDKVIIGNNANLEFFKNKLLTTTASIIGHSFGGATSIASSSSDFQKAIVLDGWMYPLDQNQQEQAKQPIMFLNVGDWQWNENLEVMRKILPNNEGNILLTLSGAVHQSFTDFPFVFPNWLAKQFGVHGPTEPYLCMQSAIELTLSFLKDGKDGVQKLKDEKYTTFITNEIYGRVKLIV

SEQ ID NO: 5035 - protein, 161 aa, Caenorhabditis elegans
MAEDIEEILAEIDGSQIEEYQKFFDAFDRGKQGYIMATQIGQIMHGMEQDFDEKTLRKLIRKFDADGSGKLEFDEFCALVYTVANTVDKETLEKELREAFRLFDKEGNGYISRPTLKALLKEIADDLTDQQLEEAVDEIDEDGSGKIEFEEFWELMAGESD

SEQ ID NO: 5036 - protein, 2697 aa, Caenorhabditis elegans
MLQQHGISFQMNADRQNKAATTSNRIVSAPATNEFDERHRKQGIDAARALASQYRSRITENRDANQRQAARELSRYVRSELKDEPNTFSDAFLNAIDGRTDIASQSAIYNCMKSNSNIDQKRAGIYLIVCLAETHSGNVIRYANYLLKMLNNGNGLDEDTVKMASKALAFLIATCKSYAAELVDRCLDHCHEWLGQNVPHSQQPKNQQEIDQIRRLAASHLSRELALATPTAFFLRVNLFFKYIFNAVRDKNPAVRIAGIDALHVVLTIVSQREAKNKTEWFKKCFDEALEGQPNPSQKDDLDRWHAVALILNELLRISDQRFELIRCESSQFIKQKFLKEDEEEGVEWLVLTKQQTIVESVTARKLVLERFPKILDCVRQIIPLANKTSSTKQQSSIYLNTVLMQLLPRICAFPQCDRTFQTISFDTSFTILQRNAVAAPAIGMMMLSNPDVHATHIEKTISFISAAIKKTTNSDVLDNYFTFLFLFVDAYHEQVTTQIKAIIPQLMDITLSRSLANVLKMIMMRIPKLRLNVQDGVMASVYQTLTGSLIPPKSEPIGRPASPKAILQKAETDPKELQRIVLAVDVLGEFYFSRGALQRIMQYVADYYLTADNVEIRLAAVSSCCEMVVPFVGVYKKVTSDKRNSLLQTIYGVLRAVCSVIVNDQDVRVRMQVISCFGQMPRPFLAHLAQPEMLEVQFMALHDEKLEMQQACVTLLGRLAELNPALVLPRLRLMLLETLSQMQQSGQARLEQHSAKMIAQLAKQSPKFMRPYVGSLMIAMIPKLRNDQKYAEVTAQVLNAVSEIAVIGGAEIVKNLKPLFEKLTHMINDSSSLHKREAALRAIGGICRSTAYVVDPYRDYPSLLDDLLRILKTVMSNTMRREAIKTLGILGAIDPYTHKVFTGSVQSSTAISTALSLPISETDSKDPRQDIIHWFNYEKCTLEEFYPAITIANLMLMMQDEDSQSYAEIAQAIVTIFRSLGDMAPLYTEQVIPRLIEVCRRATESSNRANLREFFLQQLANFVAIIRKHAAPYMPAIFTIIADAWKEDISVKMVVIEVLTDMGTAIGNDFSKYTGELIPYLLTVLQTDKTKERVLTVKVMESIQKLTHCIVQHLHLVLPPLLIILDDFSLKLSIRNTALSTVLHMTQQVDVSAYAPRMMQSWHHNISTAEMRDKLLLLLIEIIKQLGKFFDIFKRGVDQKLRDYNLDKSVHYEQYRKLAQRAQMSRDVLTSSVFAGSNGNIQYSSTQAGMRGQANNVYANNDLHERLMNGSIDSGASRQDNRDDYYRYGVEEKKEVPKVAPTTARPTSELVTVQITKQRLNKDALMPQWKNENLTSKDEWLQWLMKIRIGFLTYGSSPSLRAASSLGDQHPHLARDLFPAAFMSVWTELDSDVQNDLTSCLLRAISTGIPELIQTILNLAEFMDHSEKGPLPISHDVLGRWAEQTKAFAKACRYKEMSVLKKSGSMQTTFTRKVKLEPNDCQSLITYANKLNVQEEAAGVVRYAERNEMNFQMRGRWYEKLNEWEKALGAYELEEKKKSSCPNLQVYDEKDHLMTPEEAATAEEARMHEMRCLEALGRWDELNSKSVVWADQRGNRNDSVRDEINKKQLDHKMAVIAARGAWAVDNWERMADYVSVISENTQDGAMLRAVVAVHNDENTKAMGLIEKVREMIDSELTAMANESYERAYIPMVSVQQMAELEEAIEYKTRPERRPRIALLWSRRLQGCRRNVEQWQRLIMLRGLVLSPQEMHPLRVKFSSMCRKQGKNSMSRAVLRELLSLPANSDLVRAKAPFDKPLLVLALAKQLYQDDHKDEAIRALEDLANHWNKRINPIPKATGRELIPPSTKEPARICAKVLLKLGEWTELKSKTSNNMQVGELSFVRQQVSPQYRTKESRTPETIAFENTINYYQQATQYDPGWHKVWHKLASTHFYAVCRERPHPTTVISPPQQPQQPKKMHIPPVTRATSPPPPAQKSPQPAPFHSITEPLSVIIDYPVPPPLGSLVGLPPMPAYLSSNSSLPPQHHHVSPLSNDSPSNSAENKLYLKHAAHAVRCFAKALMCSPGSRLEDTLRLMQLWFDHGDDKDQDVYFALTETIFDLPVTTWLEAIPQLMARLDCPDDQKSVQLVLRVLCEIARHRPQAVIYALTVASRSKDVHRSKNAGTVLEKMMEYHSKLVREASLVTEELVRCAILWHEQWHDALDDASRVYFHRRLQDNNVQAMFDALRNMNDLMQKGAPTTMKEHSFQQTYSSDLKEAGRYVQAFESSGNVKDLNQAWEIYCSVFKKLRDQLATLNSLDLVYVSPNLVSAKDLELVVPGTYDPSAPIVSIQSFSSKMNVITSKQRPRKMVIRGSNGLDYQFLLKGHEDPRQDERVMQLFGLVNTLLANNSETCRRNLTIQRYSIVALSKDSGLIGWVPNCDTLHTLVKEYREKKAKIPLSIEHKTLQKLSLETEHLTLMQKLQLFESALSVTQGEDLRHVLWLKSPSSEVWFDRRTNYTRSVACMSMVGYILGLGDRHPSNLMLDRLTGKVVHIDFGDCFEVAMLREKFPERVPFRLTRMLINAMEVTGLDGVYNYTAERVLKMLRTNQESLLAVLEAFVYDPVINWRLVEGMKKDPKTRKDTGGRQNMAGAVLPSSSTTDSIMETIKRKLDGTEFVHTDGSTPPEPLQVTEQLAMLTEQATSPLNLCQSYIGWCPFW

SEQ ID NO: 5037 - protein, 323 aa, Caenorhabditis elegans
MEGLNVLVTGSTCGLGLHTAKILFKKGANVILTCRDEIRGRHAVESLLSGVSQEQSQKEAERIHLFTLDVTNYNSICNFTDEISRMFKYLHVIINNAGIMGMPFELSVDGIEMHFATNVFGHYVVVERLLPLLLKTDRPDFKSRVIVVSSGLYRNAEAIPQVSKLLGQKTYDYSPKQAYAFSKLANCLYTGALSKMLEPHNVGVYCVRPGFVNGTELGRETHWILRALAAPIIWFIAKTLEQGCETIVYLAETSGNQLKNGSMYYERKEEAYNEMVEVTSIRQVWAILRHLEDTVWKRNTQMTDEQRNHGEMVRELLNESLIV

SEQ ID NO: 5038 - protein, 974 aa, Caenorhabditis elegans
MTNRLAFTAKNSKAIIQKMHRLALSAKRKVLLNPKTVSIYFFAILFTFLLAYHQRLGQHNNELHISRVVNMRSFVKEANNLSNSQKNPNIFEPKNEVCQRPLTESSTNFNTFDLFESVVAKGNTLPPASKKSRTEKLKVYVLPFTHVDPGIKPQTMWSNDPFGYSNSVPYLFKKSGVHRTVINRIHHKLKQTLQSQKAIPFKWRQYFDATGEDDVLTQILPYTHYDILNSCGSDASVCCEFDFKRMTHWSCPGPKPEKITNANVAAKAEKLVNQLEKMSEMYKAPVILMMHGDDFRFDMIEEWNQQHDNFIPVFDEINKGSRVEIRLPLRLEVFRFGTFTDYFNDLEKWYSNNKDSEPPTVSGDFFPYMCALGDYWTGYYTTRPFFKRQGRLLHSLIRNGDIMLSMLRVNLKQRKIGENVKRLEAARRNLALFQHHDAITGTSKVSVMDNYSELLHASIVSTNIVLENLTKSDIDLYPRIHDGIELQTIVDLESSEKEIRIFNSHLFEITDVFKIRVKEREVIVSIDGKIIEAQLEPFFQKSKVEKDSFLLLFQATVLPLSMMKVKVQRGDSGGLTKMAKIEAKDTNAWDLGSSWTIASSTSAPNLETPYFKVSNDPITGAIQSVNKLSDNSKFHCQQSFYNYKEAGGGAYLMRLHTNPKEIIEYQWLKVSGPLRQSIYQKSTNVLQRLSIHNVEGPSGEEVDISMSIDITKERNTELMTRFSTKWDKPLTYTDSVGMQLLRRDFYKLPVQSNYYPMPTAAVLQSGKQRLSIVSNVEHGARFLESGTVEINIDRILNQDDGKGLGTGPDAIPIDMKPVDMKFKLIFDSLESDPTENSRYSTHSFRAQQAVQTIIYPPMMFNRPPKKEEDIEEIEEISNLKFPCDIQLLTVRPLEDNKQLLILYRHATVCSSQKVGNCGGELKSSLMDLLIKLGAKQVQKTDLSGVTRVGGIIKVEYLPDYELKTFDFLTLILYR

SEQ ID NO: 5039 - protein, 343 aa, Caenorhabditis elegans
MLGILYWILNLTVVESVFYLVVAFLLFLIGRHFIEKLQINNLSKRAVFITGCDSGFGRGLALKCLEQGMPVFAGCLTEQGIESLSAEARKSIGNGRSLDAFLMDVTSDESVGEVAKRLEKKCEQYGGLHAVVNNAGITGKHIADDFLDINEYLKVANINLWGPIRTTMAVKKLLKKARGRVVTVASICARVGLPGLGPYSVSKYGVSAYCDVIRQELRPFGISVHVLEPGFFNTPLINREKIDAEILEAWKHAPNEVKQEYGEKFFNDARESTHLFLNSVASSQISLVVDAYFHAITSKHPRSRYQIGWDSILLFIPFSYLPTGLQDYIFAAAGLFLPKPACR

SEQ ID NO: 5040 - protein, 277 aa, Caenorhabditis elegans
MLSTERSGIAAHLSVCQNQYKIGMIAEMIHTASLVHDDVIDEANTRRGSASVNAVWGNKMSVLVGDFILARATQILCSIGKPNIISVMASIIEDLVLGEFMQMSTTPTDATPVDRMKAYIEKTHRKTASLFASSCRSAAILADGSDLKLHEIAFEYGRNLGIAFQLADDLLDFIATADEMGKPVAADLKLGLATAPVLYACEQYPELNTMLLRKFKHDGDAEKAREIVVNSDGMDKTRRLIDSYSQKAVEMASSLPNRNESTEHLIKLAMSQSDRKF

SEQ ID NO: 5041 - protein, 207 aa, Caenorhabditis elegans
MAQLMKRGFSTSAALAKAQLVKTPIQVHGVEGRYAAALYSAGHKQNKLDQISTDLNNVRSVYKDNKKFQEFVLDPTLKANKKKTAIEAISTKLGLTKETGNFLGLLAENGRLNKLESVVSSFESIMRAHRGELFVQVTSAEELSSSNQKALSDALSKIGKSGQKLTVTYAVKPSILGGLVVTIGDKYVDLSIASRVKKYKDALATAI

SEQ ID NO: 5042 - protein, 1019 aa, Caenorhabditis elegans
MEIKSKFPAWKKKKRKFQIDKDGKKIKPNPGAQISKILQNGKVNGNSRQTGGQEQKFQNLEALKKKTMLLKKKKKQMNNFQKEEELLSSTFRITNGILKKEKKIEVTTISTQTPKKLPKTPISTPSNSKNATPMSTRKHSSSQQSPPHFEANYEKFSRPQLPIDAVEQQLMYELASQETLIVIGETGSGKSTQVPQLCVRAGIANSGSIAVTQPRRVAAISLASRVATEMGTNIGGIVGYHVRFENATCHKTKIEYMTDGIVLRKALVSPLLDKYSCVIIDEAHERSLHSDVLMCILRQCQDQRRETNNPLRLIIMSATLQVIIIRRKIAHFSTKYLKSLHSEQKFRFCKIYYLKIEKKTLFVTYFQLFSLSYFFDKSIIFNLKCPPIFCLSIHQFTLKNTDNPKKISATFLIRKTKIIHFSWYIREINFFQAEKFQSYFNNAKVVLVAGRTFPIEVFHVNPKINKSFSSTDYVYNAVICVKYVHLTEPKGRDILVFLTGSEEIEAVASQLAELNGSLPASADVLMPVPLYAALRPEKQKEAFRKTPQVWFRVKGKIGKSKIRKKDEKSKIFVARFFSRRCRHPCSGLSQKILLKFTFLSGARKVIISTNIAETSVTIPGIRVVIDSGKVKTKRFEAFNRIDVLKVHNVSKAQAKQRAGRAGRDAPGKCYRLYSREDFHKFEAENMPEILRCNLSATFLELMKLGMKNPHRLKLIDPPETDNINAALLELTSLGAIRPVNSDRSKFALTEMGDAFCMYPLPPDHARILFQAQKEGCIMEAIKIVAAMQTDALFSGAGDSKSDADVDRIRRRFETREGDHITLLKLVLVTNQFFDQLNKKTESDARYGKANKSLEREYNQTIRKFCNDNMINEQHLKTASMIEEQLKQIAIEQKVTFSTCGADFMKMRKALALGMFLNSCEYDRQEDRYRLMINPAITLKIHPSSCLSRSKPAYIVFSELMKTNDLFALQVTLIDGDWVRPLISDHKKMRANHLAETTERVQQITRLEPKAKKAKLNVTF

SEQ ID NO: 5043 - protein, 587 aa, Caenorhabditis elegans
MNVARRRSGLFRSTIGATPKITRGRAAAPSTKEANSTTIPRQSAPGGITIGAAARRPPSRLPTPTTPATGRASLPERSAMAKPASCSRPIPTMQSTASRISTLTAASTFRQLRTGRPPPPSTQRSTATSSLKPSVTRARPVAQKPILPSKMALLEEKIAQLESAMAEATDFAEHQKSKIQILDGKLEGADRKLISLQDQLSTLKEVNKAKVEECEDYRVHNNDLRDLLNEKEAELRKLHNDVVDLRGQIRVAVRVRPLIKSEADASSSAIEYPAIDTIRINEGSKPGIVVKFEKVFTPVFSQKEVFANVEEFIRSSLHGYNVGLIAYGQTGSGKTHTMRGGNGEEEGIIPRAAAFLFAESRKLESLGWKFDFSLSFLEVYNNVAYDLLSDRAVVQLRLNDQTVSMIGLSEHTISNVSDVARLLRVADGGRKTAATKCNESSSRSHAVYMWKITAHQPSTGISTSCQLKLVDLAGSERAKESGVSGDQFKEMTNINQSLSILQMCISQQRSQKGHVSYRDSKLTQVLMDCLGRGNSKTMVVVNLNPCNEQATESKRSIEFASKMRSTNIGSAVQQRTLLGDVSQMSMN

SEQ ID NO: 5044 - protein, 126 aa, Caenorhabditis elegans
MASQTQGIQQLLAAEKRAAEKINEARKRKLQRTKQAKQEAQAEVEKYKQQREAEFKAFEQQYLGTKEDIESKIRRDTEDQISGMKQSVAGNKQAVIVRLLQLVCDIKPELHHNLTLQKKLHGQFAA

SEQ ID NO: 5045 - protein, 253 aa, Caenorhabditis elegans
MLSNHFSEMQSVQHVLVAEGSARSIVSDCGKHGKCVNGQCILNRCQGVSCDEGSMCRDGKCEKVLETFCIGHADCGPNMLCQQNKCQLKPQEPLCNCQPHEICHHGQCYPNTQCTSIYCEPGTYCVEGQCLSAVGKTCQDDTCHGGTVCVNSVCVMNPCPGRCPHDQDCRLGECRIMEGIPCIGECKHPFVCIDGRCRRNDCARKVCQLGESCEGGNCARVAGRFCTLAIRDCGEQFTCQENKCVDQMTALKG

SEQ ID NO: 5046 - protein, 746 aa, Caenorhabditis elegans
MTNISIPGNWQTCDVEAMDGDFDDNMLQFLGSFEEVLPEGVEVETKKGMKKKNKPKKVENTERPEEDAKCVEERRLAKKLRRKEQMAANRKQKKERLAKRKQKEAESSAKKSENATETTTEKPKEQKKRKGGENGDTGKPKKSKKEASKKTDISAWKQFYFLPNEVLEAIEQMGFSEPTEIQSAVLPAAVRDRQDVLGAAETGSGKTLAFGIPLVARLLESSDDSQETESTEVRGPRALIVAPTRELVIQIMKHINALISTTQLIATSIVGGLAQVKQERIISQQRPDIVVATPGRLWAMMQEAETGEFLAEWKDLKCLVVDETDRMVEEGYFAELTHILNKIHEESEKEKLQTLVFSATLTFAKAQDVAEEEKKKAKELSSQQKIQRLIKLTGLRENKHKVIDLTRQMGTAGCLVEARINCGNLLEKDTSLVYLLTRYPGRTIVFVNSIDAARRLYSVLKSVNIDPMILHAKMIQKQRLKNLEKFSESKNAVLLATDVAARGLDIQGIDHVIHYQVPKKVEIYIHRSGRTARASHRGLTVVLVDPPSRQFYMKLCKGLNRMQDLNVFPIDFEPLMNAIKKRVRLASEIDSLGFRCKKIKMSESWFEKAARAADLDYDETRHREMDGLNLEVDTMVQKSRQLQAQLRTELSLPLPRVDGSDSMKTKYITPEIVARLRSVGDNAIDVLNQKIDETKEWKRKSRKATREDEMNSMKKSLKSSQKNKERLAEKKKKEKAAKVTKLSETD

SEQ ID NO: 5047 - protein, 925 aa, Caenorhabditis elegans
MDTNFKLSNCIGTVYRDGQVAFSKDGYSVISPIGNKLSIFDLRNNTSKTLDIDCNYNIKRLSISPSGYHLLASDERGVVHFVHLLSEFKIYTFRSNKPIGSLQWSPDATRVAICRENDLQIHEFGKSIENKVYNPFSLSRTYKLSSDSLKTIDWSDDANLLVSGGEDRVVRVVGAKDFKNLFIHPLASHKGYIVNCQFMKNSYDMITVCKRGLANVWTCNLRPGELVEGIWKKDEEGSDDIEMLEDGEQKVEKIFFEKTKKYWLSESSGSGKSVDVTAARFHKETNILATAFNNGVIVLHEIPSFALVHNLRVSEMRIQTVAWNLTGDWLAIGCGKGSTAQLVVWEWQSESYVMKQQAHSLRITTAEYSPDGSLMATGAEDGKVKIWNSRSSFCTVTFDEHTSGVTAVKWTQSGRAILSASLDGTVRAHDLKRYRNFRTLVCPEPTQLATLAVDKAGDLVIAGAKEVFNIYIWSFETGHLLDILSGHESAISSIDIHGNHIVSGSWDRTIKMWTIVDSQAETVEVSHEALDVKFSPAGDEIAVLTSDGVITFFEAKEMINLGSIDTKLDTDPARGSRDTITRQSAAKTKTFTRIRFSPDGNLLLAGGESNNFCLYSVPERMILKKWQITANRSLDGVILDFNRRNFTEFGNMQLVDTSDEEDELEPNNKMSIKLPGTKNFDLGERRARPEVNIYEVTYCPTGRRFAICSTEGVSVYSLDTISMFDPFQLDSQTNAEVIKRAVWNNDYSTAIMASLRLNNAQYITECLESTSISQNSQIKINGKLEKQFSVPLVASSLPLMYAERLLKWMVEGNVMSSTRHVHFYMIWLRAILQHHGMQLKGRADVATLTGIQQIVAHHQQHITKLANQNKFALNWLVKIRQSKKSVKKEEEEEEDVSDESDDEDIEDESAGSDDEDSDDSVEIIE

SEQ ID NO: 5048 - protein, 185 aa, Caenorhabditis elegans
MTLPRFDQIRPKIEQHIREVKDFPKKGINFRDIMPLFTNPQLVNELCVVIADHVRHTVGHVDSVAGLEARGFLFGPQVAIQLGVPFVPIRKKGKLPGATIEASYVKEYGEDRVEIQEGAIKNGDIVFLIDDLLATGGTLRAATDLVVKAGGKVGEAFVLIELAPLNGRSKLPDVNLTTLISYDSA

SEQ ID NO: 5049 - protein, 1173 aa, Caenorhabditis elegans
MSNGSLWIESVSSAEEGTYQCAVHVTTKSDQTSDTWTFLSRKATLRLADLAKFELQAIDRTLAKGQPTAFHCLINSKPTPTAVWLHNDEPIVNGGEYHILPVSNTLEISSTQSRHEGTYRCTVEGAGKRRSSQTARLTVTTGNTNFYIRDVRAAIEDVRFCYLLIEISNSCGKKAKSQFAKKNFSAIPCLIILKVTKLQRDFFSETVSNELVFITTPRLQVVEQGDEFLLECLVASLIRPQVRWLKDSRQIIVDGVRIRRVGVSSILVSRASIEDTGLYTCRASNNDDSIDRAVSVEVRAPPRITTRPTTKVAVETADVELECGTAAARPEARVNWYKNGEAIIGSEYFVIEPNRLRILGVVRADQAIYQCIAENDVGSEQASAQLLVDAPDSSSVAASSGVPMTSSAPLGLRSTSSGSRFINVEWDPPVQRNGNIMRYHIFYKDNLIDRERMINSSSTSATLTSLQPSTMYLIRVTAENEAGMGKFSDSLKVTTNKEQAVPGKVASLTTTATGPETIDIRWSPPSGGQPALRYKIFYSHDPLEKNEKETLITTSTTHYTLHGMDKYTGYQIRIEAEGSNGSGLSSDTVKVRTQSDEPSAPPVNIQAEADSSTSVRVSWDEPEEESVNGEITGYRLKYKTKARGAKGNTLVIDATAREYTMGNLEPNTQYLIRMAVVNHNGTGPFSDWVSIDTPGQDKEERTLGAPREIRPHAGIDYILVSWLPPADEQNLVRGYQIGWGLSVPDTETIRVTASTTQYKIARLHSERDYVISLRAFNNLGSGFPIYETVRTLSRETPSHFNEDSDSDDSDVGSSESTPVGVRAEAISATSIRVMWTESDETAFNTQYTVRYSTAVDGNQHRYVNSTETWATVEGLRPATEYEFAVRAVASNGQLSTWSMATRNRTLAAPPSSAPRDLTVLPAESGDPHSSSLHWQPPKYSNGEIEEYLVFYTDRASLADKDWTINYVAGDKLSHQVSNLLPKANYFFKIQARNEKGHGPFSSVVGYTPSGGAILSGKDRHNARGHGSAASGDTVSLVDQLQSLLHSNPLYLILLAAFALILILTLILIIMCCWKRSSGGGRKNGYQSGKKTSAGAGSGGGIGGLGGPPNDLWINGTGSHMRAGASDYMVDGLATAHLTAADIESPTPRYHHLQGIFKFDLIFLPIFIKLSLFL

SEQ ID NO: 5050 - protein, 430 aa, Caenorhabditis elegans
MSQTPPPKDGKNPEAMEVEDAIDEEILKMSTEDLKSRTHLLDNEIRIMRSEVQRINHSATTLKERIKENTERIKVNKTLPYLVSNVVELLDLEDNTEEEGANVDLDAQKTKCAVIKTSTRATYFLPVVGLVDPDELKPGDLVGVNKDSYLILEKLPAEYDSRVKAMEVDERPTEQYSDIGGCDKQIQELIEAVVLPMTHKDRFVNLGIHPPKGVLMYGPPGTGKTMMARAVAAQTKSTFLKLAGPQLVQMFIGDGAKLVRDAFALAKEKAPAIIFIDELDAIGTKRFDSEKAGDREVQRTMLELLNQLDGFQPNDDIKVIAATNRIDVLDPALLRSGRLDRKIELPHPNEDARARIMQIHSRKMNVNKDVNFEELARCTDDFNGAQCKAVCVEAGMIALRRDATEILHEDFMDAILEVQAKKKASLNYYA

SEQ ID NO: 5051 - protein, 720 aa, Caenorhabditis elegans
MDKSPTKTSIRTKFARHQPISDVDTTEQSSSCIKKDDRGLSSFGVQSSVFSRRSCRMSELEAKPTIISEDQRIAVRSEIGGSFSGFDDKVDNVFHSNNNLHGSPSTTELECPGIMNPRFLVGRSLNSRSRAVTRGSKRTSNVKENEGSIHRSDDQVSTENCSAKDEERDRDSGGVSSYGNKRSDEFCGTSPILEAKGFGISNTCFNCKKYGHRATECSAPQRECANCGDPNHRANECASWSKNGVQEPTKVTYVPVVDKMEEVFSMLKINAGDFFDKFFDASVQLVSRGQPVTIQPCKSFSDSDIPQSMRRNVERAGYTRTTPIQQYTLPLVADGKDILACAQTGSGKTAAFLLPIMSRLILEKDLNYGAEGGCYPRCIILTPTRELADQIYNEGRKFSYQSVMEIKPVYGGINVGYNKSQIMKGCTIIVGTIGRVKHFCEDGAIKLDKCRYLVLDEADRMIDSMGFGPEIEQIINYKNMPKNDKRQTMMFSATFPSSVQEAARKLLREDYTMITIDKIGAANKCVIQEFELCDRTSKVDKLLKLLGIDIDTYTTEKNSDVFVKKTIVFVAQQKMADTLASIMSAAQVPAITIHGAREQKERSAALKLFRSGAKPVLIATAVVERGLDIKGVDHVINYDMPNNIDDYIHRIGRTGRVGNSGRATSFISLADDVQILPQLVRTLADAEQVVPSWMKEAAGGTSNPNKFEKSIDTEEPEEAW

SEQ ID NO: 5052 - protein, 1418 aa, Caenorhabditis elegans
MSSNQYKRIKRCKSMPTIDDETVGEAVRKTIMKKVATRMNTSKREYMGRRSLGVATVSTKIKRKKSKTERDRDMYDDMYDDEGYAASPTSSSSCTYRCIPILERSNRNSQNYLPSAESSSSDSNDRVISHPNHRPILLYSTALSMAPQQNLSVESLSDALDELEGADRSKLHMEITQFLKKADGEKSKQIQMSQRLMNCPQFGQTMRLIVEESEHTRYTFENILWLILKSYFSTTSTGRDVMIGKSEWIAEDEKIVKARKQYMMVMDMIKEFKFEVGKNDKDDSPFESLNRRMEFSPDYCENLRDARKRVSDVLDKYETLVDLFPNQNALWKVVELDRGEAEKKLLEGRMTSMRVWLNTLDDLTDKFKALGVLFEIETMPDAEECWFRPLDENNKIFALEDVRAVFLEYVKNSLNLKGMKKVLSRVEKIIELTLVKTAILMQKPPTSYAAATASNGPSFPFSQTMKDRYGDMIEWRFCNSTSISLNLPPLNNLFFFLVAVPMQLVVHWLEIRAATEPPDSCLLDELTFDAMITDSRDCVEEAVRIKKNYLTILQSMCSKCAMPGFLYPLKYNTYVLDVFKKYIHYVKCWSNCDSVRKDPPLLFSRLEMEWSSAVQCAKSVKSALELLCTTYCDIVESLIREVVEVYADDQIEDIKNRYVYNTDSENEDEEDDEDMITIGSPKKPLVELKAKHRFMLELNSLTREVKERELRIFSLLRITLNDSHDAVGYELRSGVDRAQMFHEMVPDFCLIQLTMASDEQGDVNDDDDHVNLKIVLFVYRTSVDKAYVETCMLAISEGRKIDDGCIVIVPDKDHKLRKHWKGRVVKIVIDEETRICYRWLRDDIILCLANGSIRADMEHKYKNFLKCISPACSSNFLITSRIQQLTEESLLPHLDEERKRIGILLEKTEIRLEPKEEQSKEKSALSSLGFKLEKHFLVAFQIHRDVAKVVSDSFMDGLGNEMVEKALALTRQWMQYVEVKSTIPSPTLPMWASPGFTFLQYITEPRWSNPEIMTNDQFQEFNDLVKLFEAKVIKSSSNIGTPGNTGTPMQRNTRSTSSKTSSSSMENHKRTRKENQMLKLQELEDKRNRIDYDNLQIGKVITDDNRRNFVLATDKKITTKAPFQWALLDHIASGSFGSVHRAMDIDSHRVIAAKVMRIQRENHKAIESEINIFRQLIHENLVKYYGVQVEDSDVIIFMEYCSQGTLERICHGKMDLKMVRQYTNSLLRAVQYLHSHKIIHRDIKPANIFLDKCTVLKLGDFGCSSRLVESSTVYGEFQTTAGTPQFMAPEIYSYGEKDETTGSYSGYGRSVDIWALGATVVNMMTGKVPFEGQTRHQIAFALCFRKQKPTYPDIADKRPDVKRFFDNCFEFLPNDRPTAAELLQTTFANVNITDENHIPDYQSQSSKDKSSPSSFFLV

SEQ ID NO: 5053 - protein, 936 aa, Caenorhabditis elegans
MHLWEKYQISRQISGFVHERICLVSEEFNGGVQSGGLIKNESELTQMTIKQETEGNINEARREEEDEEQDEDSRTSMPPALGEDDDYEEDDADSFIDKTNTPPPSQSFLEGCRAANLPNDIVTGAWETYNHAVQRVSLEGSESAWQLSAIYYYLLSKGIKRRGKTIRILIQPFPVSILTIANSFDISVAEMLDKTARFVEIIHSRKIRRYQEYIRRIQEGLAVSCVIFKKFCRIFCKIFEEIKVGSENCPSSHELFTVLWTSFLVMKSRMTVDDLISNYQLLFSILDQVYTEMCSMKEGIVHHLNQKFVEDLLENDCTIIRALCTQFGGSVLDARHFSDHTFKKMEKTGIPSTWNFQEFRDLIMNVPKTAYENYLLQRGSIDERIFIPSVEDFSKIFQSPDTYSVADILKVSYSGRRFRDAEFLTKISNNHCLEKLALGGKVASEKLVTQSKEQPRVPCVEYNLELGNYPDDLESNNQSLYNRLTKIIGSWKLENSKLEEVCGTMSDSPMATILLKSDEMTNKFERTLSAELGETINENIPKYHYNVRKELELVFLIFMEKIIVAELKKKVREEDLLNVIRREEFLDSVFCFCVELILVSNGYDRPFPWSAELCGVHPFMFHKVIDLMITHEKQLSRQMVQHFSRIEETVIEYFSWKSDSPLWPMVVRCPFAHFQEFGEDWADKLNSYSPIKFTPIKKPDDLRDELGRPIVPQNQTSRTLRIFLKRTYFTAARRLQDLTDRVSMGARAKSQCWSLFDYLLRNDTLIFMDRHLDQILLCCVFVIMKINESSMLFTEIMAQYRRQSANSLLVYRSVTVFQEQLNPENPQAVNTKETILERLEGPQKEKTTVDIIKYYNIEFRDRIKYIIGQIDSASDEDLMEMPVATESGLMPVRVYLTHKLSIQTLPKTKHGESKQERAIANLEKSGITIAMERSGD

SEQ ID NO: 5054 - protein, 347 aa, Caenorhabditis elegans
MEDRNITEEDRVCPQLPEFDEKANEQTDLKKMKPGDAIGKNWKVVKAIQSDKGFNTIYVAEHVQKKKLAAVKVERKTEAIKMLQFELFVLLTVEKKNQCKQFCKLFEKGNEKEYNWIAITLCGKSLRALRKNQPKGKLTVACGLSVAQQCLKGLEELHRMGFIHRNVAPSVFAIGRYTGDNQSDMRNIYILDFGFAHQYMNKDGTLKPPSAHPWKYVGSLRHMPRAAFSKVEFSRMEDLEMWFYMSVELVKGCLPWAHLKKPKEVHDYQKLCRNGLQMREMLGGLPPEFFDIMQMVDKLSFTDTPNYKEIYGLLTNAILFSGKNEFPYDWEEAEINEFKNPPKPSGE

SEQ ID NO: 5055 - protein, 399 aa, Caenorhabditis elegans
MAGKKAEKDDMATVEFESSEEVNVIPTFDKMGLREDLLRGIYAYGFEKPSAIQQRAVPAILKARDVIAQAQSGTGKTATFSISVLQSLDTQVRETQALILSPTRELAVQIQKVVLALGDYMNVQCHACIGGTNLGEDIRKLDYGQHVVSGTPGRVFDMIRRRNLRTRAIKLLVLDEADEMLNKGFKEQLYDIYRYLPPGAQVVLLSATLPHEILEMTSKFMTDPIRILVKRDELTLEGIKQFFVAVDREEWKFDTLIDLYDTLTITQAVLFCNTRRKVDWLTDKMKEANFTVSSMHGDMEQKDRDEVMKEFRAGTTRVLISTDVWARGLDVPQVSLVINYDLPNNRELYIHRIGRSGRFGRKGVAINFVKQDDVRILRDIEQYYSTQIDEMPMNIADII

SEQ ID NO: 5056 - protein, 329 aa, Caenorhabditis elegans
MYSIKNWAIELLINSIYKFIVISDMENKPPVINLPEKETVNTPQKGGKFTINDFEIGRPLGKGKFGSVYLARTKTGHFHVAIKVLFKSQLISGGVEHQLEREIEIQSHLNHPNIIKLYTYFWDAKKIYLVLEYAPGGEMYKQLTVSKRFSEPTAAKYMYEIADALSYCHRKNVIHRDIKPENLLIGSQGELKIGDFGWSVHAPSNKRQTMCGTMDYLPPEMVNGADHSDAVDLWAIGVLCYEFLVGKPPFEHEDQSKTYAAIKAARFTYPDSVKKGARDLIGRLLVVDPKARCTLEQVKEHYWIQGMMEAKIRAEKQQKIEKEASLRNH

SEQ ID NO: 5057 - protein, 420 aa, Caenorhabditis elegans
MVPSRNGEGTELYAHSEELEAKLRELARRGHMEIEKELALEKKTYGSHIKILILGGPLSGKSTIFKQMQIIHVDGFKTDQELIQYRGLIDNNIRDIYLQLIAGSRVVGIPLDPIEHITYEIDEIYAPMSDAFSVRTISELLEPLTEFWNSKQIQEIYKRRCEFELLDSTKYYLENLTRIADPTYLPNQEDIVHSRKATMSINSIVFEYTGVSLLNILVKLKILDFFLFYFRMIDVGGQRSERKKWLHLFDDAKVVLFVIDLTGYAKRSEESRMEVKYFETFQFKISRTWILRILSRFPKFFRDVGSNAYDMKVALKIFNEVAAASALANAVFLLFFNKVDLFKEILSQVNLQPCFSKFDGENTYEETSKYICEKFIRAASSKKSVFPHFTTATNTENVKLVFRACMESVFKANAKATGLS

SEQ ID NO: 5058 - protein, 373 aa, Caenorhabditis elegans
MSTSSSIAKPDFRTGEVISQFEIIKKLGSGGFGAVYQVRKNGFDMALKTEFVDTESDDTLKNEAHILRLLQWSPGFCRLYTAKRLTWNKQQVNIMAMSLCARPISRLRRMMPDKHFSKSTAARLSVQLLEALRDMHASGIIHRDVKGSNCGWHASSRRILLFDLGFSRKYLELDPSTNTMRHRAARKTPGFMGTSNYCSTYAHDECDQGRRDDLWAWLYSTVEMFLGSLPWNNEDKTILVSKMKKKIGKKLFFKCPREIALMYEHIRQLKFDSTPDYQMMLNHFQQMYARLEIDESEPMDFEEGSAFYEEHFLNNDTDSEEDTDDTTTDLDSYENEKSNVVTIGTESDATQEDKKLGRLAAGLNRAFSRLMPF

SEQ ID NO: 5059 - protein, 654 aa, Caenorhabditis elegans
MWHYRLTTILLIISIIHSIRAKRKLKEQEIIQRILKDYDWRVRPRGMNATWPDTGGPVLVTVNIYLRSISKIDDVNMEYSAQFTFREEWTDQRLAYERYEESGDTEVPPFVVLATSENADQSQQIWMPDTFFQNEKEARRHLIDKPNVLIRIHKNGQILYSVRLSLVLSCPMSLEFYPLDRQNCLIDLASYAYTTQDIKYEWKEKKPIQQKDGLRQSLPSFELQDVVTDYCTSLTNTGEYSCLRTRMVLRREFSYYLLQVPLYCPLKLVPNVPFQLYIPSFMLVIVSWVSFWLDKDSVPARVTLGVTTLLTMTTQSSGINAKLPPVSYTKAIDVWIGVCLAFIFGALLEFALVNYAARKDMTQVSQRIRQMKQLPTEGYRPLSASQGRSSFCCRIFVRRYKERSKRIDVVSRLVFPIGYACFNGTYALLGRLPDVNACAKHSLMSSIYVFLYVPYPPVYFECEYSCARVVLRLRREYSYYLIQLYIPCIMLVVVSWVSFWLDKDAVPARVSLGVTTLLTMTTQASGINSKLPPVSYIKAVDVWIGVCLAFIFGALLEYAVVNYYGRKEFLRKEKKKKTRIDDCVCPSDRPPLRLDLSAYRSVKRLPIIKRISEILSTNIDISRRVDLMSRLTFPLTFFSFLIFYYVAYVKQSRD

SEQ ID NO: 5060 - protein, 873 aa, Caenorhabditis elegans
MIPGMRATPTESFSFVYSCDLQTNVQVKVAEFEGIFRDVLNPVRRLNQLFAEITVYCNNQQIGYPVCTSFHTPPDSSQLARQKLIQKWNEWLTLPIRYSDLSRDAFLHITIWEHEDDEIVNNSTFSRRLVAQSKLSMFSKRGILKSGVIDVQMNVSTTPDPFVKQPETWKYSDAWGDEIDLLFKQVTRQSRGLVEDVPWLDPFASRRIEMIRAKYKYSSPDRHMRVSTSVNGGVGIVSACTRYCVADPELLLESLAEVKHSAMTRRIRDVEDERHRQVKPNKQAKDRLETIVNLPSSQVLTREQRDLVWKFRHYLRQFPKALNKYLRSVNWVHPQEVKTALALMNDWELIEAEDALELLSSAFTHPAVRAYSVSRLLEAASPEQVLLYLPQLVQALKYEQGQQLPEEGNPVPVVSEEEGKIPSVATTPTEELEGRDMTVVTKKEARKAASGDLATFLIDYALASPKVSNYLYWHLKTEIESTKESKEEHSKMYQNIQDRLMEALVKRPDTRAQVDSLHQQQIFVEDLIILMNEAKARGGRLNESKSAEFRTMLSRAKHMLDLKGVHLPLDPSFRLSSVIPDTASFFKSEMMPAKISFKVLQPNGKADRNIPEEYTVIFKTGDDLRQDQLIQQMVRLIDIILKKGQLDLKLTPYLVLSTGVGQGFVQCIKSKPLRAIQEQYKAHKMDCIREAMKELRPGDGPFGIEPNVIDNYVRSLAGYSVIMYILGLGDRHLDNLLLCENGKLFHVDFGFILGRDPKPMPPPMKLTSEMVQVMGGVKSKQFLEFVQHVDSAYRILRRHSNVLLNLFSLMLDAGIPDIAAEPDKAIFKIEQRLRLDLSDEAATKHIFTQIESSLNAKMAMISDIIHAYKQNLM

SEQ ID NO: 5061 - protein, 811 aa, Caenorhabditis elegans
MSSSLYTGGQALFICLAFIGLDLLVNVFGLAWNGKYFTFDNIAHWFDLANYSFLKNPAVALIRDSILLGGAVSAWASPSGFSQVAENVKNVVFAMMLLIVAFAPSKLLAFYEDDNIRLAVGDWILMIWCIFASLLLQGIWTSVLAHVTEVAAGTGDSLLFGDAEHEERLRQEEAEKAAEQRETFQLLFRLLGYMGRQWKYYGMAFFFLFCYSLSRVFIPYYTGEVVTAVFGDKASYEKLHKTVFIMGMLSLASTVFGGLRGGSFTYAHATIDRQIRNDLFRSVVKQEIGFFDMNKTGEICSRLSADCQTMSNTLSLYMNVLTRNLTMLFGSLIFMFTLSWKLSMITLINIPIIFLVNKIFGVWYDMLSEETQNSVAKANDVAEEVLSSIRTVKSFACENYESSRFMTFLNVTLKIATRKVFVVIGLIWSNELLQMGILTIVLWYGGHLVIENKVESGLLVSFLLYQFQLGENLRELGEVWNGLMQAVGASRKVFEFIDRPPRVENTGTYAPDGMTGKIEFRHVAFSYPIRPDLPIMEDLTFTVEPGEVVALVGPSGGGKSSCIAMLEHFYEPTSGEVLIDGVPVREYDHKFLHTKVALVGQEPVLYARSVTENIGYGLDKYDDDMVQNSAKLANAHTFIMNDTTDGYNTNVGEKGSQMSGGQKQRIAIARALVRQPVVLLLDEATSALDAESEHTVQEAISKNLKGKTVILIAHRLSTVENADKIVVINKGKVEQLGNHKTLMEQEGLYKQLVQRQMMSGEDGLDDEIEEPEPAREGGSGRSTRAGARRIRSPSQSVSQSFLGTSFASSYL

SEQ ID NO: 5062 - protein, 758 aa, Caenorhabditis elegans
MDVETAVRSAVDAGAFIRPTFDQKIFKDQCAYCFKDPHGKDGLYISLKNYHAFCREHAEIYGTTSGNTLFVQFESTKKIIEERTDGEPTSKMTKLTIDSDPKFEFEDKYCVVVHPEYSQQVKNVQNLPEIAEAIAQIANTTSAERLSLLSSTSNAWDAEIKLITKHQNLEQQDNGKHLALTGWTCEVEGCGLNDNLWLNLTDGAVRCGRSQFLSDGKKTNGNGHMQDYFDSTRFPLVVKLGTISSNLELIDVYSYDEDDAVIDPNLEKHLKHFGLDPTKMEKTAKSTMEMELDMNEKWEWSKCTEDGLLLEPIFGPGYTGLVNTGSSCYMNSVLQALVTVDSFQTRYGEQGLETLVNCPLDKLHNDFNAQFSKVVRAMLSGDYSSEMDPTNNHIKPLQFKRVAAGNHRDFSTSKQQDVEEYIRFLFEKIAENSRTEVIDPTDSFKFKAINRFEDRGTRRVRYTDQEEMLIRLPISGDYISPITGEPKGATNTISMKTFPDYLFFQVSKFAYNVDGTQKKLDMELEIEEELDLSGYRGHGKLEHEIALPDEEPTAPRTTPDIPASVRFVAGELMLMGFCENACYRAAYYSNGNVEIASNWLMEHMDDSDINDLFVIPSGTPSARGEVDPNLVASIVEMGFSNHQAKYALKQVPTVAEAVEWLFANMDSIPVESAAVGLSSDAPEPSVTESATQKTFKDGGEKYKLIGMISHMGSRPDSGHYVAHMLKEGKWVLFNDEKVALSQDPPKKLAYVYLYKRIA

SEQ ID NO: 5063 - protein, 260 aa, Caenorhabditis elegans
MKFLKLQGLVKDFEECFGILGANGAGKTTTFDIITGLTIPTGGSATMYGHDITETIHIGCPQFDAMLQQISCRQTGGQKRKISVGIALMSRASCIILDEPTAGIDPRARREIWDIIHEMREQGKCSIVLTSHSMEECEALCTRIGILHRGEMIALGTSQSLKSQYGNTYMMTLVLNSLEGLTSVIAIVSEEKPDAVLKTPESSLTTSIVWEVCYCQVIHFELKCFSFKNLNLINGPKVQSSGNSCKESQCKRLHVDPSIT

SEQ ID NO: 5064 - protein, 506 aa, Caenorhabditis elegans
MQRVQALRPLLPKGHVTYYKDQLLITKGEKQFLFDSNGKKYLDFFGGIVTVSVGHCHPKINAALTEQAQKLWHTTSIYHTEPIYEYAEKLLSKFPSKLNVSFYFLPFYQTLQFADLKLLGLPISVFFVNSGSEANDLALALARNYTGRFDVISMRNGYHGMTQTVLGATNLGNWKPVFPHGFNIFKSLNADPYRGIFGGSNCRDSPIQVKNRKCDCKPGSCQASDKYIEQFDDMLLHDFSHSSGPAAFLIESIQGVGGTVQYPHGYLKKSYESVQKRGGLAIADEVQTGFGRLGSHFWGFESQDALPDMVTMAKGIGNGFPLGAVVTSKEIADSFNKSLYFNTYGGNPLASVVGKAVLEVIEEEKLQENSAVVGDYFLKQLAAIDDATIGDVRGKGLMIGVELIDEQGKPLAAAKTAAIFEDTKNQGLLIGKGGIHGNVLRIKPPMCITKKDVDFAAPSFLHFDITKFLFFVVVSNYNSNIQNSFGFYEIIVPKRFNLYCSDHSLF

SEQ ID NO: 5065 - protein, 129 aa, Caenorhabditis elegans
MTEFFSQKQIDVLRTDSQLRCALRSLGYSPTASKTDIYFKKLNKKPIEFATFLDICKDEQNSPNPLTEIIKALSGLDRNKTRAMPSRELAAILSHVGEQMSPEEIKYLLSKVEVNGMVPHQALIEYISK

SEQ ID NO: 5066 - protein, 381 aa, Caenorhabditis elegans
MTSLDPINILCSSTEDHHTMQRFSKIVNIDPYLDAVNSHHRSLSLFFRSNYSFSPNILKRTETMFAENPFFTPTESKLKSEIALLQMKLDDERFDHQKTRRELANSRLEISDLKGEAKCHDSELNRLYTIINNLEKKVEDLNGEHQKSLEKLKERLHEKDAFIEACEEFYDEKKINVNKMTLMKQEMELKRIKKNFEEYKERMTEVEKNLNEFIKRQSAICMGVRYELNMEKDSRERYFKEAQQLKQEKDVLVHEINEREVRILCLRSDILTLKSENNDTSKELDEMKNGTKALKHELEETKKMKSEALSKYEESQKEFEQFNLKFQRLCTKFYEERVSSQTTSPKMKEHLASAKKRLSAIKETLQNEEDFDETGEVTNYQ

SEQ ID NO: 5067 - protein, 493 aa, Caenorhabditis elegans
MIFNFTCSKLIKLRDKSRTINIPTRIGKSNHFSFSNCYRQLLTTSISTNYLVKLAMGNKMALPQKKQEKPTHAAMKIAMKSGRRGIENANKLPTVAPKRQCLVRLLKMNRIHDYLQLEKEFITRQTSRHGRPLAVQKRREQQLVQSLRGTPTTLARVHELFDDEKHAVVVVEGSRREWYVPILSIVDKDLLRLNALVMVKAGGMFKTVPSAIVGVLDDKIDSNAMGHKVEKTPKETFDDIGGCESQIQELKESVELPLTHPEYYEEMGITAPKGVILYGEPGTGKTLLAKAVANSTSATFIRATGSDLVQKQSGEGARLVRQIFQMAKEQAPSIVFIDEIDAVGTKRFDTSSRGEQEVQRTLLELLNQLDGFESRGDVKIIMATNRIDSLDPALIRPGRIDRKIELPKPDEKTRQKIFTIHTSGMTIQKAVTYENVLGKEKSISGAEIKAVCTEAGMLALRAQRKCVGTDDFEKAVKSVMLSKKGGAPEGFFS

SEQ ID NO: 5068 - protein, 462 aa, Caenorhabditis elegans
MKMPKSTDLPAVPTRAMTPGPKPSCDPPNNNKSAMKMKVMQLNKLFLFRKNVYNNFLSHFYLVIKEINHFLNCLTSFDIMADDNITLDIHQFIKSHLFVKNWINYRQHVYEKSDLLLLIGQIMELFKMEKTLATISPPVTIVGDIHGQYPDLVRILNSRISKEEAKQKIVTSYSSNRFVFLGDYVDRGNHSIECICLVFALKVLDLKFVSLLVIMFQIAYPTNFVLLRGNHETKAINFAYGFREELENRLGKKDGFEIWEKFNEVFSFMPLACLVGGRILCMHGGISEKLESLDSIDSIVRPLPEVTDLAQDLLWSDPMDVQTLASISDTPKYAKNIVRGLAHSFNDAAVRDVCRRLNLHLVVRAHQMIPEGFKFNSDRKLLTIFSAPRYMNESDNRGATLQVDVNGQLSISVMRYTKPLRTKALGSDEITRGDHLPDISRKKSNSFIPSTFSSSKSTSLKK

SEQ ID NO: 5069 - protein, 531 aa, Caenorhabditis elegans
MTLTETSLSHNAEEGKDEGGRLQQYKNLTKHEELRRRRTECSVEIRKQKGADMMMKRRNIVDVDEGGNSESELEEPEKISHQQSSTRLSNDEIRAILSNNPSEDDMVRCFESLRKSLSKTKNPPIDEVIHCGLLQALVQALSVENERVQYEAAWALTNIVSGSTEQTIAAVEAGVTIPLIHLSVHQSAQISEQALWAVANIAGDSSQLRDYVIKCHGVEALMHLMEKVDQLGDSHVRTIAWAFSNMCRHKNPHAPLEVLRVLSKGLVKLVQHTDRQVRQDACWAVSYLTDGPDEQIELARESGVLPHVVAFFKEAENLVAPALRTLGNVATGNDSLTQAVIDLGSLDEILPLMEKTRSSSIVKECCWLVSNIIAGTQKQIQAVLDANLLPVLINVLKSGDHKCQFEASWALSNLAQGGTNRQVVAMLEDNVVPALCQALLQTNTDMLNNTLETLYTLMLTVQNGYPHKVDILHDQVEENGGLDSLERLQESQSEQIYTQAYRIITQFFTDDDAGEKESHENADPQDNKWSF

SEQ ID NO: 5070 - protein, 942 aa, Caenorhabditis elegans
MRISIGRIAWQILAVLIAVAFTIEHDSICDESIGACGEPIHTVIRLAKRDDELARRIAADHDMHVKGDPFLDTHYFLYHSETTRTRRHKRAIVERLDSHPAVEWVEEQRPKKRVKRDYILLDNDVHHSNPFRRSVLNRDGTRRAQRQQPQSPREIPSLPFPDPLYKDQWYLHGGAVGGYDMNVRQAWLQGYAGRNVSVSILDDGIQRDHPDLAANYDPLASTDINDHDDDPTPQNNGDNKHGTRCAGEVAALAGNNQCGVGVAFKAKIGGVRMLDGAVSDSVEAASLSLNQDHIDIYSASWGPEDDGKTFDGPGPLAREAFYRGIKNGRGGKGNIFVWASGNGGSRQDSCSADGYTTSVYTLSISSATYDNHRPWYLEECPSSIATTYSSADFRQPAIVTVDVPGGCTDKHTGTSASAPLAAGIIALALEANPELTWRDMQHLVLRTANWKPLENNPGWSRNGVGRMVSNKFGYGLIDGGALVNMAKTWKTVPEQHICTYEYRLANPNPRPIVGRFQLNFTLDVNGCESGTPVLYLEHVQVHATVRYLKRGDLKLTLFSPSGTRSVLLPPRPQDFNANGFHKWPFLSVQQWGEDPRGTWLLMVESVTTNPAATGTFHDWTLLLYGTADPAQSGDPVYSATPATSQGVLSRVHQLTSQVEESAPISFPDLTSAGNCHDECNGGCTESSSATSCFACKHLTQTLRNKGGSGFKCVQKCDDTYYLDGDKCKMCSSHCHTCTKAEVCETCPGSLLLIDVDNMPHYDHGKCVESCPPGLVADYESNLVQAKCIWRKDLCGDGYYINAVGKCDLCDSSCETCTAPGPMSCEKCSKGYGKGSIGYCRPCCPEGSTKSWQCEDCSKPDPTLLIDSNKSSGFGLMFWIVVSLIAACGICACKKCASETKSSNVEYAPLAQYNATNGAINLGAHTDDEDDDEDEVFVNPQIV

SEQ ID NO: 5071 - protein, 670 aa, Caenorhabditis elegans
MRISIGRIAWQILAVLIAVAFTIEHDSICDESIGACGEPIHTVIRLAKRDDELARRIAADHDMHVKGDPFLDTHYFLYHSETTRTRRHKRAIVERLDSHPAVEWVEEQRPKKRVKRDYILLDNDVHHSNPFRRSVLNRDGTRRAQRQQPQSPREIPSLPFPDPLYKDQWYLHGGAVGGYDMNVRQAWLQGYAGRNVSVSILDDGIQRDHPDLAANYDPLASTDINDHDDDPTPQNNGDNKHGTRCAGEVAALAGNNQCGVGVAFKAKIGGVRMLDGAVSDSVEAASLSLNQDHIDIYSASWGPEDDGKTFDGPGPLAREAFYRGIKNGRGGKGNIFVWASGNGGSRQDSCSADGYTTSVYTLSISSATYDNHRPWYLEECPSSIATTYSSADFRQPAIVTVDVPGGCTDKHTGTSASAPLAAGIIALALEANPELTWRDMQHLVLRTANWKPLENNPGWSRNGVGRMVSNKFGYGLIDGGALVNMAKTWKTVPEQHICTYEYRLANPNPRPIVGRFQLNFTLDVNGCESGTPVLYLEHVQVHATVRYLKRGDLKLTLFSPSGTRSVLLPPRPQDFNANGFHKWPFLSVQQWGEDPRGTWLLMVESVTTNPAATGTFHDWTLLLYGTADPAQSGDPVYSATPATSQGVLSRVHQLTSQILITIAIHLVVNA

SEQ ID NO: 5072 - protein, 699 aa, Caenorhabditis elegans
MRISIGRIAWQILAVLIAVAFTIEHDSICDESIGACGEPIHTVIRLAKRDDELARRIAADHDMHVKGDPFLDTHYFLYHSETTRTRRHKRAIVERLDSHPAVEWVEEQRPKKRVKRDYILLDNDVHHSNPFRRSVLNRDGTRRAQRQQPQSPREIPSLPFPDPLYKDQWYLHGGAVGGYDMNVRQAWLQGYAGRNVSVSILDDGIQRDHPDLAANYDPLASTDINDHDDDPTPQNNGDNKHGTRCAGEVAALAGNNQCGVGVAFKAKIGGVRMLDGAVSDSVEAASLSLNQDHIDIYSASWGPEDDGKTFDGPGPLAREAFYRGIKNGRGGKGNIFVWASGNGGSRQDSCSADGYTTSVYTLSISSATYDNHRPWYLEECPSSIATTYSSADFRQPAIVTVDVPGGCTDKHTGTSASAPLAAGIIALALEANPELTWRDMQHLVLRTANWKPLENNPGWSRNGVGRMVSNKFGYGLIDGGALVNMAKTWKTVPEQHICTYEYRLANPNPRPIVGRFQLNFTLDVNGCESGTPVLYLEHVQVHATVRYLKRGDLKLTLFSPSGTRSVLLPPRPQDFNANGFHKWPFLSVQQWGEDPRGTWLLMVESVTTNPAATGTFHDWTLLLYGTADPAQSGDPVYSATPATSQGVLSRVHQLTSQLCFNFENSQPTECVCLRVCEPGVIINFQIEKLKKSTKCLIFS

SEQ ID NO: 5073 - protein, 827 aa, Caenorhabditis elegans
MRISIGRIAWQILAVLIAVAFTIEHDSICDESIGACGEPIHTVIRLAKRDDELARRIAADHDMHVKGDPFLDTHYFLYHSETTRTRRHKRAIVERLDSHPAVEWVEEQRPKKRVKRDYILLDNDVHHSNPFRRSVLNRDGTRRAQRQQPQSPREIPSLPFPDPLYKDQWYLHGGAVGGYDMNVRQAWLQGYAGRNVSVSILDDGIQRDHPDLAANYDPLASTDINDHDDDPTPQNNGDNKHGTRCAGEVAALAGNNQCGVGVAFKAKIGGVRMLDGAVSDSVEAASLSLNQDHIDIYSASWGPEDDGKTFDGPGPLAREAFYRGIKNGRGGKGNIFVWASGNGGSRQDSCSADGYTTSVYTLSISSATYDNHRPWYLEECPSSIATTYSSADFRQPAIVTVDVPGGCTDKHTGTSASAPLAAGIIALALEANPELTWRDMQHLVLRTANWKPLENNPGWSRNGVGRMVSNKFGYGLIDGGALVNMAKTWKTVPEQHICTYEYRLANPNPRPIVGRFQLNFTLDVNGCESGTPVLYLEHVQVHATVRYLKRGDLKLTLFSPSGTRSVLLPPRPQDFNANGFHKWPFLSVQQWGEDPRGTWLLMVESVTTNPAATGTFHDWTLLLYGTADPAQSGDPVYSATPATSQGVLSRVHQLTSQVEESAPISFPDLTSAGNCHDECNGGCTESSSATSCFACKHLTQTLRNKGGSGFKCVQKCDDTYYLDGDKCKMCSSHCHTCTKAEVCETCPGSLLLIDVDNMPHYDHGKCVESCPPGLVADYAENFDFCAKNNESGRDTTVFVKFKKPSAFKDYCNLKLVDLDFFIFSLLF

SEQ ID NO: 5074 - protein, 730 aa, Caenorhabditis elegans
MRISIGRIAWQILAVLIAVAFTIEHDSICDESIGACGEPIHTVIRLAKRDDELARRIAADHDMHVKGDPFLDTHYFLYHSETTRTRRHKRAIVERLDSHPAVEWVEEQRPKKRVKRDYILLDNDVHHSNPFRRSVLNRDGTRRAQRQQPQSPREIPSLPFPDPLYKDQWYLHGGAVGGYDMNVRQAWLQGYAGRNVSVSILDDGIQRDHPDLAANYDPLASTDINDHDDDPTPQNNGDNKHGTRCAGEVAALAGNNQCGVGVAFKAKIGGVRMLDGAVSDSVEAASLSLNQDHIDIYSASWGPEDDGKTFDGPGPLAREAFYRGIKNGRGGKGNIFVWASGNGGSRQDSCSADGYTTSVYTLSISSATYDNHRPWYLEECPSSIATTYSSADFRQPAIVTVDVPGGCTDKHTGTSASAPLAAGIIALALEANPELTWRDMQHLVLRTANWKPLENNPGWSRNGVGRMVSNKFGYGLIDGGALVNMAKTWKTVPEQHICTYEYRLANPNPRPIVGRFQLNFTLDVNGCESGTPVLYLEHVQVHATVRYLKRGDLKLTLFSPSGTRSVLLPPRPQDFNANGFHKWPFLSVQQWGEDPRGTWLLMVESVTTNPAATGTFHDWTLLLYGTADPAQSGDPVYSATPATSQGVLSRVHQLTSQGDEVVERIRNHWEVTLEESSHWNWEHAREHKSLQELNSSSRTHSFLYSFTKFQPIFLIILVCIFDAIHRQFAV

SEQ ID NO: 5075 - protein, 1026 aa, Caenorhabditis elegans
MASFRKNHVIIDSSDSSEDEDRKVCSSLTFEFCFKIIEFQERHSSSSEVDETASMRSTDSSEPPRTIIDASLNSMASTVYTSTPNSKQSISRTGSSTTYGSSKCSTDDHYRSRSFIDNSFEKPVTPITKKLQESDEPRAKQQLRERLLRKSIKQQSDQDLTGGSSRSGWGTGENSSLESSDLINSHFSPIAKTFRHASDLDDSMNTSPPPNRSTLPSVETSSGNSPQTPYPGSPEASPQPSPPKNTASELQKLSIKELEANKDKKLKLLKFSSNLPDNGARVKLQVDEITEEIERRIINGVTDTMVVDKTTAIPPPPQPKNLIAPIPQDFAAMLDKNGRKVMSGRMTEQKILKVNKISDRLMQQLADATHTIPAETDLTDTPDGLLVELMPHQKAGLRWLVWREGQPHSGGILADDMGLGKTLSMLSLIVHQKAARRARKESGDNAADKEKRRVAKEEGLYPSNGTLIIAPASLIHQWEAEINRRLESDLLSVFMFHGTKKQRQIEPKELARYDVVITTYTLAANELMEKKAAGSKKEEDSDDESENEENPRRPAGKNDSPLARVAWSRVILDEAHAIKNRLSQCSKAVCRLSSFSRWCLSGTPIHNNLWDLYSLVRFLRIPLFGDRKFWAESIMPMKTGMADRVNLLTKNLMLRRTKDQQCALTNKKIVNLKEKKIEIHELEMVGDEANGYAIMMEAAQKLVKQIVTNTDDIQKYGQIRRRRQRGNDDEFANPYNVGPRNLAGNSNFQNMSCILLLLMRLRQACVHFHITKSGMDLDAFKINGGDDEDADMKELENLMEKTMADLTIADSDNDEEGVDTNKEEPKQPPTRIFEPDFISCKMAKTLEVVREILEKKEKVVIVSQWTSVLNLVEKHIQAGGHNYTSITGQVLVKDRQERVDSFNQEKGGAQVMLLSLTAGGVGLNLIGGNHLIMVDLHWNPALEQQACDRIYRMGQKKEVFIHRLNISKFCRLIVKGTIEQRVMDLQEKKLALAASVLEGTATRKLNKLTTADIRMLFGLDGSSNAN

SEQ ID NO: 5076 - protein, 201 aa, Caenorhabditis elegans
MARRPYDMLFKLLLIGDSGVGKTCILYRFSDDAFNTTFISTIGIDFKIKTIELKGKKIKLQIWDTAGQERFHTITTSYYRGAMGIMLVYDITNAKSFDNIAKWLRNIDEHASEDVVKMILGNKCDMSDRRVVSRERGEKIAQDHGISFHETSAKLNVHVDTAFYDLAEAILAKMPDSTDEQSRDTVNPVQPQRQSSSGGCC

SEQ ID NO: 5077 - protein, 216 aa, Caenorhabditis elegans
MARRPYDMLFKLLLIGDSGVGKTCILYRFSDDAFNTTFISTIGIDFKIKTIELKGKKIKLQIWDTAGQERFHTITTSYYRGAMGIMLVYDITNAKSFDNIAKWLRNIDEHASEDVVKMILGNKCDMSDRRVVSRERGEKIQLPPLSCQHFALCFRQALVKQLMSFFFFILPTTRALSLFLRLYSFSRCLGSIDLPFNIRPRRPLLSVSLVSLSSRE

SEQ ID NO: 5078 - protein, 419 aa, Caenorhabditis elegans
MSSLSRSLLISRSAAPVVATMSTKPRAHIDGHVPSPLQQLSEEESSIVGTVRRFAVNVIKPLVREMDDKSQMHQSVITGTFENGLMGIEIPEKYGGPGSSFFDAVLVIEELAKVDPSVSVFVDVQNTLVAPLIIQLGTEEQKQKYLPKIVTEAIGSFALSETGSGSDAFALKTTAKKDGDDFVISGSKMWITNAGHAQFFLVFANADSAKGYKGITCFLVDRNQEGVSVGKKEDKLGIRASSTCSVHFDNVRVHKSSILGEYGKGYKYAIECLNAGRIGIGAQMLGLAQGCFDQTIPYLQQREQFGQRLIDFQGMQHQIGQTRMEIEAARLLVYNAARMKQNGLPFVREAAMAKLFASQVATTATSKCVEWLGGVGFTKEFPVEKFYRDSKIGTIYEGTSNIQLNTIAKLVDIEYQQKA

SEQ ID NO: 5079 - protein, 604 aa, Caenorhabditis elegans
MATTGEKAIYEDQNNVNIIENVVDVANGINESPKTLFEEDGSSRDSGVSMTSCSDKSDASPEEDVDFSKLESGRVALTDCSNFVSILQRNSSVSSSRSSSFYNYDTPTGRKMKTVFDLDSLDHSEYEKRVMSERPTDNHRKRTSSSMSPSVTLLDRKRSRNLSLVAPQSDKSCRYNGLNNPRDDPFGDEDDEVFEQSNVRNSQVQNTSIFAQPAPRTATSLWDLAPPMFFERKTSDTSGNGSFQERPKQILRAMSVGEIDSELPPTLEVKYTLPGVDNPQRESQAFRSISPTTLLLEFQRLGDDFDKKYIIVDCRFPFEYKGGHVKGAINLFRHDKIKPIFFPENGEASSFQNRVPIFYCEYSQKRGPTMAHAVRSIDRVLNELRYPHVEYPEMYLLDYGYKSLWSTAECRQICEPCSYIPMTHSSFSMEFKSARLERHHSMASLKPNGETSHREEKKKRCTRSVIRRNNSSLNMLSRSSSALTSTGSKTSSMENILYGLDDERRPKWVSAFDIQSTESENDLDAALIYQRNISSNASNASSIVNLAEERIVQLGLQVITPDFPDRPSESSSTTPAGEHLPLGEGGHQIPCGILDFSSISDDAE

SEQ ID NO: 5080 - protein, 378 aa, Caenorhabditis elegans
MGIEVPEKYGGPGATFFDAALVIEEISKVDASVGAMVDVHNTLFIPLIIELGTEKQKEKYLPKCYTSSVGSFALSETGSGSDAFALKTTAKKDGDDYVINGSKMWISNSEQSETFLVFANADPSKGYKGITCFIVEKELFIVTFRSKKSRHEQNIKSMTLKMSASKKYSNPLYRFFIVSSIQDIILLKKLLKNMKYIKDSKEINGSRHMGLLYSSYFIPGENGGTVEDKLGVRSSSTCPLHFDNVRVHKSAILGEFGKGYKYAIEYLNAGRIGIGAQMLGLAQGCFDQTIPYLQQREQFGQRIIDFQGMQHQIAQVRTEIEAARLLVYNAARMKQHGLPFVREAAMAKLFASPKNSPSRNTIVTVKLERFTKELPTFN

SEQ ID NO: 5081 - protein, 570 aa, Caenorhabditis elegans
MLYTVINLLAQIYCNGPILQTVQDSHMFPDSKHFVDMSLKYDPITTLRHFDELGDRTSDMIILREFVTSHFNPPGSELVEWFPPDWVDFPSNFLNIHDYHHRRWALHLHRIWKDLCRKVRDDVKHRQDHYSLLYVPHPFIIPGGRFLEFYYWDTFWILKGLLFSEMYETARGVIKNLGYMVDNHGFVPNGGRVYYLTRSQPPLLTPMVYEYYMSTGDLDFVMEILPTLDKEYEFWIKNRQEWFKDKDGVKQFPYYQYKAKLKVPRPESYREDSELAEHLQTEAEKIQMWSEIASAAETGWDFSTRWFSQNGDTMHRMDSIRYRGTWSIIPADLNAFMCANARILASLYEIAGDFKKVKVFEQRYTWAKREMRELHWNETDGIWYDYDIELKTHSNQYYVSNAVPLYAKCYDDDDDIPHRVHDYLERQGLLKYTKGLPTSLAMSSTQQWDKENAWPPMIHMVIEGFRTTGDIKLMKVAEKMATSWLTGTYQSFIRTHAMFEKYNVTPHTEETSGGGGGEYEVQTGFGWTNGVILDLLDKYGDQFASSSTASKFSFSLSNITFVVFILYIFS

SEQ ID NO: 5082 - protein, 829 aa, Caenorhabditis elegans
MGITGLWKIVEPTATEIPLECLEGKKLAIDVSIWIYQAQLAYPSDQPFPHLRLLVNRLSKLLFYKIRPVFVFDGPQVPPLKRQVLEARRQKRQNDDDILKNSKKMGKLKVLKKSQKIREIASGGLDDVALANAIKEVISPSKKVILNDIYKDIPSTSTYLDKPSAHQNDQLVYGNIEDSDSDDSDIIIVPTVKEERISKQFTSRKLEIQSLVEKREIMRNSRLRPDMIPQDSKSFSNFQMQRLLRRGRLNAEIEQLAKSTTTSTGGYSSDKINVTGPDGTSHILKYAHSDEIQEVRPELKRDIDSLYQEPLSMTLDFFNVEYGGKKLSREVTPDDVREEIVDRLEERLIDKKERGYQSKSGMLEAIARKRIRQHYGTETVEDKKEEEKRKKEQRIEDDMIEVSDDEMVLQEVLLETAAKSLDKRMASLEKHKVPSEDEEIEWDPQRYDKPSTSSAPALMEDYIHLNYSDEDDKTPELYRDLQEFLTNAGIPWIESPGEAEAQCVELERLGLVDGVVSDDSDVWAFGAQHVYRHMFSKNRRVQRYGEQTTANRDNCKLFCLQREDYISIALLSGGDYCAGLVKVGAIGALELVSEYVECRIDNTNDLKVIENRIMRLLKNVESLFLTAPDDKRVASRNAMMLRRHVTEANDMENIKCVCSNQDAVHAYLHPIVDSSSEKLRWRQMNIPLIRRILHQRLQWPDRKQHNEEQNSFDAFEKWNNFLKSGGQSQMRLDRFFAQKLDSSLELKWSKKIVEALDKIGQRVAGTMKNNEMSKEKKVDKQIKKSKTAVKRVTRARGIGRGKGGALLVPANSKLNLSEESSSNDSFDEF

SEQ ID NO: 5083 - protein, 539 aa, Caenorhabditis elegans
MFVALGAQIYRQYFGRRGMAMANNSSVANKVCLIVIDGWGVSEDPYGNAILNAQTPVMDKLCSGNWAQIEAHGLHVGLPEGLMGNSEVGHLNIGAGRVIYQDIVRINLAVKNNKFVTNESLVDACDRAKNGNGRLHLAGLVSDGGVHSHIDHMFALVKAIKELGVPELYLHFYGDGRDTSPNSGVGFLEQTLEFLEKTTGYGKLATVVGRYYAMDRDNRWERINVAYEAMIGGVGETSDEAGVVEVVRKRYAADETDEFLKPIILQGEKGRVQNDDTIIFFDYRADRMREISAAMGMDRYKDCNSKLAHPSNLQVYGMTQYKAEFPFKSLFPPASNKNVLAEWLAEQKVSQFHCAETEKYAHVTFFFNGGLEKQFEGEERCLVPSPKVATYDLQPEMSAAGVADKMIEQLEAGTHPFIMCNFAPPDMVGHTGVYEAAVKACEATDIAIGRIYEATQKHGYSLMVTADHGNAEKMKAPDGGKHTAHTCYRVPLTLSHPGFKFVDPADRHPALCDVAPTVLAIMGLPQPAEMTGVSIVQKI

SEQ ID NO: 5084 - protein, 461 aa, Caenorhabditis elegans
MIFNLINSILSLVIIHSNLCDGSVAETKLFTDLLKGYNPLERPVQNSSQPLEVKIKLFLQQILDVDEKNQIVSVNAWLSYTWFDHKLQWEPKKYGGIQDIRFPGSSDHIWKPDVLLYNSAAEDFDSTFKSNLLTYHTGTVVWIPPGVLKFVCQLDVTWFPFDDQVCEMKFGSWTFHGYAIDLQIDDDTNGTQSMDLSTYLVNGEWQVISTNAKRVVSYYKCCPEPYPTVNYYLHIRRRTLYYGFNLIIPSLLISLMAILGFMFPPDAGEKITLEVTILLAIVFFLSMVSEMTPPTSEAVPLIGVFFSCCMLVVSASVVFTIVVLNLHFRSADSHEMNPLVRRVLLEFLPWLLFMSRPGYKFVKANVIDSTDKMPKKPKNPLDCNLPSNHAGYEAQILLLHSVHTELRRVVAFYNKEEHDERIQTDWRFAAMVVDRACLLLFTVFIVISILAIMMSAPHIIA

SEQ ID NO: 5085 - protein, 350 aa, Caenorhabditis elegans
METLERSEETVILIDGLAIPKVKPYVPMLKDRNGSEYLSNDQMFRGKFMVKGLIGRGGFGQIYYGSDATFPEDVVIKIEPVVLKGRPRRRMILEQKVLYRLQGRPHVPIMCASGHTEQLNFIVMQLLGPNIGDLKKRSPVKRLSQTTVARIMIQGIAALRDVHSLGYIHRDVKPANMCFGVTQSTRHVLKLVDYGMVRRFKNVDGTRRKQRYKPGFRGTLRYSSVRVHDGKEQTPVDDFVSMAYSGAELLLVNLPWKLVSTDDIRQTKVDFNTPNSPYLLLTGPYFSVFCGAIFNLRSEDEPDHSSLQNLLCDMTRGKSLREAYDWDENYRDALGSTKVLFFSFPYCVDS

SEQ ID NO: 5086 - protein, 357 aa, Caenorhabditis elegans
MDNYEKVRVVGRGAFGVCWLCRGKNDASHQKVIIKLINTHGMTEKEENSIQSEVNLLKKVQHPLIIGYIDSFIMDNQLGIVMQYAEGGTLERLINDQRAIKDSNMREYFPEKTVLDYFTQILIALNHMHQKNIVHRDLKPQNILMNRRKTVLKLSDFGISKELGTKSAASTVIGTPNYLSPEICESRPYNQKSDMWSLGCVLYELLQLERAFDGENLPAIVMKITRSKQNPLGDHVSNDVKMLVENLLKTHTDKRPDVSQLLSDPLVLPYLISIHCDLGRIEPPPTDKRKPSASLSSRLRTYPTQSTLRPYSLSSNAPTTHLTQLTPMPSHIDSGFFSSGRTSNQRTQSRSQVHSKY

SEQ ID NO: 5087 - protein, 397 aa, Caenorhabditis elegans
MQFLLFSVILTILGKSHRSRSITNFYLLNLAFADLLRSIICIPSTLLGELTQCWLLGAAMCKIVAFLQLQISFAISIKFSAVGVCASAYTLAVIAIERYYAICRPLESRKWQTKKRALITISLVWCFSFSANLTSLFLYDANPGKFTCDSTKGPLVDFIYQLYLTFTLLFVPLALMVGLYGNVIITLNTAINSDHPTVEQQMIEKTLPSRASFSDWFVSAVQRVPSMKVVSKTFQFKEKNSLSIPQTSGLSVRPSRSSFSSFFSTPRGSFDVTMLLRSTNQEKILIAKKKVTRMLITLVIVFAFCWVPSYLYWLLLRMAELAATDLWNPGLNSSLTIMTYISSLANPITYCFMNKSFRSSVLAYCRPKPKRPLVRNQTIVYSKYSYFSDSLLCSTNS

SEQ ID NO: 5088 - protein, 300 aa, Caenorhabditis elegans
MTTKEGFDYRKFLVDLASGGTAAAISKTAVAPIERVKLLLQVSDVSETVTADKKYKGIMDVLARVPKEQGYAAFWRGNLANVLRYFPTQALNFAFKDTYKKMFQEGIDKNKEFWKFFAGNLASGGAAGATSLCFVYPLDFVRTRLGADVGKGVDREFQGLTDCFVKIVKSDGPIGLYRGFFVSVQGIIIYRAAYFGMFDTAKTLYSTDGQKLNFFTTWAIAQVGTVGSGYLSYPWDTVRRRMMMQSGRKDILYKNTLDCVRKIVKNEGITALYKGGLSNVFRATGGALVLTIYDEIQHLI

SEQ ID NO: 5089 - protein, 411 aa, Caenorhabditis elegans
MSQNAEQKYIYSKLPPGAISKSTVIVLATGIASYTALELLYGSETFYKKAVMPMVHKFVDGEDSHRWAVRAASWGLLPRFGWNRKEYPELKCELFGREFKNPIGLAAGFDKDGQAITQLAKNSGFGLIEIGSVTPIPQPGNNRPRVFRLLEDEGVINRYGFNSDGVGRVHQRVRSARDSWVPESYAYFGVNLGKNKLTEDAKLDYEIGVNYFAPHCDYLVLNVSSPNTPGLRSMQKKSDLEKLLAYVHQALEMHKLEKQPQVFLKIAPDLIESELKDIAQVVTNKKFAIDGIIVSNTTIARPDYLRSENKTETGGLSGAPVREISTECVRKIYKLTNGQIPIIGCGGVFSGADAYEKIRAGASLVQLYSAFVYEGFPVIGKIKRELVELLRKDGFSHVSEAIGADHREKTK

SEQ ID NO: 5090 - protein, 141 aa, Caenorhabditis elegans
MSELRVISLDEVSKHNWEDADQSCWIVISGKVYDVTKFLNEHPGGEEVITQLAGKDATVGFLDVGHSKDAIEMANEYLIGQLPESDVPKVETAAAKPSKNEKSSSLLNDFTEIMTSPTWTNFLIPTTMGLVIYAVYKCMFN

SEQ ID NO: 5091 - protein, 612 aa, Caenorhabditis elegans
MKASYLETLDRIKDEHAEMSKHVNQQRSDIEKVALEKENMNRSYMTYAEVSNTLRSDLRKAEEINKRLQEFIMQSLAPQLSQDNQANCLAALEAFKTASPRENGNGAPALPPGFPPGAAGMLGMMPNMPFGMSPAMSQLFNQFASPHVNGGDGAGGSSGGASEAKKAKLEDPDDGELEIDVTNDDHPSTASNGGAANKNGRDSTNSVASSGASTPSIASNSRARQQQQPLAGLQGLEQMNFLAGFNPNLLRQASAAGGFNFLNDPHAQARLAAAIGQIGSRPAYSFKIVDGGVPTPTSFPPDAQKGPGIPTGLKKKMELNHGEVVCAATISRDNSRVYTGGKGCVKIWDVKESDISGATVVNRPPIASLDCLKENYIRSCKLFEDGNTLLIGGEASTVALWDLTTETKTLDLETDSQACYALAMSPDEKLLFACLADGNILIYDIHNKVKVGTLPGHQDGASCLDLSKDGTKLWSGGLDNSVRCWDLAQRKEVAKHDFASQVFSLGCCPNDEWVAVGMENNYVEVLSTTGKEKYQLTQHESCVLSLKFAHSGKFFISTGKDNALNAWRTPYGASLFQLKENSSVLSCDISFDDSLIVTGSGEKKATLYAVEY

SEQ ID NO: 5092 - protein, 62 aa, Caenorhabditis elegans
MDKSDMQRTVDSLRSQLNIERTPITVSAAELRRFTESQEDPLVNPIDKKVNPWAEKSKCSML

SEQ ID NO: 5093 - protein, 313 aa, Caenorhabditis elegans
MHNILHHCIDFRRKRADGSIFQFKILKFIKTVLQMDGSVSPSDHKKPASEQKLNLKSGQESVEKFAKALDTNNDGFVDKSEILAWVSESYQKTVDREAVERISELDENADGFLYFKNTLFSLVDRKHVSWEEYLADSFPDEELHNKEEESLIAQDKMYFKQADEDNDGKLNLEELASFLNPEHHPHMHPVLIAVTLLEKDQNGDGAIEEKEFLGELDEQRGSEWYKVEVERFRTVYDKNKDGKLAGDELTDWLLVDGTTAGSYEAESLLTNSDDDKDGQLSYEEIVKHHALFAKTEAAQEADHLHPYYSHDEL

SEQ ID NO: 5094 - protein, 570 aa, Caenorhabditis elegans
MAGRKSSRTAERVPTTQKPERKSAILSPHDELRERLLETAIDMKENIPQRNTRNSSVGSQKSDCSETRKRRSTKNTVLCPLCMSNTCLPSESHCSSGGIAQWQSIRLQIERSLVQLREGPAAKRHSGEKHRNGSREDSLEYISEYSDDREVGSSSSQSSRTRGQPLPAMPEEEEVFDKSSSSDNLAESEESHEMVRLEERQDIEEEIEDDFDDEEEDVVNDKEEYEEIESEDEDDYPVQNEGFAVTKRLMNDEHMVTAPTFLSTAKCDGIGSPTKVWSLMVKRDEIPRATRFLLGNHPDMDDEKRRILIDWMMEVCESEKLHRETFHLAVDYVDRYLESSNVECSTDNFQLVGTAALFIAAKYEEIYPPKCIDFAHLTDSAFTCDNIRTMEVLIVKYIGWSLGPITSIQWLSTYLQLLGTGKKNKSDHYEEQNMYVPELLRSEYLEMCKILDFLLFEIDSFTFSYRTIAAAVLFVNYEPTCAVEKATGFMQAQLEKVIEYVEPVCRAFAKQRQLLDDVIPKHESIKSDDSHNIQVYVKRSSMEPIVVEKRTREDSAFKSSPSSSATTFLK

SEQ ID NO: 5095 - protein, 442 aa, Caenorhabditis elegans
MFQALLTKLKNNAALGAAANNLNKFRSSNLGNQRRSVSVAVTSTSPKSEKPVAREHMIYDETHFVMQKSLGKLIEEKINPNVAKWEQDGRYPAHLVFKMLGDHGVFGVNKPEAFGGTGTDIAMATAIAEQMGAINCGSIPMSVMVQTDMSTPALAQFGSDALRERFLRPSITGDLVSSLAVSEPHAGSDVSAVHTHARRQGSDLIINGSKMWITNGGQADWACVLVNTSNTSNVHKNKSLVCVPLDAVGVHRSTPLDKLGMRSSDTVQLFFEDVRVPSSYIIGEEGRGFGYQMKQFNDERLVTVAVGLLPLQKCIDETIEYARDRLLFGKTLLDQQYIQFQLAELEAELEATRALLYRTVLARSRGDDVSMLTAMAKLKIGRLARAITDQCLQVWGGAGYLNENGISRAFRDFRLFSIGAGCDEVMMRIIHKAQSRRQLKKA

SEQ ID NO: 5096 - protein, 610 aa, Caenorhabditis elegans
MEWMRNTLNGQFIAENSDFLSENTTTTTLGFTPITEESPNCSFYEWSRNPSHAQFFRIFSIISVLTVLVVVVVLGNALVIAAVLLRRRLRSATGLLILSLALADLLVGTVILPFSIANEVLDQYWIFGETWCTIWLTLDIWMCTASIYNLVAISIDRYIAIIKPLNYPMLVTKFRARCTVAIVWIGSFLICSPSFFLASSIKDKETPCRCTPANAGRVYVVFSASSSFYIPMIIVVFVYFRIYVAARAATKSIYSGMMSVTAAANKKQNPKSYLLNHPDVINKDSLPMLRVHRGSSVVAQITPNKPYNTCRQNGNSIDATANGTSQITAAATKARKFANDSAKTLVNRGAVGATQQAPIGARFKRHGRDSESSVDSMNGTNSYSATPHKSGNEELGSLIENSRSSSTDSNEKTEQLTNQTDDNFSMSNNNNNGDEKEAFDESLLSESKKKSKSLASKFNHLMRRGQKKRTAGAYEKRLSLEIKAAKTVAIVTGCFIFCWLGFALVYGLEIKLNDVVWSIVFWLGYLNSALNPVIYTVFNREFRICFKRLLTCHHLNHPTQKYTNNNSYNSTAIRSTNAVNRVPQTSLGNYTQTQNSEKSSAAVTFNTPTN

SEQ ID NO: 5097 - protein, 437 aa, Caenorhabditis elegans
MAQSKPAYKVADIKLADFGRKEIILAENEMPGLMAMRSKYGPSQPLKGARIAGCLHMTIQTAVLIETLTALGAEVQWSSCNIFSTQDHAAAAIAQTGVPVYAWKGETDEEYEWCIEQTIVFKDGQPLNMILDDGGDLTNLVHAKYPQYLAGIRGLSEETTTGVHNLAKMLAKGDLKVPAINVNDSVTKSKFDNLYGIRESLPDGIKRATDVMLAGKVAVVAGYGDVGKGSAASLKAFGSRVIVTEIDPINALQAAMEGYEVTTLEEAAPKANIIVTTTGCKDIVTGKHFELLPNDAIVCNVGHFDCEIDVKWLNTNATKKDTIKPQVDRYTLKNGRHVILLAEGRLVNLGCATGHPSFVMSNSFTNQVLAQVELWTKFGTPQEYKLGLYVLPKTLDEEVAYLHLAQLGVKLTKLSDEQASYLGVPVAGPYKPDHYRY

SEQ ID NO: 5098 - protein, 931 aa, Caenorhabditis elegans
MMFNFYQFLYNLQNVSPFIDFSVLKQLTHTKMRENEPARFETRSFSQLIDHARSWKTEVRGMTTQGFTKISLMRAEKDRLNMYAISSVPGTNTQSIFSVTIPLELVEKAQVADRKFELKLKSGYNVDSYIRMSCRKTPPSAEFTLQCERQRSQVVTGISDYEIRNGKMILMAGDQLFRYNPLNEALAAIPIAVPDDQSSTEPMDISEGSITSGTKGCSNEAPQSSTVPPVTRIPIKKPTTSTEKPATAPPTNNFVSSAKVCPADSSLLAYVLNKQVYIEKNGKIIHRTSSNSKHITNGVPSYIVQEELERFEGIWWSESKTRLLYEHVNEEKVAESQFGVNGDPPVAPMKYPRAGTKNAYSTLRMVILENGKAYDVPLKDEVIYKHCPFYEYITRAGFFSDGTTVWVQVMSRDQAQCSLLLIPYTDFLLPEELGGSIKEDNLQLSTDLNMGVWDDKSHEETMEKPPRGKLRGTVQIHKARNDYWINTHNAIYPLKITDEEHPMYEFIYCLEKPNGSCLALISAELDQNGYCRHTEEKLLMAENFSINKSMGIVVDEVRELVYYVANESHPTEWNICVSHYRTGQHAQLTESGICFKSERANGKLALDLDHGFACYMTSVGSPAECRFYSFRWKENEVLPSTVYAANITVSGHPGQPDLHFDSPEMIEFQSKKTGLMHYAMILRPSNFDPYKKYPVFHYVYGGPGIQIVHNDFSWIQYIRFCRLGYVVVFIDNRGSAHRGIEFERHIHKKMGTVEVEDQVEGLQMLAERTGGFMDMSRVVVHGWSYGGYMALQMIAKHPNIYRAAIAGGAVSDWRLYDTAYTERYMGYPLEEHVYGASSITGLVEKLPDEPNRLMLVHGLMDENVHFAHLTHLVDECIKKGKWHELVIFPNERHGVRNNDASIYLDARMMYFAQQAIQGFGPTTAAPRQGPL

SEQ ID NO: 5099 - protein, 604 aa, Caenorhabditis elegans
CFNCQQPGHRSSDCPEPRKEREPRVCYNCQQPGHTSRECTEERKPREGRTGGFGGGAGFGNNGGNDGFGGDGGFGGGEERGPMKCFNCKGEGHRSAECPEPPRGCFNCGEQGHRSNECPNPAKPREGVEGEGPKATYVPVEDNMEDVFNMQKISEGLMFNKFFDAEVKLTSSEKTVGIKPCKTFAEANLTETMQKNVAHAGYSKTTPIQQYALPLVHQGYDIMACAQTGSGKTAAFLLPIMTRLIDDNNLNTAGEGGCYPRCIILTPTRELADQIYNEGRKFAYQTMMEIKPVYGGLAVGYNKGQIEKGATIIVGTVGRIKHFCEEGTIKLDKCRFFVLDEADRMIDAMGFGTDIETIVNYDSMPRKENRQTLMFSATFPDSVQEAARAFLRENYVMIAIDKIGAANKCVLQEFERCERSEKKDKLLELLGIDIDSYTTEKSAEVYTKKTMVFVSQRAMADTLASILSSAQVPAITIHGAREQRERSEALRQFRNGSKPVLIATAVAERGLDIKGVDHVINYDMPDNIDDYIHRIGRTGRVGNSGRATSFISEDCSLLSELVGVLADAQQIVPDWMQGAAGGNYGASGFGSSVPTQVPQDEEGW

SEQ ID NO: 5100 - protein, 1465 aa, Caenorhabditis elegans
MWNQSESSSGSDAEPDEKTDEPVREEENPEGNSTSEDNDEKEKAADSPESSSDQSDDSDDASENSSSSEPDEPAPKKKNNNNRGMDAETRKLLENENYFRRSKRSKRQDDSPSDNSEESQSSEDDWDDRRKPRRTVTKKVVKQTKKAVSVVKRKSVKGNVNYAEKNSDDDIDDDDVLEWDEEPAVPAEGPAILTETVERVIKWRHGVPGATGSATTCYNIADKGDPNDQIPGDKTEQQFFVKWTGWSHLHNTWESENSLALMNAKGLKKVQNYVKKQKEVEMWKRSADKEYIEFFECEQQMAEELCEEYKKVERVVAHQTSRDRAADGSMATEYLIKWSGLPYSDCTWEDEKMVAPEQIKAYYHRIENLKSPNKNSNVLRKRPKFEKFESMPDFLKTDGESTHKLRDYQLEGLNWMVYAWCKGNSSILADEMGLGKTIQSISLLASLFHRYDLAGPYLVVVPLSTMAAWQKEFAQWAPEMNLVVYMGDVVSRDMIRQYEWFVGGTKKMKINAILTTYEILLKDKAFLSSIDWAALLVDEAHRLKNDESLLYKSLTQFRFNHKLLITGTPLQNSLKELWALLHFIMPEKFDCWEEFETAHNESNHKGISALHKKLEPFLLRRVKKDVEKSLPPKTEQILRVDMTAHQKQFYKWILTKNYRELSKGVKGSINGFVNLVMELKKCCNHASLTRQYDHIYDDAQGRLQQLLKSSGKLILLDKLLCRLKDKGHRVLIFSQMVMMLDILQEYLQLRRFPSQRLDGSMRADLRKQALDHYNAPGSTDFAFLLSTRAGGLGINLATADTVIIFDSDWNPQNDLQAMSRAHRIGQTKTVNIYRLVTKGSVEEEIVERAKRKLVLDHLVIQRMDTTGKTVLSKNATASGSVPFDKQELSAILKFGAVELFKEKEGEEQEPEVDIDRILMGAETREAEEEVMKENELLSSFKYANFAIDEEKDIAAATDEWAAIIPEEDRNRILEEERMKELAEMNLAPRQRKQPIPQVVEDDDGDDDEEEDDTGKKKKKKAVGNFTIPEIKRFIKSFRKFSMPLNRLEEIAQDAELEEHSTDEMKKLVESLSEACKKAADEFDSNEKNGDAGAAESEKKDIERKFKFHTCDVNLKQIERSHAELKPLHEILKSEETKTSFKPPANAKLQKGWDVDWSRPDDSALLLGVWKYGYGSWEAIKMDPTLGLADKIFIKDKTKKPQGKNLQVRVDYLLKLMSKDKVKTTEKKERKRKADDVPVGPEKKKRHTNNVPQEGEKKKKEKKEEKNSSSLKDQLALLSIDKSLYGGALEDSSAKPFLECVKLCMPVHKYMKKLKEAQEAKNQADEAKYLTRLGDSFLENLETLIKKKPKTNIRKWYNYLWIFLCKFTLREPGEMADRYRSITSDKHKNHHHHHHHKSKEEKPKEAKDHKERDREKDRERNRGERRMDHGEGTSKDHHREHHKDHHKDHHHREQHKVFIKKTTTFF

SEQ ID NO: 5101 - protein, 502 aa, Caenorhabditis elegans
MATESALIKVHVKSPSNKYDVEIAADASVSELKDKVLVFVPTANKEQVCIIYTGKILKDEETLTQHKIADGHTVHLVIRNQARPTPAPAAATPTASSAPSSNPTPSSQPNPTNNPFAAMGGMGSPADILNNPDAMRSVMDNPITQQLLGNPEFMRTIIQSNPQFQALIERNPEVGHILNDPNVMRQTMEMIRNPNMFQEMMRNHDQAIRNLQGIPGGEAALERLYNDVQEPLLNSATNSLSGNPFASLRGDQSSEPRVDRAGQENNEALPNPWASNANQATNNQSNNRSADFNSLLDSPGISSLMEQMMSNPSMQASMFSPEVINSIRQNMSNNPGLIDSIVGQIPSARDNPQISEGIRRSFPQMLNMMSDPSVMEAMRNPRVSEAFRQIQEGFSTLRREAPQLLNLFQAGAMGGGAFGSDANASSAGANSANGLADLFNSMNMGGGRPSSTAAPVNPEQTYASQLEQLQSMGFSDRARNVAALTATFGDLNAAVERLLNSP

SEQ ID NO: 5102 - protein, 502 aa, Caenorhabditis elegans; identical to SEQ ID NO: 5101

SEQ ID NO: 5103 - protein, 373 aa, Caenorhabditis elegans
MVRFMKDTTLTRDVNGGARTPFFDLTVYNDWPQFEDYIKGVAHDNPSFVQLKTIGRTREGRPLLGVRIGKPALPGKRKIAVWLDGGNHAREWPAFHVAVYFIEKLVNGYLSDDKITKYVETLDIYVFPVLNPDGFVYSRTSTRAMIRQWRKNRAPENCTGTGPFQTDICCEGVDLNRNYDIGFSHKNYPFNNPCSDEFQGPRPFSEPETRAVRDFIMSSEIYGRLYALVSMHTHGQLWILPYNYQKRTYPQDIKDLEILANRAADRVFAYRETKYRVGTAADMLGTATGGATDWIKKNTPTKYVYVLELPPDMKTWFAFQVKPHWLIPIGKETWLGIEVIFDQVVEETKNFQPTEPTTNGTSADSRSPRFRQL

SEQ ID NO: 5104 - protein, 285 aa, Caenorhabditis elegans
MSGIEFEARMKPGTPDDLKKLHSWLESIIFRYFHVWSPVNCQDMLKRYEIYELCLRARELFWTQPLYRHGGKDGKQTFPAVLGSGTDRQKTQKNYLFLGDYVDRGPYSIEVVLMLFAMHLRWPDRVTLLRGNHESRPVNRQIYEVFQLAFNAMPLTAIVNKRIMCMHGGISEELFDLKQLDALKRPIDTPDIGIIADLTWADPECEIDYYKESPRGAGKIFGAKAVDEFCKHFQLDLIVRAHQVVQDGYEFFADRKLVTIFSAPFYCGQTNNIASMLNIDKDMVR

SEQ ID NO: 5105 - protein, 922 aa, Caenorhabditis elegans
MLKLAALLLLAAIAVRAQHGTVGRPCEVSTDCGTGNYCAGNKRCACLTTYVEIDSYCWRKINPGESGCTQNRQCEAVWPGAYCRSGECRCANNQPPFRTRDGLVCLNYGFCPLNGNNPKFRIENQVQQCYGGADATCEAIGALSYDCICDSDDCTVNNPISFCCPSRAFACIQPPNEGYTPPGGGTTLNHWYHDPITGECRELKYQGYGGNANNFQTKDHCESYCKQTCNRGLPLYRDRTTGVKQEPVYCQGNDNGCNNPNYQCTTMGTLQQCCPTYLFICSRNGGIPSEVYNTAGGLPTEYFDVGIPDGSGNTSPRFYYDSREGRCIQFSYLGQGGNFNNFLSQDHCEKFCSRILCSAGEPLKDSSGERNMECSPTGSGANSCPSTHSCESTSGSTTFGGVCCPRPQYVCKLPREQGNCGTYSNRWWFNAKTGNCEEFIYSGCQGNANNFETYKECQDYCRDARSEPQCIQGTALTDSNGNFIICGGSSAASTTCPANHYCYYDGTTYGCCPTQAYTCSLSYKSGASCGPAVTRWYYDSTTRTCQTYSFNGCDGNSNNFATQQDCKDYCRVESCPDGGEVWKEQNGAARACTTNRQCPSTHYCTPVTTWTGTVYQTKSLCCPSKNFVCSQPRDVGVRCSSTRISRWYFNADSKTCQTFEYNGCEGNRNNFASQKSCQNYCLSEACPPGTVVAKDGDGSRLVQCSNPGGNGRVSGGCPDGYTCYSSPLLDQNVCCGASTELQSLCPAASTPFISALSLQPMQCTPNVDGACPGNFFCWFSTTTTSVNAFYCCRSPDSVDTGYCPPQLVPVPGENGAQYKYCSPSAPLNDAIQGCGANRHCQFSTNLERYICCGLESDVRLPNVCPPQPANLVPVELAGNYRTCNPYARAGTPQSCPDNSACLYTGNDNGFICCRVQLGNGKS

SEQ ID NO: 5106 - protein, 241 aa, Caenorhabditis elegans
MPKRRYNPSANEEEKIPIVEKLYRENQESDFLGGGFCDDDDEVQERREQISEMRQKREEAAHNLIQAPENCEKCDKGLMDSWLWERYNCAVCDACRDDKGEHKLLARTEVKNTYLLKDCDLDLRKPKLRYWAKKNPHNPRYGDMKLYLKCQIETRVLEVHGSWEDLELKKELREQSKEVRSEKRFEKKLKDLRQQIRGTSGVKVDFGRPHTHEFGKETHVEEDTWRRTCITCEYEEVFEKL

SEQ ID NO: 5107 - protein, 612 aa, Caenorhabditis elegans
MACKVTGPNRHLTSVLEMSSFVYWPRSRQQAHNFPMQAVEQKLADATRTLHAKSSLQPSLSIETPKSKENDESGCESSNCMFHPHTIKSEPNFCFAREFKSVPDDFRIGGGDLQMGNNSKRLTCVIDTNRVDMAGILPDNMSFRGLPENKSLLVSAQIEVIPCKVCGDKSSGVHYGVITCEGCKGFFRRSQSSIVNYQCPRQKNCVVDRVNRNRCQYCRLKKCIELGMSRDAVKFGRMSKKQREKVEDEVFTFPILNFVFMSSFLSVQSLKVQVRMHKELAANGLGYQAIYGDYSPPPSHPSYCFDQSMYGHYPSGTSTPVNGYSIAVAATPTTPMPQNMYGATPSSTNGTQYVAHQATGGSFPSPQVPEEDVATRVIRAFNQQHSSYTTQHGVCNVDPDCIPHLSRAGGWELFARELNPLIQAIIEFAKSIDGFMNLPQETQIQLLKGSVFELSLVFAAMYYNVDAQAVCGERYSVPFACLIAEDDAEMQLIVEVNNTLQEIVHLQPHQSELALLAAGLILEQVSSSHGIGILDTATIATAETLKNALYQSVMPRIGCMEDTIHRIQDVETRIRQTARLHQEALQNFRMSDPTSSEKLPALYKELFTADRP

SEQ ID NO: 5108 - protein, 478 aa, Caenorhabditis elegans
MASEDKFESVLSTRYCKNSPLVSILSETNKATLWRQLWIWLAEAEKELGLKQVTQDAIDEMKSNRDVFDWPFIRSEERKLKHDVMAHNHAFGKLCPTAAGIIHLGATSCFVQDNADLIAYRDSIDHILKRFATVIDRLAAFSLKNKEVVTVGRTHYQTASLVTVGKRGVLWAQELLMAFQSLSEFRDKMRFRGIKGATGTQDSFLTLFAGDESKVEALDELVTKKANFSNRFLITGQTYSRQQDSQLVFSLSLLGAAAKKVCTDIRVLQAFGELLEPFEKDQIGSSAMPYKKNPMKSERCCALSRKLINAPQEALTILADQGLERTLDDSAGRRMLIPDVLLTAEALLTTLQNIFEGLSVQTDNVKKIVEDEIAFLGLEKAMMMLTEEGVDRQQAHAVIRKTALEAKQLQATQKVDIRQTMADPFFDSVRDRVVGLVNNPINFTGRCVSQTESFIAKELKPTIDKYLDKSAGNVQLDV

SEQ ID NO: 5109 - protein, 1938 aa, Caenorhabditis elegans
MSLEHEKDPGWQYLKRSREQQLADQSRPYDSKKNVWIPDAEEGYIEGVIKGPGPKADTVIVTAGGKDVTLKKDIVQEVNPPKFEKTEDMSNLTFLNDASVLWNLRSRYAAMLIYTYSGLFCVVINPYKRLPIYTDSVARMFMGKRRTEMPPHLFAVSDQAYRYMLQDHENQSMLITGESGAGKTENTKKVICYFATVGASQKAALKEGEKEVTLEDQIVQTNPVLEAFGNAKTVRNNNSSRFGKFIRIHFNKHGTLASCDIEHYLLEKSRVIRQAPGERCYHIFYQIYSDFKPQLRDELLLNHPISNYWFVAQAELLIDGIDDTEEFQLTDEAFDVLKFSPTEKMDCYRLMSAHMHMGNMKFKQRPREEQAEPDGQDEAERACNMYGIDVDQFLKALVSPRVKVGTEWVSKGQNVDQVHWAIGAMAKGLYARVFHWLVKKCNLTLDQKGIDRDYFIGVLDIAGFEIFDFNSFEQLWINFVNEKLQQFFNHHMFVLEQEEYAREGIQWTFIDFGLDLQACIELIEKPLGIISMLDEECIVPKATDMTLAQKLTDQHLGKHPNFEKPKPPKGKQGEAHFAMRHYAGTVRYNVLNWLEKNKDPLNDTVVSVMKASKKNDLLVEIWQDYTTQEEAAAAAKAGGGRKGGKSGSFMTVSMMYRESLNKLMTMLHKTHPHFIRCIIPNEKKQSGMIDAALVLNQLTCNGVLEGIRICRKGFPNRTQHPDFVQRYAILAAKEAKSSDDMKTCAGAILQALINQKQLNDEQFRIGHTKVFFKAGVVAHIEDLRDDKLNQIITGFQSAIRWYTATADAGARRKQLNSYIILQRNIRSWCVLRTWDWFLLFGKLRPQLKCGKMAEEMIKMAEEQKVLEAEAKKAESARKSQEEAYAKLSAERSKLLEALELTQGGSAAIEEKLTRLNSARQEVEKSLNDANDRLSEHEEKNADLEKQRRKAQQEVENLKKSIEAVDGNLAKSLEEKAAKENQIHSLQDEMNSQDETIGKINKEKKLLEENNRQLVDDLQAEEAKQAQANRLRGKLEQTLDEMEEAVEREKRIRAETEKSKRKVEGELKGAQETIDELSAIKLETDASLKKKEADIHALGVRIEDEQALANRLTRQSKENAQRIIEIEDELEHERQSRSKADRARAELQRELDELNERLDEQNKQLEIQQDNNKKKDSEIIKFRRDLDEKNMANEDQMAMIRRKNNDQISALTNTLDALQKSKAKIEKEKGVLQKELDDINAQVDQETKSRVEQERLAKQYEIQVAELQQKVDEQSRQIGEYTSTKGRLSNDNSDLARQVEELEIHLATINRAKTAFSSQLVEAKKAAEDELHERQEFHAACKNLEHELDQCHELLEEQINGKDDIQRQLSRINSEISQWKARYEGEGLVGSEELEELKRKQMNRVMDLQEALSAAQNKVISLEKAKGKLLAETEDARSDVDRHLTVIASLEKKQRAFDKIVDDWKRKVDDIQKEIDATTRDSRNTSTEVFKLRSSMDNLSEQIETLRRENKIFSQEIRDINEQITQGGRTYQEVHKSVRRLEQEKDELQHALDEAEAALEAEESKVLRLQIEVQQIRSEIEKRIQEKEEEFENTRKNHQRALESIQASLETEAKSKAELARAKKKLETDINQLEIALDHANKANVDAQKNLKKLFDQVKELQGQVDDEQRRREEIRENYLAAEKRLAIALSESEDLAHRIEASDKHKKQLEIEQAELKSSNTELIGNNAALSAMKRKVENEVQIARNELDEYLNELKASEERARKAAADADRLAEEVRQEQEHAVHVDRQRKSLELNAKELQAKIDDAERAMIQFGAKALAKVEDRVRSLEAELHSEQRRHQESIKGYTKQERRARELQFQVEEDKKAFDRLQENVEKLQQKIRVQKRQIEEAEEVATQNLSKFRQIQLALENAEERAEVAENSLVRMRGQVVRSATNK

SEQ ID NO: 5110 - protein, 1938 aa, Caenorhabditis elegans; identical to SEQ ID NO: 5109

SEQ ID NO: 5111 - protein, 146 aa, Caenorhabditis elegans
MPVIKVQTNVKKVSDGFEVRLAIHMAKVMKRPESQIFVSLDMNSRMTRGQLTDPLAVLDVTSSTVLTPILTEEYTVALCEFFSQELALDSDAVLINYRSLSPELIGFNGHILTENRPFISTDRARFIIGVLGIAFLAFLLQFLKYI

SEQ ID NO: 5112 - protein, 356 aa, Caenorhabditis elegans
MPENSQPTTTEKGSEYLEQLANEAEELRKKLDQERHKLNDIPIQQAAERLDVMGALGVKQRRILKGHVGKVLCMDWSLDKRHIVSSSQDGKVIVWDGFTTNKEHALTMPTTWVMACAFSPSSQMIACGGLDNKCSVVPLSFEDDIIQKKRQVATHTSYMSCCTFLRSDNLILTGSGDSTCAIWDVESGQLIQNFHGHTGDVFAIDVPKCDTGNTFISAGADKHSLVWDIRSGQCVQSFEGHEADINTVRFHPNGDAFATGSDDATCRLFDLRADRQVCVYEKESILFPVNGVDFSLSGRILFAGYGDYRVGVWDSLKCARHSVLYGHENRISCLRTSPDGTAVCSASWDCTIRIWA

SEQ ID NO: 5113 - protein, 146 aa, Caenorhabditis elegans
MNQLCRAVPSLRSAVRLASSGRLYTKKHEWVLVENGVGTVGITDFATEQLGDVVFIELPDEGTEISKGDSTGAVESVKAASDIYAPISGTVTQKNVKLEEEAGLINKSPFEKGWLYKLKVKSADELEKLLNEEQYAKFKKDEEAAH

SEQ ID NO: 5114 - protein, 590 aa, Caenorhabditis elegans
MGFRIRINKLDVFLVVIAIVFIVFGIVTWAAFSSIYSTLVIKNLQLTENSDTSLGYSAFQYTSPQVDNIMKFYFFNVTNPDEVKYYSAAPNLVEIGPFSVMESEQKKYLEFSDDKSQMFYQNYKKYILSKDYSCEDCDWDRNIVFPNPPGLGAVASMLDPQFQITKTGRTIIAVALTILGEYPFVSHKVREVLFDGYEDALLSAAHSGFVTVLSGIFKGDGGSIVPIPIPAMPKFGYFQGYNNSRDEEYWIETGKKDINQIGNVQRWAGITELPGEWWTTPKARSIRGSDSGSFTQMHLDESSTADMFFSFMCRSFTKTFYQRETIESIPTIGYHIGYDEWDTTSDNNVGFRYRNIEKRNYFPDWPKCPPKGQCHQSGSIDCSKSINFCHACCDGSLYNGTYLLPPGMFPLVCYPGRLQPTPFAVVYSPPHFLFSPDEVRTTVVGMAPNKSLHEPMIYYHEPYSGTTLKVVNRLQVNMPVIRSHDVPSSQNMPNVMIPLFWQDTSPKYHQFIFNEVWLGFVLVPRLMRVLQFVALGIGLLLVAIIVFLQLRKGKPSLIRPLKTSFLETTSNWLSSTSSSNSNESRGLRRM

SEQ ID NO: 5115 - protein, 354 aa, Caenorhabditis elegans
MGCTMSQEERAALERSRMIEKNLKEDGMQAAKDIKLLLLGAGESGKSTIVKQMKIIHESGFTAEDYKQYKPVVYSNTVQSLVAILRAMSNLGVSFGSADREVDAKLVMDVVARMEDTEPFSEELLSSMKRLWGDAGVQDCFSRSNEYQLNDSAKYFLDDLERLGEAIYQPTEQDILRTRVKTTGIVEVHFTFKNLNFKLFDVGGQRSERKKWIHCFEDVTAIIFCVAMSEYDQVLHEDETTNRMHESLKLFDSICNNKWFTDTSIILFLNKKDLFEEKIKKSPLTICFPEYSGRQDYHEASAYIQAQFEAKNKSANKEIYCHMTCATDTTNIQFVFDAVTDVIIANNLRGCGLY

SEQ ID NO: 5116 - protein, 722 aa, Caenorhabditis elegans
MSWVRFTKTGVAVVATSAAAVLALDMTNERRFQRQVKDHFRTVHADRLAELNKRAPSALPTRKDILTNLSKGEEFDVLIIGGGATGAGVALDAQTRGLKTALVELDDFSSGTSSRSTKLIHGGVRYLQAAIMKLDLEQYRMVKEALFERHNLLEIAPHLSSPLPIMLPIYKLWQVPYYWSGIKAYDFVSGKRVLKNSFFINKSQALERFPMLRNESLKGALIYYDGQHNDARMNLAIILTAIRHGAACANHVRVEKLNKDETGKVIGAHVRDMVTGGEWDIKAKAVINATGPFTDSIRLMGDPETARPICAPSSGVHITLPGYYSPSNTGLLDPDTSDGRVIFFLPWERMTIAGTTDAPSDVTLSPQPTDHDIEFILQEIRGYLSKDVSVRRGDVMSAWSGLRPLVRDPNKKDTKSLARNHIIEVGKSGLITIAGGKWTTYRHMAEETVDRVVEVHGLKTENGCVTPGLLLEGAHDWNSLQYIHLVQDYGMEVDVAQHLSNTYGDRAFVVARMCKMTGKRWPIVGQRLHPEFPYLDAEVRYAVREYACTAIDVIARRMRLAFLNTYAAHEVLPDVVRVMGQELGWSSAEQRAQLEKARTFIDMEMGQNAKQTAVSNVALNLTKEEMQRAKERFQQLDKDRKGHITVNDLRKHFREHNQKIDERVLHELLNEVDLNKNGEIEIAEFFQLYSGLKGGQLTGNRLVGYLDEIHGTPSVNRACGGI

SEQ ID NO: 5117 - protein, 722 aa, Caenorhabditis elegans; identical to SEQ ID NO: 5116

SEQ ID NO: 5118 - protein, 540 aa, Caenorhabditis elegans
MGLRSHEQLVVCVGVMFLLTVCITAFFFLPSGGADLYFREENSVHVRDVLIREEIRRKEQDELRRKAEEANPIPIPKPEIGASDDAEGRRIFVKQMIKFAWDGYRKYAWGENELRPNSRSGHSSSIFGYGKTGATIIDAIDTLYLVGLKEEYKEARDWIADFDFKTSAKGDLSVFETNIRFTGGLLSAFALTGDKMFLKKAEDVATILLPAFETPSGIPNSLIDAQTGRSKTYSWASGKAILSEYGSIQLEFDYLSNLTGNPVFAQKADKIRDVLTAMEKPEGLYPIYITMDNPPRWGQHLFSMGAMADSWYEYLLKQWIATGKKDDRTKREYEEAIFAMEKRMLFKSEQSNLWYFAKMNGNRMEHSFEHLACFSGGMVVLHAMNEKNKTISDHYMTLGKEIGHTCHESYARSTTGIGPESFQFTSSVEAKTERRQDSYYILRPEVVETWFYLWRATKDEKYRQWAWDHVQNLEEYCKGTAGYSGIRNVYESSPEQDDVQQSFLFAELFKYLYLIFSEDNILPLDQWVFNTEAHPFRIRH

SEQ ID NO: 5119 - protein, 4753 aa, Caenorhabditis elegans
MILRLLIFTALAVTTANSSTRQQSTFHSIQVDSPPSVRSRIISASVNTASSVCNENDFRCNDGKCIRTEWKCDGSGDCSDGEDEKDCPHPGCKSDQWQCDTYTWHSVSCIAEYQRCDNITDCADGSDEKDCPASTVDCSSQNVFMCADGRQCFDVSKKCDGKYDCRDLSDEKDSCSRNHTACFQYQFRCADKTQCIQKSWVCDGSKDCADGSDEPDTCEFKKCTANEFQCKNKRCQPRKFRCDYYDDCGDNSDEDECGEYRCPPGKWNCPGTGHCIDQLKLCDGSKDCADGADEQQCSQNLCPSLGCQAGCHPSPHGGECTCPSGYKLDDRFHRTCSDINECAEFGYCDQLCANHRPGFTCSCLGDCFTLQMEHGPGKDNLTMRGYCVSNNADKMKLFVARREGLYRLNPKNPDEEVKKLASGEFIYGIDFDYGDRKIFWTDRLAHSAFSADVDDEGEISQIKKLSLKSLVYPRCLAVDWITNTLYIIESGSRRIDVSSYDGERRTVLLADGLTLPLDIALDPLRGEMFFTNQLKLEAAAMDGTNRRTLVNTHTHQVSGIVVDITAKRVYWVDPKVDRLESIDYQGNDRRIVAQGMNVVPHPFGLALFDQYLYWTDWTRLGVIQVEKFGSDTKLLWSNTENNVFPMGISAYHPMAQPGPGQSECLAMKIENPCTNADCEGMCILSKDNGGFGVGYKCACPIGQKLVNGKRCIDSIDYLLFSSNKIVRGIFPEINEKALAEAVLPISPISQRRIGMYFEVECDVHGNSFFYADIMDNTIYRIRPDGEGAAPVLVTHNDGLFSMSFDWISKQLYYVDNIRNSLEVVKIGETGLVHPDELVRRQLITELRDPVSVVVHPWKGLLFYAEAMRPAAIYRCHIDGQNCQVIRNTTLGRPSEMAIDFAENRLCWGDTLLKTISCMDFDGKNVVKLDIDNPIPVAITIMNEYIYYVHQRPYSIRRVHKKNGGGSKIVREFGADERSIFSLKACSHQNQPIPDDSREHPCRASQCTQLCFATPSESHPNELEAKCACRQGFMINKENNHSCQKDPAEKIEQLCSSNSTQFQCKNGRCIPKEWKCDGENDCLDESDEIDEKGDKCFHETECAENTIKCRNTKKCIPAQYGCDGDNDCGDYSDEDVKYCKDGQKPVCAAKKFQCDNHRCIPEQWKCDSDNDCGDGSDEKLEMCGNATCAANQFSCANGRCIPIYWLCDGDNDCYDGTDEDKERCPPVQCSALQFRCANGRQCVPLRNHCDGQSDCEDGSDEDSCAVTAESCTPDQFKCVSSGLCIPASWKCDGQQDCDDGSDEPKFGCTSGRQCSSDQFKCGNGRCILNNWLCDGENDCGDGSDESSERGCKTSMNARKCPFEHVACENDQETCIPLHQLCDGKTHCPGGTDEGGRCARDLCSADRAGCSFKCHNSPNGPICSCPFGEQLVNKTKCEPENECLDSSSCSQRCKDEKHGFTCSCDEGYELDVDKRTCKVADNVKDTRIYVSNRNRIYYSDHKLDNWHTFGAIVENAIALAWDSLTDRIYWSDIREKKILSANRNGTNATVFIADGLDITEGIALDWVGRNLYWVDSSLNTIEVANLEDPKQRTLLVHQNVSQPRGIAVDPRKGVMFWTDWGQNPCIERASMDGTDRQIIVKTKIYWPNTIALDYTTDRVYFADSKLDFIDFVNYDGSGRTQVLASSKFVQHPHALAIFEDMMYYSDRRLQKLQVYPKYPNGTTSEYPSHTFSKALGVVAVHPVLQPVIKNNPCSTNPCSHLCLLNNKNTFTCKCPMGEKLDASGKKCIDDAKPFLVIIQKTNVFGIEMNSASEKETPVLAGMVPLSGLGNAFDAAYDALSEEMFILEHTNHAKTLAQITTDSAIYRSTVNGGNKTKMFSSAVPDDAYCLGFDWNGRNLVVGNKITQTIEIIRTQGKQYRSVILSNDQSPTAVVTPVAIAVDADKGYVFWLDRGGGAADAKVARAGLDGSNPLVIASNDLAELDHIAIDTTNTRVYFSEAKAGRISSVTYDGQDRHYVLSDGGRQPNGLAFYGDRLFYADSAFDSIEVATINGDSQPPQWTHFKKDVENLANIKALQPRASSSGHPCHINNGNCDHICIPLMFAQRTCTCANGYVKDGQTSCKLFDESFVIVATKTKVIGYPIDETQSKGVAMEPIGGLSITGVDYDYESKTIYVAEASGINKGITAYTIGESSPRAVIRDSIGSLTIKSLAIDWINYNMYFINHDAERTNIEVSKLDGTYRKILLTTKTETPSSIAVDPVSRYLYWADQGQKPTIQRSFLDGSRREVIVSSGIAEPTDLVVDVASKMIYWSDAKMDGIYRVRSTGGTPELVRSDIASAAGVALHGQNMYWTDNRLEKLFRATSKPNQTSLLLSPTTVAASLKDIGDVAVFSSNNQPRASSPCQITDNLRKSPCTQLCFATPGTQTPTCSCARGVLKGRTCEEPDTYIMFSDGDKIIDVAIEPDVKASRPLKDPFPEISNLQTFDVDVNLRRVYFVVESPVGVNISWFSMNNAENPRLVFGASKQPHAKEIRHISDMKLDWLTQKIYFTTGRGGKVMAIDTAGEHLSTIASGDWTYALAIDPCSGLLFWSDSGYKTSGGLYEPRIERSNLAGGSRKVIVSESISLPAAIAVDFRNQKIYWADVNRLNIEVADYDGQNRKVIASGYRAKSLDIWDRWLYMSDPLSNGVFRIDKESGSGLENVVSDRRIPGALRVFASESDVRTRNQVCNALTSQLCKTDNGGCDQLCTVVADDIGLAASKVQCSCNDTYELVQEPGKDYPTQCVLRGSNSEPAKECLPPYNFQCGDGSCILLGATCDSKPDCADASDENPNYCNTRSCPEDYNLCTNRRCIDSAKKCNHIDDCGDGSDELDCPSAVACAEGTFPCSNGHCINQTKVCDGHNDCHDEQVSDESLATCPGLPIDCRGVKVRCPNTNICIQPADLCDGYDDCGDKADENQLFCMNQQCAQHYVRCPSGRCIPETWQCDGDNDCSDGWDETHTNCTDTAGKKICVGDYLFQCDNLKCISRAFICDGEDDCGDGSDEHSRHGCGNRTCTDQEFHCTSNAKLAQPKYECIPRAWLCDGDVTCAGGEDESTELCKTEKKECNKGEFRCSNQHCIHSTWECDGDNDCLDGSDEHANCTYSSCQPDFFQCANHKCVPNSWKCDGNDDCEDGSDEKDCPKNSASAQKASKCSNGQFQCTSGECIDDAKVCDRNFDCTDRSDESSLCFIDECSLAEKPLCEQKCMDMKIGYKCDCFEGFAIDISDQKSCHNVNECYEGISGCSQKCDDKIGSYKCGCVDGYQLSSDDHSCKRTEMEPEPFFLLANKHYIRKISIDGNKYELAAQGFDNVVSLDIDLTEKKAYLIDQGKLRLLRVDLDEMDSPLSSYETVLRHNVYGTEGIAVDWVGRKLYMLNRQERSIRVCELDGRFCKTLIRDRIQQPKAIVVHPGKGYLFFTEWSLQPYIGRIALDGSPELQDPIFKLAEHDLGWPNAIAIDYFSDRLFWGDAHLNEIGFMDFDGNGRRHIPAQRTSHVSSMVVFDDYLYWADWNLREVLRCDKWTGKNETILKKTVQLPNDLRIVHPMRQPAYPNPCGDNNGGCSHLCLIGAGGNGYTCSCPDQFVLLSDQKTCEPNCTERQFACGGDDAKCIPKLWYCDGEPDCRDGSDEPGESICGQRICPVGEFQCTNHNCTRPFQICDGNDDCGDSSDEQNCDKACDPWMFKCAATGRCIPRRFTCDGDDDCGDRSDEADTLCMSAERNCTAEEFRCNNNKCIAKAWRCDNDDDCGDGSDETPECAQIECKKGWTRCSSSYRCIPNWAFCNGQDDCRDNSDEDKQRCPTCDDVGEFRCATSGKCIPRRWMCDTENDCGDNSDELDASCGGTTRPCSESEFRCNDGKCIPGSKVCDGTIQCSDGLDESQCTLRRCLPGHRQCDDGTCIAEHKWCDRKKDCPNAADELHCEDVSRRTCSPFEFECANSVCIPRKFMCDGDNDCGDNSDETSSECRSAQCDPPLRFRCAHSRLCLNILQLCNGFNDCGPNDFSDEHLSMCSSFSEYGDCSSDQFKCANGKCVNGTVACDRKDDCGDASDEIGCSKHGGKTSCEAFGNNGGCKHICTDVRDGFYCHCRDGFRPDPQSPKECIDIDECAGNNTCTQLCLNTKGSYLCRCHEDYENNVVVGSMTGKDCRAKGDAANVMIGADDSLVQLSLHGSGTNRHAAAKANDDDNDIIGIAFDPRKELMYWIDGSERTIYRSAIANGNQSHEGQKLDVDFAAMGVVPTAIAVDYTTGNLFIAAVSENIENGLVTARKKRMSEPIDNQNTGFIFVCLPDGRYLKKIVAGHLQQPTALITAPSAGRICYSDAGLHAKIECADMDGTHRQIIVKDLVFSPTSMAIDEGKGNRIYWVDPKYRRVDAVNIDGSERTTVVHDRHIPYAVDVFENHIYWLSRESKTLYVQDKFGRGRVSVLASDLEDGHTVRVSQKYAKDTQRTVSGCERAQCSHLCVSLPSTGFACLCPDGIVPQLDGSCATQHVEALTMPKQCKCTNGGKCRLDGSCECTSDFEGDQCEKESSVSRKIIGTLSENFITVLLYILAFLFAFGLIGFCALNLYKRRQLLFKKNEAADGSVSFHGNVISFSNPVLENKQDAPGSEFNMQQMTSMHDDSTTFTNPVYELEDVDMSSPPPSNDQPSTSASAMSPNRPSTSAASSFVPPTFDQDEIELKTADEIIVPKAEISKPPIPARPKKEKADPLRVDNPLYDPDSEVSDV

SEQ ID NO: 5120 - protein, 366 aa, Caenorhabditis elegans
MSSRAVSLFSKCGSRISQTRGKAHFTFQPSTTLPAGLENLEKTKMNLMQSVNEAMRIAMETDDSAVLFGEDVAFGGVFRCSLDLQKKFGKDRVFNTPLCEQGIAGFGIGVAAAGATAIAEIQFGDYIFPAYDQLVNEAAKFRYRSGNQFDCGKLTVRTTWGAVGHGALYHSQSPEANFTHTPGLKLVVPRGPVQAKGLLLSCIRDPNPCIFFEPKILYRLASEDVPTGDYTIPLGQAETVRSGKDLTLVAWGTQVHVALEAAQLAKEKLNADVEVIDLQTIQPWDEDHVVESVQKTGRLIVTHEAPISSGFGAEIASTVQKRCFLNLESPIDRVAGFDTPFPHVHEPFYLPTVHRVFDAIKKSVNY

SEQ ID NO: 5121 - protein, 824 aa, Caenorhabditis elegans
MSPVPCLSTCCCFRKIVEYSTMSWFRKSANDSLLETNHDRIPVAPPREVRAPSPRLPPSYQTSNEKMFRVRKAPSEEHTLANYAYVNRSDFDDKQIKHVRVNPGPAHHYIFSIRNDGSIKPGEIAFGVPHRKWAALSLDQEVRVTPFTFQQSEYVGSMILTADFNAKKNVTSEPLNADLMAREFSIQFGGQAFSKGMQMAFRFEDKEKNKTHTLSLVVKSIEGFDIGKAAAAASGASNTDSSATKPKQIEAGELLPNSVIVFDKEEGSMLNLIGKSKGKSAYRSIINPDWDFQQMGIGGLDTEFSHIFRRAFASRVFPPEFIEQLGMKHVRGILLFGPPGTGKTLMARQIGKMLNAREPKIVNGPQILDKYVGESESNVRKLFADAEEEWRRCGANSGLHIIIFDEIDAICKQRGSMAGSSSVHDTVVNQLLSKMDGVEQLNNILVIGMTNRRDMIDEALLRPGRLEVQMEVSLPDETGRLQILKIHTARMREYNKMDPNVDLEDISKRTKNFSGAELEGLVRAAQSSAMNRLVKAGGKAQADPDAIEKLAINSGDFDYALENDIKPAFGRSDESLNRFLSRGMIVWGPEVTKILDEGSLLAATVKNPENSGFRTVVLAGAAKTGKTSLAAQMAKSSDFPFVKVISPEDTVGFSESAKCMALKKAFEDAKRSKLSVLLIDNLERLIDYHPVGPRYSNLVIQALLVLLNAPPPAGHRLFVIATSSDRMFLRDMGLMDVFGDVIDIPKLTTAGQMMNVIQESNIYSDDQLPMIEQKLASICRGEGFHGVGIKHLLELIESARQCEADYRVPTLLNMMEGLALNLYR

SEQ ID NO: 5122 - protein, 824 aa, Caenorhabditis elegans; identical to SEQ ID NO: 5121

SEQ ID NO: 5123 - protein, 645 aa, Caenorhabditis elegans
MDSENSSSHSISSPQMFQNTHNNSAMEDNLLSRPMNNESLQMIIGYLRRNGLTETEELLTREAGPVLRVEGSNGLPPEEAISVEFDTFVQHANDCTDVVQAEFSQLLFPIFAHSYIALIEKHAATARIFFNRFKIFIPECFSEFVYQLSLIEDAMTLRANEHVHILRENKFLVRLSRPTLKHLESIQTRVIGVKNIIAKHICIENADEVSTNRTTIETQMGGILGVTSKSDKRHKMMFSVLKDELMQNIEKRKTKGKDWKDMGKKMQTHCPQADRIPLPPISEHLREERRNWLRDVGKMAIISAESPVSICMYTTVNAPIGVASCDFTDDSSLIAMGLSDSSIVMNAMDPMNKMKKLRDMEFLDKIDIETADNVQSQMFDLQGSTTSVRYTGHGGPVFSVNFSPDRRLLISSAGDRTVRLWSMETQRNAVIYRTPAVAQFCSRGYYFATASADKTAAMWSTDRMHPLRIFADPYGDVGCIDYHPNCNYIAGGSDDRYVRVWDVCSGTRVRIFSGHKASIIAVKFSPCGRYIVSLDAIGNLMIWDLAYQRLVAAEITEQAGTKGSITFSRDGGVFAVSHGNSSIQLYSLDTLIGTVLAAGQNDSYIEPKVNLDGFNIGSYATKETAVIGLHFTRRNLLLGFGCFGQ

SEQ ID NO: 5124 - protein, 645 aa, Caenorhabditis elegans; identical to SEQ ID NO: 5123

SEQ ID NO: 5125 - protein, 654 aa, Caenorhabditis elegans
MSVDPNLLTPYKNTGAANASLRQISEDAFYVVNEVVMKRLGHVPILKGDFHLLPAKVQRFIAEKAELMRPRGIFICDGSQHEADELIDKLIERGMLSKLEAYENNYICRTDPKDVARVESKTWMVTKNKYDTVTHTKEGVEPIMGHWLAPEDLATELDSRFPGCMAGRIMYVIPFSMGPVGGPLSKIGIQLTDSNYVVLSMRIMTRVNNDVWDALGNQDFVRCIHSVGLPRPVKQRVINHWPCNPERVLIAHRPPEREIWSFGSGYGGNSLLGKKCFALRIASNIAKDEGWMAEHMLIMGVTRPCGREHFIAAAFPSACGKTNLAMLEPTLPGWKVRCVGDDIAWMKFGEDGRLYAINPEAGFFGVAPGTSNKTNPMAVATFQKNSIFTNVAETANGEYFWEGLEDEIADKNVDITTWLGEKWHIGEPGVAAHPNSRFAAPANQCPIIHPDWESPQGVPIEAIIFGGRRPQGVPLIYETNSWEHGVFTGSCLKSEATAAAEFTGKTVMHDPMAMRPFMGYNFGKYLQHWLDLKTDSRKMPKIYHVNWFRKDSNNKFLWPGFGDNIRVIDWIIRRLDGEQEIGVETPIGTVPAKGSINLEGLGEVNWDELMSVPADYWKQDAQEIRKFLDEQVGEDLPEPVRAEMDAQEKRVQTL

SEQ ID NO: 5126 - protein, 666 aa, Caenorhabditis elegans
MRYLCKSILLAVHTILLVGSVCCSTDVHNTDDKYALIHVSAHDEQSLHLIKQLQLNDFKYDLDFWKSPSSISDKADIMVKRGKSERMLRQILSFANVTVSMSVPDVEKSTELYQFSADLDLTKVGALKKAKYPFGDYASYADMVKYMRTIEFYYPRIAKIVRIGATHEGKPIEGLKIGARSSHKKRAVWVDGNIHAREWASSHTALYFINQLVSEYGKDAQITNYVDTLDFYIVPCLNPDGYEYTRTSPIPTVRLWRKNRSPELCRPSLWGGEKCCRGVDLNRNFRFHWAERGSSYEPCSNIYHGEEVFSEPETRAVRNFLATPEMKDRVDAFVTLHSYAQLWIYPYSHEEQNYPEDIGELRKTARKAINRLSRVYGTNYRMGTGADTLSPAAGGSDDWAKSALNVKYVYLIELRPQMELSNGFILHKKELIPTAVETFEGFREVVDAVLTLNNSTSSIGLSSGSNTSRKTISDLQMRKQQCKFFENTNAYSFDNIFRSYETVGISSSWKYYKKYYNTQNFHYICIDNEGSLYFCQCIVSATSPSKTSRHFDRFTADLNSSTRARPTPPMAPPIMSPSTEFSTTTTEEEDVTGVIRSSSIASRATTYGFFTATKPSAFLDPECRDMRYSCGFWLKNNKQVCEEQQSFMRAQCAYTCKFCTSFIKRH

SEQ ID NO: 5127 - protein, 424 aa, Caenorhabditis elegans
MSPSAARGSQEEKRGSRIPAGGNSICHPRHHIPMQDGSSGAASLGNSSPDATDCVVCGDKSSGKHYGQFSCEGCKSFFKRSIRRSLSYTCRATKNCAIDVQHRNQCQYCRLTKCIRMGMRKEGRRSNETQTAVSAVQRGRLPVTMPSLFPPNMFLRSPFPFMSVPFNPLMTAQFTKPSIKESIFEFAAQTIFATVNWARTSMSNLVKGDQLILLRHSWTPIFIFALAQSNFALNLSTHLTAVTATAASTENGSSSLGSKSEDEEKSEEKPERVFDEPQFQGFQAKIDKIRDFHLDVVESSSLRAVLLFSCGYRNIHYFEVASVILIIGLISDEEALEEKGKIEEIVEKLKSAVDEYCKMNKRSERYHQICECLQLLKSTRNLPISRLFFSRLLGTTPLETILSDLLITPPPPTLPFFPQLPSRN

SEQ ID NO: 5128 - protein, 2020 aa, Caenorhabditis elegans
MTSSRQKDDEIDQLRVCFFKYFYSYSFISNFQAKTDFLNPSISADWAKKKLMWVPSEKDGFALGAVIGEPHADGTIDIELMETGERQRVSSDDCQKPNPPKYDKCEDMSMLTCLNEASVLHNLKQRYFSNLYYTYSGLFCVVINPYKRIPIYTDTIAEQFKCKKRKEMPPHIFAVADEAYRSMLQERDDQSILCTGESGAGKTENTKKVIQYLAYVANRSMVKNRKTSVDLDTSTNRIMGQLEEQLLQANPILEAFGNSKTVKNDNSSRFGKFIRVHFDSTGCISGANIEFYLLEKSRVLKQAPNERSFHIFYQLLKGLSKVQREHYLLEDSLSKYKFVSNGDSKLAGVDDGAEMKETLNAMSIMGLNDEEIGGILRVVSAVMLFGNLEFSHENKNNDQAVLLNDAVAQKIASLLGVNVTELMRAFLKPKIKVQRDLVHRAQSVDQVNFSVGAIAKASYERLFRWLVHRLNKSLDRTRQQSVSFIGILDIAGFEIFETNSFEQLCINYTNEKLQQLFNNTMFVREQQEYLDEGLEWKFLDFGLNLQPTIDLIDKPMGIMSTLDDVCLFPQGNDQSFVQRLNNTHSQHPKYVVPEIRSRSDFAVVHYAGRVDYQSEGWRVKNMDPLNENVIDVLKTSKESLIVDMWKDIADVCSLSAADSTSDTGVFGSRVPKKGMFRTVSQLYKEQLARLMSTLNNTNPHFVRCIIPNHEKKHGVLNAHLVLDQLRCNGVLEGIRICRQGFPTRLPFQEFRQRYEKLLAPDVNPAGFMDGKNAVYRIVQYLEVDANLFRIGQSKIFFRSGVIAEFEEMRDQKLSALIESFQAQCRGWLGRRVMVRRREQEVAIKILQRNGLAWMRLREWQWWRLLTKVKPLLEVTNKDELIAEREQELKVTAEKLRRSEVFISDYKQQMEKMDEERLVLKTRLDAESSERAEIFEERSRMAARRDELEGILEEVSKRLEIEEQKAKKADSESRKLTEMVRHLEENLEDEERSRQKLLLEKNSIESRLKELEAQGLELEDSGNKLSKEKKALEERCEDLSSRLIDEVERSKQLVKAKARLEATVAEINDELEKEKQQRHNAETARRAAETQLREEQESCLEKTRKAEELTNQLMRKESELSQISIRNDEELAARQQLEREIREIRAQLDDAIEETNKEKAARQKAEKARRDMAEELESYKQELEESNDKTVLHSQLKAKRDEEYAHLQKQLEETVKSSEEVVEEMKAQNQKKIEELNETIDQLKRQKISADKAKSSAESDNENFRAELSNIASARLEAEKKRKAAETSLMEKDHKMREMQSNLDDLMAKLSKMNNELESIQKAKSADETLNSNLLKKNASLDMQLSELTEASEEDRRTRATLNNKIRQLEEDLAVAVEARDDALDAQEKIEKEVKEVKSLLAEARKKLDEENREVMEELRKKKEKELSAEKERADMAEQARDKAERAKKKAIQEAEDVQKELTDVVAATREMERKMRKFDQQLAEERNNTLLAQQERDMAHQMLRDAETKALVLSNELSEKKDIVDQLEKDKRTLKLEIDNLASTKDDAGKNVYELEKTKRRLDEELSRAEQQIIELEDALQLADDARSRVEVNMQAMRSEFERQLASREEDEDDRKKGLTSKIRNLTEELESEQRARQAAIANKKKIESQISELTEKNEASLRQIEDLSRQLRKAQLGWKDLQLDVTEARAAMEDALAGQRDAEKRARASEDEIKRLTADIQAVSSSKRKAEAERDELIEEVSSLRASSFSNEEKRRLEAKVIDLEDQLDEEASANELAQEKVRKSQQQLEQMTADLAMERSVCERTESDKIALERANRDLKQQLQDAENTAVARLRTQINVAEAKVSSLEQQLSLEEQDKMRQGRTLRRMETKMAEMQQMLEEEKRQGESNRQAVDRQNARIRQLRTQLEDTEAERDRLTNKLKDERRRAEEMTDLNETLSRDVSLLKQRETTARRTPGLIGHRESRRFGSNTSLARDEFRGSALTNEMSPSDRPASRLTSGTGSQLGNTDEDRDSVRN

SEQ ID NO: 5129 - protein, 2020 aa, Caenorhabditis elegans; identical to SEQ ID NO: 5128

SEQ ID NO: 5130 - protein, 346 aa, Caenorhabditis elegans
MGKNFGKLISFIFNEGDEAALLKSLEGVPDAEKVQKLIKKLAESEKQNAELKIKVLDYDKVVKVKDLTEKKLERNNQILLRTEEAKSKLEELCRGLQKANHQTREEACAKMKKLEVERGLAVEQLKVTLKDIEKTMAEGRSKSDSLAEDNKKLSEKFSEIGHQYEEKMKVIDQQIQKKEKYWEEYGKTKDLEIKLLTAKLESASIQVKKSGMEKDELAKIMLEETARVGGALKTEKALREQVQEYSAKYSELTSCLSKSNEAFDKFKDEISRVNKKCMQVEKEGLSYKKKSDEANKKVLVLTMTNQEYAEKIATSDKKIQMLENLCRALRKGEQEPVTTAETTEAN

SEQ ID NO: 5131 - protein, 794 aa, Caenorhabditis elegans
MSTPAIKKPKKAPPRSNRKKNLTKELSREASRMGAPSQMGAPSAVTPIPVPVSDPTKKGTTMSTMSQVKSTKSKNHKKEEKKKGSKNDEADSKKPDSASKDDESSTKKEKEPKKFLKIVGGREIKLQEHLRNPVHLGEFNAVNEKNEKFIVRLEPSNRGKLKFGSDVVAEVEKLFAGQEKVPVLRNIEFCQTQHLNYWIISPFSLQILEILRIVKALTVPCAFNVALQTLDAIQYLHQAGFLNRNIKPASFSVGLNEEETKIYMTDYRLVRTHIDPSTKKVRPARTGLKYGGTARYASIAGLKKKDQGRKDDVEAWIYMIYDLIDPENGLSWRKSPRCNMMIKEKENFKYHVLPHTYDKVPEEFKKLVDLVHGYSYDSLPDYAAFKEIVQNVGKSKGHDMTTCDWVGKITPVNQEIAIKTAAEKSTGNKCSGDDDFEFKTARPVRKIMNPDDVITNGQYAWKVVRLLGSGGFGDVYKVFDDKAKGPKKTHYALKTESEGGKKAMLRLKVEMQVMITISDARKKSKGDVNRHFVDFIDRGKSEELKCKYIVMSLVGPSLDDCRRKFGVNLSNTSTPYIIAIQTLESIRDLHNLGYLHRDIKPANFAVGVGAKESTVFMLDFGIGRSYLDPKTKQHRAPRKKVKFLGTLRYASRACMLEVDQGRKDDLECWIYMVFDIFDPKNGVSWKKQRDRVKIREAKQLFFDGKAQYDYAPISLRPIIIYINSLQFQTTPEYANLVKTLYTSSSASGYPIHSLDDGGWVGKLKKEAKSKMEKKTARFGDSSSESGKQSGTDED

SEQ ID NO: 5132 - protein, 794 aa, Caenorhabditis elegans; identical to SEQ ID NO: 5131

SEQ ID NO: 5133 - protein, 785 aa, Caenorhabditis elegans
MEDILMPEGEKVSMENFALLRVLGKGAYGKVFLVRKVGGKDHNTIYAMKVLRKTRVLTKQKTLEHTMAERQVLERLRGTPFLVNLFYAFQTDTKLHIVMEYVRGGELFTHLCSRGHFDLEAARFVIAELVVAIDSLHQRKVIYRDLKLENILLDEEGHVKLTDFGLSKLFLPGELDRANSYCGTIEYMSPEVINRPEGGYSDVVDWWSLGVISFELLTGCSPFTVDGAQNSSKDIAKRIMTKKVPFPKTMDVDARDFIGQLLEKKLEKRLGYNGVDEIKNHKFMSSIDWDAAVKRTLKPVIVPRIGHDLDTQFFSAEFTSQPPLYSPAESPLNANTLFRGYSYVSPSVIFANDNVIGEELMAEDVNALLASSSFFAKYKLDKSDAGLLGKGAFSVVRRCERVVDGAQFAVKIVSQKFASQAQREARILEMVQGHPNIVQLHDVHSDPLHFYLVMEILTGNELLERIRKLERFTESEAADIMRQLVSAVKYLHDKRIVHRDLKPENILFESIDSSARLRLVDFGFARLLPNSMEQQLKSVQVLRKMYGLIAHNHSLHSETPCFTLQYAAPEVLDVGDSQPEYNEQCDLWSLGVVLFTMLSGQVPFHARSRQESATEIMQRICRAEFSFTGDAWTNVSADAKNLITGLLTVDPKKRLSMQELTAHMWLKSSASMDTPLQTPSILPSSADETFNETLRAFLHANRDGFHLLDVAAAPLMKRRGIKRQSGDKDASGNSKNSRVTQFECLPEEQEAEMTSSTSRPSNLGMMNYREPNSGTIRETRGSDSS

SEQ ID NO: 5134 - protein, 724 aa, Caenorhabditis elegans
MSSAKKKPSLVTCPQCNAVVLTKDSLRHQDFCGKPVVESEIACAQNGTLRGFNVAVDKAEGFLPPDAVGWEKEHSILINQQTMESLGLLARQPVRIIHSSDSFIGIVWPCKEVALLKVSIISSRIARERMITLESCGRVEKLKSLSVTVKTSLTLNPALSGFLEAYLSHSYLQYNSSVDLKYLGQNVTVTPEEPIESKMSAMGIDDDKKRNSKVVSTAVGYKIQILNASAEGSTSDVLQTLPTDLSNIGGCFTAKQVLEDYVISPVRQKESPCSVLIWGLPGSGKTLLLKEVALVLSGSTTYIGSCEELMELNGVTTGNIVIVDVNELEKENTKANRALSFLLGDEKKCVILCVRSSETLDIGFRVRFPIEAEITVPTQDERLDILSKIGNIYNFPLELHLDVARHTHGFTGGDLCSLLKAAKFARGRTHLERVNDARKRIRPTGIRQFILEVPNVSWNDIGGNEELKLEIQQAVIWPQKHPEAFERFGIDPPAGILLYGPPGCSKTLIARALASEAKMNFLAVKGPELFSKWVGDSEKAIRDLFSRARQVAPTIVFFDEIDAVGSSRGSEKSSGVSDRVLAQLLTELDGLEKSSRVILLAATNRPDQLDSALLRPGRLDRAIYVGLPCEVTRRAILEMRTKKMKFDDTVRTIDKLVEKTSGYSGAELVAVCRTAAMFAMRESIDATIVQWTHFEQALAAVVSRTEAYLLEIYDDFKAGRASNA

SEQ ID NO: 5135 - protein, 333 aa, Caenorhabditis elegans
MDENNLRAASNFHSLQIVCPLAGIPMIEVLTRKELSRIMNKFPYVAVVGVIDFKRNRGHREELENTRFMQAVSHRSIFPLAVNQPSWSSLSSRLLCSLGGPPSDEEDSTRMSAVSNGNPSIVSPRGEHKGTLIFLHGLGDQGHGWADAFKTEAKHDNIKFICPHSSERPVTLNMGMRMPAWFDLFGLDPNAQEDEQGINRATQYVHQLIDAEVAAGIPASRIAVGGFSMGGALAIYAGLTYPQKLGGIVGLSSFFLQRTKFPGSFTANNATPIFLGHGTDDFLVPLQFGQMSEQYIKKFNPKVELHTYRGMQHSSCGEEMRDVKTFLSAHIAH

SEQ ID NO: 5136 - protein, 4131 aa, Caenorhabditis elegans
MSSDSKDQRKTYFLRVASYLLGLNIVEEKLKSTEPLEIFLDSNTNLLVFSRSEQKLELSNKMKSSAPSANVFRVVFYKTQSVPLNNDNFKSVVNVISANGTLNHVFLKSVQNVFGKELTEGNNMQLIAAVNELEESLLATVEMSGGGSLHDEIRSWKGQTGKPANDYNEAFKQLQLLVETMEERSIDELSELVECFEDTCDELWNCGTPYPQNRMKMLIEYGASYLCETITFKIDDSAIWRNDKVADQLRSAIDVCDQMLIIVRLLTAQTWKRNVEHTWEGDAMEMKFLNGFKDRLDEILSLKSLGGQLEELLEERGVREETEKTIETAMRGMAPLAYNPFTEPNWKSRLLVSERSIEGTIDRTLPILKQRLAPANGDSQSIVLSLEKLKSFLCRSNIKEKLQHEREMFLNRLVSMLSQKNQEFNEKSLQVDAKNFQFLTEVAARIVWIRQQTSQMESIRSLSKMMLNNISNYSAFASKLDEFIEKLQYAEKECFDDWCRETVGLIDNKNETINLETTGKIMYLEASNRELNVNYSDRLLRLLKEVRQLISLGFNIPSKIMSCANNGEKYYRFGVILKQIAHFYNTIDQQMIPSQQSLMLEEAIAFEKLVIPRKDASNSASKVTWNDPKQLEEFIVQLQSAEQKLSNRNRRLRNVHMELIEMVEKLMDLNIVKQNNEWKEIILKIRSKMKEEEIVHGAVKNNMKPWLIHWDFQLYKALLIQYEWGIESIQSQLSTISVSLVFADQKIQLRPTIEEIRSKYYKELCRFLRIPDKFRGVQEDENSTKFYAQMIERSMHLLPTVYEKAEQLMMKVETCDAIFVDWLVISQVDLEELIEENLKTAADWESQFKILKGKAREAERLPHELKFECILVSTAGVKSAIEDAIQRLYDALSWTLRHSISTTSQSISTFLSQAIEVLNTVPQSIDEIAEANAKHVIFAENNRRLKEEWKVMEEQLTLLRSVAGTGMEQIDNLEQTWDRFELMLDGHQSMIKDQVEVLKSNVETSVKGMKDEAEKLKARWEQFKPRNDALQGDREEMLKAIQFIKEKRVQWQQLSDGREKIEKECGQFGLEPPKMDIIDEIDEDIKQFEDNWLIYEMFNNELDTMSQEEWIVFRSKTYLFDEFLQKWMEKLKGTGSQTHMSVRLMKDVEHFKEVSSALKFCRGDVLSADHWHEMFRFLGLPRGTTIEKLKFADLLSVSKNIIENTDQLKQLNSRAQGEVAIRDAIQELTLWAAQTEFTLADYKHSNGQNLKIIKEWKESINSLKDSQALLQSLKSSPYYSQFTDKTAVWETRLADLDVFLAQMNEIQRKWIYLEPIFGRGALPSEASRFSRVDSEYRAILNDVSKDARLVSLCSRQSLKKSLEQIVDQLNRCQKALNQFLEQKRTAFPRFYFIGDDDLLEILGQSTNPQVIQTHMKKLFQGINRVQFSSTGETIISMVSSEGETVPLSKAVRIVPQVESWLQELSDEMRRTLKDLTAQAVADAQPSLAKYPSQVLCLAEEVKFSASIENNLNGSSDLNSFKSQLLEKLKAYTNMKVDDKVSDLKLKSLILDLIHHIDVVDQLLTNQAKSINSWTWQRQLRFYLVNGGIVLRQVSSEFEYTYEYQGNYAKLVHTPLTDKCYLTLTQAMYMGLGGNPYGPAGTGKTESVKALAALMGRQVLVFNCDEGIDVTSMGRIFTGIVECGAWGCFDEFNRLDSTVLSAVSMQIQTIQGAIKSRAGSCTFGGKNVQVNPNSAIFVTLNPAGKGYGGRQKMPDNLKQLFRAVVMGKPDNELISSTILYSEGFVDATALARKIVSVFQLSRQMLSKQQHYDWGLRALKVVLGGCGALRRTQTNKNETDLVVQALLLNTLSKLTFSDSERFNSLIDDIFSNVTKEMTKFEELVEPLGVAAQEMGIKLGDKQMEKVFQLYEQMRQRIGVVVVGAAGSGKSTIWKILQRSLILTKKPLKVTQFNPKAVNRSKLLGNMDMDTREWSDGIITMAAREVTKDTSVHHWIVCDGDIDPEWVEALNSVLDDNRLLTMPSGERIQFGSNVNFLFETDSLQFASPATVSRMGMIYISEEDVTPKDIVASWLVKTTEDLHADMPSWIEEHFWRCLKWVRSHKISGITSFAILKNGLTHLKASKTKTQFLVLLFNGFLPTVTPENRQEFAKGVVFQGMSVPDPKNICYDERIDGIMSYTDDVSQNVTKEEVEREDLRPFVQTADTQRYSDIIGSWLQSGNRESFLITGTTGCGKQQLLKHCFQNDPESQLASLYCSAQSSSSHLLQLIQQNCVQASNPTGRVWRPKDRPNMILFLKGINLPAPDKYGTNELLALLQQLLTYQGFFDHNLEWVSIENIQFVGSMNPIGDGAAVSISNRLFSLLRCVSLNTTDSSQLTSIYRTYLTPILEEVGERNSEIIANRMVDIYNKVQSNFRPTDSVVFLFSPRDLTNWVVSLLRHELDQGKLEAVICFEARRIFADRLPTENDKLKFEEILRNVIPISQANETVIFKEKVYVTTGTVVPGESNTGLPLTPINMSDFNQLLAKSINRFAFEIANFNCPLTSQLAFFCACIDRVLTGPGGHLFLPGRPGFGRRDSVRLVAHMHNIQVFSPPVTANFSAKQFDNELKNVKYILMAITQAVTNNEHVVLILEDHQLRKNIFLQAINSLLASGNVPGLFTQQELDGLVALVSEAANQASFTGALQQFLAHRIRSLVHVVLILEVEANDFKINITENPAILKHCNVIFADRFDRNSLVEIPKIQMESQGITTTDAILTGFNDVLVNLPEHLSIQPIKYRQFVENFFQLLGYKRLTLSVRLERLKGAEDQKLSMEQLKAATEKENVRIEEQKAKIDEQLKEVQPLIDEARRAVGSIKSESLSEIRSLRAPPEAVRDILQAVLLFMGILDTSWEAMRKFLSKSGVKDDIMNFDANRITNEIHKKVTALVKQKSNSFEEANAKRASAAAAPLAAWVKANLEYSKILEKIAPLEGEKNKLVKNLKKAEKQMENLSKGLQSVDEVVGELKRKFEVLMKEATQIKVDLDREQDTIRIAGTLVESLSGEFERWKIQIETFGEEQSKMELCSLITSAFITYLGGCSEKDRKSLLKSMCKMFNMPPTFKPLSFASLETEQLNWKTKGLPADQLSLENGSILFTSCHAPLIIDRSGQVSLFLSKFLEKSETFKAAQPDLMTQIELAIRFGKTIIIDDIVEFDSALIPILRKDLSSQGPRQVISFGGKSIDFNPDFKIYFCTRDEKVDIRPNSYVQLNIVNFTTTISALSAQLLDVAIHLEKPELEERSSSLLRDAELKKLELEGLEQLLLQQLASSQGNLLENTALLDSLNKSKESAEIITKSIVESEQLHKELTTQKDIYVPLSLFTSSLFFSFSNLQFHNPMYNYSVNTIMHLFGKTIKSCEDKSSTRVETLARQMQLTVFYHISRGIFRQDRLMFAVAFINATMPKMFQPKEWELFTGVLVDESTDLSALRVQWISPDRLQSLARIRTHLPSLFNNFQIQDDATWNEFSKTLQCENAFPKNVELKMTHFQKVLFIQAVKPERLYNCLMDFVLKTLNIPSINPPAFELKHIFQESESTEPILFILADGADPSQELSEFASSMNVPYHSISMGQGQEIAAYEAIRESASKGEWLCLNNLHLMLQAVPSIFKHLSLTTPHENFRLWLTTEGDARFPSMMLQQSLKITFEPPPGVRNNLLRTYTQIDRSTKNVITCQSIFVLAWLHALLQERRTFIPQGWTKFYEFGASDVRVAKSFVEQLTANKADWEFVRGILKFVIYGGRIENDFDFKVLDSYLNVLFCDEKINGRAGSQLVKGIDLLATTNVQEYIGHISKSVPSVDEPYLFGLPENIKYSWQIVEADRTISSIRTLALGDTKNALSDQSDKISQIVSLWKKLCQSDDLPKRELPTAIRSADPISEVLCLETINALSLIKQLHRSIGHVAKSMKTPSLASPAVQKTIQSLVFQQTPDEWDSMWAGPSDPADYLNVVVKKTRGTLQLFESSKSSSLLSSPIDFSDLFYPNIFLNALRQTTSRQIKIPLDQLILSSAWTPSQLPAKQCVQVQGLLLQGATFDSFLRETTVSSAAYSQAPIVFLAWTSESSSTITGEQIQVPVYSSSERSDLICSVNMPCRGADQWNIAAVALFLR

SEQ ID NO: 5137 - protein, 234 aa, Caenorhabditis elegans
MSSSEEVSWITWFCGLRGNEFFCEVDEEYIQDRFNLTGLNEQVPKYRQALDMILDLEPDDIEDNATNTDLVEQAAEMLYGLIHARYILTNRGISQMVEKWRDHDFGVCPRVYCENQPMLPIGLSDVPGEAMVKLYCPRCNDVFVPRSSRHQHTDGSYFGTGFPHMLFFVHPDLRPRRPVTQFVPKLYGFKIHPVAYGGQEGNSGGNTANNVAAAQNNTTPAGQQSGGQFNNYGL

SEQ ID NO: 5138 - protein, 235 aa, Caenorhabditis elegans
MSSSEEVSWITWFCGLRGNEFFCEVDEEYIQDRFNLTGLNEQVPKYRQALDMILDLEPEDDIEDNATNTDLVEQAAEMLYGLIHARYILTNRGISQMVEKWRDHDFGVCPRVYCENQPMLPIGLSDVPGEAMVKLYCPRCNDVFVPRSSRHQHTDGSYFGTGFPHMLFFVHPDLRPRRPVTQFVPKLYGFKIHPVAYGGQEGNSGGNTANNVAAAQNNTTPAGQQSGGQFNNYGL

SEQ ID NO: 5139 - protein, 472 aa, Caenorhabditis elegans
MNGDVQSVIRGYLERAQVAKTMSDAGRWNEAGDLLRQLMTDVKSCKISASNRDEHDARNTFLRALEANLKLVQQNVRDEDDLHEAMTRQSGSPEPPADPDVWSKPSPPLPSSSKFGATKKGVGAAGPRPREISKSTSSMSTNPADVKPANPTQGILPQNSAGDSFDASAYDAYIVQAVRGTMATNTENTMSLDDIIGMHDVKQVLHEAVTLPLLVPEFFQGLRSPWKAMVLAGPPGTGKTLIARAIASESSSTFFTVSSTDLSSKWRGDSEKIVRLLFELARFYAPSIIFIDEIDTLGGQRGNSGEHEASRRVKSEFLVQMDGSQNKFDSRRVFVLAATNIPWELDEALRRRFEKRIFIPLPDIDARKKLIEKSMEGTPKSDEINYDDLAARTEGFSGADVVSLCRTAAINVLRRYDTKSLRGGELTAAMESLKAELVRNIDFEAALQAVSPSAGPDTMLKCKEWCDSFGAM

SEQ ID NO: 5140 - protein, 1175 aa, Caenorhabditis elegans
MEEETDEESPAKIARSRSCEPPGSSSRSRESRGSLWMSMGVHVENSRRRRMSKARRESQSIELSSLAPGTRVMFLLKEKENTPALFTEMGELNNEEWRETARWVKFEEDVEQGGNRWSKPHVATLSLHSLFQLRSCIMNGHFMNDLAETDIPSIFNAVIENLEKSGDLPSENREELREILLRKHVHQYEQAKKNGAGGEKGGFLSTVRSISDIGKSFSHGKNLSKIEEKPEGPVTSQTAGAPSGSSNQLTLPTVESVPKDISSEESSKGNLHFLKKLPAGVEASNVLIGEVDFLTRHICCFIRLKNANQLGDLTEVPVPTRFIFLLLGPTGHGQQYREIGRAIATLMADEIFHDVAYGARDVDDLLDGIDEFLDQVTVLPPGEWDPNIRIEPPSKLPSQEKRKQIGQELLVEPSSHKHVKKVVEEEEIHSHGDDPALKRTGKLFGGLILDIKRKAPHFVSDFTDAFNLQCLASICFMYFGLLAPIVTFGGLLEEATHQRMAAMENLFGGALCGVIYHFFAGQPLTIVGSTGPVLVFETIVFDFCHRFGIVYLSFRFWVHVWTAVIIFLMVVTDASALVSFITRFTEESFATLIAVIFIYEAIMKLVKIKGQLDMINYSRDFVEGGFCSCVPPIGKPSVSPDHARLVIKSTGLPIAFNDTFIDYTAANLTDCRTIGGSFDGTTCFPLYDKLLMSILLTVGTFFLATTLKKMRNSCYFPSSVRQLLSDFAVMIAIASMTFVDIFVGVNTPKLNVPSTFRPTWEGRGWFIPPFDANEWWTAPLAILPALLACILIFMDQQITTVIVNRKENKLKKGCGYHLDLLVLSVSILMVGFLGLPIYVAATVLSINHINSLKVESECKAPGEVAQFVGVREQRVTGIVTFLIIGLSVLATNILGRIPMPVLYGVFLYMGISALGGIQLFDRTLLLFMPMKYQPDTIYIRHVPIRKIHLFTAFQIGCLALLWVIKSIKSTSILFPIMLVVMVAIRKMMEKAFTTTDLKYLDDPMPDFHLRKKEDAKRRQSERVIIYLITFILQFQGEAVEIEFDNENQATIHAVKTEAHLHIPMASGNVIKIPLAAIQEPSHSINLTKEVNNSGMWKHITSVDSKNSLVRDVPASSDPTSSRDAPIEQPEDDDDPIMIKVIRPSPHTSTSNLTTENTPLLKDEEPPKTNPDEPKV

SEQ ID NO: 5141 - protein, 323 aa, Caenorhabditis elegans
MDNEKKSMYEPGVILGGCTLRRQLNDSGEAMVFLAESGNEEKKEVIIKFFKCGYGEDEIKYLDVLTNHEQRRNIVEMLKSFETPEIRLGMVFKRYETDLFGILGDRQRLQPSTIQKYMKGLMEGLQFIHRMDYIHRDIKVRIYRRVLFILSIREFCKKTADPENLLIDGETICIADFGETVLSTSDKVVKPGTLPYLTIEHILGYKENTKSMDIWAAACVLGAMFQGSHLFSQNSNLQTIHAIRLLLGNHTKETWPEMDKLPLMQSIELPPVGEKTFSKIENITKEAADLMEQMMKYDPTKRLMASQVLNHEYFKKEASAQAN

SEQ ID NO: 5142 - protein, 1425 aa, Caenorhabditis elegans
MSDEPPGFFRGGVDSKRCSRNGFDASRVLPRGTDNDTRKEYRRVANEIIRSFLKSGQKNTTLEPMGRDQRKVMHEVALLNEMTTKSHGREPDRYMILSKRVNRLSKSTLVATEPITPSFECLQKLSKFVEKHPITREEMDEFLTETQTKQMHTTKGHISDRMVIPPKSKCSKELQKVRNSLPASKYCDQVLKSISSCNVVIISGGTGCGKTTQVPQFILDEAHENNKHVRVMVTQPRRIAAISIAERVARERGEPIGRTVGYQVRLDSRRSDDTVLTYCTTGVLLRMLTSDPVASGITHIVMDEIHEREINTDYLLIALRECLKMRPDLKVILMSATIEGNMQLFSNYFENHSMDVIRIESRAFDVKVFYLDQILAMTGYQPPESKAFFSTAEYEEEDWKDEIEAVEREEKDKAKQRAADSSLSTLSKPVTKMAANTKRNSPIEEREWTSGPCSTPDGDIIDERAMRQYMNIIGNPDIRPVITVEFRPTTPNSVFINDVKYTTNPNQSAQALLQQKRERCLMPRGPLTFTCENPASTTKSPPSPTPTLGISSGLAKFTPFGGFGEKQRISTLLEKKFKEELKTALPDRTVYYHPQMNDVVDKTDFSKLRFGEKYNLFYGSSSNNSVDYVLLDQVIQYLADSPVFGTILVFLPGYEDIQQMLKAIDCWKNSLKNMKNVIVLPLHSQMTSINHGDIFKSVPKDTRKIILATNIAEASITIEDVIFVVDTGKVKEKSFDHEAKLSTLTVKPIARSNADQRSGRAGRVANGYCIRLYTEQEYNSMPETQIAEMKRAAIYDVTLHAKLFAPKTLKISEFLSLAPEPPEKESILQAITFLEQIGAFYTPIKIYDNSGNEEGLKNDEEAENSENPEDPELTDLGRLMARLPLDPQLSRMLLFGLALKCLTPIVNLVALLASREPYVLALSEDRDLQSKMKFEMAQQDLSDHLLYIRLCNEFCSKNNSQQNQFCRDHFLNFSTMRMVQGTRRQLLRELVRAKLINISPNRDVLTVLTDHHFNQFSQCWPMIQAVIAAGCYPFIGVSASESNLKKVQTFNDKPAFLHPSSMVKKQIVKMGKSEKSPRVEYVAFQEMCQMPSDRSLSMKTVTVIPSMTALLFTGPIRLDERTIEDNNIIFEEGEDISVEDKPLPWGASLSLLKLDEWYNVRSVKKNLCHFLRLRHKFMHFFVKGISDPDTFGKQTSLADLEMLELIRYVLESENKRYNFAPVVMPHLNLKFYSNSENPYASIVRNDNNRRNHSDPNQKSTERESRKPKEAVSHGNSRKQSKPPKNHQTKTTSNFPSHNFPPPDLMRNSHYNQNMSTSHQSSSSNNHHYSHNYSYPHYNIQLPQNQYQSWTPQFDFHSMNTSYGEHGHNGNHQYMESSGIHGHIPYQGGNFNTRGVSRGGFSYTSGNQFRGRGLSRKLYEHNPRNE

SEQ ID NO: 5143 - protein, 447 aa, Caenorhabditis elegans
MREIVSIHIGQAGVQIGNACWELYCLEHGITPDGLMPDDTSYGVEDQSYNTFFSETPSGKHVPRAIFVDLEPTVIDEVRTGTYAKLFHPEQLISGKEDAANNYARGHYTIGKELIDVVMDRVRRLTERCQSLQGFLIFHSFGGGTGSGFTSLVMERLSIDYGKKAKLEFSIYPAPQISTSMVEPYNSLLTTHTTLEHSDCSFIMDNEAIYEITKVNLGVRSPTYTHLNRLLAQVVSSITASLRFDGALNVDLTEFQTNLVPYPRIHFPLVTYAPIISAEKAYHEQLSVSEITNVCFEPGSQMVKCDPRNGKYMACCLLYRGDVVPKEINSAISTIKTKRAIQFVDWCPTGFKVGINYQPPTVVPGGDMAKLQRAVCMLSNTTAIQEAWARLDHKFDLMYAKRAFVHWYVGEGMEEGEFSEAREDMAALEKDYEEVGVDSFDPNDEEY

SEQ ID NO: 5144 - protein, 516 aa, Caenorhabditis elegans
MFQVSDGDGGVVEEVDYSKIAKLAGISTGNESDVVSEMCKEQLRIILREKLRTGEQLPPAVLVLLCIPAVIIILLTIFGNLLVLFFKARVGRTNTTLLVWNLGLTDFLVGVIVLPMGAVYLIYRKWIFGRFLCRLWVAADVTFCTCSVVTICVISVDRYLAVTRPLRYKSIVTKTKVISVMTIIWIFSSSILLTTVRWEQPECYDDSLCFVGNEIRHLAHSVVFAFFLPASVTLTLYWRIYKLARNRQKALDRGFLMILGSNMNFLTNTLSQQVLNFCKRFVFNNSQSFRFQTTLRVHFGKTNGMVEHQRRVLRTHERIAKTLGVVSCSFLFCWLPFFGLYLTSEYSIIICFKIFYPVTNPISDYKCSGCVPPIAIDVASWLGYCNSMLNPIIYSFTVKEFKRSAFRLVVPIWQFVNRCLPFVPAPPDNILQRIARHVHRHKEKVSHTFLLFFLQNVMFQEMQTRHRSFEMSSNKNGMLTTKVRSKRRQTEPNVVGLITPDHKVSSTFESIFTPNK

SEQ ID NO: 5145 - protein, 516 aa, Caenorhabditis elegans; identical to SEQ ID NO: 5144

SEQ ID NO: 5146 - protein, 423 aa, Caenorhabditis elegans
MASPRTRRVLKELRPCDDNNFCFECEANNPQWVSVSYGIWICLECSGIHRSLGVHLSFVRSVTMDKWKDIELAKMKAGGNRKFAEFLQSQPDYKEKWTIQEKYNSRAAALFRDKVACEAEGREWSQSTSPAANYVPPTLGGMSSQSKPTNKSSGNSSLGSYYGGNSSYSQSTGDGAYSTQDSNSKYQGFGNTGYVPNQSNSGDDLLAGAMSGLSMGWSMLSKGASQAAAMAKDVGIQAQQKASQLSENVSQNNSLFGGVANKASEVGTKSWDGLSSFVKSPSLNAFSGILAKTGYEDFGGGGGGMSGSSSQNEFNDWLKQSNLPRGTTEGGDHLSNEELKPTEPVETKKKKERSVKPVQSKEKVTAENVEDDDSSSTITQFESSFNKPKTTAPRLAPVAAAPPKKKEEKAKGWDDDAWDLLNQ

SEQ ID NO: 5147 - protein, 375 aa, Caenorhabditis elegans
MGSTCSTPESKEQKRINSVIDKQIRKDEDDEIGNQKLLLLGTGECGKSTILKQINILHSSGFSKADLKNVAGTVYSNIIQGVATLLKAKDHFYYELSTPELDADAQHILSLADSSKDAMPFIPLTFNAIKRLWHDPVVQKTFERRAEFQMMDTLVYFMNELDRINNADYIPTVDDMLRIRIPTMGVVQQTIEIKGTKFRWSSVNGIFNGRPHNLDLVRIYDVGGQRSERRKWIHLFDNVNATIFISAINEFNQKLNEDGQTNRMKESIKLFETICNSRWFVQAAMILFLNKRDLFEQKLKTTSINVLFSTYQGSNDYAECVAYIQMRFERLNKYSDIKKIYTHVTCATDTNQIQLVIDSVVDMVIGRNLRGTGME

SEQ ID NO: 5148 - protein, 797 aa, Caenorhabditis elegans
MGLQRGMPLAQLGEPFGITPSSIENVSPGIDQCKDHRMDVSMRSDPTDCSSDTTNTFHSSIHIIQPPPNNGFRLMNWKTDSSSETEIDIGDVRKCGEKADPRQFELLKVLGQGSFGKVFLVRKVRGRDSGHVYAMKVLKKATLKVRDRQRTKLERNILAHISHPFIVKLHYAFQTEGKLYLILDFLRGGDLFTRLSKEVMFTEDDVKFYLAELTLALEHLHSLGIVYRDLKPENILLDADGHIKVTDFGLSKEAIDSEKKTYSFCGTVEYMAPEVINRRGHSMAADFWSLGVLMFEMLTGHLPFQGRDRNDTMTQILKAKLSMPHFLTQEAQSLLRALFKRNSQNRLGAGPDGVEEIKRHAFFAKIDFVKLLNKEIDPPFKPALSTVDSTSYFDPEFTKRTPKDSPALPASANGHEIFRGFSFVSNAVMEERKLIAKSVRSVPTAKTNPFTDDYEILEKIGNGAHSVVHKCQMKATRRKYAVKIVKKAVFDATEEVDILLRHSHHQFVVKLFDVYEDETAIYMIEELCEGGELLDKLVNKKSLGSEKEVAAIMANLLNAVQYLHSQQVAHRDLTAANILFALKDGDPSSLRIVDFGFAKQSRAENGMLMTPCYTAQFVAPEVLRKQGYDRSCDVWSLGVLLHTMLTGCTPFAMGPNDTPDQILQRVGDGKISMTHPVWDTISDEAKDLVRKMLDVDPNRRVTAKQALQHKWIGQKEALPDRPIQSEQVGELDMQNVKVALEQTYKAIASAPSVQLRPVGSSALAKRRMKEILYANYTKNVSANAWCVFFLQCRWLLS

SEQ ID NO: 5149 - protein, 740 aa, Caenorhabditis elegans
MLILAEVEEFAENEIEQGEEKTDSSSETEIDIGDVRKCGEKADPRQFELLKVLGQGSFGKVFLVRKVRGRDSGHVYAMKVLKKATLKVRDRQRTKLERNILAHISHPFIVKLHYAFQTEGKLYLILDFLRGGDLFTRLSKEVMFTEDDVKFYLAELTLALEHLHSLGIVYRDLKPENILLDADGHIKVTDFGLSKEAIDSEKKTYSFCGTVEYMAPEVINRRGHSMAADFWSLGVLMFEMLTGHLPFQGRDRNDTMTQILKAKLSMPHFLTQEAQSLLRALFKRNSQNRLGAGPDGVEEIKRHAFFAKIDFVKLLNKEIDPPFKPALSTVDSTSYFDPEFTKRTPKDSPALPASANGHEIFRGFSFVSNAVMEERKLIAKSVRSVPTAKTNPFTDDYEILEKIGNGAHSVVHKCQMKATRRKYAVKIVKKAVFDATEEVDILLRHSHHQFVVKLFDVYEDETAIYMIEELCEGGELLDKLVNKKSLGSEKEVAAIMANLLNAVQYLHSQQVAHRDLTAANILFALKDGDPSSLRIVDFGFAKQSRAENGMLMTPCYTAQFVAPEVLRKQGYDRSCDVWSLGVLLHTMLTGCTPFAMGPNDTPDQILQRVGDGKISMTHPVWDTISDEAKDLVRKMLDVDPNRRVTAKQALQHKWIGQKEALPDRPIQSEQVGELDMQNVKVALEQTYKAIASAPSVQLRPVGSSALAKRRMKEILYANYTKNVSANAWCVFFLQCRWLLS

SEQ ID NO: 5150 - protein, 797 aa, Caenorhabditis elegans; identical to SEQ ID NO: 5148

SEQ ID NO: 5151 - protein, 581 aa, Caenorhabditis elegans
MSLAFRTLSFGIKRSQPKKKDADDLNKKKELSTITEESLRRYDELREKMIGKVESKIEKKVKKNKKKASIEILASRKRVHDSDGDSENEVEETVGDVEKRMQKLLDDIRRTNRIFTWGDHLPNIILRFSDSSMSPSLLNRLSENSIRQPSPIQMQSIPFMTERRNVLASAPTGSGKTLAFALPVIDEILELKQRADYSSSNSSKLLAVVLEPTRELAAQTYTEFLKYCANTSISAANFSGEETDIQHADILVSTPNRIVFHLDKIDTSSLRWLVVDESDRLFEVVEGQDKCFRNQLAAIYKACDAKCTRVAFFSATFSHEVEKWCKENIDEIGMVCVGERNSSNTSVKQKLTYCGTEDGKKIAIRNLLRTSFKPPALVFVQSKDRAVQLVKLLSAIDSNLKVDSINSGKSDKERDETMERFRRGEIWVLVCTELLGRGLDLSDVGLVINYDLPTSIVSYIHRVGRTGRAGKSGHAVTYFTDADMKYIKSIATVIRQSGFDVPEYLMEMKKVSRDRKKDMLKHAPKRHKIAIVKEQVIKKKKMLAKAAAEEKAKNKTETQTAEKPEKKIKKKKLIKKNNKNI

SEQ ID NO: 5152 - protein, 374 aa, Caenorhabditis elegans
MLGKCIKKASSTVGQSIRYSSGDVRRVTLIPGDGIGPEISASVQKIFEAADAPIAWDPVDVTPVKGRDGVFRIPSRCIELMHANKVGLKGPLETPIGKGHRSLNLAVRKEFSLYANVRPCRSLEGHKTLYDNVDVVTIRENTEGEYSGIEHEIVPGVVQSIKLITETASRNVASFAFEYARQNGRKVVTAVHKANIMRQSDGLFLSICREQAALYPDIKFKEAYLDTVCLNMVQDPSQYDVLVMPNLYGDILSDLCAGLVGGLGVTPSGNIGKGAAVFDEIQFFIQTKLTKFLYRSVHGTAPDIAGQDKANPTALLLSAVMMLRYMNLPQHAARIEKAVFDAIADGRAKTGDLGGTGTCSSFTADVCARVKDLE

SEQ ID NO: 5153 - protein, 294 aa, Caenorhabditis elegans
MPHDSNEGKQRPSVVLSLSAGAIAGALAKTTIAPLDRTKIYFQVSSTRGYSFRSAIKFIKLTYRENGFFALYRGNSATMARVVPYASMQFAAFEQYKKLLKVDENGSRTPVKRYITGSLAATTATMITYPLDTAKARLSVSSKLQYSSLKHVFVKTYKEGGIQLLYRGIYPTILGVIPYAGSSFFTYETLKIMYRDHRGEVENSYYRMLFGMLAGLIGQSSSYPLDIVRRRMQTGRIPSGWSPLRALIHIYHTEGLKRGLYKGLSMNWLKGPIAVGVSFTTYEKVLELVGHLKR

SEQ ID NO: 5154 - protein, 192 aa, Caenorhabditis elegans
MSAFASSDRAEKSGIALEAQQKIYEKYDKNLAGEILQWVQNVTGQSFDTQGDADNLVKVFQDGSLLCTLANSLKPGSVKKVNTSAMAFKKMENISFFLKFAEEYVQKSELFQTVDLYEGQDPNAVLICLASLARKSEKNFGRSGLGPKEAQGDRREWTDEQLKAGHNVIGLQMGSNKGATASGLNMGNTRHM

SEQ ID NO: 5155 - protein, 236 aa, Caenorhabditis elegans
MNAHDEVQRTLNPTCTGTSVIALQYKTGVVVLTDRVVSYGKMARYKNVSRQYKVNDNVLIAFGGDHADFHWLQNVIERQVLLWKRFDQDIGPKALHGYLTSLLYAKRCKMNPVWNTLVVAGVEEEEKNNKETSTPFIGVITQKGCAYQVKHIATGLGAFLLNQAVEDEWRKKGEDLSREEAEAVLRKSLELTLYHDCVADNEFEIGRVDATEGVVLGKEEKIIGDWSIAETNCQYE

SEQ ID NO: 5156 - protein, 622 aa, Caenorhabditis elegans
MTLMIDENFKKQLAQRRERVEDLFYFENSKEIGRGTYGLVYKAVPKKQNGQFPNKEYALKMIEGQGFSMSACREIALFRELRHPNLICLQRVFLTNEKKVWLLLDYAEHDLWHVIKHHRTAKSKKVPIMVPRNMVKNILFQILSGMHYLHSNWVLHRDLKPANILLMGDGPPDMRGRVKIADLGFSRIYANPLKPMAELDPVVVTFWYRAPELLLGAKHYTKAIDVWAIGCIFAELLTAEPLFFCKEEDIKAQNPYHYDQVKRIFHLLGYPSDADWPDMKKMPDHQRLLSDARNEGTPIQTFPNSLHRYFDKWKINSQSSPYRLLVKLLTVDPTKRVSCEEAMNDIYFRKMERPPRETDDVFNKYPIPYAKKEQQMTVRASIVEYTANVPKILLQVAPDQAQQQHQQQQVQMQQQPQMGQQQMMGQPQMVQPQMGQPPMGGAHPGVVAPDGHPHQMMQQQQHPQQHHVSFLNIQNEKLTFSVQMQYQGMHDPMQGGMDEGPQAKMMRMGNVPVGRYAPMPPPYGAPQDYHPQQGPPMVQMMQQPGPSGYYPQRPGQPTGAVPGPGPQGYMNPQMGMQMGMRAPGVPPQGYMPGRGMAPPQMGQQQPGPNQQQQQQWQQQYHR

SEQ ID NO: 5157 - protein, 253 aa, Caenorhabditis elegans
MNRYDRAITIFSPDGHLFQVEYAQEAVKKGSTAVGVRGKDCIVIGVEKKSIPALQDDRTIRKIHMIDDHVMLAFAGLSADARVLVDRARIECQSYKLTLEDPVTVAYISRYIANTKQRFTQSPGRRPFGISMLIGGFDHDGTPRLFKTEPSGAYYEYVANATGRGEKPVREYLEEQYSEENTVDEATTLKLVVKSLAQVVPPGSQNIEIAVMKKVNDELQQRVLSTEEIEALLKVVETERVAAEAEEAASKKK

SEQ ID NO: 5158 - protein, 189 aa, Caenorhabditis elegans
MRKMNLIVAMDAEGGIGKNGVLPWRIKKDMQYFASVTKNVSDQSKRNAVLMGRKCWESIPVTRRPLAGRLNIVLSRQLPAQKSDDYIVVNSLEAAMKLLSEPPFVDSIETIWNIGGAEIYDLALRENLVDEIHLTRIFKNFEADVHLKSLDFSKMEKVQNAEVSSENSEIFEENGLKFEFCKWKVVENH

SEQ ID NO: 5159 - protein, 381 aa, Caenorhabditis elegans
MPNTYRTSDEIVAQRLEDGRDMNLSLQNMNLFASGAFSNVYRGIARTESNHQMEIVIKKTWPRHKGCPLEVKILGKLGKLKHKNIVRLLFSYQKQHEGRICLGLIFEYIPMNLHQFLKDNNRRVDIIEVKLIVWQLFRGQAHLEKSEICHRDIKPQNLLYNADTGLLKISDYGSSAIESVKTPQQSYHVTRYYRPPELLLGSKNYGCKIDTWSCGCVFGELLKGGIFLAGKSAKNQAEVVFDMFGVPTAEDVSSMNVSNTKYKEIIQSYEPDTSKRTADLAYLYNQTASFQRDRRSTVYNTKIDYSDMKDSVELLRQVLVYNPSRRLCGIEFLTNPFFTVLFNEKTVRFNKKKIQCVSAVDLQAVKSGDVTLTNESVEHST

SEQ ID NO: 5160 - protein, 566 aa, Caenorhabditis elegans
MSSRKGTRSSRIVTLERSANSSLSNNGGGDDSFGSTLLETSRLQEKDHLTSLNSRLATYIDKVRQLEQENNRLQVQIRDIEVVEKKEKSNLADRFEAEKARLRRALDSAQDELAKYRIEYDAAKVEVKKLKPQVEKLERELAGAEEQALHAQSIADQSQAKQKTLQARNDKLVVENDDLKKQNITLRDTVEGLKKAVEDETLLRTAANNKIKALEEDLAFALQQHKGELEEVRHKRQVDMTTYAKQINDEYQSKLQDQIEEMRAQFKNNLHQNKTAFEDAYKNKLNAARERQEEAVSEAIHLRARVRDLETSSSGNASLIERLRSELDTLKRSFQEKLDDKDARIAELNQEIERMMSEFHDLLDVKIQLDAELKTYQALLEGEEERLNLTQEAPQNTSVHHVSFSSGGASAQRGVKRRRVVDVNGEDQDIDYLNRRSKLNKETVGPVGIDEVDEEGKWVRVANNSEEEQSIGGYKLVVKAGNKEASFQFSSRMKLAPHASATVWSADAGAVHHPPEVYVMKKQQWPIGDNPSARLEDSEGDTVSSITVEFSESSDPSDPADRCSIM

SEQ ID NO: 5161 - protein, 425 aa, Caenorhabditis elegans
MRLNLLLLLLFYFAHGSVVPNVDQKILRGEFHDEGKFMVDYEDNSQNLTDYASRRSSDDDKITPEEQKRRGNDSTEVSEDDDSSDISEERERDSVDHQHLKSLTAIKPEKHQPVAGVINSAFNDRKTFSCPRIKTELLTGTNVGNISPEDITIIAAMGDALATGIGLWPNADIEFRGASFPIGGDSTIDGLITIPNILREFSPKLVGVSHGMGADLPNHQLNVAVTGATTEDLPDQARRLTRRLKKLSELDYHNEWIMIIITIGTEELCSRCEGPSYDNIRKAIEHLQIEIPKALVVLLGPVHVSSFHEQKSNLLKARCACSRDQTEGFMYDVSRKWSKVWRDVQKFVENGVTARPTFGMISYPMVTITSRYPSGLFIRDKPLLNRRGHNYATKWLWNRLIGGDLYNLSSATLSQDNYFCPSVVS

SEQ ID NO: 5162 - protein, 2915 aa, Caenorhabditis elegans
MSGHSVDGEEQSSSAPARNHTLTHVLYAQEAVGDEKKDSAIIDLIVDQFKQENIGNILANPAIASLGPSRIRQVVLGPKHVGVLLDDATVCRIPYHVLQIQSGEVKEAEAVKGEPSSRLHDVYARAGAAGEVEVIPLSGGMNTLRAAAGQAKYRRVMLSNRAYYRLRGNLGESRSYVLGAPRVPATNVPEELINNVQVRICRDKITLFDDLFQQVLQGKSRDVIIRELQRTGLNVNEAVNNLLSRDDGDEQDVLDVGGEHLIPEELLQILEGGVPPGSSGAVAMAESLLEREDRLLDSLASRAEMRYHFGGASGSKKPKANEKDKKKKDSETNWKNCIQLGEHVEWWRGAPGDGIPEHAKTDAPVKSEDDKANPVISITATSYQMYALHRNGKMYSWAWDESEGLDDPLTIVKNRDHPDHATIGTHGNPVIQMSSSNLRISILTRSGHLVSWLDECGAGVRFSLASETVTKISEDSVMAVQDLVTSDHLAAFRIDSIIHWCGIVPLVESTRSTKKEKEEADREKKKHVSFGEAPVSSIPAVQSNSIEFFVGQQVQMKKAPLYPAGSVAAQIDTSNPMIGVLLEDCWSATDHCRFRSMTPKEYDYELEVDGFIALLNGASPEVSSASGTSTKTLPGGRVSRKRTHDEADDSNSVPPTEFGRRRVEVWLAEDLVWIHEHRKRDVMTVQVVDNNLVAVKHVPNSSQKPIFQSLFSERLEMDGMPQTVISIEKSTDIDKIRLMRKEDLQVIDKCPPRAPVILQKELLKFDVDCNRTIVSMVADLNELRVLARSKHVERGMHMYRVSTNGKVISRRRVPVFLPSVERPIFGGLSPKLISFGDARTLFLRDTAGQLIPLQRDALNGFREPPAMHSQPILHIATACRPSFNVLASCEKNSQWQGSMLIIPGVDRPWHSHFIKDGSSLMQMVLYCDADGVSQFLDRLFELRMSCTISHHEFRQIMSEQLFTITSDLCSNVLHAAIRLTSATKNSEDSDKAVPDTTMPTLFPTRNITLPPQDVSMEDAAPAEESSSSNMQGDEIDDEEEPRWSRVLRSRPKREQVTPSKKSKKEKRADSEENDEYGGENHSFSAVRSDESGMPFGSPRPPMVRQKSALQIIDTFLKHPAMFYDKDAEEHIEYVDEPDRLSAVKALLLTRDLNGMTPFQSAINQRAYGAATSIWRALLQLGFQTMSEEQKLKYIFPSFNVDESHNADDSPLFILCYNDVCSFTWTGEDHINQDIYECKTCGLTGSLCCCSECALTCHRNHDCRLKRTSPTAYCDCWEKSSCNCKALIAGNELLREHLLSTAMQTSQSSGTPEHNLNPPKFAKTALEQCCKNANVVMNSIRCGINKFGQMELATPGQLHFVQQSTSTHLDKLTFALSNKILKDYSSLFVGTLRNLLSAPIRDPRVDQDIEMWVGRFVRSLVRVLTLAINVSPLAPSTILAAEDPTDNATPRDPREDRSRYNQATFQVFHALVISKKESSKLSEKSASFVAMITRIMQFLQQLPTFAVVQLAIAADAIFEPVRDGMLRPMVNPALAGNNHDPMDILEKYFTSDLSFSEVLKRSKKEERAIATSKPDTKRVRRTSRRDTDRENGSDNRESMEDERSAGDRASESQETLRIRHDSTATSTVPTPRRRRLLSGNTTNDTNEDNEERNGQPREFDGESSSSDDDNDDDDDDDDEEEDDDDDDDDDDEDSDRPAEERQEDEEREEGDEHEQDEQVEGEIEVVDRIEVQPVVEESERAEEPVWHAYEPASPSPRQPDFDDNSSDSQEGGAREPAFVIADVAHPLEVAQAQPANVPIVRPVAENPSPSIMASIAASSAARERALEALAERRGAAASRVPGSSVPRIERFLPYRFSSRSSFLSNRREDSSNSQGSTLSYAAGSTTGTGSTAPAPASATAGNNNSQVRSVPPPTTTTSSSNQESSPASNSSKKSNDNTDQPSLETAREQLALTFSVLVRAGCDILSRMPRPVMSVYTKADDNAKRSQLKAQRLFGDILQDTFRWMGRVFESTEAKINFNETYEKSLVRPASPGSEDKRGRKDALHYIHSLLRLATDEAKDSLAHVDIEMLYPVALVADAYFHFLSCNVERPIELKQLIDYYEDSQRRHFREKCEQTDNDLMIGFFMRPVSLSWPGHLHDGAWDTLSGRHHISKTLKIEEECPMLGGPKMLTMLTKQEDLFRDPVIDETKRRTSSYLNDPVEEYTYNLLDRPFEYRNPGVSLAMVPHRLKLEREFISITRDFYHLDRTPDHEVKDYSTAVGKFPGYIGRLDDSISKFKDNLLIHSCNRERLYFSKWFKTLNAIGNRFYDKMTEALGADVAFENSIMLRRLASFETKQRLFNKATEKYRTQHSNVKEIVLDVRREPGSLFRDTMVQLHHLYAKRMMSVRSLESGHAPLAGTRLRVHFIDEPGEGTGVTRSFYTAFAESCMMDVAPFTPETVAEKSSLIQSVLHPNNEYEHDMEITKTLRKARREQAIRLRTHLQRLKTFPLNLAAPRFDIKNFTGEGNWTKKVLQDSSAESQPVAPLNWGQHEGTLRKIHTMTSGFLTDEKTIGRVMGIMCQLPTEVFVKAVNNDDTMRLHIQQILAELRAEGELDDYSRVFRGLQNAEQPRSDDEQWNVLVGTESPLDQLFEKAPYGEFYVPKIGNGAPMRLAAYRTVGRIMGICLSQGDIFPLRFSRHIFSYILKLPICWLDLGFYDPVLFNNLRALFKAHPSELDTDFSIVEQSADGKAVTVNLKPNGDEVLVNKDNVIEYVYKYAERVLVGKRIITFEAIREGILDVIPESMLFGLTPEDLRLIICGIESVSISVLQENTGFLDESRASQETLNRFKQWFWQVIESFTQQEKQELVFFWTGSPALPAAGKWPTSASVMLRPQEDVFLPTANTCISRLYVPVYSSKRVLRTKLLLAIKAKNFGFV

SEQ ID NO: 5163 - protein, 2915 aa, Caenorhabditis elegans; identical to SEQ ID NO: 5162

SEQ ID NO: 5164 - protein, 1100 aa, Caenorhabditis elegans
MAFHWQSKVNVQHVGVDDMVLLPKLTEQSIVENLKKRLQANSIFTYIGPVLISVNPFKQMPYFTEKEMLLYQGAAQYENAPHIYALADNMYRNMLIDNESQCVIISGESGAGKTVNAKFIMNYISRISGGGQKVQHIKDVILQSNPLLEAFGNSATVRNWNSSRFGKYVEIVFSRGGEPIGGKLSNFLLEKSRVVHQNEGDRNFHVFYQLCAGADKNLRSTFGIGELQYYNYLNMSGVFKADDTDDGKEFESTLHAMKVVGVNDQDQLEVLRIVATVLHIGNITFTEENNFAAVSGKDYLEYPAFLLGLTSADIEAKLTGRKMESKWGTQKEEIDMKLNVEQASYTRDAWVKAIYARLFDYLVKKVNDAMNITSQSTSDNFSVGILDIYGFEIFNNNGFEQFCINFVNEKLQQIFIELTLKAEQEEYVREGIKWTEIDYFDNKIVCDLIETKRPPGIMSLLDDTCAQNHGQREGVDRQLLTTLSKSFAGHPHFGPGSDSFVIKHYAGDVTYNVDGFCDRNRDVLYPDLILLMQKSSRPFIQALFPENVAASAGKRPTTFSTKIRTQANTLVESLMKCSPHYVRCIKPNETKRPNDWEESRVKHQVEYLGLRENIRVRRAGFAYRRAFDKFAQRYAIVSPQTWPCFQGDQQRACEIICDSVHMEKNQYQMGKTKIFVKNPESLFLLEETRERKFDGYARVIQKAWRQFSARKQHIKQKEQAADLMYGKKERRRYSLNRNFVGDYIGLEHHPTLQSLVGKRQRVLFACTANKYDRKFRVTKLDLLLTVNHLTLIGKEKVKNGPEKGKIVEVIKRQFDLPQIKSIGLSPYQDDFVILYLGNDDYSSLLETPFKTEFCTALSKAYKERTNGTLHLDFRSSHVVSYKKMKFDFSDGKRTVQFGNDGTSSAEKTLKPNGKVLNVSIGTGLPNTTRPSTERPQGGYTPRRDQLRTSTRRTKQNNQSYGQNGQSQAMRAPVPAHGMNNNYNQTPAPVSTNHQYSQEPARIPVMGNVINQLNNMNLSGNGNSPAGRGPPPARGPKPPPPAKPKLNPVVIAVYPYEAQDVDELSFEAGAEIELMNKDASGWWQGKVNNRVGLFPGNYVKE

SEQ ID NO: 5165 - protein, 768 aa, Caenorhabditis elegans
MPTPVSTKKTIAPSTMKTTVAPPTMRTTMAPTTMKTTVAPPTMKTTRSPSTMKTTKEPSMTQTTKTVQSTITNPVSFLDSEVTAKEYVKDGGAARKAYRDAIQVENTDRQAFRGIESLLSSLGQAIGLGNIWRFPTVAYQNGGTSFLIVYIICAFVFAVPAIHMEFALGQYAAKSPPAVFRRIMPALEGVGWMTCIVGAVIGVYYMILISWIVLYIINIFYVNNMGRCDNPWNQNNCYDGSEQSRCNKGLYSNMTANASSFLNTTMAPLMSSGSKRILYINGKCQDATNMSVEVGTEQFFSKSVIRPSAGFTDFNSINLPILGAVALCWVIAAVVLIRGMKAIGKLSYVTVILPYFIIVSLLICGVSLPGAKDGLYHLFGQTDFNYLYKRETWTAALQQICFSLSIGQGGLMNIASYNKKTYNWYRDVYIIVFLDTLMSILGGITVFSTLGFLAYERGINSTDIDAFNHIVKEGHALAFIVYTEAIAEMPVPYLWYALFFIMLFLLGISTEVVIVEIVCSCLADRFRYLRERRWLTVLSVSAVFFLLGLVMTTDAGFYWFDMFDEYSTGISATFGTAIMCMTVFWCYGTNHFREDIAVMWGEPESWLATCLGPAAYFWTLIWKFVTPVCSLLMMGLWIWEKKYPHKGDGKIYPPVFDALGWFIAVVPFLVIPGFAIAAVINTRRMNIPIRGAFMLQKQHPSYDRISEQWPEWKKAIGDKLPEQEPGDDDLNMIDGLETKETWSFLYKFLSIRVFNKAKIVIETGKYLK

SEQ ID NO: 5166 - protein, 2824 aa, Caenorhabditis elegans
MKCHTQKIVHYSKISMCVLLHQLSHVHFECSFRLAPRASKEKSTVSGNAENERNMISDDKHSFSLFIYSFISCFLSISNYISFLIDRAIIDFPLTLIGWYHLTATCIFPLTQFERNYSTATQMCGAVSHSIGYRETNWLIASLLLELFSNQNNKNLMKLYWTGLQIKDETMIGVKSEDVSETITDFTSIYNPLWAEGQPPEDIPSDQFPNYCIALDLRNSSFFGWRAVPCTRQLPILCQNYACLSGTFRCADNSKCIPASLKDDGFKDCQDGSDESEALTFPVSSPSSSIVSNFVQRQNPIYDWPMIVSNGGVLSPTTIRYGIGECTHRWIVLSPNGRDFVLWIKWMSSTTSTTIFVEGKDQNGRIVVNSRNATSSIMILSSSFVLTASDTDTRKTEFQIYYQEADASLCNISDSNQLIFNSESIPIPCHYTFKTQHFNSYIAVLVQKCEGLNPATIQYNNSTVILPPSSFKKLMVIPASSLDVHVDTTWPGSETKLEIQFFELKPGSESVDVFLIDSDLEIEWISKSTETCMEGEFRTLTVNMIMTSSSNSAAEHFESTWNVQGFRKSCSEDNVQIVSKNQSTYVTNLGVLTGFGPTTVVIHQSAEPFEFHSIYKINHNDVITTTPGRILDESEIDQEQPTTDPIITPTTSSPNWDGVLCKLPTVVDGYIINVFLRYILGSKVVIDCSQGFALSSLPYIIQCNSNGQWVDEDGKTFDADHPTVECYQIDCSNKTPVENKYELTPDNNHTSYGTMRKYQNLTNFGFGAFCVCGDERSQPDEWICYNTEGLMTNPINNACMLPEAQDALFVKQDPTDGYVFPTGYMIQMTCMICPSLIKYYTCEFGLWKTSDGSIQPYDTFECDCTTDPNFIDPCLPHGYYVQHNGFYSCQCDVGYKYVLLDSNVGKCVDRDECEEKSDYCDSFATCNNTDGGFECHCPVGYHLYNANSPDLSTWARIYDDLIDGYSCVETVCKYDINWAVYGLDVIAPPVYPQIYRSGDYMDYLYANDLCSSKGFPCVFQFQEYCLGENLCPFPNPVAACPALDSTIYTYKIEASPSFHVFQIIDVECVNSAMLMIGRPRVFCTSESKWDMLPICIYQSCSDPRQFIKPPLLIDRVDRPLGHGFEYQTVIYFKCENGYMLSPGSGSESITCIRYDDEYQWSDAIPVCISTTTPSSTPSSTSSPTLPSGSSTEYTPRATQSSTTTSYGSTLSSDFSNFHDDVVIEGSMIFEEINALDRQEIWTKTADWIWTPSGCIVHQWTYPISFMVTSIPIVLNSDQIELLIDVSQCNSNVQVGIASSTDGFIPPISDFRTVINTTSSGSFVVNLRNLKSHLALSISANGYVQICGVTIREKMCNEVDYNGLHLKSSAPFKMRRYLPATCGQSKRITQVNGYCDNQRGWVIQNTPCLCNPQPPCPSTELLPQRDQIGDCTLNSCQNGVCLQMNGMHDCACNEYFIVDRENGTPFCKPNHCLFTNQTRNSGYDCSTGRENALFLCPNLNEFGDFCQYEGQLYNNSYTYILSAGIENAIATNLCESLDTLYAVPNTFCVQNPTSTTPSIHRCDFCYGGENCEFLNPPYQGGAWCICAQDWYGRQCDVSKFCFNGTNDNYICQNGGRCNKDLRLCECLSSFTGAFCETAIDESNCALDEKDCVFGLCRRENAQVYCNCYDGYMKDSLGNCTLAWDMCSLNNPCQQNGYCNFNQNIGDEICDCTSSGWLGDHCEIQPKLDNCLYCQNSVKCFDTFTNYSRCQCAPGFSGDYCSDLIDDCFFEPCFNGGTCSIFNYNTTTKVSIESYNCTCQTGYFGTNCESRIHPSCTDLITCQNGGTCQLTSFDTAVCQCTDQFYGIYCEKSQPCTIYLPNGTATPYCLNEGKCLDLPNGAACDCSGTNFIGRRCETSSSFNFNLVFNGMSYTPDIVTGLFSNLIIAQFTVCSFIQYNHPTIDSNPSPADEILPPWLSIRGYGSNSQQIVFDNNGFFICDVGRQCNRSVQNNFKTTPITANTWHHFCLVSPANAISPSYTVYLDGLLVWEQYAETFNPGEYAHLLLAPADLTPSRFVGMISMTQLFIVRLTEAQIGQLAFDCYDTILNGTNDITRNPFINWNGNFTRVSSSNPGVYLDPSGICSSVKCMFGRQAKANNYNSTGSCDKDRLPPTVLRCPKNIRKGTTEDFTKVEWPDEDVAFFDNIGVIRIEVNYHNGQQFGVGITTVRYVGFDAAGNSAECTFDVTIYQKSCPSQVYAEGGTVLAMQFTTAPFTAKAEKVKCDDNLYPTDSRPMFYVCDIMGDYQYGGWSDNTKQIYYLPACGQTSPAVQAINGTVVGSGQCQQIHQRLRDVIWASADCDRILSCRLMIYPSCDEIDGRVSIADELSNIALQYTFSTKNATETIDTTVLHNLQTNFTYIRQDSTVDCDPSYPIHDTNGNVTICVKCPEGTFANKESNKCIDCPINTYRNSTNLDQLKCTACPGTTVTGDVTGAVDESQCYVNCPIGQFESKGLCNPCPEGTFGPTTGLRKCICCGFDLSTFGGPCIQCPRGLTTTSQASTSINSCDTINCIDANTMINKNVTVGPSTPYSEICIACEQGTFQNVSNSDSCIPCSDLSENATSIPVTCQSTCSDAIPTAGCNCQLQQNGKSSMITRNCLPEVTPVPGNSNAIKIVLGVVFGVLLLIIIVVLVCFRKQIIAWFRKTDTSDNQHVALSHWDNATNRNEEENQNPTSTNTYPRIPPQAPIPHPNLRIVTSRAEMDQLPPLPTASTASFHVDSAYKSDGFGSGFGTSSGMRHLGTGISTVHPTIFSSNDIAFEANGSPIILRSSNTPRKESSDDSSLDSFF

SEQ ID NO: 5167 - protein, 493 aa, Caenorhabditis elegans
MRTNRLSWILVLSVVIFLVIINTINASDDEERLMVDVFRGYNSLIQPVRNSSELPLIVKMALQLVLLINVDEKDQVMHTNVWLTLQWHDFQMKWNPVNYGEIKQIRVSPDKVWLPDIVLFNNADGNYEVSFMCNVVINHKGDMLWVPPAIYKSSCIIDVEFFPFDEQVCTLVFGSWTYNENEIKLEFVQAELVDVSEYSASSIWDVIDVPASLVNKRSRIEFQVRIRRKTLFYTVVLIIPTVLMAFLSMAVFFLPTDSGEKITLTISVLLSIVVFLLLVSKILPPTSSTIPLMAKYLLLTFVLNVITILVTVIIINVYFRGPRTHRMPQWVRVVFLQFLPKLVCMKRPKSASERSAVRSGMAQLPGVGQFTLSPSAHHPLCPSADDRTTTIRNTASNETSAYYPLSTDALRAIDAIEYITEHLKRDEQHKSFRDDWKYVAMIIDRLLLYVFFGITVGGTCGILFSAPHVFQRIDQQEMLDRLKEKYDTASNIP

SEQ ID NO: 5168 - protein, 460 aa, Caenorhabditis elegans
MWIREVISIHVGQAGVQIGNACWELFCLEHGIQPDGYHVEDDTYDEETETINTFFAETAGGKHVPRCLFVDLEPTVVDEVRTGTYRSLFHPEQLLSGKEDAANCYARGRYTIGREMIDVVMDRVKRLAENCNGLQGFVIFHSFGGGTGSGFLSLLMERLSTEYGKKPKLEFAIYPAPQVSTSMVEPYNSILMTHTTLEHSDCTFMVDNEAIYDICRRNLDLARPTYTNLNRLVAQIISSITASLRFEGALNVDLTEFQTNLVPYPRIHFPLVTYAPLVSAERASHEQNTVSDMTHACFEPGYQMVKCDPRRGKYMAVCLLYRGDVVPKDINSAIAAVKTKRTVQFVEWCPTGFKVGINYQPPTVVPGGDLGKQTRSVCMISNTTAIAEAWARLDHKFDLMYAKRAFVHWYVGEGMEEGEFSEAREDMAALEKDYEEIGEDELPDDIDDQSYRGRSSGSRY

SEQ ID NO: 5169 - protein, 560 aa, Caenorhabditis elegans
MIINICQLVLSVSILIWETKCSKVIWTGDHERRLYAKLAENYNKLARPVRNESEAVVVLLGMDYQQILDIDEKHQIMNSNVWLRMSWTDHYLTWDPSEFGNIKEVRLPINNIWKPDVLLYNSVDQQFDSTWPVNAVVLYTGNVTWIPPAIIRSSCAIDIAYFPFDTQHCTMKFGSWTYSGFFTDLINTTISPATYKPNGEWELLGLTSQRSIFFYECCPEPYYDVTFTVSIRRRTLYYGFNLLLPCMLISSLALLSFTLPADCGEKLNLGVTIFMSLCVFMIMVAEAMPQTSDALPLIQIYFSCIMFQVGASVVATVIALNFHHRSPEQYKPMNKFLKTLLLGWLPTLLGMERPDVLELSVHGAHYASDNKKKQRQYLIEVERHILTRPNGNGHSAVDKAVHLDLSTGNPHSDAKKSSPSPKRTSASIMGMTGLPTTQMNGALDSSINKYTCTKVTRPLENGSATINHKSSPQINPINNNNIYKCANNQKTQFEDRHFHHILNELRVISARVRKEEAMHALQADWMFASRVVDRVCFLAFSAFLFMCTAIISYNAPHLFV

SEQ ID NO: 5170 - protein, 449 aa, Caenorhabditis elegans
MSEFDELKYLTGFGNEHATSDPRVPDALPVGQNSPQKCSHGLYAEQLSGTAFTAPRSQNQRSWLYRIRPSVIHRPFEAMKENDQHWTNNFSSIPPNPNQYRWNPFPLPTKEGVTFVDNLYTVCGGGDVISRTGLAIHQFSCNASMEHTAMYNSDGDFLIVPQQGALEITTEFGRLLVNPQEIAVIPQGIRFSVAVRGPSRGYILEVYGTHFQLPDLGPIGANGLANPRDFEAPVAWFEDLDVEFTIINKYQGSWFQAKQGHSPFDVVGWHGNYVPYKYDLKKFMVINTVSFDHCVSLLIKMLILKKDPSIFTVLTAPSVKHGTAIADFVIFPPRWGCADNTFRPPYYHRNCMSEYMGLITGCYEAKEGGFKPGGGSLHSMMTPHGPDFNCFEMASNADLKPQRVAEGTMSFMFESSLNMAITNWAVYQNVDKDYYKDWQPLKKHFTMPK

SEQ ID NO: 5171 - protein, 449 aa, Caenorhabditis elegans; identical to SEQ ID NO: 5170

SEQ ID NO: 5172 - protein, 562 aa, Caenorhabditis elegans
MASSQVQDVELAEAGDTINEVKASSASGRGRLARRMTIEEEHAGDYFKQEQKLAAVPATTHMEHLCRLDIREAPHLVRQTGIICTIGPACASVEMLQKLILNGMNIARLNFSHGSHEYHAGTIANVREAADSFSDKRVIGIALDTKGPEIRTGLLAGGASAEIELARGASIRLTTDPHFSESGTAVNLFVDYKNIAKVLSVGSRVYIDDGLISLIVEELQTDAVICSVENGGMLGSRKGVNLPGTIVDLPAVSEKDCKDLQFGVEQGVDIIFASFIRNAEGIRTIRKVLGEKGKKIKIIAKIENQEGVDNADEIISESDGVMVARGDLGIEIPAEKVFLAQKMLISKCNRAGKPVICATQMLESMVHKPRPTRAEGSDVANAVLDGADCVMLSGETAKGEYPVDALKIMHYICKEAEAAVYHRRLFDELLQNTQKPTDMSHTIAIAATSAAASCHASAILLITTTGRSAIQCSRYKPAVPILTISRDVAVCRQLHLYRGVFPVHYPAERAADWPTDVDNRINHAIAIGKDRGFIHKGDFLVVVTGWRQGAGATNTLRIITAE

SEQ ID NO: 5173 - protein, 600 aa, Caenorhabditis elegans
MYRFWSLISGDKVISKTSMKSIENAKHIAHVEQVPLSPMLSKLIGEPPALDENNNEKIGGSCSDENRPKTHVCSVPGFMQKPYKTRQEQKLAAVPATTHMEHLCRLDIREAPHLVRQTGIICTIGPACASVEMLQKLILNGMNIARLNFSHGSHEYHAGTIANVREAADSFSDKRVIGIALDTKGPEIRTGLLAGGASAEIELARGASIRLTTDPHFSESGTAVNLFVDYKNIAKVLSVGSRVYIDDGLISLIVEELQTDAVICSVENGGMLGSRKGVNLPGTIVDLPAVSEKDCKDLQFGVEQGVDIIFASFIRNAEGIRTIRKVLGEKGKKIKIIAKIENQEGVDNADEIISESDGVMVARGDLGIEIPAEKVFLAQKMLISKCNRAGKPVICATQMLESMVHKPRPTRAEGSDVANAVLDGADCVMLSGETAKGEYPVDALKIMHYICKEAEAAVYHRRLFDELLQNTQKPTDMSHTIAIAATSAAASCHASAILLITTTGRSAIQCSRYKPAVPILTISRDVAVCRQLHLYRGVFPVHYPAERAADWPTDVDNRINHAIAIGKDRGFIHKGDFLVVVTGWRQGAGATNTLRIITAE

SEQ ID NO: 5174 - protein, 1059 aa, Caenorhabditis elegans
MNQHFSFILFLFTFHLLSTFITSRLIRPLRVFFYSHFEHSSVHSHFFNYSLFHFKLCCRSLFSRRRVLHSRTVRVGYGPVGHDANVTFTPNTVCNQKYNIFSFVPIVLFQQFKFFLNLYFLLMACSQFIPAIQIGAPITYWGPLGFVLTITLIREAFDDFVRYLRDRDLNSEKYEKLTRDGTRIEIRSADIEVGDVIIMHKDRRVPADVVLLRTTDKSGACFIRTDQLDGETDWKLRIPVPHTQHLPNEADIMELNCEVYAEKPQKDIHAFVGTLKITDDDNVQDGSLNVENVLWANTVVASGTAVGIVVYTGRETRSVMNTTLPESKVGLLDLEVNNLTKLLFCFVLVLSSVMVAMKGLDNLWYRYLMRFILLFSYIIPISLRVNLDMAKLFYSWQIGRDKHIPETVIRSSTIPEELGRISFLLSDKTGTLTKNEMHFKKIHLGTVAFSSDAFEEVGQHVRSAYAGRLAKHSFSAKLQNAVEAIALCHNVTPIFENGEISYQAASPDEVALVKWTETVGVRLASRDLHAMSLSVQLPNGQTLMKQFQILYVFPFTSETKRMGIIVKDETTDEVTLLMKGADTVMSGMVQYNDWLDEECSNMAREGLRTLVVARKPLSQAELEAFDRAYHAAKMSISDRSQNMANVVNRMLERDLQLLCLTGVEDRLQDQVTTSLELLRNAGIKIWMLTGDKLETAICIAKSSGLFSRSDNIHVFGNVHNRTDAHNELNNLRRKTDVALVMPGSALNVCLQYYEAEVAELVCACTAVVCCRCSPEQKAQIVQLLRKYRAPLRVAAIGDGGNDVSMIQAAHAGIGIDANEGKQASLAADFSITQFSHVCRLLLVHGRFCYKRSCALSQFVMHRGLIISTMQAIFSCVFYFASVSLYQGVLMVAYSTCYTMLPVFSLVVDRDVTATNALTYPELYKELGKGRSLSYKTFCIWVLISLYQGAVIMYGALLVFDADFIHVVSISFSALIVTELIMVAMTVHTWHWAMLLAQALSLGLYMISLILFDQYFDRQFVLSWVFISKTTAITAVSCLPLYIVKALRRKFSPPSYAKVN

SEQ ID NO: 5175 - protein, 1059 aa, Caenorhabditis elegans; identical to SEQ ID NO: 5174

SEQ ID NO: 5176 - protein, 1797 aa, Caenorhabditis elegans
MKIIIFCFILATLTASVTFGRKCDADLKPEKLVVVGVWKRGFDNSTAQYRISDEDLSVRGYERTESDKGSSTVMLARHPEGCVINECGVRLSAMMQNNGAILHTDYRMIRMNDSTMNNIEDEFYCAEKNNFCGADVPIYRLVKHSLTGPHYAYTFNDVGQSLPGYEKEFFPLCFAWRQTPSVVLFNSTDDGVCLTLPEVQNGKILYSNDQLNVFSIGTSATLECHQGFAGNGPSSLVCTKNGWYPKREDLGSCVRLEQSNKSRLLVASDVTPTSSSCRVPSSTPNGNIVYSANVATSTSINSVPTATRATVLCSLGHVPTTSVTSSKCVDGEWEPSLPTCLSLLDIKCPILSAPRNGELVFTNSVKSPYSLNSVISLKCDRNYFGTGNLTSTCTSTGWDQKIGQCEPVGIRRLSESASTGAVCAAIANPANGNLLYMQSNPTVQYSSGTSAYLMCNLGYSLSGSVSTLCSNGVWSPSIGQCTNALALGQTTGNCEAIPTRINGTITYSSFGTYTSGTIATLACNLMNTVSGSSTSTCLSGVWNPTIGNCVSSGGTGGTGTTCPNPTVINGQITYNQGNTFDITRPSGTAATLTCNSGYTISGSSQSTCTNGAFSPTLGTCNFGSSTGGAGTTCPNPTVVNGQVTYNQGNTFDATRPALTIATLTCNSGYTISGTSTSTCINGVFTPTLGTCTFGTSGSTGTACINPIIMNGQITYSQGNTYDITRPSGTVATLTCNSGYTISGSSQSTCTNGAFSPTLGTCNFGSSTGGTGTTCPNPTVVNGQITYSQGNTFDATRPALTTATLTCNSGYTISGTSISACMNGVFTPTLGTCTFGSSGSAGTACMNPYVINGQITYSQGNTYDITRPAGTTATLTCSSGYTVSGTSVSTCTNGIFTPTLGTCTLGSSTGGTGIQCTAMIAPLGGSVIYSNGGTMGPFPSGTTVTGSCTNGGAITGASTATCSNGMWNPTFLGTCSLIGGSTTGQCSALTIPSGAQATYSPFSLSTTSFTSGTVATVTCTTGGSMLGTSTCTNGLWSPAIMGTCSGTGNTCSALTRPVGETVTYDGTTSFATTFNSGVIARVTCSNGTQIGQSTCLVGQWTPAITATCSGSSTAVGSQCIGVIVPTNAQVTYSDGSMVLHSAGTTATLTCLNSATLTGSSYSSCSNGVWTPTLGSCTSSGTGTGPCYTPPLTPVGATLTYSSGYFAPWTAGSTATMSCPAGQTVIGTSISYCTNSAWSPALGSCSGSSVGQASTTTTTCSFLPIAPPYGSIVTSQTAPFSAGTMVTLQCDNGYQIQGNNATSTCTNGVFSEITATFVPGCTPLSAFSGTLTNGRMSYSPTITATIPVGTMVNIVCYAGYTLSGNSISTCTSSGWSPSTVGSCIQQGRRACRMEMFIKKCNEAWLRSSIFTIYGVLSRVSNQNCAAMDTPNHGTFSYSVAGSFTTGTIVTLRCDTNYAATNGDTSAICTNGVWSPKSLAMCQRTLKEVIGASCPAGIPAVLAATMTYSNGQLLGPYPAATVVTATCQAGYIPTGIMTSTCTNGLWTPPSLGLCELIGNEIGGTSCGRLGEPLGGTLVYSAIGLGPYPTGTSATVLCNIGTTLSGSASSLCTNGVWNPLPGTCIATLLRKPPAKGVPENGTAADSPKVGNGTNDDTPTQIQLSGEKCPPPIAPAFGEITFSGFSTKGTFEDGTTAALKCNLGYKPTGPSFSTCRKGSFRPIIGKCSNGSEHQLPGVCVPLTPPKNARVVYIQSGTSLDFEDGTTALLYCEEGFAVTGVATLRCETGQWEPSSGFGMCDSI

SEQ ID NO: 5177 - protein, 1805 aa, Caenorhabditis elegans
MKIIIFCFILATLTASVTFGRKCDADLKPEKLVVVGVWKRGFDNSTAQYRISDEDLSVRGYERTESDKGSSTVMLARHPEGCVINECGVRLSAMMQNNGAILHTDYRMIRMNDSTMNNIEDEFYCAEKNNFCGADVPIYRLVKHSLTGPHYAYTFNDVGQSLPGYEKEFFPLCFAWRQTPSVVLFNSTDDGVCLTLPEVQNGKILYSNDQLNVFSIGTSATLECHQGFAGNGPSSLVCTKNGWYPKREDLGSCVRLEQSNKSRLLVASDVTPTSSSCRVPSSTPNGNIVYSANVATSTSINSVPTATRATVLCSLGHVPTTSVTSSKCVDGEWEPSLPTCLSLLDIKCPILSAPRNGELVFTNSVKSPYSLNSVISLKCDRNYFGTGNLTSTCTSTGWDQKIGQCEPVGIRRLSESASTGAVCAAIANPANGNLLYMQSNPTVQYSSGTSAYLMCNLGYSLSGSVSTLCSNGVWSPSIGQCTNALALGQTTGNCEAIPTRINGTITYSSFGTYTSGTIATLACNLMNTVSGSSTSTCLSGVWNPTIGNCVSSGGTGGTGTTCPNPTVINGQITYNQGNTFDITRPSGTAATLTCNSGYTISGSSQSTCTNGAFSPTLGTCNFGSSTGGAGTTCPNPTVVNGQVTYNQGNTFDATRPALTIATLTCNSGYTISGTSTSTCINGVFTPTLGTCTFGTSGSTGTACINPIIMNGQITYSQGNTYDITRPSGTVATLTCNSGYTISGSSQSTCTNGAFSPTLGTCNFGSSTGGTGTTCPNPTVVNGQITYSQGNTFDATRPALTTATLTCNSGYTISGTSISACMNGVFTPTLGTCTFGSSGSAGTACMNPYVINGQITYSQGNTYDITRPAGTTATLTCSSGYTVSGTSVSTCTNGIFTPTLGTCTLGSSTGGTGIQCTAMIAPLGGSVIYSNGGTMGPFPSGTTVTGSCTNGGAITGASTATCSNGMWNPTFLGTCSLIGGSTTGQCSALTIPSGAQATYSPFSLSTTSFTSGTVATVTCTTGGSMLGTSTCTNGLWSPAIMGTCSGTGNTCSALTRPVGETVTYDGTTSFATTFNSGVIARVTCSNGTQIGQSTCLVGQWTPAITATCSGSSTAVGSQCIGVIVPTNAQVTYSDGSMVLHSAGTTATLTCLNSATLTGSSYSSCSNGVWTPTLGSCTSSGTGTGPCYTPPLTPVGATLTYSSGYFAPWTAGSTATMSCPAGQTVIGTSISYCTNSAWSPALGSCSGSSVGQASTTTTTCSFLPIAPPYGSIVTSQTAPFSAGTMVTLQCDNGYQIQGNNATSTCTNGVFSEITATFVPGCTPLSAFSGTLTNGRMSYSPTITATIPVGTMVNIVCYAGYTLSGNSISTCTSSGWSPSTVGSCIQQGRRACRMEMFIKKCNEAWLRSSIFTIYGVLSRVSNQNCAAMDTPNHGTFSYSVAGSFTTGTIVTLRCDTNYAATNGDTSAICTNGVCTITKLHLTNQFLSALKYCTTFQVIGASCPAGIPAVLAATMTYSNGQLLGPYPAATVVTATCQAGYIPTGIMTSTCTNGLWTPPSLGLCELIGNEIGGTSCGRLGEPLGGTLVYSAIGLGPYPTGTSATVLCNIGTTLSGSASSLCTNGVWNPLPGTCIATLLRKPPAKGVPENGTAADSPKVGNGTNDDTPTQIQLSGEKCPPPIAPAFGEITFSGFSTKGTFEDGTTAALKCNLGYKPTGPSFSTCRKGSFRPIIGKCSNGSEHQLPGVCVPLTPPKNARVVYIQSGTSLDFEDGTTALLYCEEGFAVTGVATLRCETGQWEPSSGFGMCDSI

SEQ ID NO: 5178 - protein, 752 aa, Caenorhabditis elegans
MKLLLLLLFSFPVFIYSEVNHATPLILPHRNEDPVFVLLSSTPSTLPTTSAPPPPSIPILKPDASPCDLIEEAAALHCIGPLVDYAADLTNNVLHPPLSDVVETCAKYNQYMMCTQGVRPDCRQSRAPNIEFMYETICEPKFAAIMKEEQACLLEVENDKNVKECFVNKTNTLRDETPDTVSNPTQNYECTVIQAYVDCLIEREETSCRDAEKIEISFLSMLAKRNSESRCELNTNAIKSRPKAQPLEECDTQGNCKCRLPGYYYEAARKKCLDVDECESLSSACSQKCVNLPGTFECTCDPRTYKLATDNKTCERIDQSPMWLFFAHGQSVWNISTDGKSFQLQRAGLQKTAMIDIDVKENRLYYADIGANVIERMNIEGTFPQAVQRFDVDGLEGIAVDWIGRNLYSLRREDILVQSLDGRFRQPLYKNVMTLPRSITLHPAKGIMFVTDWSANAFIAAASMDGSHFRKIITERITWPNAVAVDIFAEKIYWADAFLDTIESANMDGTGRRVIIADAGSVPHVFGLAIADDYLYWTDWTYRGILRANKHNGENITVLAQTALLPYSLKVFHKSLQPEETSTCETRGCDQLCLLGENGAATCACGEGFDLLNDGKKCSSNCSESQIECGGADPKCISKIYLCDGLAQCSNQADEEKCRRFKKKIKYIKNQIQKIKSIENFIRIFWFNSPRICLPGQFQCHDNHKCLPPGGLCDKVTDCSDSSDEIYCEYQKTTEKGQFVLNTTKGKHSIRN

SEQ ID NO: 5179 - protein, 752 aa, Caenorhabditis elegans; identical to SEQ ID NO: 5178

SEQ ID NO: 5180 - protein, 500 aa, Caenorhabditis elegans
MSSIVCHPILDSQNGIATDAVIKKQRPPPLVLSRPKDLIQEACQRLVLSDQQLRRIMQSMEKSMEQGLATSTKKVAVKMLPTYVDSVPNGTESGDFLALDLGGTNFRVLHIKLQGKETKMTGKIFRVPESIMRGTGEALFDHIAGCMAKFMGENDLKDAQKLPLGFTFSFPCEQEGLTKGKLVTWTKGFKASGVEGVDVVTLLHEACHRRKDIDIDVVALLNDTVGTLMACAFQENSCQIGVIVGTGTNACYMERLDRIPKLAGYVDEHGVTPEEMIINTEWGAFGDDGALDFLRTEWDEVVDRESINPGQHLYEKMISGMYMGECARVVLEDLAKQGLLFGGNSDAISVPHCFPTKFVSEIDSDLLEDDDRTFQKTYQILEDIGVEMITANDCANVAYVCSLISTRAAHLTAAGIAMLLNRMNKKHVTVGVDGSVYRFHPTYPTLLDAKIGELIVGDIEYKLMLSEDGSGRGAALVAAVATRLKEEKLAASLSSSSSNQ

SEQ ID NO: 5181 - protein, 1127 aa, Caenorhabditis elegans
MDCDIASYHVDSFDFLVSKGCQFAAQAVPAEKFRLKNGDAVTMKFTSAQLHKPTLDTGAKLTSDTLPLLPAECRQRGLTYAGNLKVGIDVHVNGSRLDIIEIILGKVPIMLRSEGCHLRGMSRKELVVAGEEPIEKGGYFIVNGSEKVIRLLIANRRNFPIAIIRKTFKEKGKLFSEFGVMMRSVKENHTAVMMTLHYLDTGTMQLALQFRREIFYVPLMYIVKALTDKNDAVISAGFKRGRNQDQFYSSCILNMLAQCQEEEILNQEAAIRAIGSRFRVAVSDRVAPWEDDLEAGRFIIRECVLIHLDSDEEKFHTLAYMTQKLIALVKGECAPETPDNPQFQEASVSGHILLLILRERMENIIGMVRRKLEYMSSRKDFILTSAAILKALGNHTGGEITRGMAYFLATGNLVTRVGLALQQESGFSVIAERINQLRFVSHFRAIHRGAFFMEMRTTDVRKLRPEAWGFICPVHTPDGAPCGLLNHVTASCRIVTDLSDNSNVPSLLAELGMYTHKTVALAPPGEELYPVLMNGRFLGYVPITKAASIERYLRCAKVAKDARIPYTSEIALVRRSTDIKNIQTQYPGIYILSDAGRLIRPVRNLAMDAVEHIGTFEQVYLSVVLDPEEAEPGVTMHQELHPSCLFSFAGNLIPFPDHNQSPRNVYQCQMGKQTMGTAVHAWHSRADNKMYRLQFPQQPMLKLEAYEKYEMDEYPLGTNACVAVISYTGYDMEDAMTINKASYQRGFAHGTVIKVERINLVTERERKTIFYRNPREEIKTVGPDGLPIPGRRYFLDEVYYVTFNMETGDFRTHKFHYAEPAYCGLVRIVEQGEGDSGAKHALIQWRIERNPIIGDKFASRHGQKGINSFLWPVESLPFSETGMVPDIIFNPHGFPSRMTIGMMIESMAGKAAATHGENYDASPFVFNEDNTAINHFGELLTKAGYNYYGNETFYSGVDGRQMEMQIFFGIVYYQRLRHMIADKFQVRATGPIDPITHQPVKGRKKGGGIRFGEMERDAIIAHGTSFVLQDRLLNCSDRDVAYACRRCGSLLSVLMSSRAGSHLLKKKRKDDEPLDYTETQRCRTCDKDDQVFLLQVPRVFRYLTAELAAMNVKIKLGIEHPSKVTGS

SEQ ID NO: 5182 - protein, 208 aa, Caenorhabditis elegans
MAARNAGTARPGGPNRTCQFKLVLLGESAVGKSSLVLRFVKGQFHEYQESTIGAAFLTQTVCLDDATIKFEIWDTAGQERYHSLAPMYYRGAQAAIVVYDITNQESFQKAKNWVKELQRQASPNIVMALAGNKADVANKRTVEYEEANAYAEDNALLFMETSAKTSMNVNDIFMAIAKKLPIGPAQGEPTGTVDMNQPQQQQKGSCCK

SEQ ID NO: 5183 - protein, 370 aa, Caenorhabditis elegans
MAAPGRKINFAAGPAKLPEEVLLKMQEEQLNFNNLGVSVIEMSHRSKEFGALLNETISLIRELMNVPDNFEILFMQGGGTGQFAAIPLNLKGDHEHADYIVTGAWSSKAADEAGKYINVKKVFQPSKPYVTVPDQENWVHDEKAAYLYYCANETVHGIEFTPTAPESHNVPLVADVSSNFMARPFDFKDHGVVFGGAQKNLGAAGLTIVIVRKDLIGKQQAITPSVFSYKEMIANNSLYNTPPTGGIYTTNLVLKWIKSKGGLQAIYELNLQKSGMIYDIIDNSNGFYHCAVDKRYRSIMNVCFRIGGPSGNDELEEKFLKGSIERNMISLKGHRSVGGIRASLYNAISVEETQVLATWMNEFQKLHNTN

SEQ ID NO: 5184 - protein, 643 aa, Caenorhabditis elegans
MSTCKAIGIDLGTTYSCVGIYQNGKVEILANSEGNKTTPSYVAFTDTERLVGDAAKDQAARNPENTVFDAKRLIGRRFDEETVQSDIKHWPFTVKGKQGKPVVEVEVKGEKREFNAEEISAMVLQKMKETAEAVLGHSVRDAVITVPAYFNDSQRQATKDAATIAGLNAIRIINEPTAAALAYGLDKGITDEKNILIFDLGGGTFDVSILSIAEGSIFEVKSTAGDTHLGGEDFDSRVLQHFMTEFKRKTGKDISSNPRAIRRLRTACERAKRTLSSSTEATVEVDSLFDGTDFYSKITRARFEELCADLFRKTLEPVEKALRDAKTDKGRIDEVVLVGGSTRIPKIQKLLKEFFNGKDLNCSINPDEAVAFGAAVQAAVLSGVKDDTIKDVLLVDVVPLSHGIETAGGVMTNLIDRNTRIPAKASKTFTTYADNQPGVSIQVYEGERAMTRDNHRLGTFELTGIPPAPRGVPQVDVTFDIDANGILNVSAADKSTGRSNRITIRNEKGRLSQADIDRMVNEAKQFEREDAAQRDRISSRNQLEAYAFQVKQALEEHGSLLSAEDAKRAKDAVEDTLRWMERNTLADKDEIEAKDKELKSICQDILTKMHQQEAQSGSGCGNPGSGGFHSSNYPQGPTVEEVD

SEQ ID NO: 5185 - protein, 444 aa, Caenorhabditis elegans
MIRTDNLSDLASARDYWRTDKYISFVITFQFYLLLDTMSDSFNWPAGNNEARERLGEKFESLHLDSRISTSHAKPLSNADPVVVPIYHSSTYRFKTVDQFNEDNHGANFVYRRCGNPTTENVEVVINEIEGGAGSLLYNSGLAAISAVFLEFLSSGAHMIVMNPIYSGTSSFINETLARFGVEITSVDVEKEKDFAGAVEKAIRPNTKMIYFESIANPTMAVPDILGTIEVAKKYKILTCLDATFSSPYNIQPLKLGADISLHSCSKYIGGHTDVIAGVVTVSSYDNWKKLKLQQLTTGSSLSPYDAALLTRGLKTLGLRVDRISENAQKTAEFLESHPKVERVFYPGLPSHPQHQYAKQVMKQFAGMIAFDVGTAENAIKLVEAISLGGTESLIEHPLSMSHGKHLLRYLDGPTVAPGLLRFSVGIENVEDIIGDLNDALEKL

SEQ ID NO: 5186 - protein, 527 aa, Caenorhabditis elegans
MTPRIRRKTNIASFRIFHISGDYILCIVMSIYFLLSSKTDNIFRYLMTKRLGDGTFGEVMLAKKIDTGDRVAIKRMKKKFYSWEEAMSLREVKSLKKLNHPNIIKLREVIRENDILYFVFEFMQENLYELMKDRDRYFPESVIRNIIYQVLQGLAFMHKNGFFHRDMKPENIMCNGTELVKIADFGLAREIRSKPPYTDYVSTRWYRAPEILLRSTSYNSPIDMWALGCIMAELYILRPLFPGTSEMDQLFKIISILGTPNKDEWPEGYQLASAMNFRFQQVVATPMEQVVNTISKEGMKLMMDMMLWNPEKRPNANQSLRYKYFQVAEKLGAPVVSQPAPGSIRKTSAASVKSDTKAMTAKAAKKDYIGSENVSPQQPAKVIDRHINRNLPLNKETLFEKSDNKPLGPTKSNEAKPTAKEIYLSKSKYVPGTVKNKFKKSLKWLDLLIPYLNCQVSKDTHQNQIMTTNGLTGTTKTTTFSAKKEGRTAVQTRFEYAYGSSFCSSHKSLFLFVFLLPFGACLSSQYS

SEQ ID NO: 5187 - protein, 1286 aa, Caenorhabditis elegans
MKLTEIFGFVSSLDDESGILSAQTTIHKNIHFQALCQVISYDAIHDRRWLFDNFLPRFSQMLKDPTMHVRKSALHIFGNLGNMFGQKFTEVFLVPHLITLSCDMTWAVRKVACEIFVKVAECASNQVRIDILSPNFVRLLNDPNKWVSFIAYQQLGPFISLFANPDITGLELRNGQVVVRDPVVLEPSVTEQEDPSNSTFSEDTSDDFRTLPKDTWLPEVDFNDDFEYQLGSIDNTQNQKELTTVTTALVKTPKRGERVMDSVLSGINKMFGSLERSSPKSKEVEKIAATFSSPSKRSPLSLHSAVSLIDKFSKRSNPNNPQRFPVFDSANSDSTLSSNSSNNNSSEQQNSTGIAAKCSSTDDLTKLGLEDDDSPDAAEDSDDFTSETRTTSPRGRRIATNAWSKLDIRQKIFLRRLGALPPSFPKKKATHSSSSSPRKSPTRSPLLSSRKKGLLFDFAAPIEIKSSSSDHSETIPVRTANQQQEKADDDKLNTDERQQYMENSGPKFNTDEDSTNDSDSDDEDNDFEKSFVADEDDGEQDDSPLSIEIKSSSSSDFESVSAATPTSQEPVSNEFSLTYWSSNYAISSIEDELKPFGSSSSFTNSPTSNSYLESRFDVMKVNLSPRARSVSFGTNGSPISTSPRRKANSTSEPSPPNTGNLKSDDSIVMLNTEEKEKLGILDFDEMNMSISSNSSIHGEAAMTEDSDISLTSIEQAALQHVPVDLVESYMRVMGPIGGSGSGGGGNGSSTTIATGDPSLCAETYRHCAHNFPAVCYTLGRAAWPRLKLVFRKLAMDEQARVRQSISHSIHEIANMLGQEITDEDLLPVFYDLRNDQNPDVRNGILIHLYDFVKFLSPEKRDEMILSLPQFFPIGAQPGNQAQNGDWRSRFELISQLSKLCSLYSIQDVNFHMSGIALTLADDRVAEVRREAVMLVSTIVGALVTAEWDNIKGVRDIENGHVDVKKKSNKTDFLSEQFVDDIVSSFAKTQKWTRRQTFCFICAQILRDKQCDGIQFRYFFATPLQQLAQDKVPNVRLASCEALSVWRKTLIAARAQERRGQSPISSPASEPSAIRRDINLVSDMMVKLSNDSDIDAAFIAKKCQGLTDDHQPVDVASRTTRMREREEQFFGDIILSYSPGCNARVSGKEIKQLIRHDQGAVQKAAPLQSMEDFGDEILAHAADSVNIQTPPEVVATVQRVSITNEQFEDNTEAVDMEIEEDEDENSTEKKENTEKTAEEESENVKNTEDELDIPMDPAPTLPPPVTSKNQSSSPITASSSDNNETSA

SEQ ID NO: 5188 - protein, 1160 aa, Caenorhabditis elegans
MKLTEIFGFVSSLDDESGILSAQTTIHKNIHFQALCQVISYDAIHDRRWLFDNFLPRFSQMLKDPTMHVRKSALHIFGNLGNMFGQKFTEVFLVPHLITLSCDMTWAVRKVACEIFVKVAECASNQVRIDILSPNFVRLLNDPNKWVSFIAYQQLGPFISLFANPDITGLELRNGQVVVRDPVVLEPSVTEQEDPSNSTFSEDTSDDFRTLPKDTWLPEVDFNDDFEYQLGSIDNTQNQKELTTVTTALVKTPKRGERVMDSVLSGINKMFGSLERSSPKSKEVEKIAATFSSPSKRSPLSLHSAVSLIDKFSKRSNPNNPQRFPVFDSANSDSTLSSNSSNNNSSEQQNSTGIAAKCSSTDDLTKLGLEDDDYMENSGPKFNTDEDSTNDSDSDDEDNDFEKSFVADEDDGEQDDSPLSIEIKSSSSSDFESVSAATPTSQEPVSNEFSLTYWSSNYAISSIEDELKPFGSSSSFTNSPTSNSYLESRFDVMKVNLSPRARSVSFGTNGSPISTSPRRKANSTSEPSPPNTGNLKSDDSIVMLNTEEKEKLGILDFDEMNMSISSNSSIHGEAAMTEDSDISLTSIEQAALQHVPVDLVESYMRVMGPIGGSGSGGGGNGSSTTIATGDPSLCAETYRHCAHNFPAVCYTLGRAAWPRLKLVFRKLAMDEQARVRQSISHSIHEIANMLGQEITDEDLLPVFYDLRNDQNPDVRNGILIHLYDFVKFLSPEKRDEMILSLPQFFPIGAQPGNQAQNGDWRSRFELISQLSKLCSLYSIQDVNFHMSGIALTLADDRVAEVRREAVMLVSTIVGALVTAEWDNIKGVRDIENGHVDVKKKSNKTDFLSEQFVDDIVSSFAKTQKWTRRQTFCFICAQILRDKQCDGIQFRYFFATPLQQLAQDKVPNVRLASCEALSVWRKTLIAARAQERRGQSPISSPASEPSAIRRDINLVSDMMVKLSNDSDIDAAFIAKKCQGLTDDHQPVDVASRTTRMREREEQFFGDIILSYSPGCNARVSGKEIKQLIRHDQGAVQKAAPLQSMEDFGDEILAHAADSVNIQTPPEVVATVQRVSITNEQFEDNTEAVDMEIEEDEDENSTEKKENTEKTAEEESENVKNTEDELDIPMDPAPTLPPPVTSKNQSSSPITASSSDNNETSA

SEQ ID NO: 5189 - protein, 320 aa, Caenorhabditis elegans
MEKKVDENATLMNGVETTGPARDDVPETFREFLYNKKNGTVMGRTGKSWFQIIVFYIIFYAFLAAFWLTCLTIFMKTLDPKVPRFYGKGTIIGVNPGVGYQPWLKERPDSTLIKYNLRDQKSYKAYLEQMKTYLTKYDSNATETRECGAGDSNDDLEKNPDALPCRFDLSVFDKGCSEKSDFGYKSGKPCVIISLNRLIGWRPTDYQENSVPEEVKDRYKAGSIAINCRGATNVDQEHIGKVTYMPSNGIDGRYYPYVFTKGYQQPIAMVKFDTIPRNKLVIVECRAYALNIEHDISSRLGMVYFEVMVEDKPVEEKKEL

SEQ ID NO: 5190 - protein, 174 aa, Caenorhabditis elegans
MADQKEASEAAKNREIKISSSDDEIFLVPRNVIRLSNTLNTLLVDLGLDDDEGTNAEPIPVQNVTASILKKVINWCTKHQSDPIPTEDSEKKTDGSIQDWDKKFLDIDQGTLFELILAANYLDIKGLLDVACQSVANMIKGKSPDEIRRAFNIKDDFTAEEREQIRKENAWCDD

SEQ ID NO: 5191 - protein, 176 aa, Caenorhabditis elegans
MADQKKVSEAAKEREIKISSSDNEIFLVPRNVIRLSNTINTLLMDLGLDDEEGTNAEPIPVQNVTASILKKVISWCNHHHSDPISTEDSDNREKRTDDIGSWDVEFLKVDQGTLFELILAANYLDIKGLLDVTCKTVANMIKGKSPEEIRRTFNIKNDFTPEEEEQIRKENAWCED

SEQ ID NO: 5192 - protein, 176 aa, Caenorhabditis elegans; identical to SEQ ID NO: 5191

SEQ ID NO: 5193 - protein, 587 aa, Caenorhabditis elegans
MNVARRRSGLFRSTIGAPPKATRGRAAAPPIKEADPATIPRQSAPGGITIGAAACRPPSRLPGATISATGRASLPERSAMAKTSTSSHSRPALQSTASRNTTLTAASTSRQLRTGRPPPPSTQRSTATFSLKPSVARARPVAQKPILPSKVTLLEERNAQLEREMAEATDFAEHQKSKIQFLDGKLEGADRKLISLQDQLSTLKEVHKSKMEECEEYRVHNNDLRDLLNEKEAELRKLHNDVVDLRGQIRVAVRVRPLIKSEVDTSSSAIEYPAVDAIKINEGSKPGNVVKFENVFTPVFSQKEVFANVEEFIRSSLHGYNVGLIAYGQTGSGKTHTMRGGNGEEEGIIPRAAAFLFAESKKLESLGWKFDFSLSFLEVYNNVAYDLLSGRDVVQLRLNDQTVSMIGLSEHTISNVSDVARLLRVADGGRKTAATKCNGSSSRSHAVYMWKIKAHQPSTGISTTCQLKLVDLAGSERAKESGVSGDQFKEMTNINQSLSILQMCISQQRSQKGHVSYRDSKLTQVLMDCLGRGSSKTMVVVNLNPCNEQATESKRSIEFASKMRSTHIGSAVQQRTLLGDVSQMSMN

SEQ ID NO: 5194 - protein, 164 aa, Caenorhabditis elegans
MSEYLCVASNGIPPDESWTVKLLVTFPPLVQAQSETVQASVGSMARMVCTTEAWPRPEMGWEKDGEPVYESNNVAMTHTVSGQYHSVHILEIRNVQSSHFGVYRCVAKNDNGIHHSQVTLNQISHNHFTNSNLIPEELRAIQVDSASFPSLLLITIIYFVYHGF

SEQ ID NO: 5195 - protein, 412 aa, Caenorhabditis elegans
MSEAESCEETSKEHRIWKKNVPYLYDTVVTKEVEWPSLSVQWMPDVTKTENSDSSMHRMIHGTHTCGGVQNHLMISKFTITTDTPEFDDAKWDSEREEFGGYGEGSAAKWDTEIKINHPGEVHRARYMPHNPFIIASRGPSDDVYIFDYTKHPSEPKDTKFRPQLRLKGHEGEGYGMSWSNTREGHLLTAGDDGMICHWDINANQTISGQIVPQSKFKGHSSNAEDVSFHALHNFVFGSVGDDRKLNLWDLRQSKPQLTAVGHTAEVNCITFNPFSEYILATGSVDKTVALWDMRNMRKKMYTLKHHNDEIFQVSFSPHYETVLASSGSDDRVIVWDISKIQDPSSSSAASSDSVPPEVIFIHAGHTGKVADFSWNPNRPWTICSSDEFNALQVWEVSNSLVSSEKWETEMI

SEQ ID NO: 5196 - protein, 417 aa, Caenorhabditis elegans
MATLEDGTSEDRVANDEYKIWKKNTPFLYDLVMTHALEWPSLSVQWLPDVAKDNSDHTIHRLILGTHTSDEQNHLLISKICMPTDDAQFDASRYDTERSEYGGFGAVNGKVEPDIRINHEGEVNRARYMPQKSNIIATKSPHADVYIFDYLKHSAVPRDNTFNPLIRLKGHTKEGYGLSWNPNKEGLILSASDDQTVCHWDINANQNVAGELQAKDVFKGHESVVEDVAWHVLHDGVFGSVGDDKKLLIWDVRTSTPGHCIDAHSAEVNCLAFNPYSEFILATGSADKTVALWDLRNLRMKLHSFESHRDEIFQVQWSPHNETILASSGTDKRLHVWDLSKIGEDQSAEDAEDGPPELLFIHGGHTAKISDFSWNPNEPWVVCSVSEDNILQVWQMADNIYNEVDEETPADVVERQQ

SEQ ID NO: 5197 - protein, 417 aa, Caenorhabditis elegans; identical to SEQ ID NO: 5196

SEQ ID NO: 5198 - protein, 409 aa, Caenorhabditis elegans
MVLFHDVFDAAQKNGLVIPSASSVVRTAKCSSAATSVAAPIEFGSSQFYAMCALGGSLSCGLTHFAITPLDIVKCRIQVSSKVYFLLLPIFQFQVNKEKYGSMVQGFKVTIAEDGVRGLARGWAPTFIGYSAQGLGKFGFYEVFKNIYSLSLGEENAYIWRTSIYLAASASAEFFADIFLAPMEAVKVRMQTSPTAPTTLRACAPMIYKQEGLTGFFKGLPPLWTRQIPYTMMKFTCFEKTVELLYQYVVPKPRAQCSKSEQLAVTFTAGYIAGVFCAVVSHPPDVLVSKLNQDSNASVGSLVKQLGFKGLWGGLGPRIIMVGTLTALQWFIYDSFKVAMNLPRPPPPQMPESLKKKLGIPGTTEVAPVAEKVAAPEKNAKCEKPGKVDKKQEKKEKKEKKAKKSEEAV

SEQ ID NO: 5199 - protein, 585 aa, Caenorhabditis elegans
MATRGPTPDKARMGLPDRWLHCPKTGTLINNLFFPFKTPLCKMYDNQIAERRYQFHPAEVFSHPHLHGKKIGLWIDLTNTDRYYFREEVTEHECIYHKMKMAGRGVSPTQEDTDNFIKLVQEFHKKYPDRVVGVHCTHGFNRTGFLIAAYLFQVEEYGLDAAIGEFAENRQKGIYKQDYIDDLFARYDPTEDDKILAPEKPDWEREMSIGMSTQIDNGRPSTSQQIPATNGNNNQNGNQLSGGGDNSKLFMDGLIRGVKVCEDEGKKSMLQAKIKNLCKYNKQGFPGLQPVSLSRGNINLLEQESYMVSWKADGMRYIIYINDGDVYAFDRDNEVFEIENLDFVTKNGAPLMETLVDTEVIIDKVEINGAMCDQPRMLIYDIMRFNSVNVMKEPFYKRFEIIKTEIIDMRTAAFKTGRLKHENQIMSVRRKDFYDLEATAKLFGPKFVQHVGHEIDGLIFQPKKTKYETGRCDKVLKWKPPSHNSVDFLLKVEKKCKEGMLPEWIGYLFVQNLSDPFGTMKATATLKKYHNKIIECTLLVDNQGRPKEWKFMRERTDKSLPNGLRTAENVVETMVNPVTETYLIE

SEQ ID NO: 5200 - protein, 495 aa, Caenorhabditis elegans
MVMEVDEPAVAATTSQNQPQEHANDFDMDTSEGPIENDETFEPVDQINWKFNQVKGNIDADVHTEADVISCVEFSHDGEYLATGDKGGRVVIFQRDQSGKYVKGVRSREYNVYSTFQSHEPEFDYLKSLEIDEKINQIRWLKKKNAANFILSTNDKTIKLWKISERERKIGDDAWNLPRTNRINTSSFRGRLQIPSIVPMELIVEASPRRVYGNAHTYHVNSISVNSDQETFLSADDLRVNLWNLEITNESFNIVDIKPANMEELTEVITAAEFHPTQCNWFVYSSSKGSIRLCDMRDRALCDAYAKIFEEPEDPQSRSFFSEIIASVSDVKFSHNGRYLLTRDYLTVKVWDLNMESQPVETYPVHNYLRTKLCALYENDSIFDKFECDWSGDDKHILTGSYHNLFRSYARGNNQDAKTWEARPQEPHSQLRSRFVVPSAKRKRNNLSSSGETTEEDLSSDQLQFDRKILHTAWHPKDNIIALAATNNLYIFSDV

SEQ ID NO: 5201 - protein, 495 aa, Caenorhabditis elegans; identical to SEQ ID NO: 5200

SEQ ID NO: 5202 - protein, 491 aa, Caenorhabditis elegans
MRDAENMNKWVEPKKKKRKKTLLKRERNRKRGETVKITEMPPNSVFLLPVLCLIVPIYSRGFFGIPGDYCSVRTHTCCENRDDDCTVPILGDHLCYCDMFCDRGPDGGNDCCPDFEATCRGKDIQNDQRIDGESCSMDGDTKEKNCEKCTCHNGFWKCDGTACLIQPDILEKIHTGRYSWSARNYSAFWGRSLSDGIKYRLGTLFPERSVQNMNEILIKPRELPEHFDARDKWGPLIHPVADQGDCGSSWSVSTTAISSDRLAIISEGRINSTLSSQQLLSCNQHRQKGCEGGYLDRAWWYIRKLGVVGDHCYPYVSGQSREPGHCLIPKRDYTNRQGLRCPSGSQDSTAFKMTPPYKVSSREEDIQTELMTNGPVQATFVVHEDFFMYAGGVYQHSDLAAQKGASSVAEGYHSVRVLGWGVDHSTGKPIKYWLCANSWGTQWGEDGYFKVLRGENHCEIESFVIGAWGKGSKRRRRFKMRKLRRFRKMFK

SEQ ID NO: 5203 - protein, 449 aa, Caenorhabditis elegans
MREVISIHVGQAGVQIGNACWELYCLEHGIQPDGTMPSDQQADGESFTTFFSDTGNGRYVPRSIFVDLEPTVVDEIRTGTYKKLFHPEQMITGKEDAANNYARGHYTVGKELIDTVLDRIRRLADNCSGLQGFFVFHSFGGGTGSGFTSLLMERLSVDYGKKSKLEFSIYPAPQVSTAVVEPYNSILTTHTTLEHSDCAFMVDNEAIYDICRRNLSVDRPSYTNLNRIISQVVSSITASLRFDGALNVDLNEFQTNLVPYPRIHFPLAAYTPLISADKAYHEALSVNDITNSCFEPANQMVKCDPRHGKYMAVCLLYRGDVVPKDVNTAIAAIKTKRTIQFVDWCPTGFKVGINYQPPTVVPGGDLAKVPRAVCMLSNTTAIAEAWSRLDYKFDLMYAKRAFVHWYVGEGMEEGEFTEAREDLAALEKDYEEVGADSNEGGNEEEGEEY

SEQ ID NO: 5204 - protein, 611 aa, Caenorhabditis elegans
MRVGSTVRSRAKARVVRRLILLPVALVAIIGAAHLMRERRSNQTGPGIITPENTPVNASKPFWKTLLPTCNRNPLKNSFQLYEFFSRSLAPPAPDVNDDGQFPPDPFSLEQRQNGFVVLHMCGLIYMFVSLAIVCDEFFVPSLDVLTEKLSLSDDVAGATFMAAGGSAPEFFTSVIGVFIAQNNVGIGTIVGSATFNILCVLAFCTLFSKSILDLTWWPLFRDVSIYMLALAMLVFFFMDEMITFPEALAMFSIYIVYCTVMKFNGQLEQLVKKGSDSEEASAHETQKLAADVPHNNNNNDLAQLEGSELRRRSSARRQSVPILHSGTMFRNGIMQLMNQTLEQLPEDSEEDDSSRSRSNVNIESHDMHRLNVNQSMPDRRSSQIEEIKSLLEEQEEKPLDMTWPETWVKRLTYVLLAPVVIPMWVTIPDVRKSHNRGLYPATFIISILWIAFFSYLMVWWANTIGETFVIPTEIIGLTILAAGTSIPDLITSVIVARKGLGDMAVSSSVGSNIFDVCVGLPIPWLLYFLIEYIKHPNEPLSPISVSSKGLLCSVGMLFIMLIVLVFAIFLSGWKMNKIFGILMIVSYVFFCVFSVSLETDKLVCPLNICG

SEQ ID NO: 5205 - protein, 568 aa, Caenorhabditis elegans
MHRHILILFLFGCLSADQRLSSTSISSMNGFSTTRKCEHITIPMCKNLDYNQTVFPNLLGHTTQSEAGPAIAQFNPLIKVKCSEDIRLFLCTVYAPVCTVLEKPIQPCRELCLSAKNGCESLMKKFGFQWPDQLDCNKFPVTDLCVGKNSSESSNSKKSSNDVTFGVSTIANEVVLSPKKCPHHMHTTSGSHFSLPLLSGRLPECSLTCEADNQVPMMFDGRVRRILRIWTAAWSVACFVCSLFTLVTFLVDLSRFAYPVRPILYLAFCYLAISTVYMIGVVGEDGFACGTYGSTPTTLVTQGGENVGCSALAVVHYFFFMSSCAWWLVLCLAWFLAANLKWGAESIAALSPYFHAMCWGVPAVLSVTVLVTNSVDGDVFTGICSVGNLNPSALVYFFFTPIVVSLALGAVLLVCGIWSMIRIRSYIKLQHADVERNISKLEKLMLRIGAFAIMYSLPTAMNAAIMWYQAVNMPAWLEGWLHHRCVRLQDRELFGFTYPVDDCPMDPKVAAPEIIVFLLKYVSQLVVGITCAIWVVSSKTLSSYHKAYLALSSRSPTVPAHVDQVNMR

SEQ ID NO: 5206 - protein, 352 aa, Caenorhabditis elegans
MSKMKRRTNKPRATESANSSTKSSVLDEPTLVERKQQKKQILKFVQRTLEKMPQGLRAEFVGMRRFNDFEKMKAFKEAQEAGKNRYKDVGCLDNNRVKLEGPWPHEYIHANYVATPTNPKRFICTQAPLEKTCADFWYMCYQDKVEYIFMLCNFLEKGAKKCFEYFPSKKGDVMDFDEGGQKISVKCESSVTFIESFHYSFRADAKANVTATEIVIEGPGEKTRKTTHYHWNDWPDRGVPAADMAVLELLENARPSKGPIVVHCSAGIGRTGSVVMLEYIMDQLLAGQIIDDGEKILVKICEQRNNSIQTDAQYLFVHQVILNYFRKKKLMDESGVQEAYDAFLEQYKKVVV

SEQ ID NO: 5207 - protein, 373 aa, Caenorhabditis elegans
MFGSSGFGNKSMFGGSNISTSTTTPAANTTQNDDFLVDGAPEDTIQVIKFSPTPQDKPMLACGSWDGTIRVWMFNDANTFEGKAQQNIPAPILDIAWIEDSSKIFIACADKEARLWDLASNQVAVVGTHDGPVKTCHWINGNNYQCLMTGSFDKTLRFWDMKNLPNQTQMAQIQLPERVYAADVLYPMAVVALANKHIKVYNLENGPTEVKDIESQLKFQIRCISIFKDKSNQNPAGFALGSIEGRVAVQYVDVANPKDNFTFKCHRSAELVNGFQEIYAVNDICFHPQHGTLVTIGSDGRYSMWDKDARTKLKTSEPHPMPLTCCDVHSSGAFLVYALGYDWSRGHEGNTQPGSKIVIHKCIEDMKPRPTKK

SEQ ID NO: 5208 - protein, 190 aa, Caenorhabditis elegans
MGIKGSKPKLSKEDLEFLKKNTNFTEEQIKEWYKGFVQDCPKGHLTKEQFIKVYKDFFPSGSAEGFCEHVFRTFDTDNSGFIDFKEFLLAINVTSSGTPEQKLEWAFRMYDIDGNGTIDEKEMIKIIEAIYEMLGPEVTKSADDSPRKRAKMIFEKMDVNNDKELTLKEFVDGCLADKELFQILTNEVKK

SEQ ID NO: 5209 - protein, 403 aa, Caenorhabditis elegans
MHRVVITGMGAISPFGVTVNALRNGLNEGRSGLKYDEILKFVVGAVPGERVEDRWSTGQQREMSKASMFVLAASEEALKQAKAEDVDHNETLVNIGTCMSDLEHIGETAQKVSEGQSRRVSPYFVPRILNNLPAGYVAMKYKMRGGVESTSTACATGLHCIGNSFRSIRYGDSRRALAGAVECALNPIALAGFDRMRALARGDQPNISRPFDKKRAGFVMSEGVGLVFMERLEDAQARGAQILAEVVGYGISSDCYHISTPDPSAIGAVLSMNRAIGNAHLEPKDIGYVNAHATSTPNGDSVEAEAVRQVFPEQNIAVSSVKGHIGHLLGAAGSVEAIATIFAMNDDVLPANRNLEETDEGNGLNLLRENQKWSDVSGNKSRISICNSFGFGATNASLILKQF

SEQ ID NO: 5210 - protein, 399 aa, Caenorhabditis elegans
MSIAVILESIQGSSSFEWIRTNLRHLLPIFCFIGILGNSMALILIRTNFWLRRLTSNIYLCTLSVSSCFFLLTVIISWADTYMGLPLYSESELGCKFFSFLAHFSDFICVWMISLISCDRMIVLYRPRIRKWVCTKKFSRNMTIGFVLSSVVLYSWLFLLAGLQIYRLKDGTENTFCGLSQDVNLFGFQVDQHYFMFTLMDTALCTLLPAILIIIVNSFSTYRYRQCMKIYSSGVLRVRFVRAPTTQQQQQQLNNDTIQFEETTVKKYLLSTDNTHSNLPTSSTQSRNCGKLRSSDLQLSRTLIIVTSTFVLLNVPSYAMRILQSIISSAGPLFNFVYYVTLLIYYLHHAVLFYMYIFWSPQMKKQLKPTAMRLLECYCLKTVPDFGHRSTSTQGKELG

SEQ ID NO: 5211 - protein, 1149 aa, Caenorhabditis elegans
MMITRELVLKANREQPPYASILALAASGFSLEKSVQFSEKQQLALNLDGELLSNDVEIARIIAQSTDAADSLLGSSIIDFAVVDDLTNFIADAVTKNDYSLLLGKDFPTKILDNSLTVADFAIFSVAHNNPQLKAKFSGIIDKVLKEPTLAAAHNFVGLYKSAAAPTATASTGKEKKKDEGKFVELPGAEKGKVVVRFPPEASGYLHIGHAKAALLNQYYQQAFEGQLIMRFDDTNPAKENAHFEHVIKEDLSMLNIVPDRWTHSSDHFEMLLTMCEKLLKEGKAFVDDTDTETMRNEREQRQDSRNRSNTPEKNLQLWEEMKKGSPKGLTCCVRMKIDMKSNNGAMRDPTIYRCKPEEHVRTGLKYKVYPTYDFTCPIVDSVEGVTHALRTTEYHDRDDQYYFICDALGLRRPHIWEYARLNMTNTVMSKRKLTWFVDEGHVEGWDDPRLPTVRGVMRRGLTVEGLKQFIVAQGGSRSVVMMEWDKIWAFNKKVIDPVAPRYTALDSTSPLVSIELTDSISDDTSNVSLHPKNAEIGSKDVHKGKKLLLEQVDAAALKEGEIVTFVNWGNIKIGKIEKKGAVITKISATLQLDNTDYKKTTKVTWLGDVKAEAGKTIPVVTADYDHIISKAIIGKDEDWKQFINFDSVHYTKMVGEPAIKNVKKGDIIQIQRKGFYIVDQPYNPKSELSGVETPLLLIAIPDGHTGKEAEKPPKGAPVSAAASSGGSDALQLYNSIEQQGGIVRDLKTKDAKSQATKDAIAKLLDLKKKYKELTGSDHKPGAPPSAPAPTTPSSSESNSALNIYNLIEAQGLLVRELKGKDAKSQATKDAIAKLLELKKQYKEVSGSDHKPGVPPAASVASAPAPAPAAGSTNALDIYHQIESQGALVRELKGKDAKSQATKDAIAKLLALKKQYKEVTGSDHKPGVVPVSAPAPTPLAGGADIAGQIEAQGVLVRDLKNKDSKSQETKDAIAKLLELKKNYKEVTGSDYKPGPAPAAAPAKVTVPAPSVSGGDTLSKQIDDQALLVRELKMKDAKSQETKDAIAKLLQLKKQYKDATGSDYKPAPAQLAASAAAAPAPAPAFDEAALLKEIEEQGAVVRDAKSKDPKSQDSADAINKLLALKANFKKATGKDFPAPSNAQSKKGKKK

SEQ ID NO: 5212 - protein, 360 aa, Caenorhabditis elegans
MTATPEVQKSIEEVYTKLQGASDCSSLLKKHLTKDVVAKNKSKKTRLGATLLDVIQSGGENLDSGVGIYAPDAESYTLFADLFNPVIEEYHNGFKATDTQPAMDLGEKNVGELADLDPEGKFIVSTRIRCGRSLQGYPFNPCLSETNYKMMETRMKEIFNSITDPELKGTYYPLTGMDEETKKKLIADHFLFKEGDRFLKAANANRYWPNGRGIFHNEKKTFLVWVNEEDHLRIISMQNGGNVGEVLARLIKGLNLVAAKAPFARHPRLGWLTFCPTNLGTTVRASVHIKLPKISAKDDFKKICSDMKLQIRGIHGEHSESKEGIYDISNKQRLGLTEYQAVRQMYDGLKKLIELEKAAA

SEQ ID NO: 5213 - protein, 527 aa, Caenorhabditis elegans
MTTKRTRNTLWLLILISAFAINAEIADDKPPKFQVLRAHATDVPQLKALRDIHERTQHDLDFWQTPSKVGHRADIMVDEDRMEWLDSVLKNSNISYDVIIEDVGKLILEKEHGPPRFSNLLFSKRMHNEGGNRARYGFGEYHSYQTICDWMKDIERKYPDKAKVFTMGTTSEGRPIQGIKIGSQVWRNDKRIFWIDGGIHAREWAAVHTALWFIDRIRLWRKNRAGVVCKKDRWFRDRCCGGVDLNRNYDWHFGETGSSTDKCSEIYQGSSAFSEKLNGKIDAFITLHTYSQMWIHPYSHARKSVPADVAELVCVDENNVQRVGRAAVAALENTYGTKYKFGTGSDILYPSAGGSDDWAKGTLRIKYVYLLELRPGEDVWDGFILDQHQLIPTAKETWNGIKVVIRAVTEQAGSRSSSPRVLPAFVRRPNGSIVRTNVRRPGSRQFIRRPGSFAQQRSGQFRNRNSHRSQVANVAQRPGPPQQASRSGTCADRSSWCASWLNANSRVCQISQIYMRQDCARTCGFCQ

SEQ ID NO: 5214 - protein, 1267 aa, Caenorhabditis elegans
MLYSHVTLLMLRVVDVVAKTTVQQSARMLVAEIHGEIQIGALFPIHRQIAGSESCGEIWEQYGIQRSEIAMLTVKQLNEELPFKLGLSIRDSCWTERIAMEQTIAFLREGVAQCSCCQTPGCNKKSVPVVAVIGPGKSSSTIAVQNLLQVFRIPQVGYSATTPDLSDKEQFGYFLRVVPSDVFQAQAINRLLHHYNWTYVAVLYSAGNYGEKGFESLEKLIAHRSSSVCIAYSEKIKTLASEQEYRQVLTRLDSQNSRPQVVVCFCEGASMRMFFKAQKHLADGKMQMKRFQWIGSDGWADRNDVVEDLEEEAEGSFSIRIHAPKIPGFRQYYTALHPENNTMNPWFREFWQQKFNCQFAVSKEDKNNENIRICSGDENLDEQYKEDPKLSQVINSIRVVALGLKAMYQDRCRDNSTLCTEMLSRNGTLLYEYLLNVTYSDQFKQPVYFDRNGDPPAWYDILNYIGTKDLDNPYNEVGSFKSINDYGVEELDMTAKSMFFDKTELLPESVCSRPCGIGQRQRETMACCWICESCLDIQYVNKTTNQCMNCTLGSWPNANRTGCEYIIPEVVSWTSFGHILALVLAVTGIITSMATLAVFLRHNSTPVVKSTTRELSYIILSGLVACYAVSFALLATPSTTSCFITRVIPPIAFAVVYSALLTKTNRIARILAGSKKRILTKKPRFLTTFSQVVITWILVAVQCVIVGVGLMRDWPDATYAKYALPRKLILECDTETKSFLIPFFWDFFLITLCTLYAFKTRNLPENFNEAKFIGFTISQPAKSLPFFQKEHVIIFQYCTVVVWIAFLVLHMGTTHKALVMSFSYSLSASVALALLFFPKLYIILMHPEKNIRASYTTTKLIRCHFGNSQAAYDSTSKQQHLGSKTTARTSVQSGSASKSSSMGGGVTRTASVHVPVSRGSTHSTDVSTQTEGTLRSIFPLIMFKIVFLSNFDILLAASKFSRSFSIVGRKKQGLDDDVQQLVDACRRYQDEKINSSAANLLLEESEDEVGALLADSIENSMRTVLSTVAGKAVVPLVPMVPMIPVVTLPTAPSQEDNFEQAGFKEKCQLSKDLSRKSPKQFLHVAPKSRCSTSRAVSSYTIMSGNQQLMSPMGSVSSSAGSGSPSPMSSFDHLSDEELAQISVRQLNQKLMGQDRNVVMQWKQKRRTLKNRGYALNCRARRVNNQVQLEADNMMLRNQIKTLREALSEAQMRLHYYEPVFYQAYPSIVPSTTSPVTVSLPTIARPIPVPPDSTATVTKFATDFKQIF

SEQ ID NO: 5215 - protein, 1267 aa, Caenorhabditis elegans; identical to SEQ ID NO: 5214

SEQ ID NO: 5216 - protein, 153 aa, Caenorhabditis elegans
MSNTERTFIAIKPDGVHRGLVGKIIARFEERGYKLVALKQMTASKAHLEVHYQDLKDKPFFPSLIEYMSSGPVVAMVWQGLDVVKQGRSMLGATNPLASAPGTIRGDFCIQTGRNICHGSDAVDSANREIAHWFKQEEINDYASPFINSWVYE

SEQ ID NO: 5217 - protein, 248 aa, Caenorhabditis elegans
MFLTRSEYDRGVNTFSPEGRLFQVEYAIEAVKLGSTSIGIKTSEGVLLAAEKRSTSKLMVNDAIEKISKVDQHIGVTFAGLIADSRTLVERAQIEAQNFWFTYNRKIRVEDVTQSVANLALQFGDDDVKASMSRPFGVAMLFAGVDQEGAKLFHLDPSGTFIDCKAKSIGAASDGAEQNLKEQYHDALTIKEGLKMALAILKQVMEEKLNSANVEVVVIKPTVDAKGRPIGEFTRVSNEELDQVITSL

SEQ ID NO: 5218 - protein, 994 aa, Caenorhabditis elegans
MPPKASNSTEVWINPKLSVKFPFEPYECQRIFMKNVVDVLDRKLDAALESPTGTGKTLSLLCSTLAWVQRQKETKPLDFATWQTSGAGGAEKTDEKLKSAYVPTIFYASRTHSQLEQVVHELNRTEYKWVKTTILGSREHFCINQKVKKIKESNRQAHVCRGLVSKRACHYYNKFDACTTDKMTEFLDKGEAMDIEDFVKLGTQNSLCPYFMSRQRSETAELILLPYNYIIDPKMRRRYKLDLKNSIVIFDEAHNLESICESNASAELTSTSIALCIEELKKVLALLVDEEETARSEADAETGAFGSAKIDLTKKLIENLRTEDLMTVLEKIFSLEEEMDKLFGSSQLKSVPPLSGKASDGEILLETLAKAGFDANSVERLVDVLRDAISYLLSKNEEVALTEKGDGMEKVADFLLSIYSTHAQDVAAAVGEETVKLVDRVDPKTVARNCKLYIQKDKDNEKLTIKYFCFQASISMRMLKMRGVRNVLLASGTLSPIQAFTYNMGLNFGAILENEHALKQVPVLTSIVTRGKRGGLAGSFQNRKNLDYVTGVAEALLRVMEVIPQGILIFFSSYSQMDELVATWKTTKWSSNSNESFWEKMEKTKRVVVEPRAKEELAAIRLRYTQGVSEQHGAALLAVCRGKVSEGIDFCDAESRAVIIIGIPYPPIHDERVVLKKMYLDDLMGRKDTKSERQSSQDWYQMEAFRAVNQAIGRVLRHKDDFGTVVLMDTRYASAKPEMFPKWLRNTISRSDTDGCALKTSRFFKERGHLIENSKTEYIKKQAKQCKSFRQVKQTAASDSKDDIIEITLEDMFSPANMKLEKKEITKLRPPQLIPSTSSVFSLPTNEDELKIKKWEQENDIQCLSSIPLESNKRKFKIETPGPSTSTLTQKSEPPKKKKILLLTRNTLPDEYQKAIEIPTSELLKDMSDDNKKQFATTLRSYKAESIRWDEVFQRFRPIFVPHKADLFIACSNVLRSEDKMKYLKKALESKIHT

SEQ ID NO: 5219 - protein, 994 aa, Caenorhabditis elegans; identical to SEQ ID NO: 5218

SEQ ID NO: 5220 - protein, 2823 aa, Caenorhabditis elegans
MRLWLGLLAVSNIALGGWNTSEDASIWENYVEDSNYHEFISSESERGLFPNIFNLATNSLITATDTCGQYTAEEYCKLVEHVLLRKTTNTQSPQCDICDANNVHKRHPIEYAIDGTRRWWQSPSLANGLRFEKVNITIDLRQEYQVAYIILKMGNSPRPGTWVLEKSLDGEYYEPWQYYAMQDAECMRQFGIPATTGVPRFQKEDEVHCTSEYSKITPLENGEIHTSLVNGRPGAENTSLELQKFTRARFVRLRLISPRTLNADLMIINKKSDSLDKSVTMRYFYSISDISIGGQCICYGHAESCPSDPVTGQFKCECRHNTCGESCNRCCPLFNQLPWKPGTNSHPNVCQQCQCFNHAHSCVYDDELDRNKWSITPEGVYEGGGRCLECAHNTEGFNCERCKDGYYRPSGLSHYREDACRTCECDPVGSVSDACVRDDQSAENGQKPGDCICKPGFGGRRCERCAPGYRNHPTCEPCPCNRAGSVNFDTCDGASCQCKANVEGIYCDRCKAGTIHLSASNPLGCQPCFCFGHSSTCTQGKWNKAQIINNIGWHLTDLTGGKDVKPEVENGEVLMFNANQNQDRSLYYWKAPDSFKGNMLNSYGGYLHYDVYYVPTEQGATVFVADVAIEGNGIKIEYHSRIEFLPREKMTVAIPMSELSGWYNAEARSPVDKADMMRALANVDRFTVRATYHQPQLQSSIFGLSLDTAVPAPDEIVEEDTSLKALAYHTQDTLMGGVEVCECPENFAGNSCESCVPGYRRVNNQLYGGRCEKCDCHGNSEECDPFTGECLNCRHNTTGSRCELCKPGHVGNPSRGGELGACEQCECPSLDLNPNPECISTELAVLGSVASNEDNYVCINCPLGYEGNKCEYCSDGFFEDPLTGKCIECTCNGNIDPMGIGNCDSETGKCLKCIGHTTGDSCESCKEHHWGNAQLHTCKPCGCHTQGAVNPQCSEENGECECKENYIGAQCDRCKENHGDVENGCPACDCNDTGSIGSDCDQVSGQCNCKQGVFGKQCDQCRPSYFNFTDAGCQFCHCNIYGSIEDGKCDQTTGKCECRENVEGTMCEKCADGYFNITSGDGCEDCGCDPTGSEDVSCNLVTGQCVCKPGVTGLKCDSCLPNFYGLTSEGCTECEPCPAPGQVCDPIDGSCVCPPNTVGEMCENCTTNAWDYHPLNGCKLCDCSDIGSDGGMCNTFTGQCKCKAAYVGLKCDLCTHGFFNFPTCEPCGCNAAGTDPLQCKDGQCLCNEIGECPCKKNVHGTKCDQCGEGTFSLDSSNLKGCTECFCFNRTSNCEQSDLVWQQMYAEDRRAVFQEPWEFYTKKHNINLLREKPSHFNSYPTDATPLYWPLPSTMLGDRTASYNGFLRFKIWNEDNRRGLHGIRPDQQYFRHFPQVIIFGNNRIELEHIPMEINDDGIYKIRLHESEWRVRHSPELTLTRKQMMVALQDTQGIYIRGTYTYPARGDAINIQEVSLDVAVPESKIVAGLSTTKAIGVEKCLGCPQGYTGLSCQNPEVGYYRKKHREYLNQADDIALIGWSEPCSCHGHSQTCNPDTSVCTDCEHNTFGDFCEHCLPGYIGDAREGGANACTKCACPLVENSFSDSCVAVDHGRGYVCNSCKPGYTGQYCETCVAGYYGDPQHIGGTCSPCDCHPDGSLHGACNPLSGQCECKPGVTGRTCSMCQERHAFINRVCTSCDQGCYLPLMETMDTMEEHLGRQNFSGLKPIPWKRVWRIGNESQDLSTFVGGIDKDGEIVKDSKWAKDAFALLDEVNFQMGRSNKSAVSIKQFTGIAEQLILDAQIHYANAFNTTNFLKMFAEHGATTVGGAALDGMLMEAEAHLNATVERGEYVEKRLNRAQQEHKKAEELLKMVTAQKLNETIFEDLKNRIDVLEQWMNDYRETIYDVSKKDTADAERMSLVVGKRINRYKEVSNEIEKLRVEAEDQIAYSRNSIEKARSEELMNMFEDKEKINMTLAELPDLVEQCQNITLLYSQLIDEYDEEYVQTAGRHAEKLEVQAQKIVDRFVDTRTETENPLKASHAYENIVEALKNATEAVDSAAEASEAVSKMLGSEGSESGDANEESLRSQLEKLKNESSLSNVDNSNAVKIVEELKKEKKDLTDRLGHLNELKTSIVKRLGVIKNEASSWDDKHDRMHSILKNGAKTAHERSANVKKESEGIKTEVSAIKAEVEKLMNSTSSGVQEDMEKIRASRTGMEYGAQKLTKVNKLSTANQGRTDKMARNIAILKAKIEQAREKAYQIRLSLNSGERGLCKRSYISPASPSPVNTFHVSYRPLQQVSDAVILVSKTKGRRTQPSEHLAVEIRDKRVVVHWDIGSGKKMITNSHPINYVPSNDRVTWYHIDVLRIGNAVNLTVALKESYDGGFKPRGAPVSVFVGNSKDDNSIFNTIPGETTIDVGTDETVASDIGLTTHKFSGIVGGLRIDEVPLPLWSFESTTGECEGATSPPKTSQRGHLFRDGFANVSMSVSERTMSAITVIFNAFSPNGLLYFRGSEASGDFVAIYLNDGKVMFKINLGGGSVAELTSQNVYNDGKEHTVKAIRTGSEMYLQVDSDADRFNTVITGENTALNIENENHYVAGVPMTLNKEVFGDINWNGFIGCILTVKPSQVGELDLDHPEHSQGKTDGCSQVSGVTDKIIGFPKPGYLITKGISIDNSSTFAFSFRTREENGTLVYQSSKLQKVSKRDSEDDGKGYIAFYLFRGYLVLHFGKDASSRKEVVTFRSSHPYNDGQVHAVFMERNGKIISVKVDDKEIGDSQSLSDETSVGTTSGRLILGGFSDDLKPPNNEIPITSFFIGCISDVFLNMK

SEQ ID NO: 5221 - protein, 2823 aa, Caenorhabditis elegans; identical to SEQ ID NO: 5220

SEQ ID NO: 5222 - protein, 571 aa, Caenorhabditis elegans
MGIDVKKKVLKRKLKQMKDGHEKKKAKEVVVEEPMEEEDEEEVEEEQKHQTEESSETKVSEFLTKTTFASLEGKVNANLLKAVQGLGFTTMTEIQAKSIDPLLEGKDVLASAKTGSGKTLAFLLPAIELLHKLNWKQHNGTGVIIVSPTRELSMQTYGVLSELLEGSNLTYGLVMGGSNRSAEKDKLAKGVSILVATPGRLLDHLQNTDNFLVRNMKCLIIDEADRILDIGFEIEMQQVLRHLPKQRQSMLFSATHSPKVDELVKLALHSNPVRVSVHEKAEEATVEGLQQGYIVAPSDKRLLLLFTFLKKNKTKKVMVFFSSCNSVKFHHELLNYIDIPCMSIHGKQKQQKRTTTFFQFCQAETGILLCTDVAARGLDIPAVDWIVQYDPTDEPREYIHRVGRTARGTNGSGKALLVLRPEELGFLRYLKAAKVTLNEFEFSWSKVANIQSQLENLISKNYYLNKSAKEAYKCYLRAYDSHSLKVIHKVQMMTYETNCHGVSRCPATKYLKDIFDVTNMDLTAVSKSFGFSVPPFVDLPISNKPKVEIRSKLSGAGYRKKKQSFTFKAKK

SEQ ID NO: 5223 - protein, 367 aa, Caenorhabditis elegans
MNREEKSINQYSSNQNRPISQYFEFIFLWQIVEMATENNTDVSENQEEPDELSPKTKAFAPTLEKVWKLKFEKVLGSGSYSRVARATFGEKKLEVAAKIINITPTREKEDYIKKFLPREKEIVKLLKHDNICRLYEMISFQDHIIFVNEYCAGGDLLRKMKDIVAMKEEDAKFTFRQLIAALTHLQSYNIVHRDLKCENIFMDKHGNVKLGDFGFSRILKPGEKSGTFCGSRAYVAPEIFRGREYSGNAVDVWSTGVILYIMLAGSMPFDDRDPRKMIERQLAHKIKFPKSCTSSVFSKALVLEILQPHAPNRPTYKAICESEWLRTQPYYMKPNEPPKVLATRIVSPATPIVPVSGKPKEVKRQQG

SEQ ID NO: 5224 - protein, 357 aa, Caenorhabditis elegans
MEDRNITEEDRVCPQLPEFDEQANVQTDLKKMKPVRSDVQGDAIGKNWKVVKAIQSDKGFNTIYVAEHVQKKKKMAAVKVERKTEAIKMLQFELFVLLTVEKKNQCKQFCKLFEKGNEKEYNWIAITLCGKSLRALRKNQPTGKLTVACGLSVAQQCLKGLEELHRMGFIHRNVAPSVFAIGRYTGDNQSDLRNIYILDFGFAHQYMIKDGTLKPPSAHPWKYVGSLRHMPRAAYSKVEFSRMEDLEMWFYMSVELVKGCLPWAHLKKPKEVHDYQKLCRNGLQMREMLGGLPPEFVDIMQIVDKLSFTDTPNYTEIYGLLTNAILFSGKNEFPYDWEEAEINEFKNPQKPSVEQAT

SEQ ID NO: 5225 - protein, 971 aa, Caenorhabditis elegans
MYRAGAVLLRGATRTRLLAAASAHQSFATFSQRNQSILMMKSMELAGNSGERRFYSTHDDPIAVDDSLELYKDLGGMSPIQVPADMPNVPMLAINRYPLFPGFIKKVDIVKDDNLKALIRRQLSLKQPYAGVFVKRDDENKEETITSLSEVYPTGSFVQIIEVRDQGSVLELVLSAHRRIRALEPIDEITPKNETPLNGRRARGKRAASATSPLTPPPSPPPLAPSVASVAPEISATEEKEEKTTPPSATGEKQKKGIIMVRTENVVAEPVPKNNETKATMMAIVQTIRDVVQFNQLFGQQINLLLHPSQNVIDNPVYLCDLVATLVQSAETKDLQEMMDEIDVSKRLKIALLLIQKEKAVAKLKYDINKDVEKKVQDHHRKYLLNEQLKVIKKELGIEKDEKTTIIEKIDERIKTLAVPEYALKVINEEKTKLQFLDPHSSEFSVTRNYLEWLTSVPWGLTSPENRRLSVAKKALDEGHYGMKDVKERIMEFIAVNLLRKSIGGKILCFHGPPGVGKTSIAKSIATALNREYFRFSVGGMTDVAEIKGHRRTYVGAMPGKMIQCMKKVKTENPLVLIDEVDKIGGAGFHGDPASALLELLDPEQNANFNDHFLDVPVDLSRVLFICTANEISKIPGPLRDRMEMIDVSGYLAEEKVEIAHQHLIPQLRKDTSLATEQLKIEDSALEELIKHYCRESGVRNLQQHIERIFRKAALQIAEQQNEDEEPAEKATTAITENSEAEPITSTSSADCLKSSAEQIVVCTENLQKFVGRPKFTSDRMYEVTPPGVIMGLAWTAMGGSALYIETVLKRPVDLTNDKDGSIETTGNLGDVMKESVRTALTVAKGILAREQPDNKFFDKAHIHIHVPEGATPKDGPSAGVTLVSSLLSLALDRPVVQDMAMTGEISLTGKVLPVGGIREKVIAARRVGAKRVFLPNENRRDFDDLPEFMKSELDIRFVSHYDELYEHLFQ

SEQ ID NO: 5226 - protein, 640 aa, Caenorhabditis elegans
MLNVVKSINRAKTPVRTYMKKQVSATTNFDVVDHTFDAVVVGAGGAGLRAAMGLSEGGMKTAVITKLFPTRSHTVAAQGGVNAALGNMNPDNWRWHFYDTVKGSDWLGDQDAIHYMTREAERAIIELENYGMPFSRTTDGKIYQRAFGGQSNDFGRGGQAHRTCCVADRTGHSLLHTLYGASLQYDCNYFVEYFALDLIMDKGKCIGVVALDIETGQIHRFRAKNTVLATGGYGRAYFSCTSAHTCTGDGTALTARAGIRNSDMEFVQFHPTGIYGVGCLITEGSRGEGGYLVNSQGERFMERYAPNAKDLASRDVVSRAMTMEINEGRGVGPNKDHIYLQLHHLPAEQLQQRLPGISETAQIFAGVDVTKEPIPVIPTVHYNMGGVPTNYKGQVLDFTPEGGDKVIPGLYAAGECAAHSVHGANRLGANSLLDLVIFGRSCALTILNENKPGDSIPELPVNCEEKSCDNLNGLLHSKGDISSIELRQKMQMTMQKHAAVFRRGDLLKEGVDKMSSIYKEQQNLKACADSGKVWNSELVETLELQNLLINANQTIVAAENRTESRGAHARDDFQERIDEYDYSNPLEGQQKKPFDQHWRKHSIIGIDTKTGAVDLTYRPVIDKTLDKSETDWVPPKVRSY

SEQ ID NO: 5227 - protein, 360 aa, Caenorhabditis elegans
MPPIPSRARVYAEVNPSRPREYWDYEAHMIEWGQIDDYQLVRKLGRGKYSEVFEGFKMSTDEKVVVKILKPVKKKKIKREIKILENLRGGTNIITLLDVVKDPISRTPALIFEHVNNSDFKQLYQTLSDYDIRYYLYELLKALDFCHSQGIMHRDVKPHNVMIDAEKRELRLIDWGLAEFYHPRQDYNVRVASRYFKGPELLVDYQCYDYSLDMWSLGCMLASMIFRKEPFFHGHDNYDQLVRIAKVLGTDELYEYIARYHIDLDPRFNDILGRHSRKRWERFIHAENQHLVTPEALDFLDKLLRYDHAERLTAQEAMGHEYFRPVVEAHARANGTEQADGQGASNSASSQSSDAKIDGA

SEQ ID NO: 5228 - protein, 608 aa, Caenorhabditis elegans
MPEHEKSTQMRESAEKKPNVNSCVVIMLSASQLHRFVQHINRQASRNTWVLRRVFQPEVTPPGGVQKNPNDFHDYQKYEVVEFETQKSAGPINVILLQDVEGIGHQFDVVSVDRTLARKDLLLSKKAVYASPFDLKYYSDMKTRMAEELASRIRIPYELKVVGRDLQKMVIPIKVNMENQWTIDRNLVKSSLRQMGVFVAENTIFLAAKPISGPNFDIEAKLFRFYVVVNQQYIVPMLGRITHISVDESKQSSYKGAQHISKMVQESTMICVDNSEYMRNGDFQPTRLQSQQDAVNLVTQCKLRANPENAVGILSMANSVQVLSSLSTEQGRLMMKNHSIEPFGKCNFIAGIKIAHLALKHRQNRNHKMRVVLFIGSPLEEIEMNELVKIAKKMKKEKVLCDVIMFGENESDGHEKFSTFVDTLNGKEGSGSSLIVVPQGSSLTDALLQSSVCKNEDGQAAFGGGGNGMDNAFGMDVENDPDLALALRVSMEEERARQAAAAAANGGAADSGADAEVAAAAAAVPLEEMDMGAMTEEQQLEWALRLSMQENAPAEQPQVQHEQMDVDGAPAVGGDNLDDLMNNPELLQQIVDDLPAANAEKDDDKEKK

SEQ ID NO: 5229 - protein, 430 aa, Caenorhabditis elegans
MTDKDLLHQKYYHGLLPREDIQEMLNKPGQFLLRTSEPVKGEKRQFVLSVVGEKKTSANHFVVRESDHKVYVDKIGFPTIIELVNHYVSTKESFSTKDGTVKAVLKQAVERQKWELYHEDVELTKKLGEGAFGEVWKGKLLKILDANHQPVLVAVKTAKLESMTKEQIKEIMREARLMRNLDHINVVKFFGVAAGTEPLYVIMELADGGALDSALGKLHFPMIKKYELIYQAANGLAYIHEKNLMHRDVAARNCLYGGGQVKIADFGLSREGADYTMDLKKKVPIRWLPPETIRSGLYTPKTDVFAFGVMAWEITEDGKEPYPGFKVIEVAMKVLQGYRMPFSPEVNKEFAEFILTKCWPEKYEDRLPMKDICKWMKSFVKAQGGDTGPGGMMSKIGKKMKRSNSREKSKSSTMTAAHGQDQGAMTAIEK

SEQ ID NO: 5230 - protein, 154 aa, Caenorhabditis elegans
MSQSYHRPRPAGMAGAILDKQASKFNDVEAGYLLEWIRDLTKEDFDCEASRDNFREQLKDGQRLCKLVNAIKAGSVKKIMKPISNFNCLENINQFSTAARSLGVKDEETFQSVDLFDGRDLFSVTVTLQSLARKVEKLGITPPKQVSKDQIVNQ

SEQ ID NO: 5231 - protein, 356 aa, Caenorhabditis elegans
MLKSFSGSTSTLLIINFSVKEAEDYQGRSFLVPPSFTGVNLREDYVPERCFVPKKLVHTYRGHNKGVNFLQWFPKSAHLFLSCSMDTKIKLWEVYDRQRVVRTYAGHKLPVREVAFNNEGTEFLSASFDRYVKLWDTETGQVKQRFHTGHVPYCLKYHPDDDKNHMFLVGMQNKKIIQWDSRSGEIVQEYDRHLQAVNSITFFDKNRRFASTSDDKSVRIWEWEIPVDTKLIQNVGLHAIPTMTKSPNDKWVVGQCMDNRIVLFQLVDDKLRFSKKKAFRGHNAAGYACNIDFSPDQSFLISGDADGKLFIWDWRTHKIVGKWKAHDSTCIAALWHPHEKSRMITAGWDGLIKMWN

SEQ ID NO: 5232 - protein, 1216 aa, Caenorhabditis elegans
MDYEDVTQRDGFHLGIRVSDGRHDAEAAVHVALVDRNDHAPHIHGATEHRVREDVPRGTSIGRYTATDRDAGDTASEDTPVGTVLETFKAHDPSNPMYNFSFRINRQSDPKRQFTIDQDGTLRVAHTLDREDIAVYNLIIEAYDNSNNIGRQMVAVYLQDVNDNGPEPYTVPRPCIFRENTPVNQLGTCEIRATDRDTAEFGPPFTMEVSPSFKYSQYLNVIFNANGDGGNGSMTITPLQEFDREAPVPGKILEIPLILADRAGRRNEASVHVIIGDLNDNTMHDGRMTIHVNSYLGRLKETVIGRVYVDDADDWDLGDKTFSWKDSRPGFELSDKGSITMAGEMAAGTYTMSANVHDNARDEDAVGYVTVIVNAVPQIAFDNQGSVQLLIAEETPLQLPDDFIRADSNGQSLMDTFKQEMTAYMGGDVTVDVFSVQVGIATLQTRDVPVLNVRFNARGSTYRDTAQLNGLIAAHRADLQRKLNVEIVGVGIDMCKFTQCDAGCQTLNSADYDGIVVSANSTVIVGVNATSRDDCTCPVWRAPPACQHSLCHNDGVCHNTNPGFFCECRNDGLKGARCQGTTRSFGGNGFAWYKPMPACTSLNISFSFMTTQSDALLFYNGPLETLRNDTHIEYSDYIFIQLRGGRISLEVSMNGQSRSSLEVASTALNDGTWHDISVNQEGKRVELVVDNCRFLGAGADDSSCRAELYTPDDDERLNIVTPVQIGGLAPLSGQDYPQTIPRAGLNGCVRNLNVNGDQYDLATPAFEQNSEKGCRLWGATCDSNSVDSLNHCIHGDCFADVQGSGAMVAKCVCDPGWGGARCERRMEWIQFAQGAFIEYSPRIAFPEQVSDIELLFISGKVNGAPAELSFGTDSQQSYVSTNLESGQNGVTAAGKFDIGTGGRRARQELRVSEVLLKENASYWLQFTRNPTRASLSIDNAYTVSTQLDKGEPFSLQVNQITLGTQGQNKGFQGCIGTYRWSKQNLPLKRGGAMDENEESIVSISNMAGVQDGCDLRITCADLPAGYCGGSFVCVDFWKGPFCTCNDGANAILGDDGQVVGCGETLAVSKLGISSPAIILILVSLALLILLVMMMVVYTRRSPGAFENVRPEEMNRDNLRQYGVEGGGEADNDQYSMAGLRKPVMPLDTGMGPAIGGHPPHYPPRGMAPPKDDHELNSKIKDLETDQNAAPYDELRIYDDERDNISVVTLESIESAQ

SEQ ID NO: 5233 - protein, 552 aa, Caenorhabditis elegans
MLGIIELGIQYRIWRSQAHGKGKKSPRTPTTPLAKMASKLNEESISLESVMAEFKLSNTTLRRMMSHLSDNMDRGLESGLERSTIAMLPSFVPELPNGKERGKFVAMDLGGTNLRVMLMELEPGEPMRTKQFNTRMPNAAMHGTGQKLFDYIAKALCDFLVERELADEHLPVGFTFSYPCDQTGLRSATLLRWTKGVTATGCVGEDVVQLLEDAIARDGRVKVNIVALINDTVGTMVAAAYEAGGHCDIGVIIGTGTNASYMEDSRKIVHGLANATEDYNHKSMIIDTEWGGFGDNGEADYIFTRYDKIVDSKSDHPGVNSLDKLIAGMCMGELVRLVLERLCENKVLFNGIGSKMLRTRNTFPTKYISEILHDDCGVYSNTRQIMDELGIEGATFSDMLLLREVCVVVSRRSANLAAAAIACVLNRVRRPNMLVAIDGSTYKYHPFFNHWVCEKIRELLDPGLDFKIVQTGDGSGRGAALIAAIVSRVKREEEKRLKDLEAQRLRDAEAEERRLLEIEKEKEEAEERAQKISEMMRYQIERGAEESFQRHD

SEQ ID NO: 5234 - protein, 456 aa, Caenorhabditis elegans
MSAQNYHAGLHQSSTQRPPKRPNTEHAQEPPKRALIGGQTTPSSSGGGQTPNGTNYELEVKQQLSNYQKLFDQATYPFIRDVSTYEKLNKIGQGTFGQVLQGRKSRNSEVFKARCKNTGRMVALKKILMENEKEGFPITALREVKMLEQLKHPNITDLIEVCSAKSTGTTGSKDRATFYLVMALCAHDLAGLLSNPKIRMSLVHIKTMMKHLMSGLNKLHRSKILHRDMKAANVLISKDGILKLADFGLARPFVQRENGAGPRPLYTNRVVTLWYRPPELLLGDRQYGTKIDVWGAGCIMAEMWTRQPIMQGDTEQKQLQLISGLCGSINKDVWPNCVNMPLWSAMSSEPNSALPQGKYRILPNKMKNLMKFDAPDSKTDPFGKNVKQHDSATDDDALHLLEILLAIDPDKRPTSDEAEDDIWFFKDPVPMANVQDLMDTIPVRKFEAKWLKKREK

SEQ ID NO: 5235 - protein, 440 aa, Caenorhabditis elegans
MSAQNYHAGLHQSSTQRPPKRPNTEHAQEPPKRALIGGQTTPSSSGGGQTPNGTNYELEVKQQLSNYQKLFDQATYPFIRDVSTYEKLNKIGQGTFGQVLQGRKSRNSEVFKARCKNTGRMVALKKILMENEKEGFPITALREVKMLEQLKHPNITDLIEVCSAKSTGTTGSKDRATFYLVMALCAHDLAGLLSNPKIRMSLVHIKTMMKHLMSGLNKLHRSKILHRDMKAANVLISKDGILKLADFGLARPFVQRENGAGPRPLYTNRVVTLWYRPPELLLGDRQYGTKIDVWGAGCIMAEMWTRQPIMQGDTEQKQLQLISGLCGSINKDVWPNCVNMPLWSAMSSEPNSALPQGKYRILPNKMKNLMKFDAPDSKTDPFGKNVKQHDSATNSQFEYTVGKGAHANRGRHQNAQQRPNQQQARPSNAIPAGQYRDTIF

SEQ ID NO: 5236 - protein, 440 aa, Caenorhabditis elegans; identical to SEQ ID NO: 5235

SEQ ID NO: 5237 - protein, 456 aa, Caenorhabditis elegans; identical to SEQ ID NO: 5234

SEQ ID NO: 5238 - protein, 1165 aa, Caenorhabditis elegans
MRRTIENCEKRCLILNQISDIARQNEASRNEMELWLKSASDVIGERRVEELSEEVVRQELQVLERVVEQLTERKDKMAEINSQANKIVDTYTKDEAHNLSHLLSRLNMSWTKFNDNIRIRRAVLEASLRSRRDFHSALSEFEKWLSRQEDNCSKLSADTSNHQAIKDTSKRKNWTQSFKTLNAELNAHEDVMKSVEKMGKMLAESLESGNEKVELLKRVGETTRRWTALRKTTNEIGERLEKAEQEWEKLSDGLADLLSWVEAKKQAIMDEQPTGGSLSAVMQQASFVKGLQREIESKTANYKSTVEEAHSFLMQHDLRPKLHSPHVLDDDYEKEELANLEQRRRGLEINANCERLKKNWAELGIEVESWDKLVQHAMQRLQELERNLAECQLHLTSSENEIETMKAVEKIHLEDLKIAREETDQISKRIDEVRLFVDDVNDAAARLLAEDLKLDEHAKGQIEHVNKRYSTLKRAIRIRQAAVRNAASDFGPTSEHFLNQSVTLPWQRAISKSNLLPYYIEQTSEKTQWEHPVWVEIVKELSQFNRVKFLAYRTAMKLRALQKRLCLDLVDLTLLEKAFVRLKGLSAEECPGLEGMVCALLPMYEALHAKYPNQVQSVSLAVDICINFLLNLFDQSRDGIMRVLSFKIAMIVFSNIPLEEKYRYLFKLVSQDGHATQKQIALLLYDLIHIPRLVGESAAFGGTNVEPSVRSCFETVRLAPTISEGAFIDWVKKEPQSIVWLAVMHRLVISESTKHASKCNVCKMFPIIGIRYRCLTCFNCDLCQNCFFSQRTAKSHRTNHPMQEYCEKTTSSDDARDFAKMIRNKFRASKRQKGYLPIDVAEEGIPLTCPPAKVTNQATEQMNADTSQMTAHLAKLSAEHGGGAEHMEPVQSPLQIINQNKMCSLLKLLKISGKSVSDDDPIERYIKCEQCKCKRHWVEQLQRDEMDQMLHRLQFENKQLRKELEWKRGAASTMEIDRSSKRHQERHQSESRGGTLPLRNGRSVVSLKSTQSQNDVMDEAKALRLHKQRLEHRSRILEQQNEQLEMQLQRLKKVIDAQKQQAPLSTNSLLRGSHHQPWSPERARSGSASTLDRGLIVSSRHQEQAEAAGGGAEDSSDEAGGAGGGPRGSSVGQMQNLMTACDDLGKAMESLVVSVVYDSDDEEND

SEQ ID NO: 5239 - protein, 1127 aa, Caenorhabditis elegans
MRRTIENCEKRCLILNQISDIARQNEASRNEMELWLKSASDVIGERRVEELSEEVVRQELQVLERVVEQLTERKDKMAEINSQANKIVDTYTKDEAHNLSHLLSRLNMSWTKFNDNIRIRRAVLEASLRSRRDFHSALSEFEKWLSRQEDNCSKLSADTSNHQAIKDTSKRKNWTQSFKTLNAELNAHEDVMKSVEKMGKMLAESLESGNEKVELLKRVGETTRRWTALRKTTNEIGERLEKAEQEWEKLSDGLADLLSWVEAKKQAIMDEQPTGGSLSAVMQQASFVKGLQREIESKTANYKSTVEEAHSFLMQHDLRPKLHSPHVLDDDYEKEELANLEQRRRGLEINANCERLKKNWAELGIEVESWDKLVQHAMQRLQELERNLAECQLHLTSSENEIETMKAVEKIHLEDLKIAREETDQISKRIDEVRLFVDDVNDAAARLLAEDLKLDEHAKGQIEHVNKRYSTLKRAIRIRQAAVRNAASDFGPTSEHFLNQSVTLPWQRAISKSNLLPYYIEQTSEKTQWEHPVWVEIVKELSQFNRVKFLAYRTAMKLRALQKRLCLDLVDLTLLEKAFVRLKGLSAEECPGLEGMVCALLPMYEALHAKYPNQVQSVSLAVDICINFLLNLFDQSRDGIMRVLSFKIAMIVFSNIPLEEKYRYLFKLVSQDGHATQKQIALLLYDLIHIPRLVGESAAFGGTNVEPSVRSCFETVRLAPTISEGAFIDWVKKEPQSIVWLAVMHRLVISESTKHASKCNVCKMFPIIGIRYRCLTCFNCDLCQNCFFSQRTAKSHRTNHPMQEYCEKTTSSDDARDFAKMIRNKFRASKRQKGYLPIDVAEEGIPLTCPPAKVTNQATEQMNADTSQMTAHLAKLSAEHGGGAEHMEPVQSPLQIINQVEQLQRDEMDQMLHRLQFENKQLRKELEWKRGAASTMEIDRSSKRHQERHQSESRGGTLPLRNGRSVVSLKSTQSQNDVMDEAKALRLHKQRLEHRSRILEQQNEQLEMQLQRLKKVIDAQKQQAPLSTNSLLRGSHHQPWSPERARSGSASTLDRGLIVSSRHQEQAEAAGGGAEDSSDEAGGAGGGPRGSSVGQMQNLMTACDDLGKAMESLVVSVVYDSDDEEND

SEQ ID NO: 5240 - protein, 2241 aa, Caenorhabditis elegans
MLFSGASTAKPKKDEKKDKKSDRDPKNELQEWVFVRWANHLLGTERLTDYKSLQDGSNAIFVYQAIIGQTMAVLGNPSDDWPNVLQNIGDSKTNPQEVMEGQQKAVLSAWWQLVQFFWKNNAPVQLREEKLSEAIKQWCIEVMKSYEEIDVYDFTSSFRDGHAFNYLIHSYDNSLELELQCGKSKWVISRREGNSKYEFSINLEPDLHSDQLDSHSVLCYLMSLYLAMISTSKIETELEAQQIQQQKVAALLASHKMLSSQPSTSSSSALQIPPQTPPTAHHQAMLDRGKSFEQSAEGEVRSRKSSSSSQKSGKSKKARREEQLAEFKSCIEQVLTWLLEAEDELTTLTQMPRVELASVRSQFSDFESFMSSLTDSQDTVGRVLLRGQMLSNKSESEEEKESIGANLHLVNTRWEALREQAMQEQAVLQQQIHLLQQSELDTISQWLDAAELEIESFGPLAADSSQALRQIELHTKFQQKLNDFQETIDKLESFVAVVDEENDASVATLEDALSAVSVRWGHVCEWAEKRATKLDGLADLLDKTNEVFENLSGWLAERENELMTGLKSAHHLENEEQVAQQVRRLQKTEEQLEQEHASFVRLSQLSCELVGRLDDSNGAAANAVRLSLDSITQRWDNLVARIEEHGKTLVKSGKADVKQVQESQNEQKEQPASSEGLSTDTEGEEQKNQLVDKFLLHISKLSHELEPLQDWSEKFEVSRKKDDIRKMMNTCQEKLIQIKEQEARVNRLQLELEHLHVAKLNARQLKRANDAFEQFAKGWARIVTKISEAMNVLTGQEAGGNGNGSEEAAVAAKIEQWIEAVDKVINELSQLPVNERRSRIDKLEQQLQVQDKNVGFIEKDLLKKAILKKGLEIAGKRLAALKVEEKPVEKEEQLVLSNSEEPEAEKHVTFVQETTEKPAPLQEPTSEAQLLEELDGPWSRVGDVVAIEHDLLRAKRAVDTARNSQMSNETVEKAETRKAEMEEKRRVTMSARSKFRMAEETLEEIERNLDRLQVSDLEIADLVRGLEQEAAKLGERVSQRKEAERTAEKILSMDDDEISQEIVIKTKDSTEKLIKRWNQLELDLEENLRKAKRDQDVFIQKRLREGEEALNEIKTAIEGKRESLDAETAAENLDHLESSLDNISSLFGEIGSLPMDDNSREKLSKLAKAKDQITARANEALAALTRTVSECEDFEKQIMLFQNWSARIGFLLQARKSADISAFDIPHEYHATNLKLKFDLNFAQEDLGNEAELIPKLSREFEEWTVKLNEMNSTATEKDDSARMREQLNHANETMAELKRKFNEFKRPKGFEEKLEKVITTLSNVEMGLDDTTGIDGSECGGALMEVRALVRMLDGAQEKWKDLAENREQLVKDRVLDEETSKETLQKLQYAKTKSKELYERSSTCIERLEDCVEMYQRLKMESDEIERFLEEMEGKLDQYAASDRPEEAEIVNELISEWNRNEAAMKNAEHLQRQLNERAIKIPDDVLSLKRLRADALKNRLNSWCRTIQEMSEDDESALLEIDELHQNLEKELKLVSDKEPSKIAEKLRFLRADRDRLSSRTRKLAAKNPRLAATSSDVLAGLNQKWKELEVKASAEKAPAPELRDARLSSPSEQPFDKRVQELCDLFENLEAQLDFNGSPVSMVTEYQKRVENLDEYLDEYRPALDDTIEEGRKIAETGRLELQTHSAIEKLDELTNRIEQVEVELDKHRDKVPSLVEQHEQLKKDIDSFLLVLDVFTDRPQLHDVTLDKLRDRIEKLEARLSATEKKPVETVKSTIPDRPEVPEEPEKSSPDRTSRSSLQLAMEAYGTATEDDSVISEAVTVGQKSVDQVDPVEQLEPVEPVEPKLEVKQLKDEATEEEEKRTIILPDETEKVIETIPAARPSAGPSEGTVAEVSTSEILKARPAQESIERTVREVPVDEYEETANISSGDELQDHKISSAVPDSESEIASMFEVLDSIEDSHTNFEEFPFDYLDSADDDLKKTLLKLESCEKTLAKNEMTINIAQAENARERITMLRQMALQRKDKLPKFNEEWNAMQELIQLADALVDEAERYESDQIPQMDRKSAPNVLGELRKRVANAEGPVIDLVKKLSQLVPRMQEDSPKSQDIRQKVYGIEDRFRRVGQAEGAAISKALSSALTEPELKLELDEVVRWCEMAEKEAAQNVNSLDGDGLEKLDGRLAQFTKELQERYGGSQTSNNVGLSLCVGLSLGLKLGLGVVLGLGLGLTLCLGLGSP

SEQ ID NO: 5241 - protein, 2261 aa, Caenorhabditis elegans
MLFSGASTAKPKKDEKKDKKSDRDPKNELQEWVFVRWANHLLGTERLTDYKSLQDGSNAIFVYQAIIGQTMAVLGNPSDDWPNVLQNIGDSKTNPQEVMEGQQKAVLSAWWQLVQFFWKNNAPVQLREEKLSEAIKQWCIEVMKSYEEIDVYDFTSSFRDGHAFNYLIHSYDRKLINLTKTAEMSAIDRIENAFAVAEKTWNVPRLLNPKDLHSDQLDSHSVLCYLMSLYLAMISTSKIETELEAQQIQQQKVAALLASHKMLSSQPSTSSSSALQIPPQTPPTAHHQAMLDRGKSFEQSAEGEVRSRKSSSSSQKSGKSKKARREEQLAEFKSCIEQVLTWLLEAEDELTTLTQMPRVELASVRSQFSDFESFMSSLTDSQDTVGRVLLRGQMLSNKSESEEEKESIGANLHLVNTRWEALREQAMQEQAVLQQQIHLLQQSELDTISQWLDAAELEIESFGPLAADSSQALRQIELHTKFQQKLNDFQETIDKLESFVAVVDEENDASVATLEDALSAVSVRWGHVCEWAEKRATKLDGLADLLDKTNEVFENLSGWLAERENELMTGLKSAHHLENEEQVAQQVRRLQKTEEQLEQEHASFVRLSQLSCELVGRLDDSNGAAANAVRLSLDSITQRWDNLVARIEEHGKTLVKSGKADVKQVQESQNEQKEQPASSEGLSTDTEGEEQKNQLVDKFLLHISKLSHELEPLQDWSEKFEVSRKKDDIRKMMNTCQEKLIQIKEQEARVNRLQLELEHLHVAKLNARQLKRANDAFEQFAKGWARIVTKISEAMNVLTGQEAGGNGNGSEEAAVAAKIEQWIEAVDKVINELSQLPVNERRSRIDKLEQQLQVQDKNVGFIEKDLLKKAILKKGLEIAGKRLAALKVEEKPVEKEEQLVLSNSEEPEAEKHVTFVQETTEKPAPLQEPTSEAQLLEELDGPWSRVGDVVAIEHDLLRAKRAVDTARNSQMSNETVEKAETRKAEMEEKRRVTMSARSKFRMAEETLEEIERNLDRLQVSDLEIADLVRGLEQEAAKLGERVSQRKEAERTAEKILSMDDDEISQEIVIKTKDSTEKLIKRWNQLELDLEENLRKAKRDQDVFIQKRLREGEEALNEIKTAIEGKRESLDAETAAENLDHLESSLDNISSLFGEIGSLPMDDNSREKLSKLAKAKDQITARANEALAALTRTVSECEDFEKQIMLFQNWSARIGFLLQARKSADISAFDIPHEYHKLSREFEEWTVKLNEMNSTATEKDDSARMREQLNHANETMAELKRKFNEFKRPKGFEEKLEKVITTLSNVEMGLDDTTGIDGSECGGALMEVRALVRMLDGAQEKWKDLAENREQLVKDRVLDEETSKETLQKLQYAKTKSKELYERSSTCIERLEDCVEMYQRLKMESDEIERFLEEMEGKLDQYAASDRPEEAEIVNELISEWNRNEAAMKNAEHLQRQLNERAIKIPDDVLSLKRLRADALKNRLNSWCRTIQEMSEDDESALLEIDELHQNLEKELKLVSDKEPSKIAEKLRFLRADRDRLSSRTRKLAAKNPRLAATSSDVLAGLNQKWKELEVKASAEKAPAPELRDARLSSPSEQPFDKRVQELCDLFENLEAQLDFNGSPVSMVTEYQKRVENLDEYLDEYRPALDDTIEEGRKIAETGRLELQTHSAIEKLDELTNRIEQVEVELDKHRDKVPSLVEQHEQLKKDIDSFLLVLDVFTDRNLDDVDIAKSTRKELAERDSHIVSLTSRATAIHCALPGKGPQLHDVTLDKLRDRIEKLEARLSATEKKPVETVKSTIPDRPEVPEEPEKSSPDRTSRSSLQLAMEAYGTATEDDSVISEAVTVGQKSVDQVDPVEQLEPVEPVEPKLEVKQLKDEATEEEEKRTIILPDETEKVIETIPAARPSAGPSEGTVAEVSTSEILKARPAQESIERTVREVPVDEYEETANISSGDELQDHKISSAVPDSESEIASMFEVLDSIEDSHTNFEEFPFDYLDSADDDLKKTLLKLESCEKTLAKNEMTINIAQAENARERITMLRQMALQRKDKLPKFNEEWNAMQELIQLADALVDEAERYESDQIPQMDRKSAPNVLGELRKRVANAEGPVIDLVKKLSQLVPRMQEDSPKSQDIRQKVYGIEDRFRRVGQAEGAAISKALSSALTEPELKLELDEVVRWCEMAEKEAAQNVNSLDGDGLEKLDGRLAQFTKELQERYGGSQTSNNVGLSLCVGLSLGLKLGLGVVLGLGLGLTLCLGLGSP

SEQ ID NO: 5242 - protein, 640 aa, Caenorhabditis elegans
MNVILVLVVLFFAGDCAKIRKIIDFLEKDAPNDIEKTPNYNEESLAVKRNKNFNPCLENPKICSNRGKCLHENGNFYCICPVTHYGKTCEHVSDQTNCEKHLCQNNSTCVSIKSLRTIVNTVLLRQIRVQRKVNGSKAALTNEELAEIDLEVNYECICQKGYFGGLCDESEADRTCQEVYCLGRGKGAINATGKCECECENQFFGDRCEQISACFDTQCDNGGICEDVVDWKTKTVTATCKCPSAIELIGGTVTGENCETLQIPSTAPKEFIPCAEGSNSTMFFKKFIANISLEYMDDISELEAIKNDYNDGKNVNGTMTDGWCRNDGKCVPEVVRVNSSRAYYIYRCECTNPLTDGYYCEYKRHDSCSLTREEVARGDRWDEKCTDSQHGACVDISGVAHCVLVHLPACLLPSSPNFRCKPDYTGEKCEIFDPCARQPCKHGDCIPIPNTADVAFGTSRYQCLCPLSAKLNPESQACMEINEKKCAPGACGNGRCVPCESDADDLMPLCNDNDNRQGFRCLCEAGYLPPFCKVHTNPCYQNLCQNSATCHIDPKQRSYDCQCVNGTRGSLCENVDDSCDAFGKLEASCLPACLPLSLQETKSASMEPVSMMSTFTGASRVSVTTDLRVSTATWKSPGPV

SEQ ID NO: 5243 - protein, 212 aa, Caenorhabditis elegans
MGNEYYYLFKSNFIFQNFKRQIISVVLIGNPGVGKSNLLSRFTRNEFNLKSKPTIGVEFATKIISVEGKAVKVQIWDTAGMERFRCGASSYYRGALGALLVYDISKHKTYESVEQWLKVLRDHANEDIVITLVGNKSDLSHAVPTDEAKIYAERNHISFIETSALDNTNVEAAFTNIVTEIYKLVSEKYKDHSGTIIPSTASNTPKNQCCFP

SEQ ID NO: 5244 - protein, 692 aa, Caenorhabditis elegans
MSNISWYRHCSVRLQLVTLALFLLLGSASLGSAHIDEEFEDDVTTTISSIASPMRRTYTNEWAVRIAGGKVEEANRLANKYGYTNLGPIIPGDEYYLFRDDRKKSRSSRKTRSLSANQLQHEEDVMWMEQQVAKRRVKRGYRRIRRHTDDNDIFEEDDDGTQISKSRNRKHPDPNDPLWTDMWYLNRGEHHSDSTTRMDHNVKEAWDLGYTGKGVVVTILDDGLERTHPDISPNYDERASYDVNDRDNDPMPRYEFSDENRHGTRCAGEVAAIFNNSLCIVGIAYNANIGGIRMLDGDVTDAVEAASVGHNADYIDIYSASWGPDDDGRTVDGPAKLTRSAFEKGITMGRKGKGSIFVWASGNGGKDADSCNCDGYTNSIYTLSISSATENGNIPWYSEACSSTLATTYSSGATGEKMILTTDLHHACTNMHTGTSASAPLAAGIVALALEANPNLTWRDLQHIVIRTAKPINLRAGDWTTNGVGRNVSHSFGYGLMDAGAMVKLAKIWKKVDEQHRCRQFYPSRYKNIPNGNRLQLQLYSDGCYGGADENKVSYVEHVQAIVTLKAPKRGDLQIYLTSPSGTKSTLLTKRARDTSRSGFTDWAFMTTHNWGEQAAGLWILEIDNDGWDDAELVKWELVLYGTDRETGDFGGQHASPLAVRSVQMEATSSGTQYSIFHVITLVILTFSQILY

SEQ ID NO: 5245 - protein, 760 aa, Caenorhabditis elegans
MSNISWYRHCSVRLQLVTLALFLLLGSASLGSAHIDEEFEDDVTTTISSIASPMRRTYTNEWAVRIAGGKVEEANRLANKYGYTNLGPIIPGDEYYLFRDDRKKSRSSRKTRSLSANQLQHEEDVMWMEQQVAKRRVKRGYRRIRRHTDDNDIFEEDDDGTQISKSRNRKHPDPNDPLWTDMWYLNRGEHHSDSTTRMDHNVKEAWDLGYTGKGVVVTILDDGLERTHPDISPNYDERASYDVNDRDNDPMPRYEFSDENRHGTRCAGEVAAIFNNSLCIVGIAYNANIGGIRMLDGDVTDAVEAASVGHNADYIDIYSASWGPDDDGRTVDGPAKLTRSAFEKGITMGRKGKGSIFVWASGNGGKDADSCNCDGYTNSIYTLSISSATENGNIPWYSEACSSTLATTYSSGATGEKMILTTDLHHACTNMHTGTSASAPLAAGIVALALEANPNLTWRDLQHIVIRTAKPINLRAGDWTTNGVGRNVSHSFGYGLMDAGAMVKLAKIWKKVDEQHRCRQFYPSRYKRFSNLPEVYRSLQKFPKISRFFQKFLEVSEVHTIFQKFPGTSTRFQKFPKILEIEKMFRNSKKLQVFRNIPNGNRLQLQLYSDGCYGGADENKVSYVEHVQAIVTLKAPKRGDLQIYLTSPSGTKSTLLTKRARDTSRSGFTDWAFMTTHNWGEQAAGLWILEIDNDGWDDAELVKWELVLYGTDRETGDFGGQHASPLAVRSVQMEATSSGTQYSIFHVITLVILTFSQILY

SEQ ID NO: 5246 - protein, 318 aa, Caenorhabditis elegans
MLPSQINQNSKHITKKNDVRIFFCILYFNIKYFSFHTFIAELDQTIIIIDRQVTAHQCDAETECSDDETCCKLGDNTWGCCPMPNAVCCDDRSHCCPTGTTCDPQGARCIGADEKHVPMKKKKPARKTVERNQFNEVVCPDKASKCPDGSTCCLLEQGSYGCCPVPNAVCCADMLHCCPNGFTCHGQFCSQNFAMIPHLRKFASTSIHRKPAVEFLSEEEEDDDDEESTSSEDPESDVDPIACGVGKTCPAKTTCCNVRGKNGEPKTMCCPLSNAICCENTCCPAGYHCVDGGKCEKHAKTMRTRFWNVKDDEDEDQI

SEQ ID NO: 5247 - protein, 3450 aa, Caenorhabditis elegans
MQSWMTDRTRLAGDIRHKSGDPMRIDEARFEAKSLMDEVIREESRLKTIGASVLKIEQEISAMRDDVRASGSTDDVGISVDEVYETRRRVEDDYMQLLRQCQDLISFQNRLHAMNDEHSEQARRADEWLQMLQNDVEDVDQDPRFQRDEDRIQRIEELNRMAAGGSSQLDDAEQASRRLLTALEGTNVANDVRARHEELANLRRGKHQKVIDRLSQNMMEAASRKAEAEGVKQAVENLRQWSEQTAQRTRQPVQLPLTELDLHEARKDEQVLHGEIENRLALIEELEKKAADVGDHASLAELQECKMKLKRSNSDLKGLRDNIFDAINGLQTVNSEGETLSRAVDSAGAKIRSARLPEAQSEVEALQDQADNLERITNNLCNIPNVTRTEPVIQKSKDLRKRVDSCAQELDARMGKLAELESLDAEFDGAKNKLSSFIGAFDDELKGLEKVSIDKEKLAEQRRQTQDLVDKHSEGNAILDDVEAIAQKVTAEDPSKTGSAQKSVGELGARLQRQASELKARGDKINKLDSKATSFAESEAAVLGYIEKQKDQLSTGFPVPATKEGVKSQLLDLERMNKTGKEEQRRVDDARHSARELAREASVEKEVQDMNQREKKLLDEWEDLADQFDAVRSRANKAEQVLNECAQMEKYIGAKKNMLEGIGAPSTEPGVAKANRAQIQSMKAETEGEKSALEHVNSLANELIADGGANVEELMKKMDRLNRKWHSLESGLDENAGRVEEAAKLGQELKDIQKELRKELGELESNVEKASAMSSNDIGDQLATLDSLKSRFGGVDKALEKLKGILEATEELEVDATNRAEIQEQLETTQKKADELERKIENVKKAALNAQNEGLELEKKLDELIGTVNSAENELELAAPIAAESLKLADELKRAEELFQKLIENEGDVSLIRAKVAEELKKKPDAELKKKLELLYQKWPKALGAARDRKDLVSKAGDLVKQFGDQVQALEQRLQGDQAELDELLASDKAHDPEVCDALKLVELTMARRLADVDALNAVMNRIESSAPGPDANRLRRRADTLSDDAKGMAKKARTAADLAQRKQGLAKKFERLCDEVSQFTENQKAEIQDAIEKDLLNAERVQSKLNKIDDFWSSNSRELKNVGDEIKIDATPEDAQAVDTKLAELQAGIDGLLATLQEQNVHLEEKREQANRVQSESQKAAGKINSLVAEIADLDPIGRSRDELQKQKKEVVELAGDLGSAQTKMLELGAEWEAALGAGIVAQPVFEMNRAATDELNKLAARAGKRLAQREKKITETEDEIDKLHADADQIVGALEAIAKDEALQGAPSQLLDPKQVSEKVRQLKESLKPVGEKMDAFNTDCKLLIKTAGPESDTKELDSLLKKVGDAYSDVVGKVSDKEMSVDAAVQQQGKVEDAYRALLNWLEETEEMMENRKKPSADAKVAKAQLHDYEVLMKHVEDKKPSVDGFKAMIEKIVAEASSDEEKKALGNKNAQIEDRYKDLLNSAVDRQRKLLDAVDLAERLQEVTIPLDSWLQSADKRLQALAKVPITVEKAEEMIGEQEALQDELEHKSDDLKDVLEIAPMLASLVSVEDANSISGQVNQLEARARALDAGITNMRPLLESFLQQIQDFTLDAEDMTQFVGETEVKLGELDELPIEPDDLVEQTNILAEIAVSIADRDEMMANIFEVGKQLAIQGEPEEALIAQKKLDDLKFRYADLMTSADEKIALLAKAIPLSEGFHEGFDTVMQVLEDMDRDLQTIDEEDPETQAELIFLLEEDISQKMRPSVDELTALSNQLQVLCSADKADELQTNTIAMNKLVNSVADRVARRAERIEMASKQSRAVLDDLQYLIEWFSAARERILEGAPPSLDLEVLKSQLKHQRITNEEASANKVQFRNVAGEAKKVARQLGMEGNEANEKISDTVDEGKELVEEVMALCADRTETLERALALMEQLTSQFDELNKWLDQMDAELQASPSVTTATPAAELREMHDHNEELARMVAAYRPIIEGFKSDVGSLHEVLAEDQAPLLESVAGELVQGYEEVREAVRARGHAIDNMMGATIGFGERLETLVANLQGAADRLRENEGISADPSVLESRLAENRSIVESLRDKQNAYDALKQTASELLASAPEGDAAAGDVENKLNRLEKLWKEIEREAVDRGVLLEDVLDKAKHFWSELDSCQKAVDDLRNRLELVEPATGHPEQLADQQEIMAQVASEMERARPRIEALSIAGKQLADYVPDDEKAVIENQVANVRGGFSTITGLFAEKKRDLIAAMEEAMTFHGDLQELLKWLDMAEQKLLKMSPVEHAKHMTEIEQLLKELHTFKDEVHERGVAKEQVVATALQLAADAPPHLAATVRQPVADLNTRWSRLNAALAEREHKLENLMLQMGKLASTIAQLTAWMDKTRATLKDIAPPKNAVNLRDIEIAQCKLVVLSNDIHAHQDSVNAVNRAAQKYIQTSGALDAETSDSLKSMNLKWEDIQKVLESLAFDMEVAKKEAENVGGEVEKWQRWLEETESALLSTKPTGGLPETAEFQLDEFKALKLDVEHNASPLEAHLHATEQHLKEEPQDADTWLSKTHGAMKTKWNKVKELLVDREKKLQVAYEQAVALESALNDMEDWIIAAERKLTDQPSISRLPDVIEKQLAEHESWMEEVAGRKMAMTKHQASGVHMQYYCEKKDAIPIKNRLVSLKHRVEKISGRTAERAKQLAVTRDEVATWQDGLHDLEHFISDVLVKIAPEPNTTSSLEKLKAKLEEVKEAQRDVTAKQTLFDVTRKRGIGLAERATRSEYKQISMTNEKMSKKWAEMLKKLRDRLREAEQAVLEGGAFEESMNDLESWVDDELERYQKAEHEPVFADIDGVRALVDEESRRSAERKTKENGVKTVVKKADALMASGVDEKDSIAQAKERLVEKWNQVEEAARHRGNSIKEAEQAAEEFDAKTHALLDWLAVEEQKLKASGLDEVEGVKQEMDEAKGRYQECLKKGEEILSKCQPAAEPILRNWMRVVEARWKEVSEKVDEREFTLLEQEQKAKEQNEQIEKLAKFAAQKREELNRMIEQPPAQDLDTMEQNICDFANLDSELREQQPEVDAACKSAKKGARNPAAEMLSTEWKKLWLDAMGLQSSLDNQKALLEEMKRLEGWKWEDWKERYVEWNDHAKARVNDLFRRIDRLHTGNVPRQVFIDGIIGSKFPTSRLEMAKVADRFDKGDGMINAKEFINALRFDASNRNAKPQTDTEKITHEIELQKKTCSCCTPYQIEKISENHYRFGDTHIKRMVRILRSTVMVRVGGGWESLDEFLHKHDPCRAKGRLNINMFPEARPIHALDSMRSFTKNRHGKQLPTTGTPGPIMKIREKTDRSVPMSGGLGGTAGYTVTTDSHRHTDARPSRIPRAPSDMSAGRLSRVGSVSNSKNSIVDSSTPSRPESRASSDAGDRQTRIPSLRARKGQRYIPQGPSSSSSK

SEQ ID NO: 5248 - protein, 3461 aa, Caenorhabditis elegans
MQSWMTDRTRLAGDIRHKSGDPMRIDEARFEAKSLMDEVIREESRLKTIGASVLKIEQEISAMRDDVRASGSTDDVGISVDEVYETRRRVEDDYMQLLRQCQDLISFQNRLHAMNDEHSEQARRADEWLQMLQNDVEDVDQDPRFQRDEDRIQRIEELNRMAAGGSSQLDDAEQASRRLLTALEGTNVANDVRARHEELANLRRGKHQKVIDRLSQNMMEAASRKAEAEGVKQAVENLRQWSEQTAQRTRQPVQLPLTELDLHEARKDEQVLHGEIENRLALIEELEKKAADVGDHASLAELQECKMKLKRSNSDLKGLRDNIFDAINGLQTVNSEGETLSRAVDSAGAKIRSARLPEAQSEVEALQDQADNLERITNNLCNIPNVTRTEPVIQKSKDLRKRVDSCAQELDARMGKLAELESLDAEFDGAKNKLSSFIGAFDDELKGLEKVSIDKEKLAEQRRQTQDLVDKHSEGNAILDDVEAIAQKVTAEDPSKTGSAQKSVGELGARLQRQASELKARGDKINKLDSKATSFAESEAAVLGYIEKQKDQLSTGFPVPATKEGVKSQLLDLERMNKTGKEEQRRVDDARHSARELAREASVEKEVQDMNQREKKLLDEWEDLADQFDAVRSRANKAEQVLNECAQMEKYIGAKKNMLEGIGAPSTEPGVAKANRAQIQSMKAETEGEKSALEHVNSLANELIADGGANVEELMKKMDRLNRKWHSLESGLDENAGRVEEAAKLGQELKDIQKELRKELGELESNVEKASAMSSNDIGDQLATLDSLKSRFGGVDKALEKLKGILEATEELEVDATNRAEIQEQLETTQKKADELERKIENVKKAALNAQNEGLELEKKLDELIGTVNSAENELELAAPIAAESLKLADELKRAEELFQKLIENEGDVSLIRAKVAEELKKKPDAELKKKLELLYQKWPKALGAARDRKDLVSKAGDLVKQFGDQVQALEQRLQGDQAELDELLASDKAHDPEVCDALKLVELTMARRLADVDALNAVMNRIESSAPGPDANRLRRRADTLSDDAKGMAKKARTAADLAQRKQGLAKKFERLCDEVSQFTENQKAEIQDAIEKDLLNAERVQSKLNKIDDFWSSNSRELKNVGDEIKIDATPEDAQAVDTKLAELQAGIDGLLATLQEQNVHLEEKREQANRVQSESQKAAGKINSLVAEIADLDPIGRSRDELQKQKKEVVELAGDLGSAQTKMLELGAEWEAALGAGIVAQPVFEMNRAATDELNKLAARAGKRLAQREKKITETEDEIDKLHADADQIVGALEAIAKDEALQGAPSQLLDPKQVSEKVRQLKESLKPVGEKMDAFNTDCKLLIKTAGPESDTKELDSLLKKVGDAYSDVVGKVSDKEMSVDAAVQQQGKVEDAYRALLNWLEETEEMMENRKKPSADAKVAKAQLHDYEVLMKHVEDKKPSVDGFKAMIEKIVAEASSDEEKKALGNKNAQIEDRYKDLLNSAVDRQRKLLDAVDLAERLQEVTIPLDSWLQSADKRLQALAKVPITVEKAEEMIGEQEALQDELEHKSDDLKDVLEIAPMLASLVSVEDANSISGQVNQLEARARALDAGITNMRPLLESFLQQIQDFTLDAEDMTQFVGETEVKLGELDELPIEPDDLVEQTNILAEIAVSIADRDEMMANIFEVGKQLAIQGEPEEALIAQKKLDDLKFRYADLMTSADEKIALLAKAIPLSEGFHEGFDTVMQVLEDMDRDLQTIDEEDPETQAELIFLLEEDISQKMRPSVDELTALSNQLQVLCSADKADELQTNTIAMNKLVNSVADRVARRAERIEMASKQSRAVLDDLQYLIEWFSAARERILEGAPPSLDLEVLKSQLKHQRITNEEASANKVQFRNVAGEAKKVARQLGMEGNEANEKISDTVDEGKELVEEVMALCADRTETLERALALMEQLTSQFDELNKWLDQMDAELQASPSVTTATPAAELREMHDHNEELARMVAAYRPIIEGFKSDVGSLHEVLAEDQAPLLESVAGELVQGYEEVREAVRARGHAIDNMMGATIGFGERLETLVANLQGAADRLRENEGISADPSVLESRLAENRSIVESLRDKQNAYDALKQTASELLASAPEGDAAAGDVENKLNRLEKLWKEIEREAVDRGVLLEDVLDKAKHFWSELDSCQKAVDDLRNRLELVEPATGHPEQLADQQEIMAQVASEMERARPRIEALSIAGKQLADYVPDDEKAVIENQVANVRGGFSTITGLFAEKKRDLIAAMEEAMTFHGDLQELLKWLDMAEQKLLKMSPVEHAKHMTEIEQLLKELHTFKDEVHERGVAKEQVVATALQLAADAPPHLAATVRQPVADLNTRWSRLNAALAEREHKLENLMLQMGKLASTIAQLTAWMDKTRATLKDIAPPKNAVNLRDIEIAQCKLVVLSNDIHAHQDSVNAVNRAAQKYIQTSGALDAETSDSLKSMNLKWEDIQKVLESLAFDMEVAKKEAENVGGEVEKWQRWLEETESALLSTKPTGGLPETAEFQLDEFKALKLDVEHNASPLEAHLHATEQHLKEEPQDADTWLSKTHGAMKTKWNKVKELLVDREKKLQVAYEQAVALESALNDMEDWIIAAERKLTDQPSISRLPDVIEKQLAEHESWMEEVAGRKMAMTKHQASGVHMQYYCEKKDAIPIKNRLVSLKHRVEKISGRTAERAKQLAVTRDEVATWQDGLHDLEHFISDVLVKIAPEPNTTSSLEKLKAKLEEVKEAQRDVTAKQTLFDVTRKRGIGLAERATRSEYKQISMTNEKMSKKWAEMLKKLRDRLREAEQAVLEGGAFEESMNDLESWVDDELERYQKAEHEPVFADIDGVRALVDEESRRSAERKTKENGVKTVVKKADALMASGVDEKDSIAQAKERLVEKWNQVEEAARHRGNSIKEAEQAAEEFDAKTHALLDWLAVEEQKLKASGLDEVEGVKQEMDEAKGRYQECLKKGEEILSKCQPAAEPILRNWMRVVEARWKEVSEKVDEREFTLLEQEQKAKEQNEQIEKLAKFAAQKREELNRMIEQPPAQDLDTMEQNICDFANLDSELREQQPEVDAACKSAKKGARNPAAEMLSTEWKKLWLDAMGLQSSLDNQKALLEEMKRLEGWKWEDWKERYVEWNDHAKARVNDLFRRIDRLHTGNVPRQVFIDGIIGSNYVPNSTIVYSKFPTSRLEMAKVADRFDKGDGMINAKEFINALRFDASNRNAKPQTDTEKITHEIELQKKTCSCCTPYQIEKISENHYRFGDTHIKRMVRILRSTVMVRVGGGWESLDEFLHKHDPCRAKGRLNINMFPEARPIHALDSMRSFTKNRHGKQLPTTGTPGPIMKIREKTDRSVPMSGGLGGTAGYTVTTDSHRHTDARPSRIPRAPSDMSAGRLSRVGSVSNSKNSIVDSSTPSRPESRASSDAGDRQTRIPSLRARKGQRYIPQGPSSSSSK

SEQ ID NO: 5249 - protein, 3450 aa, Caenorhabditis elegans; identical to SEQ ID NO: 5247

SEQ ID NO: 5250 - protein, 3461 aa, Caenorhabditis elegans; identical to SEQ ID NO: 5248

SEQ ID NO: 5251 - protein, 1355 aa, Caenorhabditis elegans
MNKKNRWGERNMRHYCEHNLDILVEPEFSGAGNGVPEGSKGTVFGVFWDMGMELKLEAYKSITLNCLNFNLIPDERDNVQKKTFTKWVNKHLSKTDHKIDDLFVDLRDGYALIALLEALTGERIQKENGYTRFHRIQNVQYCLDFLKKKNIKLVNIRPEDIVEGNGKLTLGLIWTIILNFQVSVIRQRLLLESSQHEQMSAKHTTTNSQVTAGYPRVNVNNFSSSWRDGLAFNAILHRYRSSAIDWNKISSDSVSNTERLNNAFAAADREFGVERLLDAEDVDTNNPDEKSIITYVSSLYNALPHEPEMSRLQKVQEEYIEEAYEWREWVVRAIQLVDDRHLQGTASELIYELQRFREDDLPPREEQKRRLTLVYEHLEKVMRSTELFAIPHELSAPELQRVWNELQNSIDRRFDVLERHRIQEGNSNDLLSRLARGIGITNEKLDLILKRIEDVEARVDTSPPAAVERTVSEIVDDLNALESPIARFFEDVEELKSMQHPEANDFYKQVYGLHQRRTTYLDRLTNQILVRLGVRTDSLHKENQQRLENMRKTSFSRVEECIEWVRVRMEKLTTMEFLEDLETLEHVFEQHKFDNRDIQDFRQNVDECIARQAEVSAEDTYEYCELLRVLESEYQQLRDLSAGRMLDLDSLIAFVRAAQLELIWVSERESIEVTRNWSDIKQLDLPMLTNYYKQLLHEMELREKQYNDVHNQGAALLNQGHPAIRVIEVYLRQMQSQWDWLLALSKCLEEHLRDALNLKSFMEEASDAEAWIQEQSVRLENNYNRTDFSLEEGERFLRELDEIKEILNKYHQVLMALTERCASISPLWQRGERIPHPIKVTALCDYSDENVTIKAGDDVYLLDNSDLIKWTIRDISGAEGQVPSVVFRIPPTDARLTALLNRLLQQFEKLKKLWDKKHRMVRFNMVLNTMRTIQGWDLDTFNSIDPDQRDAIMKALNDDANKLLSELDPNDPLALRLREELRRTNEHFWNLLNASQKPPEPDWASQYDQKMAELLKKLEEAWRELNDAVGKPISRSPEDLERVIHAHKRFEDALQALDSDVANVKELFRQLPNPTPTQRVNHDRLNGLWDDLWDLSRMYVERIKVLESVLNGMVEVADIVRQHEITLNSFDDLPAALDKLRGHHSQLLEINMVLKVSKLGAQNEHFSQQQTVIDQLNRNVALLRQHVSRTRINEGHHPDVDAIEDEVQKLNVRWENVNSQIASRLLAVESALQIQMVYRSEYETEMSWLDTVEETINRLRKPEELRPEQYQQQLDMLIAEYTNLQEHTQAIEHVNKEGGRFIHEAKIFDAKLGQYSDGIVGIHGPGIKSEFRRTKPQPKNGSQIVTEELEVGISS

SEQ ID NO: 5252 - protein, 1355 aa, Caenorhabditis elegans; identical to SEQ ID NO: 5251

SEQ ID NO: 5253 - protein, 288 aa, Caenorhabditis elegans
MSKRKAEEAPAPKLASIFTKKVKPAEEDNNQKSWKFVCWNVAGLRACVKKSDFKEVLAEEPDLVFLGETKCKEWPPEMEETFKNYTKTLVVSTEKNGGYAGVGLLSKCAPMKVHKGIGDPEFDTAGRLIIAEFSKFYFIGAYVPNSGAKLVNLEKRGRWEKLLTEKMKEMDEKKPVIYGGDLNVAHNEIDLKNPESNRNKTAGFTDQERGWFSEMLELGFTDTFRAMHPDEKKYSFWSYLANSRQKDVGWRLDYYVVSNRIMNKVKRSDIMSSVMGSDHAPVVMQIDF

SEQ ID NO: 5254 - protein, 465 aa, Caenorhabditis elegans
MSLQHSKSRVSYYYDGDFGNFYYGQGHPMKPHRVRMTHSLIVNYGLYRKLNVMRPARASFSEITRYHSDDYINFLRNVKSDNMSTFTDQMARFSVGEDCPVFDGMYEFCQLSCGGSLAAAARLNRQESEIAINWMGGLHHAKKSEASGFCYSNDIVLAILELLKHHKRVLYIDIDVHHGDGVEEAFYTTDRVMTVSFHKHGEYFPGTGDLKDVGAGSGKYYALNVPLRDGVDDVTYERIFRTIMGEVMARFQPEAVVLQCGADSLAGDRLGVFNLTTYGHGKCVEYMKSFNVPLLLVGGGGYTIRNVSRCWLYETAIALNQEVSDDLPLHDYFDYFIPDYKLHIKPLAALSNFNTPEFIDQTIVALLENLKQLPHVPSVQMQSISTSCDSIVKTFDEKLIRDHQNDDVRVTQFEEDVQVEDSAEFYDGQEPETKNIQSMKRHASPICAAQEEMKKNRIDGGENVA

SEQ ID NO: 5255 - protein, 465 aa, Caenorhabditis elegans; identical to SEQ ID NO: 5254

SEQ ID NO: 5256 - protein, 289 aa, Caenorhabditis elegans
MDNSETRRGKPCWFRREGVGMSAINDAFIMDSFVEDILRLALPGHVNLDRLCEAYRKSKQKTLIGQFLDTSSVNQISSFTWDRYELMVENKTSHYTVFHPIQMALIISDVLAYHGSVKKVAYQIGFLFQSQDDFLDVYGDPKITGKIGTDIQDGKCTWLAVRALQKMHKTPEKWGAKLIEEFKTSFGSVDPEKVEKIKRIYDELQLKQEFRRFEKHFSGEKKKKVDFADFSREKSLKIEENCFFFQKFTTKKLKKKSPEAENLTKNSSLFQVFQVKKCRFLPIFPVKNC

SEQ ID NO: 5257 - protein, 382 aa, Caenorhabditis elegans
MEARNAEGLESCIEKIQEVKLSSFAELKAFRERKVALITGITGQDGSYLAELLLSKGYKVHGIIRRSSSFNTARIEHLYGNPVTHNGSASFSLHYGDMTDSSCLIKLISTIEPTEIYHLAAQSHVKVSFDLPEYTAEVDAVGTLRLLDAIHACRLTEKVRFYQASTSELYGKVQEIPQSELTPFYPRSPYAVAKMYGYWIVVNYREAYKMFACNGILFNHESPRRGETFVTRKITRSVAKISLRQQEHIELGNLSALRDWGHAKEYVEAMWRILQQDTPDDFVIATGKQFSVREFCNLAFAEIGEQLVWEGEGVDEVGKNQDGVVRVKVSPKYYRPTEVETLLGNPAKARKTLGWEPKITVPELVKEMVASDIALMEADPMA

SEQ ID NO: 5258 - protein, 416 aa, Caenorhabditis elegans
MQLRFALLLLIICFKACLNSPLICTNGFTLLNKKCLKLFDTKVNHTSAESSCNSFGATLVTVKNVNDEQAIATVVAASSARLIWLGLYCFDSDPAKCLWDDNSGSAQSYDNFSIDFPLVDAGHCVYLSTLGALAGKWISEDCESKLMSYICELPTTHADDCTYNYNGYCYTFSSTAEPFIIAQTKCAETYGDLVSIHSSNENRYIETFAAQDYYLIGAVWKLDNSLYWLDKSKWDYNNTDPENSYRGDYCVAMSTVISSPIPSGFWFSTNCTRPAKYICKRPAGVQSTTASPVTVAPSPANPSNCNAGLLMSPGVITSPNYPENYFNNENCTYQLSTLGAYKIALRFASFSTEANDVVTVYDGLTTDSPCLRRCSGTQRPFALTSSGNTMLVTFTSDSKGISSGFYARFSSIVYRR

SEQ ID NO: 5259 - protein, 417 aa, Caenorhabditis elegans
MRTVAALLFLFTCLESFESSSATPVCTNGFTLINNKCLKLLNTPVNHKAAEISCSSFGATLVTVKNDHDNQAIATIVGSSTPLVWLGLYCFSSNSSQCLWDDESGSARSYNNFSSGFPLVALGQCVYYSTQGALTGKWLSAECESQRMAFVCELPTTFADNCLHNYNGYCYTFSSSPQTFIGAQSTCAQTCGNLASVHSPNENRYITTFAPQDYYYIGAIWKTDYSLRWMDGSAWDYNNIDPIYPNRYNYCLHMSTITTSGSGFWYGDDCSLSRKYVCKREAGVPCTTVPPPVTVRPSSTNPSNCNAGLLMSPGVFTSPNYPQNYFNNENCTYQLSTLGSYRITLKFSNFRTESNYDFVSVYDGPTTSSPSLGRYSGNIGSFYVSSSENNMLVTFTSDAGVVFQGFTARFYSVVHRS

SEQ ID NO: 5260 - protein, 421 aa, Caenorhabditis elegans
MQAIAALLFLSIYLENFLTSSRSIHCTDGFTLINSKCLKLFPSLVSHTVAESSCNSYGATLVTVKNVKDDEAIAAIAGSSTPLIWLGLYCFDSDPAQCLWDDVSGSASNYNNFSAGFPLVVLGQCVYYSTQGALAGKWLSEECESQHVAYICELPITYTDNCDFNYNGYCYTFSSTTNSINTFISAQGTCAQDCGYLASIHSPLEIRYINTFAPHAYFYIGAIWKNDGSLYWLDNSPWDYNNIDPVQTNRVDYCLTMSTTNFGSSPAGFWFSTNCNNPGYYICKRQAGVQCSAAPPATVTPSPANPSNCNAGRLMSDGIITSPNFPQNYFNNANCAYQISTLGSMRIALTFTFFNTQPYDLVTIYDGETSSSPVLGKYGGNQSSLTFTSSRNNMLVTFITDGKDTSNGFSARFSSIVYGNI

SEQ ID NO: 5261 - protein, 433 aa, Caenorhabditis elegans
MIFTSGANKLNDNRNVRTKISSNRQSIKTAPTKAAEIPEYLQLYQTPPGDDISLTEFDDIAMERLKLLKSFENLKDSVSLYNDEFKDKFRKLCDGTKLIVFPDQKPPHQEEVYELWRRDNIGHFILRLAFCRTPENQKWLTQIEGDFLRFRLRQEREQVLDSALANVNFTIEKLGYTEKQAMIEDLEAACQFNLFEAPNKTFYKVDFIDAIELIRRGSVHLKKGFAYFPFDDLVTILVTKMKNNMMAAMARSFKHLAILEEEGRLLPRLSLLSNNAYSGKDYNGEQPDGSIIVTRHMIDKLSRRSFAPCMKQMHNHLRVNHHLKYGARRQYGLFLKGIGLSLDEAIAMMRDEFTKKITSDKFDKEYGYNIRYMYGKEGRRVAQTAMSCATIILRNPPSAVDCHGCPFRHSEKQVLKQKLGSDAILKKEQIERV

SEQ ID NO: 5262 - protein, 379 aa, Caenorhabditis elegans
MGAFFPVILLTPTPISSAHNLYLFQMLELQENITDSQPMDPPSLEIMMLHHLMIILVTLFGNTLLIYVIYKNNAVLRRKRVTPVQMLMLHMCAADILFALISVGPTMAITATVPFFYGPNLLCKLTKFLQVIPMYASSFLLVAISADRYQAICRPLASMKSSIYNRPALYSGIAWTAAILFSTPQLYLFEKRNGDCSENYTTALQYQLYVCLFNSVVWLLPSAIAGWLYLCVCKAVWKSTSFSSSLRNNMKKMEHMKLTEKNGGMQAHHKGATMQCVELDRRRVQTVKLTLTIVAANFVLWAPFCITSVIDAVWPTAINSTFATYIMFFGNLNSCMNPWLWFHFNRKQLKRACPCRKSSEPLIQSLVYVHVMTSEQSDF

SEQ ID NO: 5263 - protein, 405 aa, Caenorhabditis elegans
MVHQLKILIMIQYAPSGFQRPPRNYFMTFDKNHTPFPTMQTISALLILTLYLANCVTSSPICTNGFTLINNKCLKLFNTPVNHRTAERSCSSFGATLVQVKDYRVSTICPQFYDFPKSRLQDNQAIATIAGSGSSTLIWIGLSCFESDPSQCLWDDGSESAQRYNNFSSGFPIVELGQCVYYSTQGALTGKWLSEDCESQRVAYICELPTTIADSCTYNYNGYCYTFSTADAPFTTAQGICAKSCGSLVSIHSSNEAQYITTFAPEGFHYIGAIWNHNSSLNWVDGSAWDYSKIDPTSPRIDYCLKMSVFNGSPTGLWYSDNCIDNRKYVCKREAGVQCPTVPPTSVTPISSNSSNCNAGRLMDNAVITTPNYPENYFNNERCTYQLSTLGPNRVFLQFNFSSLN

SEQ ID NO: 5264 - protein, 413 aa, Caenorhabditis elegans
MHTISALLIFTVCLASCVTSSPICTNGFTLINNKCLKLFSTPVNHTTAEKSCGSFGATLVQAKNNIDNQAIATIAGSGSSTLIWLGLYCFESDPSQCFWDDETGSAHTYNNFSSGFPIVELGQCVYYSTQGVLTGKWLSENCESQRISYICELPTTIADSCKYNYNGYCYTFSTADAPFSTAQGICAQSCGNLASIHSSNEARYLTTFAPEGYYYIGAVWHHDSSLIWLDRSAWDYSDIDPIFPRVDYCLKMSAFNGYPTGMWYSNNCVDNNKYVCKRPAGVQCPAVPPTTVAPSSSYCNAGRLMNNAVITSPNYPENYFNNANCTYTLSTLGSYKIILVFYDFRLEAGRDFVTVYDGETTSSPVLAARLSGTIKGGFSYTSTGNNMLVTFTSDASIVGPGFTARFTSVIYRP

SEQ ID NO: 5265 - protein, 413 aa, Caenorhabditis elegans; identical to SEQ ID NO: 5264

SEQ ID NO: 5266 - protein, 405 aa, Caenorhabditis elegans; identical to SEQ ID NO: 5263

SEQ ID NO: 5267 - protein, 538 aa, Caenorhabditis elegans
MLSKRIVTALNTAVKVQNAGIATTARGMAGASGSEVSKILEERILGTETGINLEETGKVLSIGDGIARVYGLKNIQAEEMVEFDSGIKGMAMNLDVDNVGVVVFGNDKVIREGDIVKRTGAIVDVPVGDGLLGRVVDALGNPIDGKGPIANARRSRVEVKAPGIIPRLSVREPMVTGVKAVDSLVPIGRGQRELIIGDRQTGKTAIAIDTIINQKRFNDAGDDKKKLFCIYVAVGQKRSTVAQIVKRLTDAGAMDYTIVVSATASDAAPLQFLAPYSGCAMGEHFRDNGKHALIIFDDLSKQAVAYRQMSLLLRRPPGREAYPGDVFYLHSRLLERAAKMNNSLGGGSLTALPVIETQAGDVSAYIPTNVISITDGQIFLETELFYKGVRPAINVGLSVSRVGSAAQTKAMKQVAGSMKLELAQYREVAAFAQFGSDLDASTQQLLNRGVRLTELLKQGQYVPMGIEEQVGVIYAGVKGYLDKVDPSAITKFEKEFLAHLRSSQQALLKTIREEGQISPQTDAQLKDVVVNFLATFKP

SEQ ID NO: 5268 - protein, 595 aa, Caenorhabditis elegans
MTLGCAKLDKQVADWLAWDKNDKNRNEIQKLVDEKNVDALKARMDTRLVFGTAGVRSPMQAGFGRLNDLTIIQITHGFARHMLNVYGQPKNGVAIGFDGRYNSRRFAELSANVFVRNNIPVYLFSEVSPTPVVSWATIKLGCDAGLIITASHNPKEDNGYKAYWSNGAQIIGPHDTEIVRIKEAEPQPRDEYWDLSELKSSPLFHSADVVIDPYFEVEKSLNFTREINGSTPLKFTYSAFHGIGYHYTKRMFAEFGFPASSFISVAEQQDPNPDFPTIPFPNPEEGRKVLTLAMETADKNGSTVILANDPDADRIQMAEKQKDGEWRVFTGNEMGALITWWIWTNWRKANPNADASKVYILNSAVSSQIVKTIADAEGFKNETTLTGFKWMGNRAEELRADGNQVILAWEESIGYMPGHTMDKDGVSAAAVFAEIAAFLHAEGKSLQDQLYALYNRYGFHLVRSTYWMVPAPEVTKKLFSTLRADLKFPTKIGEAEVASVRDLTIGYDNSKPDNKPVLPLSTSSEMVTFFLKTGSVTTLRASGTEPKIKYYIELITAPGKTQNDLESVISEMDQLEKDVVATLLRPQQFGLIPRK

SEQ ID NO: 5269 - protein, 332 aa, Caenorhabditis elegans
MMFEKLHRFLQLHWKIILFGVIFEILITIGAVRLTYILSKPFCETDTSSNSTTTRPLSTSTEPAPPFTLDCTIGFTHINGKCWFLIPIRRTREDADAVCMGYGGSTLFSIRNEQENTAALDYLSNAGVNYVWTGLICAGNTSSSCTWDMKSGSAADYDNFANGFPNETNTSCVYFITSGPDAGQWKSGSCNQTMGFMCELPPTIHDGSCDYNYNNQCYLRYNTPHNIPDAQEICKTRCANLVSISSANENRFIRSLFTTQGYVLLGAAVIYYDDIYWLDGSPAVYNYIERYQHGACLLLNVNWVYITDGAWYTERCTTPGKFLCKRPAGTVC

SEQ ID NO: 5270 - protein, 345 aa, Caenorhabditis elegans
MSKSYEFEELECDEPTQQTRFEKIQNVASDHWKDILIGVLSQIMYLSFVVLLTYFLARQHLCETELFTSSTLPTIPITSSRSRPAVGNYTCTDGFTYINNKCWKLVTSSQSRADADQACYNLGGSTLFSIRSDQENQAVLDFVKNENVDNLWTGLICDDHGQFLCTWDVDSGDISAYNNFAKTYPNNVTGGCIYYMTTGSQAGQWTNGACNKALSFVCELPATIHDETCKYNYNNYCYITNDQLKISSDAQQICTSSGSNLVSIHSANENRFLTTIYSPPVLVGGVAFSSNLILWYDGTPSTFNNIKSITNGNCLFINDTHGGWYGFDCFTGSGDFICKQKIREM

SEQ ID NO: 5271 - protein, 512 aa, Caenorhabditis elegans
MNEDENKGIVFQIAYELPSQQRVGMQMANLRLHARGVFSNVYRGTILSPGTEQEIAIKKTWPKTPYRNFELLFLSGLRRKPHKNIVQMLFAFSRNTTSGEGLEMKHSFCESYVFGFMPYTLQNILKKTRLAEVDMKLYTWQLFEGIRYLQAHMIVHRDIKPVNILVDVDKGTLKIADFGSAKVVLRGSSSTSYQVTRFYRPPELLLDAKEYYWMVDVWSAGCCVGEMMKGKVLFPGASIKIMLKLIVQAIGLPSARDLDYMKVSSMIDQQSAVKVIGLKEVLGTENQEWADFLGAILRYRPRERLHGPKLLSHPFFDLIFTPKCTLSNGLLVSQVITLDDYKTAQKNDSTSGKQYAAAILRHEIRFSLKAPIVHPPAPPAPPVVPMIDMISCRFLIFLSLLVTVFSLECYTGFTYLKAQSVGTSKETCPSPNDYCYNMTADLTSLNNVKKGGCSSTRCILARNKCMTQSIGGTQIQFCCCNTGDLCNSKLTNMSFFEKTKQRAKDFLDMLRG

SEQ ID NO: 5272 - protein, 693 aa, Caenorhabditis elegans
MKLLRSLNYGTLCKLSTSAQSLKKSSRLLKKQPKNKISLTPKFLDNVREWPKIFEAEIEAQFEKLDEMIRNKVGWRVIEERGLCVGNLIVTSKYYDSYCGEVITLSGDAILRTRWLKAGTPVLLNKLNEDGHLQKVSDGHVVDCTAGIVKVCAYDDKNVDFSTLNYILTPSTNSGALKFLQSVIKYGGYRIPDLKICIQFFRNPSSLSSDSVHLVNLAYRSIPMPSIHDRKIGNLPETLNPSQVAAVSAAMNTQRNLLCIQGPPGTGKTRVIAEIVHQLMKKKKKVLVCAPTHVAVRNAMDATTGRMIEEMPEEKAEQQLCLLANTKDEFQNHKSASKLEEIKKQLSTMSTSDPLYKKMSYEYYLIRNSIFRSIFYPKLAVFSTLGTSSIQKLPEYHWNADVMIVDEAAQCTEPATWVPVLTTPSCKKLILVGDQKQLPAVVLSDKAMKGNFKLSLMEKLAEEFSSNNINILLNEQYRMNKKIMNWSNEVFYENQLTAHSTVSDITLRDICPNLPEDHVLNNPIMMINMENVKDRSHEEFESHSFTNTDELNLVTEYVNRLVVDLGINPKAIAVISPYYAQIEKLRRSIPFRVDVNTVDAFQGHERQVVIFCLVRDNDEGQIGFLNETRRLNVAVTRARRQFVLIGNGRMMKGNKHLLKLYKHLQSEKVIFGPSILETFNDLEEAALPRSDKF

SEQ ID NO: 5273 - protein, 386 aa, Caenorhabditis elegans
MSYPDDFPIPHVIQPVKVVRHVVKETPIKTPYLDVCPKCQTTIMTSVTTHIGMCWWLICFFGTFLFCWPILICLCFDVSKDVDHNCPNCGLLLATSNRAAPNFVSHSDRVKSVDFHSEKPWILTALHTGNVQIWNYDTKTLVKAMEVSEKSTRAAKFIHRKNWIATASDDQQIRIFDAETFSLINEFTAHSDFIRSLTVHPTLPYLISASDDRKIRVWDWENEWRMEQEFQEHAHYIMQIAVNPEDPEMFVSGSLDKTLKVWKLGEQESICTLEGHEKGVNCVEFLTGGRIVSGSDDCSICVWDIQTQKCIETLKNAHKNNVTFVTPFKTWIISGAEDSTVKIWNSQTFSLEKELNFEKGRAWCVAAGKSDAIAVGFDSGAVTVEI

SEQ ID NO: 5274 - protein, 1820 aa, Caenorhabditis elegans
MATNGVYIVMGEANCVVALLNKARRQYQLSQVPTLEDTDPLLRNFTDLKEVLNEVADLADMNPQTYLSPFLDVIKAQNTNGPITEAALAAVAKFLNYGLIDASSIKAANAVESIAYAVVHTKFIGGKSTGSDECLFLRNSRKKVNFHKKSTQNLLEMCQNFIRSANLDEFYVLRSLLLSPPGILLSNEAVCDMMQSCFRIVFEQNLSLLLRKAAESTLADMTQLIFTRLPTFVEDTRHPYIRQLVNPTEKRQKRKKKRQLSVHIETKAKEPENVPTEMTKLIGEAAETAETDGAANLGYDVVLTTDPPVDTVTHPDPPIEEIIKLAEPISAGDEADSESEGGGGEEHHERPPVRAHAGLQREIVSDEEEIDTEQTVGGEEKMPYGLPCCRELLRFLITMTNPVDRHNTESMVILGLNLLIVALEAIADFLPNYDILMPLIKNELCRNLLQLLDTNRLPVLAATNRCCFLLFESMRMHMKFQLESYLKKLQSIVLTEEKQHENGGGGTEQKEMALESLVQLWRIPGLVTEMYLNFDCDLYCGNIFEDLTKLLVENSFPTVGGHTASLLSLDALLVVIETIEQNCEDRENGRGEVAKEQEHKDLKKLGLPVLSGYDLAKKMAISTGGKASPMPVSSSIVLRSNRHAPSTELPSMSQIIEQKKRKRLIAEGTELFNQSPKKGIAFLREKGILGHDEQSLVQWLRTNPQLDKKAIADYICNRKHAEVLNAFVKSFPFENTRLDVALRMFLETFRLPGESAEIALVMQHFSEEWFRANNEPFFHVDAAFTLSYAIIMLNVDQHNPQAKRSQPPMTVDCFRRNLSGTNDSRDFDPEMLADMYQAIKTEEIVMPAEQKGTVKEDYMWKVLLRRGETAEGSFYHAPTGWNDHDLFAVCWGPAVAALSYVFDKSEHEQILQKALTGYRKCAKIAAYYGMKEVFDNLCIHLCKFTTLTSMRDGGAGGGADEDVDLSAAALLSHSSSPEAVALAFGENHKAQLATRTLFYLVHENGNILREGWRNLFEALLQLFRARLLPAELTEVEDYVDEKGWVNIQRVHQKELPHTRNDSGLLSWFGLGGGASEADRRKPTQEQLSSMKLASQVISECRPSQIVADSKYLTSTSLAELLSSIAANSAQIVEQAEPQQKTASLSGEDEDALVFYLELIVAITLENKDRLPLVWPHVRRHLEWLLSPRFGRCPVLVERAVVGLLRVANRNLFRDNTVSDDVLHSLSMLLRLSPKALFIFSRQIAFGLYELIRANAANVHKKEHWAVLFALLEAAGAAVLPDDYVMMTTTEKQQQSLRVGGDQQQQRMAYSDVEGASGRGGGAHEERAYTSEGEERRRGGYDSNSDLESRVDSAGSLLGAQKQPADWIHLDHKDAAKATEEALTALGANVVSSKKNFRQFGSLVLRNGLGRHEPAAFLKVCECLAFLLRDAVHVTPDNFESSLQCLRTMVEASLDGGVYAAGPLSGDAQNRLRSNVTDEKAVKKHHHHHHGHKKKELCTDVTEDADESRNEEQQLIGNYQQMSLHLLDLCSQLHSQTPAIFAKWAQGASPAASDLATVAFIWTDIWRPLLQAIGRLSCDCRRGVRAAALTHLQRAFLPANMATLGAAEWQSCFGEVLFPLLTKLLEPFSQMDPIGMEDTRVRTLQIVAKTLLNHLSALSALDSFPDLWMLLLDYMEQYLRVDSCGNLNEAVPESLKNMLLVMDSTGIFAATPRLYDVTVERLNKFMPELIKDTIPNPPRPGQQQSEASEPKKEHASGLEPPPPSSNSTAATSTSDPSIATAQSSISTASSVVGPLVTCPEDAGISAPIPIQHPLVSSLGAQ

SEQ ID NO: 5275 - protein, 1439 aa, Caenorhabditis elegans
MGGRIWNGFMIFFSIFFSKKKIEKNESFCIKIDFKYFSARTQTIRIHVADIDEPPSFVNSPLPMLAVVPLNPTIGRIVYQFVARDEHGDGDSNVLYKTIDVIPAGSFIVDPKSGVVRTGWSKYERGDTYRISAQAMDLSPSDNTTSQLSEVAILEILADERPPQFAKQEYEVTVSEDNLVDYSVVDVKAQSFRSFEDGRSKGPITYSLEGDTPEDETKWFRIDPSTGIIHLTRLLDFDDPALPKLHKLKVTAREDNRESHVDLTIRIDDVNDNVPTFTRPLYTAQVREDIPLNQTILKVTAVDKDTGDNSRITYSVDNHNFSINSNGEISAKVRLDADQLNERHFVYRFNVTARDHGEPVSLSSSAMIHIRTENTNDESAVFLPTSQYTAFVAEDAQGGTPVIQIQARDADRDEVTYSFMDKNGRSTQKMNLFSIDEHTGLVKLRHGVSAADLAEAENPINLTVIVQDDGSCCVYPSKTHTSYATLLIGIEDVNNNKPEFPDCAKYSDIAKIMEGTYKTDPPTIVKVEATDDDSSANGDIVYSLYYTQSESRKAFVIDRQTGVLTPSPHVVFDRETRPREDVTVKATDRGDRPLIGFCQFSVEVVDINDNSPQFERPSYETSVSRFEAVGTSVITVFAFDNDAAHNAEITYSLEIDTTAGEEHQNDLDFFELVNRRSGEITLIKPIPMKTQKFIFNVIADDNGIPEALQSSAQVTLNVLDKQQKAPKWQTSPDCKPGITVDENVELNKVILRCRAVSSGDSRNSDVIYKLTASGGPGNKAESKFRQFNKFENGNEWVEVVIMEGLDYEQVNNYTLTLTATVGVPTIQEKNVCVFDFQDMTSRVASTKTFVVEVRDVNDVVPQFTVDLFTGTIDEEMTPNEHLEKTNGKPIVTVKAIDTDSDGPQNEVHYRIVGEANGEETKHFRIDELTGEIFPNEKFDREKIDMYILTVEASDRSVSALPGANGPNKDNVKVQIVINDVNDNAPSFEEQKYIGRVKESEGEGHDVITIKAHDLDKHSNLRYHLIGAGGGRIPFGVRTDSGTIFVKEPLDFEASDQYHLVLIASDGRHNATTNVYIHIEDVNDNAPQFEQQKYATTVIEEDVDIPKVLFNVHATDADQDEKSSRIVYRLEGQGADEVFRIGKYSGTIELVKALDRDPPAGVPSWNFVVQAIDDDGNGLVGYADVQVNVRDINDNSPIFPERLFGYIEENREPIHSDGVYFMDVQARDFDDPTTENANIEYGIVRNKLINGESVFRIDQNTGKIFAMRSLDREISSEREFIIEVRANDRGVPSREGFANVTIKVTDMNDNAPFFEKTRYEGSVEETAPIGAAVMSFSAFDADEEAKDNVFTYQLSEESDYFYVTTDKDSKQSSVGVLRVKQIFCHIYCLVAILKNSIFTPKLHQFEKKNSLKKFFFWQLGNKYKVLKLELTNMAFVFLLW

SEQ ID NO: 5276 - protein, 580 aa, Caenorhabditis elegans
MTDEELFEIALPGFLYLTVFLVGTIGNSMVIFVVNRFKRMRNVTNIFLASLSTADLCLIWFCVPIMFMKYMSHTWSMGRFACYSVHYIQQFTCFCSVLTMTMISFERFLAIAYPMRNIWFSSIGRAKKVILLIWMSSAVLAVPTAVRMDYETNLSLSGQRVHWCRRRFPAQFLGYPRTSLNKAYAMYQLLLLIIFPVLTMSICYARVSAIVYKSSKDRVILSQAMVAFSKAATDAVTFSGYSAIPMITTSRNLKTANTTIKSYSNHRNNRVAEANKKQIVQMLISIVCMYTVCWLPTIVDELLTSFGYICRTSNTQTLKHMRMGFNALTYCQSCINPILYAFISQNFRSTFKTAYSRMKSRLQVGVHSGDPLKEGMKSFAWSGRGRNALSYGIVLFGEHDVDPQPAPNLRVQLQHTHSARSLHDHSEHVTRRLTVVIVQADVANVVLPTEESNGRRLSVDFHEVREICGRFFSKHRPRSPTDVSHDSGRPRSPTDLSQSTKPSRRSSSIRPRSPTSTSQMSTIVRSRSPTGASDTSSLFPSRTRSPTLQSNTSGQSMERTTDRLSVRDAVRPKTPPAVVV

SEQ ID NO: 5277 - protein, 1042 aa, Caenorhabditis elegans
MICASKITMLGLLVMCTLGGVLGKVDIRQTTANKAFMETMRADGYEVVHPFQIRDKNERIGIDTRNYFLKAQEHYSHVTIVIRSNQLGRLKLVLERNNFIFLNQTAFHKLDADGERVIQNRVENCYYQGTVGGEESSFVALSSCNGLRGVISFANGTTFGIWPLDGGDRNSRRHPHILYKSEWSQEAKCGSSMAHAVGQRRMKKHVHKHRSHHHEHNKKRDVSKRTKYVEVALIADYEFMKARGLHDLDAISYMLESLNIADSMLSRDLNIRLSAVYVELWTDVQRIDLWEDIERTLSGVVDYASGHIYHIQKDASILFTAGSFANQEVSNAAIRSICTARSAVIVKGVEQFATHWNGELLAQSIGHLLGLEHDTTACSCEPSPECVMRQQPGRVGGGGGSPFSWQFSKCSVARMHGIWQDGNIQCLLNKPFQVSELRECGNGVVDGSEECDCGSRENCQDPCCDPLTCTLRPHAQCAAHHKCCHRCELRKAGDTCRSSKSPCDVAEQCDGKSGDCPPDGHLIDGTVCGTDGQCWRGNCSDSHQQCQKLWGREARVAEPVCFEQNTKGAEYANCGQRQADGTYHPCQIEDTRCGTLHCHSGSITPIDSSLKAFTFHFTENSHQIQCKSIASAAVGLTSDGTNCASGRVCVAGSCVEMSSVSSATACPTNNLALLCSGHGHCTTTARCVCFNGWSGVACDIRSNSSTYQGSMGFGEEGSGGSSQKSSERKTIMIPHLNIGTTLETATLFAILLGFGVFLLLCLVCLMLCYRRRSVVEIPKPSDEKDEESPDRQIKFGNMPSYREEKRKRKSNKKIYGALNRITEADERDSTSLRSRDSAGGSQQLVDRRNGAPVVVGGIRDPYAGEHIYAESSSNHLTRQFRGINSDGSYPLRSFGSWRSSAPISPASSSGQLTDVSTATTPLRLNKIGKFLKTLQSDDESPSPFSDHQSFTTGIGIGARLEQMQFGGGGDEELSAVEADHDVGSNTESSRGCEEPMDPGSWDSPTLVNGASSSSTSNNYNFRQSPSLFSDPFKLEMTNSMHN

SEQ ID NO: 5278 - protein, 174 aa, Caenorhabditis elegans
MASLTRAVTRLAIAGRQAVRTIATTTPVSGHGDDIMEKWPADKFDNHFINYLNRPEIDGWEVRKALSELHDYDVIPDPKVVEAALRACRRVNDFALAVRFLEAIKIKCGAQKNRDTVYAYIVKQVEPVLKELGIDTPEQLGYGEPEFFVPEPEYWWEKKWYKDYGYDKHPNIQI

SEQ ID NO: 5279 - protein, 508 aa, Caenorhabditis elegans
MSSAAADESDAVLENLIAKEILPQTGNWEGTEEFLNRIVQVLLKYIKDQNDRDQKILEFHHPDKMQMLMDLSIPEKPESLLKLVKSCEDVLRLGVRTGHPRFFNQISCGLDLVSMAGEWLTATANTNMFTYEIAPVFILMEKSVMARMWEAVGWDPEKADGIFAPGGAIANLYAMNAARHQLWPRSKHLGMKDIPTLCCFTSEDSHYSIKSASAVLGIGADYCFNIPTDKNGKMIPEALEAKIIECKKEGLTPFFACCTAGSTVYGAFDPLERVANICERHKLWFHVDAAWGGGMLLSPEHRYKLAGIERANSVTWNPHKLMGALLQCSACLFRQDGLLFQCNQMSADYLFQQDKPYDVSFDTGDKAIQCGRHNDVFKLWLMWKSKGMEGYRQQINKLMDLANYFTRRIKETEGFELIIENPEFLNICFWYVPSKIRNLEPAEMRARLEKIAPKIKAGMMQRGTTMVGYQPDKQRPNFFRMIISNQAITREDLDFLIKEIVDIGESLE

SEQ ID NO: 5280 - protein, 1111 aa, Caenorhabditis elegans
MRLILLVLLATWQVVVDTRAPTFPDKLTQQLQQQGTTEPQGDHVCTVKTIVDDYELKKVIHTVVYNDTEQCLNPLTGFQCTVEKRGQKASYQRQLVKKEKYVKQCCDGYYQTKDHFCLPDCNPPCKKGKCIEPGKCECDPGYGGKYCASSCSVGTWGLGCSKSCDCENGANCDPELGTCICTSGFQGERCEKPCPDNKWGPNCVKSCPCQNGGKCNKEGKCVCSDGWGGEFCLNKCEEGKFGAECKFECNCQNGATCDNTNGKCICKSGYHGALCENECSVGFFGSGCTQKCDCLNNQNCDSSSGECKCIGWTGKHCDIGCSRGRFGLQCKQNCTCPGLEFSDSNASCDAKTGQCQCESGYKGPKCDERKCDAEQYGADCSKTCTCVRENTLMCAPNTGFCRCKPGFYGDNCELACSKDSYGPNCEKQAMCDWNHASECNPETGSCVCKPGRTGKNCSEPCPLDFYGPNCAHQCQCNQRGVGCDGADGKCQCDRGWTGHRCEHHCPADTFGANCEKRCKCPKGIGCDPITGECTCPAGLQGANCDIGCPEGSYGPGCKLHCKCVNGKCDKETGECTCQPGFFGSDCSTTCSKGKYGESCELSCPCSDASCSKQTGKCLCPLGTKGVSCDQKCDPNTFGFLCQETVTPSPCASTDPKNGVCLSCPPGSSGIHCEHNCPAGSYGDGCQQVCSCADGHGCDPTTGECICEPGYHGKTCSEKCPDGKYGYGCALDCPKCASGSTCDHINGLCICPAGLEGALCTRPCSAGFWGNGCRQVCRCTSEYKQCNAQTGECSCPAGFQGDRCDKPCEDGYYGPDCIKKCKCQGTATSSCNRVSGACHCHPGFTGEFCHALCPESTFGLKCSKECPKDGCGDGYECDAAIGCCHVDQMSCGKAKQEFEALNGAGRSTGLTWFFVLLIVALCGGLGLIALFYRNKYQKEKDPDMPTVSFHKAPNNDEGREFQNPLYSRQSVFPDSDAFSSENNGNHQGGPPNGLLTLEEEELENKKIHGRSAAGRGNNDYASLDEVAGEGSSSSASASASRRGLNSSEQSRRPLLEEHDEEEFDEPHENSISPAHAVTTSNHNENPYADISSPDPVTQNSANKKRAQDNLYT

SEQ ID NO: 5281 - protein, 674 aa, Caenorhabditis elegans
MVHLNKTIQEGDNPDLTAERLTATFDTHAMAAQIYGGEMRARRRREITAKLAEIPELHDSMPLPYMTREEKIMESARKLTVLTQRMSEIIDPTDAGELYHLNNEVLGIEGNPMALHGVMFIPALNAQASDEQQAKWLIRALRREIIGTYAQTEMGHGTNLQNLETTATYDIGTQEFVLHTPKITALKWWPGNLGKSSNYAVVVAHMYIKGKNFGPHTFMVPLRDEKTHKPLPGITIGDIGPKMAYNIVDNGFLGFNNYRIPRTNLLMRHTKVEADGTYIKPPHAKINYSAMVHVRSYMLTGQAIMLSYALNIATRYSAVRRQGQIDKNEPEVKVLEYQTQQHRLFPFIARAYAFQFAGAETVKLYERVLKEMKSGNVSLMADLHALTSGLKSVVTHQTGEGIEQARMACGGHGYSMASYISEIYGVAIGGCTYEGENMVMLLQLARYLVKSAALVKSGKASQLGPLVAYLGARSEPTSLIDRVPNGGITEYIKTFQHIAKRQTLKAANKFFGLMENGEKREIAWNKSSVELNRASRLHTRLFIVEAFARRVNEIGDITIKEALSDLLHLHVNYELLDVATYALEDGFMSSTQLDYVRDQLYFYLQKIRPNAVSLLDSWEFSDRELRSVLGRRDGHVYENLFKWAKESPLNKTDVLPSVDTYLKPMMEKARQSKL

SEQ ID NO: 5282 - protein, 679 aa, Caenorhabditis elegans
MANRSIRDGDNPELLEERRMATFDTDKMAAVIYGSEEFARRRREITDAVSKIPELADIKPYPFLTREEKVTEGTRKISILTKYLNQLIDRDNEEESLHLHREVIGYEGHPFALHDALFIPTLQSQASDEQQEKWLERARRREIIGCYAQTELGHGSNLRNLETTAVYDIASQEFVLHTPTTTALKWWPGALGKSCNYALVVAELIIKRNNYGPHFFMVQLRDEKTHIPLKGVTVGDIGPKMNFNAADNGYLGLNNLRVPRTNLLMRHCKVEADGTYVKPPHAKIGYSGMVKIRSQMAMEQGLFLAHALTIAARYSAVRRQGHLDDKQVEVKVLDYQTQQHRLFPSLARAYAFIFTGFETIHLYSQLLKDVDMGNTSGMADLHALTSGLKSVVAHETGEGIEQARMACGGHGYSMVGFENQVKKKKHFMELFQASYISVVYGIAIGGCTYEGENMVMLLQLARYLVKSVELIKAGKAKKLGPVASYLADKSDETDLTSLNGYVKMFENMARRQAWKATEKFLKLMESGESREVAWNKSAVELTRASRLHTRLFIIEAFMRRVSRIEDIPVKEVLTDLLHLHVNYELLDVATYALEFMSFTQLDYVRDQLYLYLEKIRPNAVSLVDSFQISDMQLRSVLGRRDGHVYENLFKWAKSSPLNNADVLPSVEKYLKPMMEKAKL

SEQ ID NO: 5283 - protein, 660 aa, Caenorhabditis elegans
MSSICKGDNSDLTEERKNATFDTDKMAAVIYGREEIASRRRQLTESISRIHELAESKPLVFMTREEKIAESCRKLEVLSRHWNQTPFNRDNEEDALHIYREVLGMEGHPLALHDTMFIPTLVAQASQEQQEKWLGRARRKEIIGCYAQTEMGHGTNLRKLETTATYSPDTQEFILNTPTITALKWWPGALGKSSNNAIVVANLLIKDQNYGPHPFMVQLRDEKTHIPLKGIVVGDIGPKMAFNGADNGYLGFNNHRIPRTNLLMRHTKVEANGTYIKPSHAKIGYSSMVKVRSRMAMDQGLFLASALVIAVRYSAVRRQGFLEDKTQKVKVLDYQTQQHRLFPSLARAYAFIFTGFETIHLYSQLLKDVDMGNTSGMADLHALTSGLKSVVTHQTGEGIEQARMACGEHGYSMASYISEIYGVAIGGCTYEGENMVMLLQLARYLVKSVELIKSGEEKKLGPMVSYLAAKGGHPDLSSLNGYVTAFEHMARRQAWKATEKFLKLMETGESREVAWNKSAVELTRASRLHTRLFIIEAFMRRVSRIEDIPVKEVLTDLLHLHVNYELLDVATYALEFMSSTQLDYIRDQLYLYLEKIRPSAVSLVDSFQISDMQLRSVLGRRDGNVYENLFKWAKSSPLNKSDVLPSVDKYLKPMMEKAKL

SEQ ID NO: 5284 - protein, 662 aa, Caenorhabditis elegans
MHLNTSICEVDNPDLTEEREKGTFDTDKMAAVIYGSEKLARRRREISEAVSKIPELADTQPFPFMDRLEKITEGSRKLEVLNNNIRDIIDYDDNGERLHIYQEVTGMEGHPLALHEVMFIPALVSQASKEQQEKWLGRARRREIIGCYAQTEMGHGTNLRKLETTATYFPDTQEFVLNTPTTTALKWWPGALGKSSNYAVVVVDMIIKGKSYGPHPFMVQLRDEKTHIPLKGIVVGDIGPKMSFNGGDNGFLGFDKFRVPRTNLLMRHVRVEADGTYVKPPHAKVNHSAMVHVRSHMATGQGALLAQALIIAVRYSAVRRQGFLENKTQEVKVLDYQTQQHRLFPSLARAYAFIFTGFETIHLYSQLLKDVDMGNTSGMADLHALTSGLKSVVTHQTGEGIEQARMACGGHGYSMASYISEIYGIAIGGCTYEGENMVMLLQLARYLVKSVELIKSGEAKKLGPMVSYLAAKGGHPDLSSLNGYVTAFEHMARRQAWKATEKFLKLMESGESREIAWNKSTVELTRASRLHTRLFIIEAFMRRVSRIEDIPVKEVLTDLLHLHVNYELLDVATYALEFMSSTQLDYIRDQLYLYLEKIRPSAVSLVDSFQISDMQLRSVLGRRDGNVYENLFKWAKSSPLNKSDVLPSVDKYLMPMMEKAKL

SEQ ID NO: 5285 - protein, 448 aa, Caenorhabditis elegans
MREVISIHVGQAGVQIGNACWELYCLEHGIQPDGTMPTQSTNEGESFTTFFSDTGSGRYVPRSIFVDLEPTVVDEIRTGTYKKLFHPEQMITGKEDAANNYARGHYTVGKELIDTVLDRIRRLADNCSGLQGFFVFHSFGGGTGSGFTSLLMERLSVDYGKKSKLEFSIYPAPQVSTAVVEPYNSILTTHTTLEHSDCAFMVDNEAIYDICRRNLDVERPSYTNLNRIISQVVSSITASLRFDGALNVDLNEFQTNLVPYPRIHFPLAAYTPLISAEKAYHEALSVSDITNSCFEPANQMVKCDPRHGKYMAVCLLYRGDVVPKDVNTAIAAIKTKRTIQFVDWCPTGFKVGINYQPPTVVPGGDLAKVPRAVCMLSNTTAIAEAWSRLDYKFDLMYAKRAFVHWYVGEGMEEGEFTEAREDLAALEKDYEEVGADSNEGGEEEGEEY

SEQ ID NO: 5286 - protein, 277 aa, Caenorhabditis elegans
MATADVKSTVPHMDMDRGGAFDFSNCIRNQAMCKMGGKAPKLTSTGTTIVAVAFKGGLVMGADSRATAGNIIADKHCEKVHKLTESIYACGAGTAADLDQVTKMLSGNLRLLELNTGRKARVITALRQAKQHLFNYQGYIGAYLLIGGVDPTGPHLYMCSANGTTMAFPFTAQGSGSYAAITILERDFKVDMTKDEAEKLVQRALEAGMHGDNASGNSLNLVIIEPSETVFKGPIVPEFCKRPEPNDLVYKFQAGATKVLKHKTYKYDVVESMDITH

SEQ ID NO: 5287 - protein, 922 aa, Caenorhabditis elegans
MIETLTSEQAASHEVVPCTHQLRTNLEEGLTTAEATRRRQYHGYNEFDVGEEEPIYKKYLEQFQNPLILLLLASAFVSIVMKQYDDAISITVAVVIVVTVGFVQEYRSEKTLEQLTKLVPPTCHVLRDGKEAMMLARELVPGDIVLLNTGDRIPSDLRIAESFSLQIDESSLTGETEPKHKETRSVPAASATGSDVEHLTCIAFMGTLVCAGRGRGIVISTAANSQFGEVVKMMMGEESPKTPLQKSMDDLGKQLSIYSFGVIAVIFLIGMFQGRNVVDMFTIGVSLAVAAIPEGLPIVVAVTLAIGVMRMAKRRAVVKKMPAVETLGCVTVICSDKTGTLTKNEMTAQAIATPEGKLAEITGIGYSAEGGVVQYQGEQVHQWTHPEFARIIEAGLVCNNATIEADKLIGQPTEGAIVVLAKKAQLEGVRSEYKRLREMPFSSDTKWMGVQCADAHGQNVYFIKGALDRVLDQCGTYYSSDNQRKQCDQYSRQHILEIGKELGQKGLRVLGLARGESMQSLMFLGMIGMMDPPRPGAADAISIVKASGVDVKLITGDAMETAQSIGQSLGILSSSDSCLSGQQVDQMSDHDLELVIRQVTVFYRASPRHKLKIVKALQALGEVVAMTGDGVNDAVALKKADIGVAMGVCGTDVCKEAADMILCDDDFSTMTAAIEEGKAIYHNITNFVRFQLSTSVAALSLIAASTMFKFDNPLNAMQILWINIIMDGPPAQSLGVEPVDDDIIRQRPRNTKQPMLTGKLIADILASAAIIVVGTLSVFYKEMSADNKVTPRDTTMTFTCFVLFDMWNALSCRSSRKMIWQIGLRRNRMFSLAVSASLICQLLVIYWAPLQHIFQTEALSLFGTEIVENALIFELNLKKVLNSNLIFLTTITSSVFIFNETRKYFSLRSKSLNHDPLSVSGI

SEQ ID NO: 5288 - protein, 705 aa, Caenorhabditis elegans
MIETLTSEQAASHEVVPCTHQLRTNLEEGLTTAEATRRRQYHGYNEFDVGEEEPIYKKYLEQFQNPLILLLLASAFVSIVMKQYDDAISITVAVVIVVTVGFVQEYRSEKTLEQLTKLVPPTCHVLRDGKEAMMLARELVPGDIVLLNTGDRIPSDLRIAESFSLQIDESSLTGETEPKHKETRSVPAASATGSDVEHLTCIAFMGTLVCAGRGRGIVISTAANSQFGEVVKMMMGEESPKTPLQKSMDDLGKQLSIYSFGVIAVIFLIGMFQGRNVVDMFTIGVSLAVAAIPEGLPIVVAVTLAIGVMRMAKRRAVVKKMPAVETLGCVTVICSDKTGTLTKNEMTAQAIATPEGKLAEITGIGYSAEGGVVQYQGEQVHQWTHPEFARIIEAGLVCNNATIEADKLIGQPTEGAIVVLAKKAQLEGVRSEYKRLREMPFSSDTKWMGVQCADAHGQNVYFIKGALDRVLDQCGTYYSSDNQRKQCDQYSRQHILEIGKELGQKGLRVLGLARGESMQSLMFLGMIGMMDPPRPGAADAISIVKASGVDVKLITGDAMETAQSIGQSLGILSSSDSCLSGQQVDQMSDHDLELVIRQVTVFYRASPRHKLKIVKALQALGEVVAMTGDGVNDAVALKKADIGVAMGVCGTDVCKEAADMILCDDDFSTMTAAIEEGKAIYHNITNFVRFQLSTKLNSTQTNYKL

SEQ ID NO: 5289 - protein, 705 aa, Caenorhabditis elegans; identical to SEQ ID NO: 5288

SEQ ID NO: 5290 - protein, 922 aa, Caenorhabditis elegans; identical to SEQ ID NO: 5287

SEQ ID NO: 5291 - protein, 382 aa, Caenorhabditis elegans
MLDYNNVTSGSSEEDYDTSEIIGLQVNTHEEYEDIIAEALWPNAVEQWFVYILASMMVIGVIGNTLVVVVVATNKSMVGRMGTGNRGNRVVCSMFHKRNALNLVLMNLAIADLLILLFCLPLTVVNDVTKTFWFSAVFCKSVNFVNNTSVYVSIMSLVFITCERWRAITYPLKSPFVRTRSVIGGIWFIAMFLSSPEPVTLHLAGAPFVRPNFTTKWGTRCKESWSEEFQKNYQLLQTIFSFVLPLLVISILCLHMVRTLHFSANYLTVANRQISIRKKAVRMLCAVVFLFSMSNLPVHLYNIALNYDLLSTDVSTNTIAVRKLLPRVFSYSSSCLNPILYSFLSGRFEFCSIYILEKNQSIKPTDLYIILKNQTNEKSEKK

SEQ ID NO: 5292 - protein, 806 aa, Caenorhabditis elegans
MSVVSNHHSNGNGNSTVYDTNGNDEIKKEVKDEPMASDSEVPFGELMKRDKKEKKQKKRKAESGSDEDDYKPEKRKSSAKNGKKKDVGSDSEDDYKPEKKKSKKNNKKKAQESSEDDDEESEGDVSEEDVKPQIHSDDELEEEDEAPTTDDEEEQKRKEKERRKKEKREKKERKEKKRLEKENRKIKEEDDEDSDDEDDEKAKKKKRKSKGAEKSKPSTSKKDAGGKKEPPKKKVKKEEDIEDIWEWWKEEKKPAGVKWNSLQHCGPLFAPPYIPLPSHVHFKYGGEKMKLTLETEEIAQFYAGVLDHEYSTKEAFNKNFMKDWRKVMTVEERERIHDLKKCDFRAIDAYQKEQREIRKAMTKEEKLKIKEEKEAEVKIYGIAIIDGHRQKVANFRIEPPGVFRGRGGHPKMGLIKKRIMPEDVIINCGKDTEIPKPPPGHKWKEVRHDNTVTWLCSWTESVLGQNKYIMLNPSSKIKGEKDFEKYETARRLKKKIGGIRERYTDDFKSKEMRVRQRATALYFIDKLALRAGNEKDVDEAADTVGCCSLRVEHIKLFDSAKLNEDDKKEKEFVVEFDFLGKDSIRYFNRVSVEKRVYKNLKIFMEGKAPSDDLFDRLDTATLNDHLRSLMDGLTVKVFRTYNASITLQEQLIKLTNPKDNVAAKILSYNRANRQVAILCNHQRAVSKGFDESMQKLEQKIKDKKKEVKEAEAALKSARGAEKEKAQKKYDRLKEQLKKLKISRTDKDENKQIALGTSKLNYIDPRITVAWCKKFEVPLEKVFTKTHREKFRWAIDMTNSSDEEYVF

SEQ ID NO: 5293 - protein, 734 aa, Caenorhabditis elegans
MSVVSNHHSNGNGNSTVYDTNGNDEIKKEVKDEPMASDSEVPFGELMKRDKKEKKQKKRKAESGSDEDDYKPEKRKSSAKNGKKKDVGSDSEDDYKPEKKKSKKNNKKKAQESSEDDDEESEGDVSEEDVKPQKRKSKGAEKSKPSTSKKDAGGKKEPPKKKVKKEEDIEDIWEWWKEEKKPAGVKWNSLQHCGPLFAPPYIPLPSHVHFKYGGEKMKLTLETEEIAQFYAGVLDHEYSTKEAFNKNFMKDWRKVMTVEERERIHDLKKCDFRAIDAYQKEQREIRKAMTKEEKLKIKEEKEAEVKIYGIAIIDGHRQKVANFRIEPPGVFRGRGGHPKMGLIKKRIMPEDVIINCGKDTEIPKPPPGHKWKEVRHDNTVTWLCSWTESVLGQNKYIMLNPSSKIKGEKDFEKYETARRLKKKIGGIRERYTDDFKSKEMRVRQRATALYFIDKLALRAGNEKDVDEAADTVGCCSLRVEHIKLFDSAKLNEDDKKEKEFVVEFDFLGKDSIRYFNRVSVEKRVYKNLKIFMEGKAPSDDLFDRLDTATLNDHLRSLMDGLTVKVFRTYNASITLQEQLIKLTNPKDNVAAKILSYNRANRQVAILCNHQRAVSKGFDESMQKLEQKIKDKKKEVKEAEAALKSARGAEKEKAQKKYDRLKEQLKKLKISRTDKDENKQIALGTSKLNYIDPRITVAWCKKFEVPLEKVFTKTHREKFRWAIDMTNSSDEEYVF

SEQ ID NO: 5294 - protein, 722 aa, Caenorhabditis elegans
MDGSQGSTDYGDHVVLRYGGTREMVPLIRHEQMLDMLMERARQIVQGFGNLDTRNMYLFRHEYNSPTLLYPITSASQITSGSILEIILVDRTEAAVIPHVVEPESYMRPTFCDFCGEMLTGLMRQGVKCKNCNGNFHKRCSNAARNNCGAPGAPGAQPSRPPILPPIPTTPTGFPVAALSTPTGLPHTLIEHSYRQFTVCKVCDHLLVGLVKQGLKCRDCGVNVHRKCAMELASNCVLSENAISRVNFTDPEGPGSSSSDNIPLFRLPGQVGTRATEKKKLEGWMMHFILSDPERRLKHYWMMQSNAIHLYNEYSEGIGVNPNRVYRIIPLAEITSVVQNNGKSVLAKHPPHCFEIRTTTNTVFCVGEDYHAFSGGPPKKIPRSMSVRPSSNTTMWFQFIKESLQPPSRNEDNAEQALEFANLYQVLSDKTLGSGQFGTVYSAIQRHSGKEVAVKVISKERFSKKGSGAESMRAEVAILQQTCHPGIVCLEFMCETKDKIFVVMEKMNGDMLEMILSQELGRLNSRATKFLLVQILCALKYLHDQGIAHCDLKPENVLLSDMGSNFPQTKICDFGYARFIPESQFRKTVVGTPAYLPPEVLQRKGYNKSLDMWSVGVIIYVTLSGTFPFNEGEEISEQIQNASFMFPTEPWSEVEPLAVDLIQKLLKVEIEARMSIEQCLDHGWLKGEQLYRDLRDLEVRLNTPRYLTSPQDDILYGTLVNP

SEQ ID NO: 5295 - protein, 462 aa, Caenorhabditis elegans
MSIKRLSMRLKKGIHRSWNRMTSLEAGLEEEKEIKIVEEPEPRPWKVLITGGAGHLAENLVAKLEEMTRDSIRPKIREMLEKEMPAVISTKVDKEVEKRLPMYIQIVLVDVLEPRGRVLKHHVAFVKCSFDDECTMKTALEQVDTVYHLAAVGMTGQYARDRKACMDINAVGTMNLLIWARNSGVQRFIYTSSVGVVFSGEPMYNATEEVGYPDDFYNYYCESKAHAERIVQKASGHRMRTTVLRFNGIYGPGEKRVTERVVKFMLTGMWIATCKPNGVEAQTQLSSVANCIQGLVKAELALRWSDTPHGQIYNIMDKTPVGTFSFWTPLNIALGFSSSMITVPATPIRLFAYLSQIIADRMRIDPIVSVLEVDLLLVNNTFNIEKAERDLGYEPSVSAIPEIIEHYLHRLPPDVVRPKGRSDFYVKVAVLVLGTILIFVAVFSFTFWMYLIFQRLSRWNPF

SEQ ID NO: 5296 - protein, 368 aa, Caenorhabditis elegans
MSATSATNFAVQTHPVKAPDEEYFFEGAEKLLELWFCSSTQNETRSLRIIPREEIDAMLDIARCKILHSKHNESIDSYVLSESSLFISDNRVILKTCGTTRLLAALPVIMQLAGAYAGLDQVQSVYYSRKNFLRPDLQPSLHKNFDAEVEYLDSFFVDGHAYCLGSLKQDRWYLYTFHREVEFPAHKQPDHTLEILMSDLDEEVLHKFTKDYAVDGNDCFMRAGIDKIIPAGADVHDELFDPCGYSMNAYMNDTDQYATIHVTPEKAFSFASFETNQDLVCLYSQTRKVLQCFRPNKILMTVFANDISEKGKDAQQQLWDRELPGYRRTNVQFVRLETETLVYAHFVRKASTGQDSSSSDEDDGERSD

SEQ ID NO: 5297 - protein, 368 aa, Caenorhabditis elegans; identical to SEQ ID NO: 5296

SEQ ID NO: 5298 - protein, 374 aa, Caenorhabditis elegans
MPCQNFDYSYNFNNNSGEDYRKKIAIVGGGNWGSAIACVVGKTVKAQDEVFQPIVSIWCRDSRKPGDLSPSIAETINSTHENPKYLPGRRIPDNVVATSSLLEACQSAHILILVVPHQGIPQICDELRGKLQKGAHAISLTKGISSSCENGEIKMQLISEDIERALGVQCSVLMGANLAGEVADGKFCEATIGCKSLKNGEELKKVFDTPNFRIRVTTDYEAVELCGALKNIVACAAGFADGLGWAYNVKSAIIRLGLLETKKFVEHFYPSSVGHTYFESCGVADLITTCYGGRNRKVAEAFIKSDKPLRVIEQELLKGQSAQGPPTAQDVYEMLEINEISEKFPIFASVHKVFTGHHGEQELYDSLRNHPEYD

SEQ ID NO: 5299 - protein, 496 aa, Caenorhabditis elegans
MGSCIGKEDPPPGATSPVHTSSTLGRESLPSHPRIPSIGPIAASSSGNTIDKNQNISQSANFVALFQYDARTDDDLSFKKDDILEILNDTQGDWWFARHKATGRTGYIPSNYVAREKSIESQPIFFSFVTFQKLSKKKQTHQIPSFLKFEDCIRENDSVKHYRIRQLDHGGYFIARRRPFATLHDLIAHYQREADGLCVNLGAPCAKSEAPQTTTFTYDDQWEVDRRSVRLIRQIGAGQFGEVWEGRWNVNVPVAVKKLKAGTADPTDFLAEAQIMKKLRHPKLLSLYAVCTRDEPILIVTELMQENLLTFLQRRGRQCQMPQLVEISAQVAAGMAYLEEMNFIHRDLAARNILINNSLSVKIADFGLARILMKENEYEARTGARFPIKWTAPEAANYNRFTTKSDVWSFGILLTEIVTFGRLPYPGMTNAEVLQQVDAGYRMPCPAGCPVTLYDIMQQCWRSDPDKRPTFETLQWKLEDLFNLDSSEYKEASINF

SEQ ID NO: 5300 - protein, 284 aa, Caenorhabditis elegans
MWGETFDDFENDEGEMAMAKQNLIAEPARADFTFAKLPLGIQPVDFMKTHFAETAGKSMQFRKGTTTLAFVYEPATPADKGGIIVAVDSRASSGEYISSKSVMKILDIGDRMVATMAGGAADCQFWTRIVAKYCTLYELREKTSITVSAASKYFANTLYGYRGQGLSVGSMVAGYDKKGPQIFKVDSEGDRCQLKVCSVGSGSLNAYGILDNHYKPKMTDDEARKLGLRAIMHATYRDSGSGGVCNLCHITPTEKIRLPPMDVSKLWYEFADELGRDITYNPVE

SEQ ID NO: 5301 - protein, 678 aa, Caenorhabditis elegans
MLLHSTNSYSIFTDHEVETRTSRIRSAMFPDWIPPTSAAEATNSTTSIVEMMQMPTQQLKQSVMDLLTYEGSNDMSGLSLPDLVKLMCDHDESVVARAVHRAYMLSREDPNFFNAPGFDHRSFVEALMAASKSSNVNVRRNAIGALSHMSEQRGGPLLIFRSGGLAEIIRMLYDSLESVVHYAVTTLRNLLMHVSDSRAQARALNAVEALTPHLHKTNPKLLAQVADGLYFLLIDDAPSKITFLSLLGPQILVSILREYSDHRKLIYTVVRCIRSLSVCPSNKPALISLGCLPALYVELCTAKDERSQTAILVAMRNLSDSATNEENLTQLIIKLLEIIRVANDGMTACACGTLSNLTCNNTRNKQTVCSHGGIDALVTAIRRLPEVEEVTEPALCALRHCTARHSLAEEAQSELRFCQAFPVILDQLETLRTPVIKAALGVIRNSALLQTNLIELTQEQTANGHTAVSLTMDILRRAITAIEENPDIAVDGVPMWGVIEGAVSALHQLANHPAVAAACCDDIGQVGNPECPPFLDLLHRLLAHPRLGSMDDEVLEREILGLLYQLSKRPDGARAVESTGVSALLMESRGSQYKSVVTYANGVLSNLKRGDSAAIMNMSNSYDYEMSGSAADWQRDGLERELFAEMYPTNDGGHSESINMALNNSQMRPNHNWYDTDL

SEQ ID NO: 5302 - protein, 328 aa, Caenorhabditis elegans
MSKSICKSSMRAAVVRRFGAPDVIEAVESDMPRLEKNQVLVRNYAAGVNPVDTYIRAGQYGKLPNLPYVPGKDGAGFVELVGESVKNVKVGDRVWYGSEADSTAEYVAVNRPFELPEGVSFEEGASLGVPYLTAYRALFHLAGAKTGDVILVHGASGGVGSALMQLAAWRNIEAVGTAGSADGIRFVKSLGARNVYNHSDKQYVSKMKNDYPGGFNHIFEMAAHTNLNTDLGLLAPRGRVAVIGNRAETTINARQLMVTEGAVYGVALGMSSEAELLDFGINIVSFLKETEFRPLINKLYRLEQLGLAHEEIMNNKGAKGNLVVQIEH

SEQ ID NO: 5303 - protein, 139 aa, Caenorhabditis elegans
MVDVPRNFRLLEELEEGQKGKGDGNISWGLEDDSDMTLTRWTASIIGPPRTPYESRIYNLQIQCGGNYPREPPTVRFTTKVHMVGVNQSNGVIDKRNLTTLRNWSNSYMIKTVLEDIRKNMMMAKENLKLQQPAEGAMF

SEQ ID NO: 5304 - protein, 712 aa, Caenorhabditis elegans
MRRILTLLLLFNVVRSSEAITGGVVNLRPKQIINSVGIGDRFGGIGTSSDESDHFKLLAADGDSLLVGARNAVYNLSLSTLSVNHKIDWKPPAEHIEECIMKGKSKTDCQNYIRVLARKSAGVSLVCGTHAFSPKCREYTVTEFGIRNTRQFDGQGISPYDPKHNSSALYVPGTNQLFVATVTDFVGNDALIYRKTIDETPSSKSAANIRTQSYDARVLNAPNFVATFAYKEHVYFWFREIASEAIDNNEEPQIYARVARVCKNDKGGARPANERWTSYLKARLNCSLPSGSSPFYFNELKAVSDPIDAGNNNHVVYTVFSTPDSDVRMSAVCKFSMKKIREEFDNGTFKHQNNAQSMWMAFNRNEVPKPRPGSCSPDSTKLPENTVSFILHHPLLHRPIPSVAAPLLVEGADRADLTQITVLPRVRAVGGHNYDILFIGTSDGKVLKVVEVDGNATVIQSATVFQRGVPIVNLLTTKESVVIVSADEIASLPVHNCAQQTSCSKCVQLQDPHCAWDSSIARCVHGGSWTGDQFIQNMVFGQSEQCPEGIIVREVFDDNESEAQPEAVSRSGYPKEHSTITVVLVAAVASLISLIIGAFIGIRVNRWAATSEPHRSASSTSGSDYDSFGRARLTRHDSLTTATKVDHGFVPQSKQSVDATSLVMSINATHHPMSMSQHGSGINTPSRDKNAIVTSINQNTLPRDYKVKKVYL

SEQ ID NO: 5305 - protein, 152 aa, Caenorhabditis elegans
MSDAATRRLMKELAQLKSEAPEGLLVDNTSTSNDLKQWKIGVVGAEGTLYAGEVFMLQFTFGPQYPFNSPEVMFVGETIPAHPHIYSNGHICLSILSDDWTPALSVQSVCLSILSMLSSSKEKKHPIDDAIYVRTCSKNPSKTRWWFHDDSV

SEQ ID NO: 5306 - protein, 604 aa, Caenorhabditis elegans
MKLIFLLLLFGVSPIVCQDFEDGVFLAKITSIDEHDARKIGRRFGFEAQWKLQSYTDVYVGRRLRRRKRGIEDEIVAEMMLSQQVQFIEKLQGFRRYKRAPMTNKGYPVHVWNLTPSLYIREAWEDGFNASRVTVAVVDDGVDIKHVDLKSAFSPRVSFDFVRFGDLPTPKNSKEFEHGTQCAGLVAMEGQQCGLGVGHGATLGAIKLLGQDFLNDALEGDALAFQKDLIDIYSVSWGPKDDGKSAEKPAKFTEEAIKNGALHGRNGKGNIFVWASGNGGVNGDNCAYDGYVSNEYTLSFGVIDASGAPAAYGEGCSSVLAAVSGGDAMIQTTGLESTCSSISGSSASAAIASGIISLVLDAKNPTTKKNERNRKNLVFLQIESANLLGKNFQKGTILSQTANQQTDNFSNLSTKKFAERQLPPTHDSYDPTLSQRDIQHLIARTSNASAIRDVELYENSAGLNFHPKVGFGLLNAQKLVVMAATWENVAPQVTCEKMNLANGIIDNSDCDVTKVERVIVSGSIIHPHRGQVQIRLESPRGTISELLPLRPKDTSRDLLDWNFVSVNFFGENSRGIWKLHVTSEEDDVDFRVEMKMFKVVGTMS

SEQ ID NO: 5307 - protein, 1963 aa, Caenorhabditis elegans
MEHEKDPGWQYLRRTREQVLEDQSKPYDSKKNVWIPDPEEGYLAGEITATKGDQVTIVTARGNEVTLKKELVQEMNPPKFEKTEDMSNLSFLNDASVLHNLRSRYAAMLIYTYSGLFCVVINPYKRLPIYTDSCARMFMGKRKTEMPPHLFAVSDEAYRNMLQDHENQSMLITGESGAGKTENTKKVICYFAAVGASQQEGGAEVDPNKKKVTLEDQIVQTNPVLEAFGNAKTVRNNNSSRFGKFIRIHFNKHGRLASCDIEHYLLEKSRVIRQAPGERCYHIFYQIYSDFRPELKKELLLDLPIKDYWFVAQAELIIDGIDDVEEFQLTDEAFDILNFSAVEKQDCYRLMSAHMHMGNMKFKQRPREEQAEPDGTDEAEKASNMYGIGCEEFLKALTKPRVKVGTEWVSKGQNCEQVNWAVGAMAKGLYSRVFNWLVKKCNLTLDQKGIDRDYFIGVLDIAGFEIFDFNSFEQLWINFVNEKLQQFFNHHMFVLEQEEYAREGIQWVFIDFGLDLQACIELIEKPLGIISMLDEECIVPKATDLTLASKLVDQHLGKHPNFEKPKPPKGKQGEAHFAMRHYAGTVRYNCLNWLEKNKDPLNDTVVSAMKQSKGNDLLVEIWQDYTTQEEAAAKAKEGGGGGKKKGKSGSFMTVSMLYRESLNNLMTMLNKTHPHFIRCIIPNEKKQSGMIDAALVLNQLTCNGVLEGIRICRKGFPNRTLHPDFVQRYAILAAKEAKSDDDKKKCAEAIMSKLVNDGSLSEEMFRIGLTKVFFKAGVLAHLEDIRDEKLATILTGFQSQIRWHLGLKDRKRRMEQRAGLLIVQRNVRSWCTLRTWEWFKLYGKVKPMLKAGKEAEELEKINDKVKALEDSLAKEEKLRKELEESSAKLVEEKTSLFTNLESTKTQLSDAEERLAKLEAQQKDASKQLSELNDQLADNEDRTADVQRAKKKIEAEVEALKKQIQDLEMSLRKAESEKQSKDHQIRSLQDEMQQQDEAIAKLNKEKKHQEEINRKLMEDLQSEEDKGNHQNKVKAKLEQTLDDLEDSLEREKRARADLDKQKRKVEGELKIAQENIDESGRQRHDLENNLKKKESELHSVSSRLEDEQALVSKLQRQIKDGQSRISELEEELENERQSRSKADRAKSDLQRELEELGEKLDEQGGATAAQVEVNKKREAELAKLRRDLEEANMNHENQLGGLRKKHTDAVAELTDQLDQLNKAKAKVEKDKAQAVRDAEDLAAQLDQETSGKLNNEKLAKQFELQLTELQSKADEQSRQLQDFTSLKGRLHSENGDLVRQLEDAESQVNQLTRLKSQLTSQLEEARRTADEEARERQTVAAQAKNYQHEAEQLQESLEEEIEGKNEILRQLSKANADIQQWKARFEGEGLLKADELEDAKRRQAQKINELQEALDAANSKNASLEKTKSRLVGDLDDAQVDVERANGVASALEKKQKGFDKIIDEWRKKTDDLAAELDGAQRDLRNTSTDLFKAKNAQEELAEVVEGLRRENKSLSQEIKDLTDQLGEGGRSVHEMQKIIRRLEIEKEELQHALDEAEAALEAEESKVLRAQVEVSQIRSEIEKRIQEKEEEFENTRKNHARALESMQASLETEAKGKAELLRIKKKLEGDINELEIALDHANKANADAQKNLKRYQEQVRELQLQVEEEQRNGADTREQFFNAEKRATLLQSEKEELLVANEAAERARKQAEYEAADARDQANEANAQVSSLTSAKRKLEGEIQAIHADLDETLNEYKAAEERSKKAIADATRLAEELRQEQEHSQHVDRLRKGLEQQLKEIQVRLDEAEAAALKGGKKVIAKLEQRVRELESELDGEQRRFQDANKNLGRADRRVRELQFQVDEDKKNFERLQDLIDKLQQKLKTQKKQVEEAEELANLNLQKYKQLTHQLEDAEERADQAENSLSKMRSKSRASASVAPGLQSSASAAVIRSPSRARASDF

SEQ ID NO: 5308 - protein, 1963 aa, Caenorhabditis elegans; identical to SEQ ID NO: 5307

SEQ ID NO: 5309 - protein, 359 aa, Caenorhabditis elegans
MLKFLKPKSSDEGSSKDNKNSASLKEFLDKAREDFKQRWENPAQNTACLDDFDRIKTLGTGSFGRVMLVKHKQSGNYYAMKILDKQKVVKLKQVEHTLNEKRILQAIDFPFLVNMTFSFKDNSNLYMVLEFISGGEMFSHLRRIGRFSEPHSRFYAAQIVLAFEYLHSLDLIYRDLKPENLLIDSTGYLKITDFGFAKRVKGRTWTLCGTPEYLAPEIILSKGYNKAVDWWALGVLIYEMAAGYPPFFADQPIQIYEKIVSGKVKFPSHFSNELKDLLKNLLQVDLTKRYGNLKNGVADIKNHKWFGSTDWIAIYQKKIEAPFLPKCRGPGDASNFDDYEEEPLRISGTEKCAKEFAEF

SEQ ID NO: 5310 - protein, 375 aa, Caenorhabditis elegans
MLKFLKPKSSDEGSSKDNKNSASLKEFLDKAREDFKQRWENPAQNTACLDDFDRIKTLGTGSFGRVMLVKHKQSGNYYAMKILDKQKVVKLKQVEHTLNEKRILQAIDFPFLVNMTFSFKDNSNLYMVLEFISGGEMFSHLRRIGRFSEPHSRFYAAQIVLAFEYLHSLDLIYRDLKPENLLIDSTGYLKITDFGFAKRVKGRTWTLCGTPEYLAPEIILSKGYNKAVDWWALGVLIYEMAAGYPPFFADQPIQIYEKIVSGKVKFPSHFSNELKDLLKNLLQVDLTKRYGNLKNGVADIKNHKWFGSTDWIAIYQKKITPPSFSKGESNGRLFEALYPRVDGPADTRHFVEEVQEPTEFVIAATPQLEELFVEF

SEQ ID NO: 5311 - protein, 375 aa, Caenorhabditis elegans; identical to SEQ ID NO: 5310

SEQ ID NO: 5312 - protein, 359 aa, Caenorhabditis elegans; identical to SEQ ID NO: 5309

SEQ ID NO: 5313 - protein, 1519 aa, Caenorhabditis elegans
MRLLILNILFVVWQIHGVIGQSTNAAVVSTTAAPVKPATYMLVAPAVVRPDQPFSVCMNLLKQATDEDMIVRIEVRTERNETIAARVISNLKPGIAQTVSLSEMPAQSLTPRQSYKLYIRGETLNAELIFENENELKYDQKALSVFIQTDRAIYRPASLVRYRAIVVKSDLKPYVGNATIKIFDPSRNLISQTIGVTLDRGVYSGELQLAEETLLGDWFIEVETSNGVQDKSSFTVDTYVLPKFEVNIKTSSFITINDDLSVFVDAKYTYGKGVAGKAKVSLELPWHRWHAMVPTIIDENGVKKEEELMVERTVKLNRQGEAAVVFSNDELKRHKLLHEWGGGSIRIVASVTEDITEIERNATHQISTFREEVKLDVEKQGDTFKPGLTYNVVVALKQMDDTPVKATLPKRVQVSTFYNYPYNHDTSSLQEEKETKIVEVDAHGTSVLTLQPPINCTSARIEAHYDIGGKDNFTATPIYSSLYVEAAVSPTKSFLQLLADNEGAVDVGKSLSFSLKATQPLSTITYQVMSRSNIVVSQQMTVNSEHATISFPATANMAPKSRLIVYAIIESSQEVLVDALDFKVEGIFQNQVALSIDKQAVEPGQNVKFKVTSDKNSFVGLLVVDQSVLLLKTGNDITREKVEQDLENYDSNNVGGGFGGPRPWEAIDRKKRSIWRPWWGIGGSDAQSIFSNAGLVVLTDALLYREPQREFMSERRLNTPGGLTVMMMDGAPGMAEAAFAAPPMGGSSPPPPTVRKFFPHTWIWSDLNSTSGEVEMEIEAPDTITSWVASTFAINEENGLGVAPTTSKLRVFRPFFIQLNLPYAVRRGEKFALLVLVFNYMEKEQDVTVTLKYDKDSGYDLLKKDGTVVRRDEVGQQNVRIVSVAGGGTSKAVYFPIVPSSIGEIPVHISAIASQGGDAVEMNLRVDPQGYKVDRNIPFVIDLNNNSSDFSKNLELIWPNDVVDGSQKARLDVIGDMMGPVLNNAHKLVQMPYGCGEQNMLNLVPNILVVKYLRATNRNESQLETKAIKFIEQGIQRELTYKRADNSFSAFGDSDKAGSTWLTAFVVRSFHHAKQYAFVDPNVISRAVAFLNSQQMESGAFAERGEVHHKDMQGGAQDGGVALTAFVLISILENGMENGKAVTYLEKHLDEVSGNAYTMAVVAYALQLAKSKQAGKAFENLKKHKIVEKSGDVKFASAQKKVEKLKESRAYMFQARPVDIETTSYAVLSYLAQNQTSESLSIIRWLVSQRNELGGFTSTQDTVMALQALSSYAAVTYSDKHTSQVTILNGKHTHSFDINIRNAIVLQSYQLSSLNDAVSINANGTGVVFAQLSYSYYRDSLNDDAPFFCSQEIKEIRAGNRLQLDLCCNYTRPGKSNMALAEIDALSGYRFDAEQVHTLTSIEDLQRVEMEKDDTKMNVYFNPLGGRPVCLSLYSDVTYQVADQKPANFRLVDYYDPEEQLKMTYAAKQTRSLQEKCGEDCWPPISPSLPPFDESTVTGTSSGFGAKWCALIIAVLLIA

SEQ ID NO: 5314 - protein, 1508 aa, Caenorhabditis elegans
MRLLILNILFVVWQIHGVIGQSTNAAVVSTTAAPVKPATYMLVAPAVVRPDQPFSVCMNLLKQATDEDMIVRIEVRTERNETIAARVISNLKPGIAQTVSLSEMPAQSLTPRQSYKLYIRGETLNAELIFENENELKYDQKALSVFIQTDRAIYRPASLVRYRAIVVKSDLKPYVGNATIKIFDPSRNLISQTIGVTLDRGVYSGELQLAEETLLGDWFIEVETSNGVQDKSSFTVDTYVLPKFEVNIKTSSFITINDDLSVFVDAKYTYGKGVAGKAKVSLELPWHRWHAMVPTIIDENGVKKEEELMVERTVKLNRQGEAAVVFSNDELKRHKLLHEWGGGSIRIVASVTEDITEIERNATHQISTFREEVKLDVEKQGDTFKPGLTYNVVVALKQMDDTPVKATLPKRVQVSTFYNYPYNHDTSSLQEEKETKIVEVDAHGTSVLTLQPPINCTSARIEAHYDIGGKDNFTATPIYSSLYVEAAVSPTKSFLQLLADNEGAVDVGKSLSFSLKATQPLSTITYQVMSRSNIVVSQQMTVNSEHATISFPATANMAPKSRLIVYAIIESSQEVLVDALDFKVEGIFQNQVALSIDKQAVEPGQNVKFKVTSDKNSFVGLLVVDQSVLLLKTGNDITREKVEQDLENYDSNNVGGGFGGPRPWEAIDRKKRSIWRPWWGIGGSDAQSIFSNAGLVVLTDALLYREPQREFMSVMMMDGAPGMAEAAFAAPPMGGSSPPPPTVRKFFPHTWIWSDLNSTSGEVEMEIEAPDTITSWVASTFAINEENGLGVAPTTSKLRVFRPFFIQLNLPYAVRRGEKFALLVLVFNYMEKEQDVTVTLKYDKDSGYDLLKKDGTVVRRDEVGQQNVRIVSVAGGGTSKAVYFPIVPSSIGEIPVHISAIASQGGDAVEMNLRVDPQGYKVDRNIPFVIDLNNNSSDFSKNLELIWPNDVVDGSQKARLDVIGDMMGPVLNNAHKLVQMPYGCGEQNMLNLVPNILVVKYLRATNRNESQLETKAIKFIEQGIQRELTYKRADNSFSAFGDSDKAGSTWLTAFVVRSFHHAKQYAFVDPNVISRAVAFLNSQQMESGAFAERGEVHHKDMQGGAQDGGVALTAFVLISILENGMENGKAVTYLEKHLDEVSGNAYTMAVVAYALQLAKSKQAGKAFENLKKHKIVEKSGDVKFASAQKKVEKLKESRAYMFQARPVDIETTSYAVLSYLAQNQTSESLSIIRWLVSQRNELGGFTSTQDTVMALQALSSYAAVTYSDKHTSQVTILNGKHTHSFDINIRNAIVLQSYQLSSLNDAVSINANGTGVVFAQLSYSYYRDSLNDDAPFFCSQEIKEIRAGNRLQLDLCCNYTRPGKSNMALAEIDALSGYRFDAEQVHTLTSIEDLQRVEMEKDDTKMNVYFNPLGGRPVCLSLYSDVTYQVADQKPANFRLVDYYDPEEQLKMTYAAKQTRSLQEKCGEDCWPPISPSLPPFDESTVTGTSSGFGAKWCALIIAVLLIA

SEQ ID NO: 5315 - protein, 983 aa, Caenorhabditis elegans
MSSSDAFWRMFANKNKGKSNTRSAFQVVKEEQPSTSTEPDDKKPLHHEIAGEMIKNPAKGKRKRVQIKNDEYEQLMMLGVPVRVPRGLSLYSTQKLMIVRILTALKNSQNVLGESPTGSGKTMALLASTCAWLKQYIDEKRESKEKCEIHGFSGKTQVVFTNDIGIPLESKVYEEPPEEEEFIEPVPVKNDKLFEAQWEHDFTPHTPGETPPVTLKEELEPVKKPEPVETKCTCLPRVRIYYGTRTHKQIAQVVKEFSRLPYAKILKHTILASREQSCINPAARKHADISQYCKEVNSAHSIGCSFKSAMKPRFEKALPLRDHLERNGTVVFDMEKIVETLAISYPQLCPYFSTNRILTQDADIIFCPFSYLVDPLIRNSSDVQIRNSIVILDEAHNIEDTCREAASFSFTEKELDDSILSLRIKRKAVDTELDKTGIEEKLLHIPDREVHLKEFRGHLLYLEHLILEMLRWIRQVSTEAKTPARGGQDGVKTCTISSANLFTSLTDPENGVDLFTPPLTPKHAAVAASFSAITKHNEPEMQYFDAFKPSSTAIVCIEKWLYFQSYFGNQQYQSTYRLNISIEPINQNGRFNHTFDADVSMSTSFGNPRPTTTRSSAGPRNMQYKEENAWLADAAADGDDWKDPSMSETGHKPISEGCKTTISLWCMSPALSFFDAFNETRSIVLASGTLCPMDTLKTELGMEFKQQVEGDQVINKDNIFAAVLPIGPFGNRIQCTYRNTSDPESSFYCELGAIIKYVCSNVPAGILCFLPSYRVLDQLKQCMIRNSTMRQIEMKKVVLYEPRRSSELTSVMDQFDAAIFDPSRFGANINGSLMFAVFRGKVSEGIDFADDRARVVISVGIPYPNAMDDQVNAKKLYNDQNSKEKGILTGDEWYTTQAYRALNQALGRCLRHKNDWGAMLMIDERLERQTGNLVGGASSARVSKWIRAQLKSYPSFKEFNANFREFIQRRHAVEKAKKENFCE

SEQ ID NO: 5316 - protein, 583 aa, Caenorhabditis elegans
MKVHQIADVLFRKKTFDGGSHLESQMKRCLTILDVMFIAIGHMIGAGIYVLTGSVVRNQAGPAIILSFIFSGFAALLSAFSYAEFGARFPRAGSAYTYSYVGMGEIWAFIVGWTVPLEYMIGNAAVARSWSAYFDNLVSKSVSNWTLDTVGRLSDGKGFFALYPDFLAFFLLFLVAVAVAMGSKFSANVNTSFVFLNLAVLAFVIICGLTYADFSLWSGTYQDGRSKFFPYGIQGAISGASTCFFAFIGFEALATAGEEAKNPHRTIPLATFTSLAIISVIYVLMGASLTLMIPYDLVDPDAAFAAAFEMKGATVAKIIMSVGALAGMLNNLVTGSFALPRAVYAMADDGLIFGWFGVINSKTKTPLNATIVFTIINAILALVFDLQALVDFLSIGTLLAYSMVSICVIILRHQSHLVDGSATDYDNGGCLKSWVPFQGVWENFSEGISIRVAVAGLIFGYICLAIPFRTGIFSNAGGIILLTVGAAFSLLSFVFILGHEQNKSTSTYKVPLVPFIPCLGLLINVFMMVYLNSMTWIRLFVWLAIGIVIYICYGIRHSKEGQKLSKIDVHNEIMSRTSDTKVH

SEQ ID NO: 5317 - protein, 398 aa, Caenorhabditis elegans
MVEPTGPAIVEDERTKALNSYRRKLAECRDIEQKLKDLRKKESEMTKQFDKSENDIKSLQSVGQIVGEVLKQLSEEKFIVKATNGPRYVVGCRRSINKEELKQGTRVSLDMTTLTIMRQLPREVDPLVYKMSHEDPGNISYSDVGGLAEQIRELREVVELPLINPELFKRVGITPPKGCLLFGPPGTGKTLLARAVASQLDCNFLKVVSSAIVDKYIGESARMIREMFNYARDHQPCIVFMDEIDAIGGRRFSEGTSADREIQRTLMELLNQLDGFDSLGKVKVIMATNRPDTLDPALLRPGRLDRKIEIGLPNEQSRLEILKIHSNKITKHGEIDFEAVVKLSDGFSAADLRNVCTEAGMFAIRAEREFVIDEDFMKAVRKVGDAKRLETKLDYKPV

SEQ ID NO: 5318 - protein, 589 aa, Caenorhabditis elegans
MCFSALRERVFRLKNLPAGEIATPLRRCLSTFDITLLGVGHMIGAGIYVLTGSVVRNTAGPSIILSFLLAGFASLLSALCYAEFGARFPKAGSAYTYTYVGVGELWAFVIGWNIILEHMLGAAAVARSWSGYLDSLLGNVISNSTIARTGHLHEASSFFGDYPDLLAFLLIVLVAFFVALGSKVSTNFNSFLTILNIGIVVIVVFYGITFADFSLWSGVDEKGNSRFFPYGVSGMFAGAASCFFAYIGFDGLATAGEEAKDPARSIPIATFSSMTIVTLSYVLMSASLTLMIPYNMVHPTAAFSDAFTMRGAEFASYAVSVGALFGMTTSLVGGMFALPRCVFSMADDGLLFSSLASVNPKTQVPTQALLIFGFLTAIIALLFDITTLVEFLSIGTLLAYSIVSACVIVLRYQPAYNVDEGQFDNGGKLRFSIPFCGFLDKLQPGHSIYYGMSVMIASMFFSGLGFSSGYLYGTVLCQIFLLVNIALIILSFLFICAHYPNNTPLDFKVPLVPLIPALSLLINTLMMVHLAWITWLRLVVWMSIGFVIYFGYGIHHSKEEVQDAEKFSKSSTYESVVSGVVAGAGTTSP

SEQ ID NO: 5319 - protein, 418 aa, Caenorhabditis elegans
MSQCTVEYNVSEITEYVLSTLGERCQSAGIVIPTVIIYGTIFLLGLFGNICTCIVIAANKSMHNPTNYYLFSLAVSDIIALILGLPMEFYQSLDYSYPYRFSEGICKARAFLIEFTSYASIMIICCFSFERWLAICHPLRSKIFSTLWRANVLIILAWTISFVCALPIAFIVQINKLPLPEDAKYQPWTNKVSFFAVGVLNNRIFPVSTDGIFVLHTEFCAMNQSRPDQQKMIIIFAFTVFFVIPAIAIVIMYAHIAVQLESSEIDLKGDKMVKKRRNKSNRTVLKMLLSVVITFFICWLPFHIQRLLSVYTTWSETTTISPPVQFLSMIVFYISGFCYYSNSAANPILYNILSQKYRSAFCRTILGDHIANFVFKGHQRPGQSKRCSSSTEAEQRTLMTRGSVRVDKPHRKLEVHNY

SEQ ID NO: 5320 - protein, 404 aa, Caenorhabditis elegans
MSSAKVQICHVETRGNEASHDVLLACKATKNQLIHSAELLTQNHVALTKFSIFAKKLSDEKNQSQIWFPRHISELDQCSKCITKYEPTTDPRHPGHGDVAYIARRKFLNDQALEFKFGDEIGYVDYTEEEHATWKAVYEKLGDLHLSHTCAVYRQNLKILQEEKVLTADRIPQIRDVNKFLQKKTGFELRPCSGLLSARDFLASLAFRVFQTTTYLRHHKSPHHSPEPDLIHELLGHVPMFSDPLLAQMSQDIGLMSLGASDEHIEKLSTVYWFIVEFGLCKEDGKLKAIGAGLLSAYGELMHACSDAPEHKDFDPAVTAVQKYEDDDYQPLYFVADSIHDALAKLRKYASSMDRPFSVVYDPFTKSIEAIESSADLEKAFSRLSNDLSAITHAADRMKISITM

SEQ ID NO: 5321 - protein, 323 aa, Caenorhabditis elegans
MSNEGGVPNVVKFAFGGTAGMGATLVVQPLDLVKNRMQLSGTTGKKEYRSSMHALTSIMKNEGVFAVYNGLSAGLLRQATYTTTRLGTYAFLLERFTEKDKPLSFGMKAVLGMTAGGIGSFVGTPAEIALIRMTGDGRLPVEQRRNYTGVVNALTRITKEEGVLTLWRGCTPTVLRAMVVNAAQLATYSQAKQALLASGKVQDGIFCHFLASMISGLATTIASMPVDIAKTRIQSMKVIDGKPEYKNAFDVWGKVIKNEGIFALWKGFTPYYMRLGPHTVLTFIILEQMNAAYFQYVLKRDVTSALLCCVHFSDFKFWPEILF

SEQ ID NO: 5322 - protein, 160 aa, Caenorhabditis elegans
MFLFPLVLGFLLPETLNTFVLEIQFMTRCMTHHDAWIYNGYGCYCGIGGSGDILDDIDECCANHDKCYEDLDLKKTCWTTPFEYFPIYSWKCQNQTIHCDTLSEASDHPVLAHECSNQLCECDRKLVECWAKYPEPTGQLKCPHPRLSRFLLKLQKKMLS

SEQ ID NO: 5323 - protein, 476 aa, Caenorhabditis elegans
MQDAVVFSKKSSITSGGKKEESMRGEKPRDLPLSPSPSQSPILVRLHVLGVVLLREHPPLLFLLLLLLRNNTRIWNLRVAIAALLLIWLANVAISSNTPVCKNGFTLINNKCLRLFYEEVIHRDAELSCRNYGATLVTVKNAQDNQDVATIAGSAKLIWLGLSCFEDSFGKCFWDDASGSANSYNSFSGGYPNVQVGQCVYYSTQGVLAGKWISEDCERYRMPYICELPTTYQDSCSYNYNGYCYTFSSTAVPFVTAQKICELSCGNLVSIHSPNELQYIVNFAPFVDDGYFIGATWKNNYSLSWLDDSPWDYDRIDPSFSVKVGYCFTIYTGVGSKITGSWYSVDNWEIPNQYICKIPAGVPCSPAPPVTPTPNLSNCNGPRMMYSGVFTSPNYPNNYDNNEDCTYLISTLGPYGIFLFIAPFSTEHKYDVVTIYDGPTTSHKVLAHLSGEIGISMMTSSGNSLLREILLYSIDK

SEQ ID NO: 5324 - protein, 653 aa, Caenorhabditis elegans
MAPDEVTKKKRKSVKFAEEEPPKVKEAPKKQKAGKKIEVSVELRDKNEEKMGRKRKHRMKKSQAEKRQKLMESLVGPQVDEMDFEPEHKTFADFGLDERILKSIGELGWEKANQVQESVISLALENKNIMGRARTGSGKTGAFLIPLVQKLIAESKTNDGSVGPSAVIIAPTKELITQIYKLFVKLSQALPFLQAINLCDINEEENSVWLEDRSHVVVTTPGKLLRMCSLRPEYCTLVSYLVMDEADLLLSFGYEEEMIKIRSKLPPTYQCLMTSATLKDDMTTLKKLFMTGPVITIKLTEGDLPNSDQLTQYQLTCGSDEERFAILVAMFKLKLIVGRSILFVNTIDRCYKLMLILRVFGLKSCILNSAMPANSRCHPKKSIFYMKNRILGSKNAVNSKKNCFGSYQIVIASDVSDADGSKLKEEIAGKSDEKPEKDEKKGKKASKLDKESGVSRGIDFHHVSNVVNFDFPETTDAYIHRVGRTARGFNKGTALSFCIPSERAHLEQIQEEINQQMGRKVLQPYEFRIKELDTFLLRTREALSKCTKGVIKKARLKEIRQELMRSANLQTFFAKNEREKLLMQTDCHPVMLKINSPAIADVTSYMVPEALRGMDFSAPGAKNRRYNMGQKHRQKLKHKFQKKGKDPLKTFKI

SEQ ID NO: 5325 - protein, 473 aa, Caenorhabditis elegans
MTESPQISVSFVSEDENELGGSGILVPVDISTNELQILCNQLLGSSDDPVPISFFTTEGAEIVDSIRKSLEEIDFETTLKLVYQPQAVFRVRPVTRCSASIPGHGEPVISAQFSPDGRGLASGSGDQTMRIWDIELELPLHTCKSHKSWVLCIAWSPDATKIASACKNGEICIWNAKTGEQIGKTLKRHKQWITSLAWQPMHKDPTCRLLASCGKDGNIFIWDTVQGTVVRCLSGHTASVTCLRWGGEGLIYSGSQDRTVKMWRADDGVMCRNMTGHAHWINTLALNTDYALRTSCFEPSKRCIKPDTVEECQKVAQTRYEAALEIAGGERLVSGSDDFTLFMWNPKETKQSINRMTGHMQLVNQVVFSPDTRYIASASFDKSVKLWCGRTGKYLASLRGHVGPVYQVAWSADSRLLVSGSADSTLKVFELKTKSLYYDLPGHGDEVFTVDWSPEGTKVVSGGKDKVLKLWRQ

SEQ ID NO: 5326 - protein, 449 aa, Caenorhabditis elegans
MSVSSYDTARGNELLPLRGSHQPTMGEMFASRVRDSRSITADQALIHMIKVMMGTGMLSLPLAFKHSGIWLGLILLCFICLICIYCTRQLIFGQHYITFIKREQRMDYANVMRSAVELGPAWIRGHGYLFKQMVNINMFVAQFGFCCVYFVFMADNLKQFFDQTSSIHISQAGWIALLLIPISALCTIRELKALAPLAAVANFVYIIAVVIVLADLFSDWQPLDSLPAFGAVENLPLFFGTVMFAFEGVAVVLPIENQMNEPIHFITPNGVLNTSCILVLLVYMTVGFFGFLRYGNDIKDTLTLNLPQTPFYQAIKVMFVLCILVSYPLQFYVPMERVEKWIKRKVVEAKQEPMIYAIRFGGVLLTCAMAQLIPHLALFISLVGSVAGTSLTLVFPPLIELLCSYSKQELTKWVWIRNIGLMAFAMVGFTTGTYASMVQIIEAFGKEDI

SEQ ID NO: 5327 - protein, 952 aa, Caenorhabditis elegans
MSSDTSTIFGAPSMTSYGGIVNEMYDGGGGDAEIPGENGKSPKKGAVPLIDEESQSTPRGSTSGDGGGGSPSMEFSSSRPGGLSTISGVFAPVALSMFSILLFLRMGFVVGQLGFLMTILQLAMAYAIVMLTVLSLCAISSNGAVEGGGVYYMISRSLGPEFGGAIGVLFFVANVFSCALYISGFTEALMNNIGNGQFPDSPAWRFVYCVLVSLVLLVLSLLGSALFAKTALITFVLISVCYGTWIVSVIFNGRMEVLIPKVNTPAYRVLVNASDPSQGTVEDFNQTLTANYTGWSFHTLGENMFPEYTMDYTTEKPTDFALMFAIIFSGVTGLMAGANMSGELARPSVSIPRGTVQAVFMTLFVYVMTAFLMATTSSRYLLQNDYTVMMDTNFHRVFILIGIFSTTLFSSMSNLIGSSRVLNRLSHDKLFGCLLRPAKIEIGDRNPVVSVVITWMCVVLVFLVGAMNKIAKLTSIFFLLSYMGVNVATLALELTSAPNFRPTFKYFSWQTCALGVVATATMMLVVDASMSALGVVVLMSLIMVLHYQAPSVSSGSISQALIYHQVRKYLLLLDVRKEHVKYWRPQILLLVSRPASACSLLDFVNDLKKSGLYLVGHVRKGEMDSSQVVDPLQQVFPYWLSLIDYLKLKAFVELTMSNNIRHGIQQLMRLSGLGAMKPNTVVIGFHELAPSQVTLQESQLLKDLRFSKIDRAAVVEYFTAGDYMPKELDGNLERLTPVDYVNVLKDVLHMTKNLCVARHFSKLDKEALARGWNGQKRYIDVWPVDLQKPQETGLGWDNSSLFLLQLSCILSMSSRWRSYTKLRVFICVNSLQDMHRRERQLKNMLQTLRIEGESSVVPWDHVVCHYQPPNATASANTATPSVDLPPAYVSAFNDMVKRYSEDAAITLLNLPVPPDNADIDADRYLEMVRNLTDALPPTLLVHGVSSVISTAL

SEQ ID NO: 5328 - protein, 381 aa, Caenorhabditis elegans
MAGSLQATLQQTEKSARGKSSRRTKIKQQRTAPEEKSIMAPDMEDFLVLEKTLRELKFYHGFLPREDLQTTLHNPGDYLIRVSEVVEGENKLVREIILSLMTVHMEGKQKKKRIHNVVIKRVSNKFLCEAARPFASVTDLITYYSKHTGHCSSGNFQLKHPILQQSWEFMHSDVTVGDVLGEGAFEKVCAGELRLKDGSSVEVAIKMTNASAFLSKMKIKEMMNEARFIRNFSHKNVVRLYGVAHDEQPLYILLELVKGGSLQDYMKKTKSVPLADRINFCLGAAKGLAYLHQNYCIHRDIAARNCLLHENEVKITDFGLSRAGPSYTTKTSCKLPVKWLAPETLATLSFSYATDVYRLVLSTISMINKYSSVSHLLRSLR

SEQ ID NO: 5329 - protein, 616 aa, Caenorhabditis elegans
MDAEIRKKNIPGNPNLYAGNYTLMAQSGSAAGKWVSADDFSQFRYISTTAAISTRAPATTPEAPGRCPAGSSSLNDITCVKLFDTPMIFQGANLVCRNISGGGNLVSIHSAEDNTALLNLAALNNKTKTIWLGLTCQSPSPSSCEWTDGSGTTSNYNNFTSGYPKPVRGPRGYMWALGSDIGKWFSSDEDYSTHSFFCEVPKSSNVSAAETPLILIFHFCYSVNTYLLSEPDAREFCLSLSEDLVSIHSQAENDFIQSLISNTVIDEFRTGAATDGVGKYWVDGSFFDYSNFGYFGTNLGKCSSLSMSGSVVSKGQWLSNDCSNKIPFICKHPKHFSTPAPYVSGQCNETQFLSGKGTFYSPNYSYGFSGYPNPCTYLITEPPGTIAQLRFAELHLPLGRTIVLYSGIDETKPLAIVTENTFEVYSSTTNVLRVVFNCNPDVSVRQHVSLLQSGSFAGKWVSNQNALLGYICQVPLPSSTVTIETITTTYIRSTTTTPRSPARCRDGFTSINNNATCVKFIAHKHYGTPIPCTYIIVAPQNSIPEIRFTDLIMDSSNLKMMLYGAIDDVGPFAILTNDDVYKYYSSYTNVLKVSFQCNPCNSDGYRYAADYRSDLD

SEQ ID NO: 5330 - protein, 723 aa, Caenorhabditis elegans
MLNQSVRFLARRANSQIRRSNLLKTGSLAAQDRGFFFGKRREPRCDLKNQSIVQADGSRKSAWLGDKPLRHESFIGILTTYAGIRRGPTVGGKEMLGKRVMKNGKLEWEWITYEQAFEISDNVSQAIRKLGIEIGDKSNIGIYSKNRPEWVLSDMAIHNFSNVSVPIYDNIPNEDMHYITNLCEIPLMFVDSEDKTTQLIKDKTYLSKSLKYIVQFDKVSDEMKAMAESNNFQLWSFDEFVELGKKHEHRPHAPPTPETLATISFTSGTTGRPKGAMLTHLNLCSTTVACEEFEHVEGELDSYLSYLPLAHVYERHCTLAHFKIGSNFHNFLNKFVEVFFFFKRISSKVTKIFRRIGFSRGDPALLVEDIQALAPRTFACVPRVLGKIYKSVMSQVQDKPVKKMILNSAIAYKLYHYKMTGKATRDTLVDKYILHKIQMILGPNIKQFLIPAAKTDNSSMRFARGAFGIEILELYGLTETSGPTTIQLVGDMLGSVGPPISCTSIKLVDIAELGYFVDENGGEVLVKGHNVTSGYYKDPKATASAFTEDGFMKTGDIGKFTPEGTLQLIDRRDNVLKLPQGEFVAPDLTESLYISSKFVQQICVHGNKEKPWLVAVVVPDPEYLASHANLEHNIEGKTYEELCKIPALAEDVLHALIKFFIWVFAIHLTPIAFSPQNGLTTPTHKNKRTAIAQFFKKQIVEMFDRIEKEEEGTELTTKIENAH

SEQ ID NO: 5331 - protein, 535 aa, Caenorhabditis elegans
MKIFIICLLHIYATFSVSQITSRAPYNTQTPSYSGCPDGFIVLNGYTCIQVSTTKKLFMDALSDCQSFPGGNLVSIHNSIDNKALAFSVTSSDPKWIGLICTETSSPCNWTDYSSDTSSYSNFVAGNPNLDVGNYVYMLVSGSSAGRWVSADQYTQLKYICEVPFHVPCPEGFWSYKDNTCLKLFNTPMLYQDASYVCGNFSKGSNMVSVLEAQDDFTLKLISGLNNLTRPIWLGLSCQYPSASSCSWTDGSGTTSNYNNFAPGNPNTDVGTRAYMLTSGNSAGKWISSDGDYSYYSFFCEVPRADSCEHTYNGFCYSVNTNLLDEPDARQVCQRVSGDLVSIHSQAENLFLQSLVNSTGVAEYRIGAATDGVGKYWVDGSTLAMSGSVIPKGQWLSTNCNNKIPFICKHPQNLPTPTPTALGQCNGTQFLTGNGSFYSPGYPDQASGYPTPCTYIITESQGSIAQLQFEVLHLFWGQNMQLFSGIDETQPFAIVDIYSNKIYNSTTNVLKVVFHCITSNYATYSWAANYGTNIS

SEQ ID NO: 5332 - protein, 250 aa, Caenorhabditis elegans
MKSKPSSYQSLKTVLKHVDFNLREKFPEKPANLRNTRNYIGLFLLTALTFYIIGALVQQRTQNYKNAKKPFLDWRDEGVVGPVKDQGNCNASYAFAAISAIESMYAIANGQLLSFSEQQIIDCLGGCAIESDPMMAMTYLERKGIETYTDYPFVGKKNEKCEYDSKKAYLILDDTYDMSDESLALVFIDERGPGLFTMNTPPSFFNYKSGIYNPTEEECKSTNEKRALTIVGYGNDKGQNYWIVKGSFGT

SEQ ID NO: 5333 - protein, 299 aa, Caenorhabditis elegans
MNNANNQPSRTDRKQVYVSVGRELPKRPCNCVTIRNYILFFCSIALIIALLLRHFMPYQPKTSETPRPPQYQTKLSHHMTQDFLDWREKGIVGPVKDQGKCNASYAFAAIAAIESMYAKANNGKLLSFSEQQIIDCANFTNPCQENLENVLSNRFLKENGVGTEADYPYVGKENVGKCEYDSSKMKLRPTYIDVYPNEEWARAHITTFGTGYFRMRSPPSFFHYKTGIYNPTKEECGNANEARSLAIVGYGKDGAEKYWIVKGSFGTSWGEHGYMKLARNVNACGMAESISIPIKYKLL

SEQ ID NO: 5334 - protein, 2054 aa, Caenorhabditis elegans
MVVNGQKPDIRTIVVSGNSLTNDAADQYESMEQFIHSHVADIEKRRPIKRLLVATNGIAAMRCLMTAKKFLHHTFRNDNLIHFVCMTTEDEIQSMSESLRMPNITLAESPSGTNKNNFANVDEILKHAIKYEVDAVWAGWGHASENPDLPRRLNDHNIAFIGPPASAMFSLGDKIASTIIAQTVGVPTVAWSGSGITMESIERSRGDFVVVPEDLLEQACVANYKEGLEALKTHNIGFPLMIKASEGGGGKGIRKCTKVEDFKSMFEEVAQEVQGSPIFLMKCVDGARHIEVQLLADRYENVISVYTRDCSIQRRCQKIIEEAPAIIASSHIRKSMQEDAVRLAKYVGYESAGTVEYLYLPASEGQEEHYYFLELNPRLQVEHPTTEMVSNISIPAIQLQIAMGLPLHKIKDIRKLYDLPIDGDSELPDEVLVDTKLHAIAARITCENPDDSFRPSTGKVYEINFPSSQDAWAYFSVGRGSSVHQFADSQFGHIFTRGTSRTEAMNTMCSTLKHMTIRSSFPTQVNYLVDLMHDADFINNAFNTQWLDKRIAMKIKQKCSLSMSVIIAVSAAVIGSSRVTGVFESFEESIDRGQVRPPNDLTETFIFDLVKDLNIYSLKVVRSAENTFVIILNGSKVTVGVKELQNGEFMVTHCEIVYRCAFEETKEAYKVTVNNEIITFEKDNDVSVLKSPYTGKLLQWKKEDGDWLNVGDVYATAESMKMVFQVEVAKAPGRLQRVVNEGDPIHPGSVLAKLVDQTESEADRAQPFHGTFLEWSWHSSKANEQSKFNDCLAQCQNLLAGSTPMDSACIITELFHHLNESHTAHASEVLNQLLRDYINVEKYFEGKVYDDSVGEIKEDHLSRKDVVRTIYSHTQIKSKNIVMKALLGALKQGSGSKFIPSLLDNLRQIGNLHHTEEISNLAREILLFYHSMCYKNNYSEITASGLRPTGQEVKAWLDGPLSRRPDSSGWKVIHEYFFDETIGSQCLDRYVAMHISAEEGSIGNTYPLPQMKCTIDHFTLTATPKSFNKVVLKGNKLIVVRLSLDSKTFNQQCFSSEKFLDCLKTNFRKYCKKTDVINVSIFVKITDDLEAHQDPSTLTEQEEQRVCYAQNAVVDMKTILEKEFRVNRVNTVLCLNDRPLPQLTIFEQVRLEKDRLPANSYPVLSKLSTVRVSQHDDPTSNFAKLFVRQQLIIPGNNAEEVQKKISQAVYLALDNACTAAQVAMAKKTKANKTFTSNHVFVFISCPGLPEKVIGSQEQLEFMKKCITDEVDSHKAILAKHQINEVEVVYESVDGHKRIVIRDETGVTTEVITEFSEASLGVYPVINTIEKKRLAARRVNSSYIYDFPIIFGMAAMNFWKSASSAMELPNEMAQALKEQRWREFFQIRELVLENGVLTEISDAEILKKRSANALNNCGMVAWIMTLYTPEKPRGFDLIVIGNDVTFQSGSFGTAEDDLFAAASTYSREHKLPRVNVSVNSGARIGLSTKISKLVKLQLENEDKPEQGFEYIYIDGEHKAQIEGEVVYEELGNGRLKILAVIGAKNEKIGVENLQGSGLIAGETARAYAEVPTYCYVTGRSVGIGAYTARLAHRIVQHKQSHLILTGYEALNTLLGKKVYTSNNQLGGPEVMFRNGVTHAVVDNDLEGIAKVIRWMSFLPTPTEEFPFFSKHGDDCSARDVVIPSDSEQNTYDVRDLIDSKNLSNQTGICDTMSFDEICGDWAKSIVAGRARLCGIPIGVVSSEFRNFSTIVPADPAIDGSQVQNTQRAGQVWYPDSAFKTAEAINDLNKENLPLMIIASLRGFSGGQKDMYDMVLKFGAQIVDALAVYNRPVIVYIPEAGELRGGAWAVLDSKIRPEFIHLVADEKSRGGILEPNAVVGIKFRKPMMMEMMKRSDPTYSKLSSSTEPEAREQLEERYEELSKTYRNASVEFADAHDRWQRMKSVGVVEHVTSLTNSRRLFSELLRNELAKVGMAEIYSSAPHTVKPCLATAMTWVETNLRSYVQPNSSMDEQYTQIEQYYETQFVDDLVIAINEDRKRYEQQLNTFMNKISSKRR

SEQ ID NO: 5335 - protein, 464 aa, Caenorhabditis elegans
MFNGKIHTSRKIARKKVSRGLSVNMQILPIFFPLLITSLHAIPRGRRAVRNRNEGDINSLVGVGQYLYQGDIAVVKSRARRAVIRQKHKKWKLPMPYSFDRNFREFLREKNRSNYTSRSRQRVLEAMQFWSEKTCVTFHENRYVYPHVSIFEGNGCWSFVGKQPSLREQSLSLERSCTDHTFVVAHEIAHTLGFYHEHARGDRDQFISIDYSNVNPNLTFAFAKESEKQLDHQEAAYEYGSVMHYSVDQFAVNTNRPVIYARDQKFAQAMGNRMRATFQDVSRMNVLYNCHERCANTLNRCQQGGYPAPSDCSQCVCPDGFGGNFCETIEAHSVGQKDNSDCGGVLWASETSQTFYGAVRTRVHSNSVLPTPEHCFWHIRASQGKSIEIQIKNIISPCSMSCSFNALELKLSNFTMTGPRFCCDEHIYNRYSQPKVFQSEGPLAVIGAYARYDYLDFNIEYRAV

SEQ ID NO: 5336 - protein, 662 aa, Caenorhabditis elegans
MTESSSEIPQKHTIGLITAISYTVGDIVGSGIFISPTSILNHAGSVGLSLCLWALCACISLFGALSYVELGTSIRKSGCDFAYLSHFGSTQTLNTLRQNAQILVICEKKCVELKFTLDFTQNSEKNFIIFFRKFMSFRLKKLRFLKSFTPIFLTFITQNVTKIAIISQFFHTKNATKSHRTHFSVITKNAKNPDFPKNIFRRPLASSFMWVSTCLSYPAVLAIQAISFGEYIVTEKKTKILKKKKFFSKFLNFLFKYTVSYFILKISFFKHLIIKFFQGLDSWITIDENWRFMTYRLVGFSMLWPLMLLNFFSLKKVAGAFQIVATAIKLIVASIIIITGLYHIIFKQQTQNFKNSFTGSDWNPGNLVLGVYSGLFAYNGWDVLNFGAEEIENPRRTLPIAAISGIAISATVFILMNVSYFSVLSVEDFKNSPAVAVVRTFFITFAERTLGDFHYAIPFLISLLLIGSMNTTIFACSRYMYSGAQQSVMPTPLRGIHHRTRSPRLAVFAEILIAICLSFIGNLDQLISYMSFALWSQRTCTQVGFIYFKLRGTLKTQDSFQVPIFVPVVFLGICIALLVIPITQNYHVAIYGVSMTIGGAIIYLIFIFPNTLPIFLHKINNSIVKFAQIIFNCVIEPYEDSTVEEFEEFEEINDYSKKFHRF

SEQ ID NO: 5337 - protein, 699 aa, Caenorhabditis elegans
MQHSLILLLVFIFLASASKDPICTHGYKLVKNRCLKLFSEPSNYENAQRQCYQHGGPLVTIRSKEENLDVLALAGKGHNLWIGLYCFTVLDQNGSLSNCIWDDSLGTAEQYHAFESFAGSGSRETPCVTVNTTTGYWISTKYENGMYPFVCEMPTTIEDDCQNNYNGYCYIPHSEAKSFENAQKSCEEECGNLVSIHSANENLYLNILAYNFLPGEYIYIGGMVQDFGFSRWTDGSRWSYEKFDRILKRKNGECVVVAGDWEDVIPIDQWVTTPCNRIRQYFCKRPAGEKCLGGRPKEIGPLVSYTCNSTLLQTPGIIVSPQSQERQYCEYQMHTPGFYSILLTFTTFDLDPKSDELKVYDGDSEQNRLIGTFKGNNEISVTSRTREYICKRHAGETCVAGPPEKLEPLVSHTCNSTLLQTFGIIVSSQRQSKKYCEYQMRTPGFYSKLLIFTTFDLDSKSDEVKVYDGDSEQNRLIGIFKGNNSNEISVASSGSAMLVTFRSNGTGSGKGFEARFEKYLYPSPLKKINSMTYIIVNHSLILLFVFIFLASASKEPICTHGYKLVKNRCLKLFSEPSNYKNAQRQCVQNGGTLVTIRSEEYCEYRMHTPGFYSILLTFTTFDIDPKSDEVKVYDGDLDENRLIGTFKGHNSDEFSVASSGSAMLVTFRSNGTGKGNGFEARFEKIPSQKPLEYIKSITS

SEQ ID NO: 5338 - protein, 566 aa, Caenorhabditis elegans
MKSRFLLKIFIFLAVFGVDSVRAADCTEKTFKTGTVCVCSLDSCDEIPPLDITMGQAALYTTSHTGARLHRDVIYATDTEPFGTLHMTIDSSKKYQTIQGFGSTFSDASGANLKSLPDKLSDLIMKQYFSDTGLNLQFGRVPIASTDFSGRVYSYNDVANDYSMQNFNLTKEDFQWKIPYIKNAQKYNPNLKLFAAPWAAPGWLKTTKEMTGPGALNGKAGDNYHQAYAKYFVRFLEEYGKSGISFWGLSTQNQPTLGSDKKNKIQSTLFTAETQRDFIKTDLGPALAASSSGKDVKLLILDDNRGNLPKWADTVLNDMDAAKYVGGIGVHAYQDGETDNHLDETHKKHPNFFILGTEASEGYGSKDTHVDYGNWDRAADTASDILDVRENIVLKKFLENWGKVRKKNFKILIFFSNFFFHNFFFYIFFQNMNNWMTGWTERNLILDALGGPSWVSDYTDAPVIAFPAMAQFYKQPMFYAIAHFSHFIKPGAVRIDHSLNVIELEVETTAFLNPDGSKVIVMLNKGSLVSTEHTVVVQDAADSRNHYHFTLPHRAITTLYIQTSQF

SEQ ID NO: 5339 - protein, 561 aa, Caenorhabditis elegans
MSIAWSCFVLGLFAATRPQRTPKSYNSSILSKYSQYGCQNSENFMTNSNFSTKNSNFSALASLQVALANDCAQKTFKTGIVCVCNITYCDEIPDINLLSGQAATFTTSKSGARLHRDVVYATNSDPLTSMHFTIDSSKTYQTIQGFGSTFSDASGANLKSLPDQMADTILRQYFSDSGLNLQFGRVPIASNDFSSRVYTYDDNLEDYNMAHFSLQREDYQWKIPYMQMAQKYNHDLKFFAVPWSAPGWLKTTNSTKGYGILLGTNQDTYHKSYVTYILHFLEEYQKNGILFWGLSTQNEPTSGSDKKTKMQSMGFTAEFQRDFIKLDIGPALKSSNAGKNVKILILDDNRGNLPKWADTVLNDKDAASYVSGIAVHSYQDDESDKHLTQTHNNHPDVFIFGTEASEGSKSKDVDYGSFDRAEDYVSDILDDFNNWVTGWTERNLVLDAQGGPSWVSGFADAPVIAFPALAQFYKQPMFYAIAHFSHFLKPGAVRIDHSLNMPNPEIERSAFLNPDGSKVVVLHNKNPLAPYSLSIKDTMKSTDHYQVHLSPKTIVTLYIQN

SEQ ID NO: 5340 - protein, 455 aa, Caenorhabditis elegans
MWSHTLVPILILVTTYGVNCHENSGEKRADYSGYTLHRFKVDTSSDTMEKLEGYDMQLDKTTQTARLLIDIWAEPSKQNPYADILVAPEFLQKFKSLLTSAELSTLKMLEGDIQSQINAERHAMIRNSVRRRKRAMKTWQEFDTNAYHSYNEMVEFMKLLSEQKSDMVEMIHPPGPSPPEKPSIIVDAGVHAREWIAPAVGLFMIRKIVEEYGRNPQVTANLQKFDWYIMPQVNPDGYEYSRTTDRLWRKTRSKNVTVNRWCVGADANRNWGYRWGEAGANRTPCSNIYMGSHPYSEPEIRGLKEFFTWQITNPMVYISLHSYGQLLLSPWGYTNERTENYQDQQNAAKEAAQAIKNTTGVSYSYGTISEMMYPASGTSIDFMQHRGVPYIYGVELRPTDNPNSFAFNLPPSYIRATGDEMLAALNAIGTHAGIFVEVERVEILQHDLSKLIDAP

SEQ ID NO: 5341 - protein, 292 aa, Caenorhabditis elegans
MQVPKCEICDDDFSSEEDGDHNPRNLKCSHTLCEGCIKKLLKNGRVVCPFCREPTEVPVYNIKSLHKNFSLIQMIKIVTKTTEVEKNWDNFPPKCVEHPYNVAEFACIESNCSSKNKLMCQTCEEFGAHKGHAKELLITKTDKFRKKLEFWINQLKLNIQNCTVKKNELEEAVVKSEQLLNIKVKKIKNHFDKIRQSVDKKEKGIIDETTAEATRIQKFNNEKITYLIDLQARHVKDIEAIEKQKNMTDIDLYNTGIDLPCFFGHLNIEVFRPADTKEMDIKLPNFKFEDGS

SEQ ID NO: 5342 - protein, 546 aa, Caenorhabditis elegans
MLKNEKINKKLTKFEKNSKYFEFRPQKINFFDFSHNFPLKIPIFLQIPQYNYRSFFQRRIRDHFVANRAVCDVTEQKKLYEEGQKQLESLKRQAIFCKLYPHNKTIVEQKIGEYSGIFGEKWTKSSLTPLSTQKSTKNSIFKMKECKKCKSNEYTNKQLVMMINECGHPLCKNCVDNIFALNSGNCHVCNRVLRKNNFREQIYEDPLIDKETFLRRKLRKIYNLKQDDFENLREFGDYQERKFFEPLKFPVKIKISNFRRFKNFKNFFYEFSIRYSNSPSFSWSNPEFSAQNSKIAPSNSKFQFFRFETVVYNLVFETNVNETNAEIQAFEEKHKEQIDRNKRRLDDDQKWIEDQLREERAMKARMTDHMEMDAKEQEAASAVTDTRKIMDELRDSNVAAEVILDRERKKQIEKELEEKEEQEKRKRRNKEMLQTRKRAAENMSFNTVIRVAGRAYVHQVGHENSEEIEKMQLFHSKFQIFKSIFRFSPLELVINGPPMPNVSEIEALGYLAHIRQPTAEYIAGGYTPMLGCSRALFEARIDLFSF

SEQ ID NO: 5343 - protein, 534 aa, Caenorhabditis elegans
MGFLSVEPYAAIEGNKSVNRLYVSPGPHWVYNWAMGISIYKDSMLRRLLKLENRELNETIYDKEFAELVQLEANFSTLADYRNLALDNDNMSKSRNLTDLVKMIPEIDWIKILKALARHGTSEEDEEKLLERVTVHGAGEYFFGENRELARIATETPKSALANYLVVRQLIDVALYFYDKDQPRQNKFYNHVDQQSFCATQVASFFPMPSMNVFIESSQFKIENLKVIEEMFVKIKAEYEQIFTENEYLELEIREFLIRKLNAIDGKFGLDQYTEGKPLLEKMYETVSFRGHRPEKPASFTAQLPGHGLPVAGVHENVATLVRTARRAHCTRHPAGPDINLPYLTYPWMDADFPANTNYGYLGYVIGHEIGHAFDHFHRKLDESGRQQQYWFTETNSSNTEYELREKCLRDQYSAYKEPGYDFFMNGTHCRYEIAGDHMGIRTAFRVFEKVKKEDRFRLPGLEMSEEQLFFYNYAFRQCDVYNPNKLPRNMLARQHPTNRYRVNGVIQNIPEFAEAFNCPKNSPMNPEMKCKLY

SEQ ID NO: 5344 - protein, 750 aa, Caenorhabditis elegans
MRPDEEDGTTKSPGSRWTRIWAIIALILLILFLLVLGAAIYFYINYKDSSDVCLSPGCIKTASVILSSMNSSVDPCDDFYEFACGQWIKGHPIPDDAPSVSNFENLGQDLEFALKELLDENDEPYDYETSAVGKAKYFYNLCLNESEILDNWRTTFDEVVKSFGGWPSLGHQMKPDASIEMLYADMVAKFKADSLFKATVQPDDKNSQRHVLLIDQPQLNLFARDFYVAAENEERMAYLQLIRDVLILLDADRTRATLDAKEIIDFETALANITMADEHRHDIAELYTKITLGEMRRSLPHFNWPLFFNRMFKDLHEKNGKRITFDDNTEVVVYGYEFLRRLDVLIPQYDNRLIVNYLEWCWFFKTMLRDLPDPFALTIFKFYKTLNIMNVQKVRWHGCVTRINSLMPMATSAIYVKNHFDHEAKQQVEEMISLIMESFVDLLLSEDWLTKETKQTAKQKVNEMKRKIGYPDYLNDPAAVNNEYKTFKVYPGHYYQTKFSFYEQYQRDVLERITEAVDRERWVAGAALVNAFYSPNTNEISKFLGTLTQKFKFSVFPAGILQPVFYSKDFPSSMNFGGIGVVIGHEITHGFDDRGRLYDNLGNIRQWWDNATISKFEHKAQCIEKQYSSYVLDQINMQINGKSTKGENIADNGGLKQAYRAYKKYEKRHSRPPRLPGVNLTHDQLFFLNYAQIWCGTMNDKEAIRKLRTSEHSPGPIRVKGPLSNSYDFAKAYNCEPGSQMNPREKCRVW

SEQ ID NO: 5345 - protein, 473 aa, Caenorhabditis elegans
MLFAFIALIIIQLTNASLPPICVDGYTLVNGKCLRLFHEETYHTRAEQTCRIFEGTLFDVKNAIDNRAIASFIGSQVETVWMGLFCFNNNLCLWDDNSGSTAAYDNFSPGNPKVTTGSCVYFETSSGRWLSAPCTEPRSYVCETPSTHEGNRKTGELPELKISGKSANRKMPELRISGKSENRILPILLKFGQVCPADSRKKAAKAPNCSFLPDPCYYNYNNYCYTFSHNQSSFTTAQAICEEECGNLVSIHSANENRYLMNIASHRASDNVLIGGMWPMDHMNTWVDGTMWDYSNIDSVYNPKNRCIAMANNGTSEYNLGQWFGVDCEGLSSFFCKRPAGVPCSTDQPKVTVTPVPSNESFCNSTVLMTPGIITSPNYPQNYDNNVYCSYKLSTLGSYNILLEFTSFSTEENVDLVTVYDGESTNGLKIGTYSGSREPFHLISKGNNFFVTFATDSRNVFKGFSATFVAYST

SEQ ID NO: 5346 - protein, 585 aa, Caenorhabditis elegans
MVSHVWQAITRKKRFEGDSHLDSNLRRCLGLMDITFLALGQMMGAGIYVLTGTVVRNQAGPSIIFSFALAGIAALLSAFSYAEFGARFPRAGSAYTYTYIGFGELWAFIVGWTIPLEYMIGNAAVARSWSAYFDNMLDNYIKNTTIGALGELSEPGGFFSTYPDILSFLLICLCACVIAVGPKVSANVNSSFVVLNIVVIFIVIVSGICYADFNNWTGTTSDGRSMFFPFGLTGTLTGAATCFFSYIGFEVLATAGEEVKSPHRTIPVATFLSIGVIMTLYILVSSTLTLMVPYDQVHTTAPFAEAFSARGCTTVMYIISIGALIGLTNNLVTGVFALPRAVYAMADDGLIFKWLAHVTSSTKVPLNAIVIFTLLNAIIALIFDIEALVEFLSIGTLFAYSFVSGSVLVLRYQSAPIDGDGKRMDNGGELSSWIPARNFWESLPAGTSISLGVAALIGSFFWLAFTFRTGFYEHWYGQISIGFNGLLIVLVMAFILGHQQNSLETSFKVPFVPFLPCLSLLVNVFMMAYLTTATWIRLFVWMGVGLLIYFSYGIRHSKEAKKLTTIADIRMSSTFPNKNNRITKT

SEQ ID NO: 5347 - protein, 658 aa, Caenorhabditis elegans
MSSLSQHAALFLEARTFSKCRGLDTWRQVNAEKLECLAVCALSTCYDVSGYSVLFCVDADKPECLAVCALPTSSYQISVSGVAEPGEVLALMGGSGAGKTTLMNILAHLDTNGVEYLGDVTVNGKKITKQKMRQMCAYVQQVDLFCGTLTVREQLTYTAHMRMKNATVQQKMERVENVLRDMNLTDCQNTLIGIPNRMKGISIGEKKRLAFACEILTDPKILFCDEPTSGLDAFMASEVVRALLDLANKGKTIIVVLHQPSSTVFRMFHKVCFMATGKTVYHGAVDRLCPFFDKLGPDFRVPESYNPADFVMSEISISPETEQEDVTRIEYLIHEYQNSDIGTQMLKKTRTAVDEFGGYGDDEDDGESRYNSTFGTQFEILLKRSLRTTFRDPLLLRVRFAQILATAILVGIVNWRVELKGPTIQNLEGVMYNCARDMTFLFYFPSVNVITSELPVFLREHKSNIYSVEAYFLAKSLAELPQYTILPMIYGTIIYWMAGLVASVTSFLVFVFVCITLTWVAVSIAYVGACIFGDEGLVVTFMPMFVLPMLVFGGFYVNANSIPVYYQYVSFVSWFKHGFEALEANQWKEIDKISGCDLINPLNATTTGYCPASDGPGILTRRGIDTPLYANVLILFMSFFVYRIIGLVALKIRVRFAK

SEQ ID NO: 5348 - protein, 662 aa, Caenorhabditis elegans
MRSEVEGDTPRFYMVLSFRSFMVSESLWVDFRTFPPLTDIKAHEKPTKKKRIFPEFVLKNQSTTSNSENALMLLYEKCSLRYRMENRHQETEVIQREVFENIRKIGSWPIADKNWNSSHFNLNNMLSNMASIHMLPFGLFETRVIELYPMNTTAKQLVIRPTKLKFSIPQEELVRAIRDLLSVNGITSIMKKVKEDVAESFALDKEIGNIHIDPQPKPATLSELQKAVPDIDFERIIKSYLNPKTGNWSSLRTKIFSARFELFFGKNNNLSSIIARTKPRILANYLFLKYIEYAYFFFFDNTKVFSDDDFCTEVVTTSLPRASLRVFVRNHFKKENMAVASEIVEVVKTAYVEIINNSTWLHNSTRESAIEKVVKMKKVIGYTEEYERTGALDEMFETLQLSRSDSFFVLMTKVNRFKIEQLMDFVSSDSLLNPIEPLVMANAFYFPTKNLLSNLSKSFPPRKQKIEIPDVLVPFLDKPLFDFKYPRYVAMAGVGRVLAHEIGHAFDINGRQTDEIGRTRDWWTREDTEEYDRRSECFAEQFTNFKDPSFKGKQNGTEVLAEIIADALGMEASWIAFKKINLTEEQGLIQFEDHDFGKLYFQVAALDFCAPSRIEERYSDQLSHPTNKFRINGAFSNSRAFADTYKCPVGSKMNPVQRCDMF

SEQ ID NO: 5349 - protein, 732 aa, Caenorhabditis elegans
MAIKDTLASPKFQLMASLIFFIAGVTALVITIIAISSDKKSEQPPPILPSHTEALKAPAPVTTSRPPNLTTSTLPNSSSRPPSIPICDTPECVTLAHQLLNYRDISVDPCENFEKSACGKFRENSLNSNVHRSKIFIPRMIKSLVPEEKRDFHVEIGEYFAAFVSEDNDDHEEAYQLIFNKIQSIGSCPLLNGTWDASKFNLNGIKALIIFFYNIITDMLLKIAEIGFTNFGFFEISQMRKPLLTTDSIEKMLFSLSDANYHDLDDDLVSDYAKEVEKLDVELKKTIFKDNPVDENQPKTLDTLKTFVPSIDFERLIKSFINPKNSKKEQMLKSSPTERFHLNILFFSVKREINFQLETIIKKTPPNVLANYLVLKFLTESVEEFIKKNSTALCEEIVMEKLDYAAFRVYYQNYFDKENLQIVSDMIDDTKKNFIEMIQESTWLHESTKKSAIRKVEAMKKIVGYPQEFTPPGTLDKLFENIDTSPADSFITLLQKIKRFNLELRMAYVSGESELNLKRALLQVNAMYVPHENLMRKLAPRDVSAALDLAMFLFGSSRHLIGSSFQKCLPRICPRLILTPPTQTMQNWRPLGWLSGMKWATVLTHLTGSKVKHELIADGFGAEVAWKAYKKLDLSKQPRLIGFQDFNVDKLFFYIRALVLKIVFFFSTSMFFQKFFGNEIPEKQKPRRLEKATHPTHSFRINGVVSNWKPFAETFNCPVGSPMNPEKKCELF

SEQ ID NO: 5350 - protein, 684 aa, Caenorhabditis elegans
MEKKNKRKEKEKERKKAEKFSADEKTANIKDRIINCVYPVILIILFWLLLFIGARQDEKPSLCESPQCITLAFELSAYQDTSVSKCHNFYKATCGKYKHHQALDKHRDAKKKEVVKRIVREFLRRNESSITSKFEPAIRLMFGKCNKFSQNKTYLDIFKDIEKIGPWPVLKSDWVDVMFNLNDYLLSLVELGFTDFGLFKLEFRQLAFGQFPVIAPSEQKQGNQLEKIILEILEANGVQADRQKLSKYLREYSEFKSQLRHMSLEGTSVKYIRYNASTLSVNISALVQKMAPMSTSSGLVRRIQSGILITNSSSFFGKNLDAIIQQTHKRTLANYLIFHFIDAVTFDLTSGAKHSEHTLIDLLPRGSLQVLSQDFVDEEDQGVMVEMAKDLKKHVVEMISEGSSLDKGHLVFEEKERRKLIRKVQDILVVTKYPLEILNQNFEKLNLTYSDSLHKIIQKLRRFRSEQLIEYLGGDLDPTDKGMWGSAHYEQATNDLIIIAPIIDGPYFDTSYPNYVNIFFMGFIISRELGRSLDSVRIRKDEKGHTENWLKSESLKRFDNNVKCWRKKITGTRFLNEMLADHVGHEASFMALKKWEKEMNGTIVEKIRGYESMTMEQIFFHLQALYFCRPPGGSTGELTAKDARQHYSTRVNEAFKNMPQFAKAFGCSSNQNMNSKTKRFEEHG

SEQ ID NO: 5351 - protein, 550 aa, Caenorhabditis elegans
MANQKNRGKNQKKKKSWKEVSLEIRKNEKFWVVLRILNGIIVVGLFTLYTFHFHSKSRVTPQFCESPQCIILAQELKAYSDTATKSCEDFYKATCENYKDHQALDRHRDCKKRKAVNKLVRGFLQRDESTFTSESESAIKLIFGKCDELSRNTSYLDIFKDIKKIGSWPVLEHNWKDSMFNLDGKTHEMSVDYVIAKLVKLGSTDFGLFKLELRKLAFGHFAVFVSSKQEQNIHQLEKTILGILKANGIQQDRKELSDDLKDYSDFKNHLKEFYQEETYIEYRLYAGSIVENLGISSLTTQMALKSTGLDVFNHVNQRTLITNSSLFFGEENNLGMIIQKTPKRTLANFLIFHFIDVMTTDLANATKACKETLIDLLPRASIQVLSRNFVNEDAQDDMVKMAQDLKTKITEMIDNSPFFTKFHLVFDAEEQKKLIQKVKAIGIVTEYPQEVLDRDFERLNLTPSDSIYRTIQKLRRLRSEQLIEHLGGDLDPTDTRVWGSAHYDQTTNNLTIFAPIIDGPYFDTSYPNYVNQFLMGFILGRELGRSLDSV

SEQ ID NO: 5352 - protein, 649 aa, Caenorhabditis elegans
MNMKKVKEKLSSPWIAFALNLLLLIVFLALVTVHIKMTIDVAPVFKSDDPLPRGDPDQKPATIDSETQTVDEPRNVCESPECITLAHELHNYKDPSVDPCQDFYQHFCGKFYEHSAIGQGRMATKRSTLSKLIREFLLKNKTSTSKSENTMKQVYAKCRELQKISDLNSIPPQALLDIFSDIKKIGAWPVLDKDWDGSKFNLNEMLRQLVNLGETHLGFFHFDFIARPYVLIKPPLKQGVQKSVLEKVVKMILEANEIKMDQGFSEDLDEYFELSNRIKILDTIIRSTSNRALANYLIFNFIHSSIKFLTFGLKSDRERCEKIVVQELPRPSLRVFMRNCVDKGNREEVAKLTETVKENVLEMIRESDSFTPSVKKRVLKKVEAIGAIIGYPDHFDPPGTLDKEYENLTLDASDSYYKMSQKLHQLRLQHQMEFLAGQTPLSPSDQVLEVNAHYDSKDNALTVLAPFLDDPFFDSTYPEYVNLIFTGFLIGHEFGHSIDPKILRRDGWYKTEDMTEYGKRAQCLIDQYDNYDDPDHGKQMNGTYCIGEIVGDWVGRDVTWRAFKKMDLSKMQKLIGFEDKNLDQLYFRIQSLFFCGPRSMKSLEQLLSDPHPTEVFRVNGIYSNMPQFAKAFNCPIGSPMNPEKKCKMF

SEQ ID NO: 5353 - protein, 570 aa, Caenorhabditis elegans
MNVEKMREKFSSPWIALNLLLLMVFLALVTVHIKMTVEVKPVKLDELLSNAADSRNLCESPDCITLSHELVCDFQIQLIVPRLQLNYQDPSVDPCVDFFQHACGRFHEQSSVESRTQKKRYILQKQIREFLHNNKTSTSKSENLMKLVFDKCEALQKSQNTGYLQEVHEVFNDIKKIGAWPLLDKNWDESKFDLNEMLTNLVKLGATNFGLFQFNFLGLIMGNFVEIAPTEKSDVEEIQMVLDILKGNGIEPDREEISRELEEYSMLEKKLKIVKENETISLNLILPDVRSVNFSGLIAEMSHPSRVSKLSGMITPKIITNKHPLLFETNGTESLDAIIESTSNRTLANYLIFNYIQSSRDILTETYENCEQKVEAIKVIIGYPDHFDPPGTLDKEFEHIDLDSTDSFYRISQKLHRLRTEQQMEFIAGETPISPVENVLEAECLIDQYDNYADPVYGKKMNGTHTFGEMIADWVGHEVTWRAYKKMDTSKMHSLIGLKDINMDQLYFRVQSLLWCSSRSMLSLEEALEDVHPTKPFRVNGAYANMPEFAKAFSCPVGSPMNPDKKCKMF

SEQ ID NO: 5354 - protein, 726 aa, Caenorhabditis elegans
MSAKDKLANPLIALVVFLVLTIIALLATIIIMKLNEKPVEPPRVAPIAQKLVAPEKKSRPEPVTNPVTMTRPEPVTQASKPRNVCETPGCVTLADQLLNFQDPSVDPCQDFYKAACGKYSEHEVANRRLQKKDIIIQRMIKNFLLKNETSESKSENVMRQVYRTCEGLKNEEIFNANMKTAFRELFKDIQKIGSWPAADKNWDETKLNLNEMLLNIVKLGSSNFGLFQIRPTEVPFLEVAPDMARSPKVSANFQQIIFDILEKNGLQPDENVIADDVEDYITLEETLSQYAYDYNAEKVQFSKLQAQVPSLKLEKIIEEMMNPNRKKLLVTKVKPRMVAHKHSLFFDEKMNLEKLLKSTPKRTLANYLIFYYMDHAMNGLSVHDNVIKKRNCEKLVIEYLPKASLRVFVRNHFEKGNLKIVDEMAEETKKSFIEMLQESTWLGADSKKNAILKLEKMGKMIGYPKEFEKKGALDKMFETLKLLPKDTLYGILKKIGRFHMEQGIEFVALETPMDPVLPVLMTNAFYTDRNHLSFLVGYMDDPLFDATYPKYVNIALTGNILAHETSHGFDTAGIKRDENGEVRSWMKPEDLKEYGKKTQCLVDQYNEYDDPVFGKNLNGTTTLNEMVADMIGVTVAWKVFEKLDSSKEQKVIGFENENIDKLYFRAAALDFCSLPPTTSLVEELTRVHPTGNFRVNGIFSNMPQFATAFNCPEGSPMNPKTRCSIF

SEQ ID NO: 5355 - protein, 590 aa, Caenorhabditis elegans
RPLFETLTELGEWPLLQENWDKTKFNFTSLLVNSRRDYGVDVFFQLYIYADSKNTSRNTLFIDQSTLALGRGTRDYYLNTTLFSSHMTAYRKYLRQIAHLLKTDGNLTRSESEMNADIEKIIDFEIELAKIIVAEDERRNNTRLYNKRQIQDLYNLLPQVDWVPFFQSIAPSDLTHLFHNETEIIICEIEYLQHVSELIEKTDVGLLTNYVLWRVVQSNVRYLDERFEDIKQDFLKVMTGQQQSPPRWKDCAQVPSTVLPLAAGAIYVQAHFQESDKHEALRMIMHLRNSFADLVRQNDWMDEETKAVAIEKANSMINNIGYPDVTNDLPKLDKQYLGLSISDSDTYYYIMKKSVVWMQSREFQKLTKPFDKHEFDISPAVVNAFYSPEKNAITFPAGILQPPFFSGTFPKAVNYGAIGAVIGHEITHGFDDQGSQYDKDGNLHNWWSESSLNSFDTRRRCIVEQYGNYTVPKTNFRVNGKLTQGENIADNGGVKEAFQAYQKYVTENGEEPRLPGLQQYTNEQIFFVSYAHFWCGKKKEAAAMQQVLTDEHSPEVFRVIGVLSNMQAFADVYKCPRNAPVNPDHKCIVW

SEQ ID NO: 5356 - protein, 327 aa, Caenorhabditis elegans
MDYDMDIYLMMSWRDARLVNPYDKPILVKEEDILEKIWRPDPFFANAKEAEFHEVTFLNFLMRIFPDGLVLYETRVKIKPSCNLILCKYPHDKQTCDLLIKSFAYPVETVRFEWFTRRKDAIDKNPDVKLPELYIDRYETTTCPNERKSGAFSCLRAVFRLKRDVGFHIAQTYIPTSLALMFSWVGVWLPEEFMEGRIGVAITVLLTLSTESAGAREHLPSVSYLKAIDLWFGFITGFVFFTLLQTLFVIGFDKRANQLKKWAGRKTADITEEIREALLQKATRYHKTGRYLDNFCRVFYPLSFILFLLMYYFVFTEGRQDDCMNRR

SEQ ID NO: 5357 - protein, 184 aa, Caenorhabditis elegans
MSAEAVAAAPIAEEATPVVYYSIESNDRVVLKISEQAIKQSATLSNSITNLGYSAENAESMVPIPIEKVNGKTLKLVVEWCEHHKADPVPEAYPSGNTVLPVWDRKFVDIEHDALTDLVNASNFLEVMTLLTYCCKFIAGLAKGMSPEEMRVFFCIPTDEEDEKAERFGKEKTEASATSADTTA

SEQ ID NO: 5358 - protein, 801 aa, Caenorhabditis elegans
MTSATTTPRTPRLLSSREMQNIEGKLRCLQTLLQNPKTSAIEELKKPVRSLSHNLNTILNLGRTSYKVEVRKRLEGAFKATKIILAGENKSFKNYNVKIEKKTLFMKNKFISPFQDLANGMHFYFLLLVLMQYSRVNTKIMSKIEIISKNSFVTVIIILAVPIIVILPLVLLLEAGKIGGEVSENCSNHSTSSASPKPKPMCLTPECITLVHQLLNFQDPSVDPCENFYQAACGKYNEHNVIDGSRTAQKQQIVKRLIRDFLHKNQSSTSKSENSMKLLYEKCKEAKTIKVLGNQNLLQEIFMNIQKIGSWPVLDENWDGKKFNLNEMLLSLIRLGVSNFGFFEIIISSDAFVEIKPARNFPTRENLSDIISKVFLGNGFQPNITAIENDLREYENLQRELKSITSDYPTEELSFAELQTLVPSLERLIQTTPNRSLVNYLIFNYLKSVMLEYKRLPEEQCEGVVIDFLPRASTRVFVQNFLDKENRKYVAGMIEDVKMGFIDMIQESTWLNEESKKVAVQKVKNIKSMIGYPDFFEPPGTLDRSFKDLNIEQTDSYHTIVRKIQKFTNEQCMEFVASEIPLDPRQPILHANAFYQNTNFLAILAPVLDDPIFDTTFPRYVNLAVIGNVLAHEIGHAFDHTGINYDDAGQQRIWLTPEDSEEYGKRLRCLLRQHDEYDDPDFGRNLNGSKTLHEISADRFGVEAAWRTFKKLDLSNESEIVGFQNFNIDQLYFRTAALIWCRQRDTTDLQYALQREHPTNNFRVNGIYANMPQFAETFNCPLGSPMNPKKKSFEVFLKIKE

SEQ ID NO: 5359 - protein, 330 aa, Caenorhabditis elegans
MSQEEEDDINFKTGSEISSSKATYTVVRLLGEGGFGAVYLVEQAKTKKQFAMKVEKKMDTRKHSKLKMEIAILKLVGTCKHFTKIEDRGKKDKEGYFFIVMQLVGKSLSGLKKERPNQIFTFGTGMGVGSQCLEAVEELHKQGFIHRDLKPQNYASGQDDERHLIYILDFGIARKYLNDKKEMKTPRESVAFKASGTIRFAPLSCHRYTEMGPKDDCESWFYLLIDLILEGGLPWRHCKVKNEVLKIKENTRKDNRAALYKGIPQTSELNKILDYIDSRAYQDRIDYKFIYKALGEACSNAGCDINAPYDWEMPKEISGTSTETAKSMKK

SEQ ID NO: 5360 - protein, 376 aa, Caenorhabditis elegans
MRQANQEREVRYEKFKVDTIEELQNELQDQNNQIDKLRIDRQELVKENDQLLEEIAEMSTKMDDYKRKEKAKEVEMRMKYDQKLKDIVMNKEKRVSPRFEHLEHKIEDLHAEIQKKEELILLKSRQFASEISLKNGEIEDLKRSEAYAKSQISQLEDTVKSLKLHIEKIASENDQTVVVETLRLKNEELLKENLNLEMKQRQEQLDFARQLADSEETFSVRISEFEKLCEQKDLKIEDLHSQLEKCDRLQESLEKADRSRQIEEEHRERLELEVKSLYEKLQKSAEDRQKVETTLKLDRDRLEVSLVTMKKKLESTPEAPENVEKLRKELRDSEKRRLSEKEKHQAITSELKSALKRLERSYRDAVIKLQEKIPEF

SEQ ID NO: 5361 - protein, 312 aa, Caenorhabditis elegans
MERFLRLGGLGGNLGTFGANPQDSNQVDTSETVYISSLALLKMLKHGRAGVPMEVMGLMLGEFVDDYTVNVIDVFAMPQSGTGVSVEAVDPVFQAKMLDMLKQTGRPEMVVGWYHSHPGFGCWLSGVDINTQQSFEALSDRAVAVVVDPIQSVKGKVVIDAFRTINPQSMALNQEPRQTTSNLGHLQKPSIQALIHGLNRHYYSIPIAYRTHDLEQKMLLNLNKLSWMDAVSVENYSKCGEQNKEHLKAMLKLAKNYKKALEDEKNMTDQELAIKNVGKMDPKRHIADEVSKMLNDNIVQSLAGMMATTSLQ

SEQ ID NO: 5362 - protein, 430 aa, Caenorhabditis elegans
MSEACMVESLDRRWYLVAVCGTSLSVLSIVSNMLISKVLLSSKHTHFYFLALLALSDCFLSLNYGPVIAMDIIKDRVKLRWLSNLYIQYVGPLLALSQTSMTFSCYLIILATIERYLITLRAKCLGTFRQCRGLSALCMFILALLLRAPIIFEMQIEQNPDCIGEISEYYLNLSPIVNTFWYGTVYRFYVRNIMTVLVPFVLLAILNYKVVKILRMQQRSAQMFRFLSSDHKTKIRSATILMVCIVFSYLLANILNVGVTLWEYVAFQSTQTGDAYAFYETCTDVTSVLYILVCATRLFVYYLFNQEIREAIKPLVCHSTSAPRKQDYVTVTRSLQSMPLAVVGALTFLGPRQTGIVRNQQNDSSRQIGTEIDAVAIAIARRLLSSELVFGGGGTKEANDSYVISNHHATTSGDEETDDDDDDEEIPYMV

SEQ ID NO: 5363 - protein, 502 aa, Caenorhabditis elegans
MVLLAAIDQGTSSSRFLVFEADTGELVTSHQIEVRQLFPHGGWVEMDPMELYDTVVSCISKTIEKLENLGISADEIKSVGVANQRETSIVWDKETGKPLYNAIVWLDTRTSSLADEAISRTASKSKDEFRAKTGLPIHPYFSALKLKWLFQNVPEVKKAYADGNLMFGTVDTWLIWKLTGAYVTDVSNASRTLLLDLHKRKWSTQLCEFFDLPIEILPEIRSSAEVYGHFDKGPLEGVPLSGCLGDQQAAMVGHQCLNAGQTKNTYGTGTFMLCNIGTRPIISKNGLLTTVGFQFGADSPVVYALEGSGSIGGNVVRFLRDNFKFISDAKEMEGLCRSVEDTSGAYFVPSFTGLYTPYWDSTARGTILGLTQVTQREHICLAALRAVAFQSAEMIAAVEQDLEGGTKVTTLKVDGGMIANKLFNEIQADIMGRDIVTPKITEISGWGAAVAGGIGAQQISLDEFLQQSSEDNRYTPQKDDNWRSAELARWKEAVKRSCGWAQ

SEQ ID NO: 5364 - protein, 422 aa, Caenorhabditis elegans
MLEFSQKLAAGTPGPHSSTHNIESSAFATADITLGFLLCGRLSFTTQVNNRVNVCGGTEMSAADMARKNSLINRQLEKEKIDSKKMLKILLLGGPECGKSTIFKQMKIIHMNGFSDLDYVNFRYLIYSNIMQSMDQLLEAAEFFHFPPDDSPSIRRALNHYKSYKVRYSTSEVELNRELADSLSKLYNAEFIKSVLNRKNELKLLDSAVYFLDDIDRISAHEYKPTEMDVLRARVPTTGITEIEFPFKQASLRMVDVGGQRSEQRKWIHCFDNVNGVLFIAAISGYNLYDEDEENRKDDGTPTKTNRLRYSMELFKRIANHQCFSKKTAMILFLNKIDIFKEKIGKYPLTTCFKNYKGVNAFEPACKYVTDRFSRLVSGDIQHEKPLYTHITNATDTRNIDRVFDSCMDVIFKISMEKVGFM

SEQ ID NO: 5365 - protein, 333 aa, Caenorhabditis elegans
MDSNVKYFMYEIFIPSIIILCCVAAFLNFMVVISRLYCKMRSASLELTYSLALSDTWTSIVIGFSLFWNSYKPVVLNIPHSSYCFPLTLEAFRTGGLLTGIFHLVALAFTHYMTIKRPFDHHKVLPIRTIYIMIFFMWATPPMALMIYFASNSGQGYQSEKCMGIKFYENFYFRALVSLIIVFLIILTTIFYIKMLQKITEVRSKTASNSQTLGASARGRRTVVTAVLIFGTFLIGWMPASILYILTAESMPLYNKHSVSITIMSIAVLVSIMAKTLCNPIIYATRIPEINQFVFQKLLYRVLPGRNPTIRRQSELEPLKTRCSQPNAHSVML

SEQ ID NO: 5366 - protein, 392 aa, Caenorhabditis elegans
MPLPSAFAVMNEQLFSDRREHFSILNGQIGYGAAQKNAPDEKKQCTKKRQLPSLAPACEELQPKKSKVTEETVASQKTHGLSNLDDYCLEMPDFEKQMLSIWQSNIDITEMYRALCKSASLIPAPHTLFCVYEIPESPNKTQQFCPSSIEDRQRVLLNIFSRRFQLKVSSEALHLGAALLDKCLDMMSVNKASLDELAAVTLVIASKLEDVNCLTIENIIGVELIEKSAAQMAALERFVLTSLSFKITIPTPLHFSTYMLVYLSASPAKIHLTYYLLELSILYVHNRRFPSDVVANAATCLAFAIDSEPSVDQTPSTVLRETELRLRDFTGKNVKDEWDREREVMLTLIDLFLVAGDENHDIYREYCTSRRNYVALRQSVPELLETLRKDST

SEQ ID NO: 5367 - protein, 919 aa, Caenorhabditis elegans
MSLYTGDKIYYRICDEFTDQLVYFRPQVTGPKETDMVRMNGSCIPNASKKIPGVDLIGLCMSTGSGIKTSGECVCDSGYSQIADSNGARCESCPTNTYKPKGQSLCKSCPSNSISSEAASSCRCLNGYFRAEDELISMPCTQPPSRPIKLVANAITATSTRLSWNEPSSLGGRPEIWYEVKCSGRGECGTVVMTPGDKKLSTRSVQINGLRPSSDYTFLVFAKNKVSAQFPEFSEKNAVIDIRTRSEEEDVPPVSHLRVDASQSDGITIAWSVSDSDVSDFEVEVRPAIVKKRTFETRHVNMTYTTFIGLNPETVYQFRVRIRDDLRWSQPISYQLGRGLMSSPSSNEVEESQFLNQTGSALLIIIALILIVIAVALCMIVVQKKSKNRKQMSDLDVLDTYKQDSMTPDYHTTSRHHHHQGNLPATLHEQLRSTTKLNAPLIPSFGSPISQPPPYYGGVHPNSGKYKTYVDPTTYEDPYQALIEFTFDISPNDVFITQVIGGGEFGDVCLGGLSKNSPAAAKWSVSNTTMGRGGGGGGYESEPYETVAIKTLKSGSSAKAKAEFLTEATIMGQFSHPNVIRLIGVVTSAEPVMIVAEYMANGSLDQFLRNTDQRGEKVHWEKITEMLYGIASGMKYLTDMGYVHRDLAARNVLLDMELRCKIADFGLSRGVRSEGSSVEPEYTTNGGKIPVRWTAPEAITHRKFTPSSDVWSFGVVIWEVCSFGERPYWDWTNQKVISEVMIGYRLPPPMDCPMGLYRIAQWCWKMERHERPTFTQLLATFHKYILQPTLIEHDPGELPRRVQSQSALNTYGSVNVGVVPTPPSSAAPMPSLDDFLRQIGLNHVYGQLVSNNIHSVSDLANTSHLDLLAYGLMSAECSTVRDGLNGRISGSPPGSSGTIHATTRGTRTTRPPREEGFFV

SEQ ID NO: 5368 - protein, 1827 aa, Caenorhabditis elegans
MISSSRTPNYAINGLRNRHKSLVGHRYRSTSPIGDYGRHRSSPRVLAHYNLDGADIGVGEENLDELFAKLKEELFKNNTLEEVNEMLREENDAALAANEHLRVDATNLSRQLQQLQQQQHTESMRFRSENTSRELQYCKGPEICNTFLFLLFSCKPYQERYRNQTETQHRKLISLWKEFTAVKRQLHELRTTTANDLDRQLTEFTRCATLMRKAIRHAEQKNLDQKEQMKREKDDVLDETLRQLNSVTENYMKSEEKANERQRDLKRKEDECRKLREQNDELSDILEQLSKMAHEMAGGRGRSQSPSVIVDNTTAHSLFNETPMDVARKMRKLLTTKNGEIDESREAAKQAEKERDRAKKDLEKEEKRRKDDREAERKRSSVYSQREHDLKKLDDELRKASEKIRNLEEQRESQEKLTISVQNSLNEAHRQHKQFIEELMIRHREELKEREDSHEEALRSKDTEERSRFEKERSEREKIRRESDELRETQRSLKGDVAAMKTDLDDKTLRLDMLETERDELKKKLETEREQADQRDLEIAECRAKLDEMAEKEAELRKELAEFQAIITAMEGEGKLNQEQFLESKNELNTLTDQIESLNSEVENKNEEIRNLMATLQEKEVHIQNVRTSSHQLTATYEEANGEIDILKAELTRLHEQVNERTRQISEANEKYDDAARKNDALLEDVATWQEKYEQLKMELEEMNRRGQEKEREEADLRALLDDLRGNFDKLTNELKQKGVTVDSLNEEISSLKEQLNKSEKERKEELLRMEELEQKNEAEMKEEYEVKLQLAEKDRQGVENFGKECEARMNELTKIHEMLMEEHDQLKVDHLHTEEEVERLKEKMRKELEKLNEQNDGDRAEWSNERNRLESSKNEAVTELQERVQKLEDVVKEKEDKEIALRRDLEDSHEKSRDLDDKLRKMELTDEEKEEDRKKEQKTLNEERMKLMEQKEEAMLVATKHATTIDQQTRRISVLEGDVEKLTAGIAERESSINALESNTMELISKLETTEAELEKLKDELAVMLKQNSELKNGKEGLSEKWNEERKKIQDLADQLREANKVVHNMRMKNVNLEEKKNELDQNVTDLTNKVRQLEIQLMDKAAKNEVSGDLLRKMEHDAQSMLKQAQNEQFRLTDLEKVRKALQDENQRLVNDLATVKAAFEVKRETSKSAISDILDKYRSAEEKANKGELDNQRLRSDLATVTLKLERQELKAKDSDNRLRDSQKRFEEVQSKLANLQKSAVESLQNPMSSNSRQNRSIYVDIPRAASSIGLNENSDEVPLRSSPSVRFADSSQNMQRAVDSMDVSSSVGVTLRFLKERIEQLEADNADLSDALEKAKDELRQRNEKLADRQMVIERVERQLVHITEERNTIENRMTSQRQMYLTNEESSRSREHEIRSMKARISTLELHLREKESKLAHLRKEIEVLHGQLHDALESKEKATGLVGVQDSKHRDLEEQLDRANRERELAIGKQRRTLAENENLFRKLEQLEKEREQLMREITDERRLNERNRTSLEELRVSERTWKSAMTTAKKPAEEQERAVQEQRRWEESNHEMTNRNTALTKECDRLRVEMRDQLNRMNGINLRSVDFERKNEELSSKLIVMQNTVTAMKKFEEEWKRLEAEMRAELKILRKEKLMQTAEIEDLKRKSFRSDTEKKEIEGIRVRLEREISALKRHVDALEEEKGKTEKAVRETMNERRAIDKSLASMERENQQLYRNCAQLQAQIQNLERDAGNRSVTKLAKEHSLLEARIAALIEEKRQLQSMLDQKDANYSHKRKLLESQIQLLREQLEAERRKRTKGVVATGPTVSRRGVQHTSAFRV

SEQ ID NO: 5369 - protein, 758 aa, Caenorhabditis elegans
MGTADETAKQSKLSTMQSTQKRKPGSKPNGGFLSFRGKKPNTTGGDLRSSKSKSRVSSLNSKGPLSGKNKKKDNSGRARKKPSPMKCFASGEIVEGVNQYKVTSQLRKSSKLLDYDVYLVKDTESGDDYRMKVARKDPQILKTEAALLRRLEKIPGDKCFISMIEYGSIVKDKVEFLIVSPYGATLNEIMKKATMGQLSMDCSFVVGLQMLRAIQNLHSIGYIHRNISPASFHCGLGMDEPTLFLQDFRQARKFEENKKHVTARTNVKMYGCGRFANRACQGSKDQGRKDDLESWVYTLFYLMDNGSLSWKRENNSLVVIQQKDAFMAGNGKDQFTHAPRDLVPLLSVINGYEFSSAPDYEVFRNCLEGIQTVQNLNKKSCDWLGKAGVDELAGDTVRSFDCKVTGERDFLPRGEKPKKPARKKLSSGDVILGVGATDGWKVVNLLGSGGFGDVYKVHRESQASNKCYALKTESEEGEKRYLRLKVEVTVMMKTAEKKKDNKFKNFIEFVDRGKCEQLKCKFVVMGLVGPSLEDIRRKYLLASFSKHTSFNVAIQTVTALRDLHSLGYLHRDIKPANYAVGLDEREDTVYMLDFGIAKLYVDENGVHKIKRKKVKFLGTLRYACRACMMQQEQGRKDDLETWIYLVFDLMDEAHGMPWRALCDPREILKSKNTFFATFDNFQFSNILKRLKDLVVYVDDMQYDTTPDYSYILNFLKTTANDVGAKITKKLDWMGKLKQKEFDSESEKSEKKGTGDDEE

SEQ ID NO: 5370 - protein, 241 aa, Caenorhabditis elegans
MHFSFIFLVLVYLTFAFGDSLICNNGFTVVNSNKCLKLFSSAVKHRTAEANCASYGGTLVNIRNSIDNRAVTQFVGNIGLSFWIGVYCLESNNPSSCYFDDDLGTDTAFNNFAKGFPNTDIGGCVYSATSGSLAGQWISSECDNVEMAYVCEIPMTRADSCAHNYNGYCYIMSHENSTSPILSFNDAYKSCQDNCANLVSIHSRRELSYIQGIYSPFNISSVTIGGLSTAPMAPYWSDLSH

SEQ ID NO: 5371 - protein, 469 aa, Caenorhabditis elegans
MKTLLLLAFFVGVTCGEEIKDLPGLDFEPNFKHYSGFFQVSDNHVLHYWFVESQNEPSNDPLIFWFNGGPGCSSLDGLLNEMGPYVANEDGKTLRENEYSWNKMASVVYIESPAGVGYSYATDGNITTNDDLTSLENYEAVKQFFTEFPQFRHHQTFIMGESYGGVYVPTLTARIVDGQKDFPINLKGMALGNGYVNEKLNIDTSVRFAYGHGLIDEKIWNTLERDCCRGCIDSCDLTQVTGHCATLVEDIFQFLWFGGLNPYDLYRDCDPNPSVNSKRMKHMLRGVAPAMAHFDELLKNQTKTSLYQFLKNKSQSQKPLKADVPCLNDTEMLSYMNNPKVRKAIHIPFNLGKWDICSDKVTTTYQKQYTDMTPFIKKIVKNHVRVLLYYGDTDMACNFMMGQQFSDQLGLRRTLKKTPWKYDRQIAGFKTLFDGLSFITIRGAGHMAPQWRAPQMYYAVQQFLNNHPL

SEQ ID NO: 5372 - protein, 565 aa, Caenorhabditis elegans
MHIFCVILFNFNLFIIKNFKFYLISKISLSLCCIIRFHFLLFLEMLSRLVSSVHPQIGLRAASSAANNIVSQAQLQSDPSKLLFIDGDRKTTYGEFVKRTGQYATALTEKYNIKKGDRVMARVSKTTDTAALYIACLQIGALYIPVNPGYTESEAAHYIKDATPSILVSCNEELDKVFRDKIRVINEDKLASEAGSLNACTMIEHVEKSDPASVCYTSGTTGLPKGAILTHGSLSNNAHDIVRDWGFTGNDYNLHALPFYHVHGLYYSLHCSLFSHSTMIWRSKFEVEDCIKYMKNATVMMGVPTFFSRLLASKNFNKEAFGNVRVFISGSAPLSVSTIEEFRERTGQVILERYGMTEAGVMTTNPLNGERKAGTVGPAVQGVGCRIAKNGGIEVKTNAIFAGYWKNPKKTAEEFTEDGWFKTGDVGHLDEDGYLTIGGRSKDMVITGGLNVYPKELEDFIDTLPFVKESAVIASPHPDFGEAVVAIVVPSEKVTDEKEFEKKLIGIMKKKVANYKAIFKFPSDTAILVQIFVPKRVIVLDDLPRNHITKVQKNVLRDTYKNLFA

SEQ ID NO: 5373 - protein, 467 aa, Caenorhabditis elegans
MRWYICAIVTGLMTLVQANVHVYNFTVLCMQEEQEKANNESLSRNETILPSSLNFNFSKFEQDLLFSAAYIAPLPSIIILYFLTNRSGVKTTFLICSMLSFLSTILTPIATQYGFWFFWAARFFQGLPTAILGIVVSVVTCHWSTLTENGTYVSILAAHYQIAPLLTMPLSALMCSVGGWSSVYYTQGTITAILIVLFAVFYTDKPSESKFVSKGELKAIEDGKSLEEKHVEKSKTPFVAIHKDPAVWAIWITSVGGTIGFSIFLQYGPTYLNKVLHYNLSTTGWTAAVPYIFSCIARIVAQPLSANCSFLGERLAAIVTTTISQGTMAICFLVLMFIPQTWSSVGQLCYSLVIVANGLNGVGITRSAQLVCKQHMSFVYTARAFYNGSVGLFLPLLVNFVAPNDTHNEWTRLFLIIFCIVFVSNLIFIAFSSTEPAQWTIGTSEVDNRSEQDLEDQKSTSTTVEKF

SEQ ID NO: 5374 - protein, 754 aa, Caenorhabditis elegans
MKRNNGNVAGTLDWQQCSPPFSFSHFSFQYHLSQLWRSFRMGSPLLSQVFQFLLATWQAFSYLPINSTISTTTSSYITSTPGSELCSNTEGDAYEVKNSNHVNYGSDNSTCLTPECIRLAASYLNNMNRDANPCEDFYEFACGKYATRKVIAEHEKKVTVLSEMKKEMDRHLKDILEKTSRENTTRSMKLAQIYFDSCMDEFSQDDLGVQPLMSMISNLGGWPLLTNARFDSIDFQWEVLAGHLALYGVDGIFRVFVHSSFDDSDKNVLMFSPPKLFLEKKKFYREVPSSNVYLQYYRQYILSLLSLLGVDMEDETGVIEYQVDDIIDFERRIANLTRIELSRNHSSINNMITFGEFKRKYDKINWDAFFNEEMRGNLGRMPDSLVINVVDVNYFDNLYSLIKSKPLSSINNFLMWCLVSNYDMYLPAKYRKPMLDFRQKMYGVSSDDPLWEVCVGEVRENLAMPLSTEYAQKFFTKKDKLVAEDMIRDLKKAMEQTLLNADWIDESTREAALMKLDAMGHKIGDALSKLHRTPSLIDWASPIIAVDAFHYFTGNEIIFPAGILQFPMFVPDAPAFSNYGAIGMGIGHEITHGYDDLGAQYDDKGNLRGWWHTETMTTFQKKKQCFVAQYGSKIEPQTGRKVDGKMTIGENIADNGGLRVAFQAYQLRSDREKETRRLPGLTDFSPNQLFFLAYANTWCEALKPSAIDHIMDTDVHSLGMFRVNVPLQNLPAFSKEFDCPIGSPMNPFEKCRIW

SEQ ID NO: 5375 - protein, 964 aa, Caenorhabditis elegans
MFSLLFLKCSHLKVKRGTQEFLVWFSFTISLALLFYPNLVQIFKSTTSIPNIPKVWWCLFPSSNPITLWSYAQTRTDRSFFYACSLSVYSTQSGHYGPFFRLISSTPKLVNSTFPPKLDSTQPQIFPEDPKVGDSIYLECFAYASPLPQYKWSRVDGKPIPARSHISNYGRVLKIEKVNYGDAGKYKCVAMNAFGSAAGEVHVKLRAPPSILQGLHDRLVPTESNVSFECLLSNADSYSSVEWFKDAKPIVPLLLPAEKRKRLKIDHNVLHLKFADETDSGVYQCVASNDVGSSSSSALLTVKDSAPVFPPNAMSRKVFAAFGSTVSIPCIFEASPRFHGKWADAGGSKLPQKGRIRDEEGVISIEKVLHEDAGLFFCTAHNKLGKAHAQVQLIVVNKPSIKTNFLDEETVNMSCEVELTCENSAECPEALFEWKINDRPAKEYPSLKSKVHEKKSGHKGRHLKQKVDLEVPKSLAGSRQIGRFACSSLYGGSSEFVTKPQLPSPIALTVEQMDEDGKKKKMFRLRWRLPPQHRDTRDHSPKVEGYLVELRTRKNRKWRAAERQLVGNMEKDSITVENLLPNTEYQFRVRSVESAAIGEPSIPSDWVKTAPGAPSETIDNLKWRSLDSQTLLVEWQPIEIGQESSGDNLRYRVSWSEATVGKNATDDMKLSNQDDDFENHLDSDQPQAILKLNTTEGCRMVVLAVRPVNDQGNGSVGTDTIAFLNSHGELKKVSLHNVKPINASHVNISWTWDNTSDCDTKHAVQITCINLSGSEISATVASDRIFWMLGGLEAETAYDCDLKAIDNHGSFGPASKKFRIHTKQHPPSETPLIGKLMMKQMKDTYTTILEWSSIELQKPNRTENGCGYKIFIYISETATEAIELDMPLQRLSDRRNPSARLDGLKLMYMYTIKVAGYNPGGIGPISEPRSIRLGSPGTMDYTTGSSDVPIPSLLLLLLLLLWRL

SEQ ID NO: 5376 - protein, 392 aa, Caenorhabditis elegans
MGLFHDVFDAAQKNGIVIPSAPSVVRTAKCSSAATSVAAPIEFGSSQFYAMCALGGSLSCGLTHFAITPLDIVKCRIQVNKEKYGSMVQGFKVTIAEDGVRGLARGWAPTFIGYSAQGLGKFGFYEVFKNIYSSALGEENAYIWRTSIYLAASASAEFFADIFLAPMEAVKVRMQTSPTAPTTLRACAPMIYKQEGLTGFFKGLPPLWTRQIPYTMMKFTCFEKTVELLYQYVVPKPRAQCSKSEQLAVTFTAGYIAGVFCAVVSHPPDVLVSKLNQDSNASVGSLVKQLGFKGLWGGLGPRIIMVGTLTALQWFIYDSFKVAMNLPRPPPPRMPESLKKKLGIPGTTEVAPVAEKVAAPEKSAKSEKPGKVDKKQEKKEKKEKKAKKEEAV

SEQ ID NO: 5377 - protein, 277 aa, Caenorhabditis elegans
MAVDMIVEPKWVVQNFGNIRILDASWTFKPKADVAEYKAKYYNKFGVGMNELKNPEYLAEHINGAAHFNFDIAYYPSEDERFTLYTPEEFSSYVKRLGVFNGDHLVIYGRGKDGGMAAASRAYWTFRYYGYTTVSVLNGGIEAFKLAQGVVQSDSKAEGIRCKDAIHFPIGEVCAAKGFKKKTDCDQAFAAKGIKVGDTVVISCGIGLSASAICLAAARSGIVAKLYNGGVHELAYKAPQHLNMRVTLLLHAITVLRCTYIHFTFLYAIVIKIERIV

SEQ ID NO: 5378 - protein, 568 aa, Caenorhabditis elegans
MGIAVVETPTKPFAGQKPGTSGLRKRVPEFQQQNYTENFVQAILDAGLGSKKKGSQLVVGGDGRFLSMEATNVIIKIAAANGLSRLIVGQNGFLSTPALSNLIRKGHEGRVVDGGIILTASHNPGGPKGDFGIKFNCENGGPAPDQVTDAIYQITTKIDKYLIAKDLECDFTQVGRYEYDIEGVGHFVVDVIDSVTEYINLMQKIFDFPKIKSLLAGELTGRKLRVLLDSMHGATGPYISTILVDHLGADPSDLLRTVPKPDFGGGHPDPNLTYAKTLVERLHTGEHDLGAAFDGDGDRNMILGKNGFFVCPSDSLAVIADNIDYIPYFKTRKVAGFARSMPTAGAVDLVAKAKGLQVYETPTGWKYFGNLMDAGRIAICGEESFGTGSDHIREKDGVWALLAWLQILADRKESVEEIVTKHWQKYGRNVFTRYDYENVDAAGANLLMTFLEAQLPAFVGRDFSANGVTYKVAVADNFQYTDPVDGSVATKQGLRIVFEDGSRLVFRLSGTGSAGATIRLYVDSYIPSNDTSRLLLPAHELLKPLVLIALDTCKMEQFTNRKAPTVIT

SEQ ID NO: 5379 - protein, 919 aa, Caenorhabditis elegans
MRHLDLTVFPNQMEIKERVKQEDVFGKKMILKNAPWCYFKDGVGYNLDSQQGSTYNLRKNGGPSNPWGADSTEIKLTTKSIGSVLNVKIGIDGRYEPPVDFPRETQSSTESLSLSTSFSNGVFSFSVVRQSTNRKLFDTSIGGLIFSDQFIQIATYLPSENMYGWGENTHQSLRHDFTKYLTWAMFARDQPPNSGSLDTVNLYGVHPYYMILEPDGKAHGVLIINSNAQEVTTAPGPSLIYRTIGGNLDMYFFPGPTPEMVTQQYLKFIGKPFLPAYWALGYQLSRYGYKGLAEMKTRIQAVRDAGIPIDIGVADIDYMQRYKDFTTGDDWAGFSDYVKTMHDWGMKLILIFDPAIEATYPSFQRAIAANAKFIEWETKAQVQTAIQNLYPMAKDTKIMLGVVWPDNHVAFPDFLDSTNNTQNWWINEFVNYQSQVAFDGIWIDMNEPSNFGTNQDHPWYFDSDDHPNDAPLFCPTNGSSPWEMPPYKTRAVWRFGDANSGAFLSSNTLCMLAQQDGGKQRFYNATGKRGAVVSRSTYPSAGRYAGHWLGDNTARWEDLRTSVIGAQEFNLFGIPYVGSDVCGFIGTTTEELCLRWQQMGAFHSFFRNHNTIGAPAQDPAVWPSVAAATKKANLFRYQYLPYLFSLHFTASLSGATVIRPVFFEYPTDAETFNLGYEFMWGSRILVAPVIYQGTTSVNAYLPTDRWYSLFDYRYGSIMSPGYATVPAPTTSRIPVFVRGYSVIPRQTPSITTTATRSNPFELLIAPCPLGMGEGTLYWDDGETIVNDFNSYDYHQFDFMYNSTATGGSVTITHSKKSSKISLPTLDIIEIFNYPSAPNFRSFTINGKLVNVNVQRSTYSGITKILYISTEGLVNLSSADSIVLQWSNAGNSMFDISSASSDEVGKMKALNTNRYDELYF

SEQ ID NO: 5380 - protein, 213 aa, Caenorhabditis elegans
MVHYKLSYFPIRFAGEIPRQILAYAGQKFEDHRIPQADWPALKSTMPFGTLPVLYQDGKPLGQSHAISRFLARQFGINGRCPWEEAQVNAIADQFKDYLNDIRSYNLVKMGFAQGDADALYKDTFLPNFKKNYQFFTNFLKASGSGFLIGDSVTWVDLLIAQHTSDLLSDSGSVFAASQSLLDEFPELKAHQKKIHSIPNIKKWVETRPVTPF

SEQ ID NO: 5381 - protein, 431 aa, Caenorhabditis elegans
MGIDSYNPTVRARLANASKTRVLSLKESALHRIPDDINSLACLEVLNVSQNKLTELPDLSQCVSLKTVEAIENQFIIFPAGVCKCPNLETCLLTENRIEKLPDEIHSLRAISVILNKNRLLSLNTANLLRCERLRAVNVDDNQLNRDEIEQFLVNAPREIRISFERNVSQMHTTDLQEMGNDSSKTKSIGKSGPSTSTVNKHLEMASKSRILQLKGTGLKKVPDEIEPLADVLRNLELSENKIREIPIFIGQFSQLKQLHLANNCLEFLPDELGSMKKLEILNLAGNKLKALPDTIVGCTDLKTIDLSSNVFTVFPVAVIGCLQLDILNLNGNQIESLPDDISNLKVIELSLNQNRLSSLNPSNLAKTTRLRTLRLDENCLEKSEFTRDLLESSTISVMSYDGNRFQLKDFQDLPGYDAYQERFTATKRKI

SEQ ID NO: 5382 - protein, 204 aa, Caenorhabditis elegans
MSIMSYTGGTVVAMAGDECVCIASDLRIGEQMTTIATDQKKVHKVTDKVYVGLAGFQSDARTVLEKIMFRKNLYELRENRNIKPQVLSEMISNLAYQHRFGSYFTEPLVAGLDDTNKPYICCMDTIGCVSAPRDFVAVGTGQEYLLGVCENFWRENMKPDELFEATAQSILSCLERDAASGWGAVVYTITKDKVNVSTIKARMD

SEQ ID NO: 5383 - protein, 369 aa, Caenorhabditis elegans
MSKFYGVAHGFKRGVFTEWAEAKKQIDKFPQPVYKKFETEEEAQKYVDDRKPKKVESTFPESTHDTYYAVARGHSVGVFTNYNEVKEHIKNYPQPLHKKWSTLEEAIAYFHKYYEGKEEAKKAENEEKPDKSEKRESKRKADQEESVEKKKKKKFKKFATEAEARKFVADNMSVPGSKPVTPAVSTSSATRKRTHEGTKFTEAKKMKTEEEVIDPEFANAPVVYTDGACSSNGTKNAKAGWGVYWGDDSEDNEFGPVYGAPTNNRGELIAVQKAIEKAIEKRLPKVVIKTDSNLLVQSMNIWIHGWKRKGWKTSTGSEVLNQDVLMKIDNLRQKLKVKFLHVRGHAGIDGNEKADELARKGAQMFIKRS

SEQ ID NO: 5384 - protein, 752 aa, Caenorhabditis elegans
MGIAAESKQQSKLLKAQTSKKRKAVAASKARTPEGSGRGKKPTTPNGVANPTKSKTKVSTASTMNEKKGASTGDMKKKEPSSRKKPSPMKCFANGEIVEGVNQFKVLSQIRKSSRLLDHDVYVVKDVEADEEYRMKVARKDLQILKIEAALLRRLEKIPGDKCFVSLVEYGNVSKDKLEFLVVSSYGSTLQEILKKTINGPLSMDCSFVVGLQMLRAIQNLHSLGYVHRNINPSAFNCGLGMDETSLYLQDFRQVRKFEENKKHVTARSTVKMFGCGRFANRACQNSKDQGRKDDLESWIYTLFYLIDHGSLSWKNEADSQIVVQQKDLFMTGDGKEQFSRAPRGLAPLLSKVNGYEFTSAPEYDSFKNLINGIQTSQKLNKKSCDWLGKCGLDEIGGDTDRSVDCRMTGDRDFVPKGRNRKDQQERSLQKEIWKVINLLGSGGFGDVYKVHRESQPITKCYALKTESEEGEKRYLRLKIEVTVMMKTAEKKKENKFKNFIEFVDRGKCEQLKCKYVVMGLVGPSLEDIRRKYLLGSFSKHTSFNVAIQTVTALQDLHSIGYLHRDIKPANYAVGLEDREDTVYMLDFGIAKLYVDENGEHKVKRKKVKFLGTLRYACRACMMQQEQGRKDDLETWIYLVFDLMDESHGMPWRSLCSPKEILKSKNEFFTNFDSSSVSATLKRLKGLVSYVDNMQYETTPDYDYIINFLKTTATEAGAKISKKLDWIGKLKNKEFDSESDRSDKKASGEDDE

SEQ ID NO: 5385 - protein, 1154 aa, Caenorhabditis elegans
MASQDSDEALPANYKDYPDGSLLRVVFHNFLTYEHTSFLPTASLNMILGHNGSGKSSIICGICLACGGSPKSLGRSERIVEYIRHGCTEGYVEIAIADKQKGPQVVRLTIRVGEQPKYRLNDSATTQSEIADLRKHYNIQIDNPCAFLAQDKVKSFSEQSSIELLRNTEKAASADLDQQHIDLMKQREDSTSIEDKCTTSENAIKRLEDEIGKIMPLVENYRKKLALQSKLRLLEKKMKIMEFEKFDREYKAELQNMDGAMIEYREVEKSIAECEKHRKNLEDRIKKDRSQISQMQRSCNEILAKVQEKGDKKLMEDMMQRAKAKLESAKKAADQHEKDVEKARKMIDQARARLQEAVDTLNGYEEFQSEMKSLEQKYSTAERDSRQEEDAIQKKSYEMRQLENKKRDEEQNSQLNRQDRYRVLQNFSSDASKAYRWYQQNRSQFKGDVYMPIMDMCGKSQNLPSSAYSANLFFQYLPSTANSANLPSSSNSANSAILPCLTNSEKFDIFNVFWSTKTTEFLTHIWFLNKFRVMVLKTPEAAKALENSVGVRDRTMFVCCYKEDELLINGKQHSWRINTSVVPAEKIYSEDIDAQLPSELSRLGFKYLVSNCFDAPAPLKQFLCNVSGLNRIPFGGSDVEKKIAEVSQAIEQTRYSVFLTANIRCQNSKSRYANNTLQSQSATREANTWRDQFFKVSPVAKRTDNSILEEIQKLKAEIDIRSEQLREKRGAIQKERDVLRQEQMQWKSKKQVHTKWKTELASEMAKLEALENEVVDISAIEEEYANVEKKAILETKKMLENSIRWHKEIIDKHRLIGIFELSESICKSRVNKSNSEAETHRSKLEDLKSVKDAAEDLLKTALNHKKAAASALMKECSLKTLDESKMSPAENKIYSSLVKMFEEADVPTDMNTLDQAITSEKTRLKLAEDSGEDGSIVHEQRLKVLDDDLVLEKTRQEKLIENRARIHDKLGDEINNWRKEVETMIEQINVNYVQFFDSLGCRGEVSLEVPENPLDIEKYGIMIMVCFRKGESMKRLDNKVQSGGERSVATMLYLLALQQLCPVPFRCIDEINQGMDPTNERKVFDIMVGMWNGTTGTLSKTQYFLLSPKLLHGLDMRENVNIVMVNSTLTNSHGKHYDTSAKIDATFAKMGISA

SEQ ID NO: 5386 - protein, 644 aa, Caenorhabditis elegans
MTDSPSPIDSSFDASDVATPCTVIAAKISLRNRNGLEEDQENLDSFDAFTETHETQESKNIAHGEHEEDVSNIYVDDFSKEFGDTVSSVMEPLPKPLTFARTITKVYCHLDDQEHPYMVEVHVPPDCITLRDVKRKLMRTNFKYYCIALDPDTGLEVKAEVRDDSRRLYPLKNGRFELYLLTVEGSVHSDTSSGRHRRKQDGSSKGSSGSREYLRAAHHYDNPTPFSDDESQASSLPTYVKKAHAYNRKHAPQAYERHLPHMKHNNRHNHHRQNHYEESTFDVTTESDDHYRDGVTYYDEDEDDSRSINTDLTSVSQVHLKQKWRQQQKEMRNKWKRMPSISTASSSFSSITESSMGLEVITVRLNLETIPLGMTPSGHTNARGDAGLYVGDIQDRGAVALDGRIDIGDMIVGINEISLGNYSNKEAVQLLREAVQRQYLTLTIAKTGDPKQNAFPRNPRAEPIRPIDPNEWVKHATNAMKAMPSISEGSGLDIKDRYWFKIPIPMSFLGTDLVEWLVKHVQGLETKKKAREFAEEMLKLGYIRPGVGKQSFTKECYYVMGDECADYTQLRGPDGGYKYPQSHASSASGHSSNNLIFPPSMYPPQPPTAGAVQSSKFGHSTFFNDWRIRITTGVSISSRKGICQ

SEQ ID NO: 5387 - protein, 1409 aa, Caenorhabditis elegans
MHDRGIPGLLPATKASDKQKKAVIRFREHEGRADSPPSNLNVRRDSKTVHIDEVSSPQSLDYGDSDDSSDDDEIQYCDCVAAALQQSLPGTPGRKGIIPYMSIYDTQQQARRRGYWIPGVPVNAKIVKVERNTDRGIHFINTLLYTIELEHGQFRWSVIRNYKDFTLLNNRLMAHRAREQFMAPIKRTQERFDNYLEHMGIDIISDHKPECPYSNQSSKRKRHPKVSLRVFYLIKKFKYLQLQVLKRDSDGIEESKNTSAPLASVESPGEVEDAFKKEVHMQQAVQSGILDETVNEANTSEGTPKRQRRQQRKKDRHTLPRFPMMPDSMVTNLEHRKELLENWLQMVLHIPINRNHHETAEFLEVSRYSFVNELGGKHTEGFVKKRPGGSRVFLGWKQCCVRYLLPWSKRWLMVRDSFVAYMDHRTEQIRMVLLMDRDFKVAAGGKETEGIPTGLIITNSQHELHLKCRRLQDTATWKYIIEQAMGGIGNTWLQPHRFSSSFPVRENCHAKWFVDAKTYMEYAADMMELAREEIYITDWWLSPEIYMKRPALEGNYWRLDEILKRKAEQGVKIFILLYKEMEMALGLNSIYSKRTLQGLHENIKVMRHPDHYPSTGTFFWAHHEKLLIIDQLISFVGGVDLCFGRWDDHRHLLTDLGSVQYSGAHQVATNMASGLRSLMTAPLTLSPLGLEEHEKVTPRNENGGKNGSVKRVAVEEINEVDEPKEVTGRTQETELTDNEDISEDSDVKKIMEETIFTDKETGGVVVRTLNRFPVDEAIRHSSPADPQKNWKETKTTVVESTSTSGGVTSKTTTTTTTTRVVKDNTLEKEKNKKELRRAVTSLERQRKHVPREILDKAGPAPSMIEKAAKSGMDFASAAEKYKEYVASGAVQKEKHRAQTPPNRRKAKKDSRITRAVGAVGNWKSNRAKRKWKQMLESDEATMGYELDWLRLREMDEKGDGDDEIDGGAKLWYGKDYVNYIAKDFVEVDMPFHDFIDRGSTPRMPWHDIHSVTFGAPARDLARHFIQRWNATKTEKLKDDKNYPYLLPKSYENVRVPRVFKTANASEMVNVQVLRSLSNWSGLINQTEDSIQMAYLSLIANSKHYIYIENQFFVSMIESNDVTNEVCKVIYNRIVRAYKEKDNYRVYIMIPLLPGFEGDVGAPGGSSLQAVLHWTYQSLSQGPNSLIQRLKAVMPDPFKYIHVGSLRTYDQLGQKLVSELVYIHCKLLIVDDEHVIIGSANINDRSQCGNRDSEVCCVYTDVVKERSVMDGKPFEAGRFAKSLRMQCMREHLGLLPDSRRKAKFPYAVSCDDPVADSFFVDVWQSTAKSNGQIYEEVFRSYPTDFVETFEEFQKWTSQIPMSEYSPQQAEERVRDLKGVLVDFPLNFLCKAVLTPGITSKEGLVPSAVFT

SEQ ID NO: 5388 - protein, 367 aa, Caenorhabditis elegans
MSARTTLYRAPNYYSTNIIEHKTYSISKNTVNKSKMAAPAESHARLDGRFWLEGTPYLAEENVGAGAYGVVCKAMDTRNKKQVAIKKIPRAFTAHTLAKRSLREVRILRELLHENIIAVLDMFTAEGAHGKDIYLVMDLMETDLHQILHSRQTLMEQHFQYFFYQLLRGLKYLHSAGIIHRDLKPSNLLLNGDCLLRIADFGMARAYASASTVRDDANVGGHMTQYVSTRWYRAPEILFSMVEYDTKVDLWSAGCIFAEMLLRRQLFPGKDSVSQIKMIVYYLGSPEEEVINRITSDLVRDSIEACGRKTPLPFSAIFPKASPEARNMVSYLLQISPWKRYSADQILQHPFMAQYHNDQYEPLCPPR

SEQ ID NO: 5389 - protein, 473 aa, Caenorhabditis elegans
MLHDVIYMLLISTVAKEVKTESLVDPAHCEYNSNHRKSILTVSFNLNSFLYALGLGGTHTFIFAQLFKKLICNEFHDLLQDYDKTMVPSNNSVQVSVELTVQDISSISEISSSFIADVWFSQVWYDPRLEYRNISCKTNLSLDSYVSERLWTPNVCFVNSKSTQVHKSPASNILLIIYPNGTVWLNYRVQVSAPCSFELSRFPIDAQECHLVFESYSYNIAEVRLNWQQWAPVTMPPPEDFRLPDFQFYNVTWGKTSNEYTAGMWDQLKVTFSQTFYRFKRLYGYYVLQMYLPTYLSVFISWIAFWIDTRALPARITLGVSSLMALTFQFGNIVKNLPRVSFVKAIDLWFFVCVAFIFFSLVELAVVGFVDKITEIKRRSRRIKFQRAIAGGTIKNDRPVSFRKYSCTSKCNSVRYNINNNDDEELYNISGETNGNGVSWKNNSSREASADMGARVDSFAAKAFPAMFAAFNG

SEQ ID NO: 5390 - protein, 439 aa, Caenorhabditis elegans
MAISYKQLSMIVNGSTEYRKAIKSRRRGNKINGESTDRTKRQAYLDNNYPATIWKNGVAFMFHESLTPIAKTAILKAVHFWYRETCIEFHPRTFQKEYLLFIGNDDGCWSTVGRDASQGKQVVSIGNGCEHFGVTSHELAHALGIFHEQSRFDRDESVVFNPRVVERDLLFNFAKISPRQMSTYGLPYDIGSVMHYTPTEFSNIPSIPTLAAIDTNLQQTMGQLEGPSFVDVHIMNQHYQCQEKCPTQAPCQNGGFTNSRNCKVCKCPTGFGGAYCQLIASSFSPFCGGYLNAEETTRRFDITIRQSTTTRSKTCVYHIKAPEGKRIIIDILKIDSKCIEGCWQDGLELKMKKDFRPVGYRFCCPESSRRKVISEGNMVPFMVFSKEHDFSVSFEYSFVSTSAGFDDEKNDSDVIVDNLDGVFVSDTSLLQRIGFRRQL

SEQ ID NO: 5391 - protein, 761 aa, Caenorhabditis elegans
MAESPPPVDSSLNAPNVGSPTTMMERLRLRDQTEENGKEDDFDNKSVSSAQYSQTSEATTAVKQQPFLHTMTKVYCHIDDETDPYMLEVHVPPDLITLGDLKRVLMRTNFKYYRKALDPDSGYEVKAEIRDDSQRLTPSPNNLFELFLLTIEGSTHSDGSSGKMRKYPSVPGPAPSNRNGPPMNYQHAAYQFDNSMMSTDSESMISAAIPGYLKSAAYNRRFPQHYLGNPLGNLKILNNILPSSKASDDKENSGSQQQPSTGKKLKKSRSKSRVEPESEAPFRLKRTLTDLTNNHTPAGSTWRQMVSNALGGPLKKRLSEGALLFPGTSKASDDCNDEEGDNTKTTTKRRFLQRRKQSEKSAGGANGKESGGGSASSSFFGALIRLSHSAASLTSLTSLGGSKSRSASPSPSRHRRHLEESTIGSESDARVFSDDDDRGSTTTDFTSVSRQHEKMAKKKKNKRNFRKPSRASSFSSITESSMSLDVITVNLNMDTVNFLGISIVGQTSNCGDNGIYVANIMKGGAVALDGRIEAGDMILQVNETSFENFTNDQAVDVLREAVSRRGPIKLTVAKSFENGQSCFTIPRNSREEPVRPIDTQAWIQHTNAMRGMPSIVEGSDLVEWLLDHVEGLRERKTARNFAADLLKLKYIAHVVNKVTFTEQCYYVLGDECSGRKVYIYSENVKVFVYEDGNYARFRNEDGGPKYQWTIGMNGMSAGNGSSVMLPPPHLPGGMAGPPGAFKGMAPSMVSDGESRMYVMHI

SEQ ID NO: 5392 - protein, 314 aa, Caenorhabditis elegans
MAFVYLPTILIGLLGNLLSLYAYSRKNRKSMVGFLLYSLSVSDIFLLVFALPLFSIMYLPIWTDEQRSFVVAYTAKYVYPLCMMAKTCSLYIMVLITIERWIAVCRPLEVQIWCRYTTSSYSIAAIITFAVVLNFARFFEFEIEYIDGLAFFRRDLLDSEKHWWYFMFYFIIISIIFDYLVPFVIMFVANMLIISELRRTKKERSLMTIQQQKEQNTTVMLLVITIFFGFCHFFSMALKLAESFVGKFLTIQNIYLEMLGEIFNYLIIIHTASTFFIYYMFSEKFRQIIKGIWKKIANQSQKIAMSSQNITNFS

SEQ ID NO: 5393 - protein, 219 aa, Caenorhabditis elegans
MLTFFHNSKKCAKYQLSKLWKQSSEASTSDYRVAVFGAGGVGKSSITQRFVKGTFNENYVPTIEDTYRQVISCNQKNVCTLQITDTTGSHQFPAMQRLSISKGNAFILIYSVTNKQSFAELVPIIEMMKEVKGNAIAETPIMLVGNKKDEESKREVSSNSGQKVATNMECGFIETSAKNNENITELFQQLLALEKKRQLALTMDDPDGKNGKKKGCHIM

SEQ ID NO: 5394 - protein, 597 aa, Caenorhabditis elegans [sequence omitted]

SEQ ID NO: 5395 - protein, 1200 aa, Caenorhabditis elegans
MDQLEHLSLVSKVLSEVENHFGVVEKDVAEFVIHLAQENPTFDKLKKALDSQGLGDQFDDSLTATILRIVQSMTAVKKKNKKGGDSKEDIKDSHKITLISDAKEEIKARLPALAMANTAKEKEDNEDDLMAQLEKMEGRYESEKRLQKESDSKRNRSRSRSRSRDRKRRRSRSGDRDRRRRSRSREDRRDRDRRDRDRDRDRGRGDRRGDDRQRDRRDRRDDGGARKSEVAEIGKIYDGRVNSIQSFGAFITLEGFRQKQEGLVHISQIRNERVQTVADVLKRGENVKVKVNKIENGKISLSMKEVDQNSGEDLNPRETDLNPDAIGVRPRTPPASTSSWMNPEASGVGQGPSTSIGGGKARVRISTPERWELRQMQGAGVLTATDMPDFDEEMGVLRNYDDESDGEDIEIELVEDEPDFLRGYGKGGAEIEPVKVVKNPDGSLAQAALMQGALSKERKETKIQAQRERDMDTQKGFSSNARILDPMSGNQSTAWSADESKDRNNKMKEMPEWLKHVTAGGKATYGRRTNLSMVEQRESLPIFALKKNLMEAMIDNQILVVVGETGSGKTTQMTQYAIEAGLGRRGKIGCTQPRRVAAMSVAKRVAEEYGCKLGTDVGYTIRFEDCTSQDTIIKYMTDGMLLRECLIDPDLSGYSLIMLDEAHERTIHTDVLFGLLKAAARKRPELKLIITSATLDSVKFSEYFLEAPIFTIPGRTFPVEILYTREPESDYLEAAHITVMQIHLTEPPGDVLVFLTGQEEIDTSCEVLYERMKSMGPDVPELIILPVYGALPSEMQTRIFDPAPAGKRKVVIATNIAETSLTIDGIFYVVDPGFVKQKIYNPKSGMDSLVVTPISQAAAKQRSGRAGRTGPGKCYRLYTERAFRDEMLPTPVPEIQRTNLASTLLQLKAMGINNLIDFDFMDAPPLDSMITALNTLHTLSALDGDGLLTKLGRRMAEFPLEPSLSKLLIMSVDLGCSEEVLTIVAMLNVQNIFYRPKEKQDHADQKKAKFHQPEGDHLTLLAVYNSWKNHHFSQPWCFENFIQVRSMKRAQDIRKQLLGIMDRHKLLMVSCGRDVSRVQKAICSGFFRNAAKRDPQEGYRTLTDGQNVYIHPSSACFQQQPEWVVYHELVMTTKEYMREVTAIDPKWLVEFAPSFFKIGDSTKLSTFKRNQKIDPLFDKYADANAWRITRVKKRIYNPNK

SEQ ID NO: 5396 - protein, 1422 aa, Caenorhabditis elegans
MRINRWIWWATVILLYLRTGLAADLSSEENDRKSSDDLDNFNSTKIEPDKPKTAKELGVKSCESNQDCVHDGVCHRGNDGHGICMCPRSCPAITPKQCGYNYRTPSTCLLMDADYRSKYDVKEPTCYSRKCVCPPQFDDVHVTANQKPLRLNSTLLPTKCDKRDLAVVARAHPSTSVSKGIDVTLFCCINVDPEGFIDVASVFFIQNGTIMREATSHPFAPRNGLARRVHEKYSCWELEIKNAQTSDSGSYMCRVTASASDLDVTDTMQFEVKAPRQIKNLTVNPSERDAIVTWESEGGEDMAIDLRLVRRTDTRGQVVFSKDNLTSPVSIKDLRAATPYTLFVSGNNGQVPFEFTEHFTTKQKRPFPPKEEDVRVLNSGSALSCEVEWKSPAEPNGRITKYFVSVRGAMRKSDGSLTPDDLPAAVEVDKRCANWDGDENTSKHNGINPIDFANEFYSCKFGPLKPNRNYTVTVWAENSAGRSLPAVFHKNCVTNYAQPDMVETPQPLLSNNHSTFSLTFPQPPDDINGPISCYYIAIVPLPANVSLDILPKSEEIVMHSFSKVFTNNLLPSSAEEKRFFAYIAESYVQLPEETTIGDGVRVSDLKACNVQYLSRYSSEDLALRRGLKYTGFLIVRVDKEEELNRKDVRNGADPNIFRNLIDKSVSPTSRTRTASPMSRHLRQLHLSGPAYGYSAYFKPILLDTESSSSGFGIFMKIILPFLLFLAFATGVTMFFVNRKGHMLSTWCPLFTKMTSKDVVERTLLKQTFGAIPVDDLPTEYVVRHRDTDFLFAQEYESLPHFQLDTVASNRKENAIKNRYNDIRAFDDTRVKLKKINGDDYSDYINANFIKSWKEKKLFIAAQAPVDATIGDFWRMVWEQESYLIVMVANLTEKNRQQCAKYWPDEQITRYGDIIVEPASFSFHSDYAIRAFDIAHIGECGPDVIPNGNGVEYANVPIVKGQFANNSRRILQYHFTNWNDYKAPECSTGLLRFMYRLRELPQFNNSPVVIHCRYLYFSKIHQLIVNLSAGVGRTGTFISIDSMLDQCLAEDKANIFEFVCNLRRQRNLMVQSLEQYVFIYKALAEWHMYGDTDEDVRDFEDHYQRLCASNRDRAVSFNQQSSTNGSISPRVAIVSSRESMTTSNGETGLEEEFKKLERNLTTPLSSNFAAKDENLLKNRYEAAVPFDKYRVILPPTIGHADSSYINASHIKGYFFDYIAAQDPVSEGTAFDFWRMIADQNVTTVVMLSDETDWSDVEKYWPIDGSGTECHFGSERNSVNVTCVSEEHHQDFIIRNLSYSMKDNESMPANQEVVQYSYTGWPSDSIVPKSANSLMNLIEMVLQRQSSLMGSQAPIVVHCRNGSSESGIFICISLLWLRQKAEQRIDVFQTVKGLQSHRPMMFTRFEQYSFCYRALADYISKTYR

SEQ ID NO: 5397 - protein, 145 aa, Caenorhabditis elegans
MDSLKEAEIREVFREFDKNGDGRITRQELEVALLQLGEKASNSKIETMIEQADLDGNGCIDIDEFLNVLRRQICDPKEERELRDVFNVFDKNGDGVISIDDLIFVMCQLGEKLTETEAKEMIKQGDLDHDGMIDFQEFVNIIKGQ

SEQ ID NO: 5398 - protein, 658 aa, Caenorhabditis elegans
MSKDQSSMLFFKDPENKNKNHVSHVEIGVPDPIEELQKLQNRPEPCTVLAVITTLVILVLLIFALGALGLHDISAFKWEPKPQKALRIMLDLPCQTKECVKYSAELLELMDSSVNPCENFHHHEKPDHRKAVNVVRRMLSKCAMGKTEEIHQVGRLSSIILPGLPFPLLNNSWTKPSDPISTSNSSTTYSYPFLTKILAHIILHNPDDAGFVGIKPSSDSEFSLFVVKPFSPVLTNFKFRNMYDILKRNAPESSTNGMIDLEFDRQRQLNDVIKLQTKLEKIEFKADPEVVNLTEIQRQMPIIDWKRLIDSWIPNGYAHLKEKVYGFNTSYYEEINAIISSTPSETIYNFLFLRFSFKFLRTEVASDLEDTCLHQLSTTIPGKIVLYGSEEPEALNLLNGMLHTIKDQLKRSLATLKWMDSRGIEEAQKKFNKTKTVFGFTGEDLIDELVGKITPESNYISTLQNVLLWQTRNMFKSVAENNVTVFLNSEVFYSVEKNEITISRALLHYPFMSANLPNYTNFATIASKILPQMIHIFDERGRFYDSDGNHRNWWNTETERYFQIIVQCFDGMMQNVFGVSVSIGWNAYDSTKEPYATLPGIQQSSDEALFFYSMVKTMCTSDPDNVNEALASVPQFNSAFKCNNGTKMNPPTKCKLAS

SEQ ID NO: 5399 - protein, 458 aa, Caenorhabditis elegans
MDSQKLRTEGTRVIDIVADYWYGLRKRKPLPNVKPGFMTALVPSTPPEAPEEWEKIYGDLEKVVFNPATHWNHPHFFAYFPAGLAYHSIMADILSSGLSSVGFSWMACPSITELEKVEEIKSNPSIFKWLCNSLIGKLVFDLLTLNFSGPNGNGISYDSTDVITPFYHDPRVFQHFVMYFCDQGHSSIEKGAWLAGVRYRKLKAYKKYLGNYGLDPDALRKAIKEDSDRGYIPFMLVVTVGTTSTCGVDEIEKLTPICKKEGLYVHVDSAYAGISVFRKNPTIQTIKGSYALCEENRYLVRGVEDVDSYNTNLHKAGMINFDCSPMWFKNGIYASRYYNVNPVHLVHEYQASATDYRHLEIPLGRRFRSLKLWFTLRNWGVENIKNYMRQVEREEHSNAENERLCNAINKDCRIHIIPSSVHDVFLLRFAVGSPMSNIGDARYAKKVIFEITKKLFKK

SEQ ID NO: 5400 - protein, 336 aa, Caenorhabditis elegans
MCSFFSSFPLISEDLYSRHLDWGCHNWVAVALGHELYLWNTETYNAPTNEGLITSVRWSQEGRYISLGYASGAVKIYDPNRPKTTEYVRELRTLRVGGASRCASIAWRKQGVMTCGYKSGDIVNHDVRISQHVVSSWGGDNGHCRDVTALEWSADENMCVSGSSDRTAKIWDGRHVRGSTVIQDPEPMFTIDEHTGQVRTAQFCSFRDGILATGGGINDGTVKLWDVKRQFQKVRELNVCETGGVGGIVFNRPYSEMLTASDDGFLRIYRFNANYKLSHEIQASNEPIMDLVGSPFDEVLIGDMEETLKVFQLFNVDKSTNILDRTAPKNVGLNVR

SEQ ID NO: 5401 - protein, 228 aa, Caenorhabditis elegans
MTEAPVIQLSIDYRVRRYKVFKKLEDGEFGAVYAVRDDAGEEHVLKAQLNTKEIYSLRIELCVMTKVSEKSPSHMPTLIDKGRHDNFNYIVMKLLGKSLQDAIKTGPDGHLTFGLCDWGIVSMLGSIGRFALEFYMLVDFTNAALPWKNVNEIGEIGAMKKNSRFQPIMGQFLAGCPDEFRLIMNYIDSLSFFKEPDYEMIYTTLQKVMLDKDIEEFPYDWEMEFGVD

SEQ ID NO: 5402 - protein, 386 aa, Caenorhabditis elegans
MFKVPRKLPISAISTFSTTGSISAQQQPRVFPLQHLNENEKKLVEKVKNFAQSSVKPLVREMDRDARINKQLLKKAFDLKLMGLKIDPKYGGSGVSFFELVLAVEELSKIDPAIALIMHLQNALVAPLIEEFGNEELKEKYLKKLCKDSVGAFALSEVVSGSDAFAMQTVAKKDGDHFILNGSKWGISNAPIADFFLVLANADPEKGYRGVTCFIVDRDHEGVVLGEQDDNLGMRAGTIAQVHLNSVRVPKTSIVGEYGKGYKYAIEVLNASRIVIGAQMGLQHQIAKIQTEIEAARLMVYNCARMKDCGMPFVKEASMAKYYAPEVACKTTKQCIEWLGGVGFTKNFMAEKFYRDAVVGGIYEGTSNIQLNTIAKFIDNEFKHRI

SEQ ID NO: 5403 - protein, 543 aa, Caenorhabditis elegans
MSAVSYSMHRTTTTTSSSSHGGVSAGHAAEEFVASAEREKQEMQQLNSRLEVYISRVRQLEDRNKELVIELDTLRGSLGNDIGQIKFKFNDSLVKVRREISEAHSGTIGVEVKVDRLRDDLNDYRHRYEEARREVEREKTTWGGAISQAQAELDTNKSRYAAILDEEKRLYAEQDQLYLQLAAAKDELDAAIVDRRRLQAEEDDLKIELEFLGRIHSQEITELRTLLAQAPADTREFFKNELALAIREIKAEYDKIIQTTRVDLETIFQSKISAVESSIVSKNEAAVFRQEEIRKMNESITTLRAKLSELEARNSALEREANTLQIQLGEDQRAYESELHKRDNALRFMREDCQTLIAELQALLNTKQTLDTEIAIYRKLVESEEGRFTHVGQGVVVAQQETTRLVPVEQDHWDSGEVQTRSSFKRHAKGNVSIVECDPQGKYIILENTSGSVAEDVSNFEIRRVIDGVQAFVFRLPSHLVIQQHGHLKIYGRNSGGINSPPDSIVMESHPSWGQGGQVETFLYNSHGIEKASHIQTTVASSR

SEQ ID NO: 5404 - protein, 549 aa, Caenorhabditis elegans
MSAVSYSMHRTTTTTSSSSHGGVSAGHAAEEFVASAEREKQEMQQLNSRLEVYISRVRQLEDRNKELVIELDTLRGSLGNDIGQIKFKFNDSLVKVRREISEAHSGTIGVEVKVDRLRDDLNDYRHRYEEARREVEREKTTWGGAISQAQAELDTNKSRYAAILDEEKRLYAEQDQLYLQLAAAKDELDAAIVDRRRLQAEEDDLKIELEFLGRIHSQEITELRTLLAQAPADTREFFKNELALAIREIKAEYDKIIQTTRVDLETIFQSKISAVESSIVSKNEAAVFRQEEIRKMNESITTLRAKLSELEARNSALEREANTLQIQLGEDQRAYESELHKRDNALRFMREDCQTLIAELQALLNTKQTLDTEIAIYRKLVESEEGRFTHVGQGVVVAQQETTRLVPVEQDHWDSGEVQTRSSFKRHAKGNVSIVECDPQGKYIILENTSGSVAEDVSNFEIRRVIDGVQAFVFRLPSHLVIQQHGHLKIYGRNAGEINLTPDSIVMESHASWGQGRQAETFLYNSHGIEKASHILIDRFLQLLHPSSN

SEQ ID NO: 5405 - protein, 589 aa, Caenorhabditis elegans
MSSHKESSEYEMQYRSTIQPRTAVRSQSRQSGNYVSGGNGAGSGGRVLKMVTEMGSATVGGISPALSANAAKSFLEATDKEKKTLQGLNDRLGNYIDRVKKLEEQNRKLVADLDELRGKWGKDTSEIKIKYSESLSTARKDIDDAARRKAEVDVKVARHRDDLAEYRSRYEDIQQRRESDREKISQWTNAIADAQSEVEMLRARFKQLTDEEKRVTADNSRIWEELQKARSDLDDETIGRIDFQNQVQTLMEELEFLRRVHEQEVKELQALLAQAPADTREFFKNELALAIRDIKDEYDIIAKQGKQDMESWYKLKVSEVQGSANRANMESTYQRDEVKRMRDNIGDLRGKLGDLENKNSLLEKEVQNLNYQLTDDQRQYEAALNDRDATLRRMREECQTLVAELQALLDTKQMLDAEIAIYRKMLEGEETRVGLTQMVEQAVKTHSLQQQENTDSTRSVRGEVSTKTTFQRSAKGNVTISECDPNGKFIKLENSHRNKDENVGEHKIRRKLDGRREIVYSIPANVVIKPGKNLTIYARDQGGINNPPESLVFDGENTWGIGANVVTSLVNKDGEERATHTQKTIQSGQ

SEQ ID NO: 5406 - protein, 558 aa, Caenorhabditis elegans
MEAESAPQAPMSGGRVLKMVTEMGSATVGGISPALSANAAKSFLEATDKEKKTLQGLNDRLGNYIDRVKKLEEQNRKLVADLDELRGKWGKDTSEIKIKYSESLSTARKDIDDAARRKAEVDVKVARHRDDLAEYRSRYEDIQQRRESDREKISQWTNAIADAQSEVEMLRARFKQLTDEEKRVTADNSRIWEELQKARSDLDDETIGRIDFQNQVQTLMEELEFLRRVHEQEVKELQALLAQAPADTREFFKNELALAIRDIKDEYDIIAKQGKQDMESWYKLKVSEVQGSANRANMESTYQRDEVKRMRDNIGDLRGKLGDLENKNSLLEKEVQNLNYQLTDDQRQYEAALNDRDATLRRMREECQTLVAELQALLDTKQMLDAEIAIYRKMLEGEETRVGLTQMVEQAVKTHSLQQQENTDSTRSVRGEVSTKTTFQRSAKGNVTISECDPNGKFIKLENSHRNKDENVGEHKIRRKLDGRREIVYSIPANVVIKPGKNLTIYARDQGGINNPPESLVFDGENTWGIGANVVTSLVNKDGEERATHTQKTIQSGQ

SEQ ID NO: 5407 - protein, 412 aa, Caenorhabditis elegans
MLTRLSSGTTWNRIAVQSRQMSFELSDTQKEIQSHAIKFSKDVLVPNAAKFDKSGEFPWEIVKQAHSLGFMNTIIPEKYGGPGLSNLDTALIVEALSYGCSGLQIAIFGPSLAAAPICLSGTEEQKKKYLGMLAAEPIIASYCVTEPGAGSDVNGVKTKAVKQGDEYIINGSKAWITGGGHAKWFFVLARTDDNPKTPAGKAFTAFIVDGDTPGITRGKKENNMGQRCSDTRSITFEDVRVPKENILGAPGAGFKVAMGAFDLTRPQVAASAVGLAWRCLDESTKYAMERHAFGTPIANHQGVQFMIADMAINLELSRLFTYRAAAEVDSYGVSSYNASIAKCFAADTANVAATNACQIFGGAGFNCEYPVEKLMRDAKIYQIYEGTSQIQRMVIGRTLFQNFAKNGTSKMT

SEQ ID NO: 5408 - protein, 751 aa, Caenorhabditis elegans
MPVLGQIWELSDSQKVGSLDKRGAFVAFKLVAAAQQGKPVANSSLYDSSLQPPRFAPPVPPANMQHHFQPSFPSVGRAPPVPPPPHPSHPYSISSQQSSPAHPSSAFPPQWPITPTDQAKYDSIFQSLNPVNGKLSGAHVRPVLMNSGLDAHALARIWELSDQDKDGNLDRIEMSVALHLVYRSLQSDPVPAQLPPNLIHPSKAMYAHSSPNFAAPPHPPRPMMGSRAGSVTSLDDVNMSQSYSATMPRAYPPQPGRAYSAQAHVNGSRTSGASTPISASHSIHSFPAGEWPINTGDYADQFAQTDTNKDGLVDGMDMRAPMMTTGLSAQILAHVWALADIKKCGQLNLEQFALTMHLLDMAKRGESIPSELPLHLIPPSFRPPTEPSALHHPAQSVSTPQLPEATSMEIKEALEGENEEMKQLAESIQSMLVERKTAEEAVLQLEADMTIKNSSIKNLQVELATLESTVKQLERQKGEATRRLADYDTQIEQLESACKAQKETKEDTEKRMQQIDEDAKNAEDCKANDEKEMEELKKEIEMLDNQFKTVRGEIVKETSQREQKVAELTTLERKEARDQIQMEKLDAAIENTTKLTEQVSDAVEKSEEEMVQILRSQQRLLSTVIDQSLLSDDTVYGETAGTSSQNHVQQPPDPFASARANPAADPFAQVDQFGSSGHFDAAFPTDPFAQGGFPSDSGFAQSAPAKPAPPRPAPPKSARETPVNDPFAPSQGQSTQPAGFADFADFGSAFN

SEQ ID NO: 5409 - protein, 668 aa, Caenorhabditis elegans
MPRLALRQYNFYYRVNGEKAEELLKEYGEDGDFLLRYSESNPQNFSISVRVAEDKILHIKVTKYESDMLSIFEDERTTPNQFGSITELAEFYMEFPEKLREKNGLFLELKKPVYVPYHLEACAEEQRRTQLYRWWHGNLPASSANKLLQTEKNGTYLLRASQHIPGALVISAKTEGQVVHLTIYQDPSTGRFNIDGDRTKFQSAWLLIDSYSKNPIVEKGEASRVLYLEEPLFNTFIEADLFVDRFEIIRRPINPRESMEKTGISEEFDRLSQEALPAEQYLSKREGRRPVNAEKNRYKNIVPFDHTRVILTDRPNTPGSDYINASYVRFENSQRTKNVTFACEKSFIATQGCLETTISDFWSMVWQENSRVIVMPTMENERKEKCARYWPAEVNKPEVHGDISLTCTIERKVQRAVSDEVKAELEQEKTNRIAKGLVPEAELNGDGISYILRTLVMKKGKDTREIRQLQYLTWPDHGCPLHPYAVLNFLEDVDREYDYFNAQPIAASLPQGPIVVHCSAGIGRTGTVLVLDALLNQVKKVGLLCPMDVYKMVKYVRTYRSGLVQTEQQYQFLYKALAFYLKNNNPYPVKSFIDGDTDAFDFPRRLRPTPNASRPSSARQVTSSRPSSSASSRTSHSRPRTGPQAEPIFERSTSSTSSSSTLLKSTKK

SEQ ID NO: 5410 - protein, 714 aa, Caenorhabditis elegans
MSTVAKDTNCSKTSEYETVVKDPRNCKSYRESAFEWLKDNKDKWPEVMSENMYPQNVDYAAEMTGGCSGFASNVLNWPEDMILGNPRRAKKGGKLSGADALQFVFLVASPADVFLRFKQSLEETLETLSLYEEHCIHLHRHPLLICSRNSVNSTIPSSLLDMLSCWHMLLLLILDLTTAFRLQNHQWGFALAGVLVVTFASVAGIGLATWFGIEFNAATTQIVPFLTLGIGVDNMFMLLHNYRDVVKLAGGHAEMAILMRETGMSILCTSINNILSFLTGTLLPIPALRSFCAQSSILLTFNFIAILTIYPAIISIDLRRKKAQRRDFDTREESTSEASIMQQFDGITQAQMASSDDPAPWSLHSFIRYYYIPFISKPASKVAIIVGCCALLGASFVGMRQSTLGLELGDVLPEHTAPAQFLRARDKYFSFYPMFAVIKGPNIDYAHQQRQIDNYRQSIGSSKYVIKNKNEEPSEKYWLGLMRDWLISIQRGFDEEVAKGSFNLTSGTVIGSNVSEDARLAHALMCSHGSLFECAGRIGKIRLIPFYLTGLTDTAVIVDAIKDIRSVCERFTDQGLPNFPQGIAFTFWEQYLFLTGNLMQAISIITISVFCVISVLLFNPWAALMVVCILGIMTCELAGFMGLVGIKLNPVSAVTLITAVGIGVEFTVHVVVSFLTALGTRSQRTSSAVDRVFVPVIHGSFSTLLGILMLGFSV

SEQ ID NO: 5411 - protein, 1374 aa, Caenorhabditis elegans
MIVIRNWQRISYLSFCRFSTRSLSIQQFQKTPLLLVVRQQGSARLKMTSSPPEIVPQQPLDALLLNKTDTEQEIFLTKYPNYDGRDILIAILDTGVDPSLPGMQVTTTGERKMFDVIDCSGAGDVDTSITRTVKDGVIEGISGRKLAIPEKWKCPTGQYHVGLKPIFELYTKGVKSRVISERKEDVVGPSHNIAASEALKQLTEHEKVVGGTSEKTSDKWAREDFACKVDFLKSMASVADVGPVADVVTWHDGEMWRVCIDTSFRGRLGLGNVLGTFRETGDYAYLTNKDSVVYTVRVSPDGNLTEIVVPSGAHGSHVAGIAAANYPDNPQKNGLAPGAKILSLNIGDHRLGAMETGQAMTRAFNMCAELNVDIINMSFGEGTHLPDVGRVIEEARRLINRRGVIYVCSAGNQGPALSTVGAPGGTTTGVIGIGAYLTSESADTLYGVYKPVESSIYPWSSRGPCQDGKLGVSLVAPAAAFAGVPQYCRQSMQMMNGTSMSSPNAAGNVACMLSGLKQNNLKWTPYTVRMALENTAYMLPHIESFSQGQGMIKIATAYEKLSEILVNKVFPPRLTHFEINVSNHCKKSKGVYVREPNWNGPQEFTIGVEPIFQNHLSDNNLPAISFEKQIILQSTAPWVSHPQTMFVVAQERTMVVTVDASKAPKGANYTEIVGIDTADPSLGPIFRIPVTVINPEKVAVDQYTSRLVGKSGVTERRFVEVPSWATSAKITLRSTNKDEMDRFTLHTVYIEDDKCSRNTETQKIQGPIGNEWSKSITVQGGKTLEACVVRAWSRGKNPVDVDMTIDFFGVKKPTSISLIHGATNTPIRFQAAPTKSIDVSPSISLKSLVVSLKPQSAKVEPLGPRDMFLTSGLQINRLLLTYQLKVQKPSEVQLQLAGLTPYLYESPVDCVLFQIFGANKSFVGASSSYPDRWTQKLEKGDYTIQAQIRYPDDQVLQGMKELPLLVHVKLGNKISVDLAASASDATLGKECKFAGKALLPNQEMTVYAMNIADDKLPKTIVPTSGSFLAGTFSALKDSDLSDVDKSEVIYFLSEYSTRPTKGLSMVTTKKDTNQNQEMTDAIRDLEVSWVQKLTDEKAAKEFFEACLQKYPDHLPLLQNRVKQLMQAKLVDQTPENVQKIIELCGQILQITKPNETLQFSSVKQEHDDDLLTVDKWLALTGGSEDQRKDVVKLISQFEERKKSIILALQALSSLEQDIEVRKSKFDVPASLRFGGITPLIFGGKQGEVINKKSEGYEALKSKSEQIDATVSEELKKLDSNWTGNQFYVKLLVWLSADDTKTALISAKHAAALGQFGRCAKLLNKAGDELKSSATDSQAVDTSLAEVCESLEWNHLATHFKNSALIKNRTSYRLF

SEQ ID NO: 5412 - protein, 398 aa, Caenorhabditis elegans
MTESENFAQPNTESVFSSGETRDFLQFLRRIQYDHRQVPENEKGEATYVEVSVVVSNIRAVSEVTMDYALELFYRESWRDPRLQYDRKLFKNKTELALHESYTNFLWFPDTFVPNAIASKNPQRNSISHRSLLRLDETGKLLYSRRISLVCECTMDLTLFPFDKQLCKLGIESYGYTADHVVYKWSKGARTALELKKIRLPDFTIQEAYVTSQMESYATGNYSRLYVCFVFSRSSGFCFLQLIIPSTAVVITSWVSLWMETETEFQDMISIILAITFLIFSYNEMMPRVSYIKAMDIYLGVCFMIVFLSLIKLALVKYMRQKIMLTSDSGNSLREMSQMSTRQRLRARKTSNMNFRNNGGGSIPINEEHQQMLTVPNGEDKMANGDDKEANNNGSKFF

SEQ ID NO: 5413 - protein, 1454 aa, Caenorhabditis elegans
MTTPRPTHLHRRSSSKWVPPSAPLHNPISIFRGRSNRETGSRVIRPNHLFESPRYELNNYRDFTDNRISTTKYTFWNFIPLNIWHQVSTKYANLYFIFIAILNWVPFFDAYTRYVGLIPICFVLGTTLIKDGIEDYRRYKFDNQINKKTCHVWDRDRCAFRKTEWRYILVGDFVHISNNQDVPADIILLRSSSESGTCYIETCNLDGETSLKQRMVPAKVIDYSKKDSTFKPPDFTGVVTCEKPDKSIYTIRAKVEFEPGQSDVIIKENMLLRGSRIKNTTFVEGIVVYAGHDTKVMQNNGRAPHKTSGIEKLTNKFIIACFIMLLLMVLYGAITSAVWVGQHPVDEQIPFILSNTPRPFIEGFIGIGAFFINYQLLVPISLYITVEIIKALQIYFISNDIQLYDQKSDRAIDCRSLSIPEELGTVTHVLSDKTGTLTENMMIFRNCAFDETDYGSNGSQSNPDKPVKSDELYQRILTSMQNPVQKHFFANILLNNSVVVNHIPHTDVLELGNFDGGVYNIGNSCFYDVTEEKYKQKLAAIGKGGVDDDDVSRPDELGLPTTSIQFDDRLTVIVEEDTPSDSPAPDASPRDLPETPTPTSPIYRPLSSLSSFSRKLSTVVRRSILRPISDIIPVRKRLISFKQQAMNPYEAESPDELALIEGAALYDYVLLERAATSVTISTPEKAEKRYEILLTLPFDATRKRMSVIVNSQKGPLMYCKGADSAIISRLSSDSLESKRVQDLKDHLDNYAKKGLRTLCFAMKYISKEDFEDFLDSYRFLMEDATSEREKMLSEKADELETNLKLSGVTGIEDRLQDGVPDTLRALRDAGIQVWVLTGDKLETAQNIATSSGLFHPQRSLKVIETETDAEEASESAGLNIIMSPAAIRLAQDGNAHLMEALKKAKTVLCYRMTPSEKATIVNTVKKRIKGNVLAIGDGANDVPMIQAAHVGIGIAGKEGLQAAMACDFAIARFKFLSRLLLVHGHWSYYRLANTFLYFLYKNANAVFIIFYYQFYNGASGTNIVDPIWGVIYPIIFTSVQPVVVGVLDQDYDDQTLMNKPELYVIGRENQLYTWKHFFRDVIDGIYQAAVIYYVAYLTLDNSTSSLWEMGFYIATSSILVNSGHLALQVRYWHWQLVALFSFFILFNFAFFFAECLTAAAAMVPDPPVWMPIHAMGDPRFWYYQFITVIVALCPRQSIEKQNMAELNFIELQCRIMFELAFIAVLVAGAVYVFMTLRKNGFFVTVEPSVTTSPKNLDKPLTVYYKYHLGPYQNVMNVIGEAKQLLASSPTPATFFGIYYDNPEVTDSHFLQSAVGVVFGSDGNDFHSEKYSKDLTDNGFEKLVLPNVERAVQVTQPSTGGFASFLALVWFTYSTIRKYISENKLETTYAVEFYTNTEINVIFPLDNANEFLVKDYQSIDKLESEAAKKRFDSSEEDSESEPEGAEEPATEENEQ

SEQ ID NO: 5414 - protein, 1212 aa, Caenorhabditis elegans
MTTPRPTHLHRRSSSKWVPPSAPLHNPISIFRGRSNRETGSRVIRPNHLFESPRYELNNYRDFTDNRISTTKYTFWNFIPLNIWHQVSTKYANLYFIFIAILNWVPFFDAYTRYVGLIPICFVLGTTLIKDGIEDYRRYKFDNQINKKTCHVWDRDRCAFRKTEWRYILVGDFVHISNNQDVPADIILLRSSSESGTCYIETCNLDGETSLKQRMVPAKVIDYSKKDSTFKPPDFTGVVTCEKPDKSIYTIRAKVEFEPGQSDVIIKENMLLRGSRIKNTTFVEGIVVYAGHDTKVMQNNGRAPHKTSGIEKLTNKFIIACFIMLLLMVLYGAITSAVWVGQHPVDEQIPFILSNTPRPFIEGFIGIGAFFINYQLLVPISLYITVEIIKALQIYFISNDIQLYDQKSDRAIDCRSLSIPEELGTVTHVLSDKTGTLTENMMIFRNCAFDETDYGSNGSQSNPDKPVKSDELYQRILTSMQNPVQKHFFANILLNNSVVVNHIPHTDVLELGNFDGGVYNIGNSCFYDVTEEKYKQKLAAIGKGGVDDDDVSRPDELGLPTTSIQFDDRLTVIVEEDTPSDSPAPDASPRDLPETPTPTSPIYRPLSSLSSFSRKLSTVVRRSILRPISDIIPVRKRLISFKQQAMNPYEAESPDELALIEGAALYDYVLLERAATSVTISTPEKAEKRYEILLTLPFDATRKRMSVIVNSQKGPLMYCKGADSAIISRLSSDSLESKRVQDLKDHLDNYAKKGLRTLCFAMKYISKEDFEDFLDSYRFLMEDATSEREKMLSEKADELETNLKLSGVTGIEDRLQDGVPDTLRALRDAGIQVWVLTGDKLETAQNIATSSGLFHPQRSLKVIETETDAEEASESAGLNIIMSPAAIRLAQDGNAHLMEALKKAKTVLCYRMTPSEKATIVNTVKKRIKGNVLAIGDGANDVPMIQAAHVGIGIAGKEGLQAAMACDFAIARFKFLSRLLLVHGHWSYYRLANTFLYFLYKNANAVFIIFYYQFYNGASGTNIVDPIWGVIYPIIFTSVQPVVVGVLDQDYDDQTLMNKPELYVIGRENQLYTWKHFFRDVIDGIYQAAVIYYVAYLTLDNSTSSLWEMGFYIATSSILVNSGHLALQVRYWHWQLVALFSFFILFNFAFFFAECLTAAAAMVPDPPVWMPIHAMGDPRFWYYQFITVIVALCPRFTSMCLMSSLKSETSKR

SEQ ID NO: 5415 - protein, 925 aa, Caenorhabditis elegans
MRLHGTVLLVILLGCLFATSDGQLAAMTIDLGTQFLKIGIVKPGIPMDIALNTESRRKTPNVVMIQDGHRTFADAAIGMQVRYPHLVHGQLNDLVGKSTQHPSFELFKRRNTFFEVDDAPKNASSINFKLGGESYTVEALTAMILANAKKFTEEYAQAAEIKDVVITVPVYFTPAERLAVERAAQMAGLTVLQLINDGTAAALSHGIFRRKEIGEKPQRLMVYDMGAAKTTATIVEFKLVKEKYEKQPKMTVLGVGFDRTLGGIEMTNRLRDHLIEMFEKNYKPKTKVNTNRRAMTKFSKEAERLKQVLSANAEHFAQIESAHEDIDAKLKVTREDFNHLISDMESRFGEPIEQALRMAQIPIDDIDQFVLMGAGTRVPKVQEIVQKTIGTKEIGKFLNTDEAVAMGALFQAAHLSKGFKVKPFNIEEKVIFPVEVHFVSKIRDEKTEEITGEKNVVKTLFAANSVYPTHPKTISLTSYSDDFSVALKYGKIESFTKQQVQEIGSLLDNLVDVEISGLSEALKNRSSEESEFKGVKVSFIVDASGIVRVRRAEALFEPKSGLVGSIASTISGLFSSKTEEGEPTTDDSTPQSTEEKTEEKESVKVEDSTPEPEPETPVNSTSEESPKTNETEKNASSGNATEVKEKKKELPSIVRLRITNKYPSAFVPNKYDVQEEKRRMEAFAEKERLASERAAVENELESFNFECSQYLEETEFTDYMADEEKTKLEDSVKRIRAWLEDDVTKDTPTKDFTDNLLELKNVVRSVKKRQEHDKAVPEKLKSLETLLETTFSLTTLGNNVDEEKALFKKEDRDGLKSKLDKLKIWVTDVRKHLDLKKKTDDFNFTGKDIDTKTKNLNREVDRFMKKMKKITTLDDLAKDGKIDIDTIVEEAEKKKAEQDKKKEKKSTKKANESKVENESEIKTEL

SEQ ID NO: 5416 - protein, 981 aa, Caenorhabditis elegans
MARFFLFLAFVEVNSIISPPNEIIETSVEVFNQWKETRNAFMDSMEYPMGFPNFNCPQPHRKSSESVHQLHPSQIGVIAALGDSVSVAQAAKSSSILDLFDQFPGVSFVTGDDVKLNEQATFINIFRKFAPRIKGGSSDFVQKFYDFNMAIPGSFSSELPEQALKLASTLKKKLGRETSDTWKFVNIFIGHNDLCNICNNETTFGPETFGKSLHSALTIIQTNVPKVFVNIMPPINVKIHSQAHKLSKFCEFSHRKTCSCIFELNEKEYQNIKKQFDEQLNEVVEQFNQKYGNSSTFAVVIAPAMDLKSIPLLKNQPNIGLLALDCFHLSPIAHDIAAKQIWKGLFEPIDQKTITNQLSVGFDRFVCPPVECPYLRTIQNSENCEPSREMRFLRVPSAFASSPGLSMPPYMIPVFFLFERDRIEIERMKRRRKPDCDYVTEFLSESIIVDRAHCQYYQWPEQHQQFNNFNGFPQFQQQQFQQPQQFQQQPQFQQQQQNYQQFLAQQQYQPQFQAQQQPQQPQYFQPQQQQQPVQYQQQQPQQPLQYQQQPQPAPPPIYSQTVVIPQAPPPPPEAYQQQQYGPSQQNPVMVQPADIPRYHQKPQPVPQVPDVAFQHVNTARSVQQVDFDNKLFREQPNSFTQNQEKITLLAQPPPPPAPPAQTQAPLIRVPPPPARFIPTLKSLYSIDPPRPKNPSYKPDEIIVDGHRSYFEDTQRTRPQSTKTRVQSVGGSVHSSSANIPRTSQPAAVVSPPQQRTFVRPNEVKIVVLDAKFCDFASKLRYPVSTRQEFFECEKQFQQPRVVRPQPQQQLTRPAPARPQTRRPVPQPQQATRPAPRPVAPKSHLAQQPAPVTAPVAKPRTASAKFLQCCKGRKVHNSCERICSFDVLSKKVLTGMFLGTDACPQHHGLDLMQCAADNDDHTACCIDREVDKTSAGKKCLGFCNMKPGITFQADVSMLPCWSVLNDIKQCFKENLERQLAAL

SEQ ID NO: 5417 - protein, 636 aa, Caenorhabditis elegans
MNITFIFILIFGFFNTQKCSKDYDHFDDEDLALSIPKNAIGVPKEFRQQVLKEMKLRNRPNDILKNRCYCNYDQSICGNNMTCVKQDGAACYHAVEEVYNKAEKRMETLHKWGCATLERGSGASHLTCNSWRAAHHSPKSIGCCYEGNYCNKNLIPPAYVHHHKEKALQEKTDNPEDYDSPLENMTRGGKMFIMVFATVMSVFAVIGCIYLCITRAEEKSKARARAKTVSLKTESTYMESKSMLEDSGSGSGQAALIQRTVRQDLTIIKTIGQGRYGEVRKALYRGSYVAVKTFYTTDEDSWKNERDVYQTNMINHENILQFVAADIWSEEDSMTKMLLITDYHELGSLSDYLCREETLTTDEALRLIHSCICGIEHLHAAVHGTGSFRKPEIAHRDIKSKNIIVKRPNVCCIADLGLALRYQNDKILPEKFNVQVGTKRYMAPELISNKLNPKDFSQFKMADIYSMALVMWEVAIRVEVNTCEEVLTVDETSPDHSASSGIGESVSSSGNISRMHLQKTNVEGHSTSLKAKQHVPPFDGIVHNDPNFDEMNDVICVRRIRPPPDLAWKNVPALNELSKLMEDSWHSIPHFRHSALKLKKEMAELIKNPDRQNQSQRKVEFQQQDSGLVESATNQS

SEQ ID NO: 5418 - protein, 357 aa, Caenorhabditis elegans
MYTVAVTGGAGLVGRYVVQRLLENEQIAEIRIIDRQSTSRDESRKVKLYQIDLNDRKSLENALRGCDGVIHCAHSPFPIFYSKDKEQNNLMWRDNLNACESVVDTMTNLNIKTLVNIGCAYCPIPNEDNYGLAQDVFLDYPRNYMLDEYGESRTRGEMYARKAAKKGSFNGIFLRPTFVYGLGKSKKIDTIKELILNSALPFVTGERRGMHQFIYAGNLAAIAEKSFFGLIYNSKRLNGEIVFCMDENCAHSIRDFFESRFLNPNYCQEVAVSYWPSFATSYLNYWKNMLGFKIPENILNHVAFRLFFEKTVGFPNKKLRLLLNSKPEISQEEAFKLYANSKASYSKEAVKRPTVQG

SEQ ID NO: 5419 - protein, 470 aa, Caenorhabditis elegans
MKLLSILFIFVSSYSFCLAAPATDKVNDLPGLTFTPDFFHYSGYLRAWTDKYLHYWLTESSRAPTQDPLVLWLNGGPGCSSLDGLIEELGPFHVKDFGNSIYYNEYAWNKFANVLFLESPAGVGYSYSTNFNLTVSDDEVSLHNYMALLDFLSKFPEYKGRDFWITGESYAGVYIPTLAVRILNDKKNFPNFKGVAIGNGALNFPNNYNTMVPFYYYHALVRDDLYNDIARNCCNNNIGTCDIYSKFFDPNCRDKVINALDGTNELNMYNLYDVCYYNPTTNLKKAFIERQMRIAVGLPARKHNAATTVPLCAQTNNTHVYLNRADVRKSLHIPSSLPAWEECSDQVGKNYVVTHFNVIPEFQTMIAAGIKILVYNGDVDTACNSIMNQQFLTSLNLTVLGEQEKVNEAWHYSGQTGTAVAGFQTKFAGNVDFLTVRGSGHFVPEDKPKESQQMIFNFINNKDYSTPIQL

SEQ ID NO: 5420 - protein, 701 aa, Caenorhabditis elegans
MRRFREGKRALKQRGRARDGGSIQALTVCVSTIERCFTAVSNPIFFLFSTFFSVFSFLFPSRNTQIFLSYSRSFSSFSEVLKWSEHEQLDFMDKIVHRLSHYQLGKVDNFIRPMLQRDFISNLPAHLVELILFNVNSDSLKSCEEVSTSWRCALARGQHWKKLIEKNVRSDSLWWGLSEKRQWDKFLNISRDMSVRRICEKFNYDVNIKRDKLDQLILMHVFYSKLYPKIIRDIHNIDNNWKRGNYKMTRINCQSENSKGVYCLQYDDDKIVSGLRDNTIKIWDRKDYSCSRILSGHTGSVLCLQYDNRVIISGSSDATVRVWDVETGECIKTLIHHCEAVLHLRFANGIMVTCSKDRSIAVWDMVSPRDITIRRVLVGHRAAVNVVDFDDRYIVSASGDRTIKVWSMDTLEFVRTLAGHRRGIACLQYRGRLVVSGSSDNTIRLWDIHSGVCLRVLEGHEELVRCIRFDEKRIVSGAYDGKIKVWDLQAALDPRALSSEICLCSLVQHTGRVFRLQFDDFQIVSSSHDDTILIWDFLDAPPSGLPSSTNRATLPELPNQAAVARAQMLFEMAARREIERRDREVVEEPALRPRANAARRHNADIAAAAAAAEAARGAGDNDESSSEEDLDRVDQVNNPNVAGPAPPQPHNQNHRRRQPRPELPVRLMQEMAAFDNMRRQQNNMDHLGGGDVDEEMPDGGP

SEQ ID NO: 5421 - protein, 1066 aa, Caenorhabditis elegans
MKLTQLDLSHNNLSVIPTWALTYLHSLQILHLENNRIDVLRSNTFDETQLNNLQFLYLDNNQLRIIPNLAFNHLRLVVLMLANNRITEIQKMSLPQTLKFLVLRNNLLTQIPYVALNDLKTLQSIDLEGNNITHLMDTNEVTFESEMKVILRNNKVRRLDKHSFRSFRKIRELDISYNQIQTVEDSSFETVGHMQSLDLSYNRIAYLPRGMLKNFAKTLKTLKLAENMIHATPEALRDLRNLTHLNLNGNKLNRIDGDVLKGCTDTLVELFIANNYLEHIPHGVLSGMKQLEHLDISKNKIMSLKKPTSLLSITKEETSTVRRLNLAGNRINNMSDYLIFEHMPLLTYVDVSFNRIRFISPRVFEKLKNLESLFLQNNQLAHFPSLFRLDKLRHLMLDNNQIQKIDNFSLADLPKLQHLSLAGNQLDIITENMFGSSSSSELKSLNLAHNKIHSISSRSFSDLDNLQQLRLSHNNIRTITSMTFSNLRNLRYLDLSHNRIIKILPSALYQLPALDVLHLDHNNLNEIDRDAFRSFSDLQSLKLSHNAFRRFSCEFLGSISQVHQLDLSSNQINEIDIFCIARGIRKLSLASNSVEKINRKLLQDATELTSIDISHNGIIDVDSDAFCECRKLSHIKLSHNYIRNLWKGTRVCIPWISHLTTFCFFTKEHLERTISFSYIIVDSSQLTSFGNLSILSFANNKVDSIEDGAFENLLSLKILDLSNNPVTSWSPTAFRDLSHSISSINMANTGLFSMPKFSHRSIQSLNISCNKIYELSEKDLAPLTKVVALDISHNNLKQISSMAFEPLIHLKQLNVSANPITHLTNEHIQQLYKLYNIPDMARPYQISSILSNLPPLHTIYVDIKESALDRQFYTADTRLLRHLVVAGRNLTKIEVGAFATIRGFRVRIEIHNSSIEEFPSRIFDTLTGISILSLSLTDNKLTTFNPFQSTVAPAVNQHGTILHSLELKNNPIKCDCQFKWMDDFIRVTKFLSDHHISHDFDKVECADAQSSNLESFASAANELFSYKTKMTLLSKSEDFGLECAVKYSNPLKPLIYVLMLVCLSYL

SEQ ID NO: 5422 - protein, 429 aa, Caenorhabditis elegans
MLYFNQKYFSVKHTDNGTVELPKGKIVGCSWQVIRKLGEGGCGSVYLVKNLEDETEAAMKAESNGAAGGCVLKLEVAILKKLSGKPHVCQFLFAARLTDFTYVIMTLLGESLNKIVKRIARQITVSSQVRIAANVLFCLKQIHDIGFIHRDLKPANMALGYKTNNDECRFFHVLDFGLARQFVVSQSDQPSKLMMRRPRERSLFRGTTRYCSIRMHDRAEQGRVDDLWSMVYLLAELRGPLPWSSQSDKRVVGEMKRLHSDEVVLQNSPMEFLEIAKYLRSLTYFHRPDYHKIFMLLISVMSKGKFAWNDPFDWEMPISTTPSKSTPSKSVTKSPAQLSKETVKKASREKTLSKEKTSKEDIKTARKTSIEKDVKEKLSKDMASKEKISLSAEKINMSAEKIEEDNKKEEYMRMLPFDPDFFASDPIGF

SEQ ID NO: 5423 - protein, 320 aa, Caenorhabditis elegans
MLKPLLAIFMISSALSIPLNRSDFLENDHVELMPLEKDGELNDKFRQEMIFSHNLDPSDSKQLSESIKEMFKKTDVNDDGFLTAGELKQQIRKNMEEHLEKSKNDSEIFFDIVDTNKDGSIVWEEFEPHFSKMHEKDHSDSELMDVHTEDPHRVDDEKRMFNRSDITRDGRLDRMEWHIFLHPEYSAQGLVEIVNDLMGVYDKNNDEVVSQDDFVNGIPGTVDELNPEFENMEKLEKERRLREFNEEIDENSDGKATFRELYDYVDPQNFRLASKEVNDIMMLTDANNDEKLSLEELLERDWLLARSSLLSARSSLHDEM

SEQ ID NO: 5424 - protein, 424 aa, Caenorhabditis elegans
MLYFNQKYFSVKHTDNGTVELPKGKIVGCSWQVIRKLGEGGCGSVYLVKNLEDETEAAMKAESNGAAGGCVLKLEVAILKKLSGKPHVCQFLFAARLTDFTYVIMTLLGESLNKIVKRIARQITVSSQVRIAANVLFCLKQIHDIGFIHRDLKPANMALGYKTNNDECRFFHVLDFGLARQFVVSQSDQPSKLMMRRPRERSLFRGTTRYCSIRMHDRAEQGRVDDLWSILYLLAELRGPLPWSSQNDKRVVGEMKRLHSDEVVLQNSPMEFLEIAKYLRSLTYFHRPDYHKIFMLLISIMSKGKFSWNDPFDWEMPISTPPSKSITKSPNQLSKETIKKASREKTLSKEKTSKEDIKTAQKTSIEKDVKEKLSKEMASKEKISLSAEKINMSAEKIEEDNKKEEYMRMLPFDPDFFASDPIGF

SEQ ID NO: 5425 - protein, 361 aa, Caenorhabditis elegans
MSKDTKQEDNAPTPVTTTPMALNPKTVEKTMFVNKEVLPKMKKIDPEEPGHLPLNEKFMKRWLIEGLIGKGGYGEIYLALDVVRGEEVAIKVEPKKRRGKLAKRMILEQHVLAKMQGKPHVPMIYGSGHAEKYNFIIMQILSINVGDIKKSSPNKKLSQCSVGRIIHQVIAALQDLHETGYVHRDVKPANMCFGIFPHSRHTLILLDFGLVRRYKMESGEWREPRLRAGFRGTTRYVSIRVHRRCEQSPYDDLVSVMYTAYELLAGELPWKHLEKSEEVVQLKEVMTENGINPELFQGDKSVLIDFFKQVSEMDPMKEPCYEKLIECIKVLYAPKVLTDPYEWEESSKGQDEVSEENTNSK

SEQ ID NO: 5426 - protein, 462 aa, Caenorhabditis elegans
MEKVEEQQTNQKRFTFADKTRFIVLIIGLCCICCTNANYNAINFSVICMQDVISEQSVVNQTHWLENTADVSFIFSAGAAGAIIGLFPSVPLTTKFGVRNVLSFYGLLTAVSTLLIPLAVSIGYYPVIIIRMFQGFGASILFSAIGSISEGWSPIAEISTYVAFLSAGFQISSIILMPVSGVLCESQLGWRYIFYLFGGISVIAHIIFFTFFRDSATVHRNVSGKELRKISTGRLPTAGRQTVPYLDICKDKVVLSIWAAAIGGNMSFMALITYGPTYLNKVLGLDARETGFLNAIPYMLATAVKFVAGPLSDHMTFIPETWRMIFFAALSQLGLAIGFFVMALTNSKLIAQIAYTAAIVLAGINIVGVVKCAQMVARQHVHFVMAVISLSAWGAIFLLPIIIGFVCPNHTASEWAVFYTAVGIWVIIMNVPFPFFATMDAAEYTKPEWEQKKNTVAPEQRI

SEQ ID NO: 5427 - protein, 678 aa, Caenorhabditis elegans
MLSYRQTLQFQMVSSGLARVIRTEQILLPLSVDDNNGMTLLYLKTLRDQGYKVITVAAGVGHGDLSGIADKPEWSFQVNNFFQLSPPPQPTYENRPTTGMSMRNGGPPVPPSRSGMIPVPPSRSGGPPAPMPVSRAGGPPRAPTSMGGRPMTGMARPPTAGLRPVTQQGLRAPPSRMGTGNSRQVFDKSYYIGVLRAKQNAIKVEISRMKEKRDKGIKDRNELHAYESRASAQAQEISDLQGKLLDLNKIMEKIHLNGDMSDIELEASKMKEQADEMRSLAEEVFNERRAKEEELQGLEIEVEEQKKLNEAVTHAMDPQMKEKYEDLKSEAKLLRERVVEMEAKNEDLDDRISKYEIEIRSNPLKKKAIQLQETLDTLKKQEEKLMEDMQSALTPEAWRDKMSENMKQLNADLVVIEKQHKTVKDQISLASEELHEYDSQGEAQIMAHHTKYLDLLSKSTMLDDTTENYPQQIVIYQQDIEEFSDAVVLILRKISANLKKVNLEDQITDLDERGLTLQTGNVDELKEMHVRLQEELISIEDMELALNEEIDNLETEEKKIDQELAGVGKNVDSDGLRQELEERQKRLEDEAPARSHEMQQLEANVASIRNELHSIPGYSQHKMLRERLEAVEKRTAAKSLDMSLRKTEIDYEDIKTESIRLQEEYNNMLLTNPFQRFT

SEQ ID NO: 5428 - protein, 464 aa, Caenorhabditis elegans
MSFDYKQTDFETGAEHLGNGRSWTCWGKTRFLILFIGLICITCTNANMILMNFTVICMNDVIIEQKSFSNQTHWLEKSSDISLTFSAAAVGAIFGTVPAVTLISKYGIRKVLTVYGLLSAGGTLLMPLAVNYGLIPVLIARLFQGVGASILYSSIGTISESWSPINEIGTFVAFLSSAFQISNIVTMPTAGFLCESSLGWKSIYYIFGGITVIFYIIFLWYYNDTPNDHKNVSSTELRTIRDGKIFESSKHRPQNVKFTQIFKNWEVFEISLAIVGGSTSVICLNNYGPIYLNKVLGLNIRETGYSNAIPYFFAAIVKFAAGPVTDKLAHISERTRLFIFALIPQLVMAIGYLIMSFTDHVIIAQLAYTISVILAGLNVIGMVKCAQIVAEKHLTLIMAVISMSSWVSAFILPIVIGVICPTNSHAEWSRFYLFVAFFVVCTNLPFPFLARVSKRTKVAPEIKF

SEQ ID NO: 5429 - protein, 596 aa, Caenorhabditis elegans
MGQRQAKQHMQAGVKLYHQRHYAQAINKWRQSLNRLNNAEDRFITLGYLAQALCDQGEYEGMLSYALSQMQLATDQNDSAMKCEAFLNLAKAYERLADFTKALQYGKASLEHPSMDPRTPGYAHLTIALAHLGMSQFQQCLESFESAMNVANETSDRLLELQICVGLGSLFTLLRDITKALIFLRNALAIVQSVTVDDVHAKYRCLILYHLSVALRMKGSLVDAKEACDEASQLAVEMGNRAIHARCMCSLADIYRELGESEAKETITKSWARYEDAYRVMRGANDKMGEVLVLSSMAKSASESRSHYTGQCECQAIQLNKKCIEIANQIGCKHVVLKCHLRLAELYSQLNDDDSEETARRAASRLTQEMQLFCNFCGQRYGLKDESLQALRCSHIFHEKCLHTYLLQRTDQTCPKCRCRAVLSDNISIRSSIASTIDVQSPSTSFAPPGGVATPLVSAAAELGDITPQATLTRRSQQDKILRGAEKDIDRVDRSLARLKSQQSAAANACSAVAVPSPEVPSTTASCASEPILTASTTSQSHTHSNANHKPPPPPRKPCCSQAALPPSSIVALPPAMPLAEDGPLVITHTPTVTDV

SEQ ID NO: 5430 - protein, 263 aa, Caenorhabditis elegans
MEAVVLRSLLPIRSPYFCRVFFCGKAEKFNFLIMTLVGKNLSELRANCPNRKFSRRTGLQIGIQMINAIQQLHSIGFIHRDIKPANFCINLDNPHQLVMVDFGMCRKYLNDGGTQLRHPRWSVHGFRGTVRYAPLATHYGRDSCRKEDLETIFYVLVELLVGTLPWMTMEEHIHVEHSKQVARTTGLREFLSGCPKQLVHILLYIDNLRFYDAPDYALIRGLLSFALENCQHNGSFEWEEEMKMERKKDEDMRSKDESEIEDG

SEQ ID NO: 5431 - protein, 1296 aa, Caenorhabditis elegans
MRLHNYFVSIFLFSCIVWTVFSSCLKPRPTRSYIHSLFENSDVIIAGVITGISYRVDSLYIENITVIPRRIYKGREYVEENKNIVIGNILETEPCAHRLLASDVRIFSLTNQQGVFLLDAPMIRLTGNEEERNKVAQSQNAAICEQSLCPFGSKCGLKTGVCECKARCRVVTDVVCGSDHVSYSSFCHLSVRSCVLAKNGVRLRVATKGPCKKRNPCEDLRCGPGEDCVVNQINGILLAKCVCPTQCPNYGDSVESSPVCSSHGVDYQSSCHLRHHACESKTNITVKFFGRCDPCHGHKCPNGQTCQLGVDRRPECKCSEQCTMNSAHVCGTDGKTYLNECFLKLAACKEQKDILVWKRGNCDEAGSPCEKMECGFWGSCVVKPDRTAECECPNRCEDVMRPVCATNGETFDNECEMKKKSCETKSMIKVKHQGTCGIGVCATFDSCKKPQVCVVVDGKPKCVCPSCTDEFKEVCGSDGKTYSNECRLQNAACMAQKNIFVKYNSACEACKLKKEKCDFYSACVVGENEKAECKCPDDCPSYEMEEGKEVCGTDGVTYSSECHMKKSACHQSKFVMTAFEGKCDECLHVQCRYGEECRSGVCVCSYNCPANPPLSARICGENGVLYPSLCHLQLASCQKGAPISEMPPSHCHSSKTSFPVRRPCACYFGATCHNWACTCPTCNLSSNYPICGSDGIVYNNQCHLNTISCRDQREIHVLPLISQVLDSCQCNRVGSFGHTCDETGQCKCRPGVAGIKCDHCLPSFWGIHLIAQGALSCRPCGCSAFGSSRSDCEQTTGKCECKNGALGDKCDLCPNGSMMTAGGCVSQLFIKHQDCHSLRCFHGAKCVPSPSSFPDCICPQSCNMNHLGIVANMTVCGSDGTTYSNLCELKMFACNIKLTLFQFQWEFVMMREKNSNEKRLGSPCTRHEECEKLSAQCITRPGRKSVCDCDDGWKSHLGICIEISKKRKSDQLELTTDINSDWYFSRKDINRFSKLSMHIHLKEKREGILIRMVTEDKKDLQISHENRRIVINWQRRVDSLQTIAYNVSLELKWKRNEVHFKLNGEVQKYTFEDVLDSSVKRIYVGTDGKWPRNRLNSIVGYLEIDDEPVRIDEIKPFYMAPEISRTLKFKENGFVQFENLQIDVRERTRVEIVFKPYRTNGILFYWSVPSDPHTDFIAFAMIDAKPHFVYELGSGLSYIRGEPIPLNSWHTVRIERLAKDVSMFVNETLVKKHTSQSKNAHLDISKKDALYVGFVPEGIISHKVRKLNVPFEGELQELRINELPINLISVSCKFKF

SEQ ID NO: 5432 - protein, 1357 aa, Caenorhabditis elegans
MRQHAKGASVKRASNLPPSLFPPEETVRWDFYSIYEYLMEYSSKLRFAVSCSSNMNRSMEAHGILKKRGFNIESYGSGNQVKMPGPTVDKPNCYEFGPTTYEDIYADLTNKDLHLYTQNGLLHMVDRNRRIKSRPQRFQAETREFDIVLCLEERVFDQVVDFLNRSVGKSGNPVHVINIDIEDNAEEATFGAFFVADLCEKLERSEDFEEDIDQIITDLEENNPKRNLLHTILSSTLKSQHFIEKSLIMLRIPTSNETEAVLDLNCTLNVIHTAKFLRNQLQAQAALENKFGADMYAVTIIGAFASVIVLLMFRSIRPHQSLDDQVTLMMSTMKMRVEVDEYERRKIKMKEAKKKAQDWINNLKSRSLRSLSRSSRRSKSSMAESNPLNSDSTRSYKNENSLNVPFTTSQQAIQVEDETRTGTSSTRQSVCSAPTPHPLEVNLPNRSKSHIGFLPEIVVTEERPKLCLLLPPPNRRRKSVTTQNNTIPIHKSVSCQQLVLSSRTVRVEHRVPYFRLKNIKTLLRECDATNSFQCQDGRCIPMSWRCDGDIDCQNEEDEKNCPKVCGAEEHKCGEVKSARSSLERFKCIPNKWVCDGEFDCEDKSDEFQCKNVSCQEKQFQCEELSGDYSLCIPETWVCDGQRDCTNGKDEQNCTSKTSKCPDNNFQCSNGNCIFKNWVCDGEEDCSDGSDELLTAPSNCNRTVNQCPPGEMWKCGSGECIPSRWRCDAEVDCKDHSDEKNCTAIQHTCKLAEEFACKASHNCINKAFVCDGELDCSDGSDEDDCADVRTECKSGERTCPASYGAYGAESGHVVCIPASSWCNGEEDCPDGGDEKECNMTAPVTCQKGTEYECPSTPLQCIEMSKLCASAQFDCGDGNMSVCSQKKIIEMCKPSSEGCVCRPSFVRGNNVCHCKDGYKLENGQCIDINECEIAGVCDQICLNIPGSYRCACHAGYQISFGDTKIGSGRIANKCRAMGGDPLVLLTNRHTIRQFDLVNKMHFPVSSSPGSAVAMDFHILNGTLIWSDVLSKQILKCSIGNVSNAFLGTDMCDKKHEIVLTGDKIHTPDGLAVDWVHDLLFWTDGGLDQINVLDMKNGKQRVLYSSDLEEPRAIAVDPEVGLIFWTDWGKKARIERSGMDGQHRTVIVEGDRVVWPNGLALDYVDKRVYWLMPRSSQSSVFTGADIRTVMDQVKSPMTVRIYHKQAQPLMQNKCENSECDHLCLPRAVYREKERVHEKTWHDRPFSCACEGTTASDVLECFADLETKSGISMFTIFLLLCVGGVVAAGFVIVRRKMGPRTFTALNFDNPIYRRTTEEADHQMEDPFRDPFAEPRNGRGRNDGLPTLASADNETRADALSF

SEQ ID NO: 5433 - protein, 434 aa, Caenorhabditis elegans
MTVLFPPSESSVDLEHYKKAISSKFALINLMKGMLGAGCFSVPLAFKQSGYVSGLVIIVVLGFLCALCMIKLVKCAGYLSKVNQSAPLDYGNMAYKATQASYTPIRKLAPVSRALVNSSLCILQLGICCCFYIFVVYHLHELLEFVMNDVPSRATLFPMVLPAFILLVSLSSMRALSLVSLGGNFLMLIALAVIMFQLLTTEHKKLADLPPVTDLMGIVSAAGTILYALEGQAMVLPLENRMKKPEDMKGPFGVLSVGVGMVVVIYSFAGFFGFLTYGNDVQDSITLNLPNDHLGIFVKAVLLFVVYSGFLIQVFPIVAMIWPAIKKKLRTTCGVSTTTKRIVHFAFRYSIVIVVFLLSYAIPRLSDMVPLVGVTAGMLLALVFPSLFHLLIFLPQFECRIGFLFDIFLDFVCIILGMFFVIYGSITHVQHLMH

SEQ ID NO: 5434 - protein, 605 aa, Caenorhabditis elegans
MTVINEQLTSSFLKFSHISSSSFCYYFFPFSFILNFQETLEMRIIYLISTVLLIYTNATVLRTKESIQNKVTYDKYGFQPLCISCTGLISVASFFLKFDVSEPVILEFATIVCKLFAKQPWAVCDGISSQFRDEFFYVFRRLANESPSQICGIILPDCADPTDPSESGWMVALPPKPKRTRISKKKVQKKPNMSMSQNLNVLQLTDLHVDFEYKYPSEANCDDPVCCRVSVSEPKKAAGYWGSVGKCDIPFWTVENMLSHINKTHMIDMVIMTGDYINHVDWEYSIEEHLSVLRKLHRLVQNTFPSTPIYWALGNHEGVPVNSFAPHSVDERFWPTWLYKEFQTMSGPWLSEGAKDSLLKRGSYSTQVMDGLKLITLNTGFCEVTNFFLYLNQSDPDSSMSWFVKELFESEKKGEQVYVLAHIPPGDSECLEGWAFNYYRVIQRFSSTIAAQFFGHDHLDYFTVFYEDMHNVSSKPISVGYASPSVTTFEYQNPAYRIYEIDPYNKFKIVDFTTYYADLEKATEDKKPVWEKLYSARQAHGMDDLSPLSWNKVIQKLFTSEKKREKFYQYAFRNFSPQCDSTCQMQLMCNLRMGHHNSTLYCPTF

SEQ ID NO: 5435 - protein, 816 aa, Caenorhabditis elegans
MMVANESLVMSEEDRNVFTSIDKKGGGSKQMDDLNQKCPKRKTSKLKGIPKLEDANDAGTKNSQQCTLILTEGDSAKTLAVSGLSVVGRDKYGVFPFRRKLLNVCDLNVNQIADSAEVNAIIKILGLQYTKKYETEDDFKTLRYGKLLIMANHDSDGSQFKGLLLNFFHRFWPALFKRDFVEDFITPIAKATEGKEEVSFYSLPEYSEWRMNTDNWKSYTIKYYNGLGTLTSKEAKKCFSDMVRHRIRFKYNGADDDKAVNMAFSKKKIEARTDYLMKLMQDKNQRKQQGLAEECLYNKETRFVTLKDFFNYEIVCSWNLHSIPCLVDGLKPGQRKVLFACFKRANKREVKVAQLAGAVAEISAYHHGEQSLMGTIVNLAQDYVGSHNINLLLPIGQFGTRLQGGKDSASARSIFAQLSQVTRTLFPAHDDNVLRFLYEENQRIEPEWYCPIIPMVLVNGAQGTGTGWSTNIPNYNPRELVKNIKRLIAGEPQKALAPWYKNFRGKIIQIDPSRFACYGEVSVLDDNTIEITELPIKQWTQDYKEKVLEGLMESSDKKSPVIVDYKEYHTDTTVKFVVKLSPGKLRELERGQDLHQVFKLQAVINTTCMVLFDAAGWLRTYTSPEAITQEFYDSRQEKYVQRKEYLLGVLQAQSKRLTNQARFILATINNKIVLENKKKTAIVDVLIKMKFDADPVKKWKEDQKLKELRESGEIELDEDDLAAVAVEEGEDISSAAKAVETKLSDYDYLVGLALIKLSEEEKNKLIKESEEKMAEEGIDFNSDDDGVERENVVSKLRRSRPQAKTPTRTAGWPPQD

SEQ ID NO: 5436 - protein, 392 aa, Caenorhabditis elegans
MATFPHFGTAAIHVGQEPEQWDMNQVVPPISLSSTYKQDNPGEPKGHDYSRAGNPTRDVLQKNLAALEDAKHCQVFSSGLAATSAIINLLKYGDHIVCSDDVYGGTQRYIRRVAVPNHGLEVDSVDLTDVQNLEKAIKPNTKMVWFESPSNPLLKVVDIAAVVQTAKKANPEIVVVVDNTFMSPYFQRPISLGADVVVHSITKYINGHSDVVMGAVITDNDEFQQHLFFMQLAVGAVPSPFDCFLVNRGLKTLHIRMRAHYENALAVAKYLEANDRIESVLYPALPSHPQHEVHEKQTKGMSGMISFYLKGELQESRAFLSALKVFTLAESLGGYESLAELPSIMTHASVPAETRIVLGITDNLIRISVGIEDLDDLVADLDQALKIAIPKV

SEQ ID NO: 5437 - protein, 565 aa, Caenorhabditis elegans
MVFVSKAASVKLSTTTVHERIFEACRIHASANKDAVCFIDAETTTKKKLYKDVEPTVNSLATALVKLGFKPGDVASQAFPNCPEFLVAMLAVMKCGGAMSNASAIFTDYELQLQFCDSNTSIVFTDEDRLARIRRATAKCPGVRKIICLRTFPLRTEFPENVLDYVELTQTPDQPINVNVSMDSIALLPYSSGTTGRPKGCQLTHRNIGAMLDVAKAHLETDVAPAMFGKEKATWHKEHTVLLLPWYHAYGLNTMFETILLGMTGIVFKKFDTIVMLNRIKFYKVKLAWLVPPMLIFLAKDPMVPIFNTAPFLKVIMSAGATAGKQLCEEVSKRFPNAWLCQAYGMTEMVQFTTIPRFEDGNCFETVGNLASTYELKILDKEKKEITTINTVGQLCFRGPTVMKGYLKREEADIIDKDGFLLTGDLGSIDDKGRIHVTGRIKELIKVNGMQVPPVEIEDVLLLHPKVKDCAVIGVPDEHKGESPKAYIVKKDHTLTEAELTEFVRQKLSSYKWIDTYEFIDSIPKLPSGKIQRKKLKKMAESSGSTESEASEPSQSERSSHSIRR

SEQ ID NO: 5438 - protein, 688 aa, Caenorhabditis elegans
MNAEVSTVSEGCLRRTLALGALAVLLKYIHETRCVFFRVKSLRIKEMGVNDTCMIDFVSWESLEIVDADDASKARKFQMKQKRTLMSVLNHTVTTNGYRLLRSSVLQPSTDVYLIQSRQEAIEELIGKPQLKDKLRRTLSRAHELDRVIAMCIQTSTSWTVRESEAKINQIIKLMHTLKVIQGIRTLLHSAKMKSNILIEKTEFLKDPRFDQIMNILVEKVDDSLLDGKKNSLHLQNTKCYAIRHFVAVQLDLARQTYEEIIRNVEETGAREIAEYFHGNSSVRLSFSQSRGFHYTFVTRQAESVTIPRYFLDVFRNRTTVTFNSRKVIAYNDRLEQVVAEMFLASDVIVCDMIEEMQPMIPVLYYAMDALSSIDFLCGLATYSDLRDTCKPTFGPSFSISQGRHPILDWDDSEKTITNDTCLTRDRRFGIITGPNMAGKSTYLKQTAQLAIMAQIGCFIPANYASLPIFNRIFSRMGHNDELIRNKSAFASEMSDAAAIVQYADKNSLVVLDELARSTSTEEGIAITYAICEKVLKLQSYTFLATHFLDIAALANYSNAIDNYHFLPQTDENSTKKHKLLRGQYRGPLYGFELVELSTIPDEVIEHAQSLATELRANVEDTERDYDSERRRIKVYMNHRFRECAEYFMDTHGEKWKEEKEAIDKMKALRKYLVDELAKIDSQEQMCQ

SEQ ID NO: 5439 - protein, 409 aa, Caenorhabditis elegans
MLSSSGHAIRRGITTSAALSNKHAFIVGAARTPIGSFRSSLSSVTAPELASVAIKAALERGAVKPSSIQEASVFLGQVCQANAGQAPARQAALGAGLDLSVAVTTVNKVCSSGLKAIILAAQQIQTGHQDFAIGGGMESMSQVPFYVQRGEIPYGGFQVIDGIVKDGLTDAYDKVHMGNCGEKTSKEMGITRKDQDEYAINSYKKSAKAWENGNIGPEVVPVNVKSKKGVTIVDKDEEFTKVNFDKFTSLRTVFQKDGTITAANASTLNDGAAAVIVASQEAVSEQSLKPLARILAYGDAATHPLDFAVAPTLMFPKILERAGVKQSDVAQWEVNEAFSCVPLAFIKKLGVDPSLVNPHGGAVSIGHPIGMSGARLITHLVHTLKSGQIGVAAICNGGGGSSGMVIQKL

SEQ ID NO: 5440 - protein, 390 aa, Caenorhabditis elegans
MSDKKVFILSGARTPIGAYRGSFANFGAVELGTVAAKAAIERSGVAPEKIEEVIGGCVLPAGLGQNVTRQISLSAGLPVTTQAVTVNKVCSSSMKALVTAAVEIKAGYYDTILVVGTENMSQVPFYVPRGEIPFGGIQMTDGISKDGLEDIKEKGPMGLCAEKTVKDYGITREEQDAYAIESYKKASNAWSSEKFSEEVVPVSVKTSRSEVVITEDEEYKKLIESKVSSLKPVFVRDGTGTITPANASSLNDGAVATVVVGENALPQGAHPLAELVAFAEAGRAPIDFTVAPVDAVRLLLKKSGLQVSDIALWELNEAFAVTVLAFIKELNIEPSVVNVKGGAVAIGHPLGMSGLRIVNSLAYSLAPGQLGVAAICNGGGEATAVLIKKL

SEQ ID NO: 5441 - protein, 460 aa, Caenorhabditis elegans
MLRKTSGSNIRRTKLEASAEIVAIDNKVDEAKTTKDLDDVLERIQALVQSVIDAPKLLESTGYVNSLREIMSRYFKAKMLSLDGHAIGRGITTSAALSNKDAFIVGAARTPIGSFRSSLSSVTAPELASVAIKAALERGAVKPSSIQEANVFLGQVCHANAGQASARQAALGAGLDLSVAVTTVNKGWSSGMKAIILAAQQIQTGHQDLAIGGGMESMSQVPFFLARVEQSSNKYQVEQTVQDGISDFFDKQELCINGERTNGNIGPEVVAVNVKSKKGVEAVKQDDITKIKKIKEGSVYSSIPIFPGGTISDKHIAAFTDGAAAVILASQEAVSEQNLKPLARILAYGDAATHQLDFAVAPTLLFPNLLQSAGVEQSDVAQWEVNEAFSCVPLAFIKKLGVDPSLVNPHGGAVSIGHPIGMSGASLITHLVHTLESGQIGVAALCDGDGGSSGMVIQKL

SEQ ID NO: 5442 - protein, 556 aa, Caenorhabditis elegans
MTSAPIKGKLVPLPPDGGWGWVVVIGSFFIHVFADGFVYSFGILAEKLMIEFNSNNTMTSLIVSMLTGFTLGAGPLASAVCNKYGCRITTIIGAGVAFVGCLLSCFATEIWHFVISVGVIMGIGFGLVYCPAIVIVTMYFESKRSLATGIAVAGAGVGAVVFGPINTFIISNYGWRYVFVLFLFFALVPDDDDDGEYNDVFEDEVKKIDYNKRFEEKVSLLSPPQVLERSMSQCCDIQKNNQHARPSSSVGAVDLEPLLRPRCGTIGERNSGYLNRKDVFYTGSISNVAEFRANPDKYRSTGSLHTALNIHTHHTGTVGDDRESGHGCDQSLDGMNEKKETDFMDDIEGTFLLFAISNLLTSVGFNSPLYFLPLHVTNILSDNNVSGNILSVYGTANTIGRLIFGVVADQKLPLPAGLGDDTARNRLWMYNISLTICGIVTAFCYKFDGYILLDIYAVLFGFTIASYVCLTSVILVDLLGLDKLTNAFGLLLLWQGVGTVIGPLVSGYLADLTGNYTLSFVFCGINLMVSGLMLFVIPYFKRKDDVDVSNKQRSSQ

SEQ ID NO: 5443 - protein, 383 aa, Caenorhabditis elegans
MPTEIREIRPQSISRYEEMMSPYFAGFLYIATVLTGLFGNIWVVCSVARSRKPKSLMSRSSPSDRLRAYISVLAVIDLTVLMALLVRALYHFLPHFMLDSNSCRAMFVLENSVKITSLTVLSCISIERYITIRKPFCSEVRRQFVNATPIGASIFVGLVVGAIIVQINSVTVSSDGLNCVRSYRGKAIPRVASYLTAVAFLVDLTIISLNYSQIVRHVRRKFTKRRARVQANSRVRESLVNEPRYMREMTAAIVRVGVFHVVCWLPMSLMQFIPDNTIQSELTAGIRLFSNFRDYSITRWLIFIATWLTSMNAAGDWIFYAVMNRDLRNLISAVAKFIYFQSSAIGEKKISSSRAGSSNIKNPLQRTIFFCFIPNFSQSTRKL

SEQ ID NO: 5444 - protein, 613 aa, Caenorhabditis elegans
MLSTLSKSARLNQTRFIRLSHSAAAAKDAKPKKVAAVDSPSFVMNLFRGKAVTDQVFPYPLNMTDEQKETLGMVMSPLEKMLVEVNDVVKNDETSDIPRAVLDQFAELGTFGVLVPPELEGSGFNNSQMARVAEIVGAYDLGFGVVMGAHQSIGYKGILLEGTDAQKQKYLPDLATGRKFAAFALTEPTTGSDASSVRTRAELSADGKHYVLNGGKIWISNGGFADVFTVFAQTPVKQADGSTKDKMSAFIVERAFGGVTSGPQEKKMGIKGSNTTEVHFDNLKIPVENLLGKEGEGFKVAMNILNNGRFGIPAACTGAMKHCIQKTVDHITTRVQFGKKLQEFGNIQEKLVEMISKLYATESIVYMLSSNMDRGIKEYQLEAAIGKVLASENAWLVCDDAIQVHGGMGFMRETGLERVLRDLRIFRIFEGANDVLRLFIALTGAQHAGKHLAEQASGVGGLIGLAVSRVTGGNTGSNFGQVVDASLQDSAKVLDQQIALFGQTVQGLLMKHKKGIIDRQYEMHRVADAAINIYSSAAVLSRATYAIKNKSSSADFERKVATYYVDKAMKSSNRFLKDAGSGVENASKVATIESLAKEVCGNGGLTLQHPVEL

SEQ ID NO: 5445 - protein, 329 aa, Caenorhabditis elegans
MPTEKGRTRKFYSRTYALETIKGVNLAGKTFVVTGTTSGIGIETARSLSLNGAHVVMLNRNLEESEKLKKKIVEEMNDAEIDIIECDLNSLHSVKKAAEVYISKKWSIHCLILNAGVFGTASKTTVDGLESHFAINHLSHFLLIQELLPIVRQSIPSRIVLVSSSVHATCGVSPEMSIEEKLKILCPESSSDASWFRLYSRSKMCNMLVAFKLHRDEYHNGISTYSVHPGNGVRTSIFRDSWLVSIASILSTPFTKNISQGASTTVYCAGHPEVANVSGKYWDSNWDDEKGLYEEVARDEQLQDALWKHSDKILDNMLNDRKKSCQFEC

SEQ ID NO: 5446 - protein, 574 aa, Caenorhabditis elegans
MCRTLLGVAFLVVTVLSQGEKDLIQNLPGLLFKANFKSYSGYVDANANGTWKMHYMLTESRSNPDTDPLLVWFNGGPGCSSLGGLFEELGPFYVNFDGQTLYENPYAWNAKANVLYLESPIGVGYSYDTTTPGYFQANDDQSAAQNYQALTNFFNVAQPKYTNRTFYLSGESYAGIYIPMLTDLIVQGINNPNQPFPNKNFQGSAIGNGFMNVAGLLNALTLWSAYHGRVSEQNWADIKANCSKGADVDSFDFSQFTTSQNKIDYVGDGSYCGNLIQPLISQNALGNEGFDQYNFYQECYDKSVFQAPPPAGGKRHKRSAMQGVSSVQKNLQYQQLGNFQGTSNLAKNTATLVNRFSNDNQFGYFCWNEDAVSKYLNSDNVQNALNIPQAWKDQKNTWEDCRMSIYNNYTLKYNTTNRFFNNIITNLTTDFRFLIYNGDVDTVCNYLGDAKHILQVAKDNGLTSGPRTPWYYSNNQQLAGYVQTYSGKNKNNAMITIDLLTVKGAGHMVPYDRAGPSVQMISNFVWAPKNVVINYTSQDNFNPNIQLSDLVDSGSSSTVAFFISMFAVLLNIVF

SEQ ID NO: 5447 - protein, 796 aa, Caenorhabditis elegans
MRGDTENRSDGEMDDVSTSSEIRHGNGFIENFRSQTGNSSRTTATNERIKKKLVIKNFKANANQNDVAMGDTNIDSTDGSVGRDWAVLSDNVFAILEDRKTVTTLEGLFSKVRSVCDKNQSKVLYDRLVAIVVQFAKSLKESLNAVEQVPLAEDNCEQYLEKFGQIWQAYPVKINLIRNIFLHLDRIALGATDTEILPLWECFMQIFQKTFFPNIFKEFKATKLFNALYMAMQKIMQRYPVDSPLRSLVDMLQTVHVSEEFAKFLISQLREHYNNERIDKVPKMNCNDYMEYCEDQINRYSQLVKVNFDEPSALKDVQATVTNCLIQQAIPEILTHDFDDLIDSDNISDIGRMFNLCRQCVGGEDEVRTQFSKYLKKRGEKLIATCPDEDLVSELLAFKKKVDFIMTGSFKSANDPVKMRQCLSDAFESFVNKQVDRSAELISKHFHTLLHSSNKNVSDDTTLDQMVDEAIVLFRYLRGKDVFEAYYKRGLAKRLFLERSASVDAGKDECGSAFTYKLEGMFKDMDASENYGRLFNQYLEHMNKEKANFTARVITPEYWPTYDTYEINIPKEMRDTLTDYQDFYRVQHGNRNVKWHHGLASAVISASFRPGCKKELIATMYQTVILLLFNKCETWTVAEIVEHTKILEIEVVKNVLALLGGRDKPKVLQRVEGGGSEKKEGTVENLKNEKFVVNSKFTEKRCRVRIAQVNIKTAVEETKEVKEEVNSDRQYKIDAAVVRIMKARKQLNHQTLMTELLQQLRFPVSTADIKKRLESLIEREYISRDPEEASSYNYVA

SEQ ID NO: 5448 - protein, 657 aa, Caenorhabditis elegans
MKVFSLILIAFVANAYCDEGASTEKEEKMGTIIGIDLGTTYSCVGVFKNGRVEIIANDQGNRITPSYVAFSGDQGERLIGDAAKNQLTINPENTIFDAKRLIGRFYNEKTVQQDIKHWPFKIVDKSNKPNVEVKVGSETKQFTPEEVSAMVLTKMKQIAESYLGHEVKNAVVTVPAYFNDAQKQATKDAGSIAGLNVVRIINEPTAAAIAYGLDKKDGERNILVFDLGGGTFDVSLLTIDSGVFEVLATNGDTHLGGEDFDQRVMEYFIKLYKKKSGKDLRKDNRAVQKLRREVEKAKRALSTQHQTKIEIESLFDGEDFSETLTRAKFEELNMDLFRATLKPVQKVLEDADMKKTDVHEIVLVGGSTRIPKVQQLIKDYFNGKEPSRGINPDEAVAYGAAVQAGVIGGVENTGDVVLLDVNPLTLGIETVGGVMTKLIGRNTVIPTKKSQVFSTAADSQSAVSIVIYEGERPMVMDNHKLGNFDVTGIPPAPRGVPQIEVTFEIDVNGILHVSAEDKGTGNKNKLTITNDHNRLSPEDIERMINDADKFAADDQAQKEKVESRNELEAYAYQMKTQIADKEKLGGKLTDEDKVSIESAVERAIEWLGSNQDASTEENKEQKKELESVVQPIVSKLYSAGGQGEQASEEPSEDHDEL

SEQ ID NO: 5449 - protein, 761 aa, Caenorhabditis elegans
MLIDAAITNVSFGYFAPGWKFNYDSFLGIITFSLPYHFTTTPYEFQIFSFIRQSFCAIAVLLIILNKREKVKVLFPVVICNAVVVYSLSLIKFLAFSEDSNQLYFPGLWFSVIWSILSGFIQVLVWYFVFTSNPFDYHRLLNTTAENAGTSVTETAAETVRDTETASNVESGSSTAPRAPLHKVLLRLLSYCGHQWPWFASGFVFLTVYALARVFIPNYTAQVISDIVNKRGIQALIHSIIVLTCLTATSSLFGGLRGGCFDYATALVTLRIRLDLFTSLIRQDIAFYDTAKTGDTMSRLTSDCQTISSTVSTNVNVFMRNGVMLIGALAFMILMSWRLAMVTFIAVPLVGFITKAYSSFYDKISEKLQQTIAETNQMAEEVVSTMRTVRSFACEKKELKRFEDRLSSTLSVNRKKSIAYLFYTWNNEFCDNAILVAVLFYGGHLVMTGKMEKEQLITFLLYQMQLGENLYYLSYVMSGLMEAVGASRKVFDLMNRKPQFELDGMQRPFVNGNITFSHVGFTYPSRPNNPVLKDLTLSIKSGETVALVGPSGGGKSSIVSLIEHFYEPDEGSVTLDGVPIKDINHVYYHQKVALVAQEPVLYNGSVRHNILYGCDFATEDDMLNASKMANVHDFVMELEKGYDTNCGEKGVQMSGGQKQRIAIARALVRNPAVLILDEATSALDTESEALVQQALSRCAQERTVIIVAHRLSTIEKANKIAVIVKGCLVQMGTHTELMTDTDGMYYSLVSRQMLSAKVGED

SEQ ID NO: 5450 - protein, 207 aa, Caenorhabditis elegans
MAYLERAYFGLQCFWGESAWAKLKGVVVTRVGYAGGKQPNPTYKNIKDHTEITEITFDPKVIEYSKLTNFFWKHHNPAERRKKQYQSAILYVNDDQKKVAEETLKVAKDKHGDIETYIEPLDKFYQAEDYHQKYWFRQKKILFDELSLLDTQVAEGELATKLNAYCAGFQDFHDLERLAKEYGLKDSFVNKVKDYALSGGDPRNCHA

SEQ ID NO: 5451 - protein, 1020 aa, Caenorhabditis elegans
MGKGGGRMETVGEDGIPADYKGNRKFTTSLGHLALYKEDEGIGTQASFISGYTTPGPKERATSEHVKANLGVMLGVYLPTIQHILGVTMFIRLFWVVGMSGVAWTMALLAICCLSTLLTSISLSAVATNGVVESGGAYFIISRNLGAEFGSAVGILFYLANTVAASMYIVGGVEVILMYLWPEMAIGGADALHDTEMFGSLYNNLRLYGTVFLLIQALIVAMGVKFVQLLAPVSLMCVILAIAACIGGGIEKQITMEGMKVCAIDNHLLQSSIVTHPIHKNQTSWFNETVDFCNLCDKSLYLESVFCANVNNDEASAEDDVFCTHYTSKKMTCQLAFPGFNMKTLNDNMWPEYMEKSEVVPGVRGKETAEVVQDESSTFFMLMAIYFPAVTGIFTGTNMSGDLRDPQRSIPVGTIAATLTTSAIYYILAILFGGSITRSVLRDKFGRSIGNTMVVAALSWPHPAVVTVGAFLSTFGAALQCLCSAPRLLQSIAKDDVIPILAPFARVTKNNEPFLGLVLTVIIAECGILLGAVDKIAEVLDFFFLMTLSLLGAALCFFIMFASSVPLACIACTATAVIYKYVEWKGAKKEWGDGMRGLALTTAQYSLLKVEDKDPHPKNWRPQVLILLTSQWSKEMIDRRAVSMLNLGAQLKAGRGLAIACAFLKGSVDSQKDKNRARDVKTTLVKDMSSVRLRGFAKTMFYNNHQINGTISGLYQSIGIGGLRPNTILLNWPNEKNPDELVLFAEEIIHGAANDNCLIVTKGITDFPEYSERLTGFIDIWWIVQDGGILMLIAYLLRQHKVWKGCTLRIFAVSEQDSTKSEDMKAGLQKYIYMLRIDAELFIVDLLDMEVSDEVVEKAAEVERKQKEREEMRRSKSGYLNDGFMEDNGKPRQVMMRHSDSARSFSPQPGAHTSINLDETETSFTESLFDDFYRSGTPNEDLEGAMKLNIHKMNTSVRLNRVIRENSPDSQLILLNLPSPPRNRLAFNNSYMTYLDVLTEDLPRVLFIGGSGREVITIDS

SEQ ID NO: 5452 - protein, 745 aa, Caenorhabditis elegans
MTKKAKRNIVHKRFDSIVKGSQDTKKYRGLELTNGLRVLLVSDSKTRVSAVALDVKVGHLMDPWELPGLAHFCEHMLFLGTAKYPSEREYFKYLAANNGDSNAYTDTDHTNYSFEVRSEKLYGALDRFAQFFLDPQFTESATEREVCAVNCEYLDKVNEDFWRCLQVERSLSKPGHDYSKFAIGNKKTLLEDPRTKGIEPRDVLLDFYKNWYSSDIMTCCIVGKESLDVLESYLGSFKFDAIKNTRKERKIWKDSPFGPDQLAKRIEIVPIQNTGQVSIKFPFPDLNGEFLSQPGDYIAHLIGHEGPGSLLSELKRLGWVISLEADNHTIASGFGVFSVTMDLSTEGLEHVDDVIQLVFNFIGFLKSSGPQKWIHDELAELNAVDFRFDDDTIIEETYNARLAGLECQFESSSSGVQIRVFGYDEKQSLFAKHLVNRMANFQVNRLCFDISFESLKRTLTNHAFSQPHDLSAHFIDLLVVDNIWSKEQLLAVCDSVTLEDVHGFAIKMLQAFHMELFVHGNSTEKDTLQLSKELSDILKSVAPNSRPLKRDEHNPHRELQLINGHEHVYRHFQKTHDVGCVEVAFQIGVQSTYNNSVNKLLNELIKNPAYTILRTNEALGYNVSTESRLNDGNVYLHVIVQGPESADHVLERIEVFLESAREEIVAMPQEDFDYQVWAMFKENPPTLSQCFSMFWSEIHSRQYNFGRNKEVRGISKRITKEEVINFFDRYHTCQIINYVEYVLFL

SEQ ID NO: 5453 - protein, 376 aa, Caenorhabditis elegans
MIPTTVLSNNVEMPLIGLGTTHSGGYYHDAVLHSIKKCGYRLIDTAKRYGVEKQLGIAVKNCSVPREEMFLSTKLWPVDCGDEVYNAFQTSCEKLQTDYLDMYMIHMPQLPDWIVNQKETKEKTWRQMELLYEDGKFGFCFKCFKLAFGEATSYIALKISCNELCKLNLKLPMSISRSKNPQTNFTIITEHVRSIGVSNYSIEDLDELLEFASILPHANQVELHPWFHQADLKNYCDELGILTMGYCPLAKGKYLEDETLCKIASKYQKSPAQICLRWSIQQNVPTVPKSTDCRRLKENTNVFDFELSAEDMNTLNSFSSQNRKIVDLSNICQKMSLPDGYKLNGRVFGVPEEDETIPKSCSKCAQKQNVPLPVCI

SEQ ID NO: 5454 - protein, 575 aa, Caenorhabditis elegans
MTAKINRVAPYSTHFVFFSPDIRLCGRRLHCILRAEFQKHHAIGYLKEEMASAMKFQYYSKKAAGKTMSNSVSMSSDNRMEDFKRRFRRSGSLGIPFVPEEDVKQLFTPTRTVRREASIREGDEEEGVQILTIIVKSSRVSEDISKMIANLPDHTRIKHLETRDSQDGSSKTMDVLLEIELFHYGKQEAMDLMRLNGLDVHEVSSTIRPTAIKEQYTEPGSDDATTGSEWFPKSIYDLDICAKRVIMYGAGLDADHPGFKDTEYRQRRMMFAELALNYKHGEPIPRTEYTSSERKTWGIIYRKLRELHKKHACKQFLDNFELLERHCGYSENNIPQLEDICKFLKAKTGFRVRPVAGYLSARDFLAGLAYRVFFCTQYVRHHADPFYTPEPDTVHELMGHMALFADPDFAQFSQEIGLASLGASEEDLKKLATLYFFSIEFGLSSDDAADSPVKENGSNHERFKVYGAGLLSSAGELQHAVEGSATIIRFDPDRVVEQECLITTFQSAYFYTRNFEEAQQKLRMFTNNMKRPFIVRYNPYTESVEVLNNSRSIMLAVNSLRSDINLLAGALHYIL

SEQ ID NO: 5455 - protein, 1974 aa, Caenorhabditis elegans
MDVDAPLQAPEQPVADADDEEANWEMEKAEMKRIEFNQNRELTDMRERVEDVSRSNSRMLEELTRHAAEIKEHINRQRVLESTRNELTDKNLELETVVSRLKIEKEERDAAVVNATKLAQTAQVETFALKDEIKKLTNEQASLRHSKEALEKEIQGIQFERQKYATERSLHAESKTWLMQEVSERDNKVSSLRLELSNKDIQGANERLQYVQQINLLNSQVENLNEKLDMLKFTNADLIKRMENTELSKVSEIANLEEEIRCQTELQRVMKSSMEESKNAADLFKDQLEAQENVLVEVRKVLQEHQDEMERENLAHADAIKHRDEELAQTRAELVKVTEMMKSMSDVKLNVSEEELSELAPAAAETVRYLRGGQSLSSLVLEHARVRGKLTEVEEDNVNLRNTLEELLETIDQNKPQMISQKMVTDELFDKNNRFEKQLDLAESERRQLLSQRDTAQRDLAYVRAELEKYQRDYEFVSKRNAELLYAVERQSRMQDPNWSEQADEQLFQNIVQLQRRNVELESDIENAKASAAQAAINAQSEEMAQLRADLAVTKKSEAELKTKVEQTKAAFDSLKERTEHFKELVRDSVTAAEARTARLRAEEAIAAKVVADATIERLRTQAEDYKADHLRREQDLEQRIRNTEANIASVTETNIKLNAMLDAQKTNTASMDQEFKSALKEKENIFEELKKVTAVNAENEQRLVDLGRQTLEAVEQAGSLRVRVRSLEDELQSARTEINSLQFTANGQRNILEKEEQVRMSVVEMANFLSRVEAERLTHANTQLDVLRLERDSLKASTTRLSDQLTHTKNESKLVQQRLEKELEIARQRLSEKETQVTRDEMELADLRSKLASMHSQYTGSDASGMTPDRLKREYMQLKTRTQFLESELDDAKRKLLESETTQKRMDAEHAISASHNTVLEENLKQSEQMGVMEKERLVAKAKCFEDRSKQLAESLEQNQKKLDELRSKNDEQLFAHERETNELRRQLQVASLNLDGVRRELEVVNNNLISMQNEATRNSSALEQHTTIVRQFEDRITEIESANLRLQTELNNKCAALVAESTAKREADQMIEHAERLLQKKTEELNSIEEENRQKQAEYDEKLAQLSLQYESLSANLTNQNTTMEVKVNTDGSSSTVENLQSLLQFVRQSKDEATSRAMTAEVEMRRLRAETAEYERGRNELLRKIRDLETEKIATTAALVEKASLMEKIQALTDVHNINAKLTEEKTKLQAQLHQIQKEKADLENQRSRLSASNEEQKLKIASSDQEANQRKREIEQLKQRVQTNARGAASQPQLDQLKAQLATARQESAAATAKAKAAEDKFNQTRQLAIKYRNENTELKKLAEAPPGEGDPCAARLKLQFDDFTAKINDYKTEIENLNMKVLRMGILEKSLKNTNDQINQLKQENLKLTENIRMAQLQSVSATDVESKPGPSSASKSVSSIRQTPTKVLDPLSSAAKQPNEPDQTTGLKTSQQPPSFAAKRPSFGRQAQSSSNVIPPAPAPTPTSQQKVSPVKRPIPPSIPNEPLDIIPPVPSDNIPDPTPPTNSFGTVLPVPHTFQTSVRVPTQSLFSSSSTTTVQPQPEKKNVLPSIDSAPSTPGGNSSMVTTTSSMAPGQSIFGNIGNVPVPTTAPTDNLALPEESVIEGSAGQSSLVSGSIDQRKVQDIDLVANDGESRDSTNVGGVSSSDVRRKRTANDFELSEAKRLRESPNETVTSIADIPELDDDDGVLGMEHEVSDEDPNDNTIQEQRPDVIDLENDEEVLEDEMDEEEDDDSFGNDEEFEDEEEIPEDDDDDDVVVLSDGDDEPANDNDEESLNDIDDDDGIEEIEMVEESNNRDIEEVLGGEDSQPSLDDQDREAASAVEEAEDEGRDPLGTIDEPSAPADPTGAAGIGSSGRMGQDVQRVRLPTGLRDAEREDQCSSSNETNDERPAERLTARNLARMQRPTRGAKPTRGVYTPARGNRGGRGGGTA

SEQ ID NO: 5456 - protein, 191 aa, Caenorhabditis elegans
MQTIKCVVVGDGAVGKTCLLISYTTNKFPSEYVPTVFDNYAVTVMIGGEPYTLGLFDTAGQEDYDRLRPLSYPQTDVFLVCFSVVAPASFENVREKWVPEISHHCSKTPFLLVGTQVDLRDDPGMLEKLAKNKQKPVSTDVGEKLAKELKAVKYVECSALTQKGLKNVFDEAILAALDPPQQEKKKKCNIL

SEQ ID NO: 5457 - protein, 655 aa, Caenorhabditis elegans
MAAIHINHDVFNKYHTNGKLRLTTGYVQEAIENNGYPGHDGIVQVLKGKVEQGEQLGHAFTFRIRISDGVFQYNALMSADIDDQIKREVEHLVEGTIIALTKFEIYDQGEGAKNCFLIKGYKILSRYHQVLTSPEVKPRSHSGKPDEHKGYRPNIIIEDVWPEAEGMAADYQENMANPPAAKAPKREFGEEASYNRAAAPEATRARAVPPPARRTASNTERGVMPIAMVTPYVSNFKIHGMVSRKEEIRTFPAKNTKVFNFEITDSNGDTIRCTAFNEVAESLYTTITENLSYYLSGGSVKQANKKFNNTGHDYEITLRSDSIIEAGGELLAAPKLILKRVKLGEIAGYAGQLIDVLVVVEKMDPEATEFTSKAGKSLIKREMELIDESGALVRLTLWGDEATKALVDDYVQKVIAFKGVIPREFNGGFSLGTGSATRIISVPEIAGVSELYDWYANVKPTTEVKMMSQAAGGSNEAPRTIAGLQEMQFGKDSDKGDYATVKAMITRVNPTNALYRGCASEGCQKKLVGENGDYRCEKCNKNMNKFKWLYMMQFELSDETGQVYVTAFGDSAAKIVGKSAAELGELHDESPDEYNAIFERLQFVPKMWRLRCKMDSYNEEVRQKMTVYGVDDVNQDKYIENLKQMIEQMQQMSDY

SEQ ID NO: 5458 - protein, 615 aa, Caenorhabditis elegans
MTNTGETKVIESHGTIKKIDSLSTMPYCGVETDENAVVEEKITLESGKSWSPKHYELLHERIERLIDEKQQFFSLEFFPPRFVNGVPNFLERVERLSEGGSVFVDMTWHMGSDPANVDKVTSSSSIAASMLDYCGVDTMLHMTCVQYNKADTLKHLEQAKAMGLRSILALRGDLPPGTELEDTHQFRALDMIRWIREEYGNYFSIGCAGYPLGHPQAPSYKADLMYLKAKCDAGANFVITQLFFEAETFEKFVRDCREIGITQPIIPGIMPIMGYESIKRIAKLSQLEIPQHILDDLEPIKHDDDAVQKYGTERCIEMCRRLLDNGTAPSIHLYTMNREGSIREILKSLGLWKLEGDRVFPWKNRSQHPIRCLESTVRNADDRLAMFGANIESFEDVKRVFINYITQAPNADGVKVTVLPWTEAETGVQPETSLISEQLVWCNENGILTVNSQPSVNGAPSTDPLVGWGKPGGYCYQKAYLECFMTAELSDKLIQIIEREFPVRVNYHAINKDSTFDKTNSEETTPIAVTWGVFPGSEIAQPTVVDPLSFRAWRDEAYQMWMAQWGDFYPKESKSYGVIKAVHDEFRLVTLVDNDFQKPSVLFDVLQKALDELKK

SEQ ID NO: 5459 - protein, 184 aa, Caenorhabditis elegans
MSSARRCLFGRPTPEQRSRTRIWLEDAVKRMRQEESQKWGFDFELETPLPSSAGFVYEVIPENCVPEFYRTKVLTVRTTCSSLDISSTTLTPLSSPSTSDKEEPSLMDPNSSFEDEEEPKKWQFREPPTPRKTPTKRQQKMTDFMAVSRKKNSLSPNKLSPVNVIFTPKSRRPTIRTRSSCSPY

SEQ ID NO: 5460 - protein, 258 aa, Caenorhabditis elegans
MAATTAGDGKRKAARCLFGKPDPEEVSRQLNSSLEEMYKKDSRKFNFDFSGGVPIVGSRGDYEFESISASEVPSFYREKIVRPRKIIARRNSTPVSDTVEMPSESPPVVESNETPLLIASTSTEVTVYEKPVTRSSAAKQSIEQQETYNLKQTKLTNYMPVRKRRSETCLVTAAVSMSRSVSIDSSMESCKEKRGSKIVHNNKGAPKRPLRFVASNVPKSAQSSTSDTVLVSSPRSPPAKKMTTSTRRSRRPIEAGDF

SEQ ID NO: 5461 - protein, 598 aa, Caenorhabditis elegans
MDSHVGEVDIFQQCKYIHEVELVNMKLQMRILETHIETKDRLLRNLEDIIDEQESRIANMEDFIQGRATSYTNRSNMLKGISVLSLDFGNLSEENLRLKNALSQMQKVARVNELLETDEDYESDMTSNEDRFALSRDSSCSVPRSVSPQPTGDVIKPYPQMVQSMREEGHWKKLQRCAEELKTEKDELKRLALDTKDAFNVCMAEMRMMLTSKTTDFFRVLIERYKAEMEKRKQLHNQLVELNGNIRVFYRIRPQLASETDNQKPVVVIDEMDNGVVHVSNTTGTRKTSAGADKVIPTDFSQDQIFNEVSPIITSCIDGYNVCIFAYGHTGSGKTYTMDGPVTMPGINQRAIMQLFETAKERTGDIKYDIKVAMMEIYNEKIRDLLNTSNTNLAIRQTEEGRSSIPGLEEVSVNSAEEVTETLARGRKNKAVAATEANIESSRSHVIVRVLVSATNLITKATTVGRLNLVDLAGSERVSQTNATGQLLKEAQAINKSLSELGNVVLALRQNQKHIPFRNCQLTRILEDSLNGDSKTLVIVHLSPDAKSLNESISSVNFAEKIGQVFTKSGTMKREPTRRSMTGISSGQRREIPASPRK

SEQ ID NO: 5462 - protein, 468 aa, Caenorhabditis elegans
MVQSIQIVLPVALFFLIVFNGFTVEGSKKEAQLYRDLLTNYSYLVRPVRNPKKALTVTMKVFIQQVLLVDAKHQMIEVNAWLKYIWTDFRLRWNPLDYENITSVRFQGEDQIWQPDILLYNRYIEDEQESFDITYKTNAVAYSDGVINWIPPGIFKLSCKMDITLFPFDEQICFMKFGSWTYHGFALDLRLDVVKGQEPSADLSTYITNGEWHLLSAPARREEKFYKCCKEPYPTVKFYLHLRRRTFYYVFNVVLPTLLVSFMSLLAFCLPATDLSEKIGLQTTILLSVCFFLTILSEMTPTTSEAVPLLGVFFSALTFIVAMSTTFTILVLNIRYRQITNHYLSPMVFRSIFLECLPWLMMMKRPDHKFRRGSSYRDSSADQCVQVSNKGSELANILVTILKMYEVMVSQVERIRKRIALKRKRKDIQDEWKFAAQAVDRFCLIIFTIVFIICCFIFVAIPPIKILD

SEQ ID NO: 5463 - protein, 214 aa, Caenorhabditis elegans
MAAGAILKTTATLTVITTLIILGTGLFYMLSGQGHRFDIGWFLTSTSPHMWAGLGIGFSLSLSVLGAGWGIFTTGSSILGGGVKAPRIRTKNLVSIIFCEAVAIFGIIMAFVFVGKLAEFRREDLPDTEDGMAILARNLASGYMIFGGGLTVGLSNLVCGLAVGIVGSGAAIADAANPALFVKILIIEIFASAIGLFGMIIGIVQTNKASFGNK

SEQ ID NO: 5464 - protein, 1405 aa, Caenorhabditis elegans
MLTLLEPPGAKRSPTVGNYNNRSAQHLLNLAPEEDDLYETYEETEDYAENEPTGNILTRFLDQYLVGQSSSADYNDRWKREFRARPSWCDADLCLQQMNRGKATGNRYALYSRSLIQKLLFALGNTVHRNAWSIILAVSMIFAVCCYGLQYVHIETDIVKLWVAQGGRLDEELNFLPNIKEAMRNVTGDSGPELPRENGLGGGYQVLIQTPEYEGQDALAAGPLLKHVEIMKHIASFNVSVHGVDWSLSDICFKPAPPSVAADSAASSLGDVIDKIVPCIWITPIDCFWEGSKALGPHPSLPKSSLGPLGMLLSSLSDGDMIRWSDFDPIAVIDEIHRSFNLGSHYTFFERAGVSHGYMDRPCIDPLDPECPPMAKNYFDVCPHIDRVREIAKKYGTELEEEKKKDSGYSFFDFLGRKKREAGDQPKMIHPAQPADSIPTIEDAVPAQVPVSTAPIPTTTTLSPEEARAAEEKEKKQKARELKDYCKSYRKSAFEWLKKNKDKWPEVMSENMYPQNVDYAAEMTGGCSGFASNVLNWPEDMILGNPRRAKKGGKLSGADALQSVFLVASPADVFLRFKQKPGRNSMKTGLDMDAWNETAAEQVLQAWQRNFTKSLYNHKANVDEDGNERRTLHPLASTSIADMLEEFCQFNYTIILAGYALMLAYAIVTQARFDNCLPATESSMGLALAGVLVVTFASVAGLGLATWFGIEFNAATTQIVPFLTLGIGVDNMFMLLHNYRDVVKLAGGHAEMAILMRETGMSILCTSINNILSFLTGTLLPIPALRSFCAQSSILLTFNFIAILTIYPAIISIDLRRKKAQRRDLVCCLYGDTREESYSMISKPKIQSKRIIGAPSEASIMQQFDGITQAQMASSDDPAPWSLHSFIRYYYIPFISKPASKVAIIVGCCALLGASFIGMRQSTLGLELGDVLPEHTAPAQFLRARDKYFSFYPMFAVIKGPNIDYAHQQRQIDNYRQSIGSSKYVIKNKNEEPSEKYWLGLMRDWLISIQRGFDEEVAKGSFNLTSGTVIGSNVSEDARLAHALMCSHGSLFGCAGRVGKIRLVDASGIINSDGFYNYLTAWFNVDHMMYYVSQASFFPTPPKWELSKNHTENFIPAAEPLAYSQIPFYLTGLTDTAVIVDAIKDIRSVCERFTDQGLPNFPQGIAFTFWEQYLFLTGNLMQAISIITISVFCVISVLLFNPWAALMVVCILGIMTCELAGFMGLVGIKLNPVSAVTLITAVGIGVEFTVHVVVSFLTALGTRSQRTSSAVDRVFVPVIHGSFSTLLGILMLGFSEFEFVVKYFFIVMTALICIGIINGLILLPVLLSWFGPRREISPTGGKTTLTLPPPLPKNANSSRSGGDDSDEDDEPSGLVMYSRQAPPTTRTSGGNRGTVGNNTRRLPAV

SEQ ID NO: 5465 - protein, 448 aa, Caenorhabditis elegans
MMAARLLGTSSRIFKLNKHLHTSKVAFMPVVQFKLSDIGEGIAEVQVKEWYVKEGDTISQFDKVCEVQSDKAAVTISCRYDGIVKKLYHEVDGMARVGQALIDVEIEGNVEEPEQPKKEAASSSPEAPKSSAPKAPESAHSEGKVLATPAVRRIAIENKIKLAEVRGTGKDGRVLKEDVLKFLGQVPADHTSGSTNIRTTHQAPQPSSKSYEPLKEDVAVPIRGYTRAMVKTMTEALKIPHFGYNDEINVDSLVKYRAELKEFAKERHIKLSYMPFFIKAASLALLEYPSLNSTTDEKMENVIHKASHNICLAMDTPGGLVVPNIKNCEQRSIFEIAQELNRLLEAGKKQQIKREDLIDGTFSLSNIGNIGGTYASPVVFPPQVAIGAIGKIEKLPRFDKHDNVIPVNIMKVSWCADHRVVDGATMARFSNRWKFYLEHPSAMLAQLK

SEQ ID NO: 5466 - protein, 221 aa, Caenorhabditis elegans
MDELMFFRGMAPDPTSYDRVFKFLIFGGKSVGKKTLLRSFCTEGDNESIWTSLTVDDEKVLIEATVSQKWEEGMSKEHDAIALVFSTTDVYSFEYTLELYNEIQKSTERIPLVFIENKIDIVEDSQMDKGLVEGEMRKKHKRLYRVSALKEFNVMHPFAYLIEKLTRQKKDLNANERKQSSSVNSTSTSPPSTTVEAWVEPVPTATTTSAPALKKDKCTLM

SEQ ID NO: 5467 - protein, 1181 aa, Caenorhabditis elegans
MRAPPKKLLKLFPTFFRMHQNLNFTIILPSSRFSATLLRKLHFFITYKQIHYLKRLESEDLDLINFAKKSDLIFIITALICALLGGTIQPVVLLIGGWITDLYLTNGNVCDFGNNFIFSIQNFQTAGNDEFLYSVLTLIYAGLGFGVIILVLALIQGVCIQRGTSRILDSIRKEFLGAVLRQDANWLDKHSSGSITCQLNENIEVISDGLGNKCCMLVRGFAMFTSSIIACAFINWQLTFITFTMGPVSAFVLHLLTKVIFYNTIHSCNFVVSDKSLSFQVNEVSNEELMSLSAQSHAIIEESILNVRTVQSCNGQNFMITSAPKSEGKEGEIKISSTRGNIEFRDVRFKYFTRDNEVLQGLSLQVLPGQTVALVGTSGCGKSTSIGLLTKLYRASEGEILIDGKNIDMLDAKSLRQQIGIVQQEPKLFDGTIMENIKLGRNVDEETIKTAADIANASSFIEKLENGYETRLGPGGVQLSGGQKQRICIARALVTSPSILLLDEATSALDSHNEHIVNKALTKASEGRTTIIIAHRLSSLKSVDRIYVLDQGKTKEIGTHDELILLGGIYARLAKSQEVEQSSKKDWEREELRRAEKMKKKGRTVEIIEPNSTILQEHEHNFVGSVITENEEQKISFSGISKLFNYLPKHRKTLILIIALLIPRAIELCSYGIGMSFAFKTLQMYLCGWLANEVMNEVKQEMLSEVLNKPIPYFDNPETSPSACVSRIISHAHNCYACLDHRAIRFVWFIAGTIFSLLLAFPFVWELGVLGLGITILLTIFSLHFVSVAHRAHSEKSVMDKSGEFAVEIVEHIRAIKLLAVEGYFENKFSEYLKTSEIYENKIGFVSSLNFAITQSYVFACDMLLFFVGTLLIYHGRYSPDKVFLAFNGAQMSAWGVMYFSPWFPEIVRGSASANQIFSFFDKNRTNSTSGLSKPEINGKVEVSDVTFAYPSTPHRNVCEGFSLNIPKGHSIALVGASGCGKSTIISMLERFYSAKAGRISVDDNDIDGIDVNHLRNNISVVGQEPVLFNATIRENITIGIDEVSVEEVQKACKAANAAGFIESFPLGYDTIVGEGGASLSGGQKQRIAIARAIIRKPKILLLDEATSALDTQSEEIVQKALRSATTGRTSIIVAHRLSTVQHCDTIYYISRGAVAEYGTHAELVAMDSKYARLVAAQSLS

SEQ ID NO: 5468 - protein, 507 aa, Caenorhabditis elegans
MSSDKFKLDTLFDDNDEIIEPDGADVKKRNVAYYYHKDVGHFHYGQLHPMKPQRLVVCNDLVVSYEMPKYMTVVESPKLDAADISVFHTEDYVNFLQTVTPKLGLTMPDDVLRQFNIGEDCPIFAGLWDYCTLYAGGSVEGARRLNHKMNDIVINWPGGLHHAKKSEASGFCYVNDIVLGILELLKYHKRVLYIDIDIHHGDGVQEAFNNSDRVMTVSFHRFGQYFPGSGSIMDKGVGPGKYFAINVPLMAAIRDEPYLKLFESVISGVEENFNPEAIVLQCGSDSLCEDRLGQFALSFNAHARAVKYVKSLGKPLMVLGGGGYTLRNVARCWALETGVILGLRMDDEIPGTSLYSHYFTPRLLRPNLVPKMNDANSAAYLASIEKETLACLRMIRGAPSVQMQNIVGIRLDEIEQIEENERLQKSSKSSIEYEVGKVSEKMEEECFVEEDSKPPSFPPGQDPRRIGQYWGYDRSGLAPPRSHSDVIEEAKYEDRDRRKDLNIPGIP

SEQ ID NO: 5469 - protein, 447 aa, Caenorhabditis elegans
MSLTTIIFDNGGHNMKIGTIDSESPRLVPNSIVKAKHEKKRVFVAHEQEECSDKFSLFYVRPIERGYVVNWDTQQQIWEKTFGSMDVEASTSRIALTDNNYLIPALPDVSSEILFDYFGFTEVHKTSASTLVAKHSNKINNEKCAVVVDSGFSWTTVASFVNGMLIQDSVIRLESVFKLQLALFLRIDVGGKALTNKLKDWVSYRQLNVSEETYVINECKEDLCFVSQNFDESMKEARNRFQENTTMKRYIMPDFHSTFRGVVKDVKEPHDPQIPSIHLGVERFAIPEILFKLVISAKSINYFICCSPSDIDIDQCGVAEAVIESICQCPEALRPALAENIIVIGGSSCFPGFRERLEREVRSMLPAEYGLNVSNDVINPQTHSWHCGQELLTASKVPWINRKDWDERGDSLEFSNFFQTLVQSDELKGTRNFDDQREKSPKEDEDF

SEQ ID NO: 5470 - protein, 397 aa, Caenorhabditis elegans
MSLFARQLQSLTASGIRTQQVRLASTEVSFHTKPCKLHKLDNGPNTSVTLNREDALKYYRDMQVIRRMESAAGNLYKEKKIRGFCHLYSGQEACAVGMKAAMTEGDAVITAYRCHGWTWLLGATVTEVLAELTGRVAGNVHGKGGSMHMYTKNFYGGNGIVGAQQPLGAGVALAMKYREQKNVCVTLYGDGAANQGQLFEATNMAKLWDLPVLFVCENNGFGMGTTAERSSASTEYYTRGDYVPGIWVDGMDILAVREATKWAKEYCDSGKGPLMMEMATYRYHGHSMSDPGTSYRTREEIQEVRKTRDPITGFKDRIITSSLATEEELKAIDKEVRKEVDEALKIATSDGVLPPEALYADIYHNTPAQEIRGATIDETIVQPFKTSADVLKSIGRA

SEQ ID NO: 5471 - protein, 983 aa, Caenorhabditis elegans
MRATFHLFTFIFLLLFSSVICISTPGFRNDHESIGDDEEKTSSTILVSTIDGRLRALDSETGEIKWTLQEEPVLRSPSAVKQGFTFLPNPLDGSLYVLKNSSLKKLPFNIPQLVHASPCKGNDGILYAGSKKDVWFGIDPKTGLKVEYILLNISDKILFLQVETLSSASADRICPANQKQTIFLGRTEYRVSMFDEKNRGKTWNATFNDYSAHLLPEVNTWPFKHYASSSHGYILTFDRETGEMRWEQDLKQPVVALYLLRDDGLHKLPFEVMGKETMENVAKNIFTVDQWPTVLGVNAADPQTTSLTNQFFPALFVGESSFGLYAIEALVDHQTITYSPKLLGPPLLEGPAPIALTEMEKEEYLPPRRPIIRNIPPSITHKTSDGEYLLLGYHDRPMMTMATIIPTRYPVPGPHKAIGSTIERPPPQLLGPVEPQKHEDTSFILLLLNNHPIPFYATLVTMFALLLTVIWQCGRQWDQQKSTSRMDSFEIVNNPGESRSAQTSKQSNRGSFGWANRKIEIPEGWMAVGSKLMYSPSDILGTGCEGTVVYRGTFDGREVAVKRVVSEFVKFAHREADLLRESDTHPHVIRYFCMESDSQFRYLALELCIASLNDYVEQKEVQQNVTIALRDIMKQATDGLAHLHASKIVHRDMKPQNVLITMASQRGEMRAVISDFGLCKRVQPGKNSISRGIASGLAGTDGWIAPEVLISASTSYPVDIFSLGCIFYYVLTSGTHPFGKSLHRQANIVNGEYTLNKLADLDDWSLADDLISSMLNVEPLHRLTADAVLNHPFFWTSEKRLAYFSDVSDRVEKEEDNSPVVRRIETDARIVVCGGWREKICDALKEDLRKFRTYKSFSVRDLLRAMRNKKHHYRELPEDVRQSLGDIPDQFLHYFTSRFPRLLLHVYKATEYCSGEAVFKRYYSDDVRARMYPIVEEEERVRKKIKEEMANEVWARAPKPVEQRTPLKLDKRNIKKKSNPNTD

SEQ ID NO: 5472 - protein, 810 aa, Caenorhabditis elegans
MASVPTQRDEKEKKNDELATAILKDKKRPNRLIIDQSDNDDNSMVMLSQAKMDELGLFRGDSVILKGKKRRETVSIVLNADNCPNDKIKMNKVVRNNLRSRLGDVVSISSAQLEYGKRVHVLPIDDTIEGLTGNLFDVFLRPYFTDAYRPVHKGDIFTVQAAMRTVEFKVVETDPAPACIVAPDTVIHYEGDPIKREEEEEALNEVGYDDLGGVRKQLAQIKEMVELPLRHPQLFKAIGVKPPRGILLFGPPGTGKTLIARAVANETGAFFFLINGPEIMSKMSGESESNLRKAFAECEKNSPAILFIDEIDAIAPKREKAHGEVEKRIVSQLLTLMDGLKTRAHVVVIAATNRPNSIDGALRRFGRFDREIDIGIPDAVGRLEILRIHTKNMKLGEDVDLEQVANECHGFVGADLASLCSEAAIQQIREKMELIDLEDDTIDAEVLNSLAVTMENFRFAMGKSSPSALREAVVETPNTTWSDIGGLQNVKRELQELVQYPVEHPEKYLKFGMQPSRGVLFYGPPGCGKTLLAKAIANECQANFISIKGPELLTMWFGESEANVRDVFDKARAAAPCVLFFDELDSIAKARGGSVGDAGGAADRVINQVLTEMDGMNAKKNVFIIGATNRPDIIDPAVLRPGRLDQLIYIPLPDEASRLQIFKASLRKTPLSADLDLNFLAKNTVGFSGADLTEICQRACKLAIRESIEREIRQEKERQDRSARGEELMEDELADPVPEITRAHFEEAMKFARRSVTDNDIRKYEMFAQTLQQSRGFGNNFKFPGEAPSAGQPVGGNGGSGGNDDDDLYN

SEQ ID NO: 5473 - protein, 810 aa, Caenorhabditis elegans; identical to SEQ ID NO: 5472

SEQ ID NO: 5474 - protein, 309 aa, Caenorhabditis elegans
MACKNPKKFFPICNSPILRDGALKGKVALVTGGGTGIGKAIATTFAHLGASVAIAARRMEKLEQTAEEIMKTTGGICEPFRMDIKDPGMVSDTFDKIDKKFGKHPDILVNNAAGNFIMATERLSPNAHGTIIDIVLKGTMNVTTELGKRCIQSKTGASVTSITAAYARSGAPFIVPSAVSKAGVEIMTKSLATEWSKYGLRFNAVSPGPIPTKGAWGRLFSGEMGDVAEKMKELNPEGRSGTPEEVANLVAFISSDHMSFMNGVIIDLDGGQQHFNHGSHMGDFLHTWDQDTWGDVENVIRGRTGKEKP

SEQ ID NO: 5475 - protein, 325 aa, Caenorhabditis elegans
MLNRNRNVNKQNGHQKQNGAQKSELRGKNAPPYLERETCLGRNDIFVVEKMIAGGGFGQVYRARNTETQEEVAVKVERATTNDSQRMILESKVLDDMLGSKHFPNVYYIGPYHSYNFIVMQMLGKNIGDIRKMMPNKKISILSSVRIGIQIIEALSLLHSKGWLHRDLKPTNCCLGLDEKRKTVYLVDFGMSRKFRNDNGSLRESRTYCGFRGTTRYCSYRMHDRREQGPVDDLWCLYYSLGELIEGCLPWRDIESADEMAHVKKILKHEDIFHSMPSKFASFGRNLRRLRPANTPDYTKFQNILAYCVKFVDDNAEFEWDVMDY

SEQ ID NO: 5476 - protein, 456 aa, Caenorhabditis elegans
MSFVFFILLTFYIQVKGSVDEYRLLQYLKENYDSFERPVENSSAPLDVKVRFLLNQIMDVDEKNQVMSILAYMDYHWNDYKLTWDPKLFGGIRDVRFSGDDDASFKLWRPDVLLFNSVSESFDSTYSSRFIVSSNGDVQQNPPGIFRFVCQIDVTYYPFDKQTCFLKLGSWTYNGQYINLDFLLTQIIGKRVVQKFGTDEYHELYFYIHIRRRTLAYGINLIIPSLVISMMTILGFTLPPDACEKITLETTVLLSVIFFLQMVSSTSPPQSQSVPILAAFFSCCLMLVACSCVFTVLTLSLHHRKPETHEMSPTMRKIFIDWLPYILCMCKPDHPKTPKPKVLGKSIAPIHRLSTIPMLNLPRVSQTTFPDKNVFVYHEVPAVIKNTSRICAELLIIERDIEKMLDKIEEDTKEDMLRSEWRFAAMAVDRLCLYVFSAFITMITCGLIVPHILANI

SEQ ID NO: 5477 - protein, 672 aa, Caenorhabditis elegans
MEPPCTSDCSQIKVFYYLDDETTPYVSVIEAREGVATLGNFKNSFTKRGYKYYAKELDPDIQREVKVELTTDSDRLRKSQNGFYEIFLVSTPGYGTLPRNSGTMTRPQRTALDKRRRRSADFDATPYSDASLAPSTIVSRRAGEHLAELYTSNSEDPYQYDEHTRRTGDDSSLYEPLAARDMNKIYDDDRRRKKQKKERFRRPYVPSTISSATESSVNSGLPRILEIYLPMKNVPYLGLSVCTIDGHIFVSEIAPEGAVEKDGRVNVGDQILQVNRVSFEELSGPQAVRSLREAASSKRPITLYISKFARGAPSEYDDPLASMASETMPLDVGVWVETAVQNTEKMKALGLDPQEQTATTIDDGTLPFTSTASDDEERMLYDQRRNGIPRALIEEAERKRENEQNEKIEQLTEMIDPIIVVRSMARPDSGLAVKNRKWLKILVPMSFIGRDLVDWLVDHMADIHNRKKARIYAARLLAAGLIRHVVSKLTFTEKCYYVFGDGILGNDRNSTDTTGTSGTTMRVEATTEVTYVGSPAPHALAARVGRNIPHRLETTTLSPVAHDQTWLRRRRDCESPMTNDYASMVGESQIGMNPVGNYHVFGTKNNHRQVPAPSQVTSSSLTNGSGGLGGPPPTPLSSTMVLAASPIQSQNAVNHDFDGENSSNSRTRILRT

SEQ ID NO: 5478 - protein, 549 aa, Caenorhabditis elegans
MASAGDSILALTGKRTTGQGIRSQNVTAAVAIANIVKSSLGPVGLDKMLVDDVGDVIVTNDGATILKQLEVEHPAGKVLVELAQLQDEEVGDGTTSVVIVAAELLKRADELVKQKVHPTTIINGYRLACKEAVKYISENISFTSDSIGRQSVVNAAKTSMSSKIIGPDADFFGELVVDAAEAVRVENNGKVTYPINAVNVLKAHGKSARESVLVKGYALNCTVASQAMPLRVQNAKIACLDFSLMKAKMHLGISVVVEDPAKLEAIRREEFDITKRRIDKILKAGANVVLTTGGIDDLCLKQFVESGAMAVRRCKKSDLKRIAKATGATLTVSLATLEGDEAFDASLLGHADEIVQERISDDELILIKGPKSRTASSIILRGANDVMLDEMERSVHDSLCVVRRVLESKKLVAGGGAVETSLSLFLETYAQTLSSREQLAVAEFASALLIIPKVLASNAARDSTDLVTKLRAYHSKAQLIPQLQHLKWAGLDLEEGTIRDNKEAGILEPALSKVKSLKFATEAAITILRIDDLIKLDKQEPLGGDDCHA

SEQ ID NO: 5479 - protein, 361 aa, Caenorhabditis elegans
MGTPIAPVKVNMGDKIKDQFTVKKKLGEGACGQVFLVDLIQGKGSAAMKVEPLMKNKEDEILKMEVYVLKKLQNSRHVCRLLGSGKTETYTYMVMSVLGKEIGDVRRRLPQRKMSAPSTVRVFIQLVKALQDMHEAGFVHRDVKPSNMALGVKNEQVVYIFDFGLSRQIMLPDASGKLKLREPRNKSMFRGTVRYCSLNVHLHKEQGRHDDLYGALYAMIETATSTLPWKGKPKKETSALKEKTTDVQLCKGCPKSFLEIATTLRKLTYKETPPYGSFMEKLKADLPKGVKMTDPFEWNLKGALDENNNGNKSDREDAERGGGADTVNEVDESVITEDRADTTSSSKNGEEYAPEDTLDNI

SEQ ID NO: 5480 - protein, 650 aa, Caenorhabditis elegans
MVYGLGEALKNLNSYCQERTTRIRNSLSPSRPSMSEATATGSSSSSRASTTIPSTPNMDVTPTVEDPRQNDNNASGMTRDEFRQYGKETVDYIVDYLENIQKRRVVPAIEPGYLKDLIPSEAPNTPESFESVMEDFEKLIMPGITHWQHPRFHAYFPAGNSFPSIIADMLSDAIGCVGFSWAACPAMTELELIMLDWFGKMIGLPAEFLPLTENGKGGGVIQSSASECNFVTLLAARFEVMKELRQRFPFVEEGLLLSKLIAYCSKEAHSSVEKACMIGMVKLRILETDSKFRLRGDTLRNAIQEDRNLGLIPFFVSTTLGTTSCCSFDVLSEIGPICKENELWLHVDAAYSGSAFICPEFRPLMNGIEYAMSFNTNPNKWLLINFDCSTMWVRDRFKLTQALVVDPLYLQHSWMDKSIDYRHWGIPLSRRFRSLKLWFVIRMYGIDGLQKYIREHVRLAKKMETLLRADAKFEIVNEVIMGLVCFRMKGDDELNQTLLTRLNASGRIHMVPASLGDRFVIRFCVCAENATDKDIEVAYEIIAQATQHVLHDSVKAVIAEEDEEAVALEEMVADLNITETPEKCLTRQNSANAAESGQKLERQLSKEEILAQKQHESLAKKRYTPQPLDLALAPDSDPELSPCSPQILVS

SEQ ID NO: 5481 - protein, 296 aa, Caenorhabditis elegans
MKIPDLTNYEHLIGGLCGGVTSTVVCHPFDLLKIRFSANEGSSLRPQYSSYADAVRKIVRVEGVRGLYQGWTPSLIGASLSWGLYFQWYNSLRTKIYENFSTGSKLANNLISGCISGSAIMCITNPIWLTKTRLCLQYENQQSKKYAGMMDCLKKTVKQEGFFGLYRGFVTGVIGTTHGAVQIAAYSWIIDKRCQSQGLPKDSFLSQTDYVIASSTSKVLATTITFPYQVLRTRMQDHNTDSRGVWKTTLKTIHNEGIGGLWKGCLIANVRQLPAAVVTFLTYENVKRLVGMTKQI

SEQ ID NO: 5482 - protein, 540 aa, Caenorhabditis elegans
MPPAVPAAAATARQSASGRERNFKDKDKPESVRNSNIVAAKAVADAVRTSLGPRGMDKMIQSGNGDVTITNDGATILNQMSVIHPTAKMLVELSKAQDIEAGDGTTTVVVMAGALLDAAQNLLSKGIHPTTISESFQSAAAEAEKILDEMSSPVDLSNDALLNKMATTSLNSKVVSQHSWLLAPMAVNAVKKIINSENDSNVNLKMIKIIKKMGDTVEESELIEGALIDQKTMGRGAPTRIEKAKIGLIQFQISPPKTDMENQVIITDYAQMDRALKEERQYLLEICKQIKAAGCNVLLIQKSILRDAVNELALHFLAKMKIMCIKDIEREDIEFYSRILGCRPVASVDHFNADALGYADLVEEIPTGGDGKVIKVTGVQNPGHAVSILLRGSNKLVLEEADRSIHDALCVIRCLVKKKALLPGGGAPEMEIAVKLRNLAQTQHGATQYCWRAFADALELIPYTLAENAGLSPIHTVTELRNNHANGNSSYGVNVRKGYVTDMVEEDVVQPLLVTASAIKQASECVRSILKIDDIVMAVR

SEQ ID NO: 5483 - protein, 776 aa, Caenorhabditis elegans
MDTEHRVILNVGGIRHETYSHVLKKIPATRLSRLTPNLANYDPVLNEYFFDRHPGVFSMILNYYRTGKLHYPTNVCGPLFEEELEFWGLDANQVEPCCWMTYTQHRDTQDTLAVIESLDLDGDPPTQEEIAKKFGWEDDYYTGNMSQWQRLKPRVWALFDEPWSSKYARVISSLSVAFILASTCSFILKTDPSFQIPDIDVFYSLRVVDEGGFKNYHKTIGTDKPVTSPHPNFFYVDLICNIWFTIELLIRSLFCPSFHKFVRSPLTIIDVISTGAFFFESLLHAILIQTGSLVTLDFLSMICVLRLFKLTQHFSGLKILIQTFKASAQELFLLVFFVILAIVIFAALVYYAERSQLNKDNQFTSIPLGLWWSLVTISTVGFGDMVPKTYLGMLVGSLCALMGVLTIALPVPVIVSNFSNLYSHSQARAKLPKKRRRVLQVISVVNIIFVIISIVCFCLKTHPSFRIPDIDISTTMGNFSAPLNGVQMNNIYVGKTATRAHPSFFYVELLSNIWFSGEFLTRMVFCPNVATFLRTPVNLIDFIATVSFYIDWALDRTLSGSNRDSVEFFSIIRILRLFKLTQHSTGLKILIQTFKASAQELFLLVFFVLLGIVIFAALVYYAERVEHNEENQFSSIPVPQTSLGRLVGSVCALMGVLTIALPVPVIVSNFAMFYSHAQARSKLPKKRRRVLQPHEIKPVVGRSTTAVMISALTQRGPVSGGGSNPSDGGPLSAFSNNTPLLVCPPDGSTKPKKLSQNKNGGTTPIQNNGSKASKLI

SEQ ID NO: 5484 - protein, 425 aa, Caenorhabditis elegans
MEEEQLLDYEEEQEEIQDKQPEVGGGDARKTKGTYASIHSSGFRDFLLKPEILRAIGDCGFEHPSEVQHECIPQAILGMDVVCQAKSGMGKTAVFVITTLQQLEPVDGEVSVVCMCHTRELAFQISKEYERFSKYLPGVKVAVFFGGMAIKKDEERLANDCPHIVVGTPGRMLALARSGKLKLDKVKYFVLDECDKMIGDADMRRDVQEIVKMTPQQKQVMMFSATLPKELRTVCKRFMQDPMEVYVDDEAKLTLHGLQQHYVKLKEAEKNRRLLNLLDALEFNQVVIFVKAVKRCEALHQLLTEQNFPSIAIHRQMAQEERLSRYQAFKDFQKRILVATDLFGRGMDIERVNIVFNYDMPEDSDSYLHRVARAGRFGTKGLAITFVSDENDAKTLNSVQDRFDISITELPEKIDVSTYIEGRTN

SEQ ID NO: 5485 - protein, 166 aa, Caenorhabditis elegans
MSTLQAAAHGRIVQLSRIRKEIADLAKNKRRFIKDFRKIEKCKDIFQFKIIGDGVLYKNMIFTLTLDVNVEYPFKPPYLKFCHNVENEIMVYHPNVDPVTCELCSPMLLQENWKPETTMEDVLLNLIVLLNEPDLSRPVNIDAAHDYIHNKVEFVKKSTELAKKWN

SEQ ID NO: 5486 - protein, 483 aa, Caenorhabditis elegans
MSNRLWPVKQVCIFALIAFASNFNYGFSTTYINTSVDEFKTFLNTSLSRRHVIMTEEKYDLIWNVFLNCWFIGSFFGVWINSIFMGFLIGNSVAFISSILQCLSLIWYCPELLIVSRFITSICMAATYQSCILFLQEKIILRRNIMRKECEIPIECSPTHLRGSFSFLSEVSYSSMTMVGSFLGQDYIIGSHLFWLCFFVVPFCLFFTLILFILPETPKFLLISKDEEEEAIKSVKYYHGDGTDAKQVLEDIRKEAECEQDSSKSTTFQKMKELFTERHLRMALILSVSALTNTVGLWALLLSSTFFLENANVESEIAEWSTTAMGLAYVSGTITGGIVIEKVGRRKLLLLFTFLNNLALIAFVFFAKIRILIDPMKYGCLVALIIYGYTYGTGVGPISWFISSELVPQKHRSIAQSVAYSMNTVMVVISTFTVLPLYSVIGSYAFLILYSIPSFISMLILFRYLPETKGREIHDIVNELKKK

SEQ ID NO: 5487 - protein, 483 aa, Caenorhabditis elegans; identical to SEQ ID NO: 5486

SEQ ID NO: 5488 - protein, 200 aa, Caenorhabditis elegans
MGFLKILRKQRAREREMRILILGLDNAGKTTLMKKFLDEPTDTIEPTLGFDIKTVHFKDFQLNLWDVGGQKSLRSYWKNYFESTDALIWVVDSSDRERLLQCSEELKKLLGEERLAGASLLVLANKSDLPGAIDVNSIAQVIQMSSVYTSEKKCFLVLDLHSIKSHHWKIFSCCALSGDRLVQAMTWLCDDVGSRLFILD

SEQ ID NO: 5489 - protein, 361 aa, Caenorhabditis elegans
MGTPIAPVKVNMGDKIKDQFTVKKKLGEGACGQVFLVDLIQGKGSAAMKVEPLMKNKEDEILKMEVYVLKKLQNSRHVCRLLGSGKTETYTYMVMSVLGKEIGDVRRRLPQRKMSAPSTVRVFIQLVKALQDMHEAGFVHRDVKPSNMALGVKNEQVVYIFDFGLSRQIMLPDASGKLKLREPRNKSMFRGTVRYCSLNVHLHKEQGRHDDLYGALYAMIETATSTLPWKGKPKKETSALKEKTTDVQLCKGCPKSFLEIATTLRKLTYKETPPYGSFMEKLKADLPKGVKMTDPFEWNLKGALDENNNGNKSDREDAERGGGADTVNEVDESVITEDRADTTSSSKNGEDYAPEDTLDNI

SEQ ID NO: 5490 - protein, 309 aa, Caenorhabditis elegans
MACKNPKKFFPIRKSPVLRDGAFKGKLVLVTGGGTGIGKAIATTFAHLRATVVIAARRMEKLEQTARDITKITGGTCEPFQMDIKDPGMVSDAFDKIDMKFGKVPEILVNNAAGNFIMATELLSSNAYGTIIDIVLKGTFNVTTELGKRCIQNKTGASITSITAGYARAGAPFIVPSAVSKAGVETMTKSLATEWSKYGLRFNAVSPGPIPTKGAWGRLNSGEMGDIAEKMKFLNPEGRVGSPEEVANLVAFISSDHMSFLNGAIIDLDGGQQHFNHGSHMGDFLHSWDHKNWEDAENLIRGRTGKEKA

SEQ ID NO: 5491 - protein, 469 aa, Caenorhabditis elegans
MAGATGSLLGNFQRMIRIKLSKKSYFIAAGGIFILLLAGWLGQKYGLPPPPPKIAGIDLGTTYSSIGIYHAVTGETIILPDDLGKKSVPSVVAFLPNGTVLIGTRATEQQEHNPKRTIYDAKRFIGRNFEKNNKDFLSDQKRYPFKINLDSEGKAFFEIPLDSGTKNVYPEEIGSLIIGYLKSAAAKHLGVTLGQVVISCPAEFNEKQRNFTAKAAEIAEMEVRRVISEPTAAALAYGLHKKQGVENVVVVDLGGGTLDVSVLWLQGGVFVTQAMAGNNRLGGQDFNDRVQKHLISKIAEKFGKTIDNKEDIQQIRMEVEKGKIRLTNVPSTTISLNLKTVGKWNYELTRDEFETLNGDLLKAIELPITAALADANLDTADVDEIVLVGGSTQVPAVRKIVGRFFKKSANYGVDPELAVVTGASVQAGVIGGGWPLQVAAMELPAKRRKRHFFTEEQKENEKDRTISEL

SEQ ID NO: 5492 - protein, 442 aa, Caenorhabditis elegans
MSENPVVSDKKPGPSKDSSFFSDLYDNLNQNPYFNAGAGLAGIGIAMSFLRRTAQISNTYFRRRFMINLQINNEDAAYPWLLDFINNRSATQTRNLSANTVVHQAESGKTELSISFLPGHGTHFFVHDYRWIKVERQREKQVIQRDGIRTPFETVTLTTLGSDVKFFKRMLEQSAKEAIDNAETGLVIYQAVGPQWIRFGVPRKKRDIESVILDGRICEELVEDFQEFISSATWYADRGVPYRRGYLFYGPPGTGKSSFISALASHFGYSVCLLSLSERTLDDDRLNHLLNTAPPNSVVILEDIDAAFVSREDPMSNHPAYQGLSRVTFSGLLNALDGVACAEERLTFMTTNYVERLDPALIRPGRVDRKQYFGNATDGMLSKMFSRFYRQPSDSVLADEFVKRVSEHKTELSPAMIQGHFLMYKQDPRAALDNIKNMFKTV

SEQ ID NO: 5493 - protein, 180 aa, Caenorhabditis elegans
MGGVMSYFRGLFGAREMRILILGLDGAGKTTILYRLQVGEVVTTIPTIGFNVEQVEYKNLKFQVWDLGGQTSIRPYWRCYYANTDAIIYVVDSADRDRVGISRQELATMLQEDELQGAVLAVLANKQDIAGCLTETEVYKALGLDALRNRTIQIFKTSASKGEGLDPAMDWLANQLQQKK

SEQ ID NO: 5494 - protein, 148 aa, Caenorhabditis elegans
MMTGRGFIFTVIMGLLLAVSTVTCADAVETEGSIVSGSEDVKVSLESKSTVAPTSSVTQKSSNSTESPETDSTEKGDDEKPITEQIRTYIEDSVKSVKHAISKIGKFVGELFEPSNSTVPSNRSTTVPVASTVIPSVVSSLPNDKDQK

SEQ ID NO: 5495 - protein, 458 aa, Caenorhabditis elegans
MVIVWYHQLLLVLLIFIGAAKGAQYIGSGASQPNRTDVVWMVPSWTCKNEYSIDVEKYGILQNEDQHFVGGKQFAIFYEHSFGKIPYFKAQNESDPKNGGLPQMGDLEAHLIQAEKDINETIPDENFNGIAVIDIEEFRPMWELSWGPFSVYKTESIRLTRQQHPYWSTKQIEWQAERDYEKACQKFFIETLRLGKRLRPNAKWGYYLFPKCNGDVGQKSDTDCSTLFQKFNDNLHWLWGESTALFPSIYLYPSQKQNPEYNFVNSGALITETKRIKRNYCPSCEIHVFTKIEYNPYYTPDDFYSKQNLASTLDLAIKMNANSVVIWSTSQSIGSRCGSLQTYVDNTLGPYLQLTDRNLDKCRMERCEGRGECYLPRPKTNPAIYNFACRCERPYFGKSCEYRGRRMGVSMPKASQTPQVIPDVTAYFSTSSNGTKKYNAPNQFYSRTGGDIKLARKL

SEQ ID NO: 5496 - protein, 2198 aa, Caenorhabditis elegans
MRATLHLEDGSTFVGSIYGATKSVVGEIVFQTGMVGYVESLTDPSYAKQLLTLTYPLIGNYGVPSAEILDQFKLPAEFESDRIWPAALIVEKICVDGEHSHWQAVQSLSEWLRKADVPCLSGIDVRQLVKKIRETGTMKAKLVIESDNAQNFDYVDVNAENLVDFVSRKEPVVYGSGDQTILAVDCGLKNNQIRCLAKRGFRVKVVPWNHPIDTESDYDGLFLSNGPGDPEICAPLVDRLAKVIARGDKPIFGICLGHQILSRAIGAKTYKLKYGNRGHNQPCTHYATGRCYITSQNHGYAVDPDSLPADWKALFTNENDKTNEGIVHSSKPFFSVQFHPEHTAGPTDCEFLFDVFADSVRQAKSGTFMNVDQELTRLMTFTPIYHAKEQRKVLVLGSGGLTIGQAGEFDYSGAQALKALREEGIRTVLINPNIATVQTSKGFADFTYFLPITKEYVTDVIKKERPTGILCTFGGQTALNCAIDLYKDGIFEQYDVQVLGTQINTIMKTEDRDLFNQEISAIGEKVAPSKAATTMEGAIEAAEELGYPVLVRAAYALGGLGSGFADNREELIAIAQQALAHSNQVLVDKSLKGWKEVEYEVVRDAYDNCITVCNMENVDPLGIHTGESVVVAPSQTLSDREYNALRTCAIKVIRHLGIIGECNIQYALDPYSLTYYIIEVNARLSRSSALASKATGYPLAYVAAKLALGQHLPVIRNSVTGTTTACFEPSLDYCVVKIPRWDLGKFARVSTQIGSSMKSVGEVMGIGRCFEEALQKALRMVSDHADGFSPYTFSRPTTADDLSKPTDKRMFALARGMYYGDFDVEKAHELTRIDRWFLFRMQNIVDIYHRLEKTDVNTVSAELLLEAKQAGFSDRQIAKKIGSNEYTVREARFVKGITPCVKQIDTVAGEWPAQTNYLYTTFNGIENDVSFNMKNAVMVLGSGVYRIGSSVEFDSSCVGCIRELKALGYSTITVNCNPETVSTDYDICDRLYFEEISFETVLDVYHLEKPKGVILAFGGQAPNNIAMSLSRAQVKIFGTSPNDIDNAEDRFKFSRKLESLKISQPQWKKSENMEDAKNFCAQVGYPCLIRPSYVLSGAAMNVAHNAEDLEVFLKQAAVVAKEHPVVVSKFINEAKELDVDAVALDGKLVVMAVSEHIENAGVHSGDATLVTPAQDMNKLTLDRIKDITFRIAEAFNVTGPFNMQLIAKNNELKVIECNLRVSRSFPFVSKTLDYDFVALATRAMMASDSPAIRATIKPTATLLKGKGRVGVKVPQFSFSRLAGADVMLGVEMASTGEVACFGTSRCDAYLKALLSTGFVVPKQNIFISIGGYHAKAEMLKSVEALLKLGYELYGSKGTADYFQSNKINVKPVDWPFEEGSSDEKTASGTRSVVEFLENKEFHLVINLPIRGSGAYRVSAFRTHGYKTRRMAIDNGIPLITDIKCAKTFIQALEMVGKRPTMNSLVDCVTSKSLKRLPGMVDIHVHVREPGATHKEDWATCSKAALAGGVTTILAMPNTSPVLVDTDSFYQTEQLASAKSVVDYALYIGATPNNSKFAAEFADKAAGLKMYLNETFSTLKMDNISDWAKHLSAFPANRPIVCHAEKQTLAAILCMAQMANRAVHIAHVATADEINLVKEAKQRGWNVTCEVCPHHLFLIEEDLPDGIREVRPRLVKPEDRQALWDNMEYIDCFATDHAPHTWAEKTGKDGKIPPGFPGVEYMLPLLLTAVHDGKLTMKELTDRMSTNPRRIFNLPPQDDTYIEVDLNEEWTIPENGGQSKAGWTPFAGRKVFGKVHNVIIRGEEAVIDGRIVAIPGFGKNVRLYPHSGTAHRGDSDFDQILEPIPQQMIESSSDEQSPLHTPPRAHTPIAFPGELLAKNCISVKHLDKGQINRIFELADRYKHDVEKGHPLTHILNGKVLVNLFYEVSTRTSCSFSAAMQRLGGSVISVDSQSSSVQKGETLEDTVQVLGSYGDILVLRSNENGAADRAARVCDQPVINGGDGTGEHPTQALLDVYTIRQEMGTVNGLTIALVGDLKNGRTVHSLAKLLCLYKDITLHYVAPSTELEMPQEVLDYVSSKSNFVQKKFTSLAEGINHVDVVYVTRIQKERFSSPDEYNKVKGSYVINAKLLNEAARDVEEPSSLLVPARSLPIVMHPLPRVDEIAVELDHDERAAYFRQAKNGVFVRMSILSLLLGRGHL

SEQ ID NO: 5497 - protein, 444 aa, Caenorhabditis elegans
MSLKIGPYSIALVSDFFCPNAGGVETHIYFLAQCLIELGHRVVVITHGYGNRKGIRYLSNGLKVYYLPFIVAYNGATLGSIVGSMPWLRKVLLRENVQIIHGHSTFSSLAHETLMIGGLMGLRTVFTDHSLFGFADASAILTNKLVLQYSLINVDQTICVSYTSKENTVLRGKLDPNKVSTIPNAIETSLFTPDRNQFFNNPTTIVFLGRLVYRKGADLLCEIVPKVCARHKSVRFIIGGDGPKRIELEEMLERFKLHERVVILGMLPHNQVKRVLNQGQIFINTSLTEAFCMSIVEAASCGLHVVSTRVGGVPEVLPIGEFISLEEPVPDDLVDALLKAVDRREKGLLMDPTEKHEAVSKMYNWPDVAARTQVIYQKAVESEPTGRLGRLKGYYDQGIGFGIMYIVVSCIIIFWLTVLDLFDSPRKNGTNDKTSEKNVDPDYQ

SEQ ID NO: 5498 - protein, 599 aa, Caenorhabditis elegans
MLQNHAARSLQRTSKRWINWRDSMKEGTFSADIAENKPTHIIVGAGSAGCVLANRLTEDPSNRVLLIEAGPVDHKWDWRIHMPAALMYNLCSDTYNWHYHTTAQKNLGNRVFYWPRGRVWGGSSTLNAMCYVRGHAYDYNRWEKEGASGWNYANCLPYFKKAETYSDATGPNDPYRGNNGPLYVKKGDAENPLHKAWLNVGKEHPLGWTNDMNGEKQEGISTMDMTIHNGERWSASKAYVHPIRNRPNLITSSGITCTRVLFDTNKAIGIEFIRKLNFVGTDSIDSYSREKIYCQGDVILAGGAINTPQLLMLSGVGPADHLRSHEIPIVANLPGVGQNLQDHLEIYVQQESTQPVTLYNKSSWKFPHNMIKIGLEWFTNRTGLGASSHLETGGFARSDDTVTHPDIQFHFLPSTVHDDGRTNGTCHGYQVHVGPMRSQSKGYIMLQAKDPRRAPIINPNYMEEDSDWREFRKCIRVSRELFASKAFDEFRGKELAPGPDCQSDADIDRFVKEKAASAYHPSCTCKMGSENDKMAVVNPETMGVYGTENLKVVDASVMPSIVSGNLNAPVIMMAERAADLIKHKKQLLPPSDANVWHHN

SEQ ID NO: 5499 - protein, 207 aa, Caenorhabditis elegans
MLETNVDQKSFKFKIVLLGEGCVGKSSLVLRFVENKFSCKHLSTIQASFQNKTVNVEDCQADLHIWDTAGQEKYHALGPIYYRGSNGVLLVFDITDRKSFEKVKNWVLEIKTCLGNTAEILIVGNKIDLEEERQVTRQDAEAYAESEGALYMETSAQDNVGISDAFESLTAKMIEHSRTRSTEPPSTNRSIRLIDNDEAERSKKCCR

SEQ ID NO: 5500 - protein, 521 aa, Caenorhabditis elegans
MMFEYEEDEDPMEQQKHEEFKHHSTDHSGSPQENPFRFSYDTGKRAASMFVTPSSEDLIAYGTKHLLDSPTAVQRSLVLNATTSLNIDCDLSSDDDLSPTTQRKICFCASQNPAETQEQGLRPAKSTLAISFPCHQHQITEDYTISAEIIGIGESGKVMACYQKVTGEKFALKVLRDSQKARREVELHWLTNAHENVVSILDIYENTFDNVKCLLMVVEFLEGGDLLSQFESQGSIPYTEKKVGEIIRQIGNAVMYLHDMNIAHRDIKLENILCSGTGDNCVYKLGDYGFAKRPERNVLMESPCCTPFYAPPEVLGRERYDKSCDMWSLGVAMYILLCGYPPFYSMKGVALSPGMRSRIANAYYAFPHEEWDCVSKDTKDDIRCLLRTNPSDRLTIHELMATPLVTGEPIVPGKHITTAIAIPGADESECGGGVFDDGFIVEEEETPDTVAEILPVPKSVRFLRDGVKAPRLHSIQEEVGRAMEIMRMGTDQVYIKNPTASCNNLFERRRAVHLSIPRVYC

SEQ ID NO: 5501 - protein, 457 aa, Caenorhabditis elegans
MPPAGQDDLDFLKYAMESYVADVNADIGKTTIVFTLREKAGALAETLKLFQAHDVNLSHIESRPSKTHEGCYEVLVEFAEAEDHRKIEGVIEHFQQKAEKKVLVQDWNTKNKQNKDSVPWFPQKINDIDQFANRILSYGAELDADHPGFKDMTYRERRKFFADIAFNFKHGDKIPTITYTDEEIATWRTVYNELTVMYPKNACQEFNYIFPLLQQNCGFGPDRIPQLQDVSDFLKDCTGYTIRPVAGLLSSRDFLAGLAFRVFHSTQYIRHHSAPKYTPEPDICHELLGHVPLFADVEFAQFSQEIGLASLGAPDDVIEKLATLYWFTIEFGICQQDGEKKAYGAGLLSSFGELQYALSDKPEVVDFDPAVCCVTKYPITEYQPKYFLAESFASAKNKLKSWAATINRPFQIRYNAYTQRVEILDKVAALQRLARDIRSDISTLEEALGKVNNLKMK

SEQ ID NO: 5502 - protein, 1402 aa, Caenorhabditis elegans
MALNNAKTPHDHQKELRDKTSEIIYLSTKLNHAKETCVNLDNERQKFREVSRKIKEKDIDPVWIYNGTCFLQTSQANSLNILEKDTKTVEEVRGQIQEVIKMSRDVKEFLYAWLGKNKYGNPTYDTKSETRSGRQRFKCELRITGFGYTAFGNSTNKKDAATNAAQDFCQYLVREGKMQQSDIPTLTSSSLEASSTWQDSETATMFCGGEDGNSFQESQQPIPQKRFPWSNNAYQRNEGTHEQYITQKAEEIAASETVDLKSEIHGGWTMENSKKALNEFLQKMRLPQVNYGTKIRESNTVKTMETTAQIFVPQINKNLVGKGTGSNKKVSEAACAMNIVRQMFHLNIMQSYSGPIKKSKVSTLPEIAISIPEDLSTRVTEYVRSCGLELPEINETSATPEAPTSLLTDVKLAQFPVSEICSASNISWAPPLQNWNPWRASNIDEEPLAFMSMEQISQRIMEKEDFKRGEALDKITAQRGELPVAQYRENIVQTVAENRVTLIKGETGCGKSTQVAQFLLESFLENSNGASFNAVVSQPRRISAISLAERVANERGEEVGETCGYNVRFDSATPRPYGSIMFCTVGVLLRMMENGLRGISHVIIDEIHERDVDTDFVLIVLREMISTYRDLRVVLMSATIDTDLFTNFFSSIPDVGPTPVITMHGRTFPVQSFYLEDILHNLQHMPEEPDQKKRKKGGPPPPDDDEGDEEVDDKGRNMNILTDPSINESLKTAMSRISEKDIPFGVIEAILNDIASRGVDGAVLVFLPGWAEIMTLCNRLLEHQEFGQANKYEILPLHSQLTSQEQRKVFNHYPGKRKIIVSTNIAETSITIDDVVYVIDSCKAKERMYTSNNNMVHFATVWASKTNVIQRRGRAGRVRAGYAFHLCSKMRFEALDDHGTAEMLRIPLHQIALTIKLLRLGSVGEFLGKALQPPPYDMVVESEAVLQAMGALDRNLELTSLGKMLARMPIEPVIAKVLILGTALGAGSVMCDVASAMSFPTPFVPREKHHSRLSGTQRKFAGNKFSDHVAIVSVIQGYREAVQMGASAAEREFCERYSLSNPVLKMTDGARRQLIDVLRNQCSFPEDILFDISVNVNGPDRELNLMRSLLVMALYPNVAYYVGKRKVLTIEQSSALINKYSMLVPMNNRQEMDFPSPLLVFTEKVRTRCISCKQMSVISAIQLLVFGSRKVECVGEGLVRIDETITIRMNVSTAAALIGLRPCIEALLVKSCENPESLAGLNPSDAELRQLLRDISSEEFMSEAGPIKDSLLTDNALIQKGPAPNRLEYADWGPSNNNSSFQNQDFPPAAGGKVHPYRGNRRGNHPYAQNRPYAPPNSGMGYQNFNNSGYGASGDWNAGRGNYGNVGSGYRGAGGGGGYRGGRGGRGGGRGGGGRGWNASNW

SEQ ID NO: 5503 - protein, 638 aa, Caenorhabditis elegans
MADWGIAFDEQCRSEGLEVPEKTEKVQSGSEMDQNEENKGSNGWGISRGGMFGGPKASNAPPPQTSFGSTSGTRVGGSFGGQAGVDGRGAPLGSAEELIGGVPIMPGQSQPMRGGFQGAYRGGRGSGGGQMDFGAPGQGQSMGRGRGQQNPAFVPRPRDTPPQYGGHQAAQQFVKPDSKYKFTKPATEEAHEQVPVPADIALLNKFIQKEVKMMKDVVVDVQRQDPKSPLYSISSFRELRLKPEVLKALDTMNFQFPTRIQETALPLLLMEPPSNLIAQAQSGTGKTAAFVLTMLCRIDVNLMCPQCICLAPTLELAKQIGEVVEKMGKFIDNLKIHYAIKGGNMAAMRGRKLTEQIVIGTPGITRDYLQKYKCIDPSKIRCLVLDEADVMIYHQGFTDISTTIYNMVEDASDSVQSMLFSATYDEPVINFATKIIKNAIVVMLKREEQALPNIKQFYVQCACRDSKYAAIVNLYSGLAVASSVIFCHTKASVMWLYENMRARGHQVDVLHGDMTVVERADTIIHFKRGDFKVLITTNVFARGIDVAQVSVVINYDLPIKYTDEGTPMVVDGFTQPDCETYLHRIGRTGRFGKTGIAINLIDSEDSMNMINVLENHFQMKIARMDPSNLVELEAIEMA

SEQ ID NO: 5504 - protein, 613 aa, Caenorhabditis elegans
MADWGIAFDEQCRSEGLEVPEKTEKVQSGSEMDQNEENKGSNGWGISRGGMFGGPKASNAPPPQTSFGSTSGTRVGVPIMPGQSQPMRGGFQGAYRGGRGSGGGQMDFGAPGQGQSMGRGRGQQNPAFVPRPRDTPPQYGGHQAAQQFVKPDSKYKFTKPATEEAHEQVPVPADIALLNKFIQKEVKMMKDVVVDVQRQDPKSPLYSISSFRELRLKPEVLKALDTMNFQFPTRIQETALPLLLMEPPSNLIAQAQSGTGKTAAFVLTMLCRIDVNLMCPQCICLAPTLELAKQIGEVVEKMGKFIDNLKIHYAIKGGNMAAMRGRKLTEQIVIGTPGITRDYLQKYKCIDPSKIRCLVLDEADVMIYHQGFTDISTTIYNMVEDASDSVQSMLFSATYDEPVINFATKIIKNAIVVMLKREEQALPNIKQFYVQCACRDSKYAAIVNLYSGLAVASSVIFCHTKASVMWLYENMRARGHQVDVLHGDMTVVERADTIIHFKRGDFKVLITTNVFARGIDVAQVSVVINYDLPIKYTDEGTPMVVDGFTQPDCETYLHRIGRTGRFGKTGIAINLIDSEDSMNMINVLENHFQMKIARMDPSNLVELEAIEMA

SEQ ID NO: 5505 - protein, 529 aa, Caenorhabditis elegans
MLPVQILKDNAQEERGESARLSSFVGAIAIGDLVKSTLGPKGMDKILISGNPESAGGIKVTNDGATILKSIGVDNPAAKVLVDMSMTQDHEVGDGTTSVTVLAAELLKEAEKLVNQRIHPQTIISGYRRALGIAQESLKKSSIESGDNIRDDLLKIARTTLGSKILSQHKEHFAQLAVDAVLRLKGSGNLDAIQIIKKLGGSMNESYLDEGFLLEKLPGMFQPRRVEKAKILIANTPMDTDKVKVFGSRVRVDGVAKVAELEAAEKLKMKEKVDKILAHNCNVFINRQLIYNYPEQLFADAKVMAIEHADFEGIERLALVLGGEIVSTFDSPQTAQFGSCDLIEEIMIGEDRLLRFSGVKLGEACSVVLRGATQQILDESERSLHDALCVLVTHVKESKTVAGAGASEILMSSAIAVEAQKVAGKEALAVEAFGRALAQLPTIICDNAGLDSAELVTRLRAEHANGRHNMGIDIEKGEVADVTKLGVIESYNVKLCMVSSAAEATEQILRVDDIIKAAPRARAQDNRPC

SEQ ID NO: 5506 - protein, 529 aa, Caenorhabditis elegans; identical to SEQ ID NO: 5505

SEQ ID NO: 5507 - protein, 434 aa, Caenorhabditis elegans
MPITKIHARQIYDSRGNPTVEVDLFTEKGVFRAAVPSGASTGVHEALELRDGDKAVHLGKGVLKAVSNINEKIAPALIAKGFDVTAQKDIDDFMMALDGSENKGNLGANAILGVSLAVAKAGAVHKGLPLYKYIAELAGTGKVVLPVPAFNVINGGSHAGNKLAMQEFMILPVGASSFAEAMRMGSEVYHHLKAEIKKRYGLDATAVGDEGGFAPNIQDNKEGLDLLNTAIDKAGYTGKISIGMDVAASEFFKDGKYDLDFKNPASDSSKWLSGEQLTELYQSFIKEYPVVSIEDAFDQDDWDNWGKFHGATSIQLVGDDLTVTNPKRIQTAIDKKSCNCLLLKVNQIGSVTESIEAAKLSRANGWGVMVSHRSGETEDTFIADLVVGLATGQIKTGAPCRSERLAKYNQLLRIEEELGADAVYAGHNFRNPQV

SEQ ID NO: 5508 - protein, 1367 aa, Caenorhabditis elegans
MIRWKYELHSLIWLFLVLHLSKCQSDSLTTSAEQHELFAIKKDSLSPWSQILVSLPRRHPLYQSFAAKIQDVTENISDEVRDSNKTFVSSDDAPYSIRIHALRAGHRYSIAIHGQKDGSTSLIKEESVVMDPRAPDFRSMDSDIQVAEHNITMRTIKNDSYLQDSFSIEYRQINPDKKFPVLQILDIPEQKNLEFYLGNLNSGFDYSVRVIAHKDGMSSRPWISTLTTKPSPLKEVNINQNAGSCVEVSWQNDEFSGADFYTIQYSLQSTPNNSTNMTIPSTESSISICDSMLQGEAYQIIATVQKGGQVSEPLITKFQLRPLPPIDFRVRADLKRGKYKLLAELPTSSKIDKCQITVAGDEAERSVNYANIEQTKSGHKICWFNFALSPGERFDFSISSMANESASQKLQKSIVLTPAFDFNAFGLTLQESNGGIELIWPKSEVFMTRVKDIWNKVVGAESLLNMRITPIGNNDETDKTLKFETSPKNIDPVFAKNLVKGACYRVQLFTVTKTGIISETRHNETIRMSSPAVNVSLESVTRSSATLRIVFSTHHDSTSISNCQMHIVVRDMNGKSVFDKRMQLTATFAPLLNLDGLSPFHKYTVNTQIICGSGSSETPQCPAATRTMRQLSFSTRQDKPAAVQDLKVEPLNSYSVMLTWLPPALPNGILTHYAVNVTKIGSDETRTIDVGVSSNRSDHTVQVVIDELFGGHTYSFSVRAVTEAGFGENSPVVPTVSMPLMAPPVPTVAPMIMKESVGSHNMIVRFPTTMFDNRNGEIKQFAIIVSETTADESINRWIESDNGTYTWQQVQRFDVWPSYVAKLQDIQKVKQDVDVSIFEELGEDETCLEVRADRICNGPLRSASKYRVRIRLFTSPTLFTDSPPSQVMTTGSATPAIPLLTVVAVLIVIAFVGIVGTIFLFFWNRTKKARLAAAAFKNGPSKEKESQWEALKMMMAERAADCLAKLGLDATTPPPSSTTSSNSPTSTSTTMTDCGSNPHLGAPNAGGHRRTRSLRERTGVEHRLERLSSGPVHRTPLYTVVTGANTNKSRPVRIEDFADHVRLMSADSDFRFSEEYDMMRNVGVGQSVAASELPINRPKNRFTNIPSYDHSRVKLSNPNNIEGGDYINANYVPGFSSRREFIAAQGPLPTTRDHFWQMTWEQQCPAIIALTKCVEKGRDKCHQYWPDHENVPVLYGDIEVTIVAEKEFDEFVIRDIRLEKSGPDGRVTRFVRHWHYMAWPDFGAPSHPNGIIQFSRMFRHHLPHSPHNAPTIVHCSAGVGRSGTFISIDRLLQSSSFGDPIDVFGTVCEMRYERCQMVQNEQQYIFIHYCILQVLQGSSPSPTSTSTGAHHNAGFVQDGQMIVESGF

SEQ ID NO: 5509 - protein, 1367 aa, Caenorhabditis elegans; identical to SEQ ID NO: 5508

SEQ ID NO: 5510 - protein, 646 aa, Caenorhabditis elegans
MGLLTKGSPLTWAETVPHIDYIKKHGIAQFINLYHRLKSRHGDQLKWGDEIEYTIVKFDDANKKVRVSCKAEELLNKLQAEEQVNAMLGTANRFLWRPEFGSYMIEGTPGMPYGGLIACFNIVEANMKLRRQDETCLSISFPSLGVPGFTFPEVAADRKNDDAANSVFWPEQAVFLGHPRFKNLTKNIKGRRGSKVAINVPIFKDTNTPSPFVEDLSALGGPDDTRDAKPDHIYMDHMGFGMGCCCLQVTFQAVNVDEARWLYDQLTPITPILLALSAATPIFRGKLSNVDSRWDIISASVDDRTPEERGLEPLKNSKWVIDKSRYDSTDCYIYPCSVGYNDIPLQYDETIYKQLIDGNIDEPLAKHIAHMFIRDPHQVFRERIEQDDEKSSEHFETIQSSNWMNMRFKPPPPDAPEIGWRVEFRPTEVQLTDFENAAYCCFVVLLTRMMISFRLTYLMPISMVTENMKRAQQKDAVLNQKFLFRKGLAECKSAPENLKGSEKCGPPSQDIEEMSIDEIINGKKNGFPGLISLIRQFLDSADVDVDTRCTISQYLNFISKRATGEINTLAHWTRGFVQSHPAYKHDSDVNDNIVYDLLKKMDAISNGEDHCEKLLGCYRSKTDHAISAAVRKAEEHMIVSSQKRAH

SEQ ID NO: 5511 - protein, 308 aa, Caenorhabditis elegans
MSALEETQSLCKQVDDICNNGMESVEQCNKLLDQLSKIPMSIEIIQKTNIGIKVNMMRKKVTDDAVAKRAKNIIKDWKNVVDGKSKSQDDGGAPPAKKHRKESVEEAKPEKKKIEAPYKRPEPSSRPEIVAQFASASFPPKHLENDETRLKSAQLLLSALRFGDMPQGTLDPEELAVQIEEKLYSVHRDTNKSYSAAVRSRIFNLRDKKNLALRENVLTGVVRAEKFATMTSEEMASAEIREMRDKFTKEAILEHQMSVQQGTPSDMFKCGKCGKKNCTYTQLQTRSSDEPMTTFVFCLECGNRWKFC

SEQ ID NO: 5512 - protein, 1323 aa, Caenorhabditis elegans [sequence omitted]

SEQ ID NO: 5513 - protein, 540 aa, Caenorhabditis elegans
MIFHGEQLENHDKPVHEVLLERFKVHQEKDPDNVAFVTAENEDDSLGFQQLGKKVLQISEWFVENGYKKGDVFLLASYNNWRCFAAALGAWRAGLIVSAAASQFTSFEMNYQIEDSQSQVILVDKHTLPVVQEACKNLKFVKQIISISANPPSPVIKFDVLTSRLVRNLKMPLIDPKNDIVFLPYSSGTTGKPKGVMISHLNFSMMLESSLRFFDANAKAIGLPPDFVLPYDLHFLPMYHAMGMFRTLLTSYRGTTQIMFTKFDMELMLKNIEKYSIMVLSLVPAIAVRMLNSPLLQKYDVSSLVSVTVGSAPFPESASKKLKQLLPNVNIVQGYGMTELTFATHLQSPGSPDGSVGRLVPGTSMKVKKEDGTLCGPHEIGELWIKGPQMMKGYWKKEQQTNELLDEHGFMRTGDIVYFDKNGETFICDRIKELIKVNAKQVAPAELESVILEHDDVADVCVFGVDDASSGERPVACVVSKRGRDMETSKAIMKHINQKLARYKHIKEIEFVSEIMRTGTGKLLRRAMKKAFLDAKKAKL

SEQ ID NO: 5514 - protein, 217 aa, Caenorhabditis elegans
METNFIGDDYGPLFHYQYRLIVIGDSTVGKSSLLRYFTEGKMAEISDPTVGVDFYARMIELRPGYRVKLQLWDTAGQEKFRSITKSYYRNSVGVLAIYDTTNRESFEHVENWVKEAALNLGGPSPSKCVFQLVGTKSDMDSQRQVNYEEGEYFAKYHKMKFIETSSRTGDNVNEAFHMIAQEVFLKMFQFYDVIFKFLDSKSSRRRRTAARGWLGRP

SEQ ID NO: 5515 - protein, 294 aa, Caenorhabditis elegans
MASNLTVNVHPGVYMNVVDTHMRRTKSSAKNTGQEKCMGTLMGYYEKGSIQVTNCFAIPFNESNDDLEIDDQFNQQMISALKKTSPNEQPVGWFLTTSDITSSCLIYHDYYVRVITEASARRESPPIVVLTIDTTFSGDMSKRMPVRAYLRSKAGIPGAAGPHCAIFNPLRVELAAFPGELVAMQLIEKALDSRRREATLESGLEQLETSTAQMIEWLERMLHYVEDVNKNGEKPGDAQIGRQLMDIVTASSNNMQPEKLDTLVKNTLRDYVMVSYLAKLTQTQLQVHERLVSA

SEQ ID NO: 5516 - protein, 298 aa, Caenorhabditis elegans
MLARSARLLHSAELAANAIRAASGAPATAAAAEASFPSTDDVAAKTKKTGNRIKTFEIYRFNPEAPGAKPTVQKFDVDLDQCGTMILDALIKIKNEVDPTLTFRRSCREGICGSCAMNIGGQNTLACICKIDSDTSKSTKIYPLPHMFVVKDLVPDMNLFYAQYASIQPWIQKKTPLTLGEKQMHQSVAERDRLDGLYECILCACCSTSCPSYWWNADKYLGPAVLMQAYRWVIDSRDDYATERLHRMHDSFSAFKCHTIMNCTKTCPKHLNPAKAIGEIKSLLTGFTSKPAAEPSAF

SEQ ID NO: 5517 - protein, 381 aa, Caenorhabditis elegans
MFRQEILNEVLFIVPNRYVDLLPSQFGNAMEVIAFDQISERRVVIKKVVLPENFDNWQHWRRAQRELFCTLHIQEENFVKMYSIYTWVETVEEMREFYTVREYMDWNLRNFILSTPEKLDHKVIKSIFFDVCLAVQYMHSIRVGHRDLKPENVLINYEAIAKISGFAHANREDPFVNTPYIVQRFYRAPEILCETMDNNKPSVDIWSLGCILAELLTGKILFTGQTQIDQFFQIVRFLGNPDLSFYMQMPDSARTFFLGLPMNQYQKPTNIHEHFPNSLFLDTMISEPIDCDLARDLLFRMLVINPDDRIDIQKILVHPYLEEVWSNIVIDNKIEEKYPPIALRRFFEFQAFSPPRQMKDEIFSTLTEFGQQYNIFNNSRN

SEQ ID NO: 5518 - protein, 516 aa, Caenorhabditis elegans
MSASSETTSSGTICDQVDKEEGRYGCRGANRYIILVIGLFFLSFLLSSIICYNACYVSMVNPQSSPYWEDFVNSNKSLDEINWNDPDLPLSQRRFAFDTTQKSLGFAAGFLGAIAAVVPMSRLTARFGVHKVMTLSGILGTFLVVITPIVITWSFPVFVILRVLQGITLANLFTTAGVVVNEWAAVNEKGLFISVLSAHVEMGAVFTMPVSGALATSAGWPWVFYLHGAILGALTILWAVYYRDRAVKHPFVQRKEWRKISFGKKLDQTGKGSNETPIRKIVSSIVIWGVWIAVIGNFLVSQFSISYAPIYLRGVIGCTPTEAGLLTLIPMACLLVIKFSTGFFSDRIKSISDLTKMKMFNSCALLGSSIFFIILSCSSPGGSKVLDVILLSIPMALLGFSSGGYSKCAVMVSGQYSPFVMSIVQIIACSSLMAGSFLVPALTPSDSFSEWQRVFMIYGAVLAITNTIFIVFARAEPAKWAQQKGDLTLAEAVMGSEPKNTEVMPVDSEVGASPRI

SEQ ID NO: 5519 - protein, 495 aa, Caenorhabditis elegans
MQSFIFFVFLIYGFFPHCQSINDGNIKINLPNQQDVIYRYTRSERGDPAEKEGSVFKLRTTVFFVVYGLLVLLAFIAFLVWRLRRSKTQEKRKNMALMNIYSDLRDTGDAMPEELKNRPLNDKLDYLPYKKQYEIASENLENKSILGSGNFGVVRKGILKMASPKNEEEKKMRLTVAVKSAANCYDISQTSMLAAELRLMCSIGRFPNVLALVGAVTSELRKGRLLIVTEYIDCGDIRKYLIDHRNVFQDHLIEDKTEPDSYLTPISAKRKNYVFKNTDENSDYVIKESLDSLTTSDLLSFGLQIANGMQYLASIPMVHRDLALRNVLLKKNKTIRIADFGMARTHENKSYYIPQKTKDAPVPVRWMSPEAFDTMKFTEKSDVWSFGICLYEIFTLGQLPYPDVPSERIYEYMHSGRRCPQPQHCHVELYDLMKLCWHEKPELRPNFSNCVEYFIGHMKKSASKLLENVDEMLRVEAENQRKLEDWIRVERSESV

SEQ ID NO: 5520 - protein, 400 aa, Caenorhabditis elegans
MSKASDDFLLYKLNLYYETGAERFSPLTRKVFKCAVVIIAVLMICGLIAFGITEIYCRLFPVTDNLVLNNESPKKPVCKRRIVGYFSEIESTEISKSQIDKLTHAVFAFVRIKYDGTLQFDNSKADLRFSILKDKTRGSNVEMMVSIGGGYENAHYFASALSDSQKKKNFIDSILAFLVEHRIDGVDFFCNGQQFKTLSIMLHLSNHVDFFNVYSMDYAGPWPNQWGVPTGPSSPMFYNIGARKNFYVDWTMKHYTCKLKQPSMLNMVIPFSARIWNNVQEAIDNRTEVFRNAELKNNMAEGRTQISRWTAEHEGLELSPSSWDNLTMTPYILDLKAKTFLTFEDKRSIKIKTDYAKKMDLGGVWLWSVDMDDRLNSLLSDVFSKEFCSTGSGNKIKYSC

SEQ ID NO: 5521 - protein, 432 aa, Caenorhabditis elegans
MSTSSDDVSLFYYDKKASEDVRSLKQILKHFLIIYTVLIACGVFAYAITSLLFHLNHNPTTLDKAMPTEHPDCNKRIIGYYSENETTDITKRQLSQLTHAIFAFIKLQPDGTLQFQSGSAKQRFLILKTNAESSTLKVMISIGGMDINSDFSLVISDEKKRRSLIESIVSFLTEHQIDGVDIFWKWSSSRDKFNFSVFMRDLREKLDKQLKSYIVSILLPPAGVDIWEMGYDLDEIIDHIDFMNVYSMDYSGPWDNKWGTPTGPSAPMNYNIGPRKHFTVDWTMKYYACKTRQPNKFNIVIPFYARIWRSVGEAITLKTEVFRNAKLINGKADGDPYISRLSVKQKGIELFPYSWDNATKSSYIWKPKEKTFLTFENERSIEKKLQYVNEMNLGGVWIWSVDMDDRINTLLDAVSSDKFCSSSSANSINFKF

SEQ ID NO: 5522 - protein, 444 aa, Caenorhabditis elegans
MAAKHEYNKLSLVHLPRYVIHFIDYQKLAELRKEVHSEKRIPSILTRTIAVLFVFALLALVSIGSEGVPQLRNSRDLTKSPCKKRVVGYYSEWEGTEITRSQLGKLTHAVFAFIHMDSEGKLQFKTNQKERFEKLKTAVKNANSDTKVMISIGGDHNSENFGSVLSDSEKKSMFIDSIARFIRQHKIHGVDIYWKWLGNSETEHHDFPSFLKDLKEKLKTVRDDSIISIVAPQAKMDRRHDGYKFDDFMEYIDFVNVFSMDYYGPWPNQWGTPTGPSAPLYGGIGVKKHFNVDSTMKYYTCMTEDPSKFNMVIPFYVRLWKNVKEPISSGTEVFRRADLKNGAAVGNSYMSRWTVDHEGWELTPALWDDVTKTPYVWNQETGNFLTFENKKSIEAKLAYAIEHNLGGVWIHLVDKDNENEELLRAVASKKFCASESENKVTYDC

SEQ ID NO: 5523 - protein, 432 aa, Caenorhabditis elegans
MTNIKSEQKESEELVLPNDRPQYEQRVTKQPTSGKYIIITITLISIIIVGFGLGLCAQIYFQAESDVLPICDKRIIGYYSGSGTSNITSTQLSNLTHTVFAFVYMTPDGTLLFNNQIEKNRFLKLKEVVRNGNSKIKLMFSIGGKDNSKYFSSVIPSEERIQTFIESILEFLEAYDLDGVDLFWKWPEEEYRDAYFAFINQLRKTFEAKKKYYILSIVIPPPTLDGWGKKRLNKIIESVDFINAYSTDYYTPLADNLSDDIAGPSAPIYFGAQGKSERNVHHTARNYSCLTKQASKFNIVIPFYATLWENVYETVLDSKRGVYRHVAPFYGRTVGKTYLSRLAVKQEGFQVESYSYDPAPRAAFSYNRTIGIYLTFETKESIRAKIDYVKDRILGGVWIFSVDMDDETNSQLKAVSFDGFCTIGNGSKYECV

SEQ ID NO: 5524 - protein, 432 aa, Caenorhabditis elegans; identical to SEQ ID NO: 5523

SEQ ID NO: 5525 - protein, 764 aa, Caenorhabditis elegans
MGTSPVKIMISIGGKENSQNFSPVIESEYRRQIFINSILTFLKENDLDGIDLFWEWPCSTYKSVYLHFICELKQQLQTKDKDYILSIVVPPPEVGGWIDGFDMNNIVQIVDFINVFSLDYYGPTQNDFGKITGPTAPMFNGVPGRETFNVDHTSKVLSCETMQSNKFNIAIPFYTTLWENVQGPIDKIEIFRNVNKVHGKIVGQSHMSRMIVQQKGFVLTPYSFDNATRNAFIYNSSTKIYLTFETDQSIVAKIEYVSEHLLGGICIWTVDKDDEGNSQLNAISFDGLCTTGNVPKTLIDSILAFLDMYDLDGVDLFWKWPDKQDRENYSSFIHHLRKKLNFKRDAYILSIVVPPLNVERLKYAIDIKNITNNVDFVNIFSMDYYGPQDNITGPTAPIYDGAAEKKYYNVHHSVRKYFCRMKEANKLNIAIPFYATLWENVQGPVKPPGKGVFRNAKPFNEIMSETSYLSRLDVKQLGFELDKFSYDGSSRGAFLYNSTTKTYLTFENEKTIGKKINYVKDRLLGGVWIWLMDMDDEFNTPTVCEKRVIGYYAGTEKSQITIEEVSELTHAVFAFVYMATDGTLMFSNQAQRNRFLKLKELTKNENSTVKMMFSIGGKDNSQNFSPVTASPDRKKSFINAILELLEKYDLDGVDLFWRWPKSDDKDEYAVFLRELKKQLKARRKDYILSVVVAPLDINRWDSKFDIKKIIKHADFISIYGLAKNTTDSESPMFASAWGAASSSMLELPGIQQLTCSNILLTRSL

SEQ ID NO: 5526 - protein, 702 aa, Caenorhabditis elegans
MDEQQPPANSPAIFHSPQAMPVRRTLGPHNSPVKSMSTNSSAHTSPRVTPTKGANPYGDRFMPLRQSNIEWNARYHSINSDDDSGFKKPMGTSSCNRHLGGGQNSAFMSDSSTHPSSSSLAGLGALATAPSSSQSSLSSHPHQHHNHHSSSSSSYHDYYQGTSSGSGNTSPTAQAACMDDTRSSEAVLRALLRNEMLKDRIDDVKTQVQTSEEVIATFSLGPVVSAFPQPTQESGTRGIIPQLERNAYGGSVDTVFPVVANEGIIDVTRISGAESPTMAQMMEPRLRCGADSVADIPLSPAASINGDTPTKAPPPALPLSPIVQKQSPARSLFTYSAKTTPVKYGGQATTTATSPFGGPFGVDSQRLLRTPRKPIRKVPKNPYKVLDAPELQDDFYLNLVDWSSQNQLSVGLAACVYLWSATTSQVIKLCDLGQTNEQDQVTSVQWCDKGDLLAVGTSRGVTQIWDVTTQKKTRELTGHSSRVGCLAWNADTICSGSRDRTIMHRDIRCDDNDMGRKLTNHRQEVCGLKWSPDKQLLASGGNDNQLLVWNLRRNEPIQTYTQHNAAVKALAWSPHHHGLLVSGGGTADRCLRFWNTLTAQPMQCVDTGSQVCNVAWSKHSSELVSTHGYSFNHVIIWKYPSLQPVTKLVGHQYRVLYLAMSPDGESIVTGAGDETLRFWHVFNKGNPPTITRSKLNLHSTIR

SEQ ID NO: 5527 - protein, 491 aa, Caenorhabditis elegans
MGIASKKSVSRWTSWLTKNMLLLMTMAGIVMGVIIGGVLRTADPSPDVIRYVGFPGELFMNMLKAMVLPLIAASIVSGLSQLDGKTSGRLGSRAVMYYAITTTHAVILGIIVVSIIQPGDPTIKQKMGYDKEGEAANVSAAQKFLDLFRNAFPENIMRATFSQVQTNYINQTHSNGATHEVLHTGYVDGMNVLGIIVFCIVMGLVVSRIGEEAKALANLFHALDVVITRMVMLIMWLGPIGIPSLIAQKMLEVSDLWLTARMLGLFVFTVILGLAIQAFITLPLIYFIGTRHNPYTFLKGLGQAIMTALGTSSSAASLPVTFRCLNKLGIDPRVTKFVLPVGAMVNMDGTALYEATASIFIAQMNGLELSIGQIVTVSITATLASIGAASIPSAGLVTMLIVLTALGLPANDISLILAVDWFLDRLRTSVNVIGDALGCGFVHHICADHLNADVAEAEKNHAVVEAHGVNFDELEKECEQENNNQKQIEQV

SEQ ID NO: 5528 - protein, 460 aa, Caenorhabditis elegans
MLPVSTRPYTMSISAILTRKNRAAEMASGNSEEGKGMLLRNGDDRIRLPSPQRGTPDTSSTQGHPYTDQIVTINVSGMRFQTFESTLSRYPNSLLGDRNKRQHFFVSDTNEFFFDRHRTTFESILYIYQSGGRVKRPEIVPIDIFLKEMRFFQMGDDLLEEFWIAEGYEKPKEVMMPNNKTQRKIWELMEYPDSSLSARIIAFISIAVIALSIISFCWETVPSDIEEKPINNSATAELLDEMDEKHYSPFFWIELMCILWFTIELILRFISCPCKVTFATSVLNIIDFVAIAPFFVNFFFADTSKSNSSMSFAVLRVLRLVRVFRVFKLSRHSVGLQILGKTFRSSVQEFCLLIFFMAIALVLFASGMYFAEQGEPNSKFTSIPASFWFVLVTMTTVGYGDLVPLSPFGKVVGGMCAMIGVLTLALPVPIIVANFKHFYRQENRLASMKSKGDDADDDIA

SEQ ID NO: 5529 - protein, 519 aa, Caenorhabditis elegans
MGYFWFPWFSAIFVAVFSYYIWQWTFWRRRGVVGPMGFPVLGVFLNSLDNNFPFPLQCREWTKKFGKIYGFTEGTLKTLVISDPELVHEVFVTQYDNFYGRKRNPIQGDSEKEKRTNLFAAQGFRWKRLRAISSPTFSNSSLRKLYQTVEDSALELLRHIEKQSAGGKQIDMLKFYQEFTLDVIGRIAMGQTDSQMFKNPIMPIVSKLFQGNFAKLFLIGGIFPTFLVEIIRQILLKNLKVGSFRKINEITLDAIHNRIKQREEDQKNGIEIGEPADFIDLFLDAKAEDVEHFGENNGDFSKSTTYTNRQLTTEEIVGQCTVFLIAGFDTTALSLSYATYLLATHPEIQKKLQEEVNRECPNPEVTIDQLSKLKYMECVFKEALRLYPLGAFANSRRCMRNTKLGNMKVEVGTMIQVDTWTLHTDPNIWGDDAEDFKPERWQTPNSDQIYQKSGYIPFGLGPRQCIGMRLAYMEEKILLVHILRKFTFETGAKTEIPLKLIGRATTQPESVWMHLNPRN

SEQ ID NO: 5530 - protein, 520 aa, Caenorhabditis elegans
MSLSLLIAGALFIGFLTYYIWIWSFWIRKGVKGPRGFPFFGVILKFHDYENPGLLKLGEWTKKYGSIYGITEGVEKTLVVSNPEFVHEVFVKQFDNFYGRKTNPIQGDPNKNKRAHLVLAQGHRWKRLRTLASPTFSNKSLRKIMSTVEETVVELMRHLDEASAKGKAVDLLDYYQEFTLDIIGRIAMGQTESLMFRNPMLPKVKEIFKKGGKMPFLIAGVFPIAGTLMRQLFMKFPKFSPAFGIMNTMEKALNKRLEQRAADKKAGIEPSGEPQDFIDLFLDARANVDFIEEESTLGFAKSEVLKVDKHLTFDEIIGQLFVFLLAGYDTTALSLSYSSYLLATHPEIQKKLQEEVDRECPDPEVTFDQISKLKYMECVVKEALRMYPLASLVHNRKCMKKTNVLGVEIDEGTNVQVDTWTLHYDPKVWGDDASEFKPERWETGDELFYAKGGYLPFGMGPRICIGMRLAMMEEKLLLTHILKKYTFDTSTETEIPLKLVGSATIAPRNVMLKLTPRHSN

SEQ ID NO: 5531 - protein, 520 aa, Caenorhabditis elegans
MSLSILIAGASFIGLLTYYIWIWSFWIRKGVKGPRGFPFFGVIHEFQDYENPGLLKLGEWTKEYGPIYGITEGVEKTLIVSNPEFVHEVFVKQFDNFYGRKTNPIQGDPNKNKRAHLVSAQGHRWKRLRTLSSPTFSNKNLRKIMSTVEETVVELMRHLDDASAKGKAVDLLDYYQEFTLDIIGRIAMGQTESLMFRNPMLPKVKGIFKDGRKLPFLVSGIFPIAGTMFREFFMRFPSIQPAFDIMSTVEKALNKRLEQRAADEKAGIEPSGEPQDFIDLFLDARANVDFFEEESALGFAKTEIAKVDKQLTFDEIIGQLFVFLLAGYDTTALSLSYSSYLLARHPEIQKKLQEEVDRECPNPEVTFDQISKLKYMECVVKEALRMYPLASIVHNRKCMKETNVLGVQIEKGTNVQVDTWTLHYDPKVWGEDANEFRPERWESGDELFYAKGGYLPFGMGPRICIGMRLAMMEKKMLLTHILKKYTFETSTQTEIPLKLVGSATTAPRSVMLKLTPRHSN

SEQ ID NO: 5532 - protein, 518 aa, Caenorhabditis elegans
MIFVLLSAVLLGVFTYSVWIWSYFIRKGIKGPRGFPGIGMLIQTIDHENPPFLKYRDWTKQYGPVYGFTEGPQQTMIISEPEMVNEIFKKQFDNFYGRKLRPIIGDPEKDKRVNIFSTQGKRWKRLRTLSSPSFSNNSLRKVRNSVQECGTEILWNIEQKVRKNEDIDMLIVYQEYTLGVISRIALGQSESNMFKNPLLPKVQAIFNGSWHVFLITGIFPPLAGVFRKMSKMLPASFIPAFKIFDLIEVAVQARIDQRAKDEIKGVEPGEPQDFIDLFLDARVPDVKILSGEANEDFAKSSVVKINKELTFDEIIAQCFVFLAAGFDTTALSLSYATYLLATHPEIQTKLQEEVDRECPDPEIFFDHLSKLKYLECVMKETLRLYPLGTTANTRKCMRETTINGVNFDEGMNIQVDTWTLHHNPRIWGEDVEDFKPERWENGACEHLEHNGSYIPFGSGPRQCIGMRLAQMEQKILLAQILKEYSFRTTKNTQIPVKLVGKLTLSPESVIVKLEPRDS

SEQ ID NO: 5533 - protein, 327 aa, Caenorhabditis elegans
MVNIPNFIDKVLSVNDTSNASLTHCIKEADIDGVIEECKDILSAQATMVEVQAPIAVCGDIHGQYTDLLRIFNRCSFPPDQNYLFLGDYVDRGRQQLEVICLLMAYKVRYPNGFFILRGNHECASINRTYGFYDECKRRYSLALYNEFQNLFNSLPLCAMISGRIFCMHGGLSPELVSWTQLAKIIRPFDPPNACLAMDLLWADPENNHTGWGKNSRGVSYIFGANVVKDFTEKMNIDLIARGHQVVQDGYEFFADKRLVTIFSAPKYCGEFDNNAGIMIVDERLIISFEILKPAMREVKIQARAAAKNKSTRSILVSSRGPKSKKG

SEQ ID NO: 5534 - protein, 327 aa, Caenorhabditis elegans; identical to SEQ ID NO: 5533

SEQ ID NO: 5535 - protein, 505 aa, Caenorhabditis elegans
MWWTSLVFSVLLFDLIFISNCDYIHLPGNSDIPDLKLQSGYLNANENGTQKMFYFLLEARDIPVGEASLIIWFNGGPGCSSLSAFFEEFGPLYVNFGGKSLFENVHSWYHKANILFLESPIGVGFSYDTEQSNFTKVNDDSIAEQNFNSVIDFFQRKHSSYVNHDFFIAAESYGGVYGPMLSALVVDSISKREFPNENFKGLIIGNGFMNVKLSTNTMILWSAYHDRTSPDEWDEIKEKCATSGAHDVDYYDFMQFMKTTNKMDYLADNSTECGRLIEPLLGQFSETFDGYDFFNYYHDCYTNFSIPNATDPIKETLAQIPRRRISALFNKHSTDGQASYRCWADDALHKYLNLKEVQNALGIDRAWKDRKKKWEVCNMPIYDQYVMTHQDMTPFFSKIFDKFTGPAFRVLIYSGDIDTACNYLADGYFTLKHGPWYHSEHKVIAGNFMRYEGANHLGSKLSIDVVTVKGSGHFVPLDRPGPALQMVHNFLTGKPGKMTNYTSPV

SEQ ID NO: 5536 - protein, 858 aa, Caenorhabditis elegans
MADDGLGDVPMETESMPQYTISHVIEAHKSDTKALAVTQGGCLISGGRDETVKFWAKKGKQYTKTHAFEQPKGITVNSIAYAELADGWRLFVGRRDGTIAVFGPSQAEPYAIFNEHKQNVCCLHINEKATHMLSGSWDSNVIIWPITELNSSSFTTIVCPGHTLSVWALASFPDLPNTYLSASADKTIRMWFGDTTLSVFKGHTDVVRALVVLSSSHFLSAGNDGHIIHWDVASASILRKFATQAHEFIYSMTLSDSHILTTGEDGTLEFWAIDGGKDGNLAIVSEAVIQLPTTNTWDAKVLLNSDIAVAGSDGRIYIMTTDKNRKADDDILDAFDAEVVAKLTAKTERMKQEEHETVTIKVDIDDRPTQLNLKYKKGTDPGLCAQEFLSENNLPIHYLEEITRFIKDRIPEARAFDLKSGKKVIVDGKEYDYALGVNFGKGEPDKQMPFNVNESPQFAAQRFVERHQLPVSVIPSLAGMISQEMDKLSKGAASAQSGYEDPFTGPGRYVPQGSSNSGGHGADPFTGSGRYVPQASNSSGFDTGFSGDPLTGDGGYRASAPENTGSHAVPLSSLPQNKKKPRGPLVPVPDFYIIGLAGKGEKAIAKLKELNEKQDAFQLNPDQINGLEELFVLPTSSNYSSEVTQSAFEMSLQWPVEHLTPVLDFLRIALTHHSLNSYFCDRERGQELVGRLIAILVSDPADVALKVLVCRCIANAFSHPVGRNLFASTELSTLAPLVVRQVLNEKTVLQMSAATALANWSLALLQQSEQCEQLGPKEDLLRAILNGIESVDSFGYLGEDAIIRLLQALVTVMWGDASVIRLAKNRNIAQIAARLKDAVSNDSGKNIARDIVEMTYAV

SEQ ID NO: 5537 - protein, 858 aa, Caenorhabditis elegans; identical to SEQ ID NO: 5536

SEQ ID NO: 5538 - protein, 218 aa, Caenorhabditis elegans
MATDQKRGLLIVFEGLDRSGKSTQAKRLVESINKKSTESGDASSSPSAVLQAFPDRSSSIGKLIDQYLRKEIDMDEHALHLLFSADRFSKNQMIRDNIAKGIDVICDRYCYSGVAYSLAKGLPEQWVRSSDVGLPKPDAVLFFDVSPEVAAQRGGFGEERLETATIQQKVAAVMPTLRDDAYWKTVNADGDLDSVEKNVFRIYENLDREKPFESLEKI

SEQ ID NO: 5539 - protein, 541 aa, Caenorhabditis elegans
MNIPSGQWRLDVMMMCLYQMALFFSAQLVFVIFLEYMPKTACTEKNYCYKLESKCLSDYDENKPNICLVPNGSKSQFDECVNDKKYLYFESAQHYYQQDCTSLTHYSASTNMYLGVLFANLILGVLADKLGRRPIFFASIAIGVVSLILSAAIPSLIAFYIFRFTTGVGVAGAQIVGWSYGSEMISAKRRFQLRTFSNWANARILVVFVAFITRRWDTASYVCAAISALIFPILWKLPESPVFLEQKHRIEEANEAREQLAELCDMEYEEKEAAAINNLKKITFMDLWRNERLRTNFLVLCFMWFFVGMATYITDLNGADMSTNLYVGQFLSGLLLTISKIIFGFAEPRFEWLGRRAIFLFSQGVAIIAYILILVALVTSNKETTWYLIVYLCAYSFQALATETCYLSVAELIPTDVRVTVAAITNICLRLGTIVASLTKPLKFSFEPGLFLINLIVCSIGITVVYFYLEESRNVNLQHVGQDEEPSAEDEHSKAMLNDSGEKSADDSGVASTDNSALATSTDRRDEASETEHSNTKSRVA

SEQ ID NO: 5540 - protein, 329 aa, Caenorhabditis elegans
MVNIPSFIDRLLSVNDTSNPSLTRCINEADIDVVIEKCTKILLAQATMVEVQAPIAVCGDIHGQYTDLLRIFNRCSFPPDQNYLFLGDYVDRGRQQLEVICLLMAYKIRYPNRFFILRGNHECASINRTYGFYDECKRRYSLALYNDFQNLFNHLPLCAMISGRIFCMHGGLSQKLVSWTQLAEITRPFDPPNNSLAMDLLWADPENNMTGWAESSRGVSQIFGADVVKDFTEKMNIDLIARGHQVVQDGYEFFADKRLVTIFSAPKYCGEFDNNAAVMIVDERLIVSFEILKPAIREVKIQARGAAAAKNMSTRSILVSSRGPKSKKG

SEQ ID NO: 5541 - protein, 493 aa, Caenorhabditis elegans
MAKPLRSYKIRHRTRFFILFLCLLCLSISQSNTLTLNFTIICMSTLHNFTATEASEKSTNVLDFMLHKILQKTYVYTASQSNLLFSAVAIGAMCAVYPFMYIIQKKGSRSVVTFVGLFSAATTAMIPWAAYLGFYPLLAMRFLQGIGLSTGFTLIGIVTRQWSMQVQGAFFFACLSCFFQVRHIQISKKKLKVLQIGPIFTMPVASAFCTSSFGWPAVYYTHSIVTIFIFLLFFTLYRESPVFHTIVTELELSKIQRGKGETKRQRVPLVQILRDPVVLSIWTTALANFMGIQLTMQFTPTYLHKILGFSVQDTGPFSALPQVITAFVKVSAGYSADKLQCCTPKTSVRIFNSLALGGMSFMFVGLAIIPTSMPYLGLFMLILSCSIIGFNCGGFFRCSAIYAAQHNHFVMGMNSFLNCLAALLAPVIVNIFVENDTWNEWYWVWMSHFVILFLSNLVFQIYAKGEPAEWTKKTPGKDIVVDFDDADVIIIKF

SEQ ID NO: 5542 - protein, 260 aa, Caenorhabditis elegans
MSSIGTGYDLAASTFSPDGRIFQVEYAQKAVDNAGTMIAIRGKNGVVVVADKLISSKLYTDNANPRMFNVNDNVGVAVAGNYPDGFALKNYAYGEAMKWLKDYREPMPIQNIANSVAEYIHIHTLGISRPFGAGAFFMSWNKQTGGRLFLVEPSGLNYEYKAWAVGKHRQAAKAEIEKLKIEELDVNQLVKEAARIIMVVRDENKDKNVQIEMGWVGEQTNGKYEEVPSEVVTAAEEWAIASLTRTTWTIESFSCIYSHF

SEQ ID NO: 5543 - protein, 341 aa, Caenorhabditis elegans
MSKANVGINGFGRIGRLVLRAAVEKDTVQVVAVNDPFITIDYMVYLFKYDSTHGQFKGTVTYDGDFLIVQKDGKSSHKIKVFNSKDPAAIAWGSVKADFVVESTGVFTTKEKASAHLQGGAKKVIISAPSADAPMYVVGVNHEKYDASNDHVISNASCTTNCLAPLAKVINDNFGIIEGLMTTVHAVTATQKTVDGPSGKLWRDGRGAGQNIIPASTGAAKAVGKVIPELNGKLTGMAFRVPTPDVSVVDLTVRLEKPASMDDIKKVVKAAADGPMKGILAYTEDQVVSTDFVSDPHSSIFDTGACISLNPNFVKLVSWYDNEYGYSNRVVDLIGYIATRG

SEQ ID NO: 5544 - protein, 1299 aa, Caenorhabditis elegans
MQHGSLGPSSSSRKTTVTSTAGSVHLHHRSSNGFSTASRAQLNRHNEMDFGKMFAAMEKGHKVCKIAVLKKWDPAYKQLTLDRYSRQIFLTKLELSAVRNKPTILDIRQIREVQTLNYKLNTIKVDDKWKKDREIVNFDSKAILIISYGMGFALSYWILFVARKHMKPFVQTSLQFKVQSDQLQQVTEDQMNSDQFSFASRQLIHVPELFSSRFADLAEKHERKGLVVTFQNFLRFLDGKQFDELASNRTRALEFLNRYFQEDQAYFGDRNEPSMTVFEFCDFLFSRENSLWDPTNEKVTHDMSRPLSHYWIASSHNTYLTGDQLRSESSLDCYAQALLMGCRCIELDCWDGQKKPGSAEFIDIVIYHGYTMTSKILLRDVLHVIRHYAFVTSEYPVILSIEDNCSVPAQRLLAQELKDILGDYLLTQPANREEKQLPSPAALKKKIIVKHKKLPIESEDLAAVVKTDEFQDTEIISRECVKKGILMVKNNNSHEWTSHVFILFPDRLCYLIQTADPENPNDDTVSVSGDEEREEETPSGFGVKPEEMHVTEEWFHGRCERDEAKKRILEHKEKGNGLFMIRDSNLFIGDFSLSILHDGKVHHVRIRSKIIDKEKKYYFMDNKVCDTLYELVSYYTRHYLTTAHFKMVLTIPCPQPQPHLNQPWFSATADKEKAEELLSLVPEDGAFLIRTSSTDSSVYVLSLKVDGEFWHYRLKRDGRIFVVNQKVFENLNQIVEFYANREFVRGISLRFPVNEKDISHLTAELAEARTPGCYMDLKDLDKEVQARALRPYRGTADDELSFPANVIITVLRKEEGLWRGRYGSLTGWFPSAHVQEILPEKVSTSETSNYNTIELAGTLIERIHDADRPNVIRISQSNQHWMNKQYYLLAASSSEEADGWQNNLFELTRSVNTKMSILRTKEKEKRIAAELSNLVVYCQAVPFDPAHIYNDAFYEMCSFVEGKLDKLVEKGLLPFNSRKLSRVYPNGSRITSNNYSPVPMWNAGCHMVALNYQTGDKPMQLNQGKFLANGRCGYLLKPDYMLTDDFDPTNTEKFATAYPIRLNVQVIGGRHLSRKDKNKGICSPFVEIEIIGMPCDTKVFQTKTIASNGLNPIWNQTFTFEIQCPEVALIRFHVEDGDFVGPKTDPFIGQAVFPVDSIRCGFRSVPLKNQYSEELELSSLLVDVQMCSREGTQLIRSSSHFLQASRLAPVFAHRKITNGDSIPREMAPRLRTSATDRSLDSPTNSESRATLLSGQRGSQDSMDSAAETSSIASGTISSRDGKKKQNWLKKFSFGKSSKS

SEQ ID NO: 5545 - protein, 823 aa, Caenorhabditis elegans
MTRLLEKLQRSLSHEMRSYSSLNPLLPSEDTPIQSFSNGVSLEEGKQASSSLLRDTGQPSSSRSKEAISSSSKGCLLLTVLVIFLFVTLSFAIACFLYYQTLPCTSEECVMTASRLLKRVDQSVEPCDNFYQFACGGWINQSVNLKYDSWNTLYETQRTAHDQIVQAMHKINDGSYPLPTNAGERAAAKMYEQCMDTDTLEQTGLHLWERFVDELGGWMPELKNGALEQEESFEIELDEDEKKRRRFEIEDIILSAFNYSVFPLFWAGVEVNYLNSKEHLITIYEQLPILLAPEKYHYNKELTPEMIYGKMEGPPVTRALQQVGEELSAVLGFDSTDEKVRMMIANMIYLEYQITMAGSTFYKEKKERYTVVMLRELQEIAPAINWHYFLSRLVGENLSHSEPIALKTGTQWIPILSAIVEKLKQSRSGVAVLKNYVKWKTIMFHLAYASPKCRDGLLWMAVSLYSGAASQRKEFCVLRLSGIFPLSLPSILRKIDGIDHTEKNVKAVQNIADRIQEKYEEMVRSSNLFSDRETRENVIDKVNNMTKFIGFPDAMRSDYEMEKEAVRLHDTLFWSMVLGSSSVYKERLQRLRLPVDPRSWVDTRPAISVPAHNYERNLVQIPFDSLRLPYADEHQLDFANYAGIGTIIGHELTHAFDGQGKLHGPTGNLGVWWSTDSIREFKAREQCFVKQYAGLMDSHDVSSWLRPSTLIACLLQMNAAKEGLYENIADQVGLKVAYEAWKSNGNQNSGRMPGLEKYSQDQLFFLAYTQGWCALRSKSYKLQPHMEERIRMLGSLQNSPEFASAWKCSSESFMNPPDKCSIW

SEQ ID NO: 5546 - protein, 823 aa, Caenorhabditis elegans; identical to SEQ ID NO: 5545

SEQ ID NO: 5547 - protein, 121 aa, Caenorhabditis elegans
MASAAKGKILAVIGDEDTVVGFLLGGVGELNKARKPNYLIVDKQTTVQEIEEAFNGFCARDDIAIILINQHIAEMIRYAVDNHTQSIPAVLEIPSKEAPYDPSKDSILNRARGLFNPEDFR

SEQ ID NO: 5548 - protein, 153 aa, Caenorhabditis elegans
MNFILLVFLAALSTTCYCTNPRLKALWNLEEVAECELHYNALHYNNYGCWCGIGGSHEPVDGIDECCMHHDKCYDAAVDNKVCMDVEIEYVDDYSWSCMNSTAICSDKNMGCKAALCDCDKIVVECWKKFPKPEKKAKCNRTLWAPITKHFQH

SEQ ID NO: 5549 - protein, 341 aa, Caenorhabditis elegans
MSKANVGINGFGRIGRLVLRAAVEKDTVQVVAVNDPFITIDYMVYLFKYDSTHGQFKGTVTYDGDFLIVQKDGKSSHKIKVFNSKDPAAIAWGSVKADFVVESTGVFTTKEKASAHLQGGAKKVIISAPSADAPMYVVGVNHEKYDASNDHVVSNASCTTNCLAPLAKVINDNFGIIEGLMTTVHAVTATQKTVDGPSGKLWRDGRGAGQNIIPASTGAAKAVGKVIPELNGKLTGMAFRVPTPDVSVVDLTVRLEKPASMDDIKKVVKAAADGPMKGILAYTEDQVVSTDFVSDPHSSIFDAGACISLNPNFVKLVSWYDNEYGYSNRVVDLIGYIATRG

SEQ ID NO: 5550 - protein, 160 aa, Caenorhabditis elegans
MGDVVADALEKLSADQIEQFRKYFNMFDKEGKGYIRATQVGQILRTMGQAFEERDLKQLIKEFDADGSGEIEFEEFAAMVANFVVNNENDEGLEEELREAFRLYDKEGNGYINVSDLRDILRALDDNVSEEELDEMIAEIDADGSGTVDFDEFMEMMSGE

SEQ ID NO: 5551 - protein, 809 aa, Caenorhabditis elegans
MASVPTHQSEKEKKNDELSTAILKDKVKPNRLIVDQSEQDDNSVIAVSQAKMDELGLFRGDAVILKGKKRKESVAIIVSDESCPNEKVRMNRVVRNNLRIRLGDVVSITPAPNLSYGTRIHVLPIDDTIEGLTGNLFDVFLKPYFLEAYRPLHKGDIFTVQAAMRTVEFKVVETEPAPACIVSPDTMIHYEGDPIKREEEEESMNDIGYDDLGGVRKQLAQIKEMVELPLRHPQLFKAIGIKPPRGILLFGPPGTGKTLIARAVANETGSFFFLINGPEVMSKMSGESESNLRKAFEECEKNQPAILFIDEIDAIAPKREKTNGEVERRIVSQLLTLMDGVKGRSNLVVIAATNRPNSIDGALRRFGRFDREIDIGIPDAVGRLEILRIHTKNMKLADDVDLEQIANECHGFVGADLASLCSEAALQQIREKMELIDLEDDQIDAEVLNSLAVTMENFRFAQGKSSPSALREAVVETPNTTWSDIGGLQNVKRELQELVQYPVEHPEKYLKFGMQPSRGVLFYGPPGCGKTLLAKAIANECQANFISIKGPELLTMWFGESEANVRDVFDKARAAAPCVLFFDELDSIAKARGGGAGGDGGGASDRVINQVLTEMDGMNAKKNVFIIGATNRPDIIDPAVLRPGRLDQLIYIPLPDEASRHQILKASLRKTPLSKDLDLTFLAKNTVGFSGADLTEICQRACKLAIRESIEKEIRIEKERQDRQARGEELMEDDAVDPVPEITRAHFEEAMKFARRSVTDNDIRKYEMFAQTLQQSRGFGNNFKFPGEQRGSDAPSAPVPAQDDDDLYN

SEQ ID NO: 5552 - protein, 364 aa, Caenorhabditis elegans
MSTDGNNNKKGSKEGPKSSEISKFDLAKENPKLAEWMDDCIKRMNSLYKDTNINICNVMTGHEIISIIRMVEAIFMEESNLCEAEAPIKVIGDIHAQYQDMNRLFDLIGRVPEEKLMFLGDYVDRGPQGIEVLILLFCLKIRYRDRIYLLRGNHETPSVNKIYGFYVECQYKYGIGLWWDFQSCFNRMPMSGLISKRVLCMHGGLSPELINLDTIRNIPRPCEPLDRGLLIDLLWSDPTNKGEGWFHSIRGISYMFGKGVVEQACKSLEIDLIIRAHQVVQDGYEMMTGRRLITVFSVPNYCAQFTNAAAVVCLNANLQISFQQMIPPPLPEGTKAKAAPAIAIDPNIDAARADKDAIKPFVKE

SEQ ID NO: 5553 - protein, 137 aa, Caenorhabditis elegans
MADEDDYQDMDNDDFVDDNEMEDVIEEDPQRPDNEDEDDDNVDENFELFDQGKAVPTSEHVTTPFMTKYERARVLGTRALQIAMGAPVMVELEGETDPLEIARKELKQRRIPIIVRRYLPDGSYEDWPTDQLQLADW

SEQ ID NO: 5554 - protein, 471 aa, Caenorhabditis elegans
MAAVVAVKQKEKGPQCKLSTIINGQFMAVQMIGKGAYGVVYEVVRRNSPNTRFACKAELAIDHNNLKTEWDLMTLLKDNKSKHNIIGVELGSERNFNYIVMHLVGPSLSDLRKTVPNKTFTLFTTAVCAIQCFDSLVEIQRIGYIHRDVKPSNFAIGVLGSEEEKLVYVLDFGLCRNMFNKQKELRKPRMKAPFRGTILYCSLNIHQRMEPGRHDDFWSLLYMMIEFHLSDLPWENMSKEDTKKAKETKLDGLLARCPPEFRMIRCYLLTLTYSKEPDYVKLREVLCQIMTSKKFTPDMPLDWQKGGPCEAIFKPQAAVVKHKGTKKKVSLAELLDLPKPGGKVYTERDFPQPGEQEPMRDESVSKSDDTIIEKEGPPPAPKPVSKPVPPKPGVTMSLKPQLAQQRCSAEHKDLSTPPAIARSPIGQNTTMKPPVTAIPRPPIEKHSVRKAAPVAHSPRKSKSNTKVPPAH

SEQ ID NO: 5555 - protein, 471 aa, Caenorhabditis elegans; identical to SEQ ID NO: 5554

SEQ ID NO: 5556 - protein, 882 aa, Caenorhabditis elegans
MKHCFMIIGIFVFNVSAQTLQPQETCGQPALKIKAIHPEFGSATGFYGIAKGMSDGVHTNPNSKSYENLNKWLFENGTVTLNDVFADLVAGQPGPTIFWKLGFILVFVTLALCIVTAIWLCFYSCAPKKNSSDSKITGIVYAGLLVITFAIALNGLILFNTAESDLVDSIDKTMDYVKQIASDRTKVLTEGAYQVACEFLRTTSHNFAHLNSFVSNYTSTVVDDTESGVGIVDVNDFDLSGYRDQNQITIKSGNALVNRLRNMNTLDMDCKAHAKNLVKEIPVLEKTLPVSAAATRIIKGSMQLQRINSQIKDIKDHIQTESNRALKAIKQAQKIVDGSLKTINTSLIAYQQEVTEALSTLNSGHEHFVAVASKFTLPTQFPKLATIVLVGFYVSIVVSIVLLLFSSTLFILGWFVSAICVPTFQDDNYTMFHSIHVSINRTNGPLDYLNIGKLFTSCRNPRMTLYSAIEGEKLFRLESVTEKLNLNAFRNMTNEKIMKLPNLTFSFEKHHEISFDKISHGYSTVKKSNLTDCDDEDAVQEYQEYIELLEKSYSLSDQFVDIVKTLSSNALNMTLIARDLNNDYFDSGDWSINESITALRTNLQTNIFMCRPFIDIFNNGGIILCQQLGKPIHGMWASAGLAGIAFLLQSILFLLVYRWLRQSDVDKMTRLVLLLFVPALLAFDSSFNYGCQNGQCTFQLVVPKEVAQAIDEQTLNNEVATIASSLSKLDSTILKFNDTDLLTASANANTTATLLYNSISCFQQNVNSSYTCFSPPSTIAPSTIAPSTTASDVSTVNPVTDNGSTVSQGTQPTGGSTAAPVSTDAPGSTVSGATDASVASTAGGDTTASGASVVSTAASSEASTAAPEASSAAATVISGKPV

SEQ ID NO: 5557 - protein, 423 aa, Caenorhabditis elegans
MGDVRSAPLRAYAMPSSIGTCKNQGSTFKPTKLEIDFQVDIYFQEKWVDHRLQHNNTKRILVKDPKLFGLLWHPDLYFANARTASFHDVTQPNFLVWIYPNGTVWYDCRISLTVLCMQDLARYPLDSQNCGLRILSYAYDEEQLIIRWNGGNPVEVNRGIRMPDMHLKHIKFYTKRDKYATGIWSSAVAEFHVDREITHHIIQSYIPTSLIVIISWFSFWLDVEAVPGRVSLSITTLLTLATQSSAARMALPQASDVKAIDVWMGTCMAFVFSAMIEFTVVNYCVRRKVRTKIKPRGLSEQVHDMVAQYREKKDKFNNGNCEISYEMALQPNEDNATVQRNFEKKEVREMNQASLFVRRSLLPTSKRKTIEDRINRVEENRKNAQKIDRYSRALFPLAFIIFNIFYWIYYLKYAGSNSPELLL

SEQ ID NO: 5558 - protein, 963 aa, Caenorhabditis elegans
MVKSYTLAGLAAIACLLLAIGAVISTVYILNDISDFYSEAQEELVEFKDIANNIWEEMVFELTPEEMREAEDNDREKRSYEPEGPYQSETTTPSTTTSTAATTTEAAEDESGYDFVNDNGPPSSRPRKPEPPTMPRTIQGTHKSFSINLRIIISGFRAPPPAATSTYRPPHGSNYDNYGREPASSRRPYPPQQPPSTSAPHSSPNNRTSLYNPQPPPKTGYPTNPRVPYNPPQPNYTRQPTYPEDNRAPYKPTRSPNTPPPRQPSGGYDSDGQTPPSSPRIYNTRRPNNHGPGYPEDQVPTAPPVPGQQRVPPTQTRNPPNPTNTRQPSRPVPPTSDGHIEATTPYNPSAQYPTGKRGSHPGFGPQRPRPGTRPRGNPCDQCSAQPNHCPSGPPGPRGRPGPPGFPGQDGPRGLRGLNGGYSGVQPSSYDPVIGCVQCPIGPPGERGPDGTPGVPGEDGIDGEQGVNGQDGQPGAPGAPGYHGMNGSPGTPGKPGLPGRNGQSCKSIPGPPGQPGVMGVPGRDGDPGTDGEHGQDGSPGIQGPPGRDGTSGPDGQPGVSAPGAPGTDGGYCPCPKRSSKFDFNDAYNDDEKRGLEEHRPRGYDSERAEEPRPRQTVRTNTYDENSGAEHQRRPNYEPSAEVAPPRQDRYEDEERVREPPPKRPPPPHRQTPHELYPEEQPYVRRPPPPQNRGNYEVERSREYVPEAPRPRQGYEHSSGYGGDDRKEQPKYMESRPVDEPRYETDAPSRSRPLKKVEIIRHPERGYDRRQPSYEDSKPRQEEPRRYETEAEPRYEEVPRKETHPPGFGRPKSEENPRETGRTYSEEAMPPVQQTEKYNGDKRKKNQPEYEDISKPEEDKERAMEKHHKKPNKFQEKQWEEHRKSQELRNSREHGGQVPVETSVPMQQVKPESSAEEKPVPPVHDNFQSSEKRAFSNENPLPSEQIPYRRRNRFYRNHYYEKFLV

SEQ ID NO: 5559 - protein, 1244 aa, Caenorhabditis elegans
MHIKSIHLDGFKSYQKHTDILDFSPTFNAITGYNGSGKSNILDSICFIMGINKLDNIRAKSMHELISHGGTKAIVQVRFDNTDKRCSPFGMEHLDEIVVQRIITAQATGKGCATSYTLNGHAATNGKMQDFFRGVGLNVNNPHFLIMQGRITTVLNMKPEEILGMVEEAAGTKMYDQKKKDAEKTMFLKDAKLKEVDRIFQSSIDPRMVKFREDRKNMVEVTRLKKLKENFSRKYEAFQYFQTCEAVKKSAKEIEDAKKGIEDLGEKFNQLDLDLKNKEDEKKKMEESRDDQHEEAALSAAHLSKQSIMLQKETVKNQLVETINKLKKEGEQINKSLSKDREVLDAKRKEHEDSKAANSKDIQSQSDDEALVTKYRNDLESLTRGTIANDKGEHVSIESEIQSCKSTASQMSSGITAAKKRGERLHNQIKHLEGEKATLSARSKSDIGSADNYQKEVDEINKQLQLLGFNIDADTEKREHAAKLHESITKLKDMDTRLLNSYKDGRYALNYQRPPLHIDKFDEKRDVFGYVAHLIKMKPGCEQFAVAADIALGGVLGNVVVSTQDIARILIDGKAFTSRKTMIPVSENARNASSYNTLPDVKLRRAKEIAEKYNDTVTKMIDLIEYPDFISNTILNAVGQILVVDSLDVAREIAYDEVAKTRMITRRGDDVRTNGIMTGGYNDPGNKPALIALEPMYARRPQIEAQQRELDALNRELQLTEASSQKCRDLNNQLATAMRKLAQVKTNINNSEFGIVVRDLKVHSEEYEKNQAEIEATVKTLKDVEDKIKTLESMKNKDKNSQEKRKKELTALLQKAEQTVAQNKNRGEKARREVMLLQATVEEMEKTIKKDEGIWEQKKKECDELEEKLPNAIAALKDAELEQKAAQAKLNDLKNNQRQISTRLGKIAKECDALIREKAKTKSKREEKEKELTSLQQSEASNRKEARSKLKKFEWLSDEEAHFNKKGGLYDFEGYTVSKGKDEIKELTDKIETLERSCCIQNVSNLDTCEAKVLDIKNKRERITEDFNMLKKTIATLDKKKVDELIRAHESVNKDFGQIFNCLLPDAHASLVPPEGKTVCEGLEVKVSFGGVVKDSLHELSGGQRSLVALSLILAMLKFKPAPLYILDEVDAALDLSHTANIGMMIKTHFHHNQFIIVSLKQGMFSNADVLFQTRFADGHSTCTRLNGGDIAVLCQDKVLQAQALELTDAGKAKKDAAAKKGAQKNDKEPPKKKPIVVDDDDFE

SEQ ID NO: 5560 - protein, 1244 aa, Caenorhabditis elegans; identical to SEQ ID NO: 5559

SEQ ID NO: 5561 - protein, 1244 aa, Caenorhabditis elegans; identical to SEQ ID NO: 5559

SEQ ID NO: 5562 - protein, 270 aa, Caenorhabditis elegans
MGEQQLDCALDLMRRLPPQHCDKNLTDLIDLCPHLVDDLLSTIDQPLKIAADRETGKQYLLCDYNRDGDSYRSPWSNTYDPPLEDGQLPSEKRRKMEIEANAAFESYRDLYFEGGVSSVYFWDLDNGGFAGIVLIKKEGDGAKNITGCWDSIHVIEITERARQAHYKLTSTIMLWLQTNKSSSGVMNLGGSLTRQHEMDAPINDQNTHLANMGRMIEDQESKMRLTINEIYFGKTKKVMSDLRSTEKQSELEKQDEIVRELNNAMANRGN

SEQ ID NO: 5563 - protein, 430 aa, Caenorhabditis elegans
MPRPKILKRATVQPSAAVPVKKSTPEKEGSRQKKTNGKENASRNLQSNLEEDLEQLGFEDETVSMAQSAIENYFMQGKSASERMNNAKSRRGRRAGNGNTEEIEEDDEISNAITDFTKCDLPGLRNYITKKDNTEFEKRLEHLADNDFGKWKLYLAAGFNILLHGVGSKRDVLTEFENELSDYTYMRVDARKDGLNVKVLLGAINENMKLNCNVKRGQSTISWARSIRRKMNSQQLILIIDNIEAPDWRSDQEAFCELLENRDSVKLIATVDHIYSTFIWNSRQLSSLSFVHITINTFEIPLQELMTGDSRLLGLDARSNQSSHTMSSLDVFWKSLAVNSQKLFRLFFQMYFDTKKPVKFWDLFNAAKDDFIASTDAALRTQLVEFKDHRVLKWTRGDDGNDQLSGIVELRLVTEFLESKNMPLDEKKDE

SEQ ID NO: 5564 - protein, 448 aa, Caenorhabditis elegans
MREVISIHVGQAGVQIGNACWELYCLEHGIQPDGTMPSEQQNEGGSFTTFFSDTGNGRYVPRSIFVDLEPTVVDEIRTGNYKKLFHPEQMITGKEDAANNYARGHYTVGKELIDTTLDRIRRLADNCSGLQGFFVFHSFGGGTGSGFTSLLMERLSVDYGKKSKLEFSIYPAPQVSTAVVEPYNSILTTHTTLEHSDCAFMVDNEAIYDICKRNLDVDRPSYTNLNRIISQVVSSITASLRFDGALNVDLNEFQTNLVPYPRIHFPLASYTPLISAEKAYHEALSVNDITNSCFEPANQMVKCDPRNGKYMAVCLLYRGDVVPKDVNTAITAIKTKRSVQFVDWCPTGFKVGINYQPPTVVPGGDLAKVPRAVCMLSNTTAIAEAWSRLDYKFDLMYAKRAFVHWYVGEGMEEGEFTEAREDLAALEKDYEEVGADSNEGLEEDGEEY

SEQ ID NO: 5565 - protein, 448 aa, Caenorhabditis elegans; identical to SEQ ID NO: 5564

SEQ ID NO: 5566 - protein, 410 aa, Caenorhabditis elegans
MANFIRLAYNLEVWKLIEVHKTTKKAISAHKLCGSGRFSNVYCGQMISPIEKEVAVKNVWSDTETRHLATSEYPEIQILSKLFHPAISNLLYFYSRNANDKVINCLVLDYLPQDLARLRDQGVKFDVLDAKLYTFQLFCAISHLTSKNIVHMDIKPQNVVMDRMAGRLKLADFGNARRLETNEKTGSAYQVTRFYRPPELLFGCEKFTASIDIWSATCVAFELFANRVLFKGKDTKDQIVLITGVFGYPTDDDIKSIGVKRPRVARKDARGIETVKIKEKTNKTKKEAKQSTLVHEKYTRARAMSRSTENKLAPFTSKMLDSEIYDFMKATLKIDPKKRKSAIDVLKMPLFDILRSSPPKKRSNGVEMPNLASYTEMHHKREPETEVVADIQTTEKAEKESDSTNEELED

SEQ ID NO: 5567 - protein, 207 aa, Caenorhabditis elegans
MVSYKLTYFNGRGAGEVSRQIFAYAGQQYEDNRVTQEQWPALKETCAAPFGQLPFLEVDGKKLAQSHAIARFLAREFKLNGKTAWEEAQVNSLADQYKDYSSEARPYFYAVMGFGPGDVETLKKDIFLPAFEKFYGFLVNFLKASGSGFLVGDSLTWIDLAIAQHSADLIAKGGDFSKFPELKAHAEKIQAIPQIKKWIETRPVTPF

SEQ ID NO: 5568 - protein, 818 aa, Caenorhabditis elegans
MIQFRNKNNSMNRIARHLRNVARRKGSSLLLFLMLSTVLVAAKEDGKLGEEDEDFGWNDEEPPDNQDVQDGGIPLVRKEEFTNNQLYAEAYQSYIQALAYPARLVVRPDSSTVVDESKISFFCRADGNPLPSVIWRVNGKSITDHNRISIKSLATGLSTLRFERVSLDDNATVVSCSADNGVANPVVAEASLTVVPRDKVPIGFPQIELHPSLKSVEQGKTAYVSCRVRGDPRAKVLWLRDLIPLDIRADGRYSVSTIGNPGALMIQHAREEDQGKYECIARNTLGVAHSKAANLYVKVRRVPPYFSYKLERQYVVGVGGNINLTCVAVGYPMPRVFWKKTDLMVLDDPSTAPIGKNVLTLTHVESTENFTCVAVSALGNIEATTTVIAKELPPPPVNIVVSSVTSESVVITWKPPKYNEAINKYVVNYRLKYSEGRSSRGKTMETLENSLVIDGLVAFQTYEFTVRSAGPVGVGLESLPVEAQTKPSKPATAPVSPQARSLNRDSILVKWGPCEQPNGLITGYKVYYTNDLVTTPIREWKQHDAKSDEFMTTINGLEPDSRYFVRVIAQNSEGDSPLSTLVTVATRQGIPGQPPMLTVKALDSRRMQLTWDKPLYSSPVVGYTVRYNTSDGEKELTLTSPHEKHVVTGLHPDKYYYFRVAAYSDRGQGEFTEPMISKTIASIPLSSPTIVSAAATSSKSVEIRWKGPEQKKLNGVLTAYRINYFRLEDSKTANLESVEYDEDMDDSSSFLDRMSVVVPSDATSYVLSDLLPYSSYEITVAASTMDGYGPESSIRVGAPKKNQLLRVSKKICNKIKRV

SEQ ID NO: 5569 - protein, 1585 aa, Caenorhabditis elegans
MGTPATTIAAINNNFRKFFILFLLLLAPTCRGQQKGKNWWMRRTSLVGLGVPSAPRNFNAELTSATSVKLTWDAPAAANGALLGYYVYLDRMVNGEPVVEKGSKKRIVMIRDSSKRYFELDSLDPNTEYSFRLNAFNRNGDGEFSERKSIITQGIPPEAPEIVSVSLDRDEPPVVARIEWKMPKMKPNETPIEKYNLWLRAQGYPDSYVKAKTVDGTDLSTTISGLWMGVVYDVLLAAENREGRSQNATETIATPVGSPDGEPIDVQYEVMKGKIVVSWRPPSEEKRNGNITSYKAILSAMDATADRYEQPVPAPSTSSTFEVNVRRAYLFKVAAATMKGIGPYSPVLTINPDPADLILDNNIEEEEGNQDPGEATMGENRNPPKKSKISTADVYSAILHHAPGPLTHPISAALAKAKPTIGAPMPAPYTTTSTPSTLFFQVTLPFMTTAWNRVTKLETLVGPPTNVRVEATSNSTAVVQWDFESQKADSFVVKYMHEPGNRMDTEKWKQLPVVSIDKENPKRFAVVSDLNAHKPYAFCVLAVKNNRQGPCSDPPTVLESVTPTYMVQNLRVLWKTSNSVQLTWEYNGPRNVGFYVNHTGRKDYVNHELQEKTMSTPGFGQDVDEKHREYLWTNLRPHMMYTIHVGVRTLPPGARKYWPQEVVTITDPTGPPFVDVPKLVDSSGTQPGQQMIRLTPATEEYGPISHYWIILVPANYSTEDVVNLDPIELEKATAEKRAQLARSLSVSPSKKLKRKASEVGDDSQSASYHPKEKRARRATVPGAYVTARLSADRVKQQYRNNQPFIVGDSQLYDGFTNYPLEHNLHYRLMMRAFAKNDVRTKDSFEQRAPMSEKLSRMYSDSVLTEPFTIKSALRGASQKSSPWVGACIAFLVLFSIVGMLICWWLRCNKKSAGRHPRHGSITKVALTGNIMNGGGGIPGETSKLLSTSNEYGRQIMNPYEQMNGNHHMESSMDLYPLPTSHSRSNGYAPVPVAIPSLPNNGNNMTTVSHPAVPIAELANHIERLRMNNNAGFQSEFESIETGQHFTWEHSSADMNKHKNRYANVAAYDHSRVVLSNVEGYPGMDYINANYVDGYDKPRSYIATQGPLPETFSDFWRMVWEEQSVTIVMLTNLEERSRVKCDQYWPSRGTATYGDIEVTLLESVHLAHYTMRTMRLKMVGEPEVREIKHLQYTAWPDHGVPDHPTPFLIFLKRVKTLNPNDAGPIISHCSAGIGRTGAFIVIDCMLERLRYDNTVDIYGCVTALRAQRSYMVQTEEQYIFIHDAVLDAVNSGSTEVPASRLHQHLHILSQPSADQLSGIDMEFRHLTTLKWTSNRCTVANLPVNRPKNRMLSAVPYDSNRVIMRLLPGADGSDYINASWIDGYKERGAYIATQAPTNETAADFWRAIWEHNSPIIAMLVRTNERGQEQCSDYWPLETGVQVGMLVVEPMAEYDMKHYHLREFRISDINTREVRTVRQFHFMEWPDVGKPHTADHFLDFVTQVHNTYAQFGCTGPITVHCCSGAGRTAVFIALSIILDRMRAEHVVDVFTTVKLLRTERQNMIQEPEQYHFLYLAAYEYLAAYDNFS

SEQ ID NO: 5570 - protein, 1585 aa, Caenorhabditis elegans; identical to SEQ ID NO: 5569

SEQ ID NO: 5571 - protein, 280 aa, Caenorhabditis elegans
MGSSQSTPKVQDANADAERIRKAQHSMAAAGGGSQCPLTPEQRAAASGENCGAGGACPVGADKASINPLNNELEHPNQKPAPDQPFALPTKREKSTIPKAGTETETWTYPSPQMFWNAMLKKGWRWQDDSLSKSDMENIISIHNANNEEAWREVLKWENLLHPECAEPKLKSFKGDAKNLSPRARFRNLFLGYDLPFDRHDWIVDRCGTKQVQYVIDYYDGGAVDPSSKLFTILDVRPAVNDIGNIWDRMVVAYWRFKFETLGFTPSLPIPPTEGHNVNH

SEQ ID NO: 5572 - protein, 865 aa, Caenorhabditis elegans
MGSIYRSEHMKLCQIFFQSESAYQCVAELGELGMAQFIDLNEEQNAYTRKFVNEVRRCDEMERKINFVEDEITKDLVPIPDYDEHIPAPQPKHMGEMEANLEKLEEELVQINKNCKVLKNNHVQLLEMKAVLEHVTSLLDPHSKREAAMSISEAARGEAGPISFGMKDEFDKPVKDEKELKFVTGVVKRSKAIAFERFLWRLSRAKVFAKFIQIQEQTELFSNEFEDKCVFILFFSGEQLRAKVKKICDGFQAKCYTVPENPAERTKLLLNIKVQTTDMKAVIEKTLDYRSKCIHAAATNLRKWGIMLLKLKSIFHTLNMFSVDVTQKCLIAECWVPEADIGQVKNSLHMGTIHSGSTVPAILNEMETDKYPPTYFKLNKFTQGFQNIVDAYGIANYREVNPAPWTIISFPFLFAVMFGDAGHGIIMLIAASAFVIFEKKLISMKIKDEIFNTFFGGRYVVLLMGMFAIYTGFIYNDFYSKSVNIFGSSWVNPYNQTLLANMDAQGADSNTDLSLTFPPEIAFNHDYGPYPFGVDPVWNLAINRLNFLNPMKMKTSILLGISQMAFGIMLSLMNHIGNRSVVDIVFVFIPQCLFLGCIFVYLCLQVLMKWIFFYVKPAYIFGRLYPGSNCAPSLLIGLINMFMVKSRDASFAHDVGTAAGKEWVIVNGQNVTYTINDQCYLQQWYPNQSLVELILLLIAVVSVPVMLLVKPFYIRWRHSRGLHIDLGHGPDEHGEFNFGDIMVHQAIHTIEFVLGCVSHTASYLRLWALSLAHAQLSDVLWTMVLRMSLTMGGWGGSAAITILFYFIFSILSVCILILMEGLSAFLHAIRLHWVEFQSKFYGGTGIQFEPFCFTKIIRVYEGLDQ

SEQ ID NO: 5573 - protein, 865 aa, Caenorhabditis elegans; identical to SEQ ID NO: 5572

SEQ ID NO: 5574 - protein, 299 aa, Caenorhabditis elegans
MVVNVFISAVTTDTLSRKEAVAWVNNLLKSHFTKVEEMASGAAYCQLTHLLFNAINLKKVKFNPRSEPDVLNNWKVLTTTWKDLGIDKPVDVEKMKKAKFQDNMEFLQWFYKFYNANLTTEPEEYDAVGARFGEDLPALKGSTGSRPVAAPARPVAAAPPKPRPAAPAVAAPAVKASVPPTVRNGTRPAPATSAGTRRADPSASEELLKQEIEKHKAASDEWETTAKEMETEREYYYSILQRVESLANEAEESGSSTVDVAALKTILYAGNEDTEQVDEIENEHLVESLQANLDDTETF

SEQ ID NO: 5575 - protein, 414 aa, Caenorhabditis elegans
MRWLVTTLLCCSLAHGLKDLGAPNWSCDASVMAKSKKVPTSAHSVRFADIKVIGALGDSLTAANGAGAQPGDPLAVILQYRGLAFQIGGDKSLDEHITVANVLRKFNPTLVGASKGIGSENVWEVSHLNMGVPGAESKDIIGQARALVNTMHAHSEINVKEDWKLVNIFIGANDICVYCEDPYFNSTALHGNATFEKNIIAAVQILQDNLPRRTNFKFKLFSRISVCKTFSSWREFKNSNIYSRTIVSLTGMFNMRMLRKIDKKKYFCEGLHTFECDCESNKQFTDDDIQGVCFGYMNAEKDIQNTGLFDNKDDFTFVVQPFFNGILDPPYASPGVVDMTFFAPDCFHFSAYGHGNIGMHLWNTIVQPVGFKQTSVNLSDPSVGLHCPSTNCPFFPTTKNSNNCASHFTLSELD

SEQ ID NO: 5576 - protein, 629 aa, Caenorhabditis elegans
MNWVQTGFLLIFLTTLVFFCTADPLETSADSPVLSTGLGYIRGRRVSTKSGFLVDYFTGVPFAEKPERLKKSKLVNRWVDIRNTQQYPPKCIPAARPVNISEFSEDCLYMNILKPSGLNTFRKYPVVVFVHGGGFQEVLFFSILNVLGDGNDASCDAFAEHFVSKEMIVVTIQYRLGMLGFLSLGCSDPLIPCNLGLWDMVTAFRFINATIENFNGDINNMTLMGHSAGAMAVSLHSMSPISSVHFKKYIQLSSSSWGLTRYKDQNIVQTKKILKDLNCDISSAKSIVDCVNSTSLDSMYSAQVCAHPFSFEYIFSRVETGYITFAPKIANFRICVIPLFVQEILKTRVDTTLWPEFGDELIPDIPDNMVKNTQNQKVLMGVMTLESLYFSEFRFFVNCQIYKKNVGFVNDLKQCTSYFRAYLKSSPAIFPYIHRDTVEEYINSTIAIQYGIGSESAYDMTSAYYLSANATDNDYGYFMWQRSKVSARQMFLKSTVTLVALEFPKKIDSNTGFDIPILREARARSQVSPDLYLYHFPYFNPAEFDVDFPVRATYHCHEFPYIWGVYKDNYFEFNDDDRTVSAFLITSLTNFIKTGNPSSSEFNWPLYDSSVSHTVIGPKPTTDKRLLTL

SEQ ID NO: 5577 - protein, 605 aa, Caenorhabditis elegans
MTIAGFCALSLIQDHCCWTTPQHCSVAELGTMPCPTQVSGRCVATTAAVLAGGALIGYLVGYKFGQRSARCNYKIQLDSNKIVDTVDIEDIGEKKAFCRCWKSEKWPYCDGSHGKHNKETGDNVGPLIVKSEKNLYIYIIISDFYNNHTNDLKHQIAQLERKTATIPKLENQLHKAKNQNKVLRRESALFPSASCADVSRVEDQKVKTLRNELADLKLKLRQLEDDNKEKDMENDRLIQENRTLKREKLKLINCFKTQMAEKDAIIRELNDEVVDLRGQIRVAIRVRDFERDGSSNFSIISQNEVQLQQTTGQSNTYSFEHVFFPPTAQSGVFGEIKELIMCALHGKNVCLIAYGPTGSGKTFTMRGEDSADSEGVIPRAIRFMLEQSKRDLAMIGWNYKFQASFIEVYNEEVYDLLDGKQKLEVKINGSKTNVVGLKKIEIGNISDVDVILNLADSQRSVASTASNEHSSRSHAIFQIFVDGQNASGEMVQCCLNLVDLAGSERAKETQARGKQFTELTNINQSLSTLKKCIRAQMTKMSHVPYRDSKLTMVLREYLGAGSSKTMFIAHANPRDVAETKRTLEFTSELRSTNLGKAVVQTGQKL

SEQ ID NO: 5578 - protein, 312 aa, Caenorhabditis elegans
MGGGGEDEYESLPTHSVPVHLTAGALAGAVEHCVMFPFDSVKTRMQSLCPCPETKCPTPVHSLMSIVKREGWLRPLRGVNAVAAGSMPAHALYFTVYEKMKGYLTGNSAGHSNTLAYGASGVVATLIHDAIMNPAEVVKQRMQMAFSPYGSSLECARCVYNREGVAAFYRSYTTQLAMNVPFQAIHFMSYEFWQHVLNPEHKYDPKSHLIAGGLAGGLAAALTTPMDCVKTVLNTQQAAEADPANRRIFLQARYRYRGISDAVRTIYSQRGLSGFSCGLQARVIFQVPATALSWSVYELFKFMLSFEGGHSS

SEQ ID NO: 5579 - protein, 409 aa, Caenorhabditis elegans
MLTRGFTSIGKIASRGLSSTFYQDAFQLSDQLTEDERSLMLSAREYCQERLLPRVTEAYRTEKFDPSLIPEMGSMGLLGAPYQGYGCAGTSTVGYGLIAREVERVDSGYRSTMSVQTSLVIGPIYNYGSEDQKQKYIPDLASGKKIGCFGLTEPNHGSNPGGMETKATWDETTKTYKLNGSKTWISNSPVSDVMVVWARSARHNNKIKGFILERGMKGLTTPKIEGKLSLRASITGQIAMDDVPVPEENLLPNAEGLQGPFGCLNNARLGIAWGALGAAEECFHLARQYTLDRQQFGRPLAQNQLMQLKMADMLTEISLGLQGCLRVSRLKDEGKVQSEQISIIKRNSCGKALEVARKARDMLGGNGIVDEYHIMRHMVNLETVNTYEGTHDVHALILGRAITGLNGFC

SEQ ID NO: 5580 - protein, 1130 aa, Caenorhabditis elegans
MRDVDLTAAPAKKAKLDTGERIAVSGRVASVKLTNFMCHANLQIDFKTAQNNCFYIGGPNGSGKSALFAAINLGLGGRGSDNDRGNTVKSYIKDGTTQSKITITLTNAGLNAHPDFDDLISIERTINQASSTYIMKSVKVTSSDNHVERIVSRKKADVDRIVSRFSIHLSNPAFWMSQDRSRSFLANFKPANVYKLYLESTNLENIRLSYIRFADALDECFALIQLKAGEILNEQKKLKRMQEQRDLQAKLDQDRALVASFCWKLLFCKVRDYNDQIELTLKKQEAQKTLQDETKKEYAKNRAARTEVEKKIQEFRDEVEVQDAEIAEAREDLDAKKRKVLEFEEKIRECEQSIRKKTSEKKYMERTIVNAKNEVRILLEKQGNQDLTKRLTKVENDYKDISQQRENMELGGESAKLREKLDTVITDYKRKEEEKYTIQRDINQLRRKIEQDMETMRRSRATKKDAINKFGSHMAEILMEINRSKSRFQTVPKGPLGKYITLIDPKWAFTVEECIGNLANNFLCSSHLDAEILRNIFQSLRIPAQDRPTIIVAKCNGRAYTNLHEPSSDFKSIYRVLKFSDPDVHNVIIDKSNCEQFILIEDKTEAMELMGSNYPPQNAVKAYTLDGSQAYANGPNSQYRFYSGRGGHARGTFGNDQGDVDEGALARLIEDTKSEAMRLETQDLRKQDHELKVIYNERDQTKAAIDEFDRKLSNLRSQELQKERQAKDLRAELAQTANEDQVENLNESIEEMQKKIPLIEDEVKDILKNVADITADMAPVIQERKEAEHTLAEIQKETRDFASKSQKLQNELSKYDDAGEILKIRLDKVKADEGVFFHTEAKLKSERDDAMEMVENDKKNHPMPPGETDPPDLSSFPSTTEAQRKIEEMQKAVDRATVGCDTTITLECVKDFKDKLKRLKYLCRMIEDVLIELKNLHAARVKAYPSLKKFTELKVCNKFQELLAVRGHFIGGLEFDHEKETLNVNVQSSKEKDAMAGRRPEVLEVEEVDEHSYDDDSDDSTGPRRKKSKKSGQKKKRVRDLKGLSGGERSFVTAALVMSLWEVMEQPFRMMDEFDVFMDMMNRKLVMDLLVELATKKFPHNQFIFFTPQGIKELNMVDGLQVFEMNRVRD

SEQ ID NO: 5581 - protein, 1130 aa, Caenorhabditis elegans; identical to SEQ ID NO: 5580

SEQ ID NO: 5582 - protein, 725 aa, Caenorhabditis elegans
MCGIFAYLNFLTPKKRSEIVDILVQGLQRMEYRGYDSAGIAIDGSNEIESPHSSVALLRKAGKVSVLSDFIKESSSDLDMDMEYNIHCGIAHTRWATHGSPRDVNSHPHRSNDKNEFLVVHNGIITNYREIKEYLEKKGHKFESETDTEVIAKLAQHIHDRYPDFSFRQLVETVIQQLEGAFALAFKSSRFPGQLVASRRGSPLLVGIKSNSRLQTNHFPVSFSKDAGWKWGDEKQTDGRRFMSNHATHLRDETSFVETPNNILDLSIAVRSSNGSAKMEISDSTTAVRPFDSDDWEVEYFVASDAAAIIEHTKQVLFLEDDDVAFVEDGALTIHRISRHADNGEQKREVKLLEMELQEIMKGSFKTYMQKEIFEQPDSVVNTMRGRVLPSGQVVLGGIKEYLPDIKRCRRLIMVACGTSYHSAIACRQILEELSELPVVVELASDFLDRETPIFRDDVCLFISQSGETADTLLALRYCKPRGALTIGVTNTVGSSICRESHCGIHINAGPEIGVASTKAYTSQILSLLMFALTLSDDRISMAKRREEIIDALNDLPELIREVLQLDEKVLDIAKQIYKEKSLLIMGRGLNFATCLEGALKIKELSYMHCEGIMSGELKHGPLAMVDEFLSICMVVCNDRVYKKSLNALQQVVARKGAPIIIADCTVPEGDLAGMKHILRVPKTVDCVQNILTVIPLQLLSYHIAELNGANVDRPRNLAKSVTVE

SEQ ID NO: 5583 - protein, 1095 aa, Caenorhabditis elegans
MRKTDDGGGSGRLSSSCSSIRSSNYSRSYTPSFNTFKYSPSSYTPNISRNLNTTSTGSTTSDTPKLSSSSAPRSRLSFTTPSSTSTNLPRTSITSHKTLYSSPAAARVSVSTNDSLSHSTPHNTYRGISKYSTIERSTVADTKPYYSSATSSLSSTYDSRRHSRSDRISSSTLPDVKIETGPTTRTHMVHPTSSHIRSRSSYGRSNTVSMFAQQARERADREEKDRDYKEWMQKEKDRETELGLETLYPTTSSSSSAQSSAQSEFRRSVAPSPTSTSTTTPYRSNRYSSATRGGNSSSAAPLDDIMSTSYSSVAATPPPAYSQLSTSTSTLLRTRRERLEREEEGRNSSSMTPQPQSLVPPPPPPPPPPPSAASNGRSGYLPRSVSAAVISSASSSSVYKPTAMVLPYEEDREKVCVVEQGYTGLRNIGNTCFMNAVLQMLVNNIELREYFLRNHYQPEINETNPLGSEGRLAKAFADFMHQMWSGHQKAIEPTQIKNIVAEKASQFANFAQHDAHEFLSFLLDGLHEDVNRVKKKPLTGTVESHGRHDLDVSNEAWKNHILRNDSIFVDLFHGQLKSHVQCPNCDRVSITFDPFVYLPVPFPKNKQSTDLIFWPLENQTKPYKLTVSYSTEGTVADFLSVVSETVRVPTRNLRACEAICHKFDKIYSLDMKVSDIVSPDRLFVFQTHDEMEFNEEIVILHVLQRELYRKNTKHACHECGNSKLKLKACEECYDAVYCSKECQVANWSTGGHREECSKRKPSETVGHPLIVSLPRSQLTYQHLYRVLEAKSRHTPPGESSSSSSVSSTPRRRSVAAEPRTKNQKMFEIRKLSGQNDSFGSHSISDDEACQSLESGGYVSVNWINQRNGKPYITIENRKDIDVDVEKSRQMNSRNMNGYVKSNNSETNPHLTQMLDLFSETERLKPEESWYCSTCKENVEATKKLQLYRLPPVLIIQLKRFVYTAFTYQSSMARRSKDTRSVEYPLESLDMSPFLAETSPHPNSTMYDLTGVVCHSGNSYFGHYISMGRLADFDSSKTKIEWRNFDDSTVARQSTSTLQTEDAYLLFYKMRDQNVTRSIFKRHYSCDPGAPEEVKI

SEQ ID NO: 5584 - protein, 343 aa, Caenorhabditis elegans
MRQAGIFSHLKNFWKIILQFSKLKKKHIVMSSENQKIVVFGSIVQDLVSYTDSFPRPGESVRGHNFKLGSGGKGANQAVAAARLGINVSMIGMVGEDMFGDSNIKDLSSNGVDTSCVGRTKKTHTATATITVNKEGENNIVVTLGANLEMSPEIADANSSKIAGSKMVICQGEIDEKGNRRAFEIARSHGVTTFLNPAPGDPNMDKTILELVDIICTNENEAEFITGIAQNNVKDAEKAARAMLKMGPQHAIITLGGKGVLLASKGVDDVEHTAVIKVDAVDTTGAGDCFCGSLAAHLVAGHPISASIRSAANLAALSVTRHGTQSSYWKLDEIRQQYPEFLP

SEQ ID NO: 5585 - protein, 372 aa, Caenorhabditis elegans
MTILAGLATKSVQIMCAFKTPSHFLFCFLPLILFFKMVFLFCSFINNQMMVLSVTFRTLTQVNFNLELNEDQTIAEVKALVASEKGDDYAPELQKLIYNGKILDDSVKVGEVGFDSSKFVVVMLSKRKVTEVAPSSTVATAAEPVPVAAAPASNPAPAADVAPEAAAPAEAEALTDEQEENVLAITGMGYDREQTIAALRAAFWNPDRAVEFLLNGLPDDAADQEPDLGPEQNIDNVDEDGNDDLNMLANMPQLAEIRALIQQNPEMLAAVLQQLAAVNPRLVQTIQNNQQAFMDLLNGGAQGAGAAAGNAPERNTPRRHVIHLSPEEAAAIERIKAIVVNAPEAVVVEAYFACDKNEEAAINFIFSNLDEE

SEQ ID NO: 5586 - protein, 766 aa, Caenorhabditis elegans
MKTVKQFFVQCTMYTRFGPPIVFLISCYALILCGTVDALPRAPYFNDDINKTTTTSEDKTVGNTVVEEEKKTYTVGDSEGYQEASRLLQKSLNLSLDPCDDFFEYACRAWVDSHPIPDDLTSYSQFTATREKVLAEMRKLYEDNTSIPTSKSIALIKQIYNTCMDTEKHNAVGARDLLEKIKTYGYWPMVHNEKWRESTFDLTKLLSNTIQSRDVSVFFDFGPAEDSRNVSRRLLSFDQGSLGLGYSTRDYYLDEKKYEKQMKAYRKYTIGKVRYYTEDAGMAVNESKIESDVDEIIAFEKEWAQILVAEEDRRNYTKLYNVRRFDDLKEYMSIIDWKKLTLSTTPFLVHSYLKTNPSIIISDVEYLQKMNTLLQNTDPRIVTNYILLRWAGSWSQEIGKKYEDLQQEFAFQMYGRKQRQPRWKDCVSSAGGKLSYASGSMYVRKYFDANAKNTTLDMITDLQEAFRNMMHANDWMDAETKKYALEKADQMLKQIGYPDFILNDEKLDDWYKGLEGAPEDSFSQLVEKSIQWRNNFYYRRLLEPVNRFEFISSAAVVNAFYSPTRNAIAFPAGILQQPFFDARFPKALNYGGIGAVIGHEITHGFDDTGRQFDNVGNLRDWWDNTTSSKFNERTQCIIEQYADVKLRGTDLRINGKLTQGENIADNGGIKQAFKAYKSYLEKHGGQEARLPQFESLTNEQLFFVGYAQVWCGAKTPETKTLLLLTDPHSPETARVNTVLTNQPEFAEAFKCPAGSPMNPTKRCVVW

SEQ ID NO: 5587 - protein, 766 aa, Caenorhabditis elegans; identical to SEQ ID NO: 5586

SEQ ID NO: 5588 - protein, 333 aa, Caenorhabditis elegans
MASTIKEVFAEIAAPVENSHGKVTVVGVGQVGMACAYSILQQNLANELCLVDVVADKLKGEMMDLQHGLAFTRHCTVKADTDYSITAGSKLCVVTAGARQREGETRLSLVQRNVEIFKGIIPQLVKYSPDTCILVVSNPVDVLTYVTWKLSGLPRERVFGSGTNLDSARFRFLLSEKLNIAPSSCHGWIIGEHGDSSVAVWSGVNVAGVTLHEIKPDIGEKTDNEHWEAEIHKKVVDSAYEIIKLKGYTSWAIGLSVAKIAQGIFSNSRNVFALSTNVKGFHGINDDVYLSLPVVLGSAGLTHVVKQQLTEAEVQKLHNSAKALLEVQNGIVM

SEQ ID NO: 5589 - protein, 523 aa, Caenorhabditis elegans
MLSRLARVQPKCQQLAHFSTSKSAAAAPTVKLWIDGQAVESKTTDFVELTNPATNEVIAMVPNATQAEMQAAVDSAKNAFNTWKNTSPLTRQQCMFKLQALIKRDMKKLAESITIEQGKTLPDAEGDVSRGLQVVEHACSVPSLMMGETLPNVSRDMDTHSYRIPLGVTAGICPFNFPAMIPLWMFPVALATGNTMVIKPSEQDPGAAQLLVELAKEAGVPDGCVNIIHGQHSAVNFICDNPDIKAISFVGGDAAGKHIYERGAKNGKRVQSNMGAKNHGVIMADANKEQTLNQLTAAAFGAAGQRCMALTTAVLVGEARAWLPELVEKAKNLKVNAGWKPDTDIGPLISKQSKARVLRLIESAKKEGAQVPLDGSNITVPGFENGNFVGPTILAGVKPNMTCYREEIFGPVLVVMEAENLNEAIEIINNNPYGNGTAIFTSNGATARKFTNEVDVGQIGINVPIPVPLPMFSFTGSRGSFLGDLNFYGKAGIQFYTQWKTVTQYWNESLTELKPQMSFPQLK

SEQ ID NO: 5590 - protein, 454 aa, Caenorhabditis elegans
MVMSRTLVLVALLGFAYVCESALITNLPGAPISNFKQYSGYYNVGTKKNHMLHYWFVESQSNPSTDPVLLWLTGGPGCSGLSALLTEWGPWNVNTDGATLRTNPYSWNKNASILTLEAPAGVGYSYATDNNIATGDDQTASENWEALVAFFNEFPQYKGNDFYVTGESYGGIYVPTLVQTILDRQSQSHINIKGLAIGNGCVSANEGVDSLVNFLYHHGVVDQAKWEHMKTSCCHNDTDACPWHSFSEFSACGEFVEATQQTAWNGGLNPYNMYADCISTSASFRFGMEYERRFNKKYTPEVLGTVPCLDESPVTNYLNRQDVRKALGIPSSLPAWSICSNAISYGYKRQYGDMTSRVLNAVNNNNLKMMLYNGDVDLACNALMGQRFTDKLGLTLSKKKTHFTVKGQIGGYVTQYKGSQVTFATVRGAGHMVPTDKPAVAEHIIQSFLFNKAF

SEQ ID NO: 5591 - protein, 340 aa, Caenorhabditis elegans
MSELDQLRQEAEQLKSQIREARKSANDTTLATVASNLEPIGRIQMRTRRTLRGHLAKIYAMHWASDSRNLVSASQDGKLIVWDSYTTNKVHAIPLRSSWVMTCAYAPSGSFVACGGLDNICSIYSLKTREGNVRVSRELPGHTGYLSCCRFLDDNQIVTSSGDMTCALWDIETGQQCTAFTGHTGDVMSLSLSPDFRTFISGACDASAKLWDIRDGMCKQTFPGHESDINAVAFFPSGNAFATGSDDATCRLFDIRADQELAMYSHDNIICGITSVAFSKSGRLLFAGYDDFNCNVWDSMRQERAGVLAGHDNRVSCLGVTEDGMAVCTGSWDSFLKIWN

SEQ ID NO: 5592 - protein, 645 aa, Caenorhabditis elegans
MSSCKAIGIDLGTTYSCVGIYQNGKVEILANSEGNKTTPSYVAFTDTERLVGDAAKDQAARNPENTVFDAKRLIGRRFDESTVQSDCKHWPFGVKGKQGKPVIEVEVKGEKRQFNPEEISAMVLQKMKETAETYLGHTVKDAVITVPAYFNDSQRQATKDAATIAGLNAIRIINEPTAAALAYGLDKGIQDEKNVLIFDLGGGTFDVSILSIAEGSIFEVKSTAGDTHLGGEDFDQRMLQHFMNEFKRKTGKDISPNPRAIRRLRTACERAKRTLSSSSEACVEVDSLFEGIDLCTKITRARFEELCADLFRKTLEPVEKALRDAKLDKSKIDEVVLVGGSTRVPKIQKLLKDFFNGKELNCSINPDEAVAFGAAVQAAVLSGVKDETIKDVLLVDVAPLSLGIETAGGVMTNLIDRNTRIPTKACKTFTTYADNQPGVSIQVYEGERAMTRDNHRLGTFELSGIPPAPRGVPQIEVTFDIDANGILNVSAEDKSTGKSNRITIQNEKGRLTQSDIDRMVHEAKQFEKEDGEQRERVQARNQLEAYAFQIKQALDEYSSKLSTEDASRAKEAVDETLRWLDSNSLAEKDEIEAKDKELKSVCQSILTKMHQSGQSSASAGCAGNPGTAGFNPNNYPQGPTVEEVD

SEQ ID NO: 5593 - protein, 645 aa, Caenorhabditis elegans; identical to SEQ ID NO: 5592

SEQ ID NO: 5594 - protein, 1105 aa, Caenorhabditis elegans
MSAARPPVASYFAARIAVPCETTAVETPLSLGDGVSQKTAPKCQFRITRAETSKRGIQGFGSGTEHDGDSVDSFENFCPTASSPKEKISPRSRSERIQLQECDDDDSFDAPVISSKPPALPKDSGVSGFPCLFDDKNVIHLTARKGEKRDDCLDLECIDKEGTTRIVYLQDHWSEMSIEAGSTINLIGAQAWGDRDFLVNDDVGIVILNPDALVPCTAVASATFCARKTVLNDKFKFGNASNKAMLLGTIMHEIFQTAITSKKRPVMENDLMKIWNKQAPKYAEELVALSFTPSCLDAELQPYFSIICGWINKHYPLSNSFFSKREPLPSKSELLEVYDIEENIWDSKLGLKGKIDVTMRTKSRGGMESLELKTGKSSCSSEHTGQVLLYCMMQSSRYEQPIGPGNILYLKDGASHCVTPRAADLLGVLQQRNKLSVHFEDPTTSNLPDPRQDSRFCDKCDHKTMCSFYQKTEENFSKSNDKMKNFAENEMAHLEQNHIEYAANWIRWISAEWKCERERMTSQNKDLWLKSVQERVEEGTCLSDLHPVSEEMSNSQKIIISFSRKFLKSSNTPTFRPGDVCLLSNKKHIAIGFALIDEVSDDQQIVKISTDKTIKSRYEAPFHLDKYTSMSTHSTTLGNLVYLLQNDEIGKRLRNILVDLLPPIIMDATGFNLTPAIKKIIIKAKLNNEQRKAVVHALATEDFMMVEGLPGSGKTTLISVLIQCLVATNKKVLLAAFTHSAVDNILTKLTKEVAAEKILRLGSSSSIKDDIKKMTLKAKLENETSEEYYAAVRKVMKTTPIVACTCHHVPRELLFSYRHFDVVIVDEASMVLEPLLLPVLATSNKFVLVGDCKQLTPLVVSRKAKQEGAGISTMEKLQQSHPGVVVSLTSQYRMNREISVLSSKLFYENRLICGNESVSRSSLDRTGDYIVAMDDGSDHIRKALSGDIKDSCVFLDTQSTINSKMQCEDGEGGGMCNDGEAKLISELCQQFVMSGVKPHEIGVMSAYRRQVDHIRGILNSDELEVNTIDSYQGREKRVIIWSLTWTNNSTKKSELLKDERRVNVALTRARQKLVVVGCKNSAETIPVLFRFSQLIENHISIPTQL

SEQ ID NO: 5595 - protein, 493 aa, Caenorhabditis elegans
MADAVFPTQATAQTRYISLFGTRTRFVIMVLILLCLTSIWSNILAFNFAVVCMDDDDSEMGASLNGTARKTHFTSTQNSLAMAIVAIAALLGNFPIVQLVGMVGIRTVFAGLGILSAVSTLLIPLSIRMGFYYFLAVRFLQGFAFAANFPVIGSFCAKWSYFKQNGLFVSSLVAYVQLSPAITMPASGALCSAFKWPSIFYAHGAVSLLLFVTYALFYRNSPQKHPFVGNVELKKISIGKIAAVDKRALKKVPYGPILKTPAIWAVWVAAIGNFTCVNMMFLFSPIYLSKVLGFPVHSTGITAAIPPFLQFSSKLICGAASDRLTCLSEGVKFRLFNTLAFVGSAGFLCVLAFMGDEHKRNNMIVLGCAAAMLGATTGGFFKAGPVLSKQYSHFVTGNISLGITITMLIVPFFVNALTPNNTQEEWKYVFLITGAVMVITNIFFVIFVRGDPCEWTSDSFHRASSVADFEQHHIRNTGISTISHNVEDVPEKL

SEQ ID NO: 5596 - protein, 1520 aa, Caenorhabditis elegans
MSDSDSEFSIEDSPKKKTAPKKEKASPKKKKDDANESMVMTEEDRNVFTSIDKKGGGSKQMAIEDIYQKKSQLEHILLRPDTYIGSVEHTEKTPMWVYNMEESKLEQRDISYVPGLYKIYDEILVNAADNKQRDPKMNTIKITINKEKNEISVYNNGKGIPVTQHKVEKVYVPELIFGTLLTSSNYNDDEKKVTGGRNGYGAKLCNIFSTKFTLETSSRDYKSAFKQTWIKNMTRDEEPKIVKSTDEDFTKITFSPDLAKFKMKELDDDICHLMARRAYDVAGSSKGVAVFLNGKRIPIKGFEDYVQMYTSQFNNEGEPLKIAYEQVGDRWQVALALSEKGFQQVSFVNSIATTKGGRHVDYVADQMVAKFIDSIKRKLTKTSMNIKPFQIKNHMWVFVNCLIENPTFDSQTKETMTLQQKQFGSTCVLSEKFSKAASSVGITDAVMSWVRFKQMDDLNKKCSKTKTSKLKGIPKLEDANDAGTKNSQQCTLILTEGDSAKTLAVSGLSVVGRDKYGVFPLRGKLLNVREGNMKQIADNAEVNAMIKILGLQYKKKYETEDDFKTLRYGKLMVMADQDQDGSHIKGLVINFIHHFWPSLIQRNFVEEFITPIVKATKGKEEVSFYSLPEYSEWRMNTDNWKSYKIKYYKGLGTSTSKEAKEYFLDMVRHRIRFKYNGADDDNAVDMAFSKKKIEERKDWLSKWMREKKDRKQQGLAEEYLYNKDTRFVTFKDFVNRELVLFSNLDNERSIPCLVDGFKPGQRKVLFACFKRADKREVKVAQLAGAVAEISAYHHGEQSLMGTIVNLAQDYVGSNNINLLLPIGQFGTRLQGGKDSASARYIFTQLSPVTRTLFPAHDDNVLRFLYEENQRIEPEWYCPIIPMVLVNGAQGIGTGWSTNIPNYNPRELVKNIKRLIAGEPQKALAPWYKNFRGKIIQIDPSRFACYGEVAVLDDNTIEITELPIKQWTQDYKEKVLEGLMESSDKKSPVIVDYKEYHTDTTVKFVVKLSPGKLRELERGQDLHQVFKLQAVINTTCMVLFDAAGCLRTYTSPEAITQEFYDSRQEKYVQRKEYLLGVLQAQSKRLTNQARFILAKINNEIVLENKKKAAIVDVLIKMKFDADPVKKWKEEQKLKELRESGEIELDEDDLAAVAVEEDEAISSAAKAVETKLSDYDYLVGMALIKLSEEEKNKLIKESEEKMAEVRVIEKKTWQDLWHEDLDNFVSELDKQEAREKADQDASIKNAAKKLAADAKTGRGPKKNVCTEVLPSKDGQRIEPMLDAATKAKYEKMSQPKKERVKKEPKEPKEPKKVKKEGQDIKKFMSPAAPKTAKKEKSDGFNSDMSEESDVEFDEGIDFDSDDDGVEREDVVSKPKPRTGKGAAKAEVIDLSDDDEVPAKKPAPAKKAAPKKKKSEFSDLSGGDSDEEAEKKPSTSKKPSPKKAAPKTAEPKSKAVTDFFGASKKNGKKAAGSDDEDDESFVVAPREKSGRARKAPPTYDVDSGSDSDQPKKKRGRVVDSDSD

SEQ ID NO: 5597 - protein, 1520 aa, Caenorhabditis elegans; identical to SEQ ID NO: 5596

SEQ ID NO: 5598 - protein, 209 aa, Caenorhabditis elegans
MSGTRKKALLKVIILGDSGVGKTSLMNQYVNRRFSNQYKATIGADFLTRDVNIDDRTVTLQIWDTAGQERFQSLGVAFYRGADCCVLAFDVTNAASFKSLDSWRDEFLIQASPRDPDHFPFVLLGNKVDLESQRAVSSKRAQSWCQTKGNIPYYEVSAKEALNVEAAFLAIARDALARESQETNDFPEFPDQIRLNPNQQNQQNSGCNC

SEQ ID NO: 5599 - protein, 115 aa, Caenorhabditis elegans
MPISELEKKWTGLTFEIAAEEMRRLKSEPTDRERLKLYALYKQALHGDIPNEDVYPVPAGDEVGRKKYAAWKSQKGANSEKCRADYVAIAEEMIKKYGRNIVRCKWNSEVWSVDY

SEQ ID NO: 5600 - protein, 260 aa, Caenorhabditis elegans
MVYVKSLLRRADNFMYIVKKSSEARAALLVDLVNEEDYKELADKENIDITAVLTTHHHYDHCGGNEGFRRQFPNVMILGGDSRIPAMDRHVKHGDMAEFAGLQIKCLSTPCHTSGHICYHITNPAADSTSPGVVFTGDTLFIAGCGRFFEGTAPQMDVALNEILKNLPVETQIFPGHEYTVANLKFACHVEPGNEKAAQKLEWAQRQIEQGGFTVPSTVAEEKATNPFMRVRESEEIQKSIGTCDAVVGMAKLREMKNKF

SEQ ID NO: 5601 - protein, 881 aa, Caenorhabditis elegans
MADRANNDDDVDRQPLPIADDADDDVDGIDEMFNNEDEDPEDEEGENLFGDDMERDYREQPELDQYSESGMDDASDVGSLSVSARRAAEREMAQRDQLLDDDALMYEDGDSEEVDTRRRGRGRRGRGDAADDDSVPMEEEDIPVDILENIRGRTIRDHVSDEAVAKEIERRFKNFLRSFHEPGNKQTKYIQMIKSMAADNRESLEVSFTDLSDDNGEQNISYFLPEAPNEMLAIMDRAATEVVMNMYPFYSRVCNEIKVRISQLPVEEDIRMLRQVHLNMLIRTAGVVTIASGILPQLAVVKYDCVACGYLLGPFVQQNDEEVRPTICPSCQGKGPFELNVENTVYHNYQRITMQESPNKVAAGRLPRSKDVILLGDLCDSCKPGDEIEVTGVYTNNFDGSLNYKQGFPVFNTLIHANHITNKDKMASDQLTDEDIKAIRELSQDPNISQRVFSSIAPSIYGHDDVKRAIALALFRGEAKNPGAKHRLRGDINVLLCGDPGTAKSQFLRYAAHIAPRSVLTTGQGASAVGLTAYVQRHPVTREWTLEAGAMVLADKGVCLIDEFDKMSDQDRTSIHEAMEQQSISISKAGIVTSLHARCTVIAASNPIGGRYNPTRTFAENVDLTEPILSRFDVLCVIRDSVDSVEDERLAKFVVGNHRTHHPDAKKIVKEGDELEEDQMDERTGVRLIPQDLLRKYIIYAREKCHPTLPEQHSEKFSNIFAQMRKESMATGSVAITVRHVESMIRLSEAHAKLHLRSYVNDEDCAAAIRVMLESFVNTQKASIMRMMKKTFSRHLTENRSANELLLFILKQLIRQQMHYATARAAAGTILQSVTIPESEFIEKAQQLRIENVKPFYTSEIFASNNFLYDPSKKTIVQEIF

SEQ ID NO: 5602 - protein, 247 aa, Caenorhabditis elegans
MTRKFFVGGNWKMNGDYASVDGIVTFLNASADNSSVDVVVAPPAPYLAYAKSKLKAGVLVAAQNCYKVPKGAFTGEISPAMIKDLGLEWVILGHSERRHVFGESDALIAEKTVHALEAGIKVVFCIGEKLEEREAGHTKDVNFRQLQAIVDKGVSWENIVIAYEPVWAIGTGKTASGEQAQEVHEWIRAFLKEKVSPAVADATRIIYGGSVTADNAAELGKKPDIDGFLVGGASLKPDFVKIINARS

SEQ ID NO: 5603 - protein, 231 aa, Caenorhabditis elegans
MGGRSNSATTAAQQNAVLRIVVVGGGGVGKSALTIQFIQRYFVQDYDPTIEDSYTKQCFVDEDLCKLEILDTAGQEEFSTMREQYLRTGSGFLIVFAVTDRNSFEEVKKLHELICRIKDRDDFPIILVGNKADLENERHVARHEAEELAHRLSIPYLECSAKIRKNVDEAFFDIVRLVSPIRHSTLEDTSKTFKKSPSCTVPTKYLFHILPPYPLCPLSRVQISLKFRPKI

SEQ ID NO: 5604 - protein, 412 aa, Caenorhabditis elegans
MTPTKPKVYIVGVGMTKFCKPGSVPGWDYPDMVKEAVTTALDDCKMKYSDIQQATVGYLFGGTCCGQRALYEVGLTGIPIFNVNNACASGSSGLFLGKQIIESGNSDVVLCAGFERMAPGSLENLAAPIDDRALSVDKHISVMSETYGLEPAPMTAQMFGNAAKEHMEKYGSKREHYAKIAYKNHLHSVHNPKSQFTKEFSLDQVINARKIYDFMGLLECSPTSDGAAAAVLVSEKFLEKNPRLKAQAVEIVGLKLGTDEPSVFAENSNIKMIGFDMIQKLAKQLWAETKLTPNDVQVIELHDCFAPNELITYEAIGLCPVGQGHHIVDRNDNTYGGKWVINPSGGLISKGHPIGATGVAQAVELSNQLRGKCGKRQVPNCKVAMQHNIGIGGAGVVGLYRLGFPGAAQSKI

SEQ ID NO: 5605 - protein, 334 aa, Caenorhabditis elegans
MSEKTQYERAILQLNNDPVVHKEVWACIVSYGKRKLWFQVALGRRIGFYRLGKELGAGNFSKVKLGVHQLTKEKVAVKIMDKAKMDAKAQKLLSREIQAMEEMNHPNIVKLFEVVETLTRVHLVIEYASGGELYTYVHERGKLTEGDAKPLFAQIVSAVSHMHSRNIVHRDIKAENVMFSSPNTVKLVDFGFSCLVDREQMLRTFCGSPPYAAPELFQDTSYAGELVDVWALGVLLFFMLIGVTPFKAETVPDMKVLITAGKYQIPDYVSLLATELIKSMLKTDTGQRADIDSVKKHFWMRDCRFTKSYLSIKATAKIDNEEEKKAIDDKVIFV

SEQ ID NO: 5606 - protein, 394 aa, Caenorhabditis elegans
MKLSLVFLLFVAFAKSADTAPVDFNKIFVTFVEELMDAINQLILEQMGAIRPSTTPLQSIPPITATDAPTTADTTAEPTKAHETTVAQEATSEGAETHETTVGQDTTVRSGESQETTVSQGTTVSQENTVSQETTVSQDTTVSQETTVSQDTTVSQDTTVSQESTVSQETTVSQDTTVSQETSVSHETNVSPDTTVSQESTVSQDTTVSQETTLSQETTVSQETTVSQDTTVSQETTASQDTTVSQDTTVSQDTTVVPQETTVEATKASEATEENGTTAVTPGESDPCDTTEAPTGGSTVGESEPCDTTEASEPTGHTDQAETVTDPASQATASATIIGGVDQTGSTNLEATTEQICKHPTKDSEEEKTDENKDEKTTRAGTNVHRPEREDILK

SEQ ID NO: 5607 - protein, 405 aa, Caenorhabditis elegans
MDFESSSAGPSTSYAEEPCTLSMLPQVSAVLSETSITESNVSCQLHPSRSAALNDNVRTLIYNRTDPHIQLDMRAFYNCMEYEEALQPNYHYFTGVQENITPFHREQAIDWIYDVAKEENCDGDVFLLAVSLIDRFMSVQNILKHDIQMIAGVALFIASKLKAPHPMTASKIAYYSDNSCPIDMILQWELLIVTTLQWETESPTAFSFFDFLASRIPQIHNMRGDFQTVVQKCQKMHKLATLFPSMQCAIGLYYVSNLPTQNKELAVKIKDLLANMFQLEVNLLDSYIPMVQRCMSTTPIYTSEDAEKTEPTPSAPASTQEPEAFQELKELKEEPLPTPPPEEPAFQKLVLLEPIPLSEQTPSTPLNDSGFSSDVSSPASSEKKRRRSTDWFEEDSTPPKIFKTL

SEQ ID NO: 5608 - protein, 378 aa, Caenorhabditis elegans
MFQNSPMMYDWWNDTTKPKHQQPTLNVLSPWGAYFNHIGNELLKENSNDKSVGDKNGNTTTNKTTVEPPPPEEPPVRVRASHREKLSDSEVLNQLREIVNPSNPLGKYEMKKQIGVGASGTVFVANVAGSTDVVAVKRMAFKTQPKKEMLLTEIKVMKQYRHPNLVNYIESYLVDADDLWVVMDYLEGGNLTDVVVKTELDEGQIAAVLQECLKALHFLHRHSIVHRDIKSDNVLLGMNGEVKLTDMGFCAQIQPGSKRDTVVGTPYWMSPEILNKKQYNYKVDIWSLGIMALEMIDGEPPYLRETPLKAIYLIAQNGKPEIKQRDRLSSEFNNFLDKCLVVDPDQRADTTELLAHPFLKKAKPLSSLIPYIRAVREK

SEQ ID NO: 5609 - protein, 341 aa, Caenorhabditis elegans
MSTDGNNNKKGSKEGPKTSEISKFDLAKENPRLAEWMDDCIKRMNSLYKDTNINICNVMTGHEIIAIIRMVEAIFMDESNLCEAEAPIKVIGDIHAQFQDMNRLFDLIGRVPEEKLMFLGDYVDRGPQGIEVLILLFCLKIRYRDRIYLLRGNHETPSVNKIYGFYVECQYKYGVGLWWDFQTCFNRMPMSGLISKRVLCMHGGLSPELINLDTIRNIPRPCEPLDRGISYMFGKGVVEQACKSLEIDLIIRGHQVVQDGYEMMAGRRLITVFSVPNYCAQFTNAAAVVCLNANLQVSFQQLIPPPLPDGTKAKAAPAIAIDTNIEAARADKEAIKPYVKE

SEQ ID NO: 5610 - protein, 569 aa, Caenorhabditis elegans
MNRLSQFKRSYSLLPQGAQAYIGGKWTASETGNSFDVLNPFNNEVVDRATNCTVKDAEKAVHSALEGFDKWAHTYSAKQRGAILHKWFEILVQRETELATLLTKEQGKPLAEARGEIQYSAAYFDWYAGEARRVYGQVVPSAVVNRLHLHTREPIGVVALIAPWNFPTAMIARKAAAALSVGCSAVVKPSGDTPLSALALAQTAEEAGIPAGVFNVITADHSNTAEISKYLCESTDVSAISFTGSTPVGKLLLAQSASTVKRVCLELGGNAPLIVFDDADLDVAVNGTMATKFRCSGQTCVSANRIYVHEKIHDQYISKLAAAMKEKLVLGDGLNPKTTQGPLVNQKAVDKCELLLSDALGKGSELICGGKRGEHGTSYEPTLITNVQSNTNIAHTEIFGPIASVQKFRDEQEVLEAANNCRVGLAGYVFGRDQSRLQRVARKLEVGMVGVNEGLISCAEAAFGGVKESGIGREGGAQGIDEFTNWNCRVAAIPCIYHLPIFFFFHCNFFLTRDEEKWFLGHGRRADKFQRPFILLCCFPPVFFCFSQLFPMLKRFPSKKIMYSVGKQR

SEQ ID NO: 5611 - protein, 1589 aa, Caenorhabditis elegans
MAGPGSGNIVHTLLLVAGIVLTAGVLGVVIAILVNENNTNTNTNTIYNGTNTYNSTIQYNSTYVYNSTIIEIDIASKVLNVAQPAKVSPGTDKYNSYQQVVQLFKASVNLSVDPCNDFYAYTCGNFKGDMSFDISDNSNTNDMVTRLTNDTYISTAPLPVQQTRWYFDTCVNARQNWNTIADGSVVTAAINQLAAGNPGKHENSTKFPFPMLDQKTDVTTFPDRFGLGYLTGSLTAQGVDTIISAGVDTNWKDPAGPEGFAYLIDQPTTFAPNTYYLKDFDALNASLTYQITENMLQLAKVQNKTLDANILAKDVQDIIKLDYLLATKFSTDDTTRRQYDRSYNPNTLPQLLTQYHKDVFSWHMFLPIAVGTAEHVLDKLLDQGSGYNYYITMEPTKLNMLLTSLNKDNTLGITPRALVNYFYYRLVDSLSEFLPAPPAGNMIRPFVKIERQPVGRPRHVLPEDRKYERKLIEDLTEAQYSCAQETIDIQYANARLFIDQIYPTATDRKNVREHVAKVASSIVIGFRSMIDQLNWMTPSTKKGAYNKIENLVKNIAYPDWITDDAQLTAYHAPMNFTKTDTYVDMFFNVQNFNLYSQWDQLVQGPADRTGFNGPPGITNAWYQPELNSITFPAGILKKPFYDFNWPASVNFGAMGVIAGHELTHGFDDQGVQWNGVGTLSGWMDATSKVSFTNMAQCVVNEYSGFCPLDKATYGSAACIDGAQTQGENIADNGGIHSAFRAYKNYVDLYGPDPVLPDPQLQYFNPDQLFFLSFAQVWCQMPYTDAQFLRQILVDVHSPSIYRVLGTIQNFPAFKTAFNCPSSTYAPDNHCNVWVSDIDTTFGLPNVKTDINVVPEAPITSTNVDKMNAYQMAVDYYAKSVNTAIDPCDDFYSYACGNFNQSVSFYTARAQNLVYMAQKLEDPTYQTTINSSPALKKEKQLYNACLTATASSQSEDQILISKNYIQTKVDDLKTLIGQDFTLVNGGAPKLPSAKQIGDALGYLSFEQGIDTLISPLVDTYWIDNSKGYQMFIDQNTAYLSKTYYQPAAWKIEKPKYLKMALDVVTRYAREQNITLPAGASDLLSNVLDYEQNIAVKYSTDDNTRRQFQRSWNLTKTSDLVTKYNFMDWMTYLSHAPNAVKAKITDANYQVSVMEVDRLTHFSADYLQQSPELLVNLLFVRLLLGNAQYIPSYASAFRGMTDESIFLGLSRRKTIPNHIPPPNFDLEANGPACASVANNLMQFANGRVFVDYMYPTAQDVTNIRKSAGGIIKNVISSFQGMIDQLDWMAPDTKQKAYAKTVQIQQNIAFPDWIKNDTLLGNYYSTLVIADSDNFYDIYDKLIKFNIFVQYNQLNAAQTDRTDFLGQPGTVNAWYQPELNSITFPAGILVPPYFNPNWPPSINYGGMGLVAGHELTHGFDDQGVQWGPTGNLARWMDDNSMAGFKNMSQCVINEYSGFCPLNATNYSPNCVKGPQTQGENIADNGGVHAAFNAYKTHQSLDGPDPRLPDRLFGQFTHDQLFFMSFAQVWCEVRRTDDALYTQIMVDPHSPSMYRVYGTIQNFPAFQTAFNCPLGSKSAPEQHCEVWVPGKYQ

SEQ ID NO: 5612 - protein, 360 aa, Caenorhabditis elegans
MCDISTEDQLLEFARKAAESGDQTQTFEFKKHIGFLIRHLNVFPQPYNTLETSRNTIFLFAISSLDLLGELDNLLTPERRQAYIDWIYGLQFTNGNVCGFRGSHSCENSGYDEANLAQTYSALLSLAILGDDLKKVDRKAILKTVKTAQRDNGCFWSQGVGSESDMRFVFCAVAISHILDGDKEQTIDWTKLAGFLRQSLNIDGGIGQAPGDESHGGSTFCAIASLALSNRLWTEEVLTRRDIDRLIRWAIQKQDIGFHGRAHKPDDSCYAFWIGATLKILNAYHLVSKQHLREFLMICQHPHIGGFCKYPEPGGYSDILHTYFSIAALSLLGEPAVNPVHPSLNVSMRVAERIARLQFD

SEQ ID NO: 5613 - protein, 207 aa, Caenorhabditis elegans
MAEYKFYYFNGRGLGDVSRQLFALSGTKYEDIRIEHADWPAQKPKMPFGQMPVLELSSGLQIPQSMAIARYLAKKFGYAGKTDEEAALADALIDQFKDFYAEIKPYYYAKIGVLQNDTEEEKKKTLIPARDKFLTIIGKFLKLSISGFLFSGGLTYADLMICDNMRTLIAWWPEYLNEYPDIKAWYQKVDGIPEIRKHLESSPDKGF

SEQ ID NO: 5614 - protein, 207 aa, Caenorhabditis elegans; identical to SEQ ID NO: 5613

SEQ ID NO: 5615 - protein, 209 aa, Caenorhabditis elegans
MPQYKLYYFNLRGWAEPARQLFKLAHVEFEDVRIENGTPEWGALKPKTPFGQLPFLSVDGFEIPQSAAILRYLAKKFGYAGKTSEEEAWVDAIVDQFKDFVTPLRQLIMAQRSGNAEEIERIQKEVFAPARDTFFKILNGILEKSKSGFLVGDGVTWADLVIADILTTMEMLGVFDKHGEEQKLAALREKVNEIPEIKEHNSSRPDSVV

SEQ ID NO: 5616 - protein, 209 aa, Caenorhabditis elegans
MPSYKLTYFAVRGLAEPARLLFHLAGVPFEDERLTFGDGSWEKLKDKTPMGQMPVLNVDGFEIPQSAAITRYLARKFGFAGKTPEEEAWVDAVVDQFKDFFGEFRKLIIAQRAGKSVEEIEKLTKEVINPAVSSFFKILNGLLEKSKSGYLIGDSITFADLFIAEDMQSLKNFGFLNATEQPKIAAHLEKVYSHPKLKSYIASRPVTEI

SEQ ID NO: 5617 - protein, 1441 aa, Caenorhabditis elegans
MKNVRTGECDKLAWRGAEVREHFRMLFKNDGKLLLKLFPMLVDELNGEDMICPLDGLFLERILVPPKKFRPIRMFKGAQYEDPQTLNLRKVLEATETISAISLIMKGDTSAQLKELIANRVRGKTINAQMHDAYLQLQLRANAIFDQDLNKGDRDSIAGIKQILEKKQGLFRMHMMGKRVNFACRSVITPDPYLDIDEIGIPDIFAKKLTFTEPVNAFNVNEMKGLLRQGPHQHPGANFFVEPSGKKTMLGDKPEEKKRRMQMAKTLNAATTENLRQTPKVLRHMKNGDMIMMNRQPSLHKPSILGHRARVLTGQRALRMNYAPCKAYNADFDGDEMNGHLVQSHIAQTEVREIANVGSNFLVPKDATPLLGLIQDHVVSGVLLSVRDRFLNKEDFMHLVLASFAQYSKRIEIPPPTILYPKRLWTGKQVITTIVKNCIPDGKPLINLDGKAKTPLSCWIVPGFDAPQFDMSESHVVFRQGELLVGVLDKAHFGATQFGLAHCAFELYGHRCGVQLLSCFSRLFTTYLQFHGFTLGVADILVVKDADGKRKEAVMESRTIGNQVVKTAFGLPDTATPAEIKRTLAATYCNPRGQGTDVKMLDFGMKQGIAKYNDAITKSCVPTGLLRLFPQNALQLMIQSGAKGSAVNAIQISGCLGQIELEGKRMAVTIAGRTLPSFRCFDPSPRAGGYIDQRFLTGMNPQELFFHTMAGREGLIDTAVKTSRSGYLQRCIIKHLEGIRVHYDSTVRDHDGSVIQFRYGEDGMDTTKATFLNKKTMPFLEDNLEAVTLASKPEGVTDADFGIKETEKRYKKIVKWKKKAEKSGKSGTKKSYFSAFTNFSAEHIGMEKKRILAMWFELSLEEREQYARGIPKKCPEAVDERFNPTCKLGALPEKMLDEIEGFCTRRVKKVDDEEPPKEVLKRTLYWKGMRSLADPGENVGLLAAQSIGEPSTQMTLNTFHFAGRGEMNVTLGIPRLREILMTASKSIATPSASIAVIAGTSRDRIDSIKRELDRVYLKQLLKNFSLEEKITLTQNQSCRRYHLRIDILAAEKRELGARHLKRSQIMEEIEKRFILRVAQAIKKKYHEITDYQQMSHRTMRQGNMAAGIETGGTKNRGLQGPDNGDSSDEEADGGREADAAEARLHRRHRDEGADYEGEDEERVEVREEEEPMDSDSEDVKKEGLDGEDQTTEPLLVNSSRIQSVQRLSENISSYTYDVKSNKWCEVVFELPLRNKTKMDVSSIVEKEVELFIVHQTPGIERCVETTEQKNGKEMTILQTQGVNLAAFFKHADVLDVNSVYSNDLNLILENYGVEACSKAITTEMNNVFAVYGIEVSKRHLSLTADYMTFTGQIQPFNRGAMSSSSSPLQKMTFETTMAFLREALLHGEEDNVNSPSARLVMGALPRGGTGSFDLLLDTKMQSEREEHEAARARKRNAKQKF

SEQ ID NO: 5618 - protein, 1441 aa, Caenorhabditis elegans; identical to SEQ ID NO: 5617

SEQ ID NO: 5619 - protein, 645 aa, Caenorhabditis elegans
MTYRAMIYNCLERPTGWKCFLYHFSVFLIVLICLILSVLSTVEEHSHFAAELLYILEIVLVVFFSVEFIVRLWSAGCRSKYIGVYGRLKFVRKPITLIGRFGGRHLQLIRDMLRHGGPSFCGKRDAGDTVSADSEDAPRRSAGWHMVEIRISKIPKIEIFKSLKIGIFKNFANWNFQQFRKLEFSKILKKNLAGRVHYWGSATPSSGPDPLDVGCFPKLHQLASFRRLLGSVVFIHRQELITTLYIGFLGLIFSSYFVYLAEKDHIGVDGRQAFTSYADALWWGVITMTTIGYGDVVPQTWLGRIVASCFSIFAISFFALPAGILGSGFALKVQQKQRQKHFNRQIPAAATLIQCLWRCHAAEKKVSATWNAHIDPLAHETKETHHWNGKKHASSMDSNNLTRKRQLFKKQSSLVNTFRRKGSPSTDVEMGELQQERLLRHERNSDTDDEKRIYRVGADIEIDYETEEPTTPTRPQGHISHVCELTDAHRNAIRAIRRVKYFVARRRFQQARKPYDVRDVIEQYSQGHLNMMVRIKELQRRLDQTLGKPGQYDGKGSRKGHPVTIGSRLSRLELQMSSLDRKVESSNRTLNALYRLMADRNSLTISPSPPALISRPVSPAACLSPRDQLSPTSISSQRSGSPGWQ

SEQ ID NO: 5620 - protein, 343 aa, Caenorhabditis elegans
MSTYQAATIVAAPNEFRVPFPPFVQISKVQFQREAGSRLLAASGWDGTCRVYEVGKLGDISEKLVFTHGKPLLTCTFAGYNKVAFGGVDHNVKLADIETGNGTQLGSHALAVRCMEFNPMSSLIVSGGWDSSVKLWDARSYGNGAIESVNVSSSVYAMDVLKHTILVGTKDRKIFMYDSRKLREPLQVRDSPLKYQTRAVQFFPTGEAFVVSSIEGRVAVEYVDQSGEEMMKRKYAFKCHREKDTDGTELIHPVHTVAFHPKYGTFATGGADGIVNIWDPFNRKRIIQLHKFETSISSLSFNEDGSQLAIATSYQYEKEIDPSPLPNNSITIRHITDPESRPK

SEQ ID NO: 5621 - protein, 883 aa, Caenorhabditis elegans
MAFQPDQHELEQVIQLLQHAHSTDRDVQRNVQVQLVQLNEHQKFCCYLVYILSDMKEMIDATSRSLAGLLLKNNIRAKWNKYPQDVKFFVRTTCLKSIGDQEPLIRATVGIIVTTIVMEENMCDWPDLLDTLATVLMQPDELMQEGALGALQKVFEDSADRYESEFLRPIMPKLLVFYEHHAAKMRALAMNCVNCILMVNNDPIDFAIDQFLTSLFARHNDNDEEVQKQLCRSLTLLLDTHIEKMMPHLPNVIEYIIKKTQDHNESIALEACEFWLSIAENSDICRTMVLPHLDKLIPVLLGSMRYSETDPALKANDEDSSVPDREEDIKPRFHKSKQHGLGGLVESDDEEDEDDDDDGGGDWNIRRCSAASLDVLASIFGKDLLDKLFPLLKDTLMNDNWLVKESGILALGAIAEGCMDGVVPHLGELIPFMLAMMFDKKPLVRSITCWTLSRYSSHIASDENFRQQFFKDVLANLLRCSLDGNKKVQEAACSAFATLEEEAGEQLIPFLGEILDQLVKAFQCYQAKNLLILYDAIGTLANSVGDALSHPVYVQMLMPPLMEKWERLSDEDKELFPLLECISAIVSAMGQSFLPYIQPVFTRCCSLIEKCVQQNQQHIMAPDQVEAPETDFIIVALDLLSGLAESLPEHMDPLVANSKLVELMLFCSLDVTPDVRQSCFALLGDLTKACPERVLPQSSNFIFFLAQNLDPSKISVCNNAIWALGELALKMGPAMKQFIGPIIEPLIVVINSQQNMQRTLLENTAITIGRLGQCCGEELAPHISRFVRPCCYSLRNIKDNAEKESAFIGLCNMINMNPVGVLNDFIFWCDAIASWTVPTDSLRVLFAGILQSFKQQVGDFNWNNFILQLPPPLRERLSAFYQI

SEQ ID NO: 5622 - protein, 1806 aa, Caenorhabditis elegans
MFLYGPPKGYGFYSKNITACLPTRNAIMLPESVFLLLISHFLRAVTQPPFETEGVKQKLFHFSGHIDDFIVSRDQQTIYVASLNRLTSLSISNFSIQHEVSLGPVQDSPWCSADGKSCLKLVNQHHVFIQIIIFRDNRPFPTDVRTKILQILPTNQILQCGSVKLGSCSTFNSKLSLITESTIAVAANSPDASTVSKIIDNRLIVAASATKESPYRDPFPAVAIRNLPGLNVENAGDLEGEAAVFLRAAYKNAFKFLYTFTHQHFVFVVAMVTPRESRLPMTTRLIRFCRNDTKFESYSEIELQCRGEDNTNYPFLNAIIQSYDKLIASFSTSSTSPKSSICVFSMQKVKLTFWYNVDRCRSGTDSIRLPHIGRDTKCKAHIPLDEDSCELGVGGSIELVEMSTKDIMGKVTSLMAVDQKAIFAGTTTSQIVMFKWDEHHSNQLEEYGRKEVGDGRTGSEVSKMVKFGDFVIVQMPYGIILEELSTCSHHSSCTECLVSVDPLCQWCHPTQSCTTSARCTSPVTSQCPIVDGDPIPSIVSVNSSTPISFNIHHLPPPVGFTYRCQFGTSTSSIKANWTTTGVSCPSEIFTSPNTFEILLLTSISNNPISRHNFTVYDCSGYGTCSSCMSSEYNCAWCSGLHKCSNSCGALEKSKACVKIQPMRLPIAIGSQQEIVLEASNLDTLDRRHEHFCKVNEQVSLAKIASDSIRCGKIQLTLSNTTSANMVVPLSLITRDSVIDIANVSLYSCTNLASDCSSCLALSPSLSCGWCNRQCSHECHESKATAVCDPPRIDKFEPTSGPIEGGTIIKIYGNDLGMSVEDVRGKIYVAGSRCNIVEYHVSNMIACQVDKGVSSGPIRISVGRATVAVAESSELYSFVRTSIFSAYPLYGPISGGTRITLYGQNLSSGSQTSVTVGGMPCPIERVNSSTVLTCLTPSGTRIGKSARVVVHVDHSQTQLDQPFEYRSDPSISSIFPMTSFKAGGRIVYVQGNSLNTVQTAKLFLISSPTPPFYIISDLAPCHIINSTLMTCMTPKILETITRRVEYTRQPMGIYPNPTLSPFKGVRYHQGEQSLILEGHNLNLAAEPNDFKIFIGNERCYVTLVDVRQLVCSGPVRQPKATDERGIPINGDNPLVTVIVGSLRMELGLIEYSDHALPSRLSLLILGLLLFIVVTLTVMCLVFKRRRQEREKEYRKIQLQMENLENNVRKECKQAFAELQTNLVLSPKSANSVNLGPELINFPHFVENLLWSDNNLTSAPSLARTLPVTLAQFHALLSFKGFIFTIVEAAESDVSISTSEKSMLASLLISVLLRNFSYCTEVVVDLLRAHIARSVQNKRAELLFRNSDSVVEKMFSKWMSICLYSHLTPQMNSYFYLYKALQYQTDKGPVDAVTGDARYTINEAKLLRESVDTKTLKIRVIPFEKCDESIDLEVHACDAICQVKQKVASAVYRETPYSQRPRITQFELKYKCPKRGDVKLTDVLPIETLSQKKLPVKLFTLADYGISDGCTLEMSPAVYTAESYRNSLADSGQSSWSSLDRCSPIYSSSKYYHLTNPSSGTMTFKKKSSNDSNLLPKSIPEVYLTRLLTSKGTVETYVEDFLESVLYMHDSSYPPILKFFFDILDREASVNGVSENICQQWKANGYVLRVWANFVRNPQLVFDVPHSISMDANLSTVAQTMMDCFSFSEPVLGAHSPSSRLLFAKDVARLRPLSVDLFKRVKNSPPLGMDELRTELVNMANDVSTCKGSSLALSELLSWVRGNGIRISQLLSSNEQFSQQRLPQKLSQVLHVCLETDNHIYSTISDYE

SEQ ID NO: 5623 - protein, 394 aa, Caenorhabditis elegans
MECNDSRLFDTNNNLTYFVIEQFYRFRYLYSNVHPFLSFILCVLGLAANAIHITVLTRPRMRHSSVHTVLVCIAISDMGTMTSYLMYISRFEFLSDKEGYSYFWALFLKCHAMLSIALHAITLYLVVLMAFIRLSAMKLTTSRWLDHTRALTSAIFIALFVFIMCVPTLLAHQIDETTRGVTMNGMYYKYSVGFSTLMMQNGCSLMKGNLWLTGIFLKAIPCLLLLTFTIALINRLRENNEKRKILIKEERAKKRGDFTTYMLLLMVTVFLFTELPQGIMAILNALFTTQFHQMVYLNLADVLDLLSLINCYVAFLVYSFTSSRYRQTLFSLLPLTKISYSGISTRQGTLKSHQHPGAKTLVQRANSVEVASARSPLVDKAAITRPNSAQPTDF

SEQ ID NO: 5624 - protein, 394 aa, Caenorhabditis elegans; identical to SEQ ID NO: 5623

SEQ ID NO: 5625 - protein, 489 aa, Caenorhabditis elegans
MPIVNVKWQKEKYVVEVDTSAPPMVFKAQLFALTQVVPERQKVVIMGRTLGDDDWEGITIKENMTIMMMGSVGEIPKPPTVLEKKQANRDKQAEEISALYPCGLANLGNTCYFNSCVQMLKEVNELVLKPAEEMRIREHNDRLCHNLATLFNSLRDKDRALRSKGEPIKPFAAILTLSDSFPQFEKFKQQDANECLVSIMSNVTRIYGLSGWNIESLFRIQTETTMKCLESDEVSEKKVERNNQLTCYVNQDVRFLQTGIKAGFEEEMTRNSEELNRDAKWQKNTQISRLPKYLTVNINRFFYKESTKTNAKILKSVQFPMQLDTYDLCSQELKDKLVARRADIKLEEDAKLERELRKKVLDKEQGDKIFDDGVALPTAFEDDAGSNNSGFYDLKGIITHKGRSSQDGHYVAWMRSSEDGKWRLFDDEHVTVVDEEAILKTSGGGDWHSAYVLLYEARVIKQFPELPPAPVPTEVAADTAEPMEVSEKQ

SEQ ID NO: 5626 - protein, 489 aa, Caenorhabditis elegans; identical to SEQ ID NO: 5625

SEQ ID NO: 5627 - protein, 445 aa, Caenorhabditis elegans
MLKRPGEYEPPLGKIWTRAESRMWTITMFSGTCVLYASRASLPISAAAVAKEFAWNKTDSGTVLSCFFWGYALTQVFAGRIADKYGAEKILPYSSLAWTMLTFFTPHLFDFAYWTNYPLVVLLAVRILTGVCQAFHIPSLASIVSKHLAAADKGRVFGIVLAGSHWGTVLAGAIGSILIEWIGWRALFQFVGIISLIWCWVFRWVLDRAKGPGGRSSPLPDEEVLLDKKHDTIESHLAATSPCPSVPWGTLFRHPAFWAAAVAQYTGGNSYSILFNWLPSYFHETFPTAKGFVYNVVPSLAIVVTSLVAPVMASRALSEGKTVTYTRKLMEGASLLGIAFCLMLVPMTSSFWISLIIFTMAMAARGLHHGGVSVNPHDFAPNHAGSVFGVFNACGAITGFVGVYIAGHILEATNNNWSYVFVVTAAQCVVGAMVYTLLGTGQKII

SEQ ID NO: 5628 - protein, 315 aa, Caenorhabditis elegans
MPETKRVRQFHSRTYADEVLKGIDVAGKTYAITGTTSGIGVDTAEVLALAGAHVVLINRNLRASETQKRKILEKKPDAKVDIIYCDLSDLKTARKAGEEYLKKKWPIHGLILNAGVFQPAVAKTKDGLESHFGVNVLAHFTVMVRLSAPSRIVILSSTLSSRHGFKKSMGITEKLKILQEEKASASSLQLYGASKMADMLIAFKLHRDEYKNEISTYFVHPGDGVRTDIFRDSTLGKVLTVLSTPCIKNCSQGAATTVYCATHPEVEKISGKYWESCWDNDKIDKKTARDEELQEALWKKLEELDDGINGQVTAF

SEQ ID NO: 5629 - protein, 1008 aa, Caenorhabditis elegans
MSVEQFINDQLHSIVGISDRSICQYVHALAKKAKSAPDLVEKLRDAGDFPISPAIQSFADQLMSRMPRQATSARQRGPTTAELAEQELNRLNRAVGVLEDYSASSTKTKNVRKRKESSSEDDEAPIKASKPGKSVKPSKSDDSESDIEAMEAKLDADIAERDALAARINKKEKDKTRNVMEKKRDDNKDKEGSSMDKLREESRRQYLKKRKVDKLEELEAIVHDDQTLFAREKLTKREKADMEYRKKVLEYTKAHGKAGDVMKMKRYHLPDASTKQIPSQYVEDDEEDFRPGGDGAKWEEEQLMASMLHLGAKDAKRKEQEFELLLDEKVDFIQALQMPGTNEEVVETEAEKKKMSIEETRKSLPVYAFRDAFIEAVKEHQVLIIEGETGSGKTTQLPQYLYEAGFCEGGKRIGCTQPRRVAAMSVAARVADEVGCKLGTQVGYSIRFEDCTSEKTVLKYMTDGMLLREFLNEPDLASYSVMMIDEAHERTLHTDILFGLVKDIARFRKDLKLLISSATLDAEKFSSFFDDAPIFRIPGRRFPVDIYYTQAPEADYVDAAIVTIMQIHLTQPLPGDILVFLTGQEEIETVQEALMERSKALGSKIKELIPLPVYANLPSDLQAKIFEPTPKDARKVVLATNIAETSVTIDGINYVIDPGFSKQNSFDARSGVEHLHVVTISKAAANQRAGRAGRTGPGKCFRLYTAWAYKHELEEQPIPEIQRTNLGNVVLMLKSLGIHDLVHFDFLDPPPQETLVIALEQLYALGALNHRGELTKLGRRMAEFPCDPCMSKMIIASEKYECSEEIVTIAAMLSCNAAVFYRPKAQVIHADSARKGFWSPAGDHITLMNVYNKWQESSFSQRWCVENYVQHRTMKRARDVRDQLVGLLERVEIETKSSTDTIKIRKAITAGYFYNVSKLDNTGHYKTVKHKHTTHPHPNSCLFEETPRWVVYFELVFTSKEFMREMSEIESGWLLEVAPHYYKGRELEDATNKKMPKNKGKSGKDLER

SEQ ID NO: 5630 - protein, 1008 aa, Caenorhabditis elegans; identical to SEQ ID NO: 5629

SEQ ID NO: 5631 - protein, 279 aa, Caenorhabditis elegans
MPRFSGKVALVTGSSNGIGRATAILLAREGAKVTITGRNAQRLEETKQEILRSGVPEDHVLSIIADLATESGQIELMNSTVDIFGRLDILVNNAGAAITDLEGHIGVGTNVSVFDKTMRINLRSVVTLTQKAKEHLIKTKGEIVNVSSIAGGQHAQPELIYYAMSKSALDQYTRSAAIDLIQHGVRVNSVSPGDIRTGIYETMGMNKESVENIYKFMESRKECCPIGTIAQPVDVANIIVFLADRKLSSYIIGQSIVADGGSSLVMEVQAHDWMELLKH

SEQ ID NO: 5632 - protein, 1049 aa, Caenorhabditis elegans
MCQPPPPPLRPFSQKTKIINNQSVIASIRKSSFIMFGCFKKKKTNKSLEDLKKDVVIDDHEIPLDALFKRYTTSEKNGISEAEATNRLNRDGPNALTPPKQTSKWIKLAGSIFGGFNFLLWCAASASAVGYGMDLSMSDDEEVPKDNMYMAIILATVVTVTGLFDFYQNRKSGNLMDSFANMIPPKTLVVRDGATREIEVKDLVVGDLVRFRGGDRVPADLRVTLARGLKVDNSSLTGESEPQTRNMNCTSKNALETKNLCMFSTSVLEGSGEGIIIGTGDRTFVGRIAALTTQVDPGPTPLAKEINHFIKIISIVAFTVGIAFFILALVYEYPPLKAIVFFMGIVVANVPEGIVPTVTVSLTLTAVKMRKKFCLVKKLQAVETLGSTSTICSDKTGTLTQNRMTVTHLWFDGKIKDTEILPPNDHFKGEKKYEKEDSYQKLLRCATLCSRSHFRVPEFDVPLAKRVVNGDASEVAIMRYCEMIRGDGQVDEFRKIMPKIGEIPFNSTNKYQLSIHPMSKKQNILVMKGAPEKILKLCSTYYQNGETKNVSKKFEKEFQQAYETLGSYGERVLGFCDLEMSTTKFPPGFKFNMEEPNFPIKNLRFLGLISMIDPPRPGVPEAVRVCQNAGIRVVMVTGDHPITARAIANQVHIIEENVQVTEIVNADPKCDPASDEIYGKGRLKPTGAVVIHGEQLTTMSPKTLKAVVTNYHQIVFARTSPAQKLQIVEAFQSVGNIVGVTGDGVNDAPALRKADIGIAMGITGTDVSKQAADMILLNDNFASIVTGVEEGRLIFDNLKKSIAYTLTSNIPEITPFMSYVLFGLPLPMSIIAILMIDLGTDLWPAISFAYEVPESDIMQRAPRNPLYDKLVNKRLVMFSYMQIGAIQACAGFTTYFVLMMSNGWFPQDLLNISEQWDNKYIDDLEDSYGQQWSYESRKALESCCYGTFFFTIVVTQWSDLFASKTRKNSLVMQGMENHVLNTSVIFTCFLAIFVLNTPFVNEVLGVQGFRLEIGFLALPFAFFIGLYDEVRRYFIRTYPGGYIYKETYY

SEQ ID NO: 5633 - protein, 1049 aa, Caenorhabditis elegans; identical to SEQ ID NO: 5632

SEQ ID NO: 5634 - protein, 184 aa, Caenorhabditis elegans
MGLIDVLKSFKSPSGREIRILLLGLDNAGKTTILKQLSSEDVQHVTPTKGFNVKTVAAMGDIRLNVWDIGGQRSIRPYWSNYYENIDTLIFVIDSNDKKRFDEMNIELGELLDEEKLRKVPVLIFANKQDLVTAASSEEITRKLNLDLLRDRTWHIQACSALKNEGINDGITWVASNLKPASKK

SEQ ID NO: 5635 - protein, 905 aa, Caenorhabditis elegans
MAFSLFSVVSLTVIYRLTINFPELPYTQELKNVESDEFVSTSRDIAHSIQELVKDLEGRHTAKVADYKYHKIIGSLVYVDLYAEKESPLVSDVLLSAIKSGKIGNLTVSDEGFELHVVRGVLFRLKNLTLPKIADSSIACATTEFTCLDKSCIPADQRCDGRRNCPDGSDEHKEHGKCKQHQPIIHQTEKVVFAQKHGSIHLSASIDSSVEDNKIAWSKDSVLLGVGSMTLAEDGRVTVYKKGDKHHLHIINATDADDGTYKMIVQGINVEADFEVRITSDRVATESDECPSGERACKSGHCLPVAQFCDRRVQCPDGDDEEHCSEVQCKSNEFRCESTNVCVPTVVVCDGWKDCHDGSDEKKCSHPRKTYKPHHVHHVKVNAVCQDGSEPEFSLHGSSYCWSNKVCPAMTECVAGLCCSISKTRKRQSECLEGQFKCGTGQCIEESLKCNRKYDCADGSDEITCEYYLAVQKYHVEQQRQETQQSSAAAPTRASAAPAAPASMEHQSDNLVCNDQEFRCPYLAETRCFHYDRLCDGTDDCGDGSDETNCDSNEADQPAAPIPPPVPAPDSVEEDVSRCSSVQFECKRDGKCIDKALECNHKYDCEDGSDETECEYFKAAMARRGESTSTSTTTTEQQHQRQHHQAQQAQQHQQQQERQQQERQQHERQQQERQQQDRQQQAQQHHQAQQHHSQQHPAQPAQPSQDHHEEHRRRLEEHRRREEEHHRRQEEESRARALQQSLLHASQVESTEVTFQDEYDGDSGVGCLEHEFQCAIGECIDKRRVCDTRPDCLDASDEQNCADRAPAPLPTHSQQHHHVAQPAAPPSLPSVNTYPGQLQIFKWLALKFRLLAEDLRVYVFGCIYIYFELIVPSKCLTLFFLKKRSSLHFMFILSAANFEMSQFFC

SEQ ID NO: 5636 - protein, 905 aa, Caenorhabditis elegans; identical to SEQ ID NO: 5635

SEQ ID NO: 5637 - protein, 580 aa, Caenorhabditis elegans; identical to SEQ ID NO: 5276

SEQ ID NO: 5638 - protein, 236 aa, Caenorhabditis elegans
MIRQSVFLLAAIGATVFAQNDSFDLVDANNDGKLSEKELITFMRKRGRPDGQEYFQRFDLDRNGHLDISEFVPLVYEMSRRPVDMDYEFFKKMDLNDDGIVDKAEVEKIRKDNNDRIIDGILSIADTNRDGQLTYAEFKNHLSSGAKSLSPAEEQRNQALQLLSFIDANGDNKLDQLELYTFSQKTSTNKVTKSDVQQIFAMLDKNQDGYLTENELLQLAQQFSTIGNVRSTIPKV

SEQ ID NO: 5639 - protein, 220 aa, Caenorhabditis elegans
MATTLRNNGSAHSLPIFDVDANDWDNTEMAGGEKYRRWRQHCFAKNERWKISDAVREYNFQKEAFHLAVSLVDLALPMFIIDKMRFQLVGITSMMITKIRGNLPTNRVPDFLLMEQLIGKFEFVVAKPTPSWLGACFAKRINLTKKMRNDVKLLELSPIDAYFLRYSPSDAAQNHRINNSTKWLLMMDPRNRESRRSEILNNIYVFFPFFQIYFFIFHVQ

SEQ ID NO: 5640 - protein, 651 aa, Caenorhabditis elegans
MANECRSLRNMETDGFQVVTEVVTHKLNHIPIFKGDFASLSPKVQRFVAEKAELMNPAGIYICDGSQKEYDDIVDKLVERGVLTPLKAYENNYLCRTDPRDVARVESKTWMVTKDKYDSVCHTPDGVRPIMGQWMSEEQFGVELDSRFPGCMAGRPMYVVPYSMGPIGGPLSKNGIELTDSPYVVLCMRTMTRMGTKVLEALGDNDFVRCIHSVGLPRPVKQKVINHWPCNPEKVMIAHRPKEREIWSFGSGYGGNSILGKKCFALRIACNIGRDEGWLAEHMLIMGVTNPEGEEKFIAAAFPSACGKTNLAMLTPTVPGWKVRVVGDDIAWMKFGADGRLYAINPEAGFFGVAPGTSHKTNAMAMESCRANTIFTNVAETADGEYFWEGLEKELKEAKGYTDEQLKHLEITNWLGERWHIGDEGKAAHPNSRFTAPAKQCPNIHPDWEAPQGVPIDAIVFGGRRPEGVPLVFESFSWEHGILVGALVKSETTAAAEFTGKNVMHDPMAMRPFMGYNYGKYLEHWIKLGKAPHKAPKIFHVNWFRETKDHKFLWPGFGDNIRVLDWILRRVAGGEEEIAIETAIGYVPKRGTINLDGLPRIDWNDLMSIPKDYWVEDVDESRHFLDTQVGSDLPQPIRDELDKLEKRVHAL

SEQ ID NO: 5641 - protein, 466 aa, Caenorhabditis elegans
MSLSTHYHAHKPNVPIIMEDVFGWVREGNAFQVRVWLDDHEHDLNVGDDHAFSLLHWAAKGGHVAIAEMLLSRGARVNSTNMGDDTSLHLAAAHGHRQIVVKLLSRKADVNATNEHGMTPLHYACFWGYEQIAEDLISCGAAVNVCNKKGMTPLDVCQPMCKNTILEIAQEHGQSPNDRVPFKDTTWKGTKSRTRDATLSRYTGVDVSSLNLITKIAESHSGELWRGKWQGNDIVARILNVQEVTARISRDFQTEFPALRIFAHPNICAVLAAANQPPNLVIISQYMPFGSLYNVLHEQSSVVIDHGQAVRFALDIARGMSYLHSLDPMLLRFYLSSKHVVVDEELTAKLSMADTKFSFQEVGKAYSPAWMSPEALSRAPEDLNIRAADMWSFAILLWELNTREVPFSDLPPMECGMKIALEGLRVHIPPGIARNMNRLMNICMNEDPGRRPNFDQIIPILERMIL

SEQ ID NO: 5642 - protein, 188 aa, Caenorhabditis elegans
MFLSFIILSTFLPSVVFSASFPSFFNESAYETSGHKPEIYQLEYSGGCISGYTWFSYTNFCYKSTARAANFNDAHNACRSEGSELASIHSLTENQFLVQLSAAGNRVNSKTNYVMIGLIFENREWSWTDGSSVNYLNWAAGEPNNMKHELWTALVSDVNPKKGQMYTHWNNVNMDRQRAYICKRAPLN

SEQ ID NO: 5643 - protein, 199 aa, Caenorhabditis elegans
MSNIAFNRLQRECKEVVTNSEISETGIMIEILNENLTEIKGHIRGPPDTPYAGGMFDLDIKIPDQYPFSPPNVKFSTKIWHPNVSSQTGVICLDILKDQWAASLTLRTVLLSIQALMCTPEPKDPQDAVVAKQYMEKPAVFKATAEYWTTKFAKGAVKNAGYQALVDKLKDMGVREEEAVSVLSCNNWDINRSTVYIFS

SEQ ID NO: 5644 - protein, 895 aa, Caenorhabditis elegans
MSFSRKTLRSSIIKHGGRAKSPAGTGSGRKTVSFSSKNSDAKISNVSDCWNYMQTGSDFVKLRGTNRQFRRFFSLDADLSYIRWTPTNKKPHKARIAIDEIREIRLGKNTELLRSSDEVFTDLQEECLFSIIYGDNYETLDLIASSGDDANIWVTGLMALTSNKYECKPSSSQFATLRERWIESVFDEFDTKKNGHLDEQTAFKAILHINSRISHHRLTNKLKEVTIGAEESERGKIEKSHFVDLYKEIGTRPEVYFLMVRYANKDYLSCQDLRLFLETEQGMVGVTTDNCETLIEQYEPCSEARENNLMTVDGFTSFLFSPDCGVFDPNHRVVTMDMKQPFSRYFISSSRKSYLVEDQLGPSSSDGFSSALKRNCRFLEFDIWDPNEADGDTEPMVQNGQTATSKITISSALRIIREFAFERSRYPLLLKVSVHCSTDWQKVAAMLIVTHLGTRLYLPKNDPTNWDDEKNCPTPWDFQNRILIVGKKLDNPDTDSGEVSEEDDSLASTTRRKSKRIQLCKELSDLVPVFFNVKTLNDLLSTAPGSTTMSSRKNLASVTESTCLRLMHTYATEFGQATRNYCVRVFPNPSRVDSSNLNPQEFWNNGVQMVCLNYQTPGLMMDLQEGKFSDNGGCGYVLKPQVMKDDMFVPSDRVPTSPQILHLRILSGQQLPRPRGSNAKGDSADPFVVVEVFGLPGDCAEERTRTVRNDSINPSFDESFQFQVSVPELALVRFLVLDDDYIGDDFIGQYTIPFECLQPGYRHIYLLNNEGDPLEHATLFVHVAITNRRGGGKAKKRGMSVKRKNSRISSGMKLVGIKSVDDQFKVAVVPLAESTAIRNRLENAMIDWQEECGLGPAGTIRQGIRLIHSRMITLAVNCESIFNAHYQETFKNIDF

SEQ ID NO: 5645 - protein, 727 aa, Caenorhabditis elegans
MADLEAVLADVSYLMAMEKSRSQPAARASKRIVLPDPSVRSIMQKFLEKSGDMKFDKIFNQKLGFLLLKDYAENVSESPCPQIKFYEAIKEYEKMETPDERLTKAREIYDHHIMVEMLAHAHNYSKESLQHVQYHLLKQNVPPDLFHRYVLEICDQLRGDIFQRFLESDKFTRFCQWKNLELNMQLTMNDFSVHRIIGRGGFGEVYGCRKADTGKMYAMKCLDKKRIKMKQGETLALNERIMLSLVSTGQDCPFIVCMTYAFQSPDKLCFILDLMNGGDLHYHLSQHGVFTEQEMIFYASEVILGLEHMHNRFVVYRDLKPANILLDENGHVRVSDLGLACDYSKKKPHASVGTHGYMAPEVLAKGVAYDSSADWFSLGCMLYKLLKGHSPFRQHKSKDKNEIDKMTLTQDIELPNEGLSKDCRDLLEGLLKRDVPDRLGCRGKGPTEVKEHPFFKDVDWQTVYLRRMTPPLIPPRGEVNAADAFDIGNFDDDEVKGVKLQDGDSDLYKNFNIVISERWQNEIAETIFEVVNQDADKAESKKRSKQKIKVAVEEKDSDVIVHGYIKKLGGPFTSAWQTKYGKLYPSRLELYPESLTAKPELVFMDQIEDVCAEMQTIKGETAIIVKLRDGFKEPKICLTNSVSENVLKYKTEKKNCRSVYLDEISLKEWHTSLRTAHKVSQELLQRMGRKAIKIYGVNHDPMLSESERPGSVTRAFLNRASSVDSGV

SEQ ID NO: 5646 - protein, 687 aa, Caenorhabditis elegans
MLKPGDVVFYSRGTESTDFCDAVEKVVPDNTYYHVAIVSERGTIVEATGDGVLEYSLQKSIEENRPGCLEILEVANCCEKVLEAAATWSWTKLGLPYNDLFAADLINSDGKESYYCSQLITAAFEFAGVDMKWPAHTLNFNDKNVNQISFWNEYFEKRGKSQVPQGEEGSHPAQLRRSPRLLLKMRIFPNLINLNSLTETKLLELSSHFVAGNHVEFPSDRKFEVIEPRSGKPMATWHYATRDQVDLTVKEAKKAQKQWAKSSWMERSEILKKTGDLLKTHCNDIAYWECISNGKPIAEAKADVLSCVDTFYFYSGIASDLLGQHVPLDASRYAYTRRLPVGVVAAIGAWNYPIQTCSWKTAPALACGNAVIYKPSPLSPVTALILAEILKSAGLPDGVFNVIQGDAETAQDLIHHDGVSKVSFTGSIPTGKKIMKACADRNIKPVTLELGGKSALIVFDDADIDSAVSCAMMANFYSQGQVCSNASKVLVHKSVLKEFTKKLVDHTQKMKIGDPLKEDTQVGSHISAEHRNKVEGYISTAIAEGATKLCGGDRVAVHGLENGFYLSPCILTGITPKMTVYREEIFGSVLLIIPFDTEDEAIKIANDTDMGLAAGLVTKDLSRSYRVSEQLNAGNVYVNTYNDVSPLVPFGGVGESGFGRENGTAVLEHYTHLKSVFVNTGTCPNPF

SEQ ID NO: 5647 - protein, 491 aa, Caenorhabditis elegans
MGAYLNKPIIEKEKEEGSGNGLSYACTTMQGWRVNQEDAHNCVVDLHTDWHMFGVYDGHGGTEVSKFTSAKLPDFLKERKFWEADDVAECLQKAFVDFDDFIRAEESMKELKDIGDEGKPKKAGGEADSEDEADRIDTIEEASVPLAELLKRYGGAGVGKSLLSAFLAKGDVSDDSEDEDEDEEEAEEQDDTEEKKENEDASAEVVIENAEDKEEEEGSPKKKGQKRCQKSPIQSEAKKSKSETDAETAPSSSSGVDGVATEEEDEDDSDKEFVADEEEDDEDAEDEQSDEEMVDGSLAPLLLGSGGAEVPGEDSGTTACVCLVGKDKVIVANAGDSRAVLCRNGKAVDLSVDHKPEDEVETNRIHAAGGQIEDGRVNGGLNLSRAFGDHAYKKNQELGLKEQMITALPDVKIEALTPEDEFIVVACDGIWNSMESQQVVDFVRDLLAKGSSCAEVCDALCDACLADSTDGDGTGCDNMTVICTTFDRKSK

SEQ ID NO: 5648 - protein, 350 aa, Caenorhabditis elegans
MFMASSLPVFIFLLSLPHGLTFNCTNSGVCIEKMKQHRTEYLKNEILDQLNMKEAPKGLKPMDPEMKSVYLEMYRDLLEKDEQDMGVEMSFYTAKDPSYGENPSQLVAKFDVTNDLERSDILQATLTVSIEIPAKDSGMLQDVQVQVYEKNEDGSMGEMVTSGIFATKGSERISIQLPIDTVKSWFTISPIQGIFVKAMLDGRNVALHPQQTTADVDNMRLQLSTRPKGSRKRRSHAKPVCNAEAQSKGCCLYDLEIEFEKIGWDWIVAPPRYNAYMCRGDCHYNAHHFNLAETGHSKIMRAAHKVSNPEIGYCCHPTEYDYIKLIYVNRDGRVSIANVNGMIAKKCGCS

SEQ ID NO: 5649 - protein, 412 aa, Caenorhabditis elegans
MSYNSIRLPQDLPIYYKNFFPVKPFTKWLCYGQNYGDYFNRREFTFILADDVHIRYRSYNDEHSFVKALSSTNPEKLDIGAVYNHEPINNKRYTDYQAVERELVFDIDLTDYDPVRNCCKDATVCPKCWKFMVLAVRILDFQLEEMFNFKARMWVFSGRRGVHCWVGDKKARMLNNNQRSAIATRLNLFKKNGQCEVTEGRAKLTRVPPTVRDAFNVALKDGVFEKMIYEQGWLDNDRFIIDYQYMSEFGRDDLRRISESFKTPQERWHMLRGLFDNDYRKTLSQNDGLLDFVNNARSRPKKVLLYFVLQRCYPRLDANVTTGTNHLLKSPFCIHPKTGNVAVPLNVEKIGEFDVSKCPRIDHVVEELSSLLTERGNDGDEDSKNRKFLAYKHGALSPYVENFEMFVSACIS

SEQ ID NO: 5650 - protein, 321 aa, Caenorhabditis elegans
MASTLASAARAATRAAVTRSVYNDTRNNLMINKSTKVIVQGFTGRQGTFHSKQMLEYNTNLVGGVSPNKAGQTHLGLPVFGSVAEAKDRTGADATVIYVPAAGAARAIHEAMDAEIGLIVAITEGIPQQDMVRVKNRLLKQNKSRLLGPNCPGIIASGDCKIGIMPGHIHKKGCIGIVSRSGTLTYEAVHQTTTVGLGQTRCIGIGGDPFNGTNFIDCLEVFLEDEQTKGIILIGEIGGQAEEQAAEFLKSRNSGSNAKPVVSFIAGVTAPPGRRMGHAGAIIAGGKGTAGDKIEALRNANVVVTDSPAKLGVAMQKALLG

SEQ ID NO: 5651 - protein, 722 aa, Caenorhabditis elegans
MKNSEKSTRATTTTTSSSQRNNYNDNNQNTSSSSGNKKESSSSSKQHSSKKSKKSNSKKNRSPSPQPQLSKKLFILIWKRLLILRVFFFSTIKSAILIQKWYRRCEARLEARRRATWQIFTALEYAGEQDQLKVRVWITLYDFFADVIRAMAEENGKGGVENGRNSPLMSALSHYAKPSLMDSEGETVKKMLEDTSPTNVDIDRNYKGPTLSLPLDKPQVAKMIEAFKVNKVLHPKYVLMILHEARKIFKAMPSVSRISTSISNQVTICGDLHGKFDDLCIILYKNGYPSVDNPYIFNGDFVDRGGQSIEVLCVLFALVIVDPMSIYLNRGNHEDHIMNLRYGFIKELSTKYKDLSTPITRLLEDVFSWLPIATIIDRDIFVVHGGISDQTEVSKLDKIPRHRFQSVLRPPVNKGMESEKENSAVNVDEWKQMLDIMWSDPKQNKGCWPNVFRGGGSYFGADITASFLEKHGFRLLVRSHECKFEGYEFSHNNTCLTVFSASNYYETGSNRGAYVKFIGKSKQPHFVQYMASKTHRKSTLRERLGVVEESAVKELKEKLSSFHTDLQKEFEIMDIEKSGKLPILKWSDCVERITGLNLPWIALAPKVATLSEDGKYVMYKEDRRIAQVGGTHAQEKDIVESLYRHKSTLETLFRFMDKDNSGQVSMKEFIDACEVLGKYTKRPLQTDYISQIAESIDFNKDGFIDLNELLEAFRLVDRPLLR

SEQ ID NO: 5652 - protein, 559 aa, Caenorhabditis elegans
GNWSNKSDYLLAVIGFTAGVGSFWKFPFLVFQHGGAAFLVPYLCMLCLASLPMFFMEMVLGQFSSSAAISVWKVVPLFKGIGFAQVTISGFFAVFFNIISAWTLFYLINSFSFSIPCNDVLMLSKGVDDFGTLNWYLGLCVLACWIAVFLCLFQGVKSSGKVVYVAVIVPFIILTVLLTRLLTLDGSLAAVFYFLTPKWEILMDLHVWGEAAVQAFYSVSCCSGGLFTIASYSRFHNNIYKDIWLVLIVDVIVSLVGCLLTFSAIGFTCYEFAISLDKFHIRDGFHLVFVFLAEALAGVSVAPLYAGLFFIMILLVVHATQMFVVETIVSSICDEYPERLRRNRRHVLTTVCALFILLSIPFCLSSGLFWMELLTQFVLTWPLVVIAFLECMAINWVYGVDNMLDNAKWIVGYWPPCYIFWKILFKFICPMVYLAILCFLWLDWNSIQYESYQFPYWSILTAWCIASFPLILIPIVGIWQFCIAKGTITQKWWRVLYPDDAWGPAMAIHRAEKFPLQIPEARRLLLPPEVEIASSRGVLQVDHWEKKLRRSVFTPTRVV

SEQ ID NO: 5653 - protein, 327 aa, Caenorhabditis elegans
MALNFWKSSHCQQWIFDKTEIWKQRAEDMKIYNEEEYNRLNIFWANFITAVATEGAHSQANVGCKLRQQVIATAIIYFKRFYLRQSFRDMCPFLVASTALFLACKVEEHTTLSVSSFLKNTAIVLPKRWGVTFETTSTKNGVVYDSEFILVEILDCCLVVHHASRPMCPPPPPREIFDKNWNSGIFLIFFLNFLVKKMENCGIFSEKLENFEFFNLEAIEAQCQKVANDSLRCDVSLIFPPHVIGLSSIMVAMELMGRGEELEAWLVEVDTDFEKVTDCVEQIYKMYTLWKSFDEKEEVKKLMAKLPKPNQQPPPQQQHQHQQGYHL

SEQ ID NO: 5654 - protein, 366 aa, Caenorhabditis elegans
MSINMNANFLKLLTHFRRHDLTNFKSEHDTLYEKALETGDHLEVTSHYYSVMSTVIDEYFGGNFHFVPPKFEGQKLEEALKSLHCHIAEKLELSENVHCLDIGCGIGGVMLDIADFGAKLTGVTIAPNEAEIGNEKFANMGISDRCKIVAADCQKMPFEDSTFDVAYAIYSLKYIPNLDKVMKEIQRVLKPGGKFIVYDLIKTNDYDKDNKEHYKILRKKIFAKNFFFENSTKKIKLFLAKKSNAFQTLHHLEYACGMPSLHTQSEVEAAAEKWEMPVVERENLEETYGNRAFHYCFSASPMFMWLVSSPVIDHTIRMAEILRILPAGFKQFNRTFLCGTVNSIVGGGRMGILSGADILLFEKKKI

SEQ ID NO: 5655 - protein, 320 aa, Caenorhabditis elegans
MEVPENLKNPQNARREGSNMKCLADYSVEKEVGEGSFSTVYLARRKEPKNDENPEVALKICLKRLILKNKMVPYIHREKEALALISREENAHPGIVTLYATFQDSESLYFVLEYAKYGDLCTLMQKQPDSKFNVADSRYYAANLLSALEHIHKLGIIHRDVKADNLLVKSDGRIMLTDFGSSKFLSDYQKIQENPVEEEQPTGRRSSFVGTAFFVTPELLTGSEMSPSSDLWAFSVTLYLFLTGIYPFNDMSEYLVFRRIQDILYTFSEDFPDENAKNLIERLLVKEQKSRLTSQEIKEHKFFESIDFEHLEQLEPPRIY

SEQ ID NO: 5656 - protein, 475 aa, Caenorhabditis elegans
MSLATKFPKNFKLATATAAYQIEGAKDLNGRGFSTWDAIRLEPGRILDNSDPDLSCDGLLKYKEDVALLAEIGVTNYRFSISWSRILPDGTLSTINEEGIKFYRDLCLLLKENNIEPVVTLFHFDMPLAIYDNGTAWLNRENCEHFEKFADLCFQKFGDLVKTWITYNEINCQAWGSIVKVEGEFWLCPERPEIENHKQAPYFGAANMLLTHAKIYRNYDQNYKPTQHGILGITNGGRFCFPATDSQEDIEACNRARDWLFNFTIEPILSGSGDFPVLMRERMPFIPKFSEEEKEIIKGSTDFIGINYYLSFLVRAPKDGEKASSQSQHDGGYVFVEGKWDKICGETWIRYAPDGLLKILRYVKEKYANTPVFITENGCMDIVGQDQEDAFHDQHRIDYISGHLEAVAKALDEGCNVIGYTVWTLMDNFEWDDGFELKFGLCEVDFESPDKTRTMKKSAYFYKEFIKEFKDFHGI

SEQ ID NO: 5657 - protein, 478 aa, Caenorhabditis elegans
MKNDKIFIISTCYHQTLKIFFSIQKFLPEKIFFFLTGQMEKYGYLKGIDHSSPQEFRQALMFFQEVLEVEQTGNVDEMTVEAASKPRCTQTDVRQEQTKRTKRFTLSKRAKWAHASGQSVTLKWYISDYTSDIDRLETRKVVEKAFKLWSSQSYIKNEKKVTLTFQEASSKDEADINILWAEGNHGDEHDFDGANGKIEGNKKENVLAHTFFPGYARPLNGDIHFDDAEDWEIDVDQVGHGSNKRFFPYVLAHEIGHALGLDHSQKADALMHPYYKNVPINEIQLDIDDKCGVIWNYGGASDFCLYVWLMSQIVEAHNSSAQNNHGVGSITSSRTNKKSFKSEGFFLFQLKFPHSTLTHTDDVVMREKDKRSYRGDSKIPKCSSNNSSQRTLAEKKLTLGLHLSEADAKRYTEMVCNFLAGLHMWRTNPNHHASESLEKEYKGVSQEMGTFSGKSIAVRRLIRHAEHQKERSEKGPLG

SEQ ID NO: 5658 - protein, 443 aa, Caenorhabditis elegans
MGPAPVFPNSRKPATLDANSDEQTLRPYFKTKVEQAEVNFRENNWKKRIISQKKNQVFDEKLKFLIEKLQTVAEKSINVRRLMAQQKELNGKVRLLKEEISHLHEQGSHVGEVCKAMDKKKVLVKNHPDGKYIVDVAASVDISTLAAGTRVALRADNYAIHEVLPSKVDPLVSLMMVEKVPDSTYEMVGGLDTQIKEIKEVIELPVKHPELFDALGIAQPKGVLLYGPPGTGKTLLARAVAHHTECTFIRVSGSELVQKFIGEGARMVRELFVMAREHAPSIIFMDEIDSIGSSRVEGSRGGDSEVQRTMLELLNQLDGFEATKNIKVIMATNRIDILDSALLRPGRIDRKIEFPAPDEKARAQILKIHSRKMNLMRGIRMDKIAEQIPGASGAEVKSVCTEAGMFALRERRIHVTQEDFEMAVGKVMQKDSEKNMSIKKLWK

SEQ ID NO: 5659 - protein, 620 aa, Caenorhabditis elegans
MPCCSFSARECVGRGDAVCASRLRLLSSYTLSLCKILNVDISEENIFLKVDERSGEISTIAHLDYEKRSKFDIVAVKVEESGETIDILVEVDDENDNAPSFADQVVKLEISEFAQLGTSFALPTVTDGDGPKFDVHRFVILQGNVNNVFKLASRKVNEQLQADLVVNGQLDREFRDKYELLIEAQDGGKPAKIGQLRCSIEIIDANDNAPVFSRSRYTASVSANISIGSHLITVQATDADIGENSRISYDIKKTSAPSNSNFAISQSGVITTTASLLPASTHDVIVVASDHGSPSLSSSAVVTITVLGSTLSSPPLDIIWLVESNSAHLMENSTLGSIVARVSIAQQYRDTKLRLIGSSALCPQQTDQAHVYLLLLCGILDRETASEHHLKFLLEKDGQIIIEHPQLLTIGDINDNAPQWHSSQIHISLNRTQGGSRTLTAKDPDLGQNGWIRYSVLDTELVSIDKETGRIFVPNTIDCNIGSEIKFRVRAEDGGSPALSTDLQVVADLLDTESKPPQFEKALWQVEIPEDTPIGTCLVKYKKIFRASHSVFFSVVLFFAEAALFGPAALVARSLAFVPGRELVPGRDPLLVRGLVVVVLEPADSLLLTESLVFFGVFGL

SEQ ID NO: 5660 - protein, 2163 aa, Caenorhabditis elegans
MSVDLRAIFQHLTVDTMSGTVCIQKTFDFEKQKNSETSTSLISIRLKDVNDNWPIFYPNEYHLTVREGPKPEEPLLVVSASDMDSGTFGEVSYHILSESSSFSINPVTGEVFAQKPLARGRFHLVVSAKDGGGQSSENSANIHITVIDKDTKTPQFSRSKYEIRTTEDILPGIAIGSVGAMSKVKYSIYSGDQDHNFSIDEDTGKIYVTRYLDADVHDTVLLNIQATLPSGESNQTQVVIFIEDHNDNPPQFSSSLVEISIREDLKLHEPFYVVQASDKDKKKNGEVRYSIISSHPGSSIEIDQFTGQLSTGSLLDYEATRNYKLRVKATDLGIPPRSSNMTLFIHVLDVNDNAPEFEKSWYTMEVLENSPPKTIVGKVVARDKDSLENGQIVYRITNGSEYFGIDEKLGNVYTKRSIDREVISHVDISIVAEDKGVPPRSSTASARISVLDVNDNPPSCLSITPIVVPAGSPLSTAIGTIVAMDPDKGLNGSVLYRAQLQSSLFVVKSNGDVYLRRQLNASDERHQRLSVIVSDQGVPRKSVVCHVPVRISKGSADIQIQEPFQKYIEIPKSCPTGCRLTTLNATGVSSWLIQSSEISNHFAIREGVLFMISHPIHRPPYSLVIVLSDKNDRQKSIQLRVLASGEAANKEETIRISDSNSIGTKIGRLGEKSADGSFFYRFSSEESCPLELDQTGGLLYLADGLRRGDTHNFSCFFEKFNTTDGSAEEMRVDLEISRTKSDKPRFDTGHLRVNIREDTPTGSIITTVNATVSDDSASPISYRFPLLIDNFSIDQFTGDITLIDTLHWHVTPTYNLIVEAFTSGPGTTLLVTVNVDDVNDHTPFIVSQPTVLLPSSYRKGGMVHRVVAIDLDKDPEIRYSLKYAGSEVAKEFFKIDEKSGEIFVVESSSALSTSFGGAGLPETLTIRATDLQDLTKFDEQKVLLKASNASRSTWHFFDEQHKDVTILSTSPQGSQILQLKFQEGVDLQLIPSSPHFELKSSKIVQKSASVATGTQRFTIVAQKDDELDYSTLKIHVEPVFTEPPKISSTSCGVVTIEENVGIEDFKRILATGMTEESRFRFQGNAPKFSINSTTGSISVLPLDREASQEHLLIIILTDGGSRNDSCTVRVTVADQNDNKPQLDASTPSELEIAESSRVGDVLHRFRASDMDIGQNGKFSFELLEDSSGSLDLVPETGDLVLRRLSSLQSWKIKLRVVDHGVPGLYVEKNLEISNRNPQTEAKAPLEFLKQTYLSTIDEGLPRGQFIAKLQPELAGLTYSIVEGNIDSAFSVDSEGVIRTNLELDREILERYSLKVIGTGSGQQIGTRVDVRVNNLNDNVPSFPMSKPRRVPENLRVGSYVATVGAKDVDNLAPLRYFLVSDSSGQTPTHFNIDQFTGTIHLTAPLDFEVLPEHTLTIKATDGSFDTFTNLTIFVSDINDNAPTFSKPLYQTTVSPATFSPGQPFAKIEAHDLDARGALTYSLGQGSSSIFRVAPESGALFMKVLPPAGERYLVTVTATDNGVPSFSTSVPVSVIIGEAEPTDKPGFEKAEFRFEVMENSKIGLQIGNLSGEESREFHYRIQDPEASKIFSIDKFGRLFVAGPIDREQRATHEFQVEIDNEMMTSQKVQCKCHVIVLDENDNLPVFTSVAYYLSLKDSMAHGQKIGQIMASDQDSGENGRVSYRILSGNDLNIVTLNPDTGSIQLNEWNDAQLDEFPNATWQILVEARDHGHPARAAVGKVQVSLKMSSWSGSAPFFVLPVYEVHVLEDTSVGTVLQKIRASNRLGMRNDGLLYSLKEHQGKLGIDVKTGELTLKTHLDWESEPIISMYLSVSDGNGRSAVVPLKIVVEPVDEFAPVFTKSSYTLQIPISTPAGESVGQMQAIDEDGGVHGVVKYSISDRQSTVKIEEHTGIIRLQKPLVSRRNLTIEQITVVAYSSPTKQSKTTVYLEIGPFDVQPSLPKLLLHSKPVQIAVASLILLLFLLIVVICICMCKSRRKTQNEKEKKHPDVIVTAERRPSSQKPTLQKQVYSVKTGEIRTLSDAQHHHHHPTHSMTSSVSTSSDALRMVRGSSRSQMDSGIDPDNVSINSSVTDYLVSLGVNANPIPPRIRPNTTYDSLMNEYIYARVEDVLPPGPISLTTPNQHSLLRQPLSAGNKVPHARSRFQ

SEQ ID NO: 5661 - protein, 457 aa, Caenorhabditis elegans
MGLNLKLFREVISIHIGQAGVQIGNACWELYCLEHGIQPDGQMPSDKSLGGSDDSFSTFFSETGSGRHVPRAVMVDLEPTVIDEIRTGTYRSLFHPEQLITGKEDAANNYARGHYTIGKEIIDLTLDRIRRLADNCTGLQGFLVFHSFGGGTGSGFTSLLMERLSVDYGKKAKLEFSIYPAPQVSTAVVEPYNSILTTHTTLEHSDCSFMVDNEAIYDICRRNLDIERPSYTNLNRLIGQIVSSITASLRFDGALNVDLTEFQTNLVPYPRIHFPLATFSPVISAEKAYHEQLSVAEITNMCFEPHNQMVKCDPRHGKYMAVCLLFRGDVVPKDVNAAIATIKTKRSIQFVDWCPTGFKVGINYQPPTVVPGGDLAKVPRAVCMLSNTTAIAEAWARLDHKFDLMYAKRAFVHWYVGEGMEEGEFSEAREDLAALEKDYEEVGVDSMEDNGEEGDEY

SEQ ID NO: 5662 - protein, 363 aa, Caenorhabditis elegans
MKKLASLQFFNLKLLLNGESSRGFSKFKKNYKLKAELGRGGFGVVYRAVRTCDNALVAVKFIERSNVKEWARINGEQVPMEICMLAKCSKVRGVIRLLDWYSIPEGFLIVMERPYPCIDMFDFIKGQGKISEDMARFLFRQIAVTVHECVQNRVLHRDLKDENIVIDLVTGSTKLIDFGAATVLRRSQYSDFQGTRLYCPPEWFLHSLYLGREAAVWSLGVLLYNSLNGRLPFRNEKDICTAHLLGPLPFFVPVSAEVKDLISKCLTFDPFQRCSLEAILNHPWVKQQTLSWDALTKNKVQKKTSESSDDHHSETLGDHSETEEDRSPPTSSVSQQPGSADEGVGLSASSSNTVRIFIPVVNM

SEQ ID NO: 5663 - protein, 382 aa, Caenorhabditis elegans
MIDTNLLRVTVCDEGELEKSTTHFIGYQILDISSEKCDFPSTNRFVSIYAARVLLEEKIFIVFGENAQFLTNLTLKLSRKIEPEQWITWASECKYLPESDAVALCATLIDRLSLEANVVPVSSPVTICGDIHGQFYDLLELFKTGGTVPNTKYVFMGDYVDRGHYSLETVTLLFCLLLKYPNQITLLRGNHESRRISNVYGFYDECQNKYGHGNVHKWFCKVFDVLPIGALIDESVLCVHGGLSPDIRTIDSLMLLDRAQEVPNKGPLCDIMWSDPDDDVEDWVISQRGAGFVFGAKVTEEFLMNNDLSLLCRSHQLVDEGFKYMFNEKLATVWSAPNYCYRCGNAAAVFEIDGNNRSTKYFNAVPDGSREKPDRVVAPYFL

SEQ ID NO: 5664 - protein, 268 aa, Caenorhabditis elegans
MPKDKKKDEVTEVEHVDRNISSFSQISHLIDAEIITRLTLSHNKLTSVPPNIADLVSLQSLNLWNNQIEDLPPSISSLPKLRILNVGMNKLSILPRGFGSFPELEILDLTYNNLSERSLPGNFFFMQTLRALYLGDNDFEMLPGDVENLTNLQILVLRENDLLTLPKELGKLTRLRELHIQGNRLAMIPPELGNLELVGSKQVLRLEHNPFIPRIEEQFEANGAAGVWAHIRTDDYRYFFGRQEPSSTPVPPKRNKEKKVSRKGIQQA

SEQ ID NO: 5665 - protein, 639 aa, Caenorhabditis elegans
MVQVAPVAAGAGSGQTRPSSDPKTGWFVYMLAFSAVIGGFLFGYDTGIVSAAMLYVPNASGIKPLDSVWQEIIVSITPGVAAIGSLCSGPGSDFLGRKKIIIGASVTFTIGAIICAAAWTKIILLIGRILLGLAIGFASMIVPIYVSEASPSHIRGKLVTGFQLMITVGLVIANIIGGAFSYVDPDQVGWRQKSDFFLEFLLPNSQLISIFSKFHFQSFPNPPFSRLMFAFAAVPAIIQFVCFLFLPESPRWLYEHGRTVEAREVLTRIYNGHTEWVDYEINEISFSYEEELRAKAEHAGNGPTIIRILKTPHVRKAMIIGSLLQMFQQLSGINTVMYYTGNIIRSAGVKDNHTTIWISVGTSAINFLGTFIPIALVERVGRRVLLLVSMIGVILFLIAMGVSFLLINNDSLRTFDQQNYTLNYNPSVKHAAKCLKYSNCDFCVTDENCGFCESKVAKKGYCLPFPSDDSSDYSATGICEFSNLTNNGTDFEWEDTYCHTKFTVLPIIIMVFYLLSFSAGYAPLPWVLNAEFYPLWARSTAVSVSTACNWIFNLIVSLTFLSLSQAATKYGTFFIYCGCTMVALVFVFFFVPETKGYSIDEVEMLFMTKEERRKAQKVLDESKEGKHRNSVAMSFDTKF

SEQ ID NO: 5666 - protein, 980 aa, Caenorhabditis elegans
MLIKEYRILLPMTVQEYRIAQLYMIQKKSRLDSHGQDSGVEIISNKPYTDGPGGSGQYTFKIYHIGSRIPAWIRTVLPTNALEAHEESWNAYPVTKTRYSTPMMDRFSLEVETLYFDDHGQQENVFNLNEKDKSTRIIDYMDFVKDPISSHDYCAEEDPKLYRSETTNRGPLNDDWVAEHLKKGLPIMCAYKLCKVEFRYWGMQTRAERWIHDLALRNTMMRAHRQAWAWQDEWTGLTMNDIRKLEAEAALHLSKVMSVKENEDGHQDENDTDDDMDAGDAVSDDLYFDCTDTSPIPTQKPSIIRWSSELELEIQDDSEYQNSEKFVKTDKILDSPPLTPHNGSTEVALLIMVFHGDFSPDNPADSKTTDTNTFSSTIETCVQRHYPQLRNRLHIVNVSCGHEMTQVVSKLSNISPSFGLLHPSLSLMLPSASHLYNEAVEGTIRRANETYNEFIASQPLFNGEVFVVGDCVGGIFLYEAMTRKCDSMTLLKRLSSNLSSRIIKEDFGASRLSFQPSTVFLLGCPLGLTLMQRKLDGSEIDGLDSCQLFNLYYPLDPCGARIEPVLDGQLSCVPPYNVPKYQRYPLGDGKSQKFESTIDATQMWGSKRIDNLLYCPNSMVALPSSALPNILHASYWESCDVASFLLRQFVRGEENSVLTTLSSSMNNIPLNIDLPTMHWKRKRTRFKIANLSANHRANDILVTAGMDLTVIAKFCYGPMDLVALSREPVSVFVYPQRGDWYLHGVFDTDSHGRLTLQLAKTLPCGIHSVKIVVHGDRSYLDAFVAIVPHGTKCAVFSVDGSLTASVSVTGKDPRVRPGAVDVVRYWQEQGYLIIYLTARPDMQQRVVSAWLAQHNFPHALLFFNNSFSTEPLKQKSLHLRHIVDMGVHIHVAYGSGKDVNVYTSAGVDPEHVISVAGSRRRNCVQIESYSSHLAALNSGQCTLGKRIEDDGLTLQLHRNVQRTPSFTPRGGKFENEKDRR

SEQ ID NO: 5667 - protein, 980 aa, Caenorhabditis elegans; identical to SEQ ID NO: 5666

SEQ ID NO: 5668 - protein, 452 aa, Caenorhabditis elegans
MREIVHVQAGQCGNQIGAKFWEVISDEHGIQPDGTYKGESDLQLERINVYYNEANGGKYVPRAVLVDLEPGTMDSVRSGPFGQLFRPDNFVFGQSGAGNNWAKGHYTEGAELVDNVLDVVRKEAEGCDCLQGFQLTHSLGGGTGSGMGTLLISKIREEYPDRIMSSFSVVPSPKVSDTVVEPYNATLSVHQLVENTDETFCIDNEALYDICFRTLKLSNPTYGDLNHLVSVTMSGVTTCLRFPGQLNADLRKLAVNMVPFPRLHFFMPGFAPLSAKGAQAYRALTVAELTQQMFDAKNMMAACDPRHGRYLTVAAMFRGRMSMREVDDQMMNVQNKNSSYFVEWIPNNVKTAVCDIPPRGLKMSATFIGNSTAIQELFKRISEQFTGTIMETRKTMFRRKAFLHWYTGEGMDEMEFTEAESNMNDLVSEYQQYQEATAEEDGELDGTDGDAE

SEQ ID NO: 5669 - protein, 473 aa, Caenorhabditis elegans
MLRFRCILSTSRSIMSGVKEFDYLVIGGGSGGIASARRAREFGVSVGLIESGRLGGTCVNVGCVPKKVMYNCSLHAEFIRDHADYGFDVTLNKFDWKVIKKSRDEYIKRLNGLYESGLKGSSVEYIRGRATFAEDGTVEVNGAKYRGKNTLIAVGGKPTIPNIKGAEHGIDSDGFFDLEDLPSRTVVVGAGYIAVEIAGVLANLGSDTHLLIRYDKVLRTFDKMLSDELTADMDEETNPLHLHKNTQVTEVIKGDDGLLTIKTTTGVIEKVQTLIWAIGRDPLTKELNLERVGVKTDKSGHIIVDEYQNTSAPGILSVGDDTGKFLLTPVAIAAGRRLSHRLFNGETDNKLTYENIATVVFSHPLIGTVGLTEAEAVEKYGKDEVTLYKSRFNPMLFAVTKHKEKAAMKLVCVGKDEKVVGVHVFGVGSDEMLQGFAVAVTMGATKKQFDQTVAIHPTSAEELVTMRGGVKPE

SEQ ID NO: 5670 - protein, 811 aa, Caenorhabditis elegans
MWRGKYSGGYQNRFVSAKSSGTSSLSDGKSMNNVPPPAALTVGNAPVPPPNRNILLSNRKEQEMKKEQEYANLMAYGSTSEKQSRRKRIYDDEYLEGGSDDEKPASSSSKLAADDDDEEDELDAFMAGIEKQASSDKKVSEQKEKDRKEGKDTEDPSKKGLGRADIDEEDMQESLFKFMEEYKEKHENDDEQLEYDEDGNIIWSWKKVIDPLPDIDHSQIQYQKFNKNFYEEHEDIKRLHYMDVIRLQNTMNLRVGGLKPPRPVCSFAHFSFDKLLMEAIRKSEYEQPTPIQAMAIPSALSGRDVLGIAKTGSGKTAAYLWPAIVHIMDQPDLKAGEGPVAVIVVPTRELAIQVFQEAKKFCKVYNINPICAYGGGSKWEQSNELQNEGAEMVVCTPGRIIDLVKMGATNFLRTTFLVFDEADRMFDMGFEAQVKSISDHVRPDRQCLMFSATFKQKVERLARDALVDPVRIVQGEVGEANADIEQKVFVMQNQDVKLHWLIRNLVEFASLGKVLIFVTKKLDSEDVAKKLKMKDFDIVLLHGDMLQAERNENLLKFRKKSQILVATDVAARGLDISEIRTVINFDMARDIDTHVHRIGRTGRAGHKGTAYTLVTEKDIEMVGHLVKNLESVSQEVPKPLMDLAMKSSWFRGQRAGNGGPSTGTQTRGRMGLGYTPKVRQVGGGATGAQFDPLKEQKSCRGGGNQTVDGMIRNAQSFATSSSSSSSSSSGPASGANRAQMLKSAFQKSFQTTFQRPTNESSNLPQQVASDPRPEWKKKVDELNAKIAQQQASSASGGSSSSSSSSKRSRWE

SEQ ID NO: 5671 - protein, 999 aa, Caenorhabditis elegans
MIIEDNFRQEFYNKIKKGDKSVVLIVSVDTDALCTTMILTHLLRCDDIPFSILAVEGWSSVEKIFADSQEQKCHYILINCGATRSLTRLQIPPASIAFVIDSHRPFHIENVYENGQIHLLANPSEMSELQIPDLESVIREDSDDEEDSDEDEDQEYISYEQRMEKIRRKAIKREEMQIWERQRRTILWRYYESTWFSSPSCVTLLEMAAEMNRVSAETMWFTAVGLNSAMADKLISIEMYTQICVDRMRPFVHRFMPKNIVNQGKVDDLLHITFGRELPLALYSHWDLFSAMMVSEYFSIKTKNWTQKGDVNIRHLLAQLGITLHETKQKFEALPTEQRNLVVDVLEKEMDSSFATFFGTLGYCGKLSACDVARAVTLRLEMPKSETIMNRFRSGQSILRSSITGERQDRLNLNNTFTSICQRTLQVSWKTVAAAINQSEIIPNGPYYLFSCSRSIDEDMVDSRHFLYNTAGFMIRAFASMKKGRTTKPLIAMFPLTGESAGWLVVTGVMPIATIYEDSLLKTCIGRAFERVKKMTPPLRIQSYFVSSTPNGLDGAQYLAVNRDGSVLYGLKVRIVLSIVEAPEQAPEVITTATEKSICKYHVASGNTKTFQLDDDIDPLLLARIIEFYMISDNIVALISYDSEHFQVIQTLIHLEHSKEWAQTIVVRRLTISRMSGPPLVNLSFLDKGRILLCGGRASVEGVKERMTINIAANPLNCFTKPDEDLSSLARYRRKSFRKLRLNFQMEDFNKFLTSRPSDVEAKSLISLFLLHLDEEKISVLLSEVYPDDPQSEPVFATNVMGMINRKDGTFSVEQLDNSALSICEPLIVTSIVNMRAKRGNVWMTFSVRDVEKLNTLYWRFKHFYVGVMLRLMVIGFQGSMYLWRFDNGFTFHCLTRFFMFLHGPTMIPIYSPQKQFHLCYLDINRRRFFRYEHSARVLKSKMDPNETEFAMGFDVDSDGGALVLDHPTEKSREMELSYYRNPMKPQSLAQLATYSAYR

SEQ ID NO: 5672 - protein, 999 aa, Caenorhabditis elegans; identical to SEQ ID NO: 5671

SEQ ID NO: 5673 - protein, 805 aa, Caenorhabditis elegans
MRSQKVIVAKLLAIIVVHIWTNFTGIYLCSTADRLARNAFLSARNSSEAESTAEFQSNRLNKLLSSFLPYHLINQARHQITLYKPHLYNETYSQVSVAYGRLVGFESVLAQCSSIDAARVLKELDSRIERLAASNGCTRVASEGITAVCSIPGIDSQHATKLCRFSMELETLINSFRDATGADVSVCIGIDSGPVTAGVVGVSKWHYDVIGSVFDNALLMQSNATEPGVYVSNETRRFLGSTGEFELEKCPIGWKLYGHLPSPELFPVNKRFSLVTVPQAVNRVLQSIVAMNPTLKTMGTNKKRKGEKSQEKFDMQKKKVEHSTIISTLSQRFRNPGLEAEYHKETDHWFIPSLAISIFFLVVYGIYHMLVMPRLITSLALIVGALTVMFFILLMLYIDYFHTFSQFITRTSAGHAVSIILIIVILFVCGIVNTFSCPQPNAPDVCQKAHFSTYSFAMWTITTAVFVRFPSVYLAILLIISLLTYGLQIYVTRPDEFGPREFMTELDLSCFLISLVSMVFLHSRRCERLLRLDFLAVVKGIEETSMKDKLINLNNQMLLNLVPAHVAPGVIQKAGDVWHHSHQSVGIAYIAVSGFDLEGEAGINGLNYVFSHFDQAIANYKGVEKVKSANRFYIVAVGLLPDAAQNVNETPWTIGELMSTLAHFIISISQFAMENEFHVQIGVDCGSTLAFVANTDQPRYEIFGETLDRSRTLMQAAGHDTTLVSEEVFLALRPRPLRFSSQPVKVAMNLNAYELVTGLRDVSVDIPTMPREEQERHTQGMVEAQFANQSRMYDTQTSEVGFFIF

SEQ ID NO: 5674 - protein, 805 aa, Caenorhabditis elegans; identical to SEQ ID NO: 5673

SEQ ID NO: 5675 - protein, 1469 aa, Caenorhabditis elegans
MQPFKRRALTSDDDRPYADTDSMPEVDLDVDRRRQYMEQLNIFDDVSSGAYMLELEAAENGVKYDEKEDLLNVQIPPKYEDQISDPDGNRMIILNIYVENFKSYAGKHILGPFHKNLTMILGPNGSGKSNVIDALLFVFGFKAGKIRTKKLSALINSGGNYESCSVTIMFQMVKDMPVENYDKYEVLTDNCVCITRTINRENNSKYRIDDKDASQKDVQELLLRAGIDMTHNRFLILQGEVEAIALMKPTSKNPNEEGMLEYIEDIVGTNRFVAPISKLMHRVSLLEHKSSQYGASVRRHEGHLKVFEKAMVIGMAYLNTFNNLNYLRGIRVKHNLCRYAETMRDAKMSLVTRTGELEENKDIMLEAKDEVRKKETHERSLNSIVTELENKRIDWQSKKNDWHARDAKRKQGLKSCTQDLGKLMKERDEARREKFEIETAPENARISKQNMQLEWDQLKEQENVCQRTATENLIKYDQKSSADRAKHDDLEKKLSDELLQSMRAKAELDVSESELKDMTIMMEQGQKRVDELKGTLQTMMAENIRDNTELNAVTTELQDRKLKFDKAVEKLPHLKSTEQLLRSKKYELDQEVIEASNTQEVTYRHQATAKLHELKEAGLFPGFKGRLGDLASIPIKFDTAISTVFFAQLDYHVVQTSDECRIGIGFCHEYKLPRTTFVFLDHLKDTDTSGMDSTMKFPAERLFDKIHCVNPEIRREFYFLIHDILVVDSLEEATRIDKKYPGRHRYCTLNGSILNRSGALTGGGKPTTGRIRNDNNPNMSGVKKVDLSKLRAAQEKHNHALEAHLKLQLKQEEIRADNGPIIKQLEIRKRELIMSTKEQKTRIAELKSSIAAHERRMVNYREVTVEDLDEKRAQIADLKRQVEESQKSSAKIKQQIEQYKRKMDRMFMELVQKNKDSIEQAKDRMGQLEQDIARQTAIIENNPSHLEQAEKKLSELEHMCLEKRSEADALAQLEVGEDVKGIDIINAQLQTSTASIDAQRARYTEAVAARREADAAYQTTVDNYNMVKQTYDELMRIIDDLENKTMADNAELDIIESAWMQPEKLYPPGKFVRYNDPDIAAKMTDGHVVLPYECISMIEPHREAYEEHEARMLEDDVFEDTANKICKLEKDVDKFRREFDNKGVRDYAMIVSLLMNEVTSAKKFSDKLKAHREKLNELRMARFNEFSEALAFLGTTTQMLYQLITNGGDASLKFVEEGKSTDPFDGGIKFSVRPAKKSWKLIENLSGGEKTLASLCFVFAMHHYRPTPLYVMDEIDAALDLNNVSLIANYIKHSERTRNAQFIIISLRNQMFEVGNRLLGIYKIDGKTYNIMVDPIAVEIKNRPILKIFEEEIKRREKLRRAEIEPEIDLSNGLSNVVIAPKRKQRRLEMLKLSDFGLDDDSDLPEFNRFPPATRRELSVEDSDEDDEPVRRRPRRQVEEEDEEDELIEEATPSPPPIVVQRRVRRSRH

SEQ ID NO: 5676 - protein, 536 aa, Caenorhabditis elegans
MWLKHPFVELTVKMIEPQIIVRGHARIFFIEHLIHPILEFLTIKGVVNYGAFDFRIDPLNGMRPKIAIIGAGISGISTARHLKHLGIDAVLFEAKDRFGGRMMDDQSLGVSVGKGAQIIVGNINNPITLLCEQIGIKYRNSNFFCPLIDENGRCFTLERKELDDQVDLHYNNVLDAIRNKYQSDRNFPDVPLEVTNFRHFTEMFSKMSSGLLSAADLDSLYTPEFEKLLDFHLGNLEFSCGTHVSNLSAKDYDHNEKFGNFAGEHAVITDGAQRIIDFLATGLDIRLNCPVKCIDWGRDDRKVKIFFENAEQAAEEFDKVVITTSLSVLKSNHSKMFVPPLPIEKQKAIDDLGAGLIEKIAVKFDRRFWDTVDADGLRTEYFGKVSDCKTDRSLFNIFYDFSGKDPNGEDTFVLMSYVTAEHVNLVNVLTESEVADKFCATLRKMFPSAVINPLGHMMSHWGADRFVGMSYTFVPFGSDGDATYNQLKKSIDEKLYFAGEHTIAAEPQTMAGAYISGLREAGQIVMSLKRDSATFE

SEQ ID NO: 5677 - protein, 510 aa, Caenorhabditis elegans
MALLILSSLVISIFTFFIYIILARRERFKLREKIGLSGPEPHWFLGNLKQTAERKEKLGYDDANRWFNELHEQYGETFGIYYGSQMNIVISNEKDIKEVFIKNFSNFSDRSVPSIYEANQLTASLLMNSYSSGWKHTRSAIAPIFSTGKMKAMQETINSKVDLFLDILREKASSGQKWDIYDDFQGLTLDVIGKCAFAIDSNCQRDRNDVFYHPVTVKITINNFTYFHSSSPGTFHFLESTLQIHTTGRCRNSTCRRTVKCVGFRQDKAKFCSDYERRRGGEGSDSVDLLKLLLNREDDKSKPMTKQEVIENCFAFLLAGYETTSTAMTYCSYLLSKYPNVQQKLYEEIMEAKENGGLTYDSIHNMKYLDCVYKETLRFYPPHFSFIRRLCREDITIRGQFYPKGAIVVCLPHTVHRNPENWDSPEEFHPERFENWEEKSSSLKWIPFGVGPRYCVGMRFAEMEFKTTIVKLLDTFELKQFEGEADLIPDCNGVIMRPNDPVRLHLKPRN

SEQ ID NO: 5678 - protein, 522 aa, Caenorhabditis elegans
MALLILTSILILLVSFIIYILFARREQFKLREKIGLTGPEPHWFMGNLKQIVDRKEKLGYDDSNKWFNELHKQYGETFGIYFGAQMNIVLSNEEDIKEVFIKNFSNFSDRIVPPIFDSNQLNQSLLQNTYATGWKHTRSAIAPIFSTGKMKAMQETIHSKVDLFLDILREKASSGQKWDIYEDFQGLTLDVIGKCAFAIDSNCQRDRNDVFYVNARKFIANIDIRHSKVIAASFILPELAPLWRALYKYTPLADAEIPLVEGLSNVTPFLLENFCSFSLILTKIFSYERRRGGEGSDSVDLLKLLLNREDDKSKPMTKQEVIENCFAFLLAGYETTSTAMTYCSYLLSKYPNVQQKLYEEIMEAKENGGLTYDSIHNMKYLDYVYKETLRCYPPVIHFINRRCLADITIRGQFYPKGSVVTCLPHTVHLNPENWDSPEEFHPERFENWEEKSSSLKWIPFGVGPRYCVGMRFAEMEFKTTIVKLLDTFELKQFKGEADLIPDCNGVIMRPKDPVRLLLKPRN

SEQ ID NO: 5679 - protein, 475 aa, Caenorhabditis elegans
MAFLILTSILVSLVSFIIYVILARKERFRLRGKIGLSGPEPHWLMGNLKQIIERKAKLGYDDSYDWYNKLHKQFGETFGIYFGTQLNINITNEEDIKEVFIKNFSNFSDRTPPPIIEDNKLKESLLQNTYESGWKHTRSAIAPIFSTGKMKAMHETIHSKVDLFLEILKEKASSGQKWDIYDDFQGLTLDVIGKCAFAIDSNCQRDRNDVFYVNARKFITNIDIRHSKIISTSFLFPELSKLWKVLYRFTDLAKAEIPLVEGLADVYERRRGGEGSDSVDLLKLLLNREDDKSKPMTKQEVIENCFAFLLAGYETTSTAMTYCSYLLSKYPNVQQKLYEEIMEAKENGGLTYDSIHNMKYLDYVYKETLRCYPPVIHFSNRRCLKDITIRGQFYPKGAINWEEKSSSLKWIPFGVGPRYCVGMRFAEMEFKTTIAKLLDTFELKQFEGEADLIPDCNGVIMRPKDPVRLHLKPRN

SEQ ID NO: 5680 - protein, 680 aa, Caenorhabditis elegans
MSDVRVKFNLANDGEGLDEDIFLPPAPLLAGAHCAGLQSYHDLYRSSINDADEFWRTVSSELHFEQGTSKGLEWNFDSKAGNVFVKFMDGAKTNISYNCLERNIKRGYGNKIAYIFEGNEPTDTSTWTYNELHAQVVQFSAVLRSHGVKRGDVVALYLPMIPELAVAMLACARIGAMHSVVFAGFSAESLAARVVDARCRVLVTADGVFRGAKPIGLKSIADAAAVLASQEDVKVEAIIMVEHLKRVTKPDGVELPKVDYTDITVIYDSEMLKCAGVDSPVEWMDSEDPLFILYTSGSTGKPKGIQHTTAGYMTYAYATTKYTFDAQEDDVYWCTADCGWITGHSYLLYGPLMNGLKGIWYEGVPTYPTPSRMWDVTDKYGVTKLYTSPTAARALMALGNQWLESSSRKTLKVIGTVGEPINPAAWMWLYKQVGLSNVSIVDTYWQTETGGHMITCLPGATPMKPGAAAMPFFGASPVLLDAEGRVIEGPGEGSLCFDRAWPGMMRGIYGDEQRFVKTYLAPFNGYYFTGDGARRDEDGYLWITGRVDDLMNVSGHLLSTAEIESALVAHEKVAEAAVVAAPHDIKGSFPYAFVTLNVGERINEKLVAELKKLVREKIGALAVPDVIQEAPGLPKTRSGKVTRRILRKIAEGSESGIGDTTTLVDESVIKQLISGRSARA

SEQ ID NO: 5681 - protein, 809 aa, Caenorhabditis elegans
MPPSTSLLLLAALLPFALPASDWKTGEVTGKVVEKSEFPCYSLSRDNYTCSACIQYHESCAWCGAPMFDEKKPYARCDSRAKLMEHGCPNSYIEDPATKLDITEDSKLSDQGQVESEEEAVQIKPQEMYVEIRPKSRVRFNVTYRQAVDYPVDLYYLMDLSYSMKDDKQKLSELGDLLAERMRTVTKNFRLGFGSFIDKKLMPFIDPRIEKQLSPCPTPCAEPYGFKHQMSLTTNTAKFKAEVDKAEISGNLDAPEGGFDAVVQALACNKTIGWRERARKMIVFSTDAGFHFAGDGRLAGVVEPNDGTCHLDREGYYTETLNQDYPSIALLHQMIKDRKANVIFAVTKNNQDLYTQLSNALPDVSSSVGVLANDSRNIVDLIEKEYLKISEKIIMVDNANASEGLKLTYRSMCLDGTTLKDTNVCEGIRVGDEVQFEVTLENTHCIDKRDFVLRIGPSGLDETLIVNVKVLCDCDCERQDRIVTNSADCNGGDMVCGVCRCKGGNVGKYCECNRPGMSTAALNEKCKRTNESAICEGRGVCNCGRCECNPRANPEEQISGEFCECDNFNCPRHDRKICAEHGECNCGKCICAPGWTGRACECPISTDSCLSANGKICNGKGECICGRCRCFDSPDGNRYSGAKCEICPTCPTKCVEYKNCVMCQQWQTGPLNETACDQCEFKVIPVEELPNLNETTPCQFVDPADDCTFYYLYYYDEATDNATVWVRKHKDCPPPVPVLAIVLGVIAGIVILGILLLLLWKLLTVLHDRSEYATFNNERLMAKWDTNENPIYKQATTTFKNPVYAGKAN

SEQ ID NO: 5682 - protein, 352 aa, Caenorhabditis elegans
MSKQNNFRRYNPLIDEWVIVAVNRINRPWQGAKTEKSTTISTSSNTEQSILNPLAPGGTRSSGIANENYVSTYVFDNDFPSFTEFEECAGKDENDDLFKQHEVKGVCKVICYHPNSQLTLATMDVKEVRVVIDIWNQQYLELGPKYEWVQIFENRGAVVGCSNMHPHGQLWASNYLPTLPMKKHESQKKHFEKHGKVMLMDYLEQETLKKERIIMRNEHWTWLVPYWAFWPYETMLLPNRHVERFTDLGEVEKQSLSEILRSLLIKYDNVFECSFPYMMGWSGAPTGSFLTENCSFWQLHLSFFPPLLRSATVPKFLAGYEVFAEKQRDLSPEIAAKTLSEIDEEHYSKKLQ

SEQ ID NO: 5683 - protein, 450 aa, Caenorhabditis elegans
MREIVHVQAGQCGNQIGSKFWEVISDEHGIQPDGTFKGETDLQLERIDVYYNEANNGKYVPRAVLVDLEPGTMDSVRSGPFGQLFRPDNFVFGQSGAGNNWAKGHYTEGAELVDNVLDVIRKEAEGCDCLQGFQLTHSLGGGTGSGMGTLLISKIREEYPDRIMSSFSVVPSPKVSDTVVEPYNATLSVHQLVENTDETYCIDNEALYDICYRTLKLTNPTYGDLNHLVSLTMSGVTTCLRFPGQLNADLRKLAVNMVPFPRLHFFMPGFAPLSAKGTQAYRALTVAELTQQMFDAKNMMAACDPRHGRYLTVAAMFRGRMSMREVDEQMLNVQNKNSSYFVEWIPNNVKTAVCDIPPRGLKMAATFVGNSTAIQELFKRISEQFTAMFRRKAFLHWYTGEGMDEMEFTEAESNMNDLISEYQQYQEATAEDDVDGYAEGEAGETYESEQ

SEQ ID NO: 5684 - protein, 1017 aa, Caenorhabditis elegans
MSYGGHDPNGYGVEDLVLLSTIDLKSVVQNLQLRFQKGRIYTYIGEVLVAVNPYRQLGIYEKSTVDQYKGREIYERAPHVFAIADAAYRSMKRFGRDSCIVISGESGAGKTETSKIIMKYLAAITNVRQQGEIERVKNVLLRSNCILEAFGCAKTTRNDNSSRFGKYMHINFDYDGDPVGGNISNYLLEKSRVVRQQEGERNFHVFYQLVNGGDDGLLRQFGLTKDAKQYYFLNQGQSHKVASINDSRDFAEVQTALRSIHTFDKQDVESMWSVIAGLIHLGNVRFIDGENSSGAVHIAEKAALQNAARCLNVTPDELAKSLSSQVVAAHGDIVKKQHDVNAAYYTRDALAKALYERLFSWMVSKVNEAISVQNSSRYSKSHVIGVLDIYGFEIFGTNSFEQLCINYCNEKLQQLFIELVLKQEQEEYEREGIKWVKIEYFNNKVICDLVEIPRTGILSILDEACASIGNVTDKVFLGELDKKLKSHKHYTSRNLKQSDKSMGFEEFKITHYAGDVTYSVMGFMDKNKDTLFQDLKRLLYHSKNRLVKSLFPDGSKSMAEVNRRPPTAGFLFKNSMSELVKQLAQKEPHYIRCIKPNEEKNSNVFDLERVEHQVRYLGLLENVRVRRAGFAHRMPYDRFVNRYKLICASTWPNPRRGQQLKDSCMQILESAGLAQDCVQGRTKIFIRSPQTVFRLEELRTEQLPNVITFLQKMVRGVQQRERYRRMLAVRKIIGAYRRYKLKSYIWQLINAFRDVRRMRDLGKSIRWPAPPLVLAQFVSRLRVMHQRWRAATILARMPPHLRASLPQKIAAFEVLNNKKENWGYTRMWRGDYLSQQEELELPTTVSTYHDGIQALRQSHPFGKVLFSTYVQKFNKFNKSSLRVLIVTDRFVAKLENKKFKLLKEPIPLQSISRISVCAESNGLFVIHVGDNDIVGCAKNTKNEERVGEMIGTLLAHYDKITMRRSPVLIQSAVVCTLGGKTRTIRVFDAENNNVPPVFKKNGNDVDLICHQLTAQVA

SEQ ID NO: 5685 - protein, 341 aa, Caenorhabditis elegans
MAGVMSVKDFIVATKYKLIRKIGSGSFGDIYVSINVTNGEEVAIKLESNRARHPQLLYESKVYRILQGGVGIPHIRWYGTEREYNVLVMDLLGPSLEDLFNFCSRRFTMKTVLMLADQMIGRIEYVHVKNFIHRDIKPDNFLMGIGRHCNKLFLIDFGLAKKYRDSRTRTHIPYREDKNLTGTARYASINAHLGIEQSRRDDMESLGYVLMYFNRGTLPWQGLKAATKKQKYEKISEKKMTTSVEHLCKGFPAEFPMYLSYTRGLRFDESPDYMYLRQLFRILFRTLNHQYDYTFDWTMLKQKAQQSQSSGVPGTNTTTQGATVPSAGVPAGVAPGGTTPQ

SEQ ID NO: 5686 - protein, 381 aa, Caenorhabditis elegans
MTLTEIQNVEKENAGASVPKHSSNKLKLEKELEKLEIVDQTKAASAEETNNESEVNELDADEPMLQDLDNRFVIFPLKHHDIWNFYKKAVASFWTVEEVDLGKDMNDWEKMNGDEQYFISRILAFFAASDGIVNENLCERFSNEVQVSEARFFYGFQIAIENIHSEMYSKLIETYIRDETERNTLFNAVDEFEFIKKKADWALRWISDKKASFAERLIAFAAVEGIFFSGSFASIFWLKKRGLMPGLTHSNELISRDEGLHRDFACLLYSKLQKKLTQQRIYDIIKDAVAIEQEFLTEALPVDMIGMNCRLMSQYIEFVADHLLVELGCDKLYKSKNPFDFMENISIDGKTNFFEKRVSEYQRPGVMVNEAERQFDLEADF

SEQ ID NO: 5687 - protein, 610 aa, Caenorhabditis elegans
MPFDLLAERKRWNAGYESIDTSSQKLTEVVTPITVTWENIEVKTRKKLFSKKQKQLLNRVSGIAKPGEMVALMGASGAGKTTLMNVLMCRNMKGLEKNGTVKVNGTKIGKEISLISGFAQQQEIFIPTLTVDEYLMIQARLRMKANKHTRRERVDEIIEMLRLQNCRDLKIGTPGLVKGISGGEARRLTFACELLSNPSLLFADEPTSGLDSFMAASVVQILKNLANSGRTLIHQPTAELFFQFDKIIFLSMGKTAFMGTPHESVKFFADCGHPIPKLFNPPEWIQSKLSVIPNNETKSRETIGKIIEFYEKSIIHQKSIVEIRVIATTELPPYIENPGFFAETGALLKRACLDVIRSPAQMRMKLIQKVVMGLFIGSLYWQQPLDPRGVRNTNSALYFLIAELTFSTMFGIMTFMEHELPLIAREYHDGLFYVISYYISRFLSYLPLFTIDGALMIVISYWMIGLNSTWQQVAKSILISVLVEQSATSCGLFLACLFETTSLAIAFAVPASGLFALLSGLYGNTNNFPVYIRWMQWTSWCRYGFEGLVVNQWSQVDNPKWDPFYRELILKQFSFNKDNYQLDVIGLCSIVIFFYLAGYIALFIRIRLSR

SEQ ID NO: 5688 - protein, 328 aa, Caenorhabditis elegans
MPSPCESGKTTNCSGAPSSSCVTPLDVVKIRLQQQTRPFPKGECFYYHNGLMEHVCVSCEVRKPCEWYQRPGNFRGTADAIVKIARHEGIRSLWSGLSPTMVMALPATVFYFTTYDNLSVWLKKKMCCRRAFSPEKWTPPDWSAAAVAGIVARTIAVTVVSPIEMIRTKMQSKRLTYHEIGHLVRSSMATKGISSFYLGWTPTMLRDIPFSGIYWAGYDLFKTNLQRRQGPDHNPFVVSFVSGAAAGVVASIFTHPFDVIKTNCQIRIGGSIDDMNKSITTVIKDMYHSRGISAFSSGLVPRLVKVSPSCAIMISFYEYFKFLFQKNH

SEQ ID NO: 5689 - protein, 376 aa, Caenorhabditis elegans
MADGEAVISTVNNVEEVHGQLFEVAPRYVNLSYIGEGAYGMVASALDTITRDRVAIKKISPFEHQTFCQRTLREIKILNRFKHENIINIQEIIRSETVDSLKDIYIVQCLMETDLYKLLKTQKLSNDHVCYFLYQILRGLKYIHSANVLHRDLKPSNLLLNTTCDLKICDFGLARVTDPQTDHTGFLTEYVATRWYRAPEIMLNSKGYTKSIDVWSVGCILAEMLSNRPLFPGKHYLDQLNLILAVVGSPSNADLQCIINDKARSYLISLPHKPKQPWARLYPGADPRALDLLDKMLTFNPHNRIDIEQALAHPYLEQYYDPGDEPVCEEPFTLEMEFDDLPKEKLKELIWEEAEAHHRRMEAEAAARNNGGQNPV

SEQ ID NO: 5690 - protein, 759 aa, Caenorhabditis elegans
MSNLDNPGIYYQERFFANDGVPDTGRELIAEYRQLITQFRNFIRDFSTGGFGMIYRDQLKRNYFSHEYRLEINLNHLKNFDEDIEMKLRKFPGKVLPALEEAAKIVADEITTPRPKGEEKLHDIQVTLTLDEYPTSLRQVKSAQVSQVVKISGIIVAAAQVRSKATKVTLQCRQCKHTIPDVSIKPGLEGFALPRTCAAPQQGQMQRCPIDPYIMLPDKCECVDYQTLKLQENPEDVPHGEMPRHLQLFTERYLTDKVVPGNRVTIVGVYSIKKLIQKKGGDKSLQGIRTPYLRVLGIHMETSGPGRTNFTTFTPEEERMFKTLAQRKDAYELIAKSIAPSIYGSADIKKSIACLLFGGARKKLPDGITRRGDINVLLLGDPGTAKSQLLKFVEQVSPIGVYTSGKGSSAAGLTASVIRDPQSRSFIMEGGAMVLADGGVVCIDEFDKMREDDRVAIHEAMEQQTISIAKAGITTTLNSRCSVLAAANSVYGRWDESRGDDNIDFMPTILSRFDMIYIVKDTHDVLKDATLAKHVIEVHVNASAAKERDIAGVPKTATTDSDGVMTMFDTDGFLTIEFLKKFVTYARLNCGPRLTPQASEKLVNHYVKMRNPVVNADAFKSGKKAHNSAIPITVRQLEAIVRIAESIAKMELQQFATDKHVEEALRLFRVSTIEAAATGNLAGVEGFTSTADQEALNRIEVQMKKRFAIGTHVSEHLIVQDFVARQHYRESLVKKVIDNLVRRGDLQQKMQRKMLYRVR

SEQ ID NO: 5691 - protein, 259 aa, Caenorhabditis elegans
MRKDMIAPVDTMGCHKLADPLAAPPVHRFQVLVALMLSSQTRDEVNAAAMKRLKDHGLSIGKILEFKVPDLETILCPVGFYKRKAVYLQKTAKILKDDFSGDIPDSLDGLCALPGVGPKMANLVMQIAWGECVGIAVDTHVHRISNRLGWIKTSTPEKTQKALEILLPKSEWQPINHLLVGFGQMQCQPVRPKCGTCLCRFTCPSSTAKNVKSETEETSTSIEVKQEVEDEFEDEKPAKKIKKTRKTRTKIEVKTESET

SEQ ID NO: 5692 - protein, 372 aa, Caenorhabditis elegans
MLDQIGEGTYGQVYKAVNNLTGEQVALKRVRLENEKEGFPITAIREIKILRQLHHKNIVRLMDIVIDDISMDELKRTRANFYLVFEYVDHDLIGLLESKELVDFNKDQICSLFKQLLEGLAYIHNTGFLHRDIKCSNILVNNKGELKIADLGLARLWEKESRLYTNRVITLWYRPPELLLGDERYGPAIDVWSTGCMLGELFTRKPLFNGNNEFGQLELISKVCGSPNVDNWPELTELVGWNTFRMKRTYQRRIREEFEHIMPREAVDLLDKMLTLNPEKRISAKEALNHPWIRSLEHTTVQPLKLPQHQDCHEMWSKKQKKSARLGRQAEGSSGSGHSIRATSHPRGKAGDELEEIKISDFIFQFSENKVN

SEQ ID NO: 5693 - protein, 317 aa, Caenorhabditis elegans
MFHVTSSTSATPYLLRIHRQGPSHVFMDTVNFAIFSERGLGPKLYGFFDGGRMEEFLPSRTLDSDCILDPEISRRVGAVYPKYHAIDVPVSKKRRCFQVMRESLKEYQDLGGGDYEIKPTTVTYSEHPKKISMDDLYKEIDFMEKWTNELFEDTVVFCHNDLASSNILELNSTKELVLIDWEFGSYNCRGFDLAMHLAETAADFRDSTPPGIRISEELTDNPPNLQGFCEAYVDADNKLKNRVPSNRDLEVSNLICECQFFWPITQLFWACFVMKLALLKYNCGVDMDVQAQDRFAVYWHLKERTRKIYEDLKKGTC

SEQ ID NO: 5694 - protein, 728 aa, Caenorhabditis elegans
MPPKKVSPGITVILIDAGSNMSVKDTETGKSAFENAINAADWIVSRKLFSKDPELFSVMAYNLDPKEYKTEVGGQTFNGVQCQNEKFTPASFDHLKFITKELQQNTEMIDPNFFKGVLGAVAVLKDQIESYPNPSGITLIVLTNGLNENIRQENFDLLVEAVSESNADLMIIGIDENPEYPASRVAELAETLEGRTYTFQNVAKMLSTFQARQKSERKYNKMWDIAPGIHLPVIFALKSEKSTALLKFKNADSEGNEMVRLEQMHVETDEVAPKDEFKSPVLEEKPKFQKNFKPVENIKTMHGSEILNFLKSIINASGYNFGKSVIMMDPEYLKEKYNDHNFNEGQTGGVLKLIQFTKRANILDSYLLDASAKTVLPALNSPKSGATKATVSLIEAMLSLRVAAICRYTFHAKSHVQLIALLPHQDEETGVFYLRSVKLPFSDDMRTLKFPKFSFDEEDEDLNKPTVAQLSAVDDLIDCMQLQEDEISSLVEGGMSDPKLQMQCHFLKSLVLHPNDTFENHSNRTNQILDQIMAPKRRVEAEHPEIFQKLGREFNLQPIQKTKRERVTVEPEDLQTMISEWTEKKQNMTQPDEVDDGASQKKKKKPNAKKLTRKEEVQMDIMEDGGASRVCSKILEMISNTCKFQPNGAVTEFFTLLVNELNVIRSVFVENSKCDEFNELLKKLKDEEDFEPFAEVLSEEKSCNPIDSSEVSMSEVSVANAAEFWEED

SEQ ID NO: 5695 - protein, 317 aa, Caenorhabditis elegans
MATAKIHFKPYFDEVAASEQLEKALRNKEKLKILEILVSVNNTQRQMIRTPYKTRYGKDLEDEIKKAFSGDFEDFLVALLQTPTKLDVTELNRSVKGLGTNEKNLIEILTTRTNEEIEAAKNTYFMTYSKSLEDAISADTSGDFRRLLIVILQAKREEGGFADTFKVGPHAAQILKSFDKKSGVEKFDAFKIFATCNGAHIQKVIEEVERQSGKEFQKLIDKELSGDFKNLVLSLIETSRNKPRYFANSIHLATKGMGTRDKDLIRILVSRSENDLVIIEHEFQTLFGKPLTQLIKEECKAEYRDGLTMLVKGNPRP

SEQ ID NO: 5696 - protein, 542 aa, Caenorhabditis elegans
MAQSSAQLLFDESGQPFIVMREQENQKRITGVEAVKSHILAARAVANTLRTSLGPRGLDKMLVSPDGDVTITNDGATIMEKMDVQHHVAKLMVELSKSQDHEIGDGTTGVVVLAGALLEEAEKLIDRGIHPIKIADGFDLACKKALETLDSISDKFPVENRERLVETAQTSLGSKIVNRSLRQFAEIAVDAVLSVADIESKDVNFEMIKMEGKVGGRLEDTILVKGIVIDKTMSHPQMPKELKNAKVAILTCPFEPPKPKTKHKLDITSTEDFKALRDYERETFETMIRQVKESGATLAICQWGFDDEANHLLQANDLPAVRWVGGPEIELLAIATNARIVPRFSELSKEKLGTAGLVREITFGAAKDRMLSIEQCPNNKAVTIFVRGGNKMIIDEAKRALHDALCVIRNLVRDSRIVYGGGSAELAAAIQVAKEADRIDGIEQYAFRAFADALESIPMALAENSGLAPIDALSDLKAKQIETGKSSLGIDAVFAGTNDMKEQKVIETLLSKREQISLATQVVRMILKIDDVRVPDDERMGY

SEQ ID NO: 5697 - protein, 542 aa, Caenorhabditis elegans; identical to SEQ ID NO: 5696

SEQ ID NO: 5698 - protein, 4307 aa, Caenorhabditis elegans
MKKHRVFHLFLLIFCKAISLVTTSSSTEQIFEFTAPLYNLSVEENSIGSKYARSENSTKIGVPLPEKDANCKFRVAEIVGEKSSLFKAHSRQVGDFVFLRIRYKGDNPLNRELKDFYDILVKAMCKRRDLSNLETTARIHLRVIDRNDASPVFLVGEQGYEAEIDDDLEPFSTVLRVEASDADIGINSAIYFSLVNRSHDFIVEPVTGWVRSLRHVKPGKYSLKVKSEDRASRLYYFDENEVQPSWTADVLITVRETKPKPRRILVDQRKINPNILNNRQLAAIITLKDSPNDAIVGLKGNEKEHWFEVEPEVVGNDGTKELRWMLYAKNGSQVPKNTNVTLTIGEDYIRRSGFSISKKPVIPTNETVTIQIERLAEHLIRFLDNEKLTLKTDEMAPIGRILYRMNVNVENPDDVSLIRYSLEYSKSDLPNATLPFAIGSKNGILRVSAKINRSERVYNFKVIASLHGINEKLAEKDVSIEILDSNDHAPVFSAKWMRQTPIVIGKPGDVLVKVDATDQDEGENGKIVYKFTSELPLEINANTGEITLVEVPKKGNSWPATVWAIDLGLPLSRMSALNLMFYKNGTKIPAKPKPIIIQESENKHSPVFSSFPEIVEVTEDAPIGTVVAKLQANDEDTGYNGFIRYVIHDIAGSSHEVLTVDEQSGEITVASDLSKLMKEKLEVLDVQVHYIKHVTSNISNFQLKVSAIDAGTPVKSSVKTMKLRIKDVNNHSPQFDEVSYYLRISENEKPGKDIFKVTANDFDGGNNGKIKFSLGNNQEKSSVISIDAKTGIVKLLKSLDREDQDVHTFAIIASDEGFPMRVSVTNLTISVEDVNDNPPKCVVQHSRARIPEDLPHGAFVSCMAAFDEDIGQNSKLKFLLNSEKVPFRIDHHSGCIFIHAPEYPLDYHKTPFFNLSIEVADHGDPILSTSCHLHVELVDIAHNHLAIEFDDVAKEASVYENSEIGTEVIMIEAKETGDEQKVKAENLEYRIIGGDGWPHFSIDQKGTVRTTHLLDRETKSAYWITVEARDSKTDLYKDPRRRDVLHVFIRILDRNDHRPVAKKPMYIASVAENSPANVVIVKVEATDADDVDNDAAAPLMFKIERGDPQSFFRIDLTSGYITTSGIRRLDREKQSEHELWVSICDGGEPQLCSNVIVIVNVLDENDNSPTFTQAIHHYSVRSKFAGKLCRIFAVDADEGENARLTYNITEGDARFSIDNNGNIIASEAIHGDESYALTVQATDHGTPGQQFAATRVVLTANSAGQKPRKSKNSPPEISGKKSDYVIPISDADQVGLTVGKLEASDADGDELWWSISSGDPDSVFDVRQDTGQLLLAKKVELLKRGELRLNISVTDGQAWDHSTVIIQVSRQISQRPKFSASHYQTDVSERVAVGTQIYTLKASGESLGTKPLVFNLFSVDDVAMEDKIRVEPSSGNVIVMEPLDYEAARRIRAVVQVQQANMKSFATFSVNINDENDNSPYFVGHTAFAFVDESDTVDDVLATVTAFDKDRGENGIVTYSIVSGNEESLFKIDAKSGEVRLAKPLDPELQHVESILRIRAIDSAANSLKDEMSLHIRNSNEAPETAKFDRKVYQTTLYDSTRPGTPVLVLNALHHGTVSYKLEPNCTFFEVHTLSGAVHLATWLTKLKHRKSVECTAIVESTEGQQDIAKVIAKIIRTNQHSPIFRRQVYRGTIRENMPTGSSVLSKSLLPLVVSAIDEDPGSNGLVGYRMLSPKDEQMFSVDQYSGAIRTQMSFDFEKMKEYSFYVQAFDMGQPPRRSLMPSLIVVTVIDENDEPPRFPSNSLDISMILPTANGVSVGGQTAQDMDSVGSLRYFIKDQSVPFSVDSKTGDVLVKDSNGISDMTKLFDLEVFVTDGKQSASYVMKISTISTENSKFKFTRNEYHTSLIENTTLPPGSIILSVATIGDKLDHFSIVNPHEAFFIHPGTGVISSSGIALDREKSAIIRLVVQAKSHEKNPVMARALVVVGIENINDETPIFMGTPYDITIGHSDIGTVVLEPKVIDNDEGDVVTISSENMPEYFKIVGGKVVLGKKLPSIEEEDLEFNFKLIAKDNGSVHRVEEPVKIRVVDKARPVFSQNVYTAVISKESTKKSTVLVKVMAKSSLQSKSKGLIGYRILDKKSPFSVDFLTGEVRLNNLKMLAETNYTFEVEAREVTRPKMIAKAQVEIIVKSGITTHAPVFEKLKYTASTPESTSIGQRLLTIKATTSDENDTIEYSLSGSKDIEIHPETGDVTITGQLDYEKTQKYDLKLVATSSGKQVSSEAEFIVLIEDVNDEMPEFIRSDVSAKISDSAITGQFITIMSATDMDTTNSLDEESQKLLYKIVDGDETLFNISPATGELSLARPVEQDDLVNEDTKKVLNVSVTDGIIVNKSALLTVAVKGGVPPLQFSLAPTTSSNSSTSKEAWPVAIDRKTGRIHVSRVLNYHRDKRYQIPLVVEDATGRRAFSTLTLSVIDINDKPPFFVLPFYSTSISESAKEGDTVMMVSATDDDENDTIEYSLLDGSESQFFSVHPRQGTITVAKKLEHKAGVTLSLTIKATDSANPPHHATTTVEVNIASESVKVPRFSNSHYLFSVMEDADVGNVIGRVQQMETEIDEIRFTIVPGSEESDSFLPFSVERSTGKIIVKSSLDRERKNQWKMTIRADAAGGVHAITTVTVDIGDVNDNAPAFHGDYERFTISEDAAVGTSVTIFSAMDRDDSPSGRIRFSLVEENPYFDLNENSGWLTVASQLDREKIDHYKLIARATDEGGFNTDLPFTIVVSDVNDSPPQFEKEEFNIDLHLPSTSPILHFSIKDDDLSPNNVSQFFIPKGNEEGVFWIDSNNDLLLKRPEIVENKMQYQLKVTAFDGVFETSTKVKINLKSSKDSDIRCPEANKTVILAENSKKGTVVLGESSLLGPNVTFKLSDNDGNVFVVNFRNGIVKVKESDQIDYEKNQQLEFHRLTIQDNSEVCKELITVVIENLNDNRPKIIEKLLKVSIDENLPTSEDARQYITRIVAEDADFDEIKFRMVDDFGGLFQIDDINGVVTVVKPLDSEILGFFNLTVVASDGEFEDKATILVTVIDQNDNAPTFEKSTYSMKVMESESIGYELAHFRASGGDQNETIEYYLKPSDVTSFVNLNAQTGILTLAKPLDFETLSALKLTVVAKDSGVPPLETEAQVEISVMDENDNAPKFEKEKYVGKVKENSKSGEKVLTVKALDVDSEHFGAVSYELEIVSETTTDTPVLPFAINSNGDVLISQSIDYEKIKKYNLKVIAKDGGRPPLRSEALLEIHVEDENDHAPTFDDCNMTALVQEGEAIGHRLLKFSVSDLDGPKNGAPFTVEIQGDGAKSFKVNEKLELLTAKKLEYRKKDKYLLTVIAKDVKGKTTDCPLTIFIRQTSRHAPTMKPMKIQINTLQNELPEGIIGRLKASDEDEEDQNGLLRFGLVEGSIQSPRAQVQESRSTHLFRVDPNTGDIWSDHSITQGLHTFNVTVTDSKFNTVSYVEVHVTSIDNDVIDHAVSIRIRSMSVDEFMRKHVKEFRRIISHHLNLNDDSSIQLISVQAVPSTESERRSRRNSMEDVEILMTAQRGLGRGYLKPDHIYSRLKNDFQNMNDQSQRMRYQLITEMCTTGVCLRGECREVIELIEDSWTKVSTDDFSFVSPFHSRSAQCLCPDGFGGKRCEVETNQCAKSPCEQWQLCIPSVHNSTYECVCPLGMEGDKCSVPSCQNDGKCLEEAELSVGGDGYFEISLSNEIETRMELEIELKTTTHNGIIMWSRGKRDFHMLRLVNGTPEYHWNAGTGTGIVTSKTSVVDGQWHRIAISRRQRRTRMTVDDEDLQEAFSPIGSTVINLHRYSQKLVLGAKVDDGELTDGVSACFRTISVDGMKVLKTRQGMKLFGAQPGCSALTSSPCNDLPCQHAGTCISQGKSHFKCECPSRYSGNVCEIDLEPCASSPCPTGIQCIPFYNDYLCKCPNGFTGKHCEARGFEDHETSSCSKNVCGTSGQCISIPRHSLESSDFICNCTGGILQSTPCAEKSDILSTVLEFLLKAEIVIVILGVLLLLLVFCLTFITWKCCKKNRDPKYGAHCDVPHMRNTRVLVPVVPPPLPPRGFRNDSSNFISTSSVTTSHRPMVQVKPYSSDIRDSRSPSACGSSKGTRRDPLPSDKFRRVDETANRIRHSDRKDPRGDVLSSLRDSSDEWMGIDDRIDSSLKYSRAAAGTVIVGDTELMPVINDNDYMTMKPRKDKNFEREKPPAIPAHATPLESVLKLGSSSSGEEAPRNALYDDPISLDSQTFDDIDEEVNIHIS

SEQ ID NO: 5699 - protein, 4307 aa, Caenorhabditis elegans; identical to SEQ ID NO: 5698

SEQ ID NO: 5700 - protein, 4307 aa, Caenorhabditis elegans; identical to SEQ ID NO: 5698

SEQ ID NO: 5701 - protein, 380 aa, Caenorhabditis elegans
MSSNVLGHTLRSSKNVVQKAFVATSPNSDMLRFRSPVLQTNTTKLARYGGRHNVTVLPGDGIGPEMLHHVERILSAVQAPVDFEVVNLTSKEDASEDLAEAITAIKRNGVALKGNIETKFDNPSFVSRNLELRRQLNLYANVLHCSTIPTVPSRHTGIDMVIIRENTEGEYSGNEHEAVNAPHPRVVESLKVVTREKSEQITRFAFQFAKKYGRKKVTAVHKANIQKLGDGLFLKVATDIAKAEYPDIEFNAMIVDNASMQLVSRPQQFDVMLMPNLYGNIISNIACGLVGGPGLVSGMNIGEDYAVFETGTRNTGTTLAGKDLANPTAFIRAAVDMLRFLGLQSHADMISDSLFRTLVDKRIHTADIGGTSKVRISLIF

SEQ ID NO: 5702 - protein, 1549 aa, Caenorhabditis elegans
MPPKTSAAPPQSDESDSDFDDAPVKKPQKKTTKPVNRHKEGSKDPEEELQRAVNEKFDGSDGEDDDSDLFSLQLPSRPDFLTKPNRADRLMIRNVEVDNFKSYFGKASIGPFHKSFTSIIGPNGSGKSNLIDSLLFVFGFRASKIRSAKVSNLIHKSAGRNPDKCTVTIHFQRIVDIPGHYEVVKDSEFTISRTAFQNNSSSYAIDGRPATKNEVEARLRRVDIDIEHNRFLILQGEVEQIAMMKPVKTTKSETGMVEYLEDIIGTNRLEPFVKLFQRRVNRLTCDLSQQRIARDHARNSKVAMENPVRAAIEFLMKENEATTIHMKLEQRRRQRYLDKIAPKQAELDKMKEEMKSIAETLDTNKNEYKQSEEAQKVMIEERSKLDKNFDSLSKELSDLGTEETRRKEALKRHQANISKAEAEKEKEVKKRSNLEAAPEKAERKIAKCQEEVEQLLEIEKTANEEADKNLDEFEKRSEAPKEEQKKIQETWAQKSNEFNKVRGEARIAREDFEDLKKLANSGTDKLIELKKRLESSEESYAKEKDELDKLKPEFDSWNDKLKQLSTELPTLRNTARQKNQDLAKTRDRLETLRQQNSSCSSSNKVIQALMKEKEAGRIKSFHGRLGDLGVIDPKYEGAICTNFGARLNYLIVGKEEDAKNVINFLVANKLPRQTVQPLDKIKCDKRDLAPNPTNPLPAPRLIDLIDCDPVLKPAFYDMVRSAIVGDSTQEAQRMHRMPACRGVTVCTLEGSMIHPSGSFTGGGKTVKGLILTDKNKMAKQVTPEDKAAERDLAEKLGKLRDEADELKGQEHEMDGQLIEARRKVAEMSNRLSIVTSSVQSAAPAIETLKKTIANQEKEAAKVKVDAKTLEDKQKIVEELEKKRDELGEEAAKVKARQAEIQSKLDGIFKELVQCHRDEAKESLQKRQKLEKDIAKETANISNSGRNIAKCDENISRHDKDIEKMKKKCEELMEKAIDDEEVKSKKETVERFEKQIKKLQTKGEEMTKKQSELSAAETKLEGELKKCSEGIKELKESMLADRLKVEDIEKKLAALKVNRIPRFQFLIESSRPEDLEMQIDDKMPVVDENQSPEEVERQKKHMACVMSDAAYALEFEMRQKVLENTESYENVDGEDRVPVELLSDEKINEISSRDAEEMQMKLKVCEQQVEALKAKVDISSIKAYVDKVKQYNEQVIKLTIATEVHRKHNQELQRIKQMRLEEFHSAFEFIGKHLVAVFKMLTDGGDAKLEYIDKDDPFRQGISFMVRPAKKAWKQIQFLSGGEKTLSSLALIFALHMFRPTPFYVMDEIDAALDYRNVSIIAQYVRQKTENAQFIIISLRNNMFELANRLVGIYKVDGCTRNVAIDPLRVCEMAKQITDSLGQATCTLPDEVTQRFNETMSRQNKEMIAQEKQYPNFPSSNEISKAEKIVNVEGRVRKELIQTTRDVTSRPQSKATTSGDGTERPASRSASRPESRINQMKYPAPRLVERSSSQNVRSPRKARNIEADETTPPSKRSNSASTPKRSPMKPLTPSSKKKEKAIVDDDDDME

SEQ ID NO: 5703 - protein, 679 aa, Caenorhabditis elegans
MHILIILLFTSIISSIQADLCAHCDCDFISHTVVCNRPSLLIRTVSMLPTIRQLHLNSLNLPQPPHFLFHPNLRVLRMSRCGMHEIPGSTFLPLPGLEVIDLSNNHLETLPPTVLRSLKFLRVLILSNNRLSNLDQLTWILAPGVVLEQLDLSGNPIAIATSMTVFPPVRQLFLSDTRMESVNETAIMFKKLPGKCDRDVCRHIPIHNLNVSIITTIDFSSNRDLEIDSGALDVFSNATYVDLSNTRLPVGFEEWLERKSRVKSLNISHCQLPLHEDTWTACGQFLHSLDISGIGAKRLRFSRFCPIRSVFARDNLISSVYIDAVSMESLHLERNMFSEFPIPPPGVELTELHTLGLSHNLMTSLPPHALQSYPNLQHFDVSSNQLSEIDPQAFPSIGLGLISLDLSSNQLSSLPHPILPSLLLLDLSFNTISHLDPHFFTGLPMLQQLRIASNPTLFSRCPNRDSPCWSDHLDELTSLVDLDISNSGLEFSLHWRHLRTLKSLILRGNEIRIIDSKSLPENLRTLDLGENRVQFTSNFSKLEHLRLVGKNFLTSLSNNNKNSHTVPVSDLRVDQNPLRCDCSLYDIVPHLLNQSQISDPLLYYCFSGSWQYPLLPYLASVKPCVDTTRNFYSILITTFIIAFAIVAGLIGGFLVYRKYADRANFVYKRISLMESPVRL

SEQ ID NO: 5704 - protein, 348 aa, Caenorhabditis elegans
MGQTLSEPVTKKESASCANENYLVGSSCMQGWRVDMEDAHTHLLSLPDDPKCAFFAVYDGHGGSKVSQYSGINLHKKVVAQKEFSEGNMKEAIEKGFLELDQQMRVDEETKDDVSGTTAVVVLIKEGDVYCGNAGDSRAVSSVVGEARPLSFDHKPSHETEARRIIAAGGWVEFNRVNGNLALSRALGDFAFKNCDTKPAEEQIVTAFPDVITDKLTPDHEFIVLACDGIWDVMTNQEVVDFVREKLAEKRDPQSICEELLTRCLAPDCQMGGLGCDNMTVVLVGLLHGQSPDTLFTKCARPAVFTGVNNEDGDQNQIQQDISQQRVNAANQEEEEDDNEPAPANFQV

SEQ ID NO: 5705 - protein, 366 aa, Caenorhabditis elegans
MGANLTSPLPHHHRTQTTSVCNHLFSPGDGGPTFAPQRDSNTSSRSSSNAKESVLMQGWNWSKRNIQPVMSRRSLPKSGSSSEATSSKSSDSLVSFTRNVSTSTSSQYGKISISLDRNQNYKSVPRPSDTTTIIPNYYSLREEFRRGLQINTRQDLVNNNLASNDLSVIGSPKHVPRPRSVLRDDNANCDISPIAEQENVPSEKRGTKKTIIQASTSELLRGLGIFISNNCDVSDFDPAHLVTWLRSVDRSLLLQGWQDIAFINPANLVFIFLLVRDVLPDERHLIHTLEELHAWILSCLYVSYSYMGNEISYPLKPFLIGNDRNTFWNRCVAMVTSHSRQMLLLNSSSTFFSEVFTDLKHCSSSE

SEQ ID NO: 5706 - protein, 681 aa, Caenorhabditis elegans
MVNTRPPKIDELLKIDPYLHDFQDEISRRYGVFLDYQRRIEECGGMEEFTSSYKQFGLNVQPDNSVKGLEWAPAAEKLALIGDFNNWDQNANVYKKEEHGKWSITVPAKEDGSCPIPHNSVIKIAVSRHGATHFKLSPWATFVTCPNPKETVIYHQNFWNPPEKYQLKEARPARPASLRIYEAHVGISSSEGKINTYREFADDVLPRIQKQGYNAIQLMAVMEHVYYASFGYQVSNFFAVSSRCGTPEDLKYLVDKAHSLGIFMLLDVVHSHASKNVEDGLNQWDGSNGGYFHDNARGYHNLWDSRLFDYTQTETLRFLLSNVRWWVEEYGFDGFRFDGVSSMIYHSHGMNDDFCGGYPMYFGLNADTDSLVYLMLANDFLHKKYPFMITIAEEVSGMPGICRPVEEGGQGFDYRLAMALPDMWIKILKHTSDEDWKIDDIVFNLENRRYAEKHVAYAESHDQALVGDKTIAFWLMDKEMYDFMSTDSPLTPIIDRGLSLHKLIRLITIGLGGEAWLNFIGNEFGHPEWLDFPRVGNGESFHYARRQFNLVDAEYLRYKFLNNWDREMMLLEERTGFLHKGYAYTSWKHDGDKTIVFERGGLVFVINLHPTKSFADYSIGVNTPGRYRIALNSDESKFGGHNRIDNSIKFHTTDDGYAGRRHRLQVYITCRTAIVLEKEDD

SEQ ID NO: 5707 - protein, 1253 aa, Caenorhabditis elegans
MDDDVGERTPALGGSCGPSVRAHSSSPRRVPLFERASARWWNPQFRSATLEAQYWKCSFSQLRDRFRSGLIYIAVVIAAWTLYLALFDRTFIQHWIVSLCLCAIIFAMFAFTACAAQYQRFYMPTSFLCTFLICLVTLLIFSAENQAAFMTPVASLATSFQVVLLIYTVIPLPLYLCILIGIIYSILFEILNKNKIGLEEAGYIKLVLHAGVHLLGVHLFILTQVRQRKTFLKVGQSMLARKDLELETQFKDHMIQSVMPKKVADELLKDASELRRPSASNDSNCRTSNATQVDQPLAKMVPEYRKFRPFTMNLMTNVSILFADIAGFTKMSSNKSADELVNLLNDLFGRFDTLCRLRGLEKISTLGDCYYCVAGCPEPCDDHACRTVEMGLDMIVAIRQFDIDRGQEVNMRVGIHTGKVMCGMVGTKRFKFDVFSNDVTLANEMESSGVAGRVHVSEATAKLLKGLYEIEEGPDYDGPLRMQVQGTERRVKPESMKTFFIKGRINDGVEEEVMQVQEVESLHSQKSSKKSTLKQKWAEKLKMNHTNSYPMRAAAREGGGSLRIKLAERNRSTQLLPKESNSICIMEDNRKSASLQALATNNFNGSNTDTNNTYSERGVAGSVSKKSVAGSESNSIKGSRSSGLQLSLQDGNSDLNSVGGLDTAISHHHNAASLTRFDTDNNFDQRLAMVIGQGEGGFDKGFWNHHDSLNKWTLRFNEKDVEEEYRAHFVDSSERYTASKKGHVERHKDLMEQGGEKDGITGSTVNKYRYSGVFIDIIVATLIFVISGAVAIMSVRPFPLSLIAYFPFAAAILILTIVLIGLPLLARKKSFQCANQWMPRHLIGLLLIFLPIGVAICIMPLCQSGDCANVILNYRLAFSYVTILAIFAHCNFSQLAAWPKTTAAVFIGLLHIAGVFYCEFNLKHLVEEQDTCNVTAIMIPPIRKGLNYTIALNSTSARTLSQDFGSPLFIWELLLDVILSIVLVAFLNYQFETAFRMSFFGDVQARRDTERMQIVRDQADWLLNNVIPAHAVESLKTDTKYSENHETVGVLFASITNWNDMYEENFEGGREFLRVLNEVIGDFDELLDRPDFTHIEKIKTIGPAYMAASGLNPERKKNMLHPKEHLYQMVDFALAVQHVLSVFNEDLLNFDFVCKLGLNIGPVTAGVIGTTKLYYDIWGDTVNIASRMYSTGVLNRIQVSQHTREYLLDRYEFEFRDHIEVKGIDGGMDTYLLVGRKGDGIPPSIKDNQEDEF

SEQ ID NO: 5708 - protein, 211 aa, Caenorhabditis elegans
MSNGGKRPPEDDSKLPYYKLVVIGDGGVGKSSLTIQFFQKQFVDYYDPTIEDQYIQHCEIDGNWVIMDVLDTAGQEEFSAMREQYIRGGRGFLLVFSVTERKSFEEAHKLYNQVLRVKDRSEYPVLLVANKVDLINQRVVSEQEGRELAAQLKLMYIETSAKEPPVNVDAAFHELVRIVRSFPSDEGDHEASMASVPRTKKRKDKGKCLIS

SEQ ID NO: 5709 - protein, 1106 aa, Caenorhabditis elegans
MAHWSAHVTAFPCEMISRDGSVGFTEKRQKPSALPVEEPTIAVFWQPATLGNVWYRETSDINIMNLAHNEVNIQYRYGAQFRVRSVVLITWEGVKDPLVPESEGNTFQLALIIGDSMTFAHFIYSKLNFNTNAIAGFSTRDSSYSLPDSATNDAILLSEKSDIGIPGEWLFRVDGDRIYLCGAGFKGLECIESCAPSQWFNDCSKSCHCDGGDSCDQENGRCPNGKCSPGWIGEPICDEDMDECEMGIDNCPNEQPDCLNTPGSFLCLCFEYDEAQQKCKNSKAAPPSAPIPVDVIPMHPTFTRKPTPPKVTAPPRNRFKSTTAATSPTFITETTTRQTTTTREKSISTPLLTTEVVTRPSPTTTVVTAPAACARCDQNAKCSNGVCTCSEGFTGDGFRCYDVDECEIPGAVCRDHSICSNTIGSFECTCHGGYRFEDGKCEDVDECRELPKICGDPNKGTKCINKDGTFECLCKDGYEGDPSSECRDVNECKNPDACGPNSQCTNTQGGYECECLAGFERIAEGAHCTDRDECAVEPCHPAAICSNTRGSYKCECRDGFVGDGKTCHETILYPISNDSTVIPRSWDSSTAVPILSEITIFGKKYSKIYLSTNGIISFDGPLQGLIDHAETLKKPAIFALHAQFDYIREGLVAYTFINDTDAVTLPLLMRSSIGIQTAMGIENFQTKRLHIFTFDRVRQSGSENFNSFQIVLAESDKDATILSLIYEKVQARGPMTGISTPSRFLMLPNNRLASGSNVGQPGKWMYRVDIADLQTCPPGRLGEPLCDRECAAGHYGINCESTCHCDGSVACDVITGMCPGALCRAGWEGSSCDQDIDECEMSLVTCAVGSQCVNTRGGYRCDCKGGFAPVGKECKPIDRCLSRFSVPCSRNAECVESIESNPKCVCRKGYHGDGFRCTTRDNIKSAGGNILISDLTHHLMEVASDGTNSTDLPGTGLSENPFVMKNWVSDRIGETTTPVSQRPKFVTVQTPPLFYTAPPIKPKINDKDMDLSDGEKPTAELSDGVSSVYVFICVALLSIWAVLIILVIGIMYINKRKRRNMERQQYAAMRGWKGGQFHSRSSRMITTSNPNVIYGQTPRITPYESY

SEQ ID NO: 5710 - protein, 190 aa, Caenorhabditis elegans
MGFFSSLSSLFGLGKKDVNIVVVGLDNSGKTTILNQLKTPETRSQQIVPTVGHVVTNFSTQNLSFHAFDMAGQMKYRSTWESYFHSSQGVIFVLDSSDRLRMELLKDELMMVMEHKDVVSRGIPIVILANKMDIPGAMTASDITVALGLNLYRSGTWSIHSTCALTGDGLDKAMQQLSAEITKYMESRRT

SEQ ID NO: 5711 - protein, 287 aa, Caenorhabditis elegans
MEHREYVKNNMPLIGIGTWQVQKEEILRQVIDAGFKEGYRFIDTAQVYNNEAKIGRILEKLLPANGLKREDIWITSKLAPSNAGVKKARESIEESLSNLKVEYLDLLLIHWPGSSLKSENPANKKLRVESWNVMCEMMAEGKLRSVGVSNFEICHLEELKKDSNVVPAVNQVEYHPHFHQDDLVKYCNENNIHFQAYSSLGSPTYRKQLSEEPLIKELAQKYNVEIPVLLLGFAYCQGISVLPRTTNPEHVATNFKVTKLAITQEDIDRLLALTVEHKTCWDPRVVV

SEQ ID NO: 5712 - protein, 419 aa, Caenorhabditis elegans
MSHIKMCAFEEYCSFHFISFPCTFCCLLNNLFSQVLIRMPEKGKIETGDRILARCNTFLLLHNMFSSEGKFRKTYRHQFNQLRTGDETEIPMSTLASRIETRKIPLTNGQIHAIKEAPDELVDIDGFQKIVTSKAAQRSTIKRIMYDMADPIMSDSQKIEVHSYIDSYSWCPPPIFMLLITIIQVGIFFFYWESDGGRSIWTDCAGCFVHHNHTAPGIFIFAPKLRGEAWRFTSYMFLHAGLNHLLGNVIIQLLVGIPLEVAHKIWRIGPIYLLAVTSGSLLQYAIDPNSLLVGASAGVYALIFAHVANVILNWHEMPLRWIRVLVLFVFIFLDFGGAIHRRFYTNDCDSVSHLAHIAGAVTGLFFGYVVLYNVVEHRIEKIIRYVCLFLYSAFFATTIIFVIVRQPYSKNLWNNENCS

SEQ ID NO: 5713 - protein, 1193 aa, Caenorhabditis elegans
MYDDEDEMVNDPMDGDYIDDSDEISAEAWQEACWVVISAYFDEKGLVRQQLDSFDEFVQMNVQRIVEDSPPVELQSENQHLGTDMENPAKFSLKFNQIYLSKPTHWEKDGAPMPMMPNEARLRNLTYASPLYVDITKVVTRDDSATEKVYDKVFVGKVPVMLRSSYCMLSNMTDRDLTELNECPLDPGGYFVINGSEKVLIAQEKMATNTVYVFSMKDGKYAFKTECRSCLENSSRPTSTMWVNMLARGGGGGKKTAMGQRIIGILPYIKQEIPIMIVFRALGFVSDRDILGHIIYDFNDPEMMEMVKPSLDEAFVIQEQNVALNFIGARGAKPGVTREQRIKYAREILQKELLPHVGVSEHCETKKAFFIGYMVHRLLLAALGRRELDDRDHIGNKRLDLAGPLLAFLFRSLFRNLLKEMRMTAQKYINKNDDFALDVCVKTSTITRGLTYSLATGNWGDQKKAHQSRAGVSQVLNRLTYTATLSHLRRANSPIGREGKLAKPRQLHNTQWGMVCPAETPEGQAVGLVKNLALMAYISVGSLPEPILEFLEEWSMENLEEVSPSAIADATKIFVNGAWVGIHREPDQLMTTLKKLRRQMDIIVSEVSMVRDIRDREIRIYTDAGRVCRPLLIVENQKLALKKRHIDQLKEAADEANKYTWSDLVGGGVVELIDSMEEETSMIAMMPEDLRSGGYCDTHTHCEIHPAMILGVCASIIPFPDHNQSPRNTYQSAMGKQAMGVYTTNFHVRMDTLAHVLYYPQKPLVTTRSMEYLRFNELPAGINAIVAILSYSGYNQEDSVIMNNSAIDRGLFRSVFYRSYRDNEANLDNANEELIEKPTREKCSGMRHSLYDKLDEDGIISPGMRVSGDDVIIGKTVALPDIDDDLDASGKKYPKRDASTFLRSSETGIVDQVMLSLNSDGNKFVKIRMRSVRLPQIGDKFASRHGQKGTMGIMYRQEDMPFTAEGLTPDIIINPHAVPSRMTIGHLIECLQGKLSANKGEIGDATPFNDTVNVQKISGLLCEYGYHLRGNEVMYNGHTGKKLTTQIFFGPTYYQRLKHMVDDKIHSRARGPIQMMNRQPMEGRARDGGLRFGEMERDCQISHGATQFLRERLFEVSDPYHVYVCNNCGLIVVANLRTNSFECKACRNKTQVSAVRIPYACKLLFQELMSMSIAPRLMVKPRQSKRSKHQSEA

SEQ ID NO: 5714 - protein, 1410 aa, Caenorhabditis elegans
MWPPLNYIILANDVIVTLIFIGEAAVTINQNGLFDNQNSYLRDRWYQFEFFLLINHILSCVIHIYELCSIWFPALNFVYYPWLGALRSARPFIFLRFIRSIVRFKLPKNRIKLIIKRSSQQIQNVTIFFMFFVFSYAIMGVQLFGRLNYHCVVNGTDPNNVTIADLAIPDTMCSQKGAGGYECPGNMVCMRLQLKPQEEGFYGQFSDFASSLFTVYLAASQEGWVYVLYDCLDSLPSFLAFFYFVTLIFFLAWLVKNVFIAVITETFAEIRVQFSEMWQTREATTDHVYTQKLEKDEDGWKLVEVDKYNRAHSNNSLFLHTIVTSTAFQTVMQLLILANAIFHATFVFYHDESDQIRKIWYYYVEVGFTILFNTEVIIKIYAFGWKAYIARGQHKFDCILCVGSSLNAIWVLYETNIFTYFQVFRIARLIKASPMLEDFVYKIFGPGKKLGGLVIFTGILLIVTSAISLQLFCYVPKLNKFTNFAVAFMSMFQIITQEGWTDVVIEILRACNEQAVPFVAIYFVAYHLLVTLFVLSLFVAVILDNLEMDEELKKVKQLKAREQDTIKTTLPMRLRIFNRFPTAPTMVTMKKVSSEFPLPKIRDSFTRQFADEFVETSDDTIQEIGFKVRSMLSGRGPSKETRITTTIRHVGQLSNKTILTSMLTESNRNRALFSESNQHLASLTRSNTSSKHGKSGALSTNSRSRTRGLASLKGKHMVEGFKENGDLRPEDTARKVEKHGEIDFKALQMKRAHAEITRNRIEEEMRENHPMFDRPLFLVGRESSLRRMCQLIAHSRHSYDQNDGQHRKHSNKYKQFHDFLAIMTYMDWTMVLVTTLSCCSMLWESPWPTTGENLIFNNFYLQIAEYIFVLVMSFELIVKCIANGLFFTPKALVTDVGDILTIFIYITSLMFLIWMPNHIEINSWAQLLMVCRAMRPLRVYALIPHIRRVVVELCRGFREILLVTILLVVLMFIFASFGVQLVGGKLASCNDPMITSRENCTGLYDVKLFVTRMEVYGKNDNLMHPSIIVPRVWTNPRNFNFDHIGNAMLALFETLSYKGWNVVRDVLYLRHGAWAVLFIHIYVFIGCMIGLTLFVGVVVANYTENRGTALLTVDQRRWHDLKARLKMAQPLHVPPKPPESAKLRCYLYDLTTSRWFKQLFAVLVVVNSFTLVIPWNVSEEQDRKTFLLCLTVISAICNILFTLECLLKMIAFTLSGFWQSRRNRIDFIITILGINWIVFHFLFQLPAYFAGGITEWKRLTYTYGYLVVILRFFTIAGRKSTLKMLMLTVVMSMVRSSFIIAAMFLLVLFYANAGVVLFGMVKYGQAVGKHVNFRNGREALVVLFRSVTGEDWNDIMHDCMRAPPFCNWHPGLSYWQTDCGNYVGAIVYFCSFYLIITYIVLNLLVGKSLT

SEQ ID NO: 5715 - protein, 544 aa, Caenorhabditis elegans
MFYEETSCCELTISNLIHLMLRSALRATVQARNASGVPPGLSNMKPQYTGIFINNEFVPAKSGKTFETINPANGKVLAQVAEGDKTDVNIAVKAAQNAFRIGSEWRRMDASQRGVLLNRLADLMERDRVILASLESLDNGKPYAVAYNADLPLSIKTLRKLTAKKCNFLNQILFLLRRMADKNHGKTIPIEGDYFTYTRHEPVGVCGQIIPWNFPLLMQAWKLGPALAMGNTVVMKVAEQTPLSALHVAALTKEAGFPDGVVNIIPGYGHTAGQAISSHMDVDKVAFTGSTEVGRLVMKAAAESNVKKVTLELGGKSPNIIFADADLNDSVHQANHGLFFNQGQCCCAGSRTFVEGKIYDDFVARSKELAEKAVIGDPFDLKTTQGPQVDGKQVETILKYIAAGKKDGAQLVTGGAKHGDQGHFVKPTIFANVKDQMTIAQEEIFGPVMTIIRFDTMEELVEKANNTIYGLAAGVMTKDIDKALHIANATRAGSVWVNCYDVFDAAAPFGGFKQSGIGRELGEYGLEAYTEVKTVTIKVPQKNS

SEQ ID NO: 5716 - protein, 301 aa, Caenorhabditis elegans
MHESGEPTTATGDASANHFKDGIIDLLAGTAGGIANVYAGQPLDTVKVKVQTFPNLYSNWIVCLKDTYKLDGIRGLYAGTLPALAANVAENAVLFTAYGYCQKTIATLNGLEDVRQMTPLENAFSGSLAAVFAATVLCPTELVKCKLQAAREMKKKCTPFSVCRDIMKDTGVRGFFVGMTPTLAREVPGYFFFFGAYETCRFLLTDEGQKKEEIGLVKTAMAGSVGGMALWTSIYPADVVKSRMQVTGGGTFMSTLGAVVKENGIRGLYKGLLPTNLRTCFASGCLFVAYEETRKFFHYVL

SEQ ID NO: 5717 - protein, 322 aa, Caenorhabditis elegans
MTSPYATIVDAREFNAPMFAEKIDRALRAGEKDAVVNVITSISNAQRQQLREPYKLKYGKDIIQALDKKFSGDLEKAIFALMETPLDYDVKQLKAAMKGLGTDEAVLIEILCSRTVDQLRAIRVTYEKEYGKALEADIAGDTSGEFRDLLVSLVTGSKDGSHDTNDAQAKDDAVRLFADGKAKLAKKDGTHFLHILATQNQYQLRKVFAYFQELAGGSIEKSIEKEFSGDLQKSYLTIVRAASDKQKFFAQQLHASMKGLGTRDNDLIRVIVTRSEVDLELIKAEFQELYSKSLADTVKGDTSGAYRDALLSIINGNHATAH

SEQ ID NO: 5718 - protein, 570 aa, Caenorhabditis elegans
MQAWHGNFSISLRDPLPRSSGGLACFSARVQTMASRSLASISRSASRLLQSNVQKCALPAASIRLSSNNVESKKGIHTGVATQQAAAATKVSAKATAANASGRIVAVIGAVVDVQFDENLPPILNGLEVVGRSPRLILEVSQHLGDNVVRCIAMDGTEGLVRGQPVADTGDPIKIPVGPETLGRIMNVIGEPIDERGPIASKNFAAIHAEAPEFVEMSVEQEILVTGIKVVDLLAPYAKGGKIGLFGGAGVGKTVLIMELINNVAKAHGGYSVFAGVGERTREGNDLYHEMIEGGVIDLKGKNSKVSLVYGQMNEPPGARARVCLTGLTVAEYFRDQEGQDVLLFIDNIFRFTQAGSEVSALLGRIPSAVGYQPTLATDMGSMQERITTTKKGSITSVQAIYVPADDLTDPAPATTFAHLDATTVLSRGIAELAIYPAVDPLDSTSRIMDPNVVGQNHYDIARGVQKILQDYKSLQDIIAILGMDELSEEDKLTVSRARKIQRFLSQPFQVAEVFTGHQGKFVSLEETIRGFTMILKGELDHLPEVAFYMQGGIDDVFKKAEELAKQHGN

SEQ ID NO: 5719 - protein, 370 aa, Caenorhabditis elegans
MKTGDRQRTEKEAVTKDGQTGSKKPGYKKKPVKKLLSNNTKVKTNKTKRVWCVQAHIGSGGFGDVYRVYDEPNPKMWIVMTLIGPSLESVRRMLKRQYTKSCVINMALQILDAVEVMHEVGFIHRDLKPANICTGTPPQDDHVLYVLDFGISRRVFKSSKCHELRNKRERVPFFGTRKFSSRACHQEKDQGRKDDMETYLYTILDLFHNERGLSWKLDKIIPSGIDNIIVYLRGLKFEDPVDYRQIENELRTAGKKMAPSDSSDETMDWTGKLEQLLKEANKNKAVGTPKGEETLLYERLKAKRDRDMTTDAVKTVEMRATINRDVDASEGMFNDKGLTTRTTLVSVELPPPPPPPPQKPPTKQLKIAER

SEQ ID NO: 5720 - protein, 817 aa, Caenorhabditis elegans
MFFRVKTTPTKAKPYVKPQNANNLQNNFNPRKIFTEYISKEETDAGIEDGSMFKGVLRINPKNYQECFLDHPKGTNHPDVLVLGQDRNRAMQGDVVAVKIKPKEDWLVNYVEYVKWWAEHKKGDRNSGKTDNNSPNKTEKRCLRNEIQDNGVTSDEVPDSCLITIGAIVHILEKKHFRVAAGKLQLMPNSANPNVLFVATDSRVPRILIPKSDVDKEFFSRPKDFERFLYTAKITDWRAESVYADGRLVKLLGMSGEIDTETERIVYEHQIDHREFSDECLESLPITTAENWKVPDAEFEYRRDFRSDIVFTIDPKTARDLDDALHAKHIDDCDGKGTPGLEIGVHIADVTFFLKEGTELDKWASERGNSTYLSQTVIPMLPRILCEQLCSLNPGVDRLSFSTVFKMSYEAELYDVWFGRSVIRSRVKLAYEHAQDFIENPEKDFTCDELPDISDGNTPFEIKEKTLMLHRIAQVLRQKREDSGALRIELPRLKFALDEDKKPQGVSIYEIKDSNKLVEEFMLLANMEVAKKIAENFPEHALLRNHPPPKEKMIKDVAEQCARIGFPLDGRTSGLLSTSLRKYQGKSRLDMCIRQVISSLTIKPMQQAKYFCTFEMPLSFYHHFALNVDHYTHFTSPIRRYPDVIVHRQLAAALGYNERSERVPEEIQEICTRCNDTKLASKEASDESAMLYFGVFIHQTGPMKCQAVVLGVMDLSFDVLIVEYGVVKRVYVDKMKRDFNKSTEKLTIYWPADPNAESGNREEFSSSIQMCNVVYVILVPYKSIEVSATIVRPSLEQRNILKSTLKDMKETGSTILQ

SEQ ID NO: 5721 - protein, 418 aa, Caenorhabditis elegans
MSRVIGRLPSTLEDNGPSENEHCVETDETISIFPCYNLYPKKSLRLSVSGNSEKLKSINLNCKNLVEDEIAPIKRKDARSIQNPFKKYSIPDEITEQIFSNLKKKDLLSAMLVCHRFYGIGHKSRNWIITDAQDRPISEISLIALSQRKIKVLRLAGAKADRILRADERLVEVALLSTSRLELLDLSRTNLTARQMQIMLKPCQKLKCLSIEGNQLDDHVAICIAENRGLRELDISMTNGITANGASLIFRNCKDLQQLNLAWCGLTQPIVTVIIHSIGEKLKKLNLSGTVRNFGINNKHIEILAAKSNYVTDLDLSDNVEISDPGLAVILNKFPRLTTISLNRCYGLDPNMVVHFNSKPSLVYLNVHGCVSDTNMELFLEMCSNLKVNRQYFNFTAKPVSYQCESNMIWGQTMMDIE

SEQ ID NO: 5722 - protein, 664 aa, Caenorhabditis elegans
MDCAIAVRERWPFSASLRITVAAVSLLLLSPLFFCMFVRYSKMTIRRFCKFFQNTQFFYFLSNLFLQKPPALFIMSVVEEATDDALYPIAVLIDELRNEDVTLRLNSIRKLSTIALALGVERTRNELIQFLTDTIYDEDEVLLVLAEQLGNFTPLVGGPDHVHCLLLPLENLATVEETVVRDKAVESLRKIADKHSSASLEEHFVPMLRRLATGDWFTSRTSACGLFSVVYPRVSPAIKSELKSMFRTLCRDDTPMVRRAAAAKLGEFAKVFEKTAVIEGLHSSLTDLHVDEQDSVRLLTVESAIAFGTLLDKANKKKLIEPILIELFDDKSWRVRYMVAEKLIEIQNVLGEDMDTTHLVNMYTNLLKDPEGEVRCAATQRLQEFALNLPEDKRQNIICNSLLNVAKELVTDGNQLVKSELAGVIMGLAPLIGKEQTVSELLPIYMQLLNDQTPEVRLNIISSLDKVNEVIGAAQLSTSLLPAIVGLAEDGKWRVRLAIVQFMPLLASQLGQEFFDEKLLPLCLNWLTDHVFSIREASTLIMKELTQKFGGQWASTNIVPKMQKLQKDTNYLQRMTCLFCLNTLSEAMTQEQILKEIMPIVKDLVEDDVPNVRFNAAKSLKRIGKNLTPSTLTSEVKPLLEKLGKDSDFDVRYFSEEAKNSLGL

SEQ ID NO: 5723 - protein, 1207 aa, Caenorhabditis elegans
MSSYNLIFPGVQIISVPFSAIRHFYCKLLFSVFVPLFQIIFILEFQIFNTNFQMTIGQVNGRARIKSECGKDQKCMPLEDKWLLVPAFLKVRGLVKQHLVSFDHFVQEEIRSIMLSNQKITSDANPNFYLKYLDIRIGKPSSEEGLNMTHDKITPQECRLRDMTYSAPISVDIEYTRGNQRVFKKDLIIGRMPIMLRSSKCILRDLAEEELARVQECPYDPGGYFVVKGSEKVILIQEQLSKNRIMVGRNSSKELQCEVLSSTSERKSKTYVTMKKGKYSVRHNQLTDDVPVSIIFKAMGVESDFDIVSTIGHEEKYVSAFAQTLEESINAGVYTQQQALAYVTSKVKARKFTPFGSLPGTSVSVLTPPKEHEAVDFLSNSMITHIACPDGNFKMKAIYLGLMTRRLIQTELGENGLDDRDFYGNKRLELAGSLLSLLFEDVFKRFNSELKRIADNALMKTMAAPLDIVKHMRQDMITNTIVNAMSTGNWIIKRFRMERLGVTQVLSRLSYISALGMMTRINSTFEKTRKVSGPRSLQPSQWGMLCPSDTPEGEACGLVKNLALISHITTDSDEKPVLRLLLNSGVEDLHNVHFSHVNKPENTLIFLNGVLIGTAVDPERVVKAVRDLRRSGLLSEFVSVSRSLTNRSVFISSDGGRLCRPYIIVKNGTPMLTQAHVQELKEGKMIFEDFVDDGIVEYLDVNEMNDALIAVYGREIGPETTHLEIEPFTLLGVCAGLIPYPHHNQSPRNTYQCAMGKQAMGTIAYNQQKRIDSIMYLLCYPQRPLVKSKTIELTNFEKLPAGANGIIAVMSYSGYDIEDALVLNKASLDRGYGRCLVYKHVKGTAKKYPNQTFDRLLGPALDPNTRKPIFKHKNLDQEGIVFAGARIMPKQTIINKHMPVVSGESGPGASASANTIGIAGRQVDYKDVSITYKTPTPSYAERVLLTYNEDEAHLFKVLLRQTRRPELGDKFSSRHGQKGVCGLIAQQEDMPFNDLGMVPDMIMNPHGYPSRMTVGKLMELLSGKAGVVNGTYHYGTAFGGDQVKDVCEELAACGYNYMGKDMLTSGITGQPLSAYIYFGPIYYQKLKHMVLDKMHARARGPRAALTRQPTEGRSREGGLRLGEMERDCLIAYGASMLLIERLMVSSDEFKVDVCTGCGVIGSKGWCQKCRSSKSMANIKIPYACKLLFQELQSMNIVPRLDLARYTE

SEQ ID NO: 5724 - protein, 739 aa, Caenorhabditis elegans
MSSRHRLDLDGSGRGDRRRSPNRRSRSRSRSPHRRSSPDRKRQIGAVGNMKIQINPYNNQPFSNRYWAIWEKRSQLPVWEYKEKFMELLRNNQCITLVGETGSGKTTQIPQWAVEFMKQQQQGQPPGQARLVACTQPRRVAAMSVATRVAEEMDVVLGQEVGYSIRFEDCISERTVLKYCTDGMLLREAMNSPLLDKYKVLILDEAHERTLATDILMGLIKEIVRNRADIKVVIMSATLDAGKFQRYFEDCPLLSVPGRTFPVEIFFTPNAEKDYLEAAIRTVIQIHMVEEVEGDILLFLTGQEEIEEACKRIDREIQALGADAGALSCIPLYSTLPPAAQQRIFEPAPPNRPNGAISRKCVISTNIAETSLTIDGVVFVIDPGFSKQKVYNPRIRVESLLVCPISKASAMQRAGRAGRTKPGKCFRLYTETAYGSEMQDQTYPEILRSNLGSVVLQLKKLGTEDLVHFDFMDPPAPETLMRALELLNYLQAINDDGELTELGSLMAEFPLDPQLAKMLITSTELNCSNEILSITAMLSVPQCWVRPNEMRTEADEAKARFAHIDGDHLTLLNVYHSFKQNQEDPQWCYDNFINYRTMKTADTVRTQLSRVMDKYNLRRVSTDFKSRDYYLNIRKALVAGFFMQVAHLERSGHYVTVKDNQLVNLHPSTVLDHKPEWALYNEFVLTTKNFIRTVTDVRPEWLLQIAPQYYDLDNFPDGDTKRKLTTVMQTLQRNAGRGY

SEQ ID NO: 5725 - protein, 471 aa, Caenorhabditis elegans
MALRLAVSSALRPALNSQVRNASSAVSVKDVLASAPQAEVTTLKNGFRVVTEDNGSATATVGVWIETGSRFENEKNNGVAHFLERLIHKGTGKRASAALESELNAIGAKLNSFTERDQTAVFVQAGAQDVEKVVDILADVLRNSKLEASTIDTERVNLLKELEASDDYHQLVLFDMLHAAGFQGTPLALSVLGTSESIPNISAQQLKEWQEDHYRPVRMVLSAVGGGVSNVSSLADKYFGDLSNEYPRKVPQVDGTRFTGSEYRYRNDNVPHMYAAFAVEGVGYAHKDALALQIANQFIGQWDVTHATSRTAASRLVQKIGHDHGVHNLQHFNINYKDTGLFGIYFVADAHDLNDTSGIMKSVAHEWKHLASAATEEEVAMAKNQFRTNLYQNLETNTQKAGFNAKELLYTGNLRQLSELEAQIQKVDAGAVREAISRHVYDRDLAAVGVGRTEAFPNYALTRAGMSWWRM

SEQ ID NO: 5726 - protein, 514 aa, Caenorhabditis elegans
MDSQKLRTEGKKMLDFVADYWDGIRDRKPLPDVKPGYINDLVPAQAPATPEDWAKIFDDLENVVVNGATHWHHPHFFAYFPTALSYQSIMADILSGGIAGIGFTWKSCPSMTELEMSSLDWVVDLMGLPEHFKNSHNGPGCGIIQSTASDSTMIAIMAARATHVERIKSEPTFMKWVSETGVGKTLKNIFDRVKVNKVDDEASGMITPYFHDPTVFERFVMYCSDQAHSSVEKGAMLSAVRMRKLKATRGFLGNYGVSRETLQNAIKEDRARGYIPFMFLATVGTTCSCGVDQVDELGPVCVEEGLYLHVDAAYAGTFALCEEFKYLIRGMEHVDSFNFNLHKAGMVNFDCSPMWFKNGTHVSRYFNVDAVYLAHEYQTTASDYRHLQVALGRRFRSLKIWFVLRNMGVDKIREYLRRTELLAAEFSKLILENGKFEHFVPQHLGLTCFRLKNSTNADNEKLCNAINDDRRIHLVPSTVHGTYFLRMVVCSQLTTLDDIIYARDVIFELAEKLF

SEQ ID NO: 5727 - protein, 481 aa, Caenorhabditis elegans
MDSAKLRVEGKKMIEIVANYWDGIRTRKPIPDVKPGYIEKSVPSNPPTTPESWEKVFGDLEKVIFNGSSHWNHPHFFAYFSAGIGYHSILADIISSGLGSVGFTWIACPPITELEKITLDWLVDLTSLPVEFKNSHPGHGCGIIQSSASDSTLIAIMTARAAKVEFIKQNPSTFQWLINSTSEHLRSISYWTPVNRTIHDSTDIITPYYHDPRVFKNFVMYFTDQAHSSVEKGAMLAGVRFRKLRSVRGYMENYEMDSKILIDAIEQDRSRGFIPFMVALTVGTTATCAADDVEKIGQICQKEGLYLHGAFAFCDEFKYLVNGLKYVDSYNTDLHKAGMINFDCCPLWFKNGTYASRYYNVDPVYLAHEYQSSNMDYRHLEVPLGRRFRSLKVWFTMRNMGVEKIREYQRKTVSLALLFTKIIVEGDKFELFTPPHLGMATFRLKNHTNSDNERLLQAINRDRRIHLGISMVCTLFQEHGL

SEQ ID NO: 5728 - protein, 357 aa, Caenorhabditis elegans
MYTFQSVSQQRSESYIQLNQYRLMEEIGQGSYGIVKLAYNEEDKNLYALKVLDKMKLLKNFACFRQPPPRRNKENAAPSVLRNPLQLVQKEIAILKKLSHPNVVKLVEVLDDPNDNYLYMVFEFVEKGSILEIPTDKPLDEDTAWSYFRDTLCGLEYLHYQKIVHRDIKPSNLLLSDIGQVKIADFGVSCEFEGIDAFLSGTAGTPAFMAPEALTEGANHFYSGRAQDIWSLGITLYAFVIGTVPFVDNYIIALHKKIKNDPIVFPEAPILSEALQDIILGMLKKDPGHRLMLHEVKVHTWVTRDGTVPMSSEQENCHLVTVTEEEIENCVRVIPRLDTLILVKAMGHRKRFGNPFR

SEQ ID NO: 5729 - protein, 181 aa, Caenorhabditis elegans
MGNVFGSLFKGLFGKREMRILMVGLDAAGKTTILYKLKLGEIVTTIPTIGFNVETVEYKNISFTVWDVGGQDKIRPLWRHYFQNTQGLIFVVDSNDRERVGEAREELMRMLAEDELRDAVLLVFANKQDLPQAMNAAEVTDKLGLHSLRNRSWYIQATCATSGDGLYEGLDWLSNQLKNRS

SEQ ID NO: 5730 - protein, 574 aa, Caenorhabditis elegans
MDLAQWLLAQIPIELCHVVPLGAMSQQPGSARRVNFPEEPMTLGEKFSHRMDQLKEIIADGGCSRAAKCVSITVCLVLLVLIFGGAIVYLVMSLTSSAQKMSADSMDISPQAIRHPKFWPPTDKIRFDDLNGIPMTSLFPQNVSTCSGFGFACTGAVHMVIPSSKRCDGRRDCEDGSDEENCKECQSVFSCKLRPEEESKKKGRSTVQPTLICLTAQHLCDNVENCPDGSDEAVCKSSCSKDQFKCPGSNACLPLSAKCDGINDCADASDEKNCSKCQNNAHKCGKQCIKASHVCDGVAQCADGSDEQQCDCQRCSGTDKALCDDGTCIMRTQVCDGKKDCTDGMDEEDCPGSCTIESFSPKLKMVTCSDGKQYTEAEACSGSFESCDHDCPNSKCHPKLAFTCPASKEARKMCISRRKVCDGTPDCDDGADEINCTPIKECGIAKNTQFKCDHKCLDSSRRCDGVWDCEDKSDEKGCDKCPSGTIKCAADKKCLPAFTRCNGVADCSDGSDELKCSCQECLGVHSNTYMCNESNRCLKRDEVCSPYSMCPNATYTDKAFCAALFLKKSGTSPF

SEQ ID NO: 5731 - protein, 614 aa, Caenorhabditis elegans
MGFEMKNNKSSDGSEEVKFCCCNLSENLCDNDESCYPDGVFGQCYSSESGSPEPTVLDNLDDTQLELLKLELTRLAAKDKDWGDEETQCVLAYFKMSMFYQLQYDPDFCQVRKPANVWALIQLIDTGLTEDPTILDEDVNPENVTDEDMAQIIEQLKEPSLPTEEDIEEALNAQNEDVDDEILDQYVQAVVNNENPDFSELSDGVASAVYKRRKDIARLSGADVRETGIGSGEDGSLPVESSERDWLLMPVLFVCAFTVTALGLVAAVQIARSRRHYKDNIQQIAEQLDGKNSFAYQDLCRQRADGGRASKSSSTSSWCEETAVPTIDISTGHVVLNFLQEYLSEPTKIEAQWNGIKDYRNEERTKTKAEKFASQNRTILPFDDNIVDIDGKTAENEDFYLNASFIYDDDPRQAVYIAAQTPASSQIAAFWQTIWQHGVCLVVNLSTPEECKQEKNYWPDTGSEVHGAFEIHLVSEHIWSDDYLVRSFYLKNLQNSQTRTITQFHYLSWQKESTPTSAKSILEFRRKVNKSYRGRSSAVLVHSWDGSGRTGVYCAVDVLCARLLRGIRQIDVVATVEHLRDQRDGMVATGDQFKLVYGCVAQEVNHLLKSIATK

SEQ ID NO: 5732 - protein, 701 aa, Caenorhabditis elegans
MAAEPPSLEELLEKKKREEDELAKPKFLSKAERAALALKRREEEVAKLRETQKQAEEARKNWGRTEKTSDDRRDRGLDRGNDRDRDRERERDRDRRRDRRERSGSRDRRRRSRSRDRDGGRRRDRSRSRDRRDRNDDRKRDRNEDSDNEEDVSKMADAVKDRYLGKQKEKKKRGRRLHEKKFVFDWDAGEDTSQDYNKLYQSRHEIQFFGRGSVAGTDVNAQKKEKNSFYQEMMENRRTVDEKEQEMHRLEKELKKEKKVAHDDRHWRMKELSEMSDRDWRIFREDFNISIKGGRVPRPLRNWEEAGFPDEVYQAVKEIGYLEPTPIQRQAIPIGLQNRDVIGVAETGSGKTAAFLLPLLVWITSLPKMERQEHRDLGPYAIIMAPTRELAQQIEEETNKFGKLLGIKTVSVIGGASREDQGMKLRMGVEVVIATPGRLLDVLENRYLLLNQCTYVILDEADRMLDMGFEPDVQKVLEYMPDTNMKKDTDEFDNEEALMKGFSTREKYRQTVMFTATMSSAIERLARQYLRRPAVVHIGSAGKPTERVEQVVYMVPEDRKRKKLVEVLESQFQPPIIIFVNQKKGADMLSKGLTKLGFKPTVLHGGKGQDQREYALQALKEGTSDILVATDVAGRGIDVKDVSLVLNYDMAKSIEDYTHRIGRTGRAGKHGKAITFLTPDDTAVYFDLKQVKIVTETGHQK

SEQ ID NO: 5733 - protein, 539 aa, Caenorhabditis elegans
MSSIQCLNPKAELARHAAALELNISGARGLQDVMRSNLGPKGTLKMLVSGAGDIKLTKDGNVLLHEMAIQHPTASMIAKASTAQDDVTGDGTTSTVLLIGELLKQAESLVLEGLHPRIVTEGFEWANTKTLELLEKFKKEAPVERDLLVEVCRTALRTKLHQKLADHITECVVDAVLAIRRDGEEPDLHMVEKMEMHHDSDMDTTLVRGLVLDHGARHPDMPRHVKDAYILTCNVSLEYEKTEVNSGLFYKTAKEREALLAAEREFITRRVHKIIELKKKVIDNSPDGKNKGFVVINQKGIDPPSLDLLASEGILALRRAKRRNMERLQLAVGGEAVNSVDDLTPEDLGWAGLVYEHSLGEEKYTFIEECRAPKSVTLLIKGPNKHTITQIKDAIHDGLRAVFNTIVDKAVLPGAAAFEIAAYVMLKKDVENLKGRAKLGAEAFAQALLVIPKTLAVNGGYDAQETLVKLIEEKTAAGPDIAVGLDLETGGAVEPQGIWDNVTVKKNSISSATVLACNLLLVDEVMRAGMTNLKQPQPE

SEQ ID NO: 5734 - protein, 514 aa, Caenorhabditis elegans
MASQLLINDSKYGFLKELGLTENNAGVFHGKWAASGQVVQSFAPANNSPIANVQNGNVQDYEIAISEAKKAYNDWCEVPAPRRGEIVRQIGDKLRTQLQNLGKLVSLEMGKISAEGVGEVQEYVDICDYATGLSRSLEGKIFPSERPGHALLEQWNPLGVVGVISAFNFPCAVYGWNNALALVTGNSVVWKPAPSTPLTAIAVTKLVEEVLVANNVNPALCSLVCGEGDVGQALVKDKRVNLVSFTGSSEIGKIVGQQVQARFGKLLLELGGNNAIIVNEDADLNMVVPATVFAAVGTAGQRCTTTRRLIVHDKVYDQVLERLKKAYAQFESRIGCPLDSNTIIGPLHNQQAVGKYKASVAEAVASGGKIEYGGKVLERDGNFVLPTIVTGLKHDSPVVLRETFAPILYVLKFSTLEEAIAINNEVDQGLSSSLFTTNIQNVFKWMGPKGSDCGIVNVNIPTSGAEIGGAFGGEKETGGGRESGSDSWRQYMRRSTCTINYSKELPLAQGIKFE

SEQ ID NO: 5735 - protein, 366 aa, Caenorhabditis elegans
MATVGGAFKDSLTQAQKDELHQIALKIVQDGKGILAADESTGTIGKRLDAINLENNETNRQKYRQLLFTTPNLNQHISGVILYEETFHQSTDKGEKFTDLLIKQGIVPGIKLDLGVVPLAGTIGEGTTQGLDKLAERAAAFKKGGCGFAKWRCVLNIGTHTPSHLGMLENANVLARYASICQANGLVPIVEPEVLCDGEHDLARAQKVTEQVLAFVYKALADHHVYLEGTLLKPNMVTPGQSSASKASHEAIGLATVTALRRGVPAAVPGITFLSGGQSELDATANLNAINSVQLGKPWKLTFSYGRALQASVLKAWGGKDENIAAAQKTLLHRSKANGDASLGKYAGEDAAGAAAESLFVAKHSY

SEQ ID NO: 5736 - protein, 403 aa, Caenorhabditis elegans
MACPYLGSGELTHRVTFMEGGEECQQGVNKVEMGFGQTYSEYLQLDKILTAQRLKSEADGQRVDDEHLFIVIHQAHELWFKQIIFDLDNVRKLLNNTIVDETKTLKIVSGLDRMTKILSLLTEQITLLDTMSPLDFVDFRKYLTPASGFQSLQFRVLENKLGVRQERRIKYNAQHYKNVFNDTDLKTLNVTEEEKSLLTLIESWLERTPGLKSTSEDEGFWIKYEKSVNKYLADLAKQAADPSNTEEIAKQLTAEYHKTADAFQSILDPRQHEQHIRNGNRLLSHDATKGAMMIYFYRDMPRFSQPYQILTFLMDIDSLFTKWRYNHVLLVQRMLGAKQGTGGSSGYMYLRSTVSDRYKVFLDLFNLSTWLIPREYIPMLSPRMVKTLSEHSNLSHSQSSESD

SEQ ID NO: 5737 - protein, 510 aa, Caenorhabditis elegans
MRLLPQTNRILLPTTSSTACGANQLRMSSEKAVPCYEESVRLLNGLQSNAATIKKLRVQRENLQAINLPQCRKYLESLNISAEDLNALNIIHVSGTKGKGSACAFVESILRSQGLRTGFYSSPHLVHVRERIQVDGQPVSEQMFAEEFFHVYDIIKREHSDNMPAYFKFLTLLAFRIFVKLNVQVMILEVGIGGEYDCTNVVEKPKVCGVTTLDYDHMSILGNKLSEIAWHKAGIFKESVPAFYSPTTTEAEEVLIARAISKHVPLFQTPPVSAYQFARDISPGIRGAHQFSNVSMALQLVRAWAEKCGFPLPGVPLSTDTSGFNVPLWMCDAIESCRWPGRSQIVSTDRNVTYLLDGAHTPKSMEACSEWAAEEIVNLKKENVKKILLFQCTADRCPSTLIKYLKPLGISQIVSCPTQLHSSIDKSADSANLNASRDEQAEKANQCVQAWKESLDQPESVTEDQMKVFDCISSAYKFIESQAASQEILVLVTGSLHLVGGVLNLAGKGK

SEQ ID NO: 5738 - protein, 1041 aa, Caenorhabditis elegans
MGNTLTGRSNAIAPIISAEDAKTYRFIEEYHEFASWGLSPPKLTIPLNDSYISFYEVMSYVTHLSVNEVIELEKVFATISDRAVCKLNEEKWKQALGGCFPDSYAERLFAVFDENRDGQIDFRELVCTLSALCRGPLPGRISQLARIWDVDCDKLLSDEELSNMYKDLNVPEEHQTVTKSSNGKSALVDFGIWAQENEKYVNEYYSMALQIGHICLGLRPESRKMELQIVNEFEKRASELPLSEWNIVASGWHAELRSFLEADKNPNPIDNSGIKGTREDSWTSKVACISAESARLKPDLIPSDYIRVPVPLWRAWLRWHGCALTVDSQFTRKYLDGEFFEDNKPALELYPLEILLLGHDRKKSQDGTENTPRSLTSWACAQVSRSMTVDELLALCKTELRLGDGDARLWQVVKENEEGNVLLDDGAQNLHQLYSSLGKTKKVNKMKLLLEVRERGTGVWPEELRASLSGKQITAASTLSSNAQLSGRPGAVGLVNYGNFCYRNAGIQCLARVSPLTQYFLDEDNLDAIKRGNLRRGDAAETTIEYAKLLREMWAAKKKNIAPNDLIKKKEADKEEADEEKAERSWTEYEKQNESLVTQLFTGQLRSRLICRTCQSSSSVFEPFTSLSLPIGFEDVDLYQVIVVHRDGRIPRRYGFRLSRDSKVGNLREVVAVSSGISMSHLTIQCMSSKGTLMSRSPNHRSSNLRDELPLSSFPSGARLYALELPESTGEDQWRVAMHRKLQYNHEPYILGSTAGFIVSRFGLPLIVGLDEEVTGKKLYEDVMYQMHRFMEHSVNSSSSRAHDPCEDENSGYPFTLCLVDPNYEWCGQCPALRFCRGCPIRPDESKVFIPANCPIAVDWLPIALYLRYNHSQEQACEDDPSVAETWSRHFAPSSLEHCIEKFSCPETLDAAIQCDRCEKKTMRDKVMTIWKLPKYLIIHLKRFEFLREQGRMGKCKRTVNFPLKHFDPAPFVDKPDGNTYECIALANHYGQLSCGHFIAYAKSNEDKWLLLNDCSVREVSEEEVDKQGAYLLFYERKDVK

SEQ ID NO: 5739 - protein, 474 aa, Caenorhabditis elegans
MTDDVDTHIHEKFDLQKRLGKGAYGIVWKAYDKRSRETVALKKIFDAFRNPTDSQRTFREVMFLQEFGKHPNVIKLYNIFRADNDRVIRRDIYLAFEFMEADLHNVIKKGSILKDVHKQYIMCQLFRAIRFLHSGNVLHRDLKPSNVLLDADCRVKLADFGLARSLSSLEDYPEGQKMPDLTEYVATRWYRSPEILLAAKRYTKGVDMWSLGCILAEMLIGRALFPGSSTINQIERIMNTIAKPSRADIASIGSHYAASVLEKMPQRPRKPLDLIITQSQTAAIDMVQRLLIFAPQKRLTVEQCLVHPYVVQFHNPSEEPVLNYEVYPPLPDHIQLSIDDYRDRLYEMIDEKKASFKRIQHEKIRPYGEDKSRAPIAQAECSDTDYDTARSLQRTTSMDKNNSSSHDSSSGTLRERAASAESRTSKDSNGEMRNGNGNTPSSIKQRRRSVERARLFANIKPSKILHPHKLISNY

SEQ ID NO: 5740 - protein, 559 aa, Caenorhabditis elegans
MPKRRVKEILHNVSGMAESGKLLAILGSSGAGKTTLMNVLTSRNLTNLDVQGSILIDGRRANKWKIREMSAFVQQHDMFVGTMTAREHLQFMARLRMGDQYYSDHERQLRVEQVLTQMGLKKCADTVIGIPNQLKGLSCGEKKRLSFASEILTCPKILFCDEPTSGLDAFMAGHVVQALRSLADNGMTVIITIHQPSSHVYSLFNNVCLMACGRVIYLGPGDQAVPLFEKCGYPCPAYYNPADHLIRTLAVIDSDRATSMKTISKIRQGFLSTDLGQSVLAIGNANKLRAASFVTGSDTSEKTKTFFNQDYNASFWTQFLALFWRSWLTVIRDPNLLSVRLLQILITAFITGIVFFQTPVTPATIISINGIMFNHIRNMNFMLQFPNVPVITAELPIVLRENANGVYRTSAYFLAKNIAELPQYIILPILYNTIVYWMSGLYPNFWNYCFASLVTILITNVAISISYAVATIFANTDVAMTILPIFVVPIMAFGGFFITFDAIPSYFKWLSSLSYFKYGYEALAINEWDSIKVIPESISRLRIKFLIFQFCLECSSEFA

SEQ ID NO: 5741 - protein, 450 aa, Caenorhabditis elegans
MSHGHSHDGAPCGGHHGDDGAGGSRPSVNDVQALVDQLRLAGVDVSNMPNIPTAPRDMDEARSKSFQFWSTQPVPQMDETVPADVNCAIEENIALDKVRAEPFSLPAGFRWSNVDLSDEEQLNELYNLLTRNYVEDDDSMFRFDYSADFLKWALQVPGFRPEWHCGVRADSNNRLLAFIGAVPQTVRVYDKTVNMVEINFLCVHKNLRSRRVAPVLIREITRRVNVTGIFQAAFTAGIVIPKPVSVCRYYHRSLNPRKLIDVRFSHLSAKMTMARTIKLYKLPEETATRNLREMKSTDVPQVFKLLTTSLKQYSLAPVYNSEEELAHALVPKKGVVYSYVAENQNGKITDFVSFYSLPSTVMGHTTHKTIYAAYLYYYVAGSVTPKQLINDSLILANREKFDVFNALDLMHNEKIFSDLKFGKGDGNLQYYLYNWKCADMKPSQIGLVLQ

SEQ ID NO: 5742 - protein, 687 aa, Caenorhabditis elegans
MTIDTTNESDNSPTNSPGLEASARTFSLNASKMVRITDDYADEVFIEQNDVVIEKPRMDPLHVRKLMETWRKAARRARTNYIDPWDEFNIHEYPVQRAKRYRYSAIRKQWTEDIVDVRLHPDSFARGAMRECYRLKKCSKHGTSQDWSSNYVAKRYICQVDRRVLFDDVRLQMDAKLWAEEYNRYNPPKKIDIVQMCVIEMIDVKGSPLYHLEHFIEGKYIKYNSNSGFVSNAARLTPQAFSHFTFERSGHQMMVVDIQGVGDLYTDPQIHTVVGTDYGDGNLGTRGMALFFHSHRCNDICETMDLSNFELSPPEIEATEVAMEVAAKQKKSCIVPPTVFEARRNRISSECVHVEHGISMDQLRKRKTLNQSSTDLSAKSHNEDCVCPECIPVVEQLCEPCSEDEEDEEEDYPRTNILSLQLQQMAANLENDEDVPQVTGHQFSVLGQIHIDLSRYHELGRFVEVDSEHKEMLEGSENDARVPIKYDKQSAIFHLDIARKCGILEAVLTSAHIVLGLPHELLKEVTVDDLFPNGFGEQENGIRADKGQKPCDLEEFGSDLMEIAAEMGDKGAMLYMAHAYETGQHLGPNRRTDYKKSIDWYQRVVGFQEEEELDSDCGKTTFSSFAPLTRHEILAKMAEMYKEGGYGLNQDFERAYGLFNEAAEAAMEAMNGKLANKYYEKAEMCGE

SEQ ID NO: 5743 - protein, 455 aa, Caenorhabditis elegans
MSKKTRVPEVADDCTKTVYPDPIPMPTCPQLINDGTSCFLNIILQMLKRANFHDHFKGDWQKGKQKMLMHKELQQIFNGKPGPKDVSRLREMFSNEALKDGPHPLLVALKCLIKMSAVSDNDVIKEKGARDKMFQKQKMFAEHFIKTLLACKGMTKIRTMDIFRLIHICKKIFTVQKSMVEIDGPVRICGDLHGQYPDLIRLFAQVLGGFPPDSNYLFLGDYVDRGSFNLEVILLCLAYKARYPNNFMMLRGNHEVIHINEKYGFKDEVFNRKGEYHDELYPEFNEMMDMMPLVALVGGRILCMHGGLSQHIKSLDDLRNLRRPFHSEDECLENDIMWSDPAKVSGWTANPRGASVQFGENEVKEMCKLLDIDLIVRGHQVVQDGYEFFAGKKLVVCSITVFSAPHYMQSFTNSAAVCKVSAGLEVSFEVLKPEDIRVEEIKCSAESSCASDMQQ

SEQ ID NO: 5744 - protein, 434 aa, Caenorhabditis elegans
MTINGIWEWANHVVRKVPNETMRDKTLSIDGHIWLYESLKGCEAHHQQTPNSYLVTFFTRIQRLLELKIIPIVVFDNINASSSAHESKDQNEFVPRKRRSFGDSPFTNLVDHVYKTNALLTELGIKVIIAPGDGEAQCARLEDLGVTSGCITTDFDYFLFGGKNLYRFDFTAGTSSTACLHDIMHLSLGRMFMEKKVSRPHLISTAILLGCDYFQRGVQNIGIVSVFDILGEFGDDGNEEIDPHVILDRFASYVREEIPARSEDTQRKLRLRRKKYNFPVGFPNCDAVHNAITMYLRPPVSSEIPKIIPRAANFQQVAEIMMKECGWPATRTQKELALSIRRKVHLTTTVAQTRIPDFFAATKSKNFTPIVEPCESLEDYISANNTWMRKRKRSESPQILQHHAKRQVPDRKRSVKIRAFKPYPTDVIELGDSD

SEQ ID NO: 5745 - protein, 333 aa, Caenorhabditis elegans
MESSDNLHDIDNLENGNMACQCFLVGAGYVALAAVAYRLLTIFSNILGPYVLLSPIDLKKRAGASWAVVTGATDGIGKAYAFELARRGFNVLLVSRTQSKLDETKKEILEKYSSIEVRTAAFDFTNAAPSAYKDLLATLNQVEIGVLINNVGMSYEYPDVLHKVDGGIERLANITTINTLPPTLLSAGILPQMVARKAGVIVNVGSSAGANQMALWAVYSATKKYVSWLTAILRKEYEHQGITVQTIAPMMVATKMSKVKRTSFFTPDGAVFAKSALNTVGNTSDTTGYITHQLQLELMDLIPTFIRDKILTNMSVGTRAAALRKKEREAKSQ

SEQ ID NO: 5746 - protein, 323 aa, Caenorhabditis elegans
MQCDDVTWNILNKGQCAYKAWTKPKMFCKNEMNLTGLCNRASCPLANSQYATVREENGVCYLYAKVVERSHYPRRLWEKTKLSKDMNKALEQISDQLLHWSEYVRHKCKARLIRIHQYLIRMRKMAVRGNQKKLIPIGRKVERREKRREEKALVAAKLDHAIEKELLARLKQGTYGDVYNFRQEAFEQMLENTEKELEVEQELEQDDADTGETQFVADFDSSDDEDQDMEDGGDGHWSPGDTDSENEDNWQPEQEQEDSDEDDEEGGDEPMEIEEPPKKKVKKEPKKKTGKKAADGKKKKLKKRAHVEIEYEEETEPRQRVKA

SEQ ID NO: 5747 - protein, 422 aa, Caenorhabditis elegans
MLSSLRRVVPSLPRGSRSLTSQQIFDREKKFGCHNYKPLPVALSKGEGCFVWDVEGKKYFDFLAAYSAVNQGHCHPKLLKVVQEQASTLTLTSRAFYNNVLGEYEEYVTKLFKYDKVLPMNTGVEACESAVKLARRWAYDVKGVKDNEAVVVFAENNFWGRSIAAISASTDPDSFARFGPFVPGFKTVPYNNLKAVEDAIKDKNVAAFMVEPIQGEAGVVLPDPGYLKGVSDLCKKYNVLFITDEVQSGLGRSGKLLAHYHDNVRPDIVVLGKALSGGFYPVSAVLCDDNVMMNIKPGEHGSTYGGNPLACKVAIAALEILQEEKLVENSAVMGDLLMSKLKTLPKDIVSTVRGKGLFCAIVINKKYDAWKVCLKLKENGLLAKNTHGDIIRFAPPLCINKEQVEQAADIIIKTVTDFAKQN

SEQ ID NO: 5748 - protein, 608 aa, Caenorhabditis elegans
MSFKFPSLHNLHQMKNFENFATLGCETLPNFRKFRVTTIKEKRLLLKNVSGYAKSGELLALMGASGAGKTTLLNMLMCRNLKGLSTEGTITVNGNEMAHKISSISGFAQQEELFVGTLTVKEYLMIQAKLRINGSKKLREDRVTDVLHQLKLWKCRDSKIGVIGEKKGISGGEARRLTFACEMLSNPSLLFADEPTTGLDSFMAESVIQILKGIAKTGRTIICTIHQPSSQLYQMFHRVIYLANGSTAFQGTPQESISFFEKCGHRVPDEYNPSEWIIYKLAVQPGQEKQSNDRIQKIVEQYEDSDHQKRVMEQLSDVSEKIPPPEMHRANVFTQIFALSTRCGIDVWRAPQLTLAKVIQKILFGLFIGLLYLRTPYDARGIHNINGALFFLAGEYIYSTAYAIMFFLNNEFPLVAREYHDGLYNLWTYYFARCISLIPLFSTDGLILLFIVYWLIGLNTSVMQVIVASIITVLASQAASAFGIAMSCIFPTAQMTAVMASPPLVLFRLFGGLYGNTNTFPAAIRWLQWISMYRFAFEGLVVNQWSEIDDFHSNAKNNWTNSTTNDVLDYFAFSESAIPLDIIGLILISLAFYLIGFIALVHRMKKAR

SEQ ID NO: 5749 - protein, 414 aa, Caenorhabditis elegans
MSAAALEEIGIAPLQENTSLRPPPLPATCVDVSSDDYIKLTTLERQLAHLQVMEDYIKLETRNLEKELLHAQEEVKRIQSVPLVIGQFLEAVDQNHAIVGSTTGSNYYVRVLSILDRELLKPGCSVALHKYSNALVDVLPPEADSSIQMLRPDEKPDISYGDIGGLDMQKQEVREAVELPLTHGELYQQIGIDPPRGVLMYGPPGCGKTMLAKAVAANTAASFIRVVGSEFVQKYLGEGPRMVRDVFRLAKENSPSIIFIDEIDAIATKRFDAQTGADREVQRILLELLNQMDGFDQSTNVKVIMATNRQDTLDPALLRPGRLDRKIEFPLPDRRQKRLVFSTVCSRMNLSDDVDLEDWVARPDKISGADINSICQEAGMQAVRENRYVVLTKDLEKAYKNVVKKDTNDFEFYK

SEQ ID NO: 5750 - protein, 477 aa, Caenorhabditis elegans
MLPNIILILLIRYCSCGAGSRVYEKYGKQVQLSPATTSSYREWYDSNREHSTRNNTNVDDFQTQLKKSLGQFINDQRRLVEELLDPNYYEKTVHPKRDYTRPTRVNLSMSLYQILDVDEHMQSIEVNVWMVQHWYDEFLDWNPVDYGMINRTIVPYHQIWIPDTYLYNSEELEQKKTESLMNAQLETGHWNQKKDGAKVQLMFPAIYKLSCRMDVRWFPYDRQNYKTSFKPMKLLQQTIDYWPLSSTVNLGNMARNDEWEVISFEFVRVEETFKCCTAPWVMLYAHLVIRRKPLYYMINLVVPTSIITIVAVTGFFTPTSSSSERDEKLYLGINTLLTMSVMMLMVCNQMPSTSTYVPLMSWYYIGIIMVIVVGTFLATGVLAIHGQKHYNKPISDRIRKLIYNPVVEFFILSPPTSLIDLWTEFGVISEQRHSTHLDPLLLQHMDPISVSLLPFPSPQSTCRFVVSCHLLYLLPNV

SEQ ID NO: 5751 - protein, 302 aa, Caenorhabditis elegans
MSRYYDILCPDATRVVLQNRPPDNDFIHANWMTMPDKFRYISAQGPMDQTVEDFWHMVYTEKAPAVVMICDWEEDGIQKCSRYIPSEDNISHVCGIYRITKIDQMTMVYADVALQSFEISVTDKSLECPSLVVKHYHFLKWRDHTAPMTSISVLKLLKALRDPKRPGPPVIHCSAGIGRTATLIGVDYGNQRIGEVGEMNVLDIVREMRQMRDKAVQSHHQFIFMLMCIADRMVLDGVPQNDNMLDLADFYTEFMKKVLMERKKKDEAEKAKKEKEEKRKRDEANDKTNEKSALSKTQSVLQ

SEQ ID NO: 5752 - protein, 341 aa, Caenorhabditis elegans
MSLPAKTLVQAAANSGLRAVSVRHSSQAPKVALLGAAGGIGQPLGLLLKQDPLVAHLALYDVVNTPGVAADLSHIDSNAKVTAHTGPKELYAAVENADVIVIPAGVPRKPGMTRDDLFNTNAGIVRDLAAVIAKASPKALIAIITNPVNSTVPIASEVLKKAGVYDPKRVFGVTTLDVVRSQAFVSELKGHDASKTVVPVVGGHAGITIIPLLSQVKPSTKFSEEEISKLTPRIQDAGTEVVNAKAGAGSATLSMALAGARFANALVRGIKGEKNVQCAYVASDAVKGVEYFSTPVELGPNGVEKILGVGKVSAYEQKLIDASVPELNKNIAKGVAFVKGN

SEQ ID NO: 5753 - protein, 512 aa, Caenorhabditis elegans
MILLLFITLFALGSTAPADQQITSLPNLTEPLRSKHYAGYLSISDVKQLFYWYVESEESPETAPVVLWLNGGPGCASMEGLFIEMGPFRVRNYGEEVNRNPWTWNRIANIIYLDAPAGVGFSYYNTTKKVFTDDEVAQDNFNALKMWFARFPERKTNDFYIAGESYGGTYVPMLSARITKANVDFPQFKGMLVGNGCVDDQINFNTNIMYQYYHAVVDETQMQNVTQQCCNGTMDCDYYTISQGNDTCGDLVNQLSYSIYYTGYDPYFLYFACYLNPNLPYPPHEEIRKLQKNVLRNNLYKKIIGESPVLKNKYFYPPSNDIQGQPDCASHDDHFPYLNSPEVKKALRIPDYVPKYEMCNMEIAENYQSQYPTMKKFFDTVIDAKKHVAMFNGDADTLCNYVENSQFIYKTLKKTVKTAMMPWNDPVQLPMAVGQVTEYDGITLISIKGGGHFPAATEQKPKETFQMFQNYVKHQNYSTPVAFDKTFNLTSTIIAVGSKLFLSFCISIILFL

SEQ ID NO: 5754 - protein, 644 aa, Caenorhabditis elegans
MADATSPFNVSILDNSTKLSEMVESGWNVLASTSVQAFNEAMDVLEESYPLCKKMLDHNNLFPERDPNDTRIWCNATYDTVLCWPPTPANSSVTLQCPHMKGLDPNKYIVKRCDETGRWAGKKPGHYENPWGWTNFTVCFKIDYEDAKYFHMCLFFYMLLRHYCHVKHKVLYTTTTHHTHRNILYLSISIQPINQSTTSTNISTVTLYTENITKDCHVSGVWSGRNAGEMGPTLPGWTNFTMCYTDEVIYIMQNLNNESLTIAQEVARNARKLEFVGLGLSLVSLILAISIFSYFRRLRVFRNLLHLHLMIAMLMVVILRLVLYIDLIFTGENGPHTNSAEGKTINTMPIVCEGMFFFLEYFKTVTFCWMFLEGIYLNNQIVFGFFNSEPKLLPYFIAGYGIPLVHTMLWLLVVLIKKDFKVERCLGSYYLEPEFWILDGPRMAELVINLFFICNVIRVLYSKVRESNNTSEAGLKKSVKAAMMLLPLLGVPNIMQTIPFAPTRDNIMVFAVWTYTASFTYMYQGLMVASIYCFTNKEVNHVLKTFYARYRLLHKSQNELRRGSRSVASHYAAKNGTANASAPQTNNADEFGKLSPFPSRSKKGSDDSTTKLMKDAVMEEEKNANNNGYGSAGEMTPLREGYEE

SEQ ID NO: 5755 - protein, 971 aa, Caenorhabditis elegans
MEVDDEPESSDAADSFKRFERLLQKTENFSHLATGAPVDTKKRGRPSKKNGIDGDHRHRKTEQEEDEEMVADAIKSDDLVIFDKSPFYIENGEMRDYQVRGLNWLASLQHNKINGILADEMGLGKTLQTISMIGYMKHYKNKASPHLVIVPKSTLQNWANEFKKWCPSINAVVLIGDEAARNQVLRDVILPQKFDVCCTTYEMMLKVKTQLKKLNWRYIIIDEAHRIKNEKSKLSETVRELNSENRLLITGTPLQNNLHELWALLNFLLPDIFTSSDDFDSWFSNDAMSGNTDLVQRLHKVLQPFLLRRIKSDVEKSLLPKKEVKVYVGLSKMQREWYTKVLMKDIDIINGAGKVEKARLMNILMHLRKCVNHPYLFDGAEPGPPFTTDQHLVDNSGKMVVLDKLLMKFKEQGSRVLIFSQFSRMLDLLEDFCWWRHYEYCRLDGSTPHEDRSNAIEAYNAPDSKKFIFMLTTRAGGLGINLATADVVIIYDSDWNPQSDLQAMDRAHRIGQKKQVRVFRLITENTVDERIIEKAEAKLRLDNIVIQQGRMSEAQKTLGKGDMISMIRHGAEQVFAAKDSTISDDDIDTILEKAEVKTAELNEKMGKIDENNLRNMTFEDNAKFTVYQFEGENYKAKQADGMGHFWIEPPKRERKANYQVDLYYKEAMRAGNPTEKQSKAPRPKLPQVFDFQFYPRRLFELLDKEIYHYRKTIGYVAERPKDVPPKEAEKRQAEEQKLINNARPLTDKEQEEKAELLTQSVTDWTKREFQQFVRGNEKYGREDLESIAKEMERPLEEIQSYAKVFWERIEELQDSEKVLSQIEKGEARIQRKYAVKKALDAKIAKYKAPFQQLRISYGTNKGKTYTEEEDRFLVCETHRLGHDKENVFEELRQSVRMAPQFRFDWFLKSRTAMELQRRCNTLITLIEREMGEVVESKPVIVTAADKKKSVAKDLSKSSGTPTAKKVKATPK

SEQ ID NO: 5756 - protein, 319 aa, Caenorhabditis elegans
MDRLIRSLLMNQNKQATDKLDHPDTSETVNISSLALLKMLRHARSGIPLEVMGLMLGDFVDDYTINVTDVFAMPQSGTSVTVESVDPVYQTKHMDLLKLVGRTENVVGWYHSHPGFGCWLSSVDVNTQQSFEALHPRAVAVVVDPIQSVKGKVMLDAFRSVNPLNLQIRPLAPTAEPRQTTSNLGHLTKPSLISVVHGLGTKYYSLNVAYRMGSNEQKMLMCLNKKSWYDQLNMSTYSELEKKQEEKFKSINKLIAVFNKDIDEVKEKPIADKKGKTQEEVKKFGKINAKQQLQMITSSLLNDSLCHQLTAMINAKSMT

SEQ ID NO: 5757 - protein, 402 aa, Caenorhabditis elegans
MTDVKNDVNVSSVVDADGLIEGNYDQVVESFDDMELKEELLRGIYGFGFEKPSAIQKRAIVPCTTGKDVIAQAQSGTGKTATFSVSILQRIDHEDPHVQALVMAPTRELAQQIQKVMSALGEYLNVNILPCIGGTSVRDDQRKLEAGIHVVVGTPGRVGDMINRNALDTSRIKMFVLDEADEMLSRGFKDQIYEVFRSMPQDVQVVLLSATMPSEVLDVTNRFMRNPIRILVKKDELTLEGIRQFYINVQKDEWKFDCLCDLYNVVNVTQAVIFCNTRRKVDTLTEKMTENQFTVSCLHGDMDQAERDTIMREFRSGSSRVLITTDILARGIDVQQVSLVINYDLPSNRENYIHRIGRSGRFGRKGVAINFVTENDARQLKEIESYYTTQIEEMPESIADLI

SEQ ID NO: 5758 - protein, 459 aa, Caenorhabditis elegans
MEINEQPFFHGLLPREEVKLLLQKNGDYLMRTSEPQGQARHLIISVMQNETSQEVAHYVIRTSDGAYSITDKIKFGTLTELVNHHKQAKISEVRAIHAHYRLIIVVQEVASSVLVNPIGRQSWELNHADITMTKVLGEGAFGEVKLGTLKMGSTTVDVAIKVAKLEKVTKEQIKEIITEARLMRGFDHKNVVKCYGVAAIDEPLLVVMELVPGGALDKYLQKNSSVQWPEKLDIIAQVAAGLAYIHSKNIIHRDIAARNILYGKGVAKVSDFGLSRVGTEYQMDPSKRVPIRWLSPETIVSFLYTPQTDVFAFSILCWEVIENGAQPYPEMLVVQVHQKVGRDDYRMPISQKAPAMLADVIKKCWIRDPQQRPTMSQVVQMMYEITGKKDKTSVNKSTGQLRAKMMSTGPMSDPMRDKTAKKTGRRNKKKPSSASNGPGGNSGPSSGPLSGKDSRLKKP

SEQ ID NO: 5759 - protein, 363 aa, Caenorhabditis elegans
MELKEELLRGIYGFGFEKPSAIQKSAVAPCTTGKDVTIQSQAGSGKTVISLIDILQGIDCEDAHLQVILLAPQRGMAQRAHEQLKSLGRNLNVNATCLGFDTTAENDKISHVLMGTPKDFLSNIPSDTSRIKMFVLDEADEMLSKGFKDQIYEVFRSMPQDVQVVLLSATMPSEVLDVTNRFMRDPIRILVKKDELTLEGIRQFYINVQKDEWKFNCLCDLLKTSRETQALIFCNTRRRVTQLTEQLMSIPIKVSCFHGNMEHNEREDMVKDFNSRNTRVLVTTDLMARGMNIRKSLIINYDVSGNMENYMLRNGRQGNFGSKGLPISFFTENDISDLKKIENHYSTRIEEMPESFLEYLDEN

SEQ ID NO: 5760 - protein, 2500 aa, Caenorhabditis elegans
MHSTSGLAPVFRVEENHMIRNRENLERPISKKGTITLLSKMPMGFVLNSCSCAYIDNLLAHSSIHRVKPHSFMIQRLVVICGRSSPSLPNHAANIILSAFNFCQIEAPAKKFLEEDAALSLFHTILSYSTVTQINRSGIEILGAQRLTSALCDLIYAYTKTMDDMVASKTLTHLCKKLAGLFDPLVVLPFISKLAKSRRLRHYLQPLFLGHCEYTSDTWGVSPEGAEIYNQIARGNFTTQTLIEIVQTFLEKEVKEVIISSTTDPIKLVQYLISCSNPDNTEIVQALAFLLYSNTKLLPAGSGGTIDMDVQAADTITTARLGDTKFTQPVKDALLDSGREALLRRMEIYGVSLLSSVENFVTELKQAPIQKKMVTNNSVANAILYMLQYNFDMSRDIENGRQDNSPFWGGSNFVIGITRFVEEQQAAVRDMEGFSDWYPDINWVEVIKEFDSEEFAICRQTIIMFADIFPIMFQPQNFPVSFFLTPWRYYDHQLRLFEFMIEYADTSLSKHMRQHVIYCLTSMHAADSSQLAKILDVAHDIKPTGLSELLNQAPKHLAFMVDLACLASKRDYLNLEKWIEDKEKAHGEAMTVAVLQFIQKKYQHAQLVAAIAPKTQATTPGAPSEPLQVLIPFVSKRARKPLRQQFPLVFQVMKENSGRSSSVSSGGHVQQSSGSQPQQQQFGGGSGLPPSGVVPVQQQPQQPPSLQQQHSQQSLPTPPTTSQQQIHVQQSVPGPIQRPAQFAPQPMFPPQAQAQHQHQHMMGQPPPSSQNAQPGMNLLMNMSPFASGNNRDLLKVVQPAPPPPSSMSPSTQMMRSLIPPLTQRQNSNSGWHAAPAPQRPSGPPTPQQQMDFRGQIQEFAPQGPHQLQRSGSVTGRSMGIVGQKTSSNFSVGAPIPGSAAATAAAAANVQQPMNEDFQSMTFAEDIQEEANSYFEKIYSVNNAMSVENLIDLLKRFRVSNDRRERLVLACVVKNLFEEYRFFHEYPERELRTTAAVYGGIIREDIISNVQFATAVRKVIESLSADPNTMLWTFGIVALQHCRSKLCAYPKVCQMIVSSENFARFPQLLKDYVIAGVKGELPPEGGRHTPVGSAQAGSASSTPTPAAAPTNWGAVARAASVDPKNSLPANRTGNVLSYTNVDTLVMATNKDGAEIAQPAEAIVDKISFLFNNLSQSNLIQKKDEVVEMISDHGDAFTLWLAQYIVMKRVSIEQNFQPLYNQFVNAIENPYLDHDRQLLKNLGSWLGAITIARNKPILLNDLDLKSLLLEAYYKGQAELLYVVPFISKILTACSKTSLFTPTCAWIRSILKVLAELHNEPDLKINLKFEIEVLCKELNVDLNQLQMDGILKDTEKLVRVPQQLCDVKLLTRPEAASPVQSKIHMSGSAEQLSGMSPAIPDQVKPATPQPTEAELQSGTGGGGSQGAEAQVVPNVTHFAYHDINVLTYDGLIPHVKIVSHLPLFQLHPHAKHLVRPAMIHAIKELIGPVTERALKIAMTVTESLVRKDFALDPEEQNLRAASFHMMRAMTAGMAMITCRDPLASSMHSNLANAFSSSLRSTAANPEMKQMIEDAAATITQDNVELSTNFIVKTACEKATQDIEKRLEADYQKRIAAKAEMSFYRDEIAAAIHAQLPKAIATVPGPTDKALMGIYDQFSSRICGFKANSGEDPVSAEPGSGAITPVQTQSKEMELVCQQLQVIIKEVDQTTQAQPHLSNSAFQTVCLMRELMQNVISTKDANHLMILVTRSTEHLLHAYRLEGTPPKNLLDVEWARRLRDLFIGLMRLLQNYFPLVELSRRITTAIMQIRSDYKWNMEGIEILFKQNLLQSVLWDQHLAGSMDNGGNMEAVLFAQKFVRSIGGGDMSRIQFLKERFPLTCEQLTKLHQLQSATRTEGMNNAMNNGAGNAAHHHAGLQQQPPVALPMEAAPMPQASADAMAQRGYDDQEMTAKVEIIMREWIGLCYSPTGQRSPQESLAQMIQLMHEHGVLATDDKITQFFRLCVENCVDISVRVMKSEQLANGLPTTLIRHRCYYTLDAFVKLMALMIRHSDNGQSQNKINLLKKLLNIIVGVLHMDHEVRKQDFNAMPYHRILISLFNEITGPDPLKLLEPIAWSILEAFGQTFFALQPRRMPGFAFAWLDIVGHRNVIGRLLANTGIAETVDAVKTAATYTQLIISHLKFLAPFLRNIQLPKSIAILYKGTLRVLLVILHDFPELLCEFHYVICDTIPPNCVQLRNLILSAYPRQMRLPDPFALNFKQVDTIPEMAVEPKSNLNMATIIPDNIRIPLDEYLANRISVDFLPNLPTLLQTQNQAGTKYNTTVMNALVLYVGIRAIEHLHLRRQRISTLNIAHTSYMDIFQNLAIQLDTEGRYLLFNGIANQLRYPNAHTHYFSCVFLYLFKNSTNDTIQEQITRILFERLVALRPHPWGLLITFIELIKNPTYNFWRYEFTSCAPEIQRLFQNVANTCVPAQGSQPQAQPDGAPGPLGNNTGAANQQQNPNTN

SEQ ID NO: 5761 - protein, 463 aa, Caenorhabditis elegans
MGKEKVHINIVVIGHVDSGKSTTTGHLIYKCGGIDKRTIEKFEKEAQEMGKGSFKYAWVLDKLKAERERGITIDIALWKFETAKYYITIIDAPGHRDFIKNMITGTSQADCAVLVVACGTGEFEAGISKNGQTREHALLAQTLGVKQLIVACNKMDSTEPPFSEARFTEITNEVSGFIKKIGYNPKAVPFVPISGFNGDNMLEVSSNMPWFKGWAVERKEGNASGKTLLEALDSIIPPQRPTDRPLRLPLQDVYKIGGIGTVPVGRVETGIIKPGMVVTFAPQNVTTEVKSVEMHHESLPEAVPGDNVGFNVKNVSVKDIRRGSVCSDSKQDPAKEARTFHAQVIIMNHPGQISNGYTPVLDCHTAHIACKFNELKEKVDRRTGKKVEDFPKFLKSGDAGIVELIPTKPLCVESFTDYAPLGRFAVRDMRQTVAVGVIKSVEKSDGSSGKVTKSAQKAAPKKK

SEQ ID NO: 5762 - protein, 334 aa, Caenorhabditis elegans
MEEPMEVDNKRPKVLTWTEKYRPKTLDDIAYQDEVVTMLKGALQGRDLPHLLFYGPPGTGKTSAALAFCRQLFPKNIFHDRVLDLNASDERGIAVVRQKIQSFSKSSLGHSHREDVLKLKIIILDEVDAMTREAQAAMRRVIEDFSKTTRFILICNYVSRLIPPVVSRCAKFRFKSLPAEIQVQRLRTICDAEGTPMSDDELKQVMEYSEGDLRRAVCTLQSLAPILKSGDDNARNCYLRGSSDSLLISNVCKSILTADVPQIIALTKDITKSCTGVAFIRRCFQQLMDEDVINDENIGVMGKLVATCEKRILDGCDLENNLLDFLLTLRETIQ

SEQ ID NO: 5763 - protein, 450 aa, Caenorhabditis elegans
MGNVATRKRPGCHHHIGRNEENLDDDEDGPAKKRLRIGEPQAENEYQKLAFKSRLQKLKKCRPHLKRRTYKVEEADPRPPVPRFIVDDYAEPTRKEFAIPWFEHLFLPEFPTRSVINEKSFVLERQLGRGSFGVVYCASAIHDSERKFAIKMQEKREIISKRAVLQVKREASIQVCQQDVTSDHSHFQRLLPSHPFIARTYSTWQTRTHLYSLLQYPTGSTGDLFSVWRQRGSLSEAAIRLIGAELASAIDFLHQNDVIYRDVKLENVVLDQWGHALLIDFGLAKKLKQGSSTGTICGTLQYMSPDVASGGTYSHYVDWWSLGVLLHILLTGIYPYPNSEATHHANLKFIDYSTPIGCSREFANLMDRMLAVSITHRLCSFTVLHAHPFFRSIDFSKLEQKDYTPAAEIGNAEYDTYHKSEDALDDALFKENYDVSCGRNVIFAVLPVFW

SEQ ID NO: 5764 - protein, 338 aa, Caenorhabditis elegans
MVGTHPANLSELLDAVLKINEQTLDDNDSAKKQELQCHPMRQALFDVLCETKEKTVLTVRNQVDETPEDPQLMRLDNMLVAEGVAGPDKGGSLGSDASGGDQADYRQKLHQIRVLYNEELRKYEEACNEFTQHVRSLLKDQSQVRPIAHKEIERMVYIIQRKFNGIQVQLKQSTCEAVMILRSRFLDARRKRRNFSKQATEVLNEYFYGHLSNPYPSEEAKEDLARQCNITVSQVSNWFGNKRIRYKKNMAKAQEEASMYAAKKNAHVTLGGMAGNPYGMLPGAAAAAGLLNPYNPMNIPGQDTLHMGMPPFDLSVYNPQLMAAAQYQQQMDNADKNS

SEQ ID NO: 5765 - protein, 409 aa, Caenorhabditis elegans
MIKRKLQDLAVCCSYQVDFLHEKKHSVKEFKRKYEVLDEIGRGGFGIVYEATTRQDGQQPVAVKFVQHKHVRSWTMTCRQLIPSEVCHLETCEDIPGVIKILDWFANSKGFLIVMERPANCMDLFDMVSVHGPLNEDMGKFIFKQVITTVFNMYSKHGLLHRDIKDENLIVNMNTGEVKLVDFGATAYAEKATKKEFQGTRSYCPPEWFRDQLYLPLEATSWSLGVLLFILLTGKLPFRNEIQICLGNVKFPPDLSKEVCQLVKSCLTTSTSARASLAQIAAHPWMETDKPFFGGDLTFEEALMEIKNPPVVIEDKEAEEEDNDLNDVVILTRSRESRTDLDAESICTMVTAVEDRYEPSIAVKELEQEEIVETGETTNLMRSESRYDNISSSSFCDYVSLVSSSYLLT

SEQ ID NO: 5766 - protein, 442 aa, Caenorhabditis elegans
MSLVFISSLLFRMGESNENLENNVTRLLDKLIASHDRRIRPNYGGPPIEVNITAHVTTISAVSEVSMSDVEDSLTIGIDMVKTIWTPDTFFPNEKKSFFHEATSHNSFLRIDNHGNVLRSIRLTVTANCPMSLHTFPLDRQECALEVESYGYSTKDIIYHWHGTNAVTIDENVHLAHFTIGEHKHIERTISLSTGNYSRLTAYFLFKRNIGFYLIQPLKYDFKKTEKILAFQIYFPSSLIVVISWVSFWLNREAVQARVAIGVTTVLTMTTLMTSTNASLPKVSYVKSLDVFLGVCFFIVFASLLEYAAIGYLMKRNRSVPAASPVQYYETEEFFEIQCHPKFVRGAINYCDGVLKREASRKKSRNRRDSSMKNYQNNNIHHRPSDGHVDQRIPLLSMVPMPPIPFKPQNGAWGKVDLFSRFAFPIFFVIFHIVYWTYYINQ

SEQ ID NO: 5767 - protein, 1259 aa, Caenorhabditis elegans
MSSDDYESIDTPRVASLADMNRLPTQSRHSSYSTDDDEDVTPTPSASNSAPKNTILDPLQAQFLHPNSENSDIDEPRVQLREKKKATRAQDATVSHFLEDQVPNQKFKRRSAERHSMLAGAADFASRRSPFHLSGANGSGRWTDLFSSSRFKRKQRQELNNVPSSSYSNNDYGTYAGTQSIGGFSIASNSTGESFALSGTEDEIREEFRKIMLDKGLPEADKIISNTPLDQMKMMIENSRKQDNQAKGRSPEWVVRVLGEILKTKNIPECKQDIVTVRVQLVGQGVSFLNKFAVEVHDESGRTGADLICCLYSLVLKRLRSSEVGSKYELDLIDFLQEIVRCVRTLINTHVGLVLVLRRNSPVYSLLIQTLCVLNRREQNDHEAAEIRAIRVDVVRTCYTLIFVQHDTLSTPIEMTGQQKMFMELSLIAKAESKRLNEPVSRFRPLISCIDFLESRDPKQGMYVLLMINMMINGVDRNISDDQMWTEETMWQARMRLRSEAAKDKLHKYIEKFTTSETVNSQIRDVAQNMLTEHNADLETLMGKLENVKGEYDTLDGCFELLAANSEATGTETVLLSILQLMTLTNEDMSTKRSYMKLIETAISDILLHRTPIDPQADYKFVFEVPVAEIIDKMQDEEMAKKVRQATSAKQEAVAMQGEYWKTLCDFQKEAEELRKHINDPKIPLPPPTKMNLSAPSTSAGGSSALPPITGGPPPPPGLPPITGGPPPPPPPGGLPPITGGPPPPPPPGGLPPISGGPPPPPPPPGGCPPPPPPPPPGGFKGGPPPPPPPGMFAPMAPVIPDYLPPKKVPKVDGPMRKFPWGAHTINPRDIPRESFWVGTNEEQLTSDRMFDRLRTKFATKPAANSGTLGGVLNSKKKVKTAQVIHDDKLLQKLGILQGSIKMSHSELKLAILEVNEKVLTVGFLEQLRSAMPVEKELIDKLRAVNKAQFEEMPEGEQFVTRLLQIQGLPLRLDLVLFKMRFSEVLNELKPAMSSVMEACEEVRASEGFRTFLKLVLATGNFMGGATKNYSSAYAFDMRMLTRLVDTKDVDNRHTLLHHLIEEMKRIDPRRARFALTDFHHCIESSRVNADEIRKTVQLTENNIKKLENCLKVYKIQGERDLFDEKMRPFHEKAVKEFSTVSSMCGKMKNDWESLVKYYAFNDKKYPMEEFFADIRTFSEQYSNAWKELDAEAEAKRKEAEFETQKRKQLQQSQQERKPLQERQAINRVPRTPAAMIRVSTAADKAGVLDELERAYRKC

SEQ ID NO: 5768 - protein, 548 aa, Caenorhabditis elegans
MSQQAGNAQRGRFDEEPMSLGEKISHRMDQLKEIVSSSCPCAGKFPPVAIVLIVALIILGVIIAVPLVIFLSPSAQAMSSGTRDLSSHSIRHPKVWPKTEKVQDDDLSAIQMTSLLPPNVSTCSGFGFACTGSIDMIIPSSKRCDGLKDCSDGSDEENCKECQSIYSCRAHIEEESEKKDKTSVLPTLICLTAEKLCNGVENCPDGSDEASCRSKCSKDQFKCSGSDACLPISVKCDGVSDCENESDESNCNKCQKGAHKCGKNCIKASKVCDGIPDCDDGSDEHQCDCKTCSGSEKALCEDGTCIMRSQVCDGKHDCLDGIDEENCPGSCSNERFSSKLKLLTCDDGNQYSEVEACSGLVEACELNCPKCDPKHTFTCPAVGGIHNKCIKRSKVCDGIFDCEDGADEKKCTPVKECVVESSIQFTCDNKCLESSRRCDGVWDCEDKSDEKGCDKCPSRSFKCSADKKCLPFHTRCNGVAECSDGSDEHKCSCQECLGTHHDTYMCSESNRCLKRGEVCSPYSMCPNATYIDKAYCASLALKNSGLRP

SEQ ID NO: 5769 - protein, 162 aa, Caenorhabditis elegans
MMILLEVIPVPAEINISFELGDLKNCGVKAYENVECEETNLLKWTVLLIPDKEPYNKGAFKVGITFPVDYPFKPPKVAFETKIYHPNVDEEGKFCLPIVTAENWKPATKTEQVMMALLSLINEPEPSHPIRADVAEEFQKDHKKFMKTAEEHTRKHAEKRPE

SEQ ID NO: 5770 - protein, 325 aa, Caenorhabditis elegans
MSFAGLLDFARKDVDLPQNSPNELLKDLHANFINQYEKNKNSYHYIMAEHLRVSGIYWCVNAMDLSKQLERMSTEEIVNYVLGCRNTDGGYGPAPGHDSHLLHTLCAVQTLIIFNSIEKADADTISEYVKGLQQEDGSFCGDLSGEVDTRFTLCSLATCHLLGRLSTLNIDSAVRFLMRCYNTDGGFGTRPGSESHSGQIYCCVGALAIAGRLDEIDRDRTAEWLAFRQCDSGGLNGRPEKLPDVCYSWWVLASLAILGRLNFIDSDAMKKFIYACQDDETGGFADRPGDCVSFLNNIQKFIFVLQSNNVLATTKQLFECSFNNS

SEQ ID NO: 5771 - protein, 735 aa, Caenorhabditis elegans
MLTLRPVNVIVDLEGSYRTRAFLRALEESVLVKKEYHYVFSNFDVDETDLSGFHFSLINITIFRIFDKNNKKFLKTRAEFHDVYRGGFSNTDSIPTAAAFAHDAILVAGKALQIAMNEHGKGIFDKSFVRHQLFNRGRKGLYCRPHEDQTESRQFETFEHGKKIAEAIKKVVLTDKDGTLTGRIQFDKVTGKRTNFSAEIVEIKPGVNSLNSIWERFQWAEGEGFLLGGERYVQEKKKDSSQTRKGILPSKPWQLRFNVVTVLVKPFEGYCIDLLNLLAKNITGFEYDVFISDGNKYGSRQADGSWDGMIGYLLNETADVAVAPLTITQERERAVDFSKPFMTTGISIMIKKPEKQEFNIFSFMEPLGMTIWIFTLSSYFGVSLTIFLVSWFSPYEKRIEFKRGEFTVTNEFTLYNSLWFTLAAFMQQGTDILPRAVSGRIASSCWWFFTLIIVSSYTANLAAFLTLERMTPPIESVEDLANQNKILYGVNEGGSTAAFFEDSIVPLYKKMWNFMVSTTQKQIELEKQSITNSTSNRIFVSSYADGIEKVRTSKGKYAFLLEETTNNYESGRRPCDTMKVGQNLNTLGYGIATKIGNPLRYVKNSVSLRVSLNLAILYLSEKGELKKLENKWWYDRGQCDTGTSDGGTSSSLNLSKVAGIFYILLAGMVLSMCTALVEFLFRKNKENREKERNRMRSSRPLKPGILASCERAKQKQLQNRRTKSEEVSTPRSTLF

SEQ ID NO: 5772 - protein, 436 aa, Caenorhabditis elegans
MPGSMSKLGGLATGLLACSRSGALSNQVRGVVHKSLLRLPSEHPEPWDYKHNGFNYIDGLKDDTRSHFHQNSKLIVVEGNIGSGKTTLAKQLADQLGFVHFPEFRMDDILVDRYGNDLRNYYNKFPARYRLPDISMFYKNPSGELSAAMQDRIFNCRFDQYLNALAHILNTGQGVVLERTPHSDFVFANAMRDKNYIGHEYFKHYYFVRKNALPQLHFWPHLVVYLNTPTNKCLENIKRRGNTDEIATVDERYLKTIEESYKDSLREYRNHSKILAYDWTKPGDTDAVVEDIERLDLDFFEWHSGDVMEEWNTIVDSVGWNGWRQYVTNKYDARMLAFDGIPKHEVGELYTNPRDTGHFLHVMRKEVLKSPYGYGYIAKNGDHQAGLNAWHTGHHLPEPWYEYYFREAYYDDLTSHETSLDLDSDSYDPDYVHHHH

SEQ ID NO: 5773 - protein, 717 aa, Caenorhabditis elegans
MAHPSCVGFHIRLSSTYLPIPGVQFANGKASEVGASKGLSILLILIYPYYLFQANWVDDRDGPIRNIQGHASETFPGKDTVDKVWRKCVELYDESPCLGTRQLIEVHEDKQPGGRVFEKWHLGEYVWQSYKEVETQVARLAAGIKDLAHEEQNPKVVIFAETRADWLITALACFRANVTIVTVYATLGEDAIAHAIGETEATILVTSSELLPKIVTLGKKCPTLKTLIYFAPVDQKAPAPELAPFRDQFKHVLSLSGLLTRNQEQVKESTAVKSDIALIMYTSGTTGQPKGVILLHQNVVAALLGQGDGVGIICNADTYIGYLPLAHILELDAELTCLTKGAKVGYSSPLTLHDRASKIQKGTHGDCHALRPTLMAAVPAIMDRIFKAVSEEVAASPRFMQELFKLNYERKRSRYLEGYCSPFLDRIVFKKIRRLLGGKLRGVLSGGAPLNAETQRFMNICMCCPVVQGYGLTETCGAACVADINDLSTGTVGPPVRCSDIALREWSEGGYSPFNDPPQGEILISGENISPGYYKQPEKTAEDFITYKGKVYFATGDIGQKRDDGSLLIIDRKKDLVKLQHGEYVSLAKVECALLNCPIVDNICVYGSGMEDSVVALVVPNQKHLEKIAEAEGVSTSEMKTMCEDKKVIAAYKKQLEEHAKKSKLSRSEIPAAIHLCPEIWTPDTGLLTEALKLKRKPIQMAYQKTLDDLYKQLKKN

SEQ ID NO: 5774 - protein, 156 aa, Caenorhabditis elegans
MKEPHSFRRVKMFGRQVGRVVFRTASVVVQRRSVSASVPQMVKLVAPSVNFIQTRGSKIEVFGPFDPPKQLTFKQVEDRVLKAVRSWDRFPADKESLLKLDADLSKDFGFDSLDQVEIVMALEDEFGFEIPLQDSDKFKTIRDAFKYICEREDVYE

SEQ ID NO: 5775 - protein, 610 aa, Caenorhabditis elegans
MHKIFIIFGLLSLCAAHSLRDLSNKDEEDPPSSAPGVRKRRMMSEEDQKTVDYYMDKLNKLADEKHPEEIERHKNPELVAWDRKRDSVLNPEEQGKFFQGDIVLYPEQAKALYEQALTEGKTRVKRKFIGSNLRRWDASRPIIYAFDGSHTQREQRIIELALEHWHNITCLNFQRNDQANSGNRIVFTDVDGCASNVGRHPLGEEQLVSLAPECIRLGVIAHEVAHALGFWHEQSRPDRDQYVTVRWENIDKDSKGQFLKEDPDDVDNAGVPYDYGSIMHYRSKAFSKFDDLYTISTYVTDYQKTIGQRDQLSFNDIRLMNKIYCSAVCPSKLPCQRGGYTDPRRCDRCRCPDGFTGQYCEQVMPGYGATCGGKISLTRSTTRISSPGYPREFKEGQECSWLLVAPPGHIVEFQFIGEFEMYCKIRHSLCMDYVEVRNSTDFANTGMRYCCYGTPPTRIRSATTDMVVLFRSFYRGGKGFEARARAVPEAGNWNSWSPWTACSATCGACGSRMRTRTCPPGNACSGEPVETQICNTQACTGMCAQKREEEGQCGGFLSLLRGVRCRQEKTVMAPCENACCPGFTLQRGRCVRYLIRCKKHFTLIIFVLKN

SEQ ID NO: 5776 - protein, 377 aa, Caenorhabditis elegans
MAGGLFKLMKDKSVDHSHLHKDHSIHHPTPPRSFFSSSSLAVHPNVETAQSSSEEDLRMPNIKVFSGSSHPDLSTRICERLQLEVSKASLKKFSNKETNVEIGESVRGEDVYIIQSAAGEINDNLMELLIMINACKIASSCRVAAVIPAFPYARQDKKDKSRAPISAKLVANMLSVAGADHIITMDLHASQIQGFFDIPVDNLYAEPAILKYIKESIPNWQTSVIVSPDAGGAKRVTSIADRLNVDFALIHKESKRANEVEKMTLVGSVEGKVAILVDDMADTCGTICMAADKLVEAGADKVYAFCVHGIFSGPALTRLNASKFEAVVVTNTIPQDENMKKCSKIQCIDISMILAEAIRRTHNGESVSYLFSHVPIC

SEQ ID NO: 5777 - protein, 629 aa, Caenorhabditis elegans
MRYVAPITASHFTPSVPTQRRWMASEPQRHEFQAETRNLMDIVAKSLYSHSEVFVRELISNASDALEKRRYAELKGDVAEGPSEIRITTNKDKRTITFEDTGIGMNREDLVKFLGTIAKSGSKDFIENNKENAEAVIGQFGVGFYSAFMVADSVVVTTRKVGSSDADGLQWTWNGDNSYEIAETSGLQTGTKIEIRLKVGDSATYAEEDRIKEVINKYSYFVSAPILVNGERVNNLNAIWTMQAREVNKEMHETFFKQLVKTQGKQEMYTRPQYTIHFQTDTPVSLRSVIYIPQTQFNQLTFMAQQTMCGLSLYARRVLIKPDAQELIPNYLRFVIGVVDSEDIPLNLSREMLQNNPVLRKLRKIITDKILGSLQSEMKKDPVKYSEFFKNYSLYFKEGVVTEQDQGVKEDVAKLLLFESSSKKAGELTSLGDYVKRMQEGQKEIYYMYANNRQLAESSPYYEVIKSQNKEVLFLYDPADEVVFLGLGQFGMKQLVPVEKWAQEEAEKTGTDDKKDTKDFRDNEKKELLDWMKETLGSVRVSEISGNHRPSEHPVMVTVLDMGAARHFLRTGEIKDMEHLVYFKPHVHVNLTHPLVKAMYKMRKTDKETAAILAEQYSLKEHTFSYIAK

SEQ ID NO: 5778 - protein, 581 aa, Caenorhabditis elegans
MSTKEEITKEIEEQGAEVRRVKGDKNSTEEAKKEAIDKLLALKLTYKEVTGQEYAAPNARQSKPKKEEKPKQQPKQQEKKQDGKKQTLLGVGTKKDDNYSEWYSEVITKAEMIEYYDVSGCYVLRPWSFAVWESIQEWFDSGIKKLGVKNCYFPMFVSNAALEREKTHIADFAPEVAWVTRAGNSEMAEPIAIRPTSETVMYPSYKKWVQSHRDLPIKLNQWCNVVRWEFKHPTPFLRTREFLWQEGHTAFANPADAEKEVFQILDLYAGVYTDLLAIPVVKGRKSEKEKFAGGDFTTTVEAYVACNGRGIQGATSHHLGQNFSKMFDISYEDPAKEGERAFAWQNSWGLSTRTIGAMVMIHGDDKGLVLPPRVAAVQVIVVPVGFKTENKQSLFDAVDKVTKDLVADGVKAEHDLRENYNAGWKFNHWELKGVPIRFEVGPNDLAKNQVTAVIRHNGEKKQLSLEGLSKTVKSLLDEIHTAMYNKVLAQRDSHLKSTTCIEEFKKLLDEKCIILSPFCGRPDCEEEIKKASTREDGEGAQMGAKTLCIPLDQPKQELPSKCLFPSCTYNAKAFALFGRSY

SEQ ID NO: 5779 - protein, 333 aa, Caenorhabditis elegans
MALNPFLIFVAFWSWVKWLSVSTLIIGGASYVGYLFTPDWREIVDSKHYYSNWKIRVYLSLPFNTASRVIGGLANQEIPVWLREHLLGGFARMYDCRMDDCVDPDFKNYPSFAAFFNRKLKESTRPISASPLVSPADGTVLHFGKVEDNKIEYVKGHDYDVDKFLGDVDLPQKDELDLYQVVIYLAPGDYHAFHSPARWVANQCRHVPGLLLSVRPTLLSHVPHLFCLNERVVLNGSWRHGFFSMSAVAATNVGDIVVDAEPSLRTNIVRRKTQKIMNTETEIHAPYVSGERVGEFRLGSTIVLVFQAPPTIKFAIKAGDPLRYGQSLVADGV

SEQ ID NO: 5780 - protein, 333 aa, Caenorhabditis elegans
MDVEKLNLDNIISRLLEVRGSKPGKNVQLTESEIKGLCQKSREIFLSQPILLELEAPLKICGDVHGQYYDLLRLFEYGGFPPESNYLFLGDYVDRGKQSLETICLLLAYKIKYPENFFLLRGNHECASINRIYGFYDECKRRYNIKLWKTFTDCFNCLPVAAIIDEKIFCCHGGLSPDLQSMEQIRRIMRPTDVPDQGLLCDLLWSDPDKDVTGWGENDRGVSFTFGPEVVAKFLHKHDLDLICRAHQVVEDGYEFFAKRQLVTLFSAPNYCGEFDNAGSMMTVDETLMCSFQILKPADKKKYPYGAGGVGSNRPVTPPRNAPAAQPKKGAKK

SEQ ID NO: 5781 - protein, 340 aa, Caenorhabditis elegans
MNLNSPAVSMLGGDTPAHGGPNSVLGGQGPSSILTGHGPNSVMGPNSILGPGSVLNPQSIQPMQSQQMHSLQGSSMQMHSHLANSNLNLNINPASVGPDRNPGSVMHHNLDINPPSVAYQNLTVPMTPLAYSVYDRDALTHQAPASNIAATMVPATPASQLDIPMPALQNIVSTVNLGVQLDLKKIALHARNAEYNPKRFAAVIMRIREPRTTALIFSSGKMVCTGAKSEEASRLAARKYARIVQKLGFQAKFTEFMVQNMVGSCDVRFPIQLEGLCITHSQFSTYEPELFPGLIYRMVKPRVVLLIFVSGKVVITGAKTKRDIDEAFGQIYPILKGFKK

SEQ ID NO: 5782 - protein, 527 aa, Caenorhabditis elegans
MGFFFEYLEFNSRINLGKLIDTLLTDYDTHLLPEAEGVNVTIELHVQGVSGISEITGDFSLDVMYSEIWQDPRLSFKHLNVCATNITLKVSDFRKKIWTPDTCIINSKSSSIHSSPSENTFVILYENGLVWSNFRLNVKTPCSVNLKMFPFDSLSCEIVLESYSFNTDEVRLMWHDVPITMMEKVELPDFDLIGWSTDHQRLEYPNGIWDRAKVKFTFARRYGFYLFQSYFPTSLTVISSWVGFFFDVRSVSARITLGVSSLLALTFQFGNVLRHLPRVSYIKCLDVWMIFSVIFIFCTLVELAIVCQLNRWERERQIGSKVLGHWLNQIRKTRKKESKADEGGGGGVGGLLRKRIPVLAQLKAAATDSNSGAATAMTTAIQPPNTNLNSITNSDNSKLVANNFTSIEHETYAYEKKRGFSHCFQRFVYAICPPDRDWTITSVQVDRCSMIMFPLSFLIFNVILVNIFHENGSSHVNSSHSLFPHALPPLLVFVLFKNHRIFSYYFITGMLKLAIKSPQKSWQWALR

SEQ ID NO: 5783 - protein, 501 aa, Caenorhabditis elegans
MSAVSMLQGEMLARGGAVIARGASLATARNFSRTTVPMAKIRKERDTFGELEVPADKYYGAQTARSQMNFKIGGPEERMPIPVIHAFGILKKAAALVNTEFGLDKKLADAISQAADEVVDGKLDEHFPLVTWQTGSGTQSNMNVNEVISNRAIEILGGELGSKKPVHPNDHVNMSQSSNDTFPTAMHIAVGREVNSRLLPALKKLRTALHNKAEEFKDIIKIGRTHTQDAVPLTLGQEFSAYVTQLDNSIARVESTLPRLYQLAAGGTAVGTGLNTRKGFAEKVAATVSELTGLPFVTAPNKFEALAAHDALVEVHGALNTVAVSFMKIGNDIRFLGSGPRCGLGELSLPENEPGSSIMPGKVNPTQCEAITMVAAQVMGNQVAVSVGGSNGHFELNVFKPLIVRNVLQSTRLLADSAVSFTDHCVDGIVANKDNIAKIMRESLMLVTALNPHIGYDNAAKIAKTAHKNGTTLVQEAVKLGILTEEQFAQWVKPENMLGPK

SEQ ID NO: 5784 - protein, 3507 aa, Caenorhabditis elegans
MTAGNNMFDDWNCGSHQIAKNFVNSSTPDLRPTFVVNFDTSTVICQHSSDPTDLHIHNMSSLCDGKQDCFVNPAMHDEVFPYCEHKCQSTCSGKGACLYDGAKPQCYCDSGFSGSACELQDKNECLEHPCHMMAQCQNTLGSYECRCLPGYEGNGHECTDIDECSDKLTSRCPEHSKCINLPGTYYCNCTQGFTPKGNQGSGLDKCADINECETGAHNCDADEICENSIGSFKCVNKCSPGYELIDGKCEDVNECGSEKLHKCDVRADCVNTIGGYECECEEGFEGDGKNCQRKCGHSVKLPSKSSCRKNSAICDRHASCHIVLDICDCKTGYTGDGITCHDINECDAKDTPCSDGGRCLNLDGGYVCCKNGQDDATCIKDQGAFCSGGCGDNAICSNATCACIDGFRGDPHKKCVDINECVENDSVCGGVGDRCVNLFGGFKCCQHGSTEAECTDQAFSSDSSTISSHGADFTTTGEQIIEGSGSIQTSSGGSITVTRGLIPKDVELTTSGRLACTSYCPPNSECVGGYCECVSGYGGNALVGCEDIDECITEICNIEANEWCVNLIGGFVCCNPTNATHDDCIDFLTKVKIYAYMIIIFLLKGLEITKEKGLHVIGGNEEDTVVATRSNHSTSDQLITQVVQQSRNFSTGQIILTRGKVSSGEAVTQTTDADEFGLEISAADLAGSGSGITLPTTLEPKIEGSGKKASGGVWTEEDEGEDEDLMEEGSGSWSTTINGTGITGSPRSEGTIRVRITTLGEDGEPETATKPGISAPDKTGEGSKTESDGEEKLTVEKDGKEAQSSGSSATSSGKKSEATSGSSSSSAKSGTGSEASGSSGASSSSGSGVSGESGSSVSTESGSFGTSSSGSVGSEATGSTGVDGSESGKPSKSSTEEKLPFTKNGEKSPISGSDTTGKESSEETTSRKPIEGSDSLTEGSGSGEWFETGSKGHFESGSKVSVTSGKGPTQSGAEGSGSGPKVPKGPGAPEITTDGEESSSTSTGDKSGGKPADKSDNKNVPKTGDKNPDITTDGEDSTSETSGGEQGPKGKSKGQPPGDKGSEVKKPTSEVDGPGNLSGTKGKSNVPLKPTDLPEEGSGILTTSSGGKNSTFEHGTKLERLPPKTEDKSSETPQLGLEISAGKKPEPEDGTSKEVGLEILWESTTPGSTTLDSDSVGLEISGSDLTKATKKPHVEIEGSGTGDEEITATTRDVSKSTKKPRVEVDGGDNGETSGVDGKPTTPAPTPSSSAESSTSRIPTTSEASPEGGSGEAGVPESPDGSGESSTSAPDGVSPTSSATAPEVPTTSASSTPDAVEESGIPSTSKPTAEPLETTAPSTEVTSPEGSGTEESTLPPTEGSGESTTSSAPTVEPATVLPPQNRNEKPEPTKDTFALPTTTTGAPQANDSSVENTKCTSSDECGLDALCERRTGVCRCEPGFEGAPPKKSCVDVDECATGDHNCHESARCQNYVGGYACFCPTGFRKADDGSCQDIDECTEHNSTCCGANAKCVNKPGTYSCECENGFLGDGYQCVPTTKKPCDSTQSSKSHCSESNMSCEVDTVDGSVECKECMGGYKKSGKVCEDINECVAEKAPCSLNANCVNMNGTFSCSCKQGYRGDGFMCTDINECDERHPCHPHAECTNLEGSFKCECHSGFEGDGIKKCTNPLERSCEDVEKFCGRVDHVSCLSVRIYNGSLSSVCECEPGFRFEKESNSCVDIDECEESRNNCDPASAVCVNTEGSYRCECAEGYEGEGGVCTDIDECDRGMAGCDSMAMCINRMGSCGCKCMAGYTGDGATCIKIEEEPKSDKTACTDEWSRLCELEKKQCTVDEEEVPQCGACLPGHHPINGTCQSLQISGLCAQKNDCNKHAECIDIHPDSHFCSCPDGFIGDGMICDDVDECNNAGMCDDENTKCENTIGSFNCVCLEGFKKVDEKCVVDEKKQPNREKIEIDEENSSSSNSGQEKPTTKGIVSSTSATSSESTTAEPHVTTSISSTTSTKDMTSSKSPENVTMSSESPEVSTSSSKSTTASETTVSSTPSESSSSEAPLTSSPATTTEVITESSVKSTTPKEESSSEITVKLSSKSPEVTESSVKSSPSTPSTTSQSVTSTVPETSKSTVLSSEAPVTSTSPTEVHTSSETKPSLSASSTTGDTNSTTPSTSSLASVKSTSAPEGTSASVAPVKLSSLSPDVSQPSTKTFDATESSTVQASETSSGTSVKSTSEPESHVTKLSITSSNPSSSVPVTSPKSTPTVPESTEQPTSTTPSGQSLTPMNSNSEVLTTSEPHVLSSSLSPDVSQSSTTPNNLSESSTVETPKTSSEVSLNSEEPSTTEAPTTLSPDILSTTTNNLSQSSTVSTEDRSEISSENSEKPTSAPELVTSSVTHVASSSPDVPTESSEPDDLTGSSTENIPEASSKQTISSTPTPDTTTASEEPTKSTSMSPDLSTTSNVLSESSTTPESSSKSPVSSSTEGISVVTSTEFSKVPESTISSVLEEDLTKTTPSPILEETTTASETSEPLTEDSLTVSVRIHELTTSSENVPKESESTTTSSESSKPSQEPAGILTSTVVVPTSSVSLITASEIEAITSNTPFKQGRTPITTSPKSLVKSTTSPSTVTSSEPSESTKRTTVSTTVSTTTPTEETTTSESLILTAAPSKPTESTTESSEAPTTPAKTSETKPSNVSSTSRKSTENVETSTSQSGSLESSTMSSTSSEPETNAPAVTVSSEASSTTLEENSSTSSPTSSEASVKLSSLFPESITSEAVTVSSRAPAEITMSSESHREISTVSSEPSEPEIPLSTTVSPNVVTASSIPSEEPILSSVTSSSTPRVRLITGTPDDLIVSVTVPSHGNRRQNITASSVPSNSTSPIILPSESLTTPQPPPTTTTTAKPATTSGKRGPPSIQPPAEMFTTPAPPPPSNGGYGEETNQEEEQVTSTTTTEAPSLCSTVTCHSLATCEQSTGVCICRDGFIGDGTTACSKKSTADCISLPSLCADKAKCDNSTRSCECDAGYIGDGYVCSPHPQDCVLRDNLCSPEAVCQNRRCQCLPGFTGDGVKCVSIHERASNCSQCDANAHCVGGTTCKCNPGYFGNGLCCVPDPLDCVHFTGICHPNAVCNSESRQCQCSSGFSGNGVSCFPQKSCRTDKSVCAKNAICLPTGSCICRHGFKGDPFYKCSSLVSKEPANQQDLSDVSSCVTPCDSSTQLCISGECICKSGFRRNSTLSGSETCADIDECAEKSHKCDRVATCRNTFGSHVCTCPDGHVGDGITCVPHVNQGKLSVYCEADGMTLVLGNETADFEGKIFVKGQAENPYCSKSFSSLLNSRKPYVFKVVFQHCDVQLLDNHTMASTVVVQKHAMFLTNKADSYDLRCQYPIGSRAVESHVNVSELATTSTLTEKNSTLAPICRLSVSNDQHSSISSAMVGDTLKLALEVTPSENFGILPRNCFAINIESGERYTLTDDMGCAIDESLFPQWSAATSSKKASDDVTCCERRDSSGNGFDVRS

SEQ ID NO: 5785 - protein, 3343 aa, Caenorhabditis elegans
MTIRIFFSIFLLNHLIFFHLFNFTHQFSEETIKFSVSEDAKLNTIIGHLEAEIGYTYRLSRGNSKIKFDEQTLELSVSSPLDRESENAIDMLIITSPPSIIHILIDVLDVNDNSPIFPIDVQRVEIPETAPIGWRVQISGATDPDEGKNGTIGKYELVDSLATVDTMSPFGIVQSDGFLFLEVTGKLDRETRDLYSMRLTAIDQGVPELSSSCHLNILILDINDNPPNFGIRSLTLNWNGLPNTKLFSLNATDLDSNENSLLTYRILPSGPTSEMFSISDENILVTQNNTECLQRCEFVVEARDSGVPPLSTTLNIVVNMEYGNEHEPNINIRFYPSDYPFIIVQPEDVNGKTLAILSITDSDGPLGANSTIWIENGNEQSIFSLISRQSINILTVKHVENANQEQYILEFRANDGQSPADRITRKELKIFFKKYVKSTQIHVERESHVTVEKDTVPGSFVAHVETNCTDMCSFELANSDVFKIDPFNGIIVTSSILPEGVTSYHLPIRIHLPPPSTQLVEADVFVKVIQESVPKNLIRSSESPIHLKRAYTFTTWQDVSLGTVIGRLPKAQIYSTIDTVSELGVFPDGSVFVGKTITSDFVTLPVTLVNRNTTQTSIITLIVKPLNQHSPICQITEIHVLENAPIGTIFGRIQARDEDSGLSGVVSYKILTKSDDYDGIFHLDSTSGSLRSLKAFDAEKKRSYTFEYEAKDLGTPSKTTNCPATIFIEDVNDNVPKFGSRYYTATISGKSNETVAIVQANDNDVDVKNQKLQYHLLNYHDFFQLDKETGKVTTIQDVPMTWQRLNISISAVNMDSERFLQSKTFLLVTVTSSSKLAVQLNSGNLIRIFKNDKIGEKVGHLDIASSETVYWSTLDPRLHVDSSGNIILIRRNAKQASTGFDIILTSENGEKTEKVNFEVEFVDSERSEDVEKVMDIVLNENTTEVSNLMNDWKNWKISRVILENANNSGNNTFFLEHKKLWRTKNATVSNAYIILESEDQEGSPKSFKLLHVTTSPSPSSESSCISPAHLISPPSTVPLPSNCSNVKLQNLKTSLQIHENNLLIPTQSELINHVDLVSTQNSDMKPFMMTLIKDYLSEDVRFSTNNVLMLLSSIHPIGTSFGRVTAESGYRIRYYIVGTDKISIDADTGELILKERFYRNLNDILIVAVIPKGIAKAKITIEVIEDRLILPQSNFFIPSPPSFNSKSKIGKIPIDRDDVTIDVIDEHFYVRNFEIFVKRHFIPNSNFYDLKGTVKKGKLSAPISVTLFFGEKMKSREIRENELMFEIEENSPIGTVVGVVPNSDTTKYRLVDPTCGLLIDQEGIIRTTTVFDRENTSLLKTKMIEPSENRIWNLLIFIADVNDNKPKILNAPGRIIVYDDLNYKLEWEDLDAIASDVSFSIVDGDVFGNLEIEDSGVISLNSIPNESFNATIRIYDNRPPFKVHFDDVTIEFQVTQKLRAVTCEDAEFWMFFGNEDVGMLIASEIVTWRIVPQIGSDSFKIDPITGIIQSTPNTKPTSDIAKLKIQAISYDGERVGFCDVKIHIDKAAFVENVVLSNGTFEFNISETADRFTEVGKIVILGAGLEGSVFRIQDNDYNFTISPFDGTIFTNSPLDFENIKTYRFNITAGKSTSQVIIHVTDENDEAPRFITGDVVNLKVLEELDTVSYPLIIGSSIAEDLDEGQNGLVTYSILSGNTSLFAVNSTTGDILSLIPLDREESSLHELLIEAKDAGIPSLSATSKILIHVGDINDNTPEFELSSYFIKISENSKIGSKIIRILATDKDKDAELQYSLESNDEITIPFRINVATGWITVAGKVNREENEEFRFFVKVTDGEKSSKVIVEIHVEDFNDNHPMINDRNSDIFVPDPTRSVEIIHVINVHDLDKSDHLKFSLNNSNLNLSENGEITLKSPLQTAVPVRVTVSDDAGHVAFMEYLFHPHSRKHFPVFVEKLDTVSVREHDEQELAVFKANGDSIRYSIVSRCSDHLEMEKSTGILKTKSSLDAEEYSECLVFIIATTYFDNKPLSTITKATIKIVDINDNSPRFDQQLYRFNVTENSGPKLIGHVIARDIDRSSRVFYEIVGGDANHEFMVTESGQIESVRDLDRETKSEYHLIVEAIDDGKPRRRGNTTVIVTVLDEDDNAPRFSRIFHVEVPEDVRIGEPVIQLSASDADEHSNHRFELDGGGEGIPFRVDENTGMVFVNDSLDFEKKQSYRIKVKLTDGAWLIETSLFVNVKDVNDNAPIFEKPEYLFISEENSAEIGQFHASDMDSENNGKIRYSVTSPYFKIEPSTGVLSRFRQQLPQPLMSLKVTATDHGVPRLQKTVLAHLVDKSSFGKIKQRRIRETTKVGDVIGKKIDSGATIFPLDVATVTRDGDVVLKKNATQFWILENDTIYEFVKTDAMESTKNENITLNITSDISMNSDNFKVLRNGSLIVFGFSGNQAHLKIQCDDGFWPKQDRKIINLVVNNLDADRNSFPLARQPTIRKSMSLPKTMILNIPFDSPTGTIIWKNLENAVQYMENQKNVNFSNGSKNLILKTPLEETMQIDIFGQNFERSALTITPNRSLMACPVFQKNFYFFESVANLDSKHPTEIHNFGWSSDEIKGCQIDIFDKTHLFYQNGSSLIFLKPLLPGTYQFSLQIKSQSDSKIRSACHVVVTVIPPTNLTTWNIPSVIFATRNYNIPNLFHLPSGYSLSSDQRTFSLIGSGTGKNISKLSSGVYQVNVVGKDEKKEIVRILLDDVADDVTSKDIEYHVVSSTLSNLKIPTPIDVECFPRTEENLYEITKDCRLLFNSDVINTTIPVVTSPANSTWNLRIINESPETVKSLENNAVSLEIITQKSSIPRLITDLRVTYSDMKIYCLGTWQTSEDIKYHITFVIVDRNGVVIEESEARQTLTSFLKKHRPGYLDFVDFDKDPCDGVTCIQKNSTCQPTLVGDSASRLVSRSSSVIFDLPLKKLTARCFCSSGIDCYDDTTNETIQKTQKINVITTCDDIDCGPRGKCFMEESSQPICRCGQGFESMYSCERADDVFSMSTGGSVEISVRNGTSHLLKCSENCDGRDIQKIEFDFRTVQLEKSELFRVDFGKQVALIELIGGSLTFSITDAYARPIETRIEKRVNDGRWHRLLFQMSEDGRRISIQVNGRGKEVKSRVPLQMLFTAKKIQLMTPAAFCFRRLLAQNQFVHPILNRNKFFEISSTGTSRNECQFDSIQSGSGGFRLFSNFSNTTTLILLITLALISLIGFSVCLLAIRRRWRQKSPGDQKQTERSNGWTGHVMPRRRGHINRSMVKSPDDDTYDVATVYGMKSTSTDDITHIYTSSSSRRYQPPTAPSYRRDGHINMAYL

SEQ ID NO: 5786 - protein, 696 aa, Caenorhabditis elegans
MPDFTIIQPDRKFDAAAVAGIFVRSSTSSSFPSASSYIAAKKRKNVDNTSTRKPYSYKDRKRKNTEEIRNIKKKLFMDLGIVRTNCGIDNEKQDREKAMKRKIMKRKNQKEDSDTENDDEIEPANGDGIEQEMNRVTNGNEDDESVGNDVAEPMETEDVEDSGEVEIEETAQNGEREIFKVLGKQEMKNLEALKVTSSWVQNATTFSATIDSSTSQKLSQIELPEHLTVPSAISTWFPVQYAVLPSLFFEIRSPPPLRPRDVAIAAPTGSGKTICYVLPVLAAVGSKPSKILQAVILVPVQTLVAQIVDEFKRWNDESGVAKVVSLSGANDFEKEARQLASDPPNVIVATPARLVQHLTSKIPPPIDLSKLRFLIVDEADRMGKLMREEWLDLVEFLCGGMERVACLKDIIRQRRAPQKIVLSATLSKDVEELHLWNLFKPRLFSATAVSVKDITSGIPQVDHVSGRLALPSSISHRLVVTDPKFHPLAVYQQITRNKFNRTLIFVNEVSSSNRLAHVLKELCKDQFEVDYFTAQLFGKRRYKMLEKFNKNENRVLICSDVLARGTDLNKVDCVINYNLPADDKLFVHRAGRTGRAGQDGYVISVGDKESKRLFVKMLKVTNLWGDTVEEQMEEYIFEKDMDRYSKALESLKATVSSQAKTGGSRQIAKRSGFEAKRKSRPNARGEKPWLKKKTTE

SEQ ID NO: 5787 - protein, 568 aa, Caenorhabditis elegans
MSFVRIFLKFFQLILKLSSLFPSNSTIKYPNELTTLPSSLFHPFSRRLHIVLLCMIGFFCTTFMRIHFALTMTCMVNSTALAVENEIKLAGNSNVSEISIIEEINLGSNGQCGLMDEDGQKKVVVDYGGELVWNSYEQNLIFSGTFWGSLITVLPSMFFIERFSPRHVLQISVALYILVTVITPFLATHFGYFSVFLARIGMGLGEGFVFPTNNAIIGNWFPSSEKSTALSIFTLGNQIASAAGSPMVAAVCASDLGWPATFYFAGIFATGWSILWFFTASSHPAKVKMMTKKEKEYLLANVVKKVHKSEKTRSIPYSKILTSPAFLGQLQCHFFVNLFMTLFQIYLPSYFKEVLHLGVIANGTFTAIPNIFNMIFKVVWGIGIDKLKENKILSNTKAVKVSHGVASFGSSFSLILLAFFVDCSNPTTGLIFFCLMYSSMGTFVSGFYTSLLSLAPQYTATMSAISMFVAMIGRLTTPAVMSMFRKDGTAAEWQNIFIGCSLAHIFSGSIFLLFGSGELQDWAKVEDDQEMNEKEKLKTIENGIVVVEEVDVKNEMSATLVKEDSLCL

SEQ ID NO: 5788 - protein, 788 aa, Caenorhabditis elegans
MRYHFLFGSLRNHLFSFRGVIYCREKLFNCSKLSFRPSKVAISKFEPKSYLPYEKLSQTVKIVKDRLKRPLTLSEKILYGHLDQPKTQDIERGVSYLRLRPDRVAMQDATAQMAMLQFISSGLPKTAVPSTIHCDHLIEAQKGGAQDLARAKDLNKEVFNFLATAGSKYGVGFWKPGSGIIHQIILENYAFPGLLLIGTDSHTPNGGGLGGLCIGVGGADAVDVMADIPWELKCPKVIGIKLTGKLNGWTSAKDVILKVADILTVKGGTGAIVEYFGPGVDSISATGMGTICNMGAEIGATTSVFPYNESMYKYLEATGRKEIAEEARKYKDLLTADDGANYDQIIEINLDTLTPHVNGPFTPDLASSIDKLGENAKKNGWPLDVKVSLIGSCTNSSYEDMTRAASIAKQALDKGLKAKTIFTITPGSEQVRATIERDGLSKIFADFGGMVLANACGPCIGQWDRQDVKKGEKNTIVTSYNRNFTGRNDANPATHGFVTSPDITTAMAISGRLDFNPLTDELTAADGSKFKLQAPTGLDLPPKGYDPGEDTFQAPSGSGQVDVSPSSDRLQLLSPFDKWDGKDLEDMKILIKVTGKCTTDHISAAGPWLKYRGHLDNISNNLFLTAINADNGEMNKVKNQVTGEYGAVPATARKYKADGVRWVAIGDENYGEGSSREHAALEPRHLGGRAIIVKSFARIHETNLKKQGMLPLTFANPADYDKIDPSDNVSIVGLSSFAPGKPLTAIFKKTNGSKVEVTLNHTFNEQQIEWFKAGSALNRMKEVFAKSK

SEQ ID NO: 5789 - protein, 653 aa, Caenorhabditis elegans
MAKDLIGGIFDNVVNRKGKKEQDNYGGGGNYGGGGGNQGGGGGGGFNFNDIGGLINSMGGGGGGGQRQGGGGGGFGDILGGIGSLIGGGGGGQYNGGGGNVNPNNLNGGMVNVIGNLIGEAAHRFLGVDPGTGRIIGAVAGNVIMGLGGKDNSLGNIGKVILDNIISGKFRRDVDPFVRPGPDPDRGGGGSGPSPISPRPTTEPQDFYELRDQCLESKRLFEDPQFLANDSSLFFSKRPPKRVEWLRPGEITREPQLITEGHSRFDVIQGELGDCWLLAAAANLTLKDELFYRVVPPDQSFTENYAGIFHFQFWQYGKWVDVVIDDRLPTSNGELLYMHSASNNEFWSALLEKAYAKLFGSYEALKGGTTSEALEDMTGGLTEFIDLKNPPRNLMQMMMRGFEMGSLFGCSIEADPNVWEAKMSNGLVKGHAYSITGCRIVDGPNGQTCILRIRNPWGNEQEWNGPWSDNSREWRSVPDSVKQDMGLKFDHDGEFWMSFDDFMRNFEKMEICNLGPDVMDEVYQMTGVKAAGMVWAANTHDGAWVRNQTAGGCRNYINTFANNPQFRVQLTDSDPDDDDELCTAGNNRGRLSKQFFAANKSAMRSAAFINLREMTGRFRVPPGNYVVVPSTFEPNEEAEFMLRVYTNGFIESE

SEQ ID NO: 5790 - protein, 447 aa, Caenorhabditis elegans
MGSRTGSREEHSLQFLNLTKMTTTTASNLPWVEKYRPSKLDELVAHEQIVKTYILVTKFIENRTLPHLLFYGPPGTGKTTTVLAAARQMYSPTKMASMVLELNASDERGIDVVRNTIVNFAQTKGLQAFSTSSNTGTVPFKLVILDEADAMTKDAQNALRRLDKTDYEQNIIIHNVNIYFRVIEKYTDNVRFCIICNYLASIVPAIQSRCTRFRFAPLDQKLIVPRLEYIVETEQLKMTPDGKDALLIVSKGDMRTVINTLQSTAMSFDTVSENTVYQCIGQPTPKEMKEVVKTLLNDPSKKCMNTIQTKLFENGYALQDVITHLHDFVFTLDIPDEAMSAIITGLGEVEENLSTGCSNETQLAAVVAAFFEAKPPMNPNQPPNYPPGNPNQPPPFPPTPYYPMYQAGMPMPYIPQSPQYPQPGPPGGPPPFMGIQSEALAGNIMQK

SEQ ID NO: 5791 - protein, 220 aa, Caenorhabditis elegans
MRTYSKTELFCLLDMVIELFKKEKTLAEISPPVTIVGDIHGQFEDLVRLLNTRNSSENAKSKPIYGFSTKKYAFPNNTFFCEEITKHGQSISDMDLDPAKPSFIRNNKRGLSVCFNEAAVNETCRLLNISLIVRGHQMMPAGFKFFADRKLCTIFSAPRYMNEIDNSGAVMKVASNGKISISIMKNPNFAMKMFLLQMKSHNSLDHRNMRLSKNSNNLPS

SEQ ID NO: 5792 - protein, 283 aa, Caenorhabditis elegans
MPGDVGEETLEIGAVVGKRYKILSQLISKKHVAKCVASGKKERYSYMVMTLLGESLDSLLKKHGPFLNVSTQVRIGICILFGIKQVHDKGSADERYFLVLDFGLARQYIADEDDGLKMRRPREKTYFRGTARYCSVAMHDRYEQGRVDDLWALVYILAEMRCRLAWHDVDDKVEIGEMKRKIHDEVLFAKSPVQMLSFVKTVRSTLFYHRPDYEKLFKLLEDVMKCANYKWSDPYHWEPEKKKNPASQGNKFGLGKKGTKESGELPEASFFTVDDFNTNPLGF

SEQ ID NO: 5793 - protein, 371 aa, Caenorhabditis elegans
MKTLQVQRDGFFKSGFMPTRLPVSCLTMVPKFGGHETSMMEENVAPRGVDARSQRPLNGRAGLSALPQHIVSNNADRERAQQQAAEATFREPEDAYLSQLFHQVAVLLEQRIPGLEEEEAALDGYQSPECLPVFWISKWVDYSDKYGIGYQLCDNSVGVLFNDNSRIMLDQAGNELTYIEKSNKEHYFSMHSGEMPGLLNKKVTLLKYFRSYMNDHLVKAGEGSEQRAGDDLARLPTLRVWFRTKSAIVLHLSNGTVQINFFNDHVKMMMCPLMQAVTFIDQNKRMLTYKLNNLQRNGCPEKFLHRLKYAKTMIERLMSDANVVSQNPARQPDMPRSMAAARSASAGSRGPNQAASHLPQSASGSNIHPRR

SEQ ID NO: 5794 - protein, 1257 aa, Caenorhabditis elegans
MENQAALCVLLSDRANTHAHIFVHPHFLSFTLTKSCFCCGNLIYWFVTLYLNFRSRKKSEKMRSRSGSGVRLDRILFMVEQTICSHQNPITALFANQKDFPGHAWVRDNVYIAQALWALYRAYMKCADFDEDLTKAKELGFTCVKMMQSILECLMRQAEKVELFKKYQRPLDALHSKFAVGTKGTVCGDADWGHLQMDAISLYLLTLAQITASGLQVVRNFDEVAFIQNLVYYIETGYRTPDYGVWERGDKTNQGIRELNASSIGMVKAALQALNDVGDLFVDGSRGSVVHVLPDEIEQCSAVLSSMLPRESFSKETDAALLGIISYPAFCVEDPELVSQTRETITQRLLGKYGCRRFMRDGYKTVLEDASRLYYNKSELQQFEDIECEWPIFLCYLILDAMYSKDDDAVEAYWRQLESVLVLSDKGFRLVPELYVVLKEHVSAEKAHPGTQDRVPGGATPFLWAQSLYVIICLLYEGFLLPAELDPLSRRLSVYEKRPPCEVQVTVLAESLDVQRELRAHDIHVQCVDEIDPVFTILPASALGQLLAKIGESKKLNLSGRPLDRPIGLLSTSRLYQIGNKFVIFTPQFMDSRRSHLMYDIRILTDEWSSELQYIYASWNSVSISGRPLVVLVITQGMLSTEGLSHFSNIHLNRHMKSTVIGAIKKINTGYLSGARVVMKDLSDFFRTTAVSKMEFRDKSAEDTLRSVAAEKVQFTLLTEDATEAKNEKITTPRGPRTLRRGESVKDRSAYTAVHKASMRHRSIALDSNDADLMKLRLAYKSRPRDLQDMDSTYQSPPPTQTPLGLVKEHSSGELRQQLLKTTRRGAENETTHRDLTAEQMNEMKADDLLDLVNETTVLEEQISIVHCLWMKFGPDYDTELGCQHITVRMLMEEVHTKACEAREWALVGIASKKEEVITCPKTNEELEKIMNRAYGDDANSFTLAQEIIVYLGSLVRTEPKLFLEMFRLRIGLIIQVLASELSRLRNISGAEAAETLLTVSPFELKSMIFSLLSGRLLEEYAEDGIHYSDTIRETRTGIGSFRRQIEERKSLRKSTRSVGGLEIPKEEDEDEEADEDDFQFGIWLRHRRIDGALNRVPNGFYAILWDTVHKMPHGVKINDTVLHWGLTQEMTRKEIKFALESEEALNRIAEPEYRELVVETLWLLGRLEKLVLLEQPNIPRDRPLDVDHILHVANQIFVDHNKHLETIVMECCASSNPNNTRCDGARNICKHFYDSAPAGEYGTSHYIIRALMQLYS

SEQ ID NO: 5795 - protein, 1009 aa, Caenorhabditis elegans
MCDAKTLVRRMNEVEKMMMSRIGEVDQLRDFLDNLKASKTSDTFQTTELENKFELLDVEWNHLEEELRRREVDLNDSMSQILIDEQFDTIRQWIKERTEALEADVEVSNKTKPDDIERMQKRHDELASDINDYHTIYEDFLNNGQVEEEKVQVIRHLWSSLIESSTTRQKSLAQECQKSRLFELLDGMSIWLIDAETDVHSTTNFIGLYNSVDAEKASRLLVSLGEQAGEKDDILIRIQCDESVDVIVEKLRNGISQLQMLIKANNEDLDVWKSMQKVVTAIDDEICWFKEINVIFSSTNVGNDVSSNDVLKRKHQRLQLETQRREQKVAKVVYLTTELVSSHRRPSLEYKFVEIDEKVAELTELLESNRQIAEIRTNRLEKWTEYFVTMNEIREKEQLLDQILDLKTGLPETVLADVERKLQVLETVGDHMDTLTIKAEQMSDDEVIRTKVAVTAIDQLRKKWLKMNEELKKMHQKIKESIEFTKFVSTCDTGIQCIREQEEKIGNLVRHQKPASNFENTAYHSTMTFVETYTKDTFEKLKVVCRKLQNSTDAEKKLSLVSERLNALKKQLDLLAEKIAVDDKFKLKVQNIQDEYSRTACELGNWLEQAEEDVSDVVWFQTKDSSEDCRETLLEILGTLRNEKSDLLGELELLEVELAELKEDVKTFTWHSFKTLATRMERLDQTISDRIRIADGEISRHSDNEKICEQAACTLKTYHNVIVDVKKELEILYSLKLEDQKKSLINLIDKVQKRGMIQDLEKWRSLMESRYIFNNKFSSATPHGVLVEMCQCLELMSSMLRSVEQSIADRNHNGVTEKQLHEFELAFDYFDRERNGWLDYKHFELCLKSQGYNFSAENTLKETMTLLDPSTTGHIQKHDYVRYMVKHETTNILDDHSAIEDALKNLDARKISDKSLLFLLFHDYNAIRRDAFGISGLKPVAETKATRKRCTALANKASVEAAKKRKVARQQTPRADPAPVAAQGMQFAVIGICDTYEREYQILIPHFLY

SEQ ID NO: 5796 - protein, 378 aa, Caenorhabditis elegans
MSPMNRQRKNKSNVLNEKDERPGCIIKEKSSVRSMAKTQPTSGRTISLSEINKPIALSKKNTEIKAAVEIQNRLTKKMAKNSERRKKMAHGPEMTAQNRTQERIDFVEFLDRHYQVMQAGVSTVKVHKMHYTKEEFENVIYEAQTIFSSEKALVDIDPPCVVVGNLHGQFNDLINMFILLGRPPETVYVFTECVTSIPKCGEEIWALFQRCFNNLPISALIATKILCMHGGLSPALTCLDELRNHPKPIRNPFRGIVNDMLWADPDPSVFEWKTSSRGSGFTFGTNVIDDVCKRLGVELIIRAHQMCFDGYWVLSGRKLITIFSAPMYCNFYKNTGCVLKVDETLGIQTVAFVPESENIEKIIEEMNRVWDISIDCIE

SEQ ID NO: 5797 - protein, 573 aa, Caenorhabditis elegans
MGILEKIAEIEHEISRTQKNKATEYHLGLLKAKLAKYRQQLLEPTGKGGAKGEGFDVMKSGDARVAMVGFPSVGKSTLLSSMTSTHSEAAGYEFTTLTCIPGVISYNGANIQLLDLPGIIEGASQGKGRGRQVISVAKTADLILMMLDAGKSDQQKMLLERELEAVGIRLNKKPPNIYVKQKKVGGVKFTNTVPLTHCNEKLIMTVLHEYKIFNADVIFREDCTVDEFIDVIQGNRVYMTCLYVYNKVDQISIEEIDRLARMPHHVVISCEMNLNMDYLLEKMWEYLALVRVYTKKPGNAPDLGPEDGIILRGGATIEHCCHALHRSIAAQLRYAIVWGTSTKFSPQRVGLHHKLDHEDVIQIMRRLPWLIPFFLVNISNGNNEFRIEFEYPNNEKSEKCFDSSKENDLLDLFYVSTNPLGPVVECRFLENSFILCEDPVPLYGPGQTGQQPANESFRNEGKCLKMGGYRAEDVEFTNVKCRVLPCIECHGPRTFTKSTPCIIYNGHYFLTTLLYSIFLGVVAVDRFCLGYSAMAVGKLMTLGGFGIWWIVDIFLLVLGVLGPADDSSWEPYY

SEQ ID NO: 5798 - protein, 776 aa, Caenorhabditis elegans
MSVLGFDIGNLNCYIGVARQGGIEVITNDYSLHATPACVSFGPKDRSMGVAARQAVTTNIKNTVINFKHLIGRKFSDPVAQRFIPFIPCKVVKLPNDDIGVQVSYLGEPHTFTPEQVLAALLTKLRTIVESQLSDVKKVSDCVLAVPSYFTDVQRRAVLSAIQYAGLNSLRIVNETTAIALAYGIYKQDLPEEDAKSRNVVFLDIGHSSTQASLVAFNRGKLQMVNTSYDLESGGIWFDALIREHFRKEFKTKYGIDAATSPRPWLRLLDECERVKKQMSANQTPIPLNIECFMEDKDVTGKMQRQEFEDLAAPIFNRIKQVLINLFADGVSIKPEEIDEIEIVGGSSRIPMIREIVKDLFGKEPKTTMNQDEAVARGAAMQCAILSPTFRVREFAIKDTQPYRIRLSWNSTGENGGENDVFSPRDEVPFSKLVSLLRSGPFNVEAHYAQPNVVPHNQVHIGSWKVNGARPGADGGNQKVKVKVRVNPDGIFTIASATMYEPRIVEEVPAEAMEVDGDAKTEAPAEPLEPVKKTKLVPVDLEVIESIPVSYDVQKFHNLELQMQESDAREKAKADAKNSLEEYVYEMRDKVSDQYAEFITPAAADEFRSVLTSTEDWLYDEGEDAERDVYEKRLSELKAVGTPVVERYRESETRKPAFDSFDQSIMRVRKAYEDYANGGPTYAHLDSKEMEKVINAIEDKKKWLDEARHKQETRSKTDAPVVFTEEILQNKNVFENVVNPILNKKKPAAPAPPKKEEPQPAAGDQPQSQPGEMDVD

SEQ ID NO: 5799 - protein, 504 aa, Caenorhabditis elegans
MAPKTGETVVEKMEVDEAKQDVPATEPAKDLNAIAVENIKEQLAALDKGEEHLITRVLQVLPKTRKQINDNVLYKLVSSHLSSDAQFAEGMLKYLHYTPAADTEVQPMDTSNVKTKSPKKGVKPVFASPESDCYLRLLVLLHLYAQKKNTEALALGENQLTSIYNFDRRTLDGLAAKTLYFLCVIYEREGRLFDHQGFLNSRLRTATLRNFSESQAVLICWLLRCYLINRQYQSAAHLVSKVAFPDNASNNDLARYMYYQGRIKALQLDYNSAAGYFLQAQRKAPQEGAIGFKQAVQKWVVVIGLLQGEIPDRSVFRQPIYRKCLAHYLDLSRGVRDGDVARFNHNLEQFKTQFEADDTLTLIVRLRQNVIKTAIKQISLAYSRIYIKDIAKKLYITNETETEYIVAKAIADGAIDAVITSDVRDGPRYMQSSETADIYRTSEPQAHFDTRIRYCLELHNQAVKALRYPPKKKIAVETIEQAREREQQELEFAKELADEDDDDF

SEQ ID NO: 5800 - protein, 332 aa, Caenorhabditis elegans
MQNSLAKLIKEKINPNVAQWEKSGRYPAHFVFKMLGQLGVFAVNKPVGSDSLRNRFLRPSINGDLVSSIAVSEPHAGSDVSAIRTHARRYGSDLIINGSKMWITNGDQADWACVLVNTSNAKNLHKNKSLVCIPLDSIGVHRSTPLDKLGMRSSDTVQLFFEDVRVPSSYIIGEEGRGFAYQMNQFNDERLVTVAVGLLPLQKCINETIEYARERLIFGKTLLDQQYVQFRLAELEAELEATRSLLYRTVLARCQGEDVSMLTAMAKLKIGRLARKVTDQCLQIWGGAGYLNDNGISRAFRDFRIFSIGAGCDEVMMQIIHKTQSKRQQKRI

SEQ ID NO: 5801 - protein, 983 aa, Caenorhabditis elegans
MKMCCPPIQVSLPVYGWGTLIGHFCLRLFFSYTIQMLRESFGNNEEVSRVALKAMEYTSDHINSRDDVPFKLAFDHRVVEEGAAVSWNMVNAVCDELKEGAMALLSSVDGKGREGIRGVSDALEMPLVSLTALSNDDHQQQQFGNLFEVSVRPPISELLADFIVHKGWGEVLVLIDPVHASLHLPSLWRHLRTRTNTSVKASMFDLPADEKQFEAYLMQFNMMRNNETNRILIDCASPKRLKKLLINIRSAQFNQANYHYVLANYDFLPYDQEMFQNGNINISGFNIINKDGREYWSLKKHLKTSSSLGGGDDVSVEAAVGHDAMLVTWHGFAKCLQANDSLFHGTFRHRRFFNRGFPGIYCDPLSDRSHPNRPFSSFEHGKTIGVAFRNMKIGHKEGTLTGNIEFDRFGNRKNFDVSIVDLVSNTKATFNSKEVLAWRQGVGFFSNRTVAQHSRKSQNDHKDNQVIVLTNLVAPFVMIKRECLEMANLTECQGNNKFEGFCIDLLKLLADKIEEFNYEIKLGTKASEKILRIVFYKLFQAGSKQADGSWDGMIGELLSGRAHAVVASLTINQERERVVDFSKPFMTTGISIMIKKPDKQEFSVFSFMQPLSTEIWMYIIFAYIGVSVVIFLVSRFSPYEWRVEETSRGGFTISNDFSVYNCLWFTLAAFMQQGTDILPRSISGRIASSAWWFFTMIIVSSYTANLAAFLTLEKMQAPIESVEDLAKQSKIKYGIQGGGSTASFFKYSSVQIYQRMWRYMESQVPPVFVASYAEGIERVRSHKGRYAFLLEATANEYENTRKPCDTMKVGANLNSIGYGIATPFGSDWKDHINLAILALQERGELKKLENKWWYDRGQCDAGITVDGSSASLNLSKVAGIFYILMGGMVISMLAALGEFLYRSRIEARKSNSNSMVANFAKNLKSALSSQLRLSVEGGAVAQPGSQSHNAIRRQQVAAFLPANEKEAFNNVDRPANTLYNTAV

SEQ ID NO: 5802 - protein, 1152 aa, Caenorhabditis elegans
MGKRKTKEDNASEDYDANELMIVPGEKRKKLEKSGEKSATGGKKNRNFAKEKEVAKLTKQAKRKLAAVQSRKALKQTQEELFAGLAEFQLDPSKLCQLSSSTKLSKEPEKAPVFPEKLKVFSGKTKTEAKRTQQDYYPTDDESSSEEEEEEEEGDNDIEDAGNTVEVKIEPIDLDDVDEAIDGNPETNLDQIVVKREDDEESDNEDILALPTTTVINRKKVIVERSKEIQKSRAELPIFAEEMRIVEAINENLVTVVCGETGSGKTTQIPQFLYEAGYASEGELIGITEPRRVAAIAMAQRVGVELAKPDEVSYQIRYEGTRSETTNILFMTDGVLMKEMEQDVMLKKYSVILIDEAHERSMYSDVLIGMLSRIVPLRSKTARPLRLVIMSATLRLDDFTHKKLFPLLTPKVIKVDARQFPVSVHFEKRTPDDYIASAFRKTCRIHETLPPGAILVFVTGQHEVKQLITKLKKRYPVVYETDKNGEVLVKGTKEWKEKKVEAAKSIKLEDFKEETPETEDFEDVDDGLMDGDDMNERGAAEAFDDYEEFENGDGDLSDGKVENSIGAPPADCEPLYCLPLYSLLSMGKQRRVFDETPAGMRLCVISTNVAETSLTIPGVKYVIDGGFEKRRLYDSITGVSRFAVCRISQASGDQRAGRAGRISAGHAYRLYSSAVYQDFVKFADPEILSKPADQLVLHLKSMNIVKVVNFPFPSAPDEQMLESAEKRLCRLGALSESTKNGKTEARITKLGKTLAVFPLAPSYAKFIAMADQHNLMSHAILLISLLSVREPLIPVSSLRGDTPEETKELMKNVLKERRRWCSHTGARRLGDLKVLMHAASVAEQIKVHLDYNARECEKVGLRVKALVEARKLRQQLTNIVNASCKKEHAAALDSDLPPPTDQQAQLLRQMVVASFSDRLARRVDRSVGQEEVQKGAYETTLIKGHVFIDPCSVVFTEEPEFVIYQELVQVNEKKLMTSVCAVDKEWLSRLAESYCNYGEQDKNQEPIYDPVKDMVVKTVKVTFGPLNWELPNENRSVPHDIMMYRYFALFLLDGLVFEKLKEYTPKLLAPPSTMVKSWAKLQKRTEMLLNKLIEKEVTTRSSLKEQWLKNENWLLEEYLEWVPESVHQQISLMWPPLEDHEKTIKMGRNKKY

SEQ ID NO: 5803 - protein, 497 aa, Caenorhabditis elegans
MLRAVSTSFGTARAASAVAKKNMPNIVLVDAVRTPFVVSGTVFKDLMAVDLQKEAIKALVEKTKLPYEQLDHIICGTVIQECKTSNIAREAALLAGVPDKIPAHTVTLACISSNVAMTTGMGMLATGNANAIIAGGVELLSDVPIRYNRNARKAMLGMNKAKDVPSKLKIGGQIVKNLLSPELPAVAEFSTGETMGHSGDRLAAAFNVSRREQDEFAIRSHTLASEAAKNGKFTDVVPVFLDGKKPKTIKEDNGIRVSTLEKLSSLKPAFVKPHGTVTAANASYLTDGASAALIMTEEYALANGYKPKAYLRDYLYVAQDPKDQLLLSPAYVIPKLLDKAGLTLKDVDVFEIHEAFAGQVLANLNAMDSDYFCKEQMKRSGKFGRVPMDKLNLWGGSLSIGHPFGATGVRLATHSAHRLKEEKGQYAVIAACAAGGHGVGCSLRLMESKLEPMTSKCFSSKIVGRCIENTTLNQNTTFINKGTRTSYRPEICFKSFT

SEQ ID NO: 5804 - protein, 923 aa, Caenorhabditis elegans
MDHRAQAREVFVRAQLEAVQKAITKNEVPLKPKHARTIIVGTHKEKSSGIFWHTVGRIQLEKHPVLTWKFCHLVHKLLRDGHRKVPEETYRYVNRFTQLSQFWKHLNTSGYGPCIESYCKLLHDRVTFHNKYPVVPGKLDLNDSQLKTLEGDLDNMFEMTIDMLDQMDALLVLQDRVYEMMNSLRWNSLIPQGQCMLSPLIIAILDTSKFYDYLVKMIFKLHSQVPPDALEGHRSRFRTIFERTKKFYEESSNLQYFKYLVSIPTLPSHAPNFLQQSDLESYRTPHAYLHSEGSEDGTSLNGHDGELLNLAEAEPQQASPSSQPDPREEQIVMLSRAVEDEKFAKERLIQEARSRIEQYENRLLQMQGEFDHAKREADENREEAQRLKNELALRDASRTQTDDARVKEAELKATAAEERFNKMKGVYEKFRSEHVLALTKLGDIQKQLEASEKSKFDKDEEITALNRKVEEAQREAGRALTKAEGDAGAVDEMRTQLVKADIEVEELKRTIDHLRESHANQLVQSSAEETNKIRLAELEVAKESGVGITQMFDHCEDALQNATSITYPPHLAQSAMNNLVNILSNERLDEPLATKDNVFAGHLLSTTLSAAASAAYTASIESYEGVNDQCKKVLAAAKVAFSDDSALSRADKMKLLRQDIQTLNSLMISLPLQTDIDKDVVGNELEQEMRRMDDAIRRAVQEIEAIQRRARESSDGIRLEVNESILANCQALMSVIMQLVIASRELQTEIVAAGKAGGSPAEFYKRNHQWTEGLLSAAKAVGVAARVLVESADGVVTGKGKFEHLIVAAQEIAASTAQLFVSSRVKADKDSSKLDALSVAAKAVNQNTAQVVAAVKNGQTTLNDEGSLDFSYLSLHAAKKEEMESQVKMLELEQSLNQERAKLAALRKQHYHMAQLVANKVSF

SEQ ID NO: 5805 - protein, 401 aa, Caenorhabditis elegans
MRFSRKLLGPFVGSLAKKLDYYSQFQPSSLTIQQYLDFGRIGTSANSYTFLKNELLVRLANIMQEFTLLPPKLLQMPSSKMVSNWYAESFEDLLLFEASDSSPEQVARFNDQLTVVLKRHAHVVETMAEGLIELRESDGVDIASEKGIQYFLDRFYINRISIRMLQNQHLVVFGNVLPESPRHVGCIDPACDVESVVYDAFENARFLCDRYYLTSPSMKLEMHNAVEKGKPISIVAVPSHLYHMMFELFKNAMRATVEYHGVDDDLPDIKVYVVKGQEDLSIKICDRGGGVSRTILERLYNYMYSTAPPPPRDGTQAPLAGYGYGLPLSRLYARYFLGDLFLVSMEGHGTDACIYLKAVPVEASEVLPIYSTSSRRNLTMGPQVADWSHHVPGQGNRPAQS

SEQ ID NO: 5806 - protein, 622 aa, Caenorhabditis elegans
MPPSGRFDRTIALAGTGHLKIGNFVIKETIGKGAFGAVKRGTHIQTGYDVAIKILNRGRMKGLGTVNKTRNEIDNLQKLTHPHITRLFRVISTPSDIFLVMELVSGGELFSYITRKGALPIRESRRYFQQIISGVSYCHNHMIVHRDLKPENLLLDANKNIKIADFGLSNYMTDGDLLSTACGSPNYAAPELISNKLYVGPEVDLWSCGVILYAMLCGTLPFDDQNVPTLFAKIKSGRYTVPYSMEKQAADLISTMLQVDPVKRADVKRIVNHSWFRIDLPYYLFPECENESSIVDIDVVQSVAEKTPPEKIIYFFIFRHFLKFDVKEEDVTGALLAEDHHHFLCIAYRLEVNHKRNADESSQKAMEDFWEIGKTMKMGSTSLPVGATTKSEKSERNVAKVVGKFSANVGRKILEGLKKEQKKLTWNLGIRACLDPVETMKHVFLSLKSVDMEWKVLSMYHIIVRSKPTPINPDPVKVSLQLFALDKKENNKGYLLDFKGLTEDEEAVPPSRCRSRAASVSVTLAKSKSDLNGNSSKVPMSPLSPMSPISPSVNIPKVRVDDADASLKSSLNSSIYMADIENSMESLDEVSTQSSEPEAPIRSQTMEFFATCHIIMQALLAE

SEQ ID NO: 5807 - protein, 1226 aa, Caenorhabditis elegans
MREGSFPRRIGLLLGLLGLLAGVATFNIDTKNVVVHHMAGNYFGYSLDFYHEQKGMPVLVVGAPEAESNNPNLAGIRRPGAVYACSVNRATCREVHVDKMKGNLKKLNGSHLVPIEEKSHQFFGATVRSNDKHDKIVVCAPKYTYFYSKFEVIEPVGTCFYAENGFDNAEEFSSCKQEPARHGRHRLGYGQCGFSAAVPGKKNQNRVFIGAPGVWYWQGAMFSQNIKNQTDRPNTEYGSKEYDHDMMGYSTATGDFDGDGIDDIVAGVPRGNDLHGKLVLYTSKLKMMINLTDEVSTQHGQYCGGSVAVADVNKDGRDDIIMGCPFYTDYGSVKDAKTQERKPQYDVGKVIVMLQTAPGVFGKQIAVVGDDQWGRFGHAVAAAGDLNLDGYNDVIVGAPYAGKNKQGAVYVIHGSKDGVRELPTQKIEGANIGHGNIKSFGFSLTGNEDVDGNGMPDIAVGAWKSGNAAVLLTKPVVTVTGQTEPESALISVEDKNCDVDGKLGKQACKHINTCFKYEGKGDTPNDLEFDLRFNLDDHSPEPRAYFLQKDVKSDRSIKVAQGSKTRDHPSSIEQRVRLEKGRQKCFRHRFFASSTMKDKLSPIHWSVNYTYVESKTGKLRGDKLEPAIDTTVPLSFQNKINIANNCGKDDLCVPDLKVTAVADREKFLLGTQDNTMLINVTVQNGGEDSYETKLYFDVPQGFEYGGIESVGGDGSKSAPACSPTSDEPDSDGKWTFACDLGNPLPANKVVSSVVRVTASSDKPPLAPISINAHVNSSNDEEAHTVADNKVTFTIPVDFKNQLSLNGRSNPEQVDFSMTNKTRVDAFDDNEIGPVVSHLYQISNRGPSEVDSATLDIFWPSFSTEGGHLLYIITEPVVNPPNKGRCRVKQLQNVNPLNLRITNEHVPTEPPVAKTPNEYSREEDDESYEDETTTQSQSTRHQSTQHQTHHQSGPVHVYEKDEEKIRQNTGNWQYVEDKKKKGDYEYIPDDQEYDGDDFEEEDDEDFDRAGSKRVKRNPTPKKKKKGGEHRGEPRSDKARFSDLREAVKLSKEAGGVVDYKGPLSRASVDCNSLRCTHIECDIYDLKEDEFVLVEIFSRLYTNTLVDEKNPGGDISSLALARVTSTKYNLPHKPTLITAVSTNMNAIASEEGRDLPWWLYLLAILIGLAILILLILLLWRCGFFKRNRPPTEHAELRADRQPNAQYADSQSRYTSQDQYNQGRHGQML

SEQ ID NO: 5808 - protein, 529 aa, Caenorhabditis elegans
MGDKAILTEVLEASNLTEAYVDLTAKQLIKEIRHVGDDFAVRYSNLDDRTELGEPTDQRSPDSEKTFTVDEAVEALGFGRFQLKLSILTGMAWMADAMEMMLLSLISPALACEWGISSVQQALVTTCVFSGMMLSSTFWGKICDRFGRRKGLTFSTLVACIMGVISGMSPHFYVLLFFRGLTGFGIGGVPQSVTLYAEFLPTAQRAKCVVLIESFWAIGAVFEALLAYFVMESFGWRALMFLSSLPLGIFAVASFWLPESARFDMASGHPERALETLQAAARMNRVQLPTGRLVSSTKAGSESRGDIANLLSPDLRKTTILLWCIWAITAFSYYGMVLFTTVLFQSHDECHGGLFSNGTQMEVCQPLTRSDYFDLLSTTLAEFPGLIITVLIIEWFGRKKTMALEYAVFAIFTFLLYFCLDRFTVTVLIFVARAFISGAFQCAYVYTPEVYPTTLRAVGLGTCSAMARIGAIVASEKSLSLPIGIYGTAAILGLIASLSLPIETKGRQMMVRLTSEKSSIFSNFFQDSH

SEQ ID NO: 5809 - protein, 529 aa, Caenorhabditis elegans; identical to SEQ ID NO: 5808

SEQ ID NO: 5810 - protein, 935 aa, Caenorhabditis elegans
MGDYVTPGEEPPQPGIYRSEQMCLAQLYLQSDASYQCVAELGELGLVQFRDLNPDVSSFQRKYVNEVRRCDEMERKLRYLEREIKKDQIPMLDTGENPDAPLPREMIDLEATFEKLENELREVNKNEETLKKNFSELTELKHILRKTQTFFEEHEDMIASSAESSGIGEVLSADEEELSGRFSDAMSPLKLQLRFVAGVIQRERLPAFERLLWRACRGNVFLRTSEIDDVLNDTVTGDPVNKCVFIIFFQGDHLKTKVKKICEGFRATLYPCPDTPQERREMSIGVMTRIEDLKTVLGQTQDHRHRVLVAASKNVRMWLTKVRKIKSIYHTLNLFNIDVTQKCLIAEVWCPIAELDRIKMALKRGTDESGSQVPSILNRMETNEAPPTYNKTNKFTKGFQNIVDAYGIATYREINPAPYTMISFPFLFAVMFGDMGHGAIMLLAALFFILKEKQLEAARIKDEIFQTFFGGRYVIFLMGAFSIYTGFMYNDVFSKSINTFGSSWQNTIPESVIDYYLDDEKRSESQLILPPETAFDGNPYPIGVDPVWNLAEGNKLSFLNSMKMKMSVLFGIAQMTFGVLLSYQNFIYFKSDLDIKYMFIPQMIFLSSIFIYLCIQILSKWLFFGAVGGTVLGYKYPGSNCAPSLLIGLINMFMMKSRNAGFVDDSGETYPQCYLSTWYPGQSFFETIFVLVAIACVPVMLFGKPYFLWKEEKERREGGHRQLATIEIILVVLALVQVPIMLFAKPYFLYRRDKQQSRYSTLTAESNQHQSVRADINQDDAEVVHAPEQTPKPSGHGHGHGDGPLEMGDVMVYQAIHTIEFVLGCVSHTASYLRLWALSLAHAQLSDVLWTMVFRNAFVLDGYTGAIATYILFFIFGSLSVFILVLMEGLSAFLHALRLHWVEFQSKFYGGLGYEFAPFSFEKILAEEREAEENL

SEQ ID NO: 5811 - protein, 1030 aa, Caenorhabditis elegans
MGDYVTPGEEPPQPGIYRSEQMCLAQLYLQSDASYQCVAELGELGLVQFRDLNPDVSSFQRKYVNEVRRCDEMERKLRYLEREIKKDQIPMLDTGENPDAPLPREMIDLEATFEKLENELREVNKNEETLKKNFSELTELKHILRKTQTFFEEVDHDRWRILEGGSGRRGRSTEREETRPLIDIGDMDDDSAARMSAQAAMLRLGYVVLGKMDRPESATIAKRDLVYVVLFVSFSFCIPLVFFPDSFLHEDMIASSAESSGIGEVLSADEEELSGRFSDAMSPLKLQLRFVAGVIQRERLPAFERLLWRACRGNVFLRTSEIDDVLNDTVTGDPVNKCVFIIFFQGDHLKTKVKKICEGFRATLYPCPDTPQERREMSIGVMTRIEDLKTVLGQTQDHRHRVLVAASKNVRMWLTKVRKIKSIYHTLNLFNIDVTQKCLIAEVWCPIAELDRIKMALKRGTDESGSQVPSILNRMETNEAPPTYNKTNKFTKGFQNIVDAYGIATYREINPAPYTMISFPFLFAVMFGDMGHGAIMLLAALFFILKEKQLEAARIKDEIFQTFFGGRYVIFLMGAFSIYTGFMYNDVFSKSINTFGSSWQNTIPESVIDYYLDDEKRSESQLILPPETAFDGNPYPIGVDPVWNLAEGNKLSFLNSMKMKMSVLFGIAQMTFGVLLSYQNFIYFKSDLDIKYMFIPQMIFLSSIFIYLCIQILSKWLFFGAVGGTVLGYKYPGSNCAPSLLIGLINMFMMKSRNAGFVDDSGETYPQCYLSTWYPGQSFFETIFVLVAIACVPVMLFGKPYFLWKEEKERREGGHRQLATIEIILVVLALVQVPIMLFAKPYFLYRRDKQQSRYSTLTAESNQHQSVRADINQDDAEVVHAPEQTPKPSGHGHGHGDGPLEMGDVMVYQAIHTIEFVLGCVSHTASYLRLWALSLAHAQLSDVLWTMVFRNAFVLDGYTGAIATYILFFIFGSLSVFILVLMEGLSAFLHALRLHWVEFQSKFYGGLGYEFAPFSFEKILAEEREAEENL

SEQ ID NO: 5812 - protein, 503 aa, Caenorhabditis elegans
MLLSTFKRHLPIRRLFSSNKFDLIVIGAGSGGLSCSKRAADLGANVALIDAVEPTPHGHSWGIGGTCANVGCIPKKLMHQAAIVGKELKHADKYGWNGIDQEKIKHDWNVLSKNVNDRVKANNWIYRVQLNQKKINYFNAYAEFVDKDKIVITGTDKNKTKNFLSAPNVVISTGLRPKYPNIPGAELGITSDDLFTLASVPGKTLIVGGGYVALECAGFLSAFNQNVEVLVRSIPLKGFDRDCVHFVMEHLKTTGVKVKEHVEVERVEAVGSKKKVTFTGNGGVEEYDTVIWAAGRVPNLKSLNLDNAGVRTDKRSGKILADEFDRASCNGVYAVGDIVQDRQELTPLAIQSGKLLADRLFSNSKQIVRFDGVATTVFTPLELSTVGLTEEEAIQKHGEDSIEVFHSHFTPFEYVVPQNKDSGFCYVKAVCTRDESQKILGLHFVGPNAAEVIQGYAVAFRVGISMSDLQNTIAIHPCSSEEFVKLHITKRSGQDPRTQGCCG

SEQ ID NO: 5813 - protein, 522 aa, Caenorhabditis elegans
MNPSISTAGAVVDDFQMSCRFSNFGDHAPESFDSLSCGACFYFIFMLVEHYKDRYVASLCEDTFGVLVCPVDVSDKICNCYNREYVYNIPEFALNSSRIKPLNHLRLDPPLPFQFDLIVKDCCSAARYCCRNTLVKYHHRVDDSPCPPTWDGWNCFDSATPGVVFKQCPNYIYGGSNIKTDYDRLSQKVCRSNGWATPEVNAAAREHTDYTGCMSNGDVEARILAGLLTYSASVIFLIPAVFLLTLLRPIRCQPMFILHRHLLISCLLYGAFYLITVSLFVVNDAPLSSQVFQNHLFCRLLFSIQLRYLRLTNFTWMLAEAVYLWRLLHTAQHSEGETLRSYKVICWGVPGVITVVYIFVRSLNDDVGMCWIENSTVAWIEWMIITPSLLAMGVNLLLLGLIVYILVKKLRCDPHLERIQYRKAVRGALMLIPVFGVQQLLTIYRFSNTYYQVTDQSLNGLQGMFVSFIVCYTNRSVVECVLKFWSSHQEKRALGAECRQRMSIQESGKLILRPPQTEHVVL

SEQ ID NO: 5814 - protein, 173 aa, Caenorhabditis elegans
MCTEQKPNLLKLSQLKMVLRALGYDPRNSKVQEMTRKIKDGRSMVMGWHGEKDYMDVDELWNALQSKDDEGDSTEDKVTTEMRSAFKLFDPESKGTITVANLKMVCNHVELKSKFRTKVLKKGPNFLKSVAKELGETLADADFDEMIREAGGDNNTGINEQQFFEIMKKTCLY

SEQ ID NO: 5815 - protein, 537 aa, Caenorhabditis elegans
MKDGFLGIDLSTQQIKAVIIDQNGKVVHTTAINFSTHEKLKKFGTENGVHKNGSVITSPVIMWIEAIDILFNDLRENGWTDKLRGISGCAQQHGTVYWKNGAENSLKGLDESRSLAEQLEMCFSVQKSPIWMDSSTEKQCQELETFVGGDQEMAKLTGSRAHHRFSAAQIKKIVDEKQDVWKDTEKVSLISSFFASLLIGKYALIELTDGSGMNLMNIKTENWHKPLFDFISSDLESKLGTLVHPMTSTGHVHSYWTRRFGIPSDCTVLPFLGDNPSSLAGLSLLPTDIGISLGTSDTVFFFTPTFEPNIDAHVFSHFAPNSGYMAMVCFKNGSLTRERARNLNNSSWDKWDKIMKKTPAGNDNYIGFFFDEDEIVPRKPKGDYTFECSEEELKNKHPEKFARAVFESQCLFKLLYTQKMGFKKSDCSRILVTGGASRNTVLLQILSDVFEMPVCTIDVDGSAALGGAMRSRYGKLKVIFNIFQSKISVHSKTTKTYSQYYPCDNVSLACQPISANVEVYSNLFKTFKSRFDEFIKQ

SEQ ID NO: 5816 - protein, 537 aa, Caenorhabditis elegans; identical to SEQ ID NO: 5815

SEQ ID NO: 5817 - protein, 460 aa, Caenorhabditis elegans
MSEEEGRERAVTVEGDAESMNDGRALVQPPARSGDVITPTRAVLTLSKSMFNAGCFSLPYAWKLGGLWVSFVMSFVIAGLNWYGNHILVRASQHLAKKSDRSALDYGHFAKKVCDYSDIRFLRNNSKAVMYFVNVTILFYQLGMCSVAILFISDNLVNLVGDHLGGTRHQQMILMATVSLFFILLTNMFTEMRIVSFFALVSSVFFVIGAAVIMQYTVQQPNQWDKLPAATNFTGTITMIGMSMYAFEGQTMILPIENKLDNPAAFLAPFGVLSTTMIICTAFMTALGFFGYTGFGDSIAPTITTNVPKEGLYSTVNVFLMLQSLLGNSIAMYVVYDMFFNGFRRKFGARFPNVPKWLSDKGFRVFWVLVTYLMAVLIPKLEIMIPLVGVTSGALCALIFPPFFEMITFWTDWKGLLTYRQRMTKIFINLVVMAIGVFAIIAGVYTNIHAIIQSFSQPDP

SEQ ID NO: 5818 - protein, 205 aa, Caenorhabditis elegans
MADFTNNALKKFKLVFLGEQSVGKTSIITRFMYDSFDNTYQATIGIDFLSKTMYLEDRTIRLQLWDTAGQERFRSLIPSYIRDSSVAVVVYDITNANSFHQTTKWVDDVRNERGCDVIIVLVGNKTDLADKRQVSTEDGEKKARDLNVMFIETSAKAGYNVKQLFRKIATALPGIVQEETPEQPNIVIMNPPKDAEESQGRQCPC

SEQ ID NO: 5819 - protein, 1429 aa, Caenorhabditis elegans
MRIPTICFLFLLISLSKSLHIGSCLGLICGRNGHCHAGPVNGTQTSYWCRCDEGFGGEYCEQQCDVSKCGADEKCVFDKDYRMETCVCKDCDINGNSLLKPSCPSGYGGDDCKTQGWCYPSVCMNGGQCIGAGNRAKCACPDGFKGERCELDVNECEENKNACGNRSTCMNTLGTYICVCPQGFLPPDCLKPGNTSTVEFKQPVCFLEISADHPDGRSMYCQNGGFCDKASSKCQCPPGYHGSTCELLEKEDSCASNPCSHGVCISFSGGFQCICDDGYSGSYCQEGKDNCVNNKCEAGSKCINGVNSYFCDCPPERTGPYCEKMDCSAIPDICNHGTCIDSPLSEKAFECQCEPGYEGILCEQDKNECLSENMCLNNGTCVNLPGSFRCDCARGFGGKWCDEPLNMCQDFHCENDGTCMHTSDHSPVCQCKNGFIGKRCEKECPIGFGGVRCDLRLEIGICSRQGGKCFNGGKCLSGFCVCPPDFTGNQCEVNRKNGKSSLSENLCLSDPCMNNATCIDVDAHIGYACICKQGFEGDICERHKDLCLENPCSNGGVCHQHRESFSCDCPPGFYGNGCEQEKMFRCLKSTCQNGGVCINEEEKGRKCECSYGFSGARCEEKINLTGFTEKDSLLRSVCEKRKCSERANDGNCDADCNYAACKFDGGDCSGKREPFSKCRYGNMCADFFANGVCNQACNNEECLYDGMDCLPAVVRCPVKIREHCASRFANGICDPECNTNGCGFDGGDCDNETNATIITNIRITVQMDPKEFQVTGGQSLMEISSALRVTVRIQRDEEGPLVFQWNGESEMDRVKMNERQLTEQHVLSTSISRKIKRSATNIGVVVYLEVQENCDTGKCLYKDAQSVVDSISARLAKKGIDSFGIPISEALVAEPRKSGNNTGFLSWNALLLIGAGCLIVMVVLMLGALPGNRTRKRRMINASVWMPPMENEEKNRKNHQSITSSQHSLLEASYDGYIKRQRNELQHYSLYPNPQGYGNGNDFLGDFNHTNLQIPTEPEPESPIKLHTEAAGSYAITEPITRESVNIIDPRHNRTVLHWIASNSSAEKSEDLIVHEAKECIAAGADVNAMDCDENTPLMLAVLARRRRLVAYLMKAGADPTIYNKSERSALHQAAANRDFGMMVYMLNSTKLKGDIEELDRNGMTALMIVAHNEGRDQVASAKLLVEKGAKVDYDGAARKDSEKYKGRTALHYAAQVSNMPIVKYLVGEKGSNKDKQDEDGKTPIMLAAQEGRIEVVMYLIQQGASVEAVDATDHTARQLAQANNHHNIVDIFDRCRPEREYSMDLHIQHTHQPQPSRKVTRAPKKQTSRSKKESASNSRDSTHLTPPPSDGSTSTPSPQHFMNTTHTTPTSLNYLSPEYQTEAGSSEAFQPQCGAFGNGEMWYTRASTSYTQMQNEPMTRYSEPAHYF

SEQ ID NO: 5820 - protein, 1295 aa, Caenorhabditis elegans
MRVLLILLAFFAPIASQLMGGECGREGACSVNGKCYNGKLIETYWCRCKKGFGGAFCERECDLDCKRGEKCIYDVYGENPTCICQDCEDETPPTERTQKGCEEGYGGPDCKTPLFSGVNPCDSDPCNNGLCYPFYGGFQCICNNGYGGSYCEEGIDHCAQNECAEGSTCVNSVYNYYCDCPIGKSGRYCERTECALMGNICNHGRCIPNRDEDKNFRCVCDSGYEGEFCNKDKNECLIEETCVNNSTCFNLHGDFTCTCKPGYAGKYCEEAIDMCKDYVCQNDGYCAHDSNQMPICYCEQGFTGQRCEIECPSGFGGIHCDLPLQRPHCSRSNGTCYNDGRCINGFCVCEPDYIGDRCEINRKDFKFPDIQSCKYNPCVNNATCIDLKNSGYSCHCPLGFYGLNCEQHLLCTPTTCANGGTCEGVNGVIRCNCPNGFSGDYCEIKDRQLCSRHPCKNGGVCKNTGYCECQYGYTGPTCEEVLVIEKSKETVIRDLCEQRKCMDLASNGICNPECNLEECNFDGGDCSGGQRPFSKCQYPARCADQFANGVCNQECNNEECLYDGLDCQSELFRCPAHIRKHCIERRGDGVCNLECSFIGCGFDGGDCNNGTEAIILSDIRIKVQIDPIEFQATGGETLMQISANLRATVRIQRDELGPLVFRWDGEHEMERVEMNSSKLEDQFVLSHHVRRYRQAVVTGIVLYLEVEEICKPEFCRFSTAQSVVDLIAAGLVKSDGRMSLGLPITEAMVAVPKRNEIDEGWSRSQVILFACIAFLAFGTVVAGVIAKNGPERSRKRKMVNATVWMPPMESTNEKGRRNQSNHSSQCSLLDNSAYYHPNTKRHCSDYSTGYNGEQYSQIYPQTLANGYPGDYNELNFDFQSETFAPADLPADEIPLHVQAAGPDAITAPITNESVNQVDSKYRRRVLHWLAANVRGKPEDVITTEAIRCLKAGADVNARDCDENTALMLAVRAHRVRLSVVLLREGANPTIFNNSERSALHEAVVNKDLRILRHLLTDKRLLKEIDELDRNGMTALMLVARELGKHQVEMAELLLSKGAKLDYDGAARKDSNKYKGRTALHYAAMHDNEEMVIMLVRRSSNKDKQDEDGRTPIMLAAKEGCEKTVQYLALNDASLGIVDSMDMTAAQVAEASYHHELAAFLRQVANERHRNDIMRQQIVKSGHGAKSGRQTVKNIKRAGSRKTPTSAASSRETNHLTPPPSDGSFSSPSPHYYPTTTSTPNRMETSPEYMFNHEMAPPVNAMWYTTPPPYQDPNYRHVPPNTAFQNAEQMNGSFYC

SEQ ID NO: 5821 - protein, 1295 aa, Caenorhabditis elegans; identical to SEQ ID NO: 5820

SEQ ID NO: 5822 - protein, 485 aa, Caenorhabditis elegans
MRSALSLKPSNGNAAKSQAVNNKNVIKNAPLGGKLTRQIGTSNLLQQALPSKKIDESPIIKIDAKDSFKVFEDQEPEKENSSENVDATEKDSNVIPAEDNNMIHELERKMEEKSRAEKLKFKFMQTRDNSDITSRFSEPPSEFSVLCDDDDCDKVSVASSTFTTSVRATFSSFHFDENQRKKEFGKEEAVKKIQKKAAKEARDDSMFSSEEFFPDIIKYMLHRQTKNRASHECFDIQSQVNEEMRTILIDWFSDVVKEYNFQKETFHLAVSLVDRALSMFNIDKMRFQLVGTTSMMIAVKYEEIFPPEIEDFALITDNTYRVPDILLMERFLLGKFDFVVAMPTSSWFGTCFAKRMNFTKKMRNTVHYLLELSLIDVHFLRYRPSDIAAAACCFANLQADVESWPQKMVDDTGISTEDFVDVLRDLHRMYLNASTADFKSIFYNYSETAQMEVALLPAPTDKLRSMFPSIFVTAPKSSNDSSSPQ

SEQ ID NO: 5823 - protein, 576 aa, Caenorhabditis elegans
MSSWNEAWDRGKQMVGEPLAKMTAAAASATGAAPPQQMQEEGNENPMQMHSNKVLQVMEQTWIGKCRKRWLLAILANMGFMISFGIRCNFGAAKTHMYKNYTDPYGKVHMHEFNWTIDELSVMESSYFYGYLVTQIPAGFLAAKFPPNKLFGFGIGVGAFLNILLPYGFKVKSDYLVAFIQITQGLVQGVCYPAMHGVWRYWAPPMERSKLATTAFTGSYAGAVLGLPLSAFLVSYVSWAAPFYLYGVCGVIWAILWFCVTFEKPAFHPTISQEEKIFIEDAIGHVSNTHPTIRSIPWKAIVTSKPVWAIIVANFARSWTFYLLLQNQLTYMKEALGMKIADSGLLAAIPHLVMGCVVLMGGQLADYLRSNKILSTTAVRKIFNCGGFGGEAAFMLIVAYTTSDTTAIMALIAAVGMSGFAISGFNVNHLDIAPRYAAILMGFSNGIGTLAGLTCPFVTEAFTAHSKHGWTSVFLLASLIHFTGVTFYAVYASGELQEWAEPKEEEEWSNKELVNKTGINGTGYGAAETTFTQLPAGVDSSYQAQAAPAPGTNPFASAWDEHGSSGVVENPHYQQW

SEQ ID NO: 5824 - protein, 578 aa, Caenorhabditis elegans
MTSKVGPVALKTFREKLGPELLEVFDKSYKSFTDVQVLSGTHLLNLSDVVVESPTGSGKTLAFVLPMMRMIQNAKLQPADIGALILSPSRELCSQIVSVIQPFAEKLNLTVETVTGGQKVDKNIKMFKNKNVNILVATPGRLFQIIQHEKTLIARKMRTLQLLVIDEADRFNEIQFEDHMREILSCIPKQRRTGLFSATQVKEEDDLMVFGLRNAKQVKVAQERNSAAPSTLKNYYVECRADEKTSVCLEFIRQRTDKKILIFFPSCNSVRYFYKIFERCLGKRPLFAVHGKCSNPHRASQIKAFSDSTNGVMISTDVMARGIDISDIDWVIQFDLPKHSSWFVHRAGRTARCGREGNALILIASEQLAYVNFLDNHEKVKLDEIKVPTNNSRKSEELRQKMIKIQVSDRAILEAGTRAFVSHVESYAKHDCHLICSLDDLNVVGLANSYALLRLPKMRELSQRKDLDMFDRSAIETSEIKYADVKLEANRETVMKEKHEKKVETLAAKDKKRREKEARKLKKMGGRFRNGGGTGRKAEEKKALKRKAEEEDDAQNDIRLLKRIKRGKLSKKEIKDVL

SEQ ID NO: 5825 - protein, 827 aa, Caenorhabditis elegans
MLLSPEQFSRLSEYAAYSRRKLKDMLSDFQQDGKFYSYLSVDGQHSRFPFCRQCIKHFKTINIDGFRAFLIDYFGADLPSDLVDQLFLSFSKPPIKERRTSLFEDAISTVRAKFSESLSGRMAGLNIAGGSGQQTDRSQSSEPQALVCIPEDDVMGPRVANNDSQEPRIPLKPLICTLSLLEADTPENKLDVVFHVYDSDGNGFLDKSEIDGIIEQMMNVARYQQWDTIELEQVIRQMMVDIDYDNDGIVSFDEWRRGGLTNIPLLVLLGFDTEMKEDGSHVWRLRHFTKPTYCNACCSILVGWGGKQGLSCSLCKYTVHERCVRSAATNCIRTYSSRQQDKLYHHWQDANATAKCVKCKATVGVFQGKGCRWCHNYVHHRCMSALAQECDLGALVHHILPPTHIFPAFLERKTSTSLKNHNFSSHSASLLQAVSPSNDCRPLLVLVNPKSGGKQGVKILQKFEYLLNPRQVYDLSKTGPEPGLQLFSTLKNCNILVCGGDGTIGWVLESMDKMTFPHGRPPVAVLPLGTGNDLARCLRWGGGYENENLHKILEQIEKSSLIDMDRWQIKIEITENKSARRASEKGDTPPYSIINNYFSIGVDASIAHRFHVMREKFPEKFNSRMRNKLWYFELGTSETLSSSCKNLHEQIDILCDGESIDLGQDASLEGIALLNIPSIYGGSNLWGRSRKSKGRMPGLFPMKNAEKMQLQTRVQDIGDGLIELVGLESAMQMGQIKAGVRGARRLSQCSTVVIQTHKSFPMQIDGEPWMQPPCIIQITHKNQAKMLVGEFRHILELSINFFLFTAAAPRKRSSWMLLKRQSTNDDN

SEQ ID NO: 5826 - protein, 1139 aa, Caenorhabditis elegans
MRECIISWTLLLCLSCVKSFNLDVNAPIYRYGPSGTNFGYSVAEHFKGDKPVMLIGAPRGESGQTGTERAGAMYACDINTFYNGGSNHWCEQVRFEYENVEDYAKRPNETRGRTVHPLGKNDQLLASTIVSKGTKNGSALVCAPLIRYHQTAAYPQGACYELESNLRLQSTYATCAQKNLPTTDRHNEYGGCMEGFSAAITQDTIVTGLIGAVKWTGGVFAKKSSANIFDSVVEKYTMNQPNGDMIRTRLVAHDYLGYSVDIGRFGFWYEDGKPITVVSGATRYGEHGAVIFLPFIQDSSSKLTLNEDKFIINGTAMGSAFGYSIEVVDLNGDGFDDLIVGAPFEHRSGIDGNFGGIVYVYFSQGVQRKQHESHLVFHPPKILKNPDFYSQFGLSITKLGNVDGDKSKLNDFAVGAPFAFDGAGAVYIYLGTKNIEKFRKKPAQVIKGNDLPNLPPGGMRSFGFSLSGGSDMDENGYPDLLIGSPSKNFVALLRSRPVISIETKHKMEKRMVDIDKGVNCPRGAKTCFPLDMVIYVDEETKRGAELVDFSSDVFMCNLEAIPFRADTTARGFIEGSHSHNYSWPCGSNSHVQKRTYRQLIYLPVQESKDWITPLKFRFTVSIRNEKKPVQPPQGSQLVDLKHYPVLNKYGASYEFDVPFNTLCGEDHTCQTDLSLKAAFKDIPLTSNGYVSNVGEKDYLDLTFTVENKKEKAYQANFYLEYNEEELELPQVQGSKRMIAETIGKNIVHLPLGNPMNGASKHQFTIQFKLTRGRTEGIGKALKFMAHVNSTSQETEEELKDNKWEAEVQIIKKAELEIYGISDPDRVFFGGKARAESELELEEDIGTMVRHNYTIINHGPWTVRNVEAHISWPYQLRSRFGRGKNALYLLDVPTITTEFTDGTSEVRKCFIKQQYEYVNPAEIKLNTKYSTQETAPHRVEHRMKREIDEDEEEQSDDLGAVEENIPWFSTANFWNLFAIKGGDGRPREVKHLSCQDNTANCFTVICHFDFIDANSAVVIDLRARLWNATFIEDYSDVESVKIRSFGKLQLDESQGIDDDPNNNAAFVETSADPDRPTIGDSRPIPWWIYVIAAVIGVLILSLIIICLSKCGFFKRNRLDQPSLYTAQLKHEREEWADTGL

SEQ ID NO: 5827 - protein, 1416 aa, Caenorhabditis elegans
MEQSQFSGSGRVGDVCQYNTDCLSGMYCATGLCSCLSTYILRESYCYEKVNPNQPGCTYDVQCEAVWPGSKCRMDSSIGTCRCPEETHVARETRDGWVCISLRDLSSGGTAPLYFVCALPEGAGFKISLNDPSPSMGAFPVGCTVGSSATIEPVQGLHGGGACMWPSDGEYIGDVYDCIHTSPHINLAEKFPQSNYAPTADGVCCPSRALACIQPQLTGPNPSEPRWWYNSVTGTCQQFMWDSGATEAKYHSPNNFKTIQHCESYCRDTCQRGSPQYSTESAVHSERPITSCAASVSCANDFQCTAIGSQHLCCPTPGSVCSAKGGRPYDIQPRTSIHHPGFMVYTGKESIRFYYDPGTGRCQDFVYKGAGGNYNNFLSKHECEMYCARLQCERGSPLRIGEEAQRCQNNAQCPSSHECKADQGVCCPRKQTICAQPLRIGDCTENVKRYWYNARTRQCQMFEYTGCQGNDNNFDSIMDCQNFCKNAIPEPKCIQGQAYKDMFGNFVTCSNGMGCPANYECYFDGSQWGCCPTKAFTCSLNTDSGIQCGAGSTFKYYYNPQTQNCESFQYNGCDGNSNNFANRDACESYCSVGGCPNGGTPLRDHSGMVMVCGAQQTSCPDSHECIPVLVGNSLINRCCPTRAYMCGLPPQQGTQCGANYVQRYYFNIVTSQCTSFQFGGCDGNANNFLNIQQCRNFCMSNACPAGNVAYVDPNSQMPINCNEALSNSCPSGYACTFNPLINNHVCCGATDSGVCPEAEKAFIDTIDMSPRECLINIEQSCPANYLCRFNMQKNKYYCCSSITGKTCPVGKFLYKDLRTSQPIRCTIGRNDQCPDGFTCQSYLANAFQGFCCTANSVCPDNADYLIDDQSQQPRACTQGTFVSCPNGYACRSLTSSADGFCCKSGTGALPPSVTDGCPPNEYVYLVQGEIAQCDPFNPPNAPCPSEFTCQWSLSNQRYQCCGSNPAPTPQRPSDGCPNAQIAFRDADAVRVCSAGAANCPAGYFCQFSSSNNQFQCCGVSGGCPEESVAFVGMSGEPEKCVVGQSNCPRGFACQKSLAGHHVCCTVRKVACESNEVIIEGECHAQVGPGSECLANEQCTGGSVCEDAKCECRPPLKAVGGFCQEEIQCSSNQVLHNGLCHNKAKLGEACLTVRQCQENSGCIEGSCECKKGFIEKAGKCMTPVEKKSAVSSKSINNGVTCSKPGWNPLIDEEHERPKHCSPIGKACPNGYEFCPTGRTPYLLNGAPQKCTISRCPAGYECTYRNNGYHCCSMANKPGLTVAGTTGSVVSKSTPSPDQEKCPRGNPLIYPSTSSPVLCQPGKRGCPVGFGCVQSSTSNNHICCPSRHSDRPGYQSESFGLGAYYSRGPPAAINPCEGYLVLVTRGVNGRIEKRCERSCPFPQIPIGGVCYELKNKAT

SEQ ID NO: 5828 - protein, 788 aa, Caenorhabditis elegans
MQRYNSTYVVKRDGRKEDVHFDKITSRIQKLSYGLNMDFVDPVAVAIKVISGLYKGVTTVELDNLAAETAASMTTQHPEYALLAARIAVSNLHKKTNKVFSEVMKTLHEFHHPHTGKHAPMISDETWAIIEKNADKLNSAIVYDRDYSYTYFGFKTLERSYLLKINKEIVERPQQMLMRVSIGIHGDDITSAIETYNLMSERYMTHASPTLFNSGTCRPQMSSCFLLTMSEDSILGIYDTLKQCALISKSAGGIGLNVHKIRATGSVIAGTNGTSNGLIPMLRVYNNTARYVDQGGNKRPGAFAIYLEPWHADIFEFVSLRKNTGPEEERARDLFLALWIPDLFMKRVEKDQEWSLMCPCECPGLDDCWGEEFEALYAKYEAEGRVRKTVKARKLWEHIVSNQIETGLPYITYKDAANRKSNQQNLGTIKCSNLCTEIIEYSAPDEIAVCNLASIALNRYVTPEKKFDFVKLAEVTKVITRNLNKIIDVNYYPVEEARNSNMRHRPIGLGVQGLADCFMLMRYPFTSAEARDLNKRIFETIYYAALEASCELAELNGPYSTYEGSPVSKGQLQFDMWGVTPTDQCDWATLRKKIAKHGIRNSLLMAPMPTASTAQILGNNESIEPYTSNIYSRRVLSGDFQIVNPHMLKDLVERGLWTDEMKNRLIANNGSIQNIDGIPSDIKELYRTVWEISQKDIIEMAADRGAYIDQSQSLNIHMAKPSYAGITSMHFYGWKKGLKTGMYYLRTKPAVNAVQFTVDKNALKTNQQAETPATVAESQDEGCLMCSG

SEQ ID NO: 5829 - protein, 579 aa, Caenorhabditis elegans
MQNATLPIDGPVNTEPKDPAREQWSGKLDFLLSVVGFAVDLGNIWRFPYLCFKNGGGVFLIPYSIMVLLTGVPLFYMELCLGQYYRKGAITTWGRICPLFKGIGYCVILTAFYVDFFYNVILAWGLHYLYTSFSFNLPWASCNNSYNSPACYEPHWSEDGTAMCRSANQSVSAEKISAAEEYFYKGFLGLHEANAPNSHVIRSVTDLGNVRWDIALSLFVVYLICYFSMWKGIHTSGKVVWFTALFPYVVLGILFIRGVTLPGWQNGIEYYLRPNFEMLKRPSVWQDAATQVFFSLGPGFGVLMAYSSYNDFHNNVYVDALFTSFINCATSFLSGFVIFSVLGYMSCKSGKPIEAVAQEGPGLVFVVYPEALSTMPYAPFWSVLFFLMLMTLGLDSSFGGSEAIITGLSDEFPILKKNREVFVGCLFAFYMVIGIAMCTEGGILIMEWLIIYGTTWGLLIAVFCEAMVIAYIYGLRQFVHDVKEMMGFRPGNYWKFCWSCAAPFILLSMITSNFINYQALTYQDYTYPTAANVIGIIFALSGASFIPLVGIYKFVNARGNTISERTDKAVYQISATFCN

SEQ ID NO: 5830 - protein, 579 aa, Caenorhabditis elegans; identical to SEQ ID NO: 5829

SEQ ID NO: 5831 - protein, 291 aa, Caenorhabditis elegans
MELAEFWNDLNTFTIYGPNHTDMTTKYKYSYHFPGEQVADPQYWTILFQKYWYHSITISVLYFILIKVIQKFMENRKPFTLKYPLILWNGALAAFSIIATLRFSIDPLRSLYAEGFYKTLCYSCNPTDVAAFWSFAFALSKIVELGDTMFIILRKRPLIFLHYYHHAAVLIYTVHSGAEHTAAGRFYILMNYFAHSLMYTYYTVSAMGYRLPKWVSMTVTTVQTTQMLAGVGITWMVYKVKTEYKLPCQQSVANLYLAFVIYVTFAILFIQFFVKAYIIKSSKKSKSVKNE

SEQ ID NO: 5832 - protein, 1744 aa, Caenorhabditis elegans
MSRLSLLGLTAAVVLLSSFCQDRIHVDAAAACKGCAPPCVCPGTKGERGNPGFGGEPGHPGAPGQDGPEGAPGAPGMFGAEGDFGDMGSKGARGDRGLPGSPGHPGLQGLDGLPGLKGEEGIPGCNGTDVSDLSKSDICNIIHLSDVVSVLRVSLECPDLLDLQGNLDKTETLDDQDSPDHQEKEVSIHKDAKELKENLEDQEFQVFQGNSGYPGLKGAKGDPGPYGLPGFPGVSGLKGRMGVRTSGVKGEKGLPGPPGPPGQPGSYPWASKPIEMEVLQGLSDQLVGVKGEKGRDGPVGPPGMLGLDGPPGYPGLKGQKGDLGDAGQRGKRGKDGVPGNYGEKGSQGEQGLGGTPGYPGTKGGAGEPGYPGRPGFEGDCGPEGPLGEGTGAPGQPGIDGMPGYTEKGDRGEDGYPGFAGEPGLPGEPGDCGYPGEDGLPGYDIQGPPGLDGQSGRDGFPGIPGDIGDPGYSGEKGFPGTGVNKVGPPGMTGLPGEPGMPGRIGVDGYPGPPGNNGERGEDCGYCPDGVPGNAGDPGFPGMNGYPGPPGPNGDHGDCGMPGAPGKPRSAGSDGLSGSPGLPGIPGYPGMKGEAGEIVGPMENPAGIPGLKGDHGLPGLPGRPGSDGLPGYPGGPGQNGFPGLQGEPGLAGIDGKRGRQGSLGIPGLQGPPGDSFPGQPGTPGYKGERGADGLPGLPGAQGPRGIPAPLRIVNQVAGQPGVDGMPGLPGDRGADGLPGLPGPVGPDGYPGTPGERGMDGLPGFPGLHGEPGMRGQQGEVGFNGIDGDCGEPGLDGYPGATRAPGAPGETGFGFPGQVGYPGPNGDAGAAGLPGPDGYPGRDGLPGTPGYPGEAGMNGQDGAPGQPGSRGESGLVGIDGKKGRDGTPGTRGQDGGPGYSGEAGAPGQNGMDGYPGAPGDQGYPGSPGQDGYPGPSGIPGEDGLVGFPGLRGEHGDNGLPGLEGECGEEGSRGLDGVPGYPGEHGTDGLPGLPGADGQPGFVGEAGEPGTPGYRGQPGEPGNLAYPGQPGDVGYPGPDGPPGLPGQDGLPGLNGERGDNGDSYPGNPGLSGQPGDAGYDGLDGVPGPPGYPGITGMPGLKGESGLPGLPGRQGNDGIPGQPGLEGECGEDGFPGSPGQPGYPGQQGREGEKGYPGIPGENGLPGLRGQDGQPGLKGENGLDGQPGYPGSAGQLGTPGDVGYPGAPGENGDNGNQGRDGQPGLRGESGQPGQPGLPGRDGQPGPVGPPGDDGYPGAPGQDIYGPTGQAGQDGYPGLDGLPGAPGLNGEPGSPGQYGMPGLPGGPGESGLPGYPGERGLPGLDGKRGHDGLPGAPGVPGVEGVPGLEGDCGEDGYPGAPGAPGSNGYPGERGLPGVPGQQGRSGDNGYPGAPGQPGIKGPRGDDGFPGRDGLDGLPGRPGREGLPGPMAMAVRNPPGQPGENGYPGEKGYPGLPGDNGLSGPPGKAGYPGAPGTDGYPGPPGLSGMPGHGGDQGFQGAAGRTGNPGLPGTPGYPGSPGGWAPSRGFTFAKHSQTTAVPQCPPGASQLWEGYSLLYVQGNGRASGQDLGQPGSCLSKFNTMPFMFCNMNSVCHVSSRNDYSFWLSTDEPMTPMMNPVTGTAIRPYISRCAVCEVPTQIIAVHSQDTSVPQCPQGWSGMWTGYSFVMHTAAGAEGTGQSLQSPGSCLEEFRAVPFIECHGRGTCNYYATNHGFWLSIVDQDKQFRKPMSQTLKAGGLKDRVSRCQVCLKNR

SEQ ID NO: 5833 - protein, 374 aa, Caenorhabditis elegans
MIIFYLYVATQVFVAIAFVLLMATAIIGNSVVMWIIYQHKVMHYGFNYFLFNMAFADLLIALFNVGTSWTYNLYYDWWYGDLCTLTSFFGIAPTTVSVCSMMALSWDRCQAVVNPLQKRPLSRKRSVIAILIIWVVSTVTALPFAIAASVNSLYTYDVVTSTVSKAHVCSAPVNTFFEKVLFGIQYALPIIILGSTFTRIAVAFRATNEATDSSLKNNHTRAKSKAVKMLFLMVVAFVVCWLPYHIYHAFALEEFFDAARGKYAYLLIYWIAMSSCAYNPIIYCFANERFRIGFRYVFRWIPVIDCKKEQYEYSQLFPDKMRSMAISLQKGRVNSSCLDKKVKENSSQDLVCVMHSEKNTKKYSKVHLLSCHER

SEQ ID NO: 5834 - protein, 493 aa, Caenorhabditis elegans
MEGATTKPRLVPSTRFALSLVMFFGCLVTYMMRTNMSFAVVCMVNENKTDTGVEKVSRCGKEMTPVESNSSVIGEFDWDKQTTGMVLSSFFYGYIGSQIIGGHLASRYGGKRVVFVTILGSALLTLLNPVAARTSEYALAILRAAIGFLQGATFPAMHTMWSVWGPPLELSVLTGVTYAGAQIGNVIVLPLSGFLCEYGFDGGWPSIFYIIGVFGVLWTAVWWYVSSDKPATHPRITPEEKQYIVTAVEASMGKDTGKVPSTPWIKILTSPAVWACWAGHFAGDWGAYTMLVSLPSFLKDVLGLNLSSLGAVASIPYIAYFLAINAGGVLADTLRSKGILSTLNTRRAAMLVALIGQGIFLVASGYCGCGQDVLVIIFITCGMAISGLQYAGFVVNYLEIAPPFSGTVMGTGNTISALAGIISPAVSSYLTPNGTQEEWQMVLWLTAGILTIGALLFSIFASGEVQPWAKLTAEEGHEMAPLREGEKIELATA

SEQ ID NO: 5835 - protein, 489 aa, Caenorhabditis elegans
MSDSSSSDGEDNQKFLGNRKKNLTKKKVVTEEIEKDDEEDVKEKSFAELGVSQPLCDACQRLGWMKPSKIQQAALPHALQGKDVIGLAETGSGKTGAFAIPVLQSLLDHPQAFFCLVLTPTRELAFQIGQQFEALGSGIGLIAAVIVGGVDMAAQAMALARRPHIIVATPGRLVDHLENTKGFNLKALKFLIMDEADRILNMDFEVELDKILKVIPRERRTYLFSATMTKKVSKLERASLRDPARVSVSSRYKTVDNLKQHYIFVPNKYKETYLVYLLNEHAGNSAIVFCATCATTMQIAVMLRQLGMQAVPLHGQMSQEKRLGSLNKFKSKAREILVCTDVAARGLDIPHVDMVINYDMPSQSKDYVHRVGRTARAGRSGIAITVVTQYDVEAYQKIEANLGKKLDEYKCVENEVMVLVERTQEATENARIEMKEMDEKKKSGKKRRQNDDFGDTEESGGRFKMGIKSMGGRGGSGGGRGGKKKKMSK

SEQ ID NO: 5836 - protein, 298 aa, Caenorhabditis elegans
MFTAKCAMQNIRNVAIVGSGQMGSGIAQVTASSGFNVMLADVNKKALDRAMKAISQSVTHLSKKQKGTDKEKSDFVTLTMSRIKTCNNVSTAVADADLIIEAAIENIDLKRGIFAQIEQSCKKDSILTTNTSSFLLEDVAKGLQDKTRFGGLHFFNPVPVMKLLEVIRSDDTSDETYATLIKFGTAVGKTTVACKDSPGFIVNRLLIPYFFEAARMYERGDASMTDIDEAMKLGAGHPMGPFELADYIGLDTVKFVMDGWAAKYPEVQLFEASPLVDKLVAEGKLGRKTGDGFYSYKK

SEQ ID NO: 5837 - protein, 207 aa, Caenorhabditis elegans
MSSSLQSNRQSLNRKVAVMGYPHVGKSALVLRFTQNIFPERYESTIEDQHSKHIAAFHRDYHLRVTDTAGQQEYTVFPRSCSLDINGFILVYAIDDRKSFEMCSNIYEKIVRTYGDTSIPIVIVGNKTDLSTQRVVRAEEGEELARQWDAKFVEITARESNRVHEVFELLLREIEISRGNLSPTERPNGNSPKRNPFKDDGKPCSIS

SEQ ID NO: 5838 - protein, 782 aa, Caenorhabditis elegans
MGGPEKNSTVPLPNKKRKKKTNKKKPTAPNTPTSPQAGEKNANLKNGTVTTNGSNHVERTEVNANEERLDDLSVSPGRSDSPGGGGGGHSDSFQDPMDPGEQLGSDDEEQEDPRDYKRGGYHPVNIGDVFNARYHVIRKLGWGHFSTVWLAWDTQDKRFVAMKIVKSAEHYTEAALDEIKLLLSVRSADPNDIGCHKVVQLLDEFTVTGINGQHVAMVFEVLGCNLLKLIIRSNYRGLHLEQVRKICRQVLEALGYMHEKCGIIHTDIKPENVLITMSREEIKIMAQHAVVARKMNMKMSGSAVSTAPDHLVKMAQENMTKNKKKKMKKKAKKQREKLEAELAGLEGLKMDANGLQEAYNNAPQNGVRMRPPSLLFNGPIPQLLQGSSCVNTPSSPRTVPPPPPSLYPQVGCVCNQTYHLTQVILNANVGELENFNASQVEDVTMEDTVNENGNRNKVEIRSPDRFDRTTLTPFSDPESKFGDLASPSAEYLSSPMSQLPPGGILPAPPVGPNIGDPYCDIDVKIADLGNACWVNHHYTDDIQTRQYRALEVLIGSGYGPPADIWSTACMAFELATGDYLFEPHQGDNYSRDEDHLAHISELLGAIPPSIYKKGKHWREFFHKNGHLLHIHQLKPWSLYEVLRQKYEWSHEDAQQFESFLRPMLDFDQEKRSTAKIALKHPFLLPFGGRAPKSDCPPELLSKMFPDGLIPEPFDGNEHQEVYRDENDSRSASERSANSRSAGGSDDDDEEEFNMNRPGPSGVITNNETTDISDIERFQLDLQ

SEQ ID NO: 5839 - protein, 698 aa, Caenorhabditis elegans
MGGPEKNSTVPLPNKKRKKKTNKKKPTAPNTPTSPQAGEKNANLKNGTVTTNGSNHVERTEVNANEERLDDLSVSPGRSDSPGGGGGGHSDSFQDPMDPGEQLGSDDEEQEDPRDYKRGGYHPVNIGDVFNARYHVIRKLGWGHFSTVWLAWDTQDKRFVAMKIVKSAEHYTEAALDEIKLLLSVRSADPNDIGCHKVVQLLDEFTVTGINGQHVAMVFEVLGCNLLKLIIRSNYRGLHLEQVRKICRQVLEALGYMHEKCGIIHTDIKPENVLITMSREEIKIMAQHAVVARKMNMKMSGSAVSTAPDHLVKMAQENMTKNKKKKMKKKAKKQREKLEAELAGLEGLKMDANGLQEAYNNAPELENFNASQVEDVTMEDTVNENGNRNKVEIRSPDRFDRTTLTPFSDPESKFGDLASPSAEYLSSPMSQLPPGGILPAPPVGPNIGDPYCDIDVKIADLGNACWVNHHYTDDIQTRQYRALEVLIGSGYGPPADIWSTACMAFELATGDYLFEPHQGDNYSRDEDHLAHISELLGAIPPSIYKKGKHWREFFHKNGHLLHIHQLKPWSLYEVLRQKYEWSHEDAQQFESFLRPMLDFDQEKRSTAKIALKHPFLLPFGGRAPKSDCPPELLSKMFPDGLIPEPFDGNEHQEVYRDENDSRSASERSANSRSAGGSDDDDEEEFNMNRPGPSGLDLQ

SEQ ID NO: 5840 - protein, 1150 aa, Caenorhabditis elegans
MDESIDDVQETRTIAIPLKDSHEDEVIEINCSELPDGEEVLQILEAEEAKLSYWIEVALEYYRQDRVDLFMMILESAGSRAGLEYEGVKQDQMRALDILAAYWMTQGYREKAKDKKSDFFSKATVLFNTADKIAMYEWSHLTVRAWFYLFERDKSTNKYELADQQFNYVVKTNPKNVLPLIGKAVIAFNKKDYKTAIYYFRKAIRQCRHTIADLRVGIGHCFAKMGMMDKAKTAFERAMEIEPYNVSAMCGLGIILLNTYDHDSLKHAVSLFGRSYNLQTDHPVALIHLANHFFFKKEIERAWTLAWHAATYNDCDSIKAEAFYQMGRCRHAQGQFDGAYKYYYQARQANNGEHTLAHYGLGQMYIHRNEIEEAIKCFDTVHKRLPNNTDTMKILGSLYAHVQLNDPAQTAEARQKGRDVLGKYLAVENDDYEACIDLAQLLEATDPKRSLELYENAIDLLVTNESIQPQPEMLNNVGALYMSMKQYEKAEHHFKRAKERLEEQLNTDEGSLLLERRSAPEKSHLLTIRYNLALCLEHLCRTVEAEQMYKDIVKECPGYIDGYLRLGCITRDRHQVYESSLWLKQGVQFDQASPIVWTLIGNLHFAKNEWMPAQKKFEFILSKIFNNKIPDPYSLVALGNVWFEQLLNPSRKKEDEKKYIDRALQMYQKALKLQPKNMYAANGIGCVLAYKRNWNDARDVFSQVRESTSEFYDVWLNIAHVCMEREQWMAAVQMYSSAMKKFRKENDSTLQHYLAKAYYRANMLNEAKEALECAMLDQLDNTQLKFNYAIVLKKSAKEVLRGHKMTSEQVTAAIDDLKFADKIFQYISKNDDRQSSHTGMRISRTICAEEAKNCKDLLTQAKHKLAAAQTQDEEERRLMEKQEKEKIALQNKMIEEARAKEEAEKQKLEDMKNLRLSFIEMTKDVLRLPEIVEEKRRGGGGRKRRNDDGDEFVNDSSDAGNYDGEEGGEDGERRERRKKDKAAKKASRKKRERRDSGGPDSNRRDEKKRKRKEERDRKLQEKLSAKQSAKIKSRAFLSSSESSDDDKPKPAADSSDDEVDPRPPVDEFDSPTRTDSDSDRETTTKKKKKKAVVDSDEGSVSGSGSGSDNDDKPIIGGSDDDDDDKPAGGNSRDSDGSDAPKKKVIESDSD

SEQ ID NO: 5841 - protein, 257 aa, Caenorhabditis elegans
MSGGGKDRIAVFPSRMAQTLMKTRLKGAQKGHSLLKKKADALNLRFRDILRKIVENKVLMGEVMKEAAFSLAEAKFTAGDFSHTVIQNVSQAQYRVRMKKENVVGVFLPVFDAYQDGPDAYDLTGLGKGGANIARLKKNYNKAIELLVELATLQTCFITLDEAIKVTNRRVNAIEHVIIPRIENTLTYIVTELDEMEREEFFRMKKIQANKKKLKEQEAAQKALEGPGPGEDAAHSENNPPRNLLASEEDNLPVLFN

SEQ ID NO: 5842 - protein, 1758 aa, Caenorhabditis elegans
MVLPFPIPMPHSTIVRWLRRYLQNEKAKRKAKESDIECSSSENESNDSTPLRGDGQLAESSRIPKKKMNRLRQFSLLLWKDWVLLRRNKVWTLFELIIPCLLLGPLVYLVVKNADHTSSPENIYDNFQVKGTVEDVFLESNFIKPIYKRWCLRSDVVVGYTSKDAAAKRTVDDLMKKFAERFQSAKLKLSVKNESSEEQLLTVLRNDLPMLNETFCAINSYAAGVVFDEVDVTNKKLNYRILLGKTPEETWHLTETSYNPYGPSSGRYSRIPSSPPYWTSAFLTFQHAIESSFLSSVQSGAPDLPITLRGLPEPRYKTSSVSAFIDFFPFIWAFVTFINVIHITREIAAENHAVKPYLTAMGLSTFMFYAAHVVMAFLKFFVIFLCSIIPLTFVMEFVSPAALIVTVLMYGLGAVIFGAFVASFFNNTNSAIKAILVAWGAMIGISYKLRPELDQISSCFLYGLNINGAFALAVEAISDYMRRERELNLTNMFNDSSLHFSLGWALVMMIVDILWMSIGALVVDHIRTSADFSLRTLFDFEAPEDDENQTDGVTAQNTRINEQMNPMASTSLNPPNADSDSLLEGSTEADGARDTARADIIVRNLVKIWSTTGERAVDGLSLRAVRGQCSILLGHNGAGKSTTFSSIAGIIRPTNGRITICGYDVGNEPGETRRHIGMCPQYNPLYDQLTVSEHLKLVYGLKGAREKDFKQDMKRLLSDVKLDFKENEKAVNLSGGMKRKLCVCMALIGDSEVVLLDEPTAGMDPGARQDVQKLVEREKANRTILLTTHYMDEAERLGDWVFIMSHGKLVASGTNQYLKQKFGTGYLLTVVLDHNGDKRKMAVILTDVCTHYVKEAERGEMHGQQIEIILPEARKKEFVPLFQALEAIQDRNYRSNVFDNMPNTLKSQLATLEMRSFGLSLNTLEQVFITIGDKVDKAIASRQNSRISHNSRNASEPSLKPAGYDTQSSTKSADSYQKLMDSQARGPEKSGVAKMVAQFISIMRKKFLYSRRNWAQLFTQVLIPIILLGLVGSLTTLKSNNTDQFSVRSLTPSGIEPSKVVWRFENGTIPEEAANFEKILRKSGGFEVLNYNTKNPLPNITKSLIGEMPPATIGMTMNSDNLEALFNMRYYHVLPTLISMINRARLTGTVDAEISSGVFLYSKSTSNSNLLPSQLIDVLLAPMLILIFAMVTSTFVMFLIEERTCQFAHQQFLTGISPITFYSASLIYDGILYSLICLIFLFMFLAFHWMYDHLAIVILFWFLYFFSSVPFIYAVSFLFQSPSKANVLLIIWQVVISGAALLAVFLIFMIFNIDEWLKSILVNIFMFLLPSYAFGSAIITINTYGMILPSEELMNWDHCGKNAWLMGTFGVCSFALFVLLQFKFVRRFLSQVWTVRRSSHNNVQPMMGDLPVCESVSEERERVHRVNSQNSALVIKDLTKTFGRFTAVNELCLAVDQKECFGLLGVNGAGKTTTFNILTGQSFASSGEAMIGGRDVTELISIGYCPQFDALMLDLTGRESLEILAQMHGFENYKAKAELILECVGMIAHADKLVRFYSGGQKRKISVGVALLAPTQMIILDEPTAGIDPKARREVWELLLWCREHSNSALMLTSHSMDECEALCSRIAVLNRGSLIAIGSSQELKSLYGNNYTMTLSLYEPNQRDMVVQLVQTRLPNSVLKTTSTNKTLNLKWQIPKEKEDCWSAKFEMVQALAKDLGVKDFILAQSSLEETFLRLAGLDEDQLDTHSTVEISHSTHV

SEQ ID NO: 5843 - protein, 1756 aa, Caenorhabditis elegans
MVLPFPIPMPHSTIVRWLRRYLQNEKAKRKAKESDIECSSSENESNDSTPLRGDGQLAESSRIPKKKMNRLRQFSLLLWKDWVLLRRNKVWTLFELIIPCLLLGPLVYLVVKNADHTSSPENIYDNFQVKGTVEDVFLESNFIKPIYKRWCLRSDVVVGYTSKDAAAKRTVDDLMKKFAERFQSAKLKLSVKNESSEEQLLTVLRNDLPMLNETFCAINSYAAGVVFDEVDVTNKKLNYRILLGKTPEETWHLTETSYNPYGPSSGRYSRIPSSPPYWTSAFLTFQHAIESSFLSSVQSGAPDLPITLRGLPEPRYKTSSVSAFIDFFPFIWAFVTFINVIHITREIAAENHAVKPYLTAMGLSTFMFYAAHVVMAFLKFFVIFLCSIIPLTFVMEFVSPAALIVTVLMYGLGAVIFGAFVASFFNNTNSAIKAILVAWGAMIGISYKLRPELDQISSCFLYGLNINGAFALAVEAISDYMRRERELNLTNMFNDSSLHFSLGWALVMMIVDILWMSIGALVVDHIRTSADFSLRTLFDFEAPEDDENQTDGVTAQNTRINEQMNPMASTSLNPPNADSDSLLEGSTEADGARDTARADIIVRNLVKIWSTTGERAVDGLSLRAVRGQCSILLGHNGAGKSTTFSSIAGIIRPTNGRITICGYDVGNEPGETRRHIGMCPQYNPLYDQLTVSEHLKLVYGLKGAREKDFKQDMKRLLSDVKLDFKENEKAVNLSGGMKRKLCVCMALIGDSEVVLLDEPTAGMDPGARQDVQKLVEREKANRTILLTTHYMDEAERLGDWVFIMSHGKLVASGTNQYLKQKFGTGYLLTVVLDHNGDKRKMAVILTDVCTHYVKEAERGEMHGQQIEIILPEARKKEFVPLFQALEAIQDRNYRSNVFDNMPNTLKSQLATLEMRSFGLSLNTLEQVFITIGDKVDKAIASRQNSRISHNSRNASEPSLKPAGYDTQSSTKSADSYQKLMDSQARGPEKSGVAKMVAQFISIMRKKFLYSRRNWAQLFTQVLIPIILLGLVGSLTTLKSNNTDQFRSLTPSGIEPSKVVWRFENGTIPEEAANFEKILRKSGGFEVLNYNTKNPLPNITKSLIGEMPPATIGMTMNSDNLEALFNMRYYHVLPTLISMINRARLTGTVDAEISSGVFLYSKSTSNSNLLPSQLIDVLLAPMLILIFAMVTSTFVMFLIEERTCQFAHQQFLTGISPITFYSASLIYDGILYSLICLIFLFMFLAFHWMYDHLAIVILFWFLYFFSSVPFIYAVSFLFQSPSKANVLLIIWQVVISGAALLAVFLIFMIFNIDEWLKSILVNIFMFLLPSYAFGSAIITINTYGMILPSEELMNWDHCGKNAWLMGTFGVCSFALFVLLQFKFVRRFLSQVWTVRRSSHNNVQPMMGDLPVCESVSEERERVHRVNSQNSALVIKDLTKTFGRFTAVNELCLAVDQKECFGLLGVNGAGKTTTFNILTGQSFASSGEAMIGGRDVTELISIGYCPQFDALMLDLTGRESLEILAQMHGFENYKAKAELILECVGMIAHADKLVRFYSGGQKRKISVGVALLAPTQMIILDEPTAGIDPKARREVWELLLWCREHSNSALMLTSHSMDECEALCSRIAVLNRGSLIAIGSSQELKSLYGNNYTMTLSLYEPNQRDMVVQLVQTRLPNSVLKTTSTNKTLNLKWQIPKEKEDCWSAKFEMVQALAKDLGVKDFILAQSSLEETFLRLAGLDEDQLDTHSTVEISHSTHV

SEQ ID NO: 5844 - protein, 659 aa, Caenorhabditis elegans [sequence omitted]

SEQ ID NO: 5845 - protein, 397 aa, Caenorhabditis elegans
MQKTIRDSTYSFGFDHYELQKMSLYLEMREGKPVDFADFCYLMSKCKGYRLREYLFRAALTVTPKNQRIHVFSELQRYKCVPPPIFLIFLSIVQLAFYLYYVVDSSEGVWLSGPIPTMSPLIVSQYHLPELWRLFTYCLINVGIFHIIFNILIQLAIGVPLELVHRWRIYILYFMGVLFGSILSLALDPTVFLCGGAAGSFSLIASHITTIATNFKEMENATCRLPILIVFAALDYVLAVYQRFFAPRIDKVSMYGHLGGLVAGILFTFILFRGSKPSRFYTVSFWVSLVLSGFFIAICITLIAAPRTTVQEIIKNQSFKNNATRCSVQIGINCISWTSNFLIFDHIFHVSYSHVLLISNAVSNSLYPTTSPPSILIVLCSSPGFPILSMGFPLYKY

SEQ ID NO: 5846 - protein, 410 aa, Caenorhabditis elegans
MSYNSIRLPQDLPIYYKNFFPVKPFTKWLRYGQNNGDYFNRREFAFILADDVHIRYRSYNDEHAFFKALSSTNPEKLDIGAVYNHEPINNKRHTDYQAVERELVFDIDLTDYDPVRNCCKDATVCPKCWKFMVLAVKILDFQLEDMFDFKARMWVFSGRRGVHCWVGDKKARMLNNYQRSAIATRLNLFKKNGQCEVTEGRAKMTKVPPIVRDAFNVALKDGVFEKMIYDQGWLDKEDFITEYKFMSEVGRDDLRSLSETYKTPQERWNMIRGLFDDDYRKSLSPKDGLLDFKMQGRDRNYLLYFVLQRCYPRLDVNVSTGTNHLLKSPFCIHPKTGNVAVPLNVGKIEEFDVSKCPRIDHVVEELSSLLAERGNDENEDSKNRKFLAYKHGALAPYVENFEKFVSACIS

SEQ ID NO: 5847 - protein, 444 aa, Caenorhabditis elegans
MSGTGALMTVHVGQCGNQLAQAFWKSMVDEHGINERGQTTHEDDMNDKKDLLFYQADDDHYVPRAVLVDLEPRVINGMMQSPNFSNLFNTDNIFMSDHGGGAGNNWASGYCQGQEVQEKIMDIIIREAENTNNLDGILFTHSVSGGTGSGTGSLLLERLREAFPKKVIQTYSVFANSDTSTDVVVHPYNWVLSMQRLIENPDHVVVLDNAALHRLAAGKFKTDTPTFDHINSLVARIMSTSTAPYRFNSAMCPSIRYLDLAPFPPMHFIQSAISPVVDPNENFTRKTSVADVTRFLLKPTSMMVSTASRVRPNDCMLSAYMFLQGQIEAHTIMTAEQNVDFAIRRPPFYMLKPLRMMHAPLSPYVRPQYKVSGLLLNNSTSVAPLFESLLSKYDKLRSKRAFIDKFEKIDNFSLDMMDDAMHIVQDLLDEYKAVVQKDYLTRGL

SEQ ID NO: 5848 - protein, 164 aa, Caenorhabditis elegans
MEQSSLLLKKQLADMRRVPVDGFSAGLVDDNDIYKWEVLVIGPPDTLYEGGFFKAILDFPRDYPQKPPKMKFISEIWHPNIDKEGNVCISILHDPGDDKWGYERPEERWLPVHTVETILLSVISMLTDPNFESPANVDAAKMQRENYAEFKKKVAQCVRRSQEE

SEQ ID NO: 5849 - protein, 332 aa, Caenorhabditis elegans
MDPIREGEVAHEGDSVYTLNDFTKLEKIGEGTYGVVYKGKNRRTNAMVAMKKIRLESEDEGVPSTAVREISLLKELQHPNVVGLEAVIMQENRLFLIFEFLSFDLKRYMDQLGKDEYLPLETLKSYTFQILQAMCFCHQRRVIHRDLKPQNLLVDNNGAIKLADFGLARAIGIPIRVYTHEVVTLWYRAPEILMGAQRYSMGVDMWSIGCIFAEMATKKPLFQGDSEIDELFRIFRVLGTPTELEWNGVESLPDYKATFPKWRENFLRDKFYDKKTGKHLLDDTAFSLLEGLLIYDPSLRLNAKKALVHPYFDNMDTSKLPAGNYRGELELF

SEQ ID NO: 5850 - protein, 408 aa, Caenorhabditis elegans
MGATGSSQLEKEISTTESVNNANEHYYGLFGNTCYCNSVIQALFFCRPFREKVLNYKQTLKKSGASKDNLVTCLADLFHSIASQKRRVGTIAPKRFITKLKKENELFDNYMQQDAHEFFNYLINTISETLIQEKIAEREKASRHGTLKKGNVTVNLAPATAGLPRSDEKGTSERNGGITVEGNEFLNKSDTTTWIHEIFQGILTNETRCLSCETVSSKDEDFLDLSIDVEQNTSISHCLRVFSETETLCGDQKYFCETCSSKQEAQKRMRIKKPPQLLALHLKRFKFVEPLNRHTKLSYRVVFPLELRLFNVSDDAEYGDRMYDLVATVVHCGATPNRGHYITLVKSNSFWLVFDDDIVEKLEVSSMEEFSGMSTDANIQMPPGNQSAPQKEFRICLYSVLSGKRLRC

SEQ ID NO: 5851 - protein, 169 aa, Caenorhabditis elegans
MSTDTKQIIADALLKNEQAMYGPFFGSLGVTSAMAFAAAGSAYGTAKAGTGIASMAVARPDLVMKAIIPVVMAGIVAIYGLVVAVIVSGKVEPAGANYTINNAFSQFAGGLVCGLCGLGAGYAIGIAGDAGVRALSQQPRMFVGMILILIFAEVLGLYGMIVALILGAT

SEQ ID NO: 5852 - protein, 161 aa, Caenorhabditis elegans
MSYDLETAERAAYAPFFGYMGAASAQIFTVLGAAYGTAKSAVGICSMGVMRPELIMKSVIPVIMAGIIGIYGLVVAMVLKGKVTSASAGYDLNKGFAHLAAGLTCGLCGLGAGYAIGIVGDAGVRGTAQQPRLFVGMILILIFSEVLGLYGMIVALILGTS

SEQ ID NO: 5853 - protein, 810 aa, Caenorhabditis elegans
MDNIIGGQAQQVEDTDGTRVQNEFSKFLKSFKDQKNEFIYKSAMKELVQPEKNTIFINMQHLYKFSNNLATTIELQYYRVYPFMCEALHLATLDACDESERQQMFKKQLYVSLFNLDAKTKVRELSADKVGGLVRIAGQIVRTHPVHPELSRACFVCEDCGVTTRDVQQQFRYTQPTKCANPQCMNRTRFSLDVNSSTFVDFQKIRIQETQAELPRGSIPRTVDVIVRGEMVETVQPGDKCDIVGTLIVIPDIAQLSTPGLRAETSNQNRGRATDKSEGITGLKALGVRDLTYKMAFLACHIQQTESLVGGDASGAVEETDYLDLWSKMSTEDRATLKKMSDDKKIEKNIVDSLFPNIYGNHEVKLGVLLMLLGGVAKKSRDEGTSLRGDINVCLVGDPSTAKSQVLKAVEEFSPRAIYTSGKASSAAGLTAAVVKDEESFEFVIEAGALMLADNGVCCIDEFDKMDLKDQVAIHEAMEQQTISITKAGVKATLNARASILAAANPVNGRYDRSRPLKYNVQMSAPIMSRFDLFFVLVDECNEVTDYAIARRILDNHRAISEHTERDSVYKIDDIKKYIAFARCFKPKISDKAAETLVREYKKLRMSDSNNAATSSWRITVRQLESLVRLSEALARLHCGKEVLVEHVEKAAELLNKSIVRVEQPDIALDDDDFDNNIMVVEADKENQRGDDSMDHDGEKENAPKIDIAKLKISFKEYKQLSDVLVLHMRSDEDNQGEDEYDGVKQSALVEWYLSTIEADLETEEDFNVQKTICERVIHRLIHQDHVLLEVEQGEDPTLCVHPNYVIADE

SEQ ID NO: 5854 - protein, 810 aa, Caenorhabditis elegans; identical to SEQ ID NO: 5853

SEQ ID NO: 5855 - protein, 619 aa, Caenorhabditis elegans
MVNRKWMYIFIQFLLVSSIRSDDDVFEDDEEEVTKGSDDKEEFVPSLFVAPKLSDKSTPNFFDYFPVGSKIGLTWIKSLAKKDDVDSDIAKYNGEWSIGAPTKVSIEGDLGLIVKTKARHHAIAAKLNTPFAFDANTFVVQYDIKFEEGQECGGGYLKLLSEGAEKDLANFQDKTAYTIMFGPDKCGATGKVHLIFRYKNPINGTISEYHANQPTTIGSTYWDDHNTHLFTLVVKPTGEYSVSVDGKSLYYGNMMSDVTPALTPPKQIFDETDLKPVDWDERENIEDESAVKPDDWDENEPQSVVDEAATKPYDWNEEENELIADPEAKKPQDWDEDMDGSWEAPLIDNPACKGLSGCGTWKAPTIKNPKYKGKWIRPKISNPAFKGKWTARLIDNPNYFEPKPFAGLAPITAVGIEMWTMSENILFDNILITSSEEDSSDVAKQTFYVKQKEEYRLAAATGNGNGFFQQIIDATNEKPWLWAVYILCVLLPLVAIGVFCFGKQSKPTPNFAKKSDAYSADDDRVPNLVDDDEEEIIGDEEDDVNQPGPSGSQSNPEPQDEEENAEQQSANSSQSSAAEEEDDEHVVPENEPVKPTEEFAKKSPKNTGGAKRRTARRGD

SEQ ID NO: 5856 - protein, 178 aa, Caenorhabditis elegans
MGLIMAKLFQSWWIGKKYKIIVVGLDNAGKTTILYNYVTKDQVETKPTIGSNVEEVSYRNLDFVIWDIGGQESLRKSWSTYYVQTDVVIVVIDSSDTTRIPIMKEQLHNMLQHEDLARAHILVLANKQDLPGAMNPAEVSTQLGLQTLRGARKWQINGCCAVKGEGLPEALEWIANNL

SEQ ID NO: 5857 - protein, 312 aa, Caenorhabditis elegans
MSGIQPVPGAKPLSMWQQYGPSEKTVRGIVIGGITGGIEICITFPTEYVKTQLQLDERSATPKFRGPIDCVKQTVNGHGFFGLYRGLSVLLYGSIPKSSFRFGTFEYLKSQAADERGNLSPVMRLLCGLGAGLSEAVFAVTPMETVKVKFIHDQGLAQPKYKGFVHGVGCIVKAEGLGGIYKGVTATMAKQGSNQAIRFFVMETLKDWYRGGDNTQPISKPIVGLMGAVAGAASVYGNTPIDVVKTRMQGLEAKKYKNTLDCAMQIWKKEGFFAFYKGTVPRLSRVCLDVGITFMIYDSIIEFLDVYWKKQQ

SEQ ID NO: 5858 - protein, 351 aa, Caenorhabditis elegans
MSPKKVTIIGSGNWGSAIARIVGSTTKSFPDEFDPTVRMWVFEEIVNGEKLSEVINNRHENIKYLPGKVLPNNVVAVTDLVESCEGSNVLVFVVPHQFVKGICEKLVGKIPADTQAISLIKGVSTEKRGGLKLISEEIKEILKIEVSVLMGANLAPEVANDNFCEATIGCKRKAEDGPLLKKLFHTDNFRINVVEDAHTVELCGALKNVVACAAGFTDGLGYGDNTKAAVIRLGLMETTKFVEHYYPGSNLQTFFESCGIADLITTCYGGRNRKVCEAFVKTGKSMAEVEKELLNGQSAQGPLTAEEVYLMMHKTGLDAKFPLFTAVHKICAGEMKPAELVDCLRNHPEHM

SEQ ID NO: 5859 - protein, 367 aa, Caenorhabditis elegans
MTHLNFETRMPLGTAVIDQFLGLRPHPTKIQATYVWIDGTGENLRSKTRTFDKLPKRIEDYPIWNYDGSSTGQAKGRDSDRYLRPVAAYPDPFLGGGNKLVMCDTLDHQMQPTATSHRQACAEIMHEIRDTRPWFGMEQEYLIVDRDEHPLGWPKHGFPDPQGKYYCSVGADRAFGREVVETHYRACLHAGLNIFGTNAEVTPGQWEFQIGTCEGIDMGDQLWMSRYILHRVAEQFGVCVSLDPKPKVTMGDWNGAGCHTNFSTAEMRAPGGIAAIEAAMTGLKRTHLEAMKVYDPHGGEDNLRRLTGRHETSSADKFSWGVANRGCSIRIPRQVAAERKGYLEDRRPSSNCDPYQVTAMIAQSILF

SEQ ID NO: 5860 - protein, 1131 aa, Caenorhabditis elegans
MSDKRADGRLEGTSDTFGGLVIKKKKVEGDSKPTEPSGKSLLGLDRLASTKREHARKRLEDDDDRGVTESVRKGIEKVHEKHRDRDDRGMKYKSRDDDRRRDRDRSERREPSSRRGWKDRSGDQTPRFKVPDTPSRMSWDQDDREGSSRKRNSWDMPTPRGERDRKRYMDSERSISSAWRSERRNRDDEKRRRHRKPEDSVRSVKEEKAEPTFHDDEERAQWEEEQKNLDREWYDNEGAFDDEYNPFNKVSDEFVEKREKQWQEKTQKPRLTVKQQAIKRENELWENNRLHRSGVVAMADELSSIFEDETDENRVTILVQNIVPPFLDGRIVFTKQAQPIIPVVDTTCDMAVSAARGSVAVRKRREVEDRKKAQDKHWELAGSKLGNLMGVKEKKDETADPEDDDSGNYKESHQFASHMKDNEAVSDFAMEKSIKQQREYLPVFACRQKMMNVIRENNVVIIVGETGSGKTTQLAQYLLEDGFGDSGLIGCTQPRRVAAMSVARRVADEMGVDLGQDVGYAIRFEDCTSEKTIIKYMTDGILLRECLGDGSLDQYSAIIMDEAHERSLNTDVLFGLLREVIAKRADLKLIVTSATMDADKFADFFGGNCPTFTIPGRTFPVELFHARTPVEDYVDAAVKQAVTIHLGGMDGDILIFMPGQEDIECTCEMIKEKLGELDEAPPLAVLPIYSQLPSDLQAKIFQRAPGGMRKAIVATNIAETSLTVDGILFVIDPGFCKMKVYNPRIGMDALSIFPVSQASANQRTGRAGRTGPGQCYRLYTERQFKDELLKSTVPEIQRTNLANVVLLLKSLGVDDLLKFHFMDAPPQDNMLNSMYQLWTLGALDNTGQLTPMGRKMVEFPLDPTLSKMLIMSAEMGCSDEVLTIVSMLSVPAIFFRPKGREEEADAKKEKFQVPESDHLTFLNVYIQWRTHKYSAKWCADNYLHVKALKKVREVRAQLKEIMQDLKLPLISNGSEWDIVRKCICSAYFHNAARLKGIGEYVNVRTGIPCFLHPTSALFGMGFMPDYVVYHELIMTAKEYMQCVTAVDAIWLAELGPMFYSIKESKQSRKELKMESVRTVETMEAEMREAQKEMERRKEESDKAFKRPESSRRVVEVGSKSARSERRKLWGL

SEQ ID NO: 5861 - protein, 254 aa, Caenorhabditis elegans
MGYMGCWCSNLGRKYSGTVSPQRSVQPEALSYEMVYSWQQSFDTLMSFKSGQKCFAEFLKSEYSDENILFWQACEELKREKNSEKMEEKARIIYEDFISILSPKEVSLDSKVREIVNTNMSRPTQNTFEDAQHQIYQLMARDSYPRFLTSIFYRETLASFGITEMDIGGDEEKEREQRAERARLNVPATAAEGSSKDISMPKVVKTRSVVIILEFDRKKLFPTNLIRILILLQLFAVKSKLQQCSKLLEKLTHF

SEQ ID NO: 5862 - protein, 319 aa, Caenorhabditis elegans
MANNRSTYGNVNNKSDLNVDDIIVKILNIGSGGNNFEAIMSQKTLVSLLDAAKDVFMKQGAMLELEAPVKICGDVHGQYSDVLRLFDRGGFPPLVNYLFLGDYVDRGQQSLEVACLFLAYKVKFPGNFFMLRGNHECGSINRVYGFLDEVQRKYGAKGGTTMWNCFQICFAYMPYTALVSGRILCMHGGISKRMNNLNQLRNLQRPVLEVANPSVEIDILWSDPDSTVDDFVDSTRGVGQVFGAKALTAIMNKLDVDLVARAHQVVQDGYEFFNNKRLVTIFSAPHYCGEFDNAAAMMNVDKNLTCSFQIMRPSIDAKK

SEQ ID NO: 5863 - protein, 319 aa, Caenorhabditis elegans; identical to SEQ ID NO: 5862

SEQ ID NO: 5864 - protein, 899 aa, Caenorhabditis elegans
MLDAYLDAMTYNWNSYFREGQLSTLMNTLTLTNDQFDIFDFYINRVSLMFEYKSTYALPTYNWLYDNLVVIGKTPWEKTPNIDAVFPYYKLDLQVNIPGSGPYQWYENMTFSATSTVTFQLVSPTSSITINAHRLMFDPVSIRLYNENDENAHTPIPIDFSKVMKDYDKGTVTIPTMNNTVLYPNQYSLFIEYTGFIFQNPDEGDASNTYLGGLNNRKGWIFTTDFEGGPGARSLLPCWDEPSYKGQFEVSVFHPTDMIALSNEVDIQRTIYDNGWTTTKFATTNQMSTYLLALCVGHFSNLATVTRTGVLTRVWTWSGMEQYGEFALNVTAGTIDFMENYFSYDFPLKKLDVMALPEYTMNAGAMENWGLIIGEYSLFMFDPDYATTRDITEVAETTAHEVVHQWFGDIVTLDWWNDIFLNEGFAQYWFANGIDNTFPEQHAYSIDYNRFYMNHIALKYDCIPGVAKPVISDTPPVFGIEPYYKGSALLNLLNNVLTPAVFQEGLSSYLTQYGYVNASPRNLWTSLTVAAQRHNITDWNGQPLDVSSFMDPYTLQTSYPIITLTLRGTSTVQANQQSCMSDETLWNVPLFTQTPGALDFNWFVNFTGGNDATWLRPLPTGYRVDNAGSTSFARINYDDKSWYSIQAQLLSNMNTMSSTTRAMLLDDANFFYQSGRWEMTKFLDLTLYLVNEDSLAPWEQAIEFFTEMLNRFQYQPEIDTVRNYVIQITKNAVSKFQWNTNGLWANDRIVQLLVNVNNLAVNRQSRQVALTLFNNFVLKCKYSLSGTGKCSGIHPNLRQPTYCYGLRQSNNIDDFTTVNNLYSWFVQNAGYLQTDGSNLLNALGCVQNLDLQKTMLRSILSGDYPPSLLNSIAVHDDSSDVLYNFLLDNTQDSDSQCSV

SEQ ID NO: 5865 - protein, 919 aa, Caenorhabditis elegans
MRRKLLLLLCFIGLFSLISTAPAPNNVGLESEFTEGHAETINLEEVEFNHPSILPEHPDNFRQDKLAARKRQSLYVTKTRLPPNLYAIDYSLWFQPYFPSPGVQYAPEKNFTFDGRASIQVEALVASDRFILNAYNFKIQSYKVVDIDGTVVPINSISQDDTTQQLSLITNANGVVAGQIYNIEFVYTGIINPYTDGGVYYTSYNDPQGNTHYMIATHMEPFSARKVFPSLDEPSYKAKFTITVQYPASQVALSNMMETEPTKIDNIWSTITFPQTPKMSSYLIAFAVGPYVNSQYVNKHNTLTRAWGWPGTEQYLQFAAQNAGECLYQLGEYTGIKFPLSKADQLGMPEFLAGAMENWGLIIYKYQYIAYNPTTMTTRNMEAAAKVMCHELAHQWFGDLVTTAWWDDLFLNEGFADYFMTFIQKSVYPQQATYLDTLQVLDELQVGLTADVRYDAHPLVYPDGPAFDDITYNKGASMLRMLSDVLGADVFKQGIRAYLQKMQYSNANDFDLFSTLTDTAKSNNILDWCGLPLNVTDFMQPYIHQTNHPLIRYNNNQKIGGSTFSQEPFLDISDLTATPWNYTWSIPLTSANLRHADPYKQWLPRQQGCANMNENIQEERIKEPNKRAVQWELTSITSATYGRIIYDDIGFDRILKLIKQDDINDNLKLTLLADEYNYMLREKKANRPFGYNRFLDLAKVIFNTQSFTNYPSYGVFAQAQPVLEQIAQLYRDGIDAEFVPRLYKLFFQNSYNQLKWQDTSIWDTDTFSEVFLPFAVRYDIGDVQNRTLNMFANVKSACINSLNGTAWCNPYSTNLRKAIYCGAAKYAPATSDYFFQMLHSYNKEVITNPYFYQEYMALLEGMSCTQSPATLKVLIRLFTTSTLNPSTIFGFLKYNPAASDVLYNYFMANPQVLTKTKFS

SEQ ID NO: 5866 - protein, 3051 aa, Caenorhabditis elegans
MCSNIDCAAEAECRETPIGPMCQCVSGYVDVSRQHGRPAGRVCRAVVNECAEGRHDCSSHATCIDTADGFTCRCKDSYRDESSDTLKHPGKNCVRTVQPDPPECDVSDPMSCDPAKREVCIFVENTYKCRCANGYSRLPDGRCVVINECAEPRLNTCGKNAECIDLAEGYTCQCRSGYADISPVSQPGRICRARVNECSNKEKYNVDCSENAICADTEHSYSCRCRPGFADVSAAFNKLPGRRCIEAVNECASPSLNDCSKNAFCEDAKEGYICTCRPGYVDNSPNAARHPGRICTKPVEKIKTDLKDTSFSTDDGCDPKNPKCGANEACVQRHGQHNCECVETAFRYTDGSCRVYSACSKRNTCDKNAICLNRFDSYTCQCRPGYIDLSADLTNAPGRICKELINECASSDNECSPYARCIDATNGYACQCLDGFIDVSSRYNKPPGRQCTNSNNECSEKSLNTCDENADCVDTPDGYTCQCYGGFVDVSSNANLPPGRVCTVQTTCPKQKTDLVFLIDGSGSIGSYVFKNEVLRFVREFVELFEIGRSKTRVGLIQYSDQIRHEFDLDQYGDRDSLLKGISETQYLTGLTRTGAAIQHMVQEGFSERRGARPQQSDIARVAIILTDGRSQDNVTGPADSARKLSINTFAIGVTDHVLASELESIAGSPNRWFYVDKFKDLDTRLRSMIQKAACPSPTKQETPSEDVCNPRTQTGCDRSLNEHCAVENGRPRCVCPEGFTRHPFTRVCGGDLCNPQLITSCIFPEECQITPYKNFRCSCPEGYNRDYRSGFCVSVKEVQISPQHDANCHNGGVRCSENERCTNDGSDWFCECLPGFERIRNGQCAYPGSCNPNDPMSCDVRKRQQCLPRGNIYTCQCGRNEKRHPITDICLKNECLTGEHDCDRSARCIDTDESYICACQSGFIDHSPNPSERPGRVCVALQNECLDGSNRCSPNALCTDTEEGYVCRCKSGFVDYSPNPQTFPGMVCKELVNECTNPRLNQCDRNAHCIDTIEGYSCICKPGFVDMDEFGNPGRRCEQIKTNDKCSPGKNDCDRNARCIQIGDDDYSCACPPGFKDKSPSSSRPGRLCIPVIPECDNPTLNDCDSPDRAVCTDTDDGYMCRCRQGFLDISPSISVKPGRLCKPLQNECALGIDDCARDGGICEDNPDSFTCRCAMNYLDVSFDRVTRPGRKCKRLINECQTGQNDCSEEATCTDTEDSYICACPQSHIDLSPDTVNRPGRRCLMRINECTSNRHDCSPNADCIDTPESYKCRCRDDFVDESPDSSRRPGRICRPALVDECRTGKHDCHVNAICQDLPQGYTCQCSADFVDVSPHRASHPGRLCQPRPTPPPPECRLDGGNQCKVHLNEVCRLMGGEPKCSCPVNYQRDSSGSCSIINECLFTQLNDCHTAADCIDQVQGYTCQCRDGFKDIGDRRRPGRMCKPMVNECQYPHLNDCHQNAACIDLEEGYECKCNQGFMDHSHGRPGRICKQLTNECLRPSLNSCDRNARCIDKEEGYECECRDGFIDVSPSPTLKGRACRELVNECANSRLNDCDKNARCKDTMDSYECDCPVNSKDISPSPSFPGRVCLMFINECESGVHDCDPSATCRDNEQSFTCECPSGFVDRSPNKHARPGRVCVKLVDECREGRHTCSSHADCRDLEEGYTCECRDGYVDRSPNLASQPGRVCSAPEVCPPNHDCSSAAVCEPLGGMKYQCVCIQGYVDQSPGSQKGRVCVRNNACHDPRLNTCSRNAICYDEPRGYRCECKRGFMDRSPDSSQRGRVCEPPPPPSPPPRHPCQDPERNDCHPAGTCRATGAQSYTCECLSGYADRSPDPRNKPGRLCVLTEPVCLDPEQNDCHAAAICSEVNGPEKYTCKCRDGYTDESPDPLRRPGRICKGLINECLDRSLNDCHSLAVCKDLPNGYTCQCPINAKDQSPDPRKPGRICSLSVNECANPSLNSCSAFADCFDEENGYRCRCRNGYHDDDPAHPGHRCSFMINECDSSNLNDCDRNANCIDTAGGYDCACKAPYRDEGPPQSPGRICRLNECLNPNRNTCDRNADCRDLDYGYTCTCRHGFYDQSPNPQEPGRICIEFQQEEHIERVKVTTVQSEPRREFPCGRDDCIKARGEVCISGEYCGCKPGEGRSASTGKCQEVQETPFELRVVTRDQRPLMYSTEFGSQKSPSYVEIVELFEKNMARTFGGTSLAPRYVNTKVDYITHPKTKNSSWDQGLLFKYEVQTTKSQSQPIDECELWKQMQASLDRTNGAIGGGSLRVASDTDLLNPCKQQEEWGNCGGMSCKEHLKEVCIAGHICGCPDGMKRRDANSECRVVESWNVPLWVVRDKEKPIVFSESFDNPQTPVYKDYSKRLEKGIEGCYPHTELKNAFVTAEVNDIVNPVLMNASYDTGLLFNTTVHFRKGMVHVPSDAYYQLIKYVTKENNNEVGDSELYLNPTQPDPFNPCFKNDCDPHGKCIEISKYAYKCECGVGYRDINPQSPGKKCLPVHGFNECERKEDNECSENARCIDLEHLYKCECLPSYYDTSPVGSVPGSLCVLDYCSDVNFCPTNTTCKNMEQQAECKCDAGFMDIRKSEKRTALMLGDDTLCMHVRDVDECALGLNNCSGVAHCIDRAVGYTCKCPDGYIDGNPDEPGRVCGALLCDLCNAHGDCVHNTATNNITCVCTDGWTGPQCQVAPSNASLVLLILLALLFLLLTLCCLLYFCTKCHCFKGRRFAGAGANGFGYRRGGAWPWSTLEGSASSESGAEFSAMSAAGNDYYPDIGIPRAKLKSGMMASGNTAEVRNMEVARLDQYLDENAVRIPRAHLVDAHGDTSFDSLSEASSEYTIKEEIERKVITDVTTKEIKTTTTTDEQGNTIVTTTEAVHPRDTTIVHGGGYTQNESSSSSFSGGERAYQSQSQQQQSMSQGMSQSMSQHATSAGYSSSGMESSAHNSGYASIRHTGERERGGSEEEFSIGRARGMAAASSGYQHSSSENREVEEYCSEEEDVEHSVGDKRTIVTKNHSYEPFVNGESERFKTEVVTSQTSTHVTKK

SEQ ID NO: 5867 - protein, 462 aa, Caenorhabditis elegans
MCTSQKRSFAVRTWPPLQSRGSNPPPHDRLEPIQESVVSEQPQKDDINKQEEAKDDGHGEASEPISALQAAWNVTNAIQGMFIVGLPIAVKVGGWWSIGAMVGVAYVCYWTGVLLIECLYENGVKKRKTYREIADFYKPGFGKWVLAAQLTELLSTCIIYLVLAADLLQSCFPSVDKAGWMMITSASLLTCSFLDDLQIVSRLSFFNAISHLIVNLIMVLYCLSFVSQWSFSTITFSLNINTLPTIVGMVVFGYTSHIFLPNLEGNMKNPAQFNVMLKWSHIAAAVFKVVFGMLGFLTFGELTQEEISNSLPNQSFKILVNLILVVKALLSYPLPFYAAVQLLKNNLFLGYPQTPFTSCYSPDKSLREWAVTLRIILVLFTLFVALSVPYLVELMGLVGNITGTMLSFIWPALFHLYIKEKTLNNFEKRFDQGIIIMGCSVCISGVYFSSMELLRAINSADS

SEQ ID NO: 5868 - protein, 468 aa, Caenorhabditis elegans
MSLSGMAIRRLITKGVIPVCQVAPLSTSAEGSTNLKEVLSKKIPAHNAKVKSFRTEHGSTVVQNVNIDMIYGGMRSMKGMVTETSVLDPEEGIRFRGYSIPECQKLLPKAKGGEEPLPEAIWWLLCTGDVPSEAQTAAITKEWNARADLPTHVVRMLDNFPDNLHPMAQFIAAIAALNNESKFAGAYARGVAKASYWEYAYEDSMDLLAKLPTVAAIIYRNLYRDGSAVSVIDPKKDWSANFSSMLGYDDPLFAELMRLYLVIHSDHEGGNVSAHTSHLVGSALSDPYLSFSAAMAGLAGPLHGLANQEVLVFLNKIVGEIGFNYTEEQLKEWVWKHLKSGQVVPGYGHAVLRKTDPRYECQREFALKHLPNDDLFKLVSTLYKITPGILLEQGKAKNPWPNVDSHSGVLLQYFGMTEMSFYTVLFGVSRALGCLSQLIWARGMGLPLERPKSHSTDGLIKLALAAKK

SEQ ID NO: 5869 - protein, 602 aa, Caenorhabditis elegans
MAYEFDLEDFNDNLEPFGFNCPAKDHFIEKLEGLCKTFRKSGEDIVDDVVSVMSNLGQKSVDSGILAKLEENLEAQAQKTVHTPRSVKKPARGRVPLAEKSGFILSGDPDDIEKPSHHLTNSAIAKLEGHFLDFSPFPGSPANEKFLKRADPSHVVTTIRGKKYQDKGLKGSTKSDDTIRIISKTPSTLYGGDKSSMVIEVLFKSAHLFAFNENFRVETRYPKAQRMADIAHRIQKSFEEIVDWGNPSIPSVDVVYTYGQVIHDETKDNEKFGEHSVALMINDEDGTMIRMDFSKMTEDITLFPGQIIAVRGTNETGEELQVDKIFQPAALPVNPVETDTTKEIWFACGPYTATDNCGYEHLCELLDKVVAEKPDILMLAGPFVDKKNTFLNKPTFNITYDNLLEDLLLKVKETLVGTKTQVIIQPNASRDLCVPPVFPSAPFQQNRKLDKIKKELIFVADPCIFRISGVEVAMTSSEPIQALSNTEFHRSANQENIDRVARLSSHLLTQQCMYPLEPTEVPASMGDLLDVCCIGSTPHIVFAPTKLAPSAKCVNGSVFINSSTLAKGPTGNYAKMSINLNAGELMPGETVADYAQIQILKI

SEQ ID NO: 5870 - protein, 602 aa, Caenorhabditis elegans; identical to SEQ ID NO: 5869

SEQ ID NO: 5871 - protein, 573 aa, Caenorhabditis elegans
MAGRTLKKSATAISDTLRRTFSSKTWEHREQLHSLQEDNKFFLRKVRWQIALLAHFGFAISFGIRSNFGVAKNRMINNFTDAYGEVHEKEFFWTGTEVGMMESSFFYGYAASQIPAGVIAAKFAPNKLFMLGILFASLLNIVTAICLNFHPFTDIFVMVIQVMQGLALGVCYPAMHGVWKYWAPPLERSKLATTTFTGASVGVMVGLPASAYLVSHFSWSTPFYVFGALGIVWSILWIYVSGTSPETHGYISADEKKYITEKVGSVAVKNMTLTTLPWRDMMTSTAVWAIIICSFCRSWSFFLLLGNQLTYMKDVLHIDIKNSGLIAIFPQLGMCIVTLTSGQLSDYLRSSGKMSTEAVRKSVNTFGFTVEAVMLGCLAFVRDPVIAVTFLIIACSGAGAVLSGFNVNHFDIAPRHAPILMGIANGLGAIAGVGGIVTNSLTYQNPDGWQWVFLLAMSIDIFGIIFFLIFAKGDVLPWAREPEKEETFNEFVRRMSTMVRSLSRRTRTRSTDTNYDKMEEERVNSSEMKACAKSDVPVPEEGVLNETQAIGGSLEVVPEEPANKNLRTDRPEV

SEQ ID NO: 5872 - protein, 573 aa, Caenorhabditis elegans; identical to SEQ ID NO: 5871

SEQ ID NO: 5873 - protein, 544 aa, Caenorhabditis elegans
MPNGSIRNCANAVADTVRQTFSRKTWEHKEQLQTITEQKKFFLRKVRWQIAILAHFGFAISFGIRSNFGVAKNRMVNNFTDAYGEVHEREFLWTGAEVGMMESSFFYGYAASQIPAGVLAAKFAPNKIFMLGILVASFMNILSAISFNFHPYTDIFVMVVQAVQGLALGVLYPAMHGVWKFWAPPLERSKLATTAFTGSSVGVMTGLPASAYLVSHFSWSTPFYVFGVVGIIWSLIWMYVSSHSPETHGYISDDEKKQVTEKIGDVAVKNMSLTTLPWRDMMTSSAVWAIIICTFCRSWGFFLLLGNQLTYMKDVLHIDIKNSGFISIFPQFGMCIVTLATGQLCDYLRSSGKMSTEAVRKSVNTFGFTVEAMMLGCLAFVRDPVIAVTCLVIACTGSGSVLSGFNVNHFDIAPRYAPILMGIANGLGAVAGVGGMVTNTVTYQNPDGWKWVFLLAMAIDIFGVIFFLIFAKGDVLPWAREPEKEETFNEFVRRMSIKVRSLSRKTRNREGDTSYEKMEEDSEMKPCSKKVEARAPAEKSESSS

SEQ ID NO: 5874 - protein, 1138 aa, Caenorhabditis elegans
MSQKTEQDDIPLADDDDTVTIISGGKTPRAAQPLPKEEPPEDPEEKARMITQVLELQNTLDGNSQKFHFFYIDFLNFRSLTTRRICQGREFEVEIGKSSARPVHSEPNVLLVSIPVFSAVTAQAIMGEIPPTDSGYPTPRDEIPSTSRPNSPNNAQLYPLTSTPIRGNKSRSMKENFATFRNDLSIIESTGSDTIENDSHFVLDGVKSLLEASKELKKKDRANSLLRDQNESLRGENESLREENCSLREESRRMDLVDKENVIPVIPRLVFDEKPDLDPITVKSSEQIKKELLSFIKNDEDRTIMEAKMENMLISDSKPPAKVFTATATIQVDTEKMDANIQTDKDDHVNVVNANLQIEVDQLHSEIEVIGKKKSDLENRLFDYEKLKAQFEQDENKLRADLEKKLKTSQEKLVKYEGKIEELQSRLNKKRKELEEVQAENRKLLEDKNTHDFELDEAKVQGEHLEKQRKEAWEKVEQLQEMLGELEAELDRQKELKLQLEKDMEDLRKEHEGQMAELEKRLEKVSEKEKEAIEQLEKIQKENKTIVKENVYLSESKQVLLESEINLKNELDEMAVKLRNSQHQVAGLNEKISEEKRRRKKQDADVTRLDEQNQKLLREAQDSAELLEEVQKGKREIDHLRQQLAHQSSEAGSVGQLQQKLAESEHREYLLQLELERVMKMERDLDGRIEGYIRSEAAANNELERLRKDTAEQKEKLEAMEMEARSKDLELADLTRKLAKAREEHETFEINARNQFYAVTGQMHEDIESYKQRLLELEPYPGKIISGSFRDFPSQTDPSPATTDAWMQTDVEEQLMVSPEVSLVSEAPSSLQDSRRSSHLDEKLRRTIEKIGELLAEHESFQESLRDPEFHTAEAFRKISQLLKSILSGANSEEMLERIWTWLTLKTKALVEQQDEQMKKVQKAGEMLLSQLREKESDNEVLTKKSLEMEAAAEEFRTYYNDMLTENDELRHRIVQLDEIREVESSNSTKIEKGLREQLEQAQHELEKKKREYMWKLQQKDEFYEIMDRNVKETEKENKRLLRKRTEDKERMDDFMLNIRKAQEQWKYLRMRNCQRHTSMMNMLESVKKKKHESRDMNWLLQRFEDSIRKYGVAELTTEEILEPEGSRSSSSRTLSNH

SEQ ID NO: 5875 - protein, 1138 aa, Caenorhabditis elegans; identical to SEQ ID NO: 5874

SEQ ID NO: 5876 - protein, 182 aa, Caenorhabditis elegans
MINIPTAILCRLGARSSISRSFGTSIVTKSEAKTPIQKFGWEYLLKQRSKNRPIAPHLTVYQPQLTWMLSGFHRISGCVMAGTLLVGGIGFAVLPFDFTAFVDFIRSWNLPCAVTAVFKYIIAFPIIFHTLNGIRFLGFDLAKGVNNVGQIYKSGYLVSGLSAILALAIVFNSCQNKSNKTA

SEQ ID NO: 5877 - protein, 379 aa, Caenorhabditis elegans
MGVVRRGSDVTSHVSSVSGKSAPCLQHFSVIRSIGRGAFGKVCIVQERKTKKYFALKYMNKRRCIEKGVAANVIRELTLLSKMSHPFIVNLWYTFQDGDYMYMVSDLLLGGDLRYHLSQQGKFAEDRAKLYLCEICLAVEYLHEMKIVHRDIKPENILLDEQGHAHLTDLNLATQLEDDQLATSYSGTRPYMAPEIYATYLEIEDGYDSRVDWWALGVCFYEMLRGRTPFEFSSRTKPEEAYVAFRESSIPYPAHWPTDLIQFINSMLKFDKEKRLVGLEAIKKHSYTERIDFKSVFEKKPSPVFIPCKEGLNCDPMYELEERILVSTPIHRRRTNHNNSSGRSSSEPQNAALVEVSKAFIDFSRHNVKIEPNGFVKLN

SEQ ID NO: 5878 - protein, 848 aa, Caenorhabditis elegans
MDEFSFPFQPYDIQLNLMREIRQCIEQRKIGIFESPTGTGKSLSVLCSTMTWLEAEELRISTDLSTRLGEVHTKITECDKITTADNWETAVREKMRAQDVETEILEQIQSRERLQSRIDQARRGMVEVSRKRKAPARDTDQFLEPQDEAAPSEEYNNDEKSEKQRDSDFFDDVDEEEEKPLKCLKIFYASRTHSQLEQLAEELAKTRFQPRIVTCASRGTLCVNEEVKKLKLNHLINEKCMELRKNGMSEKEKVQKLEKGTTKKTKTCATSCEFYNSTQIEDVVNGVLSNKLKSTLEVSKQGKLSNGCPYFATRKSVPQCQLVLLPYQVLLHDGTRKAWGIELKDNVIVLDEAHNVLNTISSFFFRKLEKVSKNGFKNCSLYSAEISTKSLTLALRLIREYNAHYKLKLLAHNLLYMKQLESLTSKMLIFLNSQSKEDVMTMAQLARNLNILEINLFKLAEYMEKTDLCKKFHGFYMRLQKEEIKKENEKPKLTGIQKLMAAKEAEPEPEAEPLPPPKPVPSPLFSLKSFIDALTNKCEDGRIIVEKSATEAKFRFMLLNPADRLSEVVTSARATILVGGTMEPAQLLVETLSRGSIGADSIRRFSCCHVIDDSQLLAVTVERTVDGKPFQLTYQTRGADTTLRSLATSIQALIPHIPNGVVIFVPSYDFLFNFQKKMKEFGILKRIEEKKAVFTESRQPTSDVWDRFSRAAKTSKGAILFAVVGGKMSEGINFCDELGRAVIVIGLPYPNKTSVELRERMKFLDTQMPNGGNLLYESLCMHAVNQAIGRAIRHRRDYAAVYLFDDRYAKESTRRKLSTWIGDRTQVKLGFGEIIRKTRSFFEANSKK

SEQ ID NO: 5879 - protein, 676 aa, Caenorhabditis elegans
MQSAINLNIGGLLQNTGLLRNSRNGINRKPLDIEATAASLSRVYHQVWRQFSSDTSSPVTINQMNNILRDSTLSRRIARKSEISLNYDDAVVRIIPASSSFYIQRRGFRTRKQTFGVGNAGKPTQDEVKSPLTYFSELLAGKKQKTSEGGVEKWNQYESDLKKLPENQQRTYTDGFVKGLLSNGVSGAGKDGKKSNTLTRFYIFLMDEAKLEVEEIVDYLKDPEKYSRLGGRLPKGVLLVGPPGTGKTLLARAIAGEAQVPFFHTAGSEFDEVLVGQGARRVRDLFDKAKARAPCIIFIDEIDSVGSKRVSNSIHPYANQTINQLLSEMDGFTRNEGIIVIAATNRVDDLDKALLRPGRFDVRVTVPKPDLAGRVDIFNFYLSKIVHSGGIDPKVLAKGSTGFTGADIENMVNQAALKAATDNAVEVTMAYLDEARDRVLMGPARTGGRIPDEEANRNTAYHEAGHTLVSLYTKDATPLHKVTIIPRGQSLGHTAMLPEKDSYQLTKAQMLATLDVMMGGRVAEELIFGDDKVTTGAADDLSKATQLAVQMVKVFGMSDKVGLRDFTAQDNESALVKVSDLAPQTAELIDAEINRVLQESYKRAKVILETKKKEHQLLAEALLEYETLSADEVKRVISGQKIKRPTPAAVKKSNETKRNQPSLVLHLFEEEGRGKQ

SEQ ID NO: 5880 - protein, 351 aa, Caenorhabditis elegans
MEEIQAITEGKIIAKRWKIVEKLGEGGMGAVFKVRDLTRFQTYAAMKVEGDVSDGGVLKLEAHVLKSLAPLPFCARLMDAGDRKSYCFMVMTLLGKDLMAHKRDANTPRFCEQTTLRLAMATLFAIKQIHEVGFTHRDIKPGNCVTGVHGSDAKNVYLIDYGMVRQFTAKRENGETALRRARSGEQLFRGTPRYCSMNVHNRKEQGRVDDLWSWLYMLIELHCGLPWRRLTDEKEIMDAKIACSMETLLKGCPKEFANIHKYLETLEYKSRPDYFGLWSECFAGFKRVRGSFFGRFEWELGKGGGEEMFTALSISEKRAPNDYKVATKMQMAKKIWPYADSAHFKKKILNL

SEQ ID NO: 5881 - protein, 772 aa, Caenorhabditis elegans
MTCDSEVVWKKLQDGLDVAYRRENMAPKDYMTLYTSVYDYCTSITLSTSRRDGEDGRAESSTPARTAGADFVGHEMYQRVEEYVKAYVIAVCEKGAELSGEDLLKYYTTEWENFRISSKVMDGIFAYLNRHWIRRELDEGHENIYMVYTLALVVWKRNLFNDLKDKVIDAMLELIRSERTGSMINSRYISGVVECLVELGVDDSETDAKKDAETKKLAVYKEFFEVKFLEATRGFYTQEAANFLSNGGNVTDYMIKVETRLNQEDDRCQLYLNSSTKTPLATCCESVLISNQLDFLQRHFGGLLVDKRDDDLSRMFKLCDRVPNGLDELRKSLENHIAKEGHQALERVAMEAATDAKLYVKTLLEVHERYQSLVNRSFKNEPGFMQSLDKAATSFINNNAVTKRAPPQAQLTKSAELLARYCDQLLRKSSKMPDEAELEELQTKIMVVFKYIDDKDVFSKFYTKMFSKRLISELSASDEAEANFITKLKSMCGYEYTARLSKMVNDTQVSKDLTADFKEKKADMLGQKSVEFNVLVLSSGSWPTFPTTPITLPQQLSKTIEIFGQFYNEKFNGRRLTWVYSQSRGEITSTAFPKKYVFTATTAQMCTMLLFNEQDSYTVEQIAAATKMDEKSAPAIVGSLIKNLVLKADTELQKEDEVPMTATVSLNKAYMNKKVRVDLSKFTMKQDAVRDTENVQKNVEEDRKSVISACIVRIMKTRKRVQHQQLMTEVITQLSGRFKPKVEMIKRCIGSLIEKEYMLRTEGQKDLYEYLA

SEQ ID NO: 5882 - protein, 307 aa, Caenorhabditis elegans
MSEHHVNIPAPQFSTYATVIDPPKHVTATHPDELTTASHPQPTHPSAPQDPSPAVPSTPVRVPYPTAPPPIPPAPEAVTAGPKKMALAPSSTKTYKQKRTFKVIIVGNAAVGKTCLSFRFCCGRFPEHTEATIGVDFRERSCVIENELLRVQLWDTAGQERYRQSIVAHYYRNVNAVVFVYDVTCRESFNDLALWIKECEKHGLVGDSEVPRILIGNKCDVECTNRVSTDEAQMFADRNNMALFETSAKLASEADHVESIFLTLLHKLQQSKPMHVQSQDERHQKEQERLILKANETENVEEEGFCC

SEQ ID NO: 5883 - protein, 1106 aa, Caenorhabditis elegans
MARPFTLIVLLSAHLCLHVVVTQDEDSHINTQLLSSVLDRLTNRTTYDKRLRPRYGEKPVDVGITIHVSSISAVSEVDMDFTLDFYMRQTWQDPRLAFGSLDLGLSKEIDSLTVGVDYLDRLWKPDTFFPNEKKSFFHLATTHNSFLRIEGDGTVYTSQRLTVTATCPMDLKLFPMDSQHCKLEIESCKSLCSPDIFSPNGYSILDIMYVSHEKKSVSTESYELPQFVLQSIKVVNHTQKLSSGEYSRLCWFFLFKRNIGFYIIQIYLPSVLIVVISWVSFWLSRDATPARVALGVTTVLTMTTLMTMTNSSMPKVSYVKSIDIFLGVCFMMVFCSLLEYAAVGYISKRMKLVRARKESRMLTPLPHLESLPPKRTLSVPSYFNNTTYRPFYSSTDQTSNLYIPESQRTTIFSVCTVFENCASNNEDAVPNELTPMLGRSNSQASVFLYQKFVENGDTDFADGYETKDIDYYWGKKRTDLEITAVKFDTFQLPQFQPTLYFVNTTKAETSSGKYVRLALEVILVRNMGFYTMNIVIPSILIVTISWVSFWLNREASPARVGLGVTTVLTMTTLITTTNNSMPKVSYVKGLDVFLNFCFVMVFASLLEYAIVSYMNKRLVLRREKRRKAAEQQQRNEMPMFNASPKAANNNADLYFAGHNSSMNPLMEIPENCDCRTIPMMQHPRLVTDGAHTLWPAPFARPKKVNKLPRHAANDGRLQKSISLADTVSHCLSLSSIVCLLFGLFPLTKFNCSSLLVVYEISKLKLVGQDPGERQVAADPLVNTRDIIPPVPARHSKTFSLSYYFSPFSLLPPLYLPSAIGHVFCMLAVTKPPSRMTSSSSSTSSTYAYSTAEIEYKWCTSKEPNCSTAVKADANIELSSYKFTKICQKRTLASTSSGTYSRLRVSFIFDRDSGFYFLQIFFPASLVVVLSWISFWINRDSAPSRTLIGTMTVLTETHLMTGTNRRLPPVAYVKAVDVFLGFCYLLVILALIEYACVAYSKKKNEDRRRREKKTEHKPAPPTPDILHDVRLAECTCNAAPTSIIAVIKQSNRFCVSHSHIDIVSRAAFPLVFILFNTLFWLILLYKSKRLPYISEHEGDRCDAPDLH

SEQ ID NO: 5884 - protein, 393 aa, Caenorhabditis elegans
MTTFDKGAKPDIGTFVAFDHVRFVVGNAKQAAYWYCANFGFEPFAYKGLETGSRITAQHAIRQDKIVFIFESALLPDNSELGNHLVQHGDGVKDVCFEVEDLDSIIAHAKAAGATIVHDITEESDADGSIRYATLRTYGETDHTLLERKNYRGAFLPGFKAHPMPATFFKTLPRVGLNFLDHCVGNQPDLQMDSAVQWYEKVLKFHRFWSVDDSMIHTEYSALRSIVVTNFEETIKMPINEPATSDKKAISQIQEYVDYYGGSGVQHIALNTSDIITAIEALRARGCEFLSIPSSYYDNLKERLAASSMVVKEDMDRLQKLHILVDFDENGYLLQIFSKPCQDRPTLFLEIIQRQNHEGFGAGNFKALFESIELEQTKRGNLFYDNVKDGNTK

SEQ ID NO: 5885 - protein, 216 aa, Caenorhabditis elegans
MEDYKYLFKVVLVGNAGVGKTCLVRKFTQGIFPPGQSATIGVDFMIKTVKVGNDKIKLQIWDTAGQERFRSITQSYYRSAHAIVLVYDVSCQPSFDCLPEWLGEIESYANRRVLKILVGNKVDKGDEREVPERIGRDFSDVNQFDYFLETSALDATNVDQLFEQVATRLTNDMKLTDERVHQFRADATNSSSSTGGPIKLIDRAQTQLNSCCTRQS

SEQ ID NO: 5886 - protein, 296 aa, Caenorhabditis elegans
MKMREIEENAFEFKSGALCVHDGVCTHCIPYHPGMSTSLRLTQSLHFLGKSTMLSSKLAIVTGGGSGIGQAICKKFAASGARLIVADLKKSAAEATAGNLPGNGHSAFEIDVSDPEHVARLQEFIKSSGESPSVLVNCAGITKDATLLKMSQNQWQDVMNVNLNSVFLMSQMIARESVAAGSPLSIVNVSSIVGKIGNFGQTNYAATKSGVIGFTKSAARELATKNIRVNAVLPGFIRTPMTEAMPPKVLDAMVSMVPQRRLGETEEIANAVLFLASDMSSYVTGTTLEVTGGLGM

SEQ ID NO: 5887 - protein, 636 aa, Caenorhabditis elegans
MNTRKSETSKTVSATPVKRRSTRITNLPKSAPKIVKRSSVRLRGAPQCTYKSDSSSSSSSSDSDGEDEYAATKDELKAVDHDNQMEIDFSDEIGENFSEEDSCSDKENRRVTRSRTPTRLEETPSKRLARELSKASVSKVSTSKTLFKESKSPRKVEISRKTNKARVFQEEDDDDEDDFSDEIDEKFYSKTNKRTPITIKIPSKMITQKVTPLVISKTPGGTLRTRRRARQNSEELEDLVDPLDSRSASTLKELASRLHLSKVPEKLPCRDIESREIEKFIREVIDPKRGESSAMYISGVPGTGKTATVRAVVNSMKKSKKCQKFVYVEVNAMIFKKTVFVEIYNGIQEEYNISKKPQRAKITATAARQELNSIFKREDPKRPPIVVLIDELDSLCNRKQDVLYDIFEWTALPQSKVTIIGIANTLDFPERMLCQRNASRLDKRRLVFQPYQHEQIEEIVRARLQGSNLIDPKAVELVAKKVAMNTGDLRQALDFLCRAIRVAVERKSEKLELSHVIAAQNAVLEPLKYRLVKGLRLHQFTLFRTIESMTREQEEIIFANIYKNYCIICSEVSGIGPATDSFAYGMLLQLASTSLINLSKGDHGMMNRRVKLGMTSMEAEKAIKAAIEKNKSIYSI

SEQ ID NO: 5888 - protein, 449 aa, Caenorhabditis elegans
MREIVHVQAGQCGNQIGSKFWEVISDEHGIQPDGTFKGESDLQLERIDVYYNEANNGKYVPRAVLVDLEPGTMDSVRSGPFGQLFRPDNFVFGQSGAGNNWAKGHYTEGAELVDNVLDVIRKEAEGCDCLQGFQLTHSLGGGTGSGMGTLLISKIREEFPDRIMSSFSVVPSPKVSDTVVEPYNATLSVHQLVENTDETYCIDNEALYDICYRTLKLTNPTYGDLNHLVSLTMSGVTTCLRFPGQLNADLRKLAVNMVPFPRLHFFMPGFAPLSAKGAQAYRALTVAELTQQMFDAKNMMAACDPRHGRYLTVAAMFRGRMSMREVDEQMLSVQNKNSSYFVEWIPNNVKTAVCDIPPRGLKMAATFVGNSTAIQELFKRISEQFTAMFRRKAFLHWYTGEGMDEMEFTEAESNMNDLISEYQQYQEATAEDEPLDEFAGEGETYESEQ

SEQ ID NO: 5889 - protein, 215 aa, Caenorhabditis elegans
MSGGDGIPTFKLVLVGDGGTGKTTFVKRHLTGEFEKKYVATLGVEVHPLVFHTNRGQIRFNVWDTAGQEKFGGLRDGYYIQGQCAIIMFDVTARVTYKNVPNWHRDLARVCENIPIVLCGNKVDVKDRKVKAKTITFHRKKNLQYYDISAKSNYNFEKPFLWLARKLLGDPNLEFVAMPALAPPEVQMDPAMIAEYEKDLDNAAKADLPDDDDDL

SEQ ID NO: 5890 - protein, 1353 aa, Caenorhabditis elegans
MLPQQRLVVPNNQKEPPPRYEQPNRKYCGNRISTTKYSVLTFIPKNLFEQLHRAANLYFIFIVILNMIIGAFGKYISVLPIAFVLGITAIKDAFEDYRRYKSDQKINHSTCRVWDASQQRYRKLEWQNILVGDFVHLSHDEIIPADILLLRSSDVNGVCYVETCNLDGESNLKQRQAIRSMGKYHNANVPLEYSPAEFNYRIACEQPTTDVYKFEGRLEAIEGGPPLAREFTILAKENVLLRGCVVKNTDFVEGIVLYAGKDTKAMLNNNGPRYKRSSLEKMTNVDILWSVCTLLALCVIGAVLSGVWLRTFSTPYIVPFLVFIHPNSSYHNNNDSQYKYSPSYESWFSFWSYIIVLQVMIPISLYVSIEFIKIFQVWFMSQDRNMYYDKVDKRLQCRALNITEELGQIQYVMSDKTGTLTENQMVFRRCSVNGNDYGGRPVVDAVDSSLELVASTLRSDQPTEKKLQMAALAEAAAKTRRLRPSRDPALESQLASSVLKLGADIDDPVFAFFLTMAICNTVVVNAKPHEDLMDPDGDIVNSRFAPEEVSPRRGSSLEDGFKYLADVEEESPASTQASTPVMITEENDGFEEIELIEFPEVKTDETQMTEKEETISAEVAAKKSGSDEKDNNYNGERKEGKGFGILHRPSILSVPFAKLKGMKSPFRRSVDKRSSSSTETAVAPPLHSFYDSESPDELALVEAAREYGIRLLRRRFDDVIVYLRHSTSSVKYKVLHTLPFDADRKRMSVIIRESSGLKRIIVLTKGADATVIPVLSEAFSTSARGEEVIFKSQEHLTQYAKEGLRTLCLSMKIWTEEEYQGWKEKHEEAELDMMDKETMLAESTLRAEQDLELLGVTAIEDRLQDGVPECIHSLREAGIRVWVLTGDKIETAVNIAYSSRLFSPSMDLLNIGANGVRAVSDLLTEHLKRIARAYEVSADAADSFGLVLNASTMSYCLDPHNLERFVKLLRGCRSVLCCRATPLQKAQLVNLAKNHLKGKVLAIGDGANDVSMIQPEGVKYSCRIFFKGADVGIGLSGQEGMQAVMSSDFAMARFRFLSNLLLVHGHWNYYRLAQTILYFFYKNAMLVFVIFWYQIFNGFSAQVPIDPVYLMVYNLIFTSVPPLLFGCLDQDASAELLLDCPRLYEQGRLGKRYRWYSFWINMLDAVWQSLVVFFICYFTYRGSNVDMWTFGHLLVTQLIIVNTFHLALFVQYWTWPMFWSMFLSVLLFFICALLYNGFVTANWTWTNVKDPPSMVSLKSFSSLEFWMALIISVVLCLTPRYVLTTVVNTVSPSTTLRTRLGAEDGFKKKTESRFTACAVGCLSAPFKCARMCCQKTKPADVHVSSKIVFNILF

SEQ ID NO: 5891 - protein, 747 aa, Caenorhabditis elegans
MKSCRSCKENPEVQRKRAEKPWRRAPKAKSEVEKHGIGPPDSDSGEEISFPWYNVTGKMLVVGMHVEIKRSDGRIHGAVIAEVKSNGRFMVEWYEKGETKGKESSLEELLTLNPSLQAPKPTPPPQPPQKTLQASTAVNRQNGIHAQSMILDDEDTFLLDHINMIPAKGASANKRPTGAFTQHVPVRMAPPSEKPLPTRRAPSPKEDAAPAPKSTRTTAAFKPDLDSTAITVPKHTARRTVVVAPAPAPVPAPPIANMTSQRAPSPVARVPSPKNVPRSYPQQDVQPSNGNFAFAEMIRNYRAQIDYRPLSMFDGVNENRISVCVRKRPLNKKELTKAEVDVITIPSRDITILHQPQTRVDLTKYLDNQKFRFDYSFDEYANNELVYRFTAAPLVKTVFDNGTATCFAYGQTGSGKTHTMGGDFSGKKQNASMGIYALTARDVFRMLEQPQYRRKDLSVHCAFFEIYGTKTYDLLNDKAELRVLEDKMQKVQVVGLKEEQAHNEQDVLELINKGTLVRTAGTTSANANSSRSHAIFQIILRQGKKVWGKFSLIDLAGNERGQDTRECDRDTRKEGANINTSLLALKECIRGMARNSSHVPFRQSKLTMVLRDSFIGEKSRTVMISMISPGISSSDHTLNTLRYADRVKEMGTDGSGEATPIRDEELFLPPSADKSDEEYDEMVEKQEHRRVAVDHVRNLKDMSEKIIRETTIVLSNEPSAAQKAECLAKLDQLAQIVSNTRVAVENV

SEQ ID NO: 5892 - protein, 1004 aa, Caenorhabditis elegans
MEDAHAKDANEVCKFFGTGPEGLTPQQVETLRNKYGENEMPAEEGKSLWELILEQFDDLLVKILLLAAIISFVLALFEEHEDQTEAVTAFVEPFVILLILIANATVGVWQERNAESAIEALKEYEPEMAKVIRSGHHGIQMVRAKELVPGDLVEVSVGDKIPADLRLVKIYSTTIRIDQSILTGESVSVIKHTDSVPDPRAVNQDKKNCLFSGTNVASGKARGIVFGTGLTTEIGKIRTEMAETENEKTPLQQKLDEFGEQLSKVISVICVAVWAINIGHFNDPAHGGSWVKGAIYYFKIAVALAVAAIPEGLPAVITTCLALGTRRMAKKNAIVRSLPSVETLGCTSVICSDKTGTLTTNQMSVSKMFIAGQASGDNINFTEFAISGSTYEPVGKVSTNGREINPAAGEFESLTELAMICAMCNDSSVDYNETKKIYEKVGEATETALIVLAEKMNVFGTSKAGLSPKELGGVCNRVIQQKWKKEFTLEFSRDRKSMSAYCFPASGGSGAKMFVKGAPEGVLGRCTHVRVNGQKVPLTSAMTQKIVDQCVQYGTGRDTLRCLALGTIDTPVSVSNMNLEDSTQFVKYEQDITFVGVVGMLDPPRTEVSDSIKACNHAGIRVIMITGDNKNTAEAIGRRIGLFGENEDTTGKAYTGREFDDLPPEQQSEACRRAKLFARVEPSHKSKIVDILQSQGEITAMTGDGVNDAPALKKAEIGISMGSGTAVAKSASEMVLADDNFASIVSAVEEGRAIYNNMKQFIRYLISSNVGEVVSIFMVAALGIPEALIPVQLLWVNLVTDGLPATALGFNPPDLDIMDRHPRSANDGLISGWLFFRYLAVGTYVGVATVGASMWWFLLYEEGPQITYYQLTHWMRCEIEPDNFADLDCAVFEDNHPNAMALSVLVTIEMLNAINSLSENQSLLVMPPWKNIWLMAAISLSMSLHFVILYVDIMATIFQITPLNWVEWIAVLKISLPVLLLDEILKFIARNYIDVEAPIKDKRD

SEQ ID NO: 5893 - protein, 1059 aa, Caenorhabditis elegans
MEDAHAKDANEVCKFFGTGPEGLTPQQVETLRNKYGENEMPAEEGKSLWELILEQFDDLLVKILLLAAIISFVLALFEEHEDQTEAVTAFVEPFVILLILIANATVGVWQERNAESAIEALKEYEPEMAKVIRSGHHGIQMVRAKELVPGDLVEVSVGDKIPADLRLVKIYSTTIRIDQSILTGESVSVIKHTDSVPDPRAVNQDKKNCLFSGTNVASGKARGIVFGTGLTTEIGKIRTEMAETENEKTPLQQKLDEFGEQLSKVISVICVAVWAINIGHFNDPAHGGSWVKGAIYYFKIAVALAVAAIPEGLPAVITTCLALGTRRMAKKNAIVRSLPSVETLGCTSVICSDKTGTLTTNQMSVSKMFIAGQASGDNINFTEFAISGSTYEPVGKVSTNGREINPAAGEFESLTELAMICAMCNDSSVDYNETKKIYEKVGEATETALIVLAEKMNVFGTSKAGLSPKELGGVCNRVIQQKWKKEFTLEFSRDRKSMSAYCFPASGGSGAKMFVKGAPEGVLGRCTHVRVNGQKVPLTSAMTQKIVDQCVQYGTGRDTLRCLALGTIDTPVSVSNMNLEDSTQFVKYEQDITFVGVVGMLDPPRTEVSDSIKACNHAGIRVIMITGDNKNTAEAIGRRIGLFGENEDTTGKAYTGREFDDLPPEQQSEACRRAKLFARVEPSHKSKIVDILQSQGEITAMTGDGVNDAPALKKAEIGISMGSGTAVAKSASEMVLADDNFASIVSAVEEGRAIYNNMKQFIRYLISSNVGEVVSIFMVAALGIPEALIPVQLLWVNLVTDGLPATALGFNPPDLDIMDRHPRSANDGLISGWLFFRYLAVGTYVGVATVGASMWWFLLYEEGPQITYYQLTHWMRCEIEPDNFADLDCAVFEDNHPNAMALSVLVTIEMLNAINSLSENQSLLVMPPWKNIWLMAAISLSMSLHFVILYVDIMATIFQITPLNWVEWIAVLKISLPVLLLDEILKFIARNYIDGKPETVGAKARSAISLLAWVSVTLAYFAWMLGPYAELINHALVGPSVDPSKFDAVVTPDKLHNEL

SEQ ID NO: 5894 - protein, 388 aa, Caenorhabditis elegans
MADTTILDTTCSSTLAANVEFSHATDSAIGISLKNATITEAEGVPNLKETGYDCVRYMGTCNGGQIYLGRERKKLKDYVAIKKFAIDDVDDYAAIAKESSNLRLMHHPNIIELCECFVYERSIYQITPAMNLGSLFDIVFEYMKWGINEKSAAAITRQLLDALSYLHQRRYIHRDLKPKHILIDSSGNVKLSGFRFMIELNHHLDCVFEFDAHLQNQLYYLAPEVLAQNIHGYTSKSDIYMLGISICEAINGVMPFGELEPLEMLHRKLNGQVPRPVDMISLKDDQKMGLDISHRPQEHLTRRFSKEMHEFIANCLDYDPQQRGSASDLKSSAWLGSKIHKNLGPVDVRQELNLDYAHFDLSLWEQEPLIPMEPDQKYEIVFDYSPIS

SEQ ID NO: 5895 - protein, 388 aa, Caenorhabditis elegans; identical to SEQ ID NO: 5894

SEQ ID NO: 5896 - protein, 490 aa, Caenorhabditis elegans
MGSPVSTGTTPSVIISIFRRPIDCSISCRLHARQSTEEERRTVQTDDVAEIGMQRPDYQMYCGEEEISEQFVKLNVGGQRFMLRKDTIRRRGVGRLLDLINKPVADSNADAFFSSTSEFYFERPPSLFHIVYQFYLNGVIHQPSNLCPVDIIEELEYWRIIPDQYLASCCCAQQIDDDDEEVEEQDKPNLFKTLRFGEIRRCVWNIIEEPASSGKAQAFAVCSVVFVLISISGLVLGSLPELQVATKQRNNLTGEEFTEMEPMPILGYIEYVCIVWFTMEYGLKMLVSAERSKTFRQLLNIIDLLAILPFIIEMLLLIFGISTEQLRDLKGAFLVIRILRVLRVIRVLKLGRYSSGLQMFGKTLKASFRQLGMMAMVVMTGVIFFSTLVYFLEKDEPASKFHSIPAACWWCIVTMTTVGYGDLTPVTVPGKLVATGAIACGVLVLALPITIIVDNFMKVAETERPAGGNRYRTSQYPKATKSEQMILKVT

SEQ ID NO: 5897 - protein, 346 aa, Caenorhabditis elegans
MQKTIRSQALIYRKFGDPLKVLQLETVEVPAEPGSGECLVEWLASPINPLDINRIQGNYAVRAELPVIGGSEGVGRVVKAGSGSRFKSGDHVTIFSANTPIWTEFGVVDDDELVKLDNRIPLDLAATLMINPPTAWIMLKKYVNLQKGDYIIQNSANSGVGRSVIEMCKALGYKSINIVRNRQNIEALKTDLWRIGADHVFTEEEFKGTSRQFLKSINVRPKLALNGVGGKSALQISSVLERGGTCVTYGGMSKKAHEFTTSALVFNDICVRGVAVGMWARQEEHLDEWNLCVDEVQKLAVAGKITAIPMEKVVLADHKTAIQKSLEGRSIKQLFVINSKASASHI

SEQ ID NO: 5898 - protein, 772 aa, Caenorhabditis elegans
MGFSPFLDECRAEGLWPIGPSCNKIISFGVYTFFIVVNFIVLCIPNSNSANNNYRRMTDDDASSTSKLTISKILSICTIFAVICQSIFYFCFTFYFHPYTHLLLAFCVSKLFFWILSLCSFSKWRNQPSTPISLAFAFSAALLIHCIPLTDWKKYFEPTSKNRGDLTFYIIELALVTVVFFFTIVTGLFNFSGCSSRESVRNLQGLATISAFWSLKTGKIIIIIHSSKNCHVNLKAHTYHFPMGLATILTRPKSVCAFKIGGHIFENAWNNLSKKVVTVAPYIWPTKSISLQLRVVFCLFLLIIGRLINVSLPILSKWIVDELATPDTFQYSLLFLATFLKFLQGNGAMGGFLNTVRTYLWIPIQQYTTRELEVELFKHLHSLSLRWHLSRKTGQVLRVMDRGTSSVNNILNYQVTEWKTQASLAFLNCLQNAIIGIGMIGGSVFVVYMIVHEKTLTVGDYVLFTTYLLQLYTPLNFFGTIYRVIQKAFVDMENMFDLMNDEVEVKDLPHALPYTDPRGTISVKNLTFEYNTGLPVIKNISFEIGNGQTVALVGSSGSGKSTLIRLLFRLFESTEGSIEFDGIDVRNYTMHSLRQQIGIVPQDTVLFNDTIMYNIRFGRPDASDEEVIEAAKAAMIHEKITSLPEGYATMVGERGLKLSGGEKQRVAIARTILKKPQFIFLDEATSALDTPTERAIQKCLEKLCKSRTGVVVAHRLSTVVNADLILVLDKGIILERGNHKELLAQQGTYASMWEAQIAEQRAKSIELGEELP

SEQ ID NO: 5899 - protein, 444 aa, Caenorhabditis elegans
MREVISIHVGQAGVQIGNACWELYCLEHGILPDGTSMEPDGNSGSLGTFFSDTGYGRHVPRSIFVDLEPTVVDEIRTGAYKKLFHPEQMLTGKEDAANNYARGHYTVGKEIIDTTLDRIRRLANNCEGLQGFFVFHSFGGGTGSGFTSMLMERLSAEYGKKSKLEFSIYPAPQISTSVVEPYNSILTTHTTLEHSDCSFMVDNEAIYDICRRNLRVSRPTYNNLNRIISQVVSSITASLRFDGALNVDLNEFQTNLVPYPRIHFPLVAYNPLISSAHHEFLSVDEITKSCFEASNQMVKCDPKHGKYMAVCLLYRGDVVPKDVSAAIKSIKTQRSVQFVDWCPTGFKVGLNYQPPTVIPGGDMAKVPRAVCMLSNTTAIAEAWQRLDYKFDLMYAKRAFVHWYVGEGMEEGEFSEAREDLAALEKDYEEVGADSDANDNGDDEY

SEQ ID NO: 5900 - protein, 1820 aa, Caenorhabditis elegans; identical to SEQ ID NO: 5274

SEQ ID NO: 5901 - protein, 384 aa, Caenorhabditis elegans
MSSNSSNSSNPAATDAPKKTSVEPGSEANNWHITEADEKGFKLTDMIKKLLKPVFSKAIMFDEKEIHVLLTRVFKYYTSPPNKKTAPSASASATTSMSPPKPAANALLELQAPINICGDTHGQYNDLLRIFNACGAATKTQYLFLGDYVDRGGHSLEVIMLLFSLKLAMPRKMHLLRGNHELKAINKNYGFHAELKKRFQREEVYESVYNHFNQVFSYMPLCAIVSKRILCMHGGISPHLKSLDDIRAIPLPLETAKTHPLACDLLWADPEKDAKGFEPNKIRAISNVFGKKEVDDLCKRLDIDLIVRAHQVVEYGYAFFADRRLITVFSASRYQIELCNYAAVVVVNKMLELSFVQLKPEDFEVRRDECEENAKDQTTSNVPH

SEQ ID NO: 5902 - protein, 384 aa, Caenorhabditis elegans
MSSNSPNSSNPAATDAPKKTSVEPGSEANNWHITEADEKGFKLTDMIKKLLKPVFSKAIMFDEKEIHVLLTRVFKYYTSPPNKKTAPSASASATTSMSPPKPAANALLELQAPINICGDTHGQYNDLLRIFNACGAATKTQYLFLGDYVDRGGHSLEVIMLLFSLKLAMPRKMHLLRGNHELKAINKNYGFHAELKKRFQREEVYESVYNHFNQVFSYMPLCAIVSKRILCMHGGISPHLKSLDDIRAIPLPLETAKTHPLACDLLWADPEKDAKGFEPNKIRAISNVFGKKEVDDLCKRLDIDLIVRAHQVVEYGYAFFADRRLITVFSASRYQIELCNYAAVVVVNKMLELSFVQLKPEDFEVRRDECEENAKDQTTSNVPH

SEQ ID NO: 5903 - protein, 416 aa, Caenorhabditis elegans
MAPPASTASSADPSKPTAQKLTEESDEKTLRKYFSTKVDDAQQKVADKSQNVRRLQAQRNELNTKVRMLKEELQQLHEQGSYVGEVSKAMDKKKVLVKVHPEGKYVVDVDKSIDINSLNTGARVALRADSYALHKLLPNKVDPLVSLMMVEKVPDSTYEMVGGLDKQIKEIKEVIELPVKHPELFDALGIAQPKGVLLFGPPGTGKTLLARAVAHHTECTFIRVSGSELVQKFIGEGARMVRELFVMAREHAPSIIFMDEIDSIGSSRVEGSSGGDSEVQRTMLELLNQLDGFEATKNIKVIMATNRIDILDPALLRPGRIDRKIEFPAPDEKARADILKIHSRKMNLMRGINMAKIAEQIPGASGAEVKSVCTEAGMFALRERRIHVTQEDFEMAVGKVMQKDSEKNMSIKKLWK

SEQ ID NO: 5904 - protein, 321 aa, Caenorhabditis elegans
MLEEDAAGPDQLGPNDLDRQIEIAMRCELICETQVKSICAKVREILIEEANVQVIDTPVTICGDIHGQFHDLMELFRVGGSPPNTNYLFLGDYVDRGYNSVETFILLMLLKCRYPDRITLIRGNHESRQITQVYGFYDECVRKYGSGQVWKHCTEIFDYLSLAAVIDGKLFCVHGGLSPSIATLDQIRVLDRKIEVPHEGPMCDLLWSDPEEGCSGWGISPRGAGYLFGGDAAELFCENNDFLRICRAHQLVMEGYKLHFRKRVVTVWSAPNYCYRCGNVAAIMEVTEENIDSDPVFEVFEAATVENRGEPKKQPIAQYFL

SEQ ID NO: 5905 - protein, 454 aa, Caenorhabditis elegans
MTNDILTPDDALTEPAEQKTQSIRDDELLPDKTQPSTSKSKMKTAVENLKAEIVEDDINEAENRFLVDKTQQTISISQDFGVFEDIVKDSTVSKYCDRILTWKGITVEEIKKKKDTLQGRILDKVNGRALAGELTFIMGSSGAGKTTLLNVLTGRNMDGLKIKGDVMMNGRSLSSSEMKQLSAYVQQEDVFMSSQTVSEVLHFAVKMKSPERLSTQKRASLVDQMLTTFGLKTCEHTRIGSVKEKGISRGEKKRLAFACEILTDPPILFCDEPTSGLDSFMSHQGKVAYEGSTKDVEGFLVKLGSPVPELTSVSDHFIRVLSRSIAHAVVSICGDITMSLMVAPLISVPVMVFGGFLITVDAVPVYYLPLTYVSWYHYAFEAIMIAFFKDHGDIKGCDKPVITQFECSNGLKFISDQDFKVEHFWLDFIAVGAILLFWKLFGLLAFVVRIRRTT

SEQ ID NO: 5906 - protein, 534 aa, Caenorhabditis elegans
MLKKAPCLFGSAIILGLLLAAAGVLLLIGIPIDRIVNRQVIDQDFLGYTRDENGTEVPNAMTKSWLKPLYAMQLNIWMFNVTNVDGILKRHEKPNLHEIGPFVFDEVQEKVYHRFADNDTRVFYKNQKLYHFNKNASCPTCHLDMKVTIPNIVFQKLIDAADVTIFGVRIKFAIESVLKMVSEAPYITVKVSDALFDGYEDPIIDIVCKNKILQFLCETNSLQRRVGFFYGQNGTTDGIYEVDAGVPSPSKIGHLYTWNNMTEMPEGTWDTKYARMINGTDGQLFSPMLKREDRLTIFVPQICRSIQMEYTKDVAVNGVPSWRYAPPLDLYDPALPQNRAFCNKNGMPRYFDNTTVQIENCLPAGLIDLSRCQAGNPRVYLSNPHFYNSPMELWHSVTGLSVPTASNDLTVVDIEPTAGVPTQAKRIMQINVGMVKGSLSVTENTTNVVVPVLWMNETAYFDQGTRDQLINIFNAKHYSFIGGVISLSLGLIAWLAVFVVIIVYSRQSDEEEYGRLVLEDEDEEPAQDENAVLA

SEQ ID NO: 5907 - protein, 545 aa, Caenorhabditis elegans
MSSSWSNRSQTMYSNASSLLSDLLLDYDIRLRPGFGGDALLLTMDIIIASFDSISEVDMDYTLTMYLHQYWTDERLRWSNEIPIDEMTLSGEFSQNIWVPDTFLANDKHSYLHEVTERNKMLRINVDGKVAYGMRLTSTLSCSMNLRNFPLDSQNCTVEIESYGYTTSEVLMKWNYPLAVHGVEQADVPQFTITGFHTEDSIVSTATGSYQRLSLVFQLRRSVGYFIFQTYLPCVLIVMLSWVSFWINHEATSARVALGITTVLTMTTISTGVRQSLPRISYVKSIDIYLFPTLTNQRQAPPTSKPISDARLRSLVEERAVLSADWSEFGIFILQVMCFVFVFAALLEYAAVNYSYWGRERGKGGGGNEWPVNGANKEDRESAVNVQKWVPSGLMDGVPQPQDRRVEALEEAMSTSNTAAQNNNFESTSKPKKRSSSPIPPLCRAGNTISEESESPDYPRYSTTSLKGARPHASLNHKTHHLKGRSSARAKRRMTLARMNVSMKQSISGIGRRARKVIPTIRVRDVNLIDKYSRVVFPVCFIVFK

SEQ ID NO: 5908 - protein, 499 aa, Caenorhabditis elegans
MVTVFIIPIIALIHGHHSQAVIDMKRQRLSSRSTTYNQTLIRYTTKVLDTILLNQDKNFRPVNPDNSPLQVEVDISIRSMGPVSEQNMEFSLDCYFRQKWLDRRLAFTPINPSKPEIPLASKMLKDIWIPDTYIRNGRKSYLHTLTVPNILFRVRSDGQVHVSQRLTIRSRCQMFLKKFPMDTQACPIEVGSLGYFSKDVVYKWKDVELDAKMGNTLSQYQVLSLSKSERNVSDFRFSDRNISVLNVYFKLQRQQGYYILQIYTPCTLVVVMSWVSFWINKEASPARVSLGIMTVLSMSTIGFGLRTDLPKVSHSTALDVYILTCFVFLFAAMVEYAVINYAQIVYIRKQIHDLKGLEQNTAMGQMFTAGLMGARRRDTIQVDDLTVEKEEARLKAVPWWKKLCFKDEQGNTSSEWQLEKKINFEKNSPVFYRMAVKAAIAKKTLRNGDPAEVVNKIDNFSKLAFPTLYIIFNVFYWVAYLHLIPDEIDSLPNIAGGLY

SEQ ID NO: 5909 - protein, 499 aa, Caenorhabditis elegans; identical to SEQ ID NO: 5908

SEQ ID NO: 5910 - protein, 478 aa, Caenorhabditis elegans
MHRALLNASRRVATVRSMASTVEGDAFRLSEYSSKYLGHRKAAFTEKLEIVNADDTPALPIYRVTNAVGDVIDKSQDPNFDEQTSLKMYKTMTQLNIMDRILYDSQRQGRISFYMTSFGEEGNHVGSAAALEPQDLIYGQYREAGVLLWRGYTMENFMNQCYGNADDLGKGPRKTLILLLKNRYFWRKSTYFSVFFSIFLHFDSRILQKKTVPHRKRGRQMPMHFGTKERNFVTISSPLTTQLPQAVGSAYAFKQQKDNNRIAVVYFGDGAASEGDAHAAFNFAATLKCPIIFFCRNNGYAISTPTSEQYGGDGIAGKGPAYGLHTIRVDGNDLLAVYNATKEARRVALTNRPVLIEAMTYRLGHHSTSDDSTAYRSSDEVQTWGDKDHPITRFKKYITERGWWNEEKEMEWQKEVKKRVLTEFAAAEKRKKAHYHDLFEDVYDELPLRLRRQRDELDAHVAEYKEHYPMLETLQSKP

SEQ ID NO: 5911 - protein, 635 aa, Caenorhabditis elegans
MAQSNALTTTTTGSSAPSVIPPTAPTASVKTKAPTKGPVQPQKKPTTVDNGRRAYRNQVVVENVDRQAFRGIESFLSSLGQAVGLGNIWRFPTTAYKNGGLSFLIAYVVCGILFAVPAIHMEFALGQYAAKSPPAAFRRMMPILEGVGWMTCLVGAIIGVYYMIVISWIVLYLFNIIYATKISKNFVVKPSTGFTDFNSINVPMLAAVAVCWVIAIISLIRGMKAIGKLSYYTVLLPYAIIIALMIRGLTLEGASTGLHFLFWGKPNEYGHYDFAGLYDPDVWIAALMQMCFSLSIGQGGLMNIGSYNKKTYNWYRDAYLVVLCDTLMSLLGGTAVFSTLGFLAEQRNISISNPKGFNEVVQEGHALAFIVYTEAIAQMPYPFLWYALFFVMLFLLGISTEIVIIETVCSCLADRFHYLRQHRWITVVTVSTTFFLLGLVMTSDAGFYWFDLYDEYSAGVSATIGTAIMCLTVCWCYGLDNFRADIREMWEEPESRLDKYLGPGAYVWTIVWRFVTPICCLVIMFAWIWDKKYPFKGDSKKYPPVFDAFGWFVAALPFFVVPVFAGFAIKRFKDLNIPIRGVFMVQKQHPAYDRISEKWPEWKQKIGDKLPELEPGEDDLEDGLEGSDDDLFYEY

SEQ ID NO: 5912 - protein, 635 aa, Caenorhabditis elegans; identical to SEQ ID NO: 5911

SEQ ID NO: 5913 - protein, 231 aa, Caenorhabditis elegans
MSDSEIAFEKLKISGEKEGMTETEQTTAPIYPLKRNWTWWYLNDERNKSWEDRLKKVYTFNTVSEFWALYDAIRPPSGLNALCDYNVFRDDIQPMWEVPENSNGGRWLIVIDKGKTPEMVDAIWLEILMALVGEQFGKDMESICGLVCNVRGKGSKISVWTKDCNDDETNMRIGVVLKEKLMAASKDHSKPLFDVIRYEDHESCQKKTSSVVKAKLSLHSSDAPVAEKSAV

SEQ ID NO: 5914 - protein, 441 aa, Caenorhabditis elegans
MAGKCVFIVGAKRTAFGTFGGKLKGLSATDLGVVASQAALKHANVGADAVDHVIFGNVVASSRDGIYLSRHIGLKSGVPQNVGALTVNRLCGSGFQAVVNAAQAIKLGESNIVLAGGTENMSMVPFAVRDIRFGTALGKKYEFEDMLWDSLSDPYAKLAMGQTAEKLGAQYKVTRQEADEFALRSQTLWKKAQEAGVYKNEIVGITIKGRKGEESFEIDEHPRATTAESLAKLKPVFQKDGLVNAGNASGISDGAAALVVAGEDSVKSKNLKPLARVVAYSAVGCDPTIMGIGPAPAIREVLKKSGLKIGDIDIFEVNEAFAPQALAVQRELGIPMEKLNVNGGAIALGHPLAASGARISTHIVHELHRRNVKYGIGSACIGGGQGIAILFEKIEMKVLSKKKFFSEKNQKSANTSTQSRVSDANSPPPPPPHFTRSFLGL

SEQ ID NO: 5915 - protein, 614 aa, Caenorhabditis elegans
MSIGIDLGTTFSCVAYYQNGQVNILENENGCRTTPSVLAVGEDGDLLIGQHAKDVIGKATNSLFDVKRIIGRRYDDVLLQRDMPLWPFKVEKDDNGIPYLEIHKNEKPLKFSAVTVSSLILRCLKYNAERKLGLEVKSAVITVPAYFNATQRRATEEAAEIAGLKVLRILNEPTAAAIAYSLKGQRLSRRNILIYDLGGGTFDVAAVNVDGPRITVKAKGGDTHLGGQDIDNIIMIKMLEEFKNRHGIDLKGNYRALKRIRKAAEVAKITLSASSVARIELECLHLGIDFIMRISRTDFESWIENLLMATVIHVERVIREANLKKSQINEIVLVGGSTRIPILKNIIKQSFESNTRICESIHPDEAVAYGAAIMAAVLSGAEEVQDMRLIDVIPMSIGVQCNRDYMSVLIKKGTVFPCTKRKTFINSDDFQTSINVPVYEGERVLCSHNRQLGEISLPIQPKRRGESVVDITLEVDYNGILQATALDLNTKKAITTTILYDCCTYTQPEIDEMTSQSEEDRIFDEHFKMRYKQLQKSEDMAYGYKHRLEKVKVHKYEALGSVEPGKFSNLMETVEREISWLSVFPKVSPNEYMQRRRALRLKVYPTLFINLSFY

SEQ ID NO: 5916 - protein, 614 aa, Caenorhabditis elegans; identical to SEQ ID NO: 5915

SEQ ID NO: 5917 - protein, 1116 aa, Caenorhabditis elegans
MAEKPKIRRAIVSIEGMTCHACVNNIQDTVGSKDGIVKIVVSLEQKQGTVDYNSEKWNGESVAESIDDMGFDCKLITDQEIAAVEPQKASTTKLSISPLKTVDLSDGKVELQLNGVKYSKEGSSDHLEKCTFAVEGMTCASCVQYIERNISKIEGVHSIVVALIAAKAEVIYDGRVTSSDAIREHMTGELGYKATLLDSMGANPNYSKIRLIIGNLSTESDANRIESHVLSKSGIDSCNVSIATSMALVEFSPQVIGPRDIINVVESLGFTADLATRDDQMKRLDHSDDVKKWRNTFFIALIFGVPVMIIMIIFHWILRTPMHPDKQTPIFTPALSLDNFLLLCLCTPVQIFGGRYFYVASWKAIKHGNANMDVLIMLSTTIAYTYSIVVLLLAIIFKWPSSPMTFFDVPPMLIVFIALGRMLEHKAKGKTSEALSKLMSLQAKEATLVTMDSEGRLTSEKGINIELVQRNDLIKVVPGAKVPVDGVVVDGKSSVDESFITGESMPVVKKPGSTVIGGSVNQKGVLIVKATHVGNDSTLSQIVRLVEEAQTNRAPIQQLADKIAGYFVPFVIVLSLFTLGVWIYIEYNSARNANLPPGLRFEEALKIAFEAAITVLAIACPCSLGLATPTAVMVGTGVGAANGILIKGGEPLESVHKVTTIVFDKTGTITEGRPRVVQIASFVNPSTMSLKLITFLSGATEALSEHPIGNAVAAFAKQLLNEPTWPNTSRFHVSAGHGVTCRIDSIRQSFSSLALSGSTCEIPRLPDGQTITIPGTEVNLLQVSSKEVSQPNPDTANIVIGTERMMERHGIPVSEVVKMTLSEEQRKGHISVICAINAEVVAVISIADQVKKEASLAIYTLREMGLRVVLLTGDNSKTAESTAKQVGIDEVFAEVLPNQKQQKIKQLKGYKNKVAMVGDGVNDSPALAEANVGIAIAAGSDVAIESAGIVLVRNDLVDVVGAIKLSKMTTRRIRLNFLFAIIYNAIGIPIAAGVFRPFGFMLQPWMAAAAMALSSVSVVSSSLLLKNFRKPTIANLYTTSFKRHQKFLESGSFQVQVHRGLDDSAVFRGAASSKLSILSSKVGSLLGSTTSIVSSGSSKKQRLLDNVGSDLEDLIV

SEQ ID NO: 5918 - protein, 1116 aa, Caenorhabditis elegans; identical to SEQ ID NO: 5917

SEQ ID NO: 5919 - protein, 300 aa, Caenorhabditis elegans
MSKEKSFDTKKFLIDLASGGTAAAVSKTAVAPIERVKLLLQVQDASKAIAVDKRYKGIMDVLIRVPKEQGVAALWRGNLANVIRYFPTQAMNFAFKDTYKAIFLEGLDKKKDFWKFFAGNLASGGAAGATSLCFVYPLDFARTRLAADIGKANDREFKGLADCLIKIVKSDGPIGLYRGFFVSVQGIIIYRAAYFGMFDTAKMVFASDGQKLNFFAAWGIAQVVTVGSGILSYPWDTVRRRMMMQSGRKDILYKNTLDCAKKIIQNEGMSAMFKGALSNVFRGTGGALVLAIYDEIQKFL

SEQ ID NO: 5920 - protein, 292 aa, Caenorhabditis elegans
MLNYDKMEKIGEGTYGTVFKARNKNSGEIVALKRVRLDDDDEGVPSSALREICILRELKHRNVVRLYDVVHSENKLTLVFEYCDQDLKKFFDSLNGYMDAQTARSLMLQLLRGLSFCHAHHVLHRDLKPQNLLINTNGTLKLADFGLARAFGVPVRCFSAEVVTLWYRPPDVLFGAKLYNTSIDMWSAGCIFAEISNAGRPLFPGADVDDQLKRIFKQLGSPSEDNWPSITQLPDYKPYPIYHPTLTWSQIVPNLNSRGRDLLQKLLVCNPAGRIDADAALRHAYFADTSDV

SEQ ID NO: 5921 - protein, 401 aa, Caenorhabditis elegans
MRLIILVISILISNAGSLLRSLEDDSNECMFNCPKRARNVSVPHTEKTCMGDDAIIAQILDGYNKLDLPGGGHVVVSIEIWVQEVSKIIEITSEFELDIYVTERWTDPSLAYSHLNPCKSNMSVDGATILNKIWNPHACFVNSKLANIHESPFKNIFLQIYSNGSIWHNYRIKLTGPCSSTLRTFPIDQQRCMLFYESFTHNTDQVKMEWITTVPPITILKGNITLPDYVLVDFSSSSELRLYPPGIFNELIATFTFQRLYGFYILQVYVPAYISVFISWVSFTLGAEQIPSRTTVGVNSLLALTFQFGAVVNNLPKTSDVKAIDVWILSSMAFIFASLIELAVVGYLSRDGQHGSIKCRCSWLCMNCKDWTALKIDQMSSIVFPVSFLAFNIWYWFIFLG

SEQ ID NO: 5922 - protein, 687 aa, Caenorhabditis elegans
MTNETALTVAAAILGSTYFLYCKLLKTAKLSLPNGLSVDKQAVEVKGQPGVWKSALMENESEDVLTRFYPEVATLHDVFVKGKTESNGGPCVGTRSSGDADYEFLTYDDVHEQAKNLSMTLVHEFGLTPANTTNIGIYARNSPQWLVSAVACVEQSMVVVPLYDTLGAEAATFIISQAEISVVIVDSFKKAESLIKNRENMPTLKNIIVIDSADELKDGTAIIDTIRVESLTNALNLGSRYPFTNNLPKPDDNYIICYTSGTTGTPKGVMLTHSNIVANISGFLKILFAFQPSMIDATQVHISYLPLSHMMEQLTHWTLLGFGSKIGYFRGSIQGLTDDIKTLKPTVFPVVPRLLNRLYDAITSKVQQQGFMAKLVYNFAFARKLSLVKAGKVGRDTIWDRLVFNKIQQQIGGKVDLMVTGSAPISSTVLETCRVTLGTTIVEGYGQTECTALATFTWMGDPSTGHCGAPAPCALVKLGDVPDLNYFAKDGKGEIRIKGPCVTKGYYKDPERTAELFDEEGFLQTGDIGEMLPNGTIRIIDRKKHIFKLAQGEYVAPEKIEQVYIRTPVVQQVYVDGDSLERWLIAVVVPEPDVLKEWNDKQGSGSRKIEEICNDEKAKEFVLSELHAIGKANKLNSIEQVKKVILTSDTFTVENGLLTPTLKAKRPQLRLKYKDGMAKVYKQFPNL

SEQ ID NO: 5923 - protein, 365 aa, Caenorhabditis elegans
MASYSQFLTKAQEDELRSIANAIVTPGKGILAADESTGSMDKRLNSIGLENTEENRRKYRQLLFTAGADLNKYISGVIMFHETFYQKTDDGKPFTALLQEQGIIPGIKVDKGVVPMAGTIGEGTTQGLDDLNARCAQYKKDGAQFAKWRCVHKISSTTPSVTALKEIASNLARYASICQQNGLVPIVEPEILPDGEHCLARGQKITETVLSYVYHALNEHHVFLEGTLLKPNMVTSGQSFTGEKPSNADIGLATVTALQRGVPSAVPGVVFLSGGQSEEDATLNLNAINQVSGKKPWALTFSYGRALQASCLAKWAGKDENIAAAQEVLLHRAQVNSLASVGKYTGDASADAAASQSLFVANHSY

SEQ ID NO: 5924 - protein, 309 aa, Caenorhabditis elegans
MNFETRMPLGTAVIDQFLGLRPHPTKIQATYVWIDGTGENLRSKTRTFDKLPKRIEDYPIWNYDGSSTGQAKGRDSDRYLRPVAAYPDPFLGGGNKLVMCDTLDHQMQPTATSHRQACAEIMNEIRDTRPWFGMEQEYLIVDRDEHSLGWPKHGFPAPQGKYYCSVGADRGIAAIEAAMDGLKRTHLDAMKVYDPHGGEDNLRRLTGRHETSSADKFSWGVANRGCSIRIPRQVAAERKGYLEDRRPSSNCDPYQLFNCYSDVDSDSHLYDYDDSECTGWAKSMVTRLQLYNFTCGESYYINVYKFCSP

SEQ ID NO: 5925 - protein, 290 aa, Caenorhabditis elegans
MTHLNFETRMPLGTAVIDQFLGLRPHPTKIQATYVWIDGTGENLRSKTRTFDKLPKRIEDYPIWNYDGSSTGQAKGRDSDRYLRPVAAYPDPFLGGGNKLVMCDTLDHQMQPTATSHRQACAEIMNEIRDTRPWFGMEQEYLIVDRDEHSLGWPKHGFPAPQGKYYCSVGADRAFGREVVETHYRACLHAGLNIFGTNAEVTPGQWEFQIGTCEGIDMGDQLWMSRYILHRVAEQFGVCVSLDPKPKVTMGDWNGARCHTNFSTLKCVLQAVSPRLKLPWTGSSVLIWMR

SEQ ID NO: 5926 - protein, 290 aa, Caenorhabditis elegans; identical to SEQ ID NO: 5925

SEQ ID NO: 5927 - protein, 375 aa, Caenorhabditis elegans
MEEEIAALVVDNGSGMCKAGFAGDDAPRAVFPSIVGRPRHQGVMVGMGQKDSYVGDEAQSKRGILTLKYPIEHGIVTNWDDMEKIWHHTFYNELRIAPEEHPVLLTEAPLNPKSNREKMTQIMFETFNTPAMYVNIQAVLSLYASGRTTGIVLDTGDGVTHTVPIYEGYALPHAIQRLDLAGRDLTDYMMKILTERGYTFTTTAEREIVRDIKEKLCYVAHDFESELAAAASSSSLEKSYELPDGQVITIGNERFRCPEVLFQPAFIGMEGAGIHETTYQSIMKCDVDIRKDLYANTVLSGGTSMFPGIADRMQKEIQHLAPSTMKIKIIAPPERKYSVWIGGSILASLSTFQQMWISKQEYDESGPSIVHRKCF

SEQ ID NO: 5928 - protein, 142 aa, Caenorhabditis elegans
MDDLADCREVFAYFDSKGDERISVQQVGDVLRALGQNPTEAEIHKCVGSFDREARLSFEDFVPIFQSVSKNREKHTVEEFVEGLSHFDKEGNGMINVAELRHLLTTLGERLSDEDVDQLLSGHNDSHGNVNISDFVRAVMNS

SEQ ID NO: 5929 - protein, 745 aa, Caenorhabditis elegans
MASSTKVSLRRPPRPQVMYSLKPKVVEFDKVWVQLRPSIIDIINLRPITNVQWHHKFSDVYDICVSIPTPLSERLYNEVKACIQEHVRQKRQDIVDVDPDLLLQEYHKMWRVFHEGAIFIHRLFGYLNKQFVKQKRCTDLDNFAQYAAFLQIPDVKEIGCLALEIWKEDLVKTILPQLVKLLLIAIDNDRKGNFPHIANEVSGVINSFVKMEETDFDVVPAEGARYKARESTTAFYQESFEKPLLTDTEQYYSALAQKMLTDLSCSEYMEQVIVLLEQEEMRAKKYLHESSVEKVITLCQKVMIKAHKDKLHAVCHDLITNEENKDLRNMYRLLKPIQAGLSVMVKEFEEYVKKKGLEAVSRLTGENVPQQFVENVLRVYNKFNDMKTAVFMDDGEFSSGLDKALQGVVNSKEPGQSVPKASERLARYTDGLLKKSTKGLSETDLEAKLDSAIVIFRYIEDKDIFQKFYSKMLANRLIASTSISMDAEELMINKLKQACGYEFTSSWPLNAPQLSTNSNNQTAQDVANFHLPRILQPVIQEFEKFYTGKHNGRKLTWLFNMSQGDVRLTYLDKQYVAQMYVYQMAALLCFERRDAILVKDIGEEIGVSGDYLLKTIRTILDVTLLTCDDQNLTADSLVRLNMSMTSKRMKFRLQAPQVNKAVEKEQEAVANTVSQDRKYYMECAIVRIMKTRKVLKHNALVTEIMDQTKGRFSPDVPFIKKSIEDLIEKMYIQRTDQNDEYQYLA

SEQ ID NO: 5930 - protein, 318 aa, Caenorhabditis elegans
MNQLQGVQKNAEYYPAERGKLAAPFLETGTIIGLKRPFQVEKMVGGGGFGQIFRAVDMETKLVVAVKVEPKSVESGRIVLELHILVELAHSPHIPKVHYSGEIGGYNFIVMQLLGSNITDLRKFQKGRCFSAETTARVGIQCLEGLKQIHELGYIHRDIKPSNICVGIGEHKRVLYIVDFGMARQIRFPSGAFRPERPYASFRGTTRYVSLAAHERKEQGFADDIWCLFFSLLELAEGLPWKNVVDQDQVYHAKQLLLRNFQSRKMGQNFGTFPRALELIKRTETPNYENFIVILKSCSSRVNEWEEFEWDDHDEQYR

SEQ ID NO: 5931 - protein, 643 aa, Caenorhabditis elegans
MTLNYHAHGKEIEASYRRASDDSDGDKWVIFDYEGNSNTLRVKEEGTGGLEEFADSFSSGKLQFGVISVRLSSDVFPKIVLVHWQGEGVPTLRLASTTPHAEEFRRFLKTVHIVLHARSEIDIEPDAIRKEVRKLPAANANAIVESTYSMPEKVNSVYQPTNAHSELSSEARENFWSTTNQEEKRRQADEKVAHAKQQKQYEADRDRTAAAIHTKAEDFQPEKVNSVYKPTKPHVELKTVKREEFWSKMNEEEKLRQEEEKTAREQAHKQFEADRQRMASEIHSKTENYQPDKVTSVYKPTKPHVEISSSAREEFWSKMNEEEQRRQAEEKEAQAQKQKEFETDRKRIADDLHGKAQISDKPVPSSVNPAPAPAPTPSAGLVGSRKELFSSKPSGPVLPKPQVNGSPKKWPPVGTTSPPREPVNRLTEPDEPSTYTPKPIAYEPEPMVYKPEAMKPAVSYDAYEEPPAEPAPPTFLAPTPVIAPPPPEPTPAPSHYASQYDAPPVHESFEPAVPPVSAPSHYASQYDAPPEPIDSHSSSSQLPAHIASQYDMPPVMPEEPVFAPKSSPIKVAAPPIDQYDFPPAVAEQNAMALWDYQAADDTEISFDPDDIITDIDQVDSGWWKGRAPSGRVGLFPANYVKLI

SEQ ID NO: 5932 - protein, 509 aa, Caenorhabditis elegans
MGPQPVHRLHSLDHKPDESSEEWKTSTKLEALGSMEGELAHLLSTCKPETLNHNKTELSGFRNLFARFLRAKPTVDWSKIEPLPEGAIRPYKSLGHVVDKELIASQLRKLVVVKLNGGLGTSMGCKGPKSVISVRNDLTFLDLTMQQIQTLNKTYGVDVPLVLMNSFNTNEDTQKVLKKYANVKVSVHTFSQSQYPRINRETLLPIVKSLEADDNECWYPPGHGNFYEAFHNSGLLDKFLADGKEYCFLSNIDNMGATVDLSILNFVLNPSPDQTAPEFLMEVTDKTRADVKGGTLIQYEGRLMLLEIAQVPKDYVDEFKSISKFRIFNTNNLWAKLDAMRKIVVENKLEMEVIVNPKHLDRGLDVIQLETAAGAAIKSFSGAVGVNVPRSRFLPVKKTSDLLLLMSNLYDIDNGSLTLSHQRSFPTTPLVKLGSSFDKVKDYLGRFNGIPDLLELDHLTVSGDVWFGKDVSLKGTVIIIANHGDRIDIPPGSILENKIVSGNLRILEH

SEQ ID NO: 5933 - protein, 511 aa, Caenorhabditis elegans
MAQRHVSVGCFSTFSEAEAKSSEEWKTSTKLEALGSMEGELAHLLSTCKPETLNHNKTELSGFRNLFARFLRAKPTVDWSKIEPLPEGAIRPYKSLGHVVDKELIASQLRKLVVVKLNGGLGTSMGCKGPKSVISVRNDLTFLDLTMQQIQTLNKTYGVDVPLVLMNSFNTNEDTQKVLKKYANVKVSVHTFSQSQYPRINRETLLPIVKSLEADDNECWYPPGHGNFYEAFHNSGLLDKFLADGKEYCFLSNIDNMGATVDLSILNFVLNPSPDQTAPEFLMEVTDKTRADVKGGTLIQYEGRLMLLEIAQVPKDYVDEFKSISKFRIFNTNNLWAKLDAMRKIVVENKLEMEVIVNPKHLDRGLDVIQLETAAGAAIKSFSGAVGVNVPRSRFLPVKKTSDLLLLMSNLYDIDNGSLTLSHQRSFPTTPLVKLGSSFDKVKDYLGRFNGIPDLLELDHLTVSGDVWFGKDVSLKGTVIIIANHGDRIDIPPGSILENKIVSGNLRILEH

SEQ ID NO: 5934 - protein, 522 aa, Caenorhabditis elegans
MNVSFSTSSLSVSNSRTRLISFRETEHGDQKSSEEWKTSTKLEALGSMEGELAHLLSTCKPETLNHNKTELSGFRNLFARFLRAKPTVDWSKIEPLPEGAIRPYKSLGHVVDKELIASQLRKLVVVKLNGGLGTSMGCKGPKSVISVRNDLTFLDLTMQQIQTLNKTYGVDVPLVLMNSFNTNEDTQKVLKKYANVKVSVHTFSQSQYPRINRETLLPIVKSLEADDNECWYPPGHGNFYEAFHNSGLLDKFLADGKEYCFLSNIDNMGATVDLSILNFVLNPSPDQTAPEFLMEVTDKTRADVKGGTLIQYEGRLMLLEIAQVPKDYVDEFKSISKFRIFNTNNLWAKLDAMRKIVVENKLEMEVIVNPKHLDRGLDVIQLETAAGAAIKSFSGAVGVNVPRSRFLPVKKTSDLLLLMSNLYDIDNGSLTLSHQRSFPTTPLVKLGSSFDKVKDYLGRFNGIPDLLELDHLTVSGDVWFGKDVSLKGTVIIIANHGDRIDIPPGSILENKIVSGNLRILEH

SEQ ID NO: 5935 - protein, 704 aa, Caenorhabditis elegans
MAQAENACRLKLLRADVPVDLLPAGCSATDLQPAVNVKEKIEVNGESRLVQKKKTLYPEWEKCWDTAVAEGRILQIVLMFNQTPVVEATMRLEDIISKCKSDAITHIWINTKPNGRILAQTRHLKNAPDDDHPVEDIMTSRSNSGPGIQRRRGAIKHARVHEIRGHQFVATFFRQPHFCSLCSDFMWGLNKQGYQCQLCSAAVHKKCHEKVIMQCPGSAKNTKETMALKERFKVDIPHRFKTYNFKSPTFCDHCGSMLYGLFKQGLRCEVCNVACHHKCERLMSNLCGVNQKQLSEMYHEIKRGTHATASCPPNIANLHLNGETSKNNGSLPNKLKNLFKSHQYSVEEQKETDEYMDNIWGGGDGPVKKFALPHFNLLKVLGKGSFGKVMLVELKGKNEFYAMKCLKKDVILEDDDTECTYIERRVLILASQCPFLCQLFCSFQTNEYLFFVMEYLNGGDLMHHIQQIKKFDEARTRFYACEIVVALQFLHTNNIIYRDLKLDNVLLDCDGHIKLADFGMAKTEMNRENGMASTFCGTPDYISPEIIKGQLYNEAVDFWSFGVLMYEMLVGQSPFHGEGEDELFDSILNERPYFPKTISKEAAKCLSALFDRNPNTRLGMPECPDGPIRQHCFFRGVDWKRFENRQVPPPFKPNIKSNSDASNFDDDFTNEKAALTPVHDKNLLASIDPEAFLNFSYTNPHFSK

SEQ ID NO: 5936 - protein, 597 aa, Caenorhabditis elegans
MPEWFFLIPQLQFHNKSKKVSDDDHPVEDIMTSRSNSGPGIQRRRGAIKHARVHEIRGHQFVATFFRQPHFCSLCSDFMWGLNKQGYQCQLCSAAVHKKCHEKVIMQCPGSAKNTKETMALKERFKVDIPHRFKTYNFKSPTFCDHCGSMLYGLFKQGLRCEVCNVACHHKCERLMSNLCGVNQKQLSEMYHEIKRGTHATASCPPNIANLHLNGETSKNNGSLPNKLKNLFKSHQYSVEEQKETDEYMDNIWGGGDGPVKKFALPHFNLLKVLGKGSFGKVMLVELKGKNEFYAMKCLKKDVILEDDDTECTYIERRVLILASQCPFLCQLFCSFQTNEYLFFVMEYLNGGDLMHHIQQIKKFDEARTRFYACEIVVALQFLHTNNIIYRDLKLDNVLLDCDGHIKLADFGMAKTEMNRENGMASTFCGTPDYISPEIIKGQLYNEAVDFWSFGVLMYEMLVGQSPFHGEGEDELFDSILNERPYFPKTISKEAAKCLSALFDRNPNTRLGMPECPDGPIRQHCFFRGVDWKRFENRQVPPPFKPNIKSNSDASNFDDDFTNEKAALTPVHDKNLLASIDPEAFLNFSYTNPHFSK

SEQ ID NO: 5937 - protein, 567 aa, Caenorhabditis elegans
MTSRSNSGPGIQRRRGAIKHARVHEIRGHQFVATFFRQPHFCSLCSDFMWGLNKQGYQCQLCSAAVHKKCHEKVIMQCPGSAKNTKETMALKERFKVDIPHRFKTYNFKSPTFCDHCGSMLYGLFKQGLRCEVCNVACHHKCERLMSNLCGVNQKQLSEMYHEIKRGTHATASCPPNIANLHLNGETSKNNGSLPNKLKNLFKSHQYSVEEQKETDEYMDNIWGGGDGPVKKFALPHFNLLKVLGKGSFGKVMLVELKGKNEFYAMKCLKKDVILEDDDTECTYIERRVLILASQCPFLCQLFCSFQTNEYLFFVMEYLNGGDLMHHIQQIKKFDEARTRFYACEIVVALQFLHTNNIIYRDLKLDNVLLDCDGHIKLADFGMAKTEMNRENGMASTFCGTPDYISPEIIKGQLYNEAVDFWSFGVLMYEMLVGQSPFHGEGEDELFDSILNERPYFPKTISKEAAKCLSALFDRNPNTRLGMPECPDGPIRQHCFFRGVDWKRFENRQVPPPFKPNIKSNSDASNFDDDFTNEKAALTPVHDKNLLASIDPEAFLNFSYTNPHFSK

SEQ ID NO: 5938 - protein, 328 aa, Caenorhabditis elegans
MSDSDIPSSTLYKDNVDWKDITPIYPSKEEEVAVKIAVTEDFTDAFAYFRAILIKNEKSDRVMALLEDCIRLNPANYTVWQYRRVCLTELGWDLKKEMRYLSDIIQESPKNYQVWHHRRFIVETIGESAVNDELHFCSEVIRDENKNYHAWQHRQWVVRTFKVPLEKELTFALHMLLLDNRNNSAYNYRYFLMTLYDKTEDASQLDIEINLAKKFIENIPNNESAWNYLAGLLITNGVTSNSDVVSFVEDLYETTPEEKRSPFLLAFIADMMLENIENQKSAEESAGRAKKLYKDLQSIDPVRVNYYRHQSLLAQTMLIKAQTKVTAK

SEQ ID NO: 5939 - protein, 1311 aa, Caenorhabditis elegans
MPPKIHPSLSTGYFVSLDNLPPKNLCHPKSLSSRNEGRMFIISNNHVLQVKSQSGQCRIVLRSAAQMTPKASPIAQKLKIIPKFEKSEYQFQVVENREPTVLGEVKVISDGPVTYEILGENGEKFQISNDGEIQNLEPIDRETYEKFELIVKATDLNGSSGKSQLIIHVKDENDNSPIFDKEHYFITVDEGKSEKLKITATDADSGKNGQIVYSIDQKIDNLPIDISPDGMLFIGAIDRENMGNSNEVNLTVTASDSGEPKRSASATVTIRVKQRYSTSITHLQDINDNSPVFSNSRYSIPLDANISPGGIIGRLEATDADSTSPNNYVTYTSGDPKFTVSDSGEILFTGPGTLEKSASLEFNVTAQDGGDPMNSANALVVINEHRSMKSIENELTTQINSNDTGGEKSEIKWLNAGMPGYTYEIIRASADGFSDSEVATWISIDSKSGRIYTLKKVDPSRVKQIKLHISMRKGKREVPVELIINVMDTDDVTPIYSTPTRKLSVTESATLGTTVVDMPVEGIKEQNEIKYSLKITSGPRGKLQIDRYGTIKIIKSLDFETEQIIKGIVEGMVVKNGKAAKSSFILTILDANDNRPIFKNSSNFAVSLLESSVLGTVLDLPYPLATDRDSSKFSTLKYSMTGDEGYFKIDESNSTIRLVAPLDFETQRVHSLSIKCVDNQGREPHHEVFASVTVTVIDVNDNAPVIHNTDLTHLSIEEDAQVGQVVTVLVISDSDEGGVQKTEIDVNSTLFRADSDKKLVVIASLKGHAGQRICSTVTATDVGGLRATSPYCVTVYPAKNTHHNPLVITPKQNSIHYFDENIVYDELLKVKVLEEDGDIGNVTFRLDEMFKKDWQMFTIGEINGSLHARQAFDFEKKTVHEIKILACRINNCTSTHLFISVNDRNDNCPMFPKQDVRLTVLENEKGKRQVGRIPAALDSDFHSDNTKVCYTTDTPLFFFSDPTLPILFTNSSFDREHKKQHQISITAYDCHLSCRDPHKPINGTIVALIDVLDINDNFPKFSEKIYTSTVVQGHVTTGSHILTVQATDLDEEPEGLKYSIRGFVRSPSHSFVAAESPISIDKSTGELSATEILKDSSYSFTVVVTDGAGHEDTASVVISVVTYAQQTELVFDAPFELIMKNEKKIAENLSNATGLQTIVDKCRQNANFTLMLVHFMDINGQFVNVDRAVNLLMSSSAESRRELRSVYGLREAFPPVPIPSKVPQYILIAVLLFFVISILSMCIWCRQRNNYERKLRHISAQASTVHTVTLGRGGKQTCNPGYGEIPIISRHHHPPPAPPPPTSADLQSTEL

SEQ ID NO: 5940 - protein, 412 aa, Caenorhabditis elegans
MHCGSGSQVHCLVVIPLKKHNKMEVDLPVHNEYDASRFHQVTIRDPIAGADSTFTIPTRYVNLSFLNAGAQGTVVMADDLVTTQRVAIKKMQQPFVMTMSAKRAYREFILLTTIKHPNIIRLLNAFTPDTSLSTFREVYLVMELMTHNLHEVIHRLRLDHKTLSFFVYQSLCAIKHLHNSGVIHRDLKPSNIVVNDRCVLKVLDFGLARKKNVDTSMRMSDYVVTRYYRAPEVILGLPYSEKVDIWSVGCIFAEMINHTVLFPGKDRIDQWTKIYSVLGTPDDHFISQLGQSAAMYVRSLPRHQARAFSEIVPDTNFLPETENPRVHLTPHVARDLLFNMLKINPEERYSVEDALNHPYVKLWFKDDEVNAPASENRYDQEIDFADKTLIEWKELIFNEVQRYQADHDIFTG

SEQ ID NO: 5941 - protein, 329 aa, Caenorhabditis elegans
MGCFHSTGSEAKKRSKLIDEQLRHDHERCVGEIKLLLLGAGESGKSTIVRQMRILHETGFNKQEQMAYRPVVFSNMVQSMLAILKAMQPLNISFTDAAREEDARMFISHFLHVNNAELSEAFSLELSDLMKQLWMDEGVKKCVKRAHEYQLNDSAEYYFNALDRISSSSYLPTQDDILRARVKSTGIVETTFMYKDLCFKMFDVGGQRSERKKWIHCFDSVTAVIFCVALSEYDLRLAEDQTMNRMHESMQLFDSIVNNCWFTETSIILFLNKMDIFEERIRYTPLTVCFPEYQGGMTITETSTFIQSRFEILNKRQTPAQKASCKALI

SEQ ID NO: 5942 - protein, 474 aa, Caenorhabditis elegans
MKLTGFLKQNVRVRFAPSPTGHLHIGGLRTAFFNYLFAKKYGGDFILRIEDTDRTRFIYSSLNFYNLLPDEGPREGGKFGPYEQSKRLEIYRNAAYRLIDSGHAYRCFCSENRLDLLRKTAEKRGEIPKYDRKCANLSSRDAVKMEQNGEKFVIRFKLDKQNVQFHDEVFGSVNQFIDESDPVLLKSDGFPTYHLANVIDDRKMEISHVIRGMEWLSSTGKHTILYKAFNWTPPKFVHLSLIMRSATKKLSKRDKDAFVSYYSEQLGALPEAVLNLMIRNGAGIRNFDAEHFYSLDEMIEQFDLSLLGRRNLLLDSDVLQKYSRMAFQKSDFKELYPRIIDILNKKSNYSTSREDIQKIVTFLKAKEENFGFLSSLSTEFSWFFTRPQSSQLLKESHPNVDLRNILNSLLEIEVFNSESLEYLAKNHQLNLAKAMGIVRISLIGSKKGPPISELVEFFGMTECHRRIRIMQELL

SEQ ID NO: 5943 - protein, 1219 aa, Caenorhabditis elegans
MISVSQPPPDYGRTVWITDATDGFRAARIIDLSATGFTLRLLDNTGDTVTRVFEDVLACEDDSRRHVEDNCQLMHLNEATLLNNIRLRYQNGKIYSYVANILISINPYQTIDGFYSLQKIKEYRGKSLGQKEPHIFAIADKSYREMIRHRKSQSIIVSGESGAGKTESQKAVLRYLCENWGSGAGEIQKRLLESTLFLVLKTIKIIPLKFSANPILEAFGNAKTLRNNNSSRFGKFVQIHFADTGNVAGGYVSHYLLETSRICRQAAGERNYHIFYQLIAGSSPELFKFLALGQPNQFNYLKRGFIGFFTHPSSGTTSKIPKNRLSDPKFTQDSMVDDFSDFQRLEYALKLTGLSEQEIHFIWTTIAAILHLGNVEFEESLDDSRGGCKVFNGSEQDLIQAARLLGLETMELKMGLCARIMQTTKGGARGTLIRVPLKPHEACSGRDALSKAIYSKLFDWLVSRINDSIPFEKSTNFVGVLDVAGFEFYAKNSFEQFCINFCNEKLQNFFNQRILREEQELYEKEGLNVRKIEFIDNQDCIELFELKGNGLFDLLDEEAKFPTSNYKSFTKRAHEENRKHFRLDTPRKSKVKSHRELRDDEGLLIRHYAGSVCYETKHFVEKNDDLLHNSLQILIEQSTIRLLVSLFGSTAYPTKSKLKALSVGAKFKNQLSTLLIKLESTGTHFVRCIKPNNQMIPFEFDGSAILSQLQCAGMTSVLKLMQDGFPSRTGFGDLYACYQKKLPPKLSKLDPRMFCKCLFRALGLDQHDFQFGLTKVFFRAGKFAEFDQMMKQDPETMTSLIQKVNEWLVGARWKQSQYAVWSVIKLKNKIAWRSAQVTRLQSIARGYLTRQRFSRQIALYRKSVALLKNSKEIEKILFRLNEHSRAKYTSSAHSTIRDLEKLVSHIKLTTSANDHFEKAENAYEHYVKRVDSMIADLKKQQKSDELAEIERKRRESEEKERLEIEAKKEAERQREIKRKLEEQQQNAQKEHENYLISEIHKAAEETEKKRQNEEKEKLDKMVSNRLAEADGVALISSKMEIEPSSGSATFRDGKYDVGGCSFAYLRDTINTSMDINLLKACEEEFRRRLRIYNEWKSRNAPVQDRPPARAALSTVCEELSIMRSIATPSAPQIQRYFKCEFKENNQKDQVSMWFVHFSGQQIQRQLTFTSSRPPQTLIAGRDDAQMCTLALQETLLVGKRGAEISEDEFESHWKLGCLN

SEQ ID NO: 5944 - protein, 550 aa, Caenorhabditis elegans
MNMFNRKAKQEVTKKPEASNGSKNSKSTFVNSKSPNQKRREVKKSDSDTESSHKNTRRTKPVPVPAASSNSKGSNEKHKRKSVQQVVKKVVNHIPFSPSKQPKSTSTPPVSEGNRKRLAMADVSINQLESEMDSFVKKIEPNERRATQYIHSNSLSRSNEAVPPGNVKTSQQKADHHLIRTTRSLIGLDGETEAVYSKATKASPDKGKLTADSPSSRRTSKSLEENSSETTNDSISLADDEETREAYRKLFKDFAMSSQKMTLDDFKQEFSNLPGDPPSDLCTVFNHPVNNKKNRYSNIPCLDISRVQLKFKMPNKNSTDYIHANYIRSPFLKRGYILTQGPKKETRADFWRMIWQENTTAIVMLCQFLETNREKCAEYFPRNAHCCLQFDKFSVNYEDSTVNKSLVTTRLNLSYEGETRLITHWLWKEWPDWQVPESSEVMLKILRKIRARSTPPVIHCSAGVGRSGTLMAVEIALQSIHTHFTLPDIKQIVSHLRVTGRAASVQTLQQYMLIWKVLLDFGVAYKQITEELAEKFNSTYRRSLRSINGT

SEQ ID NO: 5945 - protein, 726 aa, Caenorhabditis elegans
MSKYEVLQGFYAVHDELGSGGFGKVRLATHLLTNQKVAIKIIDKKQLGHDLPRVQTEMDALRNLSHQNICRLYHYIETEDKFFIVMEYCSGGEMFDYIVRKERLEESEARHFFRQLVSAIAFVHSQGYAHRDLKPENLLLTEDLHLKLIDFGLCAKTEKGRIDKHNLDTCCGSPAYAAPELIQGLQYKGNEADVWSMGILLYTLLVGALPFEDDNMQIMYKKIQSGCFYEPEFLSPLSKQLLRAMLQVVPERRISVKKLLEHDWLNHKYTQPVKWNTIYDKNFIDRDVARVMSKYYGFESTDKMIEKIKEWNFDYMTSTYYALLHRKRNGMEIILPMVRNSTNTAPPNVQNILCSPTIHASLENNLDKSGLEDDDSDPSSISSSSDISARLKKNCVVSDESSSSRFVKPMSPAAEKDKKMSYVNAMLTMPSQFTGRSPLRIPESPMSVRSSDSASLGSAATPSRGGVKDNDKENASTGKNYRMGASTCKSRGPLKITGVGKAENVTIKTQYLTLKISRNENYKEGTMKSVYTTPNTRPTLRGLFSPGNAEHKKRQRARSSDRASIGMPPGSPVSIGSAHSANNADGRTPRSRIKTNRLPQRVFTSLERKKEKLITLLTPRKMQRDSPQVLKDVKNMVNVSMTASQDPEEVRNLLKKVFDDERMRYELNGWKFLATQETVHGWMTVELEIVRLQMFDKVGIRRKRLKGDAFMYKKVCEKILQMAKIE

SEQ ID NO: 5946 - protein, 531 aa, Caenorhabditis elegans
MLLGLLVLSLAFQGTLAVTECEECKSIVDLLQFEWGEKKTEECVMEIAVFICETFHIEDNDVCNFIISDFSDEFMYVIKQILVTPHQLCGLLMKNDCGDFVDPLATIWNMTIPGNQPPFVPKQVVPPGNPTLRALHLTDLHVDMFYTVGLEADCGTPQCCRPQDMNVEIVENGDVKQPAGPWGSVGSCDTPYWLLTNMLQNIASTAGKLDYIMVSGDLVSHTVWAYTPETHSFMVKNLSDTIRSYFPKTPVYFAVGNHEGVPVDNIAPHFTPKKYHMDWLYKAMSNAWQGWIPADQEKSLEYNGCYMKKIYDGLRMISLNNVYGDRINFWLYINQTDPDGTLQWLINQLQDAENVGDKVHIVAHIPGSDGEALEGYALNYYKIINRLVSKVRREQVIDYEEWFFNLTSNNANPTNVKWEVLYQSANMEYGLKGQIPTEYNQMIERMKTDDSLFNKYYENHNRRSIYDGRAPCNDQQCRNGYLCDARQFHQTQQLCTDLEGGIQKPEPKKNKYSARFATSNERRRGKEECKI

SEQ ID NO: 5947 - protein, 507 aa, Caenorhabditis elegans
MRYSRMKESQLLVFTLIAVGIGFASGILLRQFDLSDNARNLVGFPGEIFMQVLKLMVLPLIFSSLISSLGQMDASRSGKMSFIAIAYYLTTVIIASCIGVAMVFLFHPGDPDMRSHRPEDVVIREDNNISALDSILDLIRNMFPQNIVEATMYRSQTAFVVVGLRTYMPTIFFPGLIVFCTGFGIVISKLGGKVRVIVEFFIVLDKVVMKFISVLMLFAPFGIVSLIASSVLDIDDLYKMVTTMALYVFTIMCSLFLHCVIAVPTLYFFITKKSPIDVAKGMVQPFVTAIGTASSGASLPQAMSSVEENLHDGNALYEAVAVIFVAQLNNVTLSFADVITICVTATFASIGLNAVPAGLVSMFVILSSVNLPVSDIALLFTVDWFIDRVRTALNVLGDAYCACVVQHFLQDDLTHEHHHILDELKLEEGDLAEIDRPDQLPEKVKKVSFVDFHHIPSPSAPPVFNSTKTYSLKSAIIGPLRAHVALQTRLSQLSEECKLEEHESKDL

SEQ ID NO: 5948 - protein, 445 aa, Caenorhabditis elegans
MTELSTSPIGLVETSNFLEFFIQNKNCNKSPNFPGSFRKNFVKNSSRVNNYQEFNMAPANREKIADEDRTLPYFHGALMNIDADQLLVNDGDFMVTTRIVADLNKLQFHLAVRLKKGIRRYEIKRNQNSAKLGNRSASNIGKLIDSLKAETIEIKGEKVILKRAIAKGKFQLMHTDVNFKKQIGSGAYGTVYRGRLVKTNAIVAVKKLDTEGTDEEGLTDMMKEARVMQLYDHPNIVKFYGYILDDVPYLLVLEFCNGGSVEDLLRDKPEIKINRRVQYTYMAACGMDYLHKKNCIHRDIASRNCLIHNGVVKMADFGMCRATAVYKVDLSKPLNVRWLAPEVWTNGETRYNTDVYAFGVMIWEFFITPYQSPYTEWKGYTVKQKVRGGYRMQPPEGMPKDVASLLAECWNHDPEKRPNAEKLKEKLEDLNQKYEAGEPSLLQGC

SEQ ID NO: 5949 - protein, 926 aa, Caenorhabditis elegans
MTPLSKLCAGAVTQNVLKSYFLTPSQFRSFSRTITALEKSQKSPSKQEHALQRSILEEVLVHEKAKPTTFGGKVAEKASNTFMYTAVVAGIGLIGAFIYVLAGEFFAQDSPQTIFNKALALVRDDGRCQEIFGASIAGFGEETSRGRRRHVAHHKYEKDGMQRIRVLFHVKGDRDEGIAQAEMEQRDGDWQWRHQIWARKQMPKNKKNNKKRAPASAPKPAPPSAPPRLLQLASSNGEVLQADIRALQLSSTISTTIKELGYDKEDCAEIKPIPVDEHEYTLDLLIKWCDQHKGDDPEIAKAEKGKKKVVIPSWDQHFFSVLPMGNLLAVIKAAYDLDITGLLILSPIQCFGVIFEFFFIEKSLRFRFSKMSEHVKRPTATETDDDLLKMQEEWEAANKKPSVEIHKMKNRQKVEEVASLPSKVVRDQAARFQIDFDEEQAASGVLFPVKERNFAERSEILAENLQKFQLYSKDDGFPEPLDLSAYFSAENPKTLTNLGGKSFFAAEFDRINGNLAENLDFKQETTENPSGSDDFQAENEKYLKSLDFEKIQEMKLEITERFDPKLLEFLKNRGNKASEETQKKPKKISKFKASRQQKEPENEQKGAPEPPAQAPPTKVVEEMMNELEVLEEYGNREDQEKYNRLATVFWKIIDIFEIFGLNFFSVKNGKSEKFQDAVQLDLTAKFGRNLVSRQQKNAVKLFDNCKLRPETSAGSTPDPILELARSSIDQIKTLYLEEIATDSSSKSIIYEFGKGLNPILDNCWTLIPVRRVLDAVERRHGTVTPDDVEIVRLSLLWTLLLFSERKSAFFAFAEPNEFYVHIAEVFLIGAEILADDVIAECAHRILNGYILAAAKDAKIGLRMSGKVAGLDAFMPFYENLLKNYEQYSMGDEHFAMTILIAAYLNSPVGDSSKSNFSLNLSRNSQN

SEQ ID NO: 5950 - protein, 443 aa, Caenorhabditis elegans
MQIRVLCVSTADFSPKNLLGPSSLIFRVFFGGFLYANVKLEAPEAQKSTRGSFFSRIGCCLSTKSSPAEKIKPPDEIMAFHEYPVTQDYRISRKVLGVGINGKVVECEHRQSGDKFALKVLRDTQKARREVELHVMASGHGHVVSVHDVYKNSYNGVDCLLVVMENMKGGELFNRIQERGQKAFTEREAAGIVNEICSAVAHLHRMSIAHRDLKPENLLYVTTASNAALKLTDFGFAKKTDESEPQGLKTACFTPYYCAPEVLGTEKYDKSCDLWSIGVIMYILLCGYPPFYSQHGQPMSPGMKAKIKSGQYTFPSPEWDCVSEAAKDLIRKLLRTEPTERITIEQTMEHKWISHYRRVPDTPLFTSSNLNDQREQWTDMQDEMEATLASMRVGPENIQIKSLGDSNNKLLAKRRKGGASPKDDPMDDIKEEEKDDEEEKMIS

SEQ ID NO: 5951 - protein, 264 aa, Caenorhabditis elegans
MRYALAACLLLLAASSFVDAKKKKIADDELGELLDNIDADEEKKSVEPAKNPCEDHQCGWGKECVVGKKGEPTCECISKCPELDGDPMDKVCANNNQTFTSLCDLYRERCLCKRKSKECSKAFNAKVHLEYLGECKKLDECTEEHMAQFPERMADWLFQVMKELKKRRELHKLEWEELLSEAENDDEKKHVYPVIWKFCELDTKPHDKSVSHHELIPITAPVIPMESCIKPFLEGCDANNDGNISIKEWGKCLGLKEGEIQERC

SEQ ID NO: 5952 - protein, 646 aa, Caenorhabditis elegans
MGRGEHKEHKRKRSRSKERKRSRSRSPRGSREHREHRDRDRDRERRRERDTDREKTRDREKQRDAEKKKEKESKTAIFEMEESRNDTEEVMKMKEAELLQGVERRRRNVEKWRAQKKKEELDLQSEQSDEKSEKKPWNLEDEDDEDEFDIKNEGISEENPVKMEEKVEKMDTDDEEDPLDAFMKEIATKNAKKTGNSTQKASGIVTIVQEEKPEPEKGQVLENEDNMDMVIDDFDIETAAASLCHKGRMLAQTDHSKVYYRKFKKNFYIETEEIRRMTKAEVKAYREELDSITVKGIDCPKPIKTWAQCGVNLKMMNVLKKFEYSKPTSIQAQAIPSIMSGRDVIGIAKTGSGKTLAFLLPMFRHILDQPELEEGDGPIAVILAPTRELAMQTYKEANKFAKPLGLKVACTYGGVGISEQIADLKRGAEIVVCTPGRMIDVLAANSGKVTNLRRVTYLVLDEADRMFDKGFEPQVGQKIRKSSIFRFLPKTCQIYVFEGGVRPIMKVVNNIRPDKQTVLFSATFPRHMEALARKVLDKPVEILVGGKSVVCSDITQNAVICAEHQKFLKLLELLGMYYEEGSSIVFVDKQEKADDIVDQLMRTGYNSVAPLHGGIDQHDRDSSIADFKTGVIKVLVSSFLKAHFCR

SEQ ID NO: 5953 - protein, 334 aa, Caenorhabditis elegans
MSKSEKQQLAPWVEKYRPKVLADIVGNENIVERLKVIGHEGNVPNIVLSGPPGCGKTTSVWALARELLGDKVKEAVLELNASDERGIDVVRHRIKTFAQTKVTLPEGRHKIIILDEADSMTDGAQQALRRTMEMYTKTTRFALACNQSEKIIEPIQSRCALLRYTKLSPVQLLTRVKEVAKAEKVNYDDGGLEAILFTAQGDMRQALNNLQATVNAYELVNKENVLKVCDEPHPDLMIKMLHYCTDRKFFEASKIIHEFHRLGFSSDDIVSTLFRVVKTVELSKNVSEQLRMEYIRQIAMCHMRIVQGLTSKLQLSRLIADLCRVSAAATATSA

SEQ ID NO: 5954 - protein, 392 aa, Caenorhabditis elegans
MFTNFGNLFQKFWTKKIWKFAQTFFSQILKQFYRFIWQYVFPLQFALGLLGNSLNLWVLASDEVPNIASDMVLAAVSFCDLAFLLVMLPNCLAAFDTIAYNVSFRYFYLNTKQHMSAVANWMSAAAIWLILAVSIERYLIVRSPFRAKLYWQRGKMVVVLSSIFVTTGLLTVYHHFEWDCVIEEFCNGTQLLDFCYYSGMRHQKTYRNKDWVTPSNVKKVYLKFSTFLNAILVVFVPIVLVIVLNMLMIRQLKINWTSPRLESMRGAMTRSHVRQRQRVAVTVIAIGLCFSLTQGPSAFMALYELFSEYELGHTFYAIFSITNSLVVTGKTINFILFCLSSEHFRQKCFKAIYRKFPKVRRGSCGGAVNHSGMGVYPENAGIHGAISASWLA

SEQ ID NO: 5955 - protein, 310 aa, Caenorhabditis elegans
LDKSWVSPRKLLYPLFNLSKPCVTINEFKLEKFEIFRLRHNNIVQLFDTYDEKQFVYLVMELVTGGELFDRIVAKGSYTEQDASNLIRQVLEAVGFMHDNGVVHRDLKPENLLYYNQDEDSKIMISDFGLSKTEDSGVMATACGTPGYVAPEVLQQKPYGKAVDVWSIGVIAYILLCGYPPFYDESDANLFAQIIKGEYEFDAPYWDQISDSAKDFITHLMCCDPEARFTCQDALSHPWISGNTAYTHDIHGTVAVHLKKSLAKRNWKKAYNAAAAIRQLQMLRLSSNSNRLQKQASQQQPEPPTPAFHA

SEQ ID NO: 5956 - protein, 521 aa, Caenorhabditis elegans
TASVQALTDVQLWVLDRSVFQMITQRLGMERHSQLMNFLTKVSIFQNLSEDRISKMADVMDQDYYDGGHYIIRQGEKGDAFFVINSGQVKVTQQIEGETEPREIRVLNQGDFFGERALLGEEVRTANIIAQAPGVEVLTLDRESFGKLIGDLESLKKDYGDKERLAQVVREPPSPVKIVDDFREEFAQVTLKNVKRLATLGVGGFGRVELVCVNGDKAKTFALKALKKKHIVDTRQQEHIFAERNIMMETSTDWIVKLYKTFRYSLQQQNTSKNIWFLLDQKFVYMLLEVCLGGELWTTLRDRGHFDDYTARFYVACVLEGLEYLHRKNIVYRDLKPENCLLANTGYLKLVDFGFAKKLASGRKTWTFCGTPEYVSPEIILNKGHDQAADYWALGIYICELMLGRPPFQASDPMKTYTLILKGVDALEIPNRRIGKTATALVKKLCRDNPGERLGSGSGGVNDIRKHRWFMGFDWEGLRSRTLKPPILPKVSNPADVTNFDNYPPDNDVPPDEFSGWDEGF

SEQ ID NO: 5957 - protein, 1110 aa, Caenorhabditis elegans
MPSSDDYDCSISELKLLMELRGAEALEKVNSTYNGVEGLCRKLKTDPINGLPNDTKELEHRRTAFGKNEIPPAPSKSFFRLAWEALQDITLVILLVAALVSLGLSFYKPPAEHASNDSSESEAGWIEGVAILVAVLVVVLVTALNDWTKEKQFRGLQSKIETEHKFSVIRGGEPLDIVVNELVVGDIARVKYGDLLPADGLLIQSNDLKIDESSLTGESDLIRKSEEFDPVLLSGTHAMEGSGRFLVTAVGLNSQTGIIMSLLGAAKEKKDDKKEEPTTLTNGNHMNGLGNGVDKAAELPVPEEEEVGRMSKSVLQTKLSNLALQIGYIGSIVAAATVLILIIRHCISKYAIEGKSFEASDISHFVNFIIIGVTVLVIAVPEGLPLAITLALTYSVKKMMKDNNLVRHLDACETMGNATSICSDKTGTLTTNRMTCVQQYINSEFYKGNAPKYEQMDPSTRDILFNGIVINSGYNSTVVTPKNPGEQRGQIGNKTECSLLGFIMDSGRSYEDLRRQFPEEKLYKVYTFNSSRKSMMTVIELGDKKYRIYAKGASEIILTRCNYIFGKSGKIEQFGPKEAAVMTKNVIEPMASDGLRTIGLAFKDLVPAGSKKYEYEEEYDGEIDWEDEEKIREGQTVIAVMGIQDPVRPEVPAAIAKCQKAGITVRMVTGDNINTARSIATQCGIMQPGGDFLALEGKEFNARIRDADGKVNQQKFDAIWPKLRVLARAQPSDKYVLVKGIIESTVTKNREVVAVTGDGTNDAPALKKADVGFAMGIAGTDVAKEASDIILTDDNFSSIVKAVMWGRNVYDSIAKFLQFQLTVNVVAVTIAFIGACAISDSPLKAVQMLWVNLIMDTLASLALATEMPTEDLLNRKPYGRTKSLISRTMVKNIVGHAVYQLAILFAIMFWGDKLIPNTPSGRNAELGSPPSAHFTIIFNAFVLMTLVNEINARKIHGERNVFKGIFTNPIFCVIWITTLISHILIVQFGGQWFSTAPLDLTQWIICICCGVGELFWGQIINCIPASILPKSFRFGKGDVQPTSIMLSGEYDMPSTASTLPMKDGAAADHQRAGQSLWLLGLTRLQTQGLVAYEPVDRYILRRQMQRIHPE

SEQ ID NO: 5958 - protein, 366 aa, Caenorhabditis elegans
MALRKCGNLFVARLAGTSTRAASTMTVRDALNQAMDEEIKRDDRVFLMGEEVAQYDGAYKISKGLWKKHGDKRVVDTPITEMGFAEKTENSSKKITFFSGIAVGAAFAGLRPICEFMTFNFSMQAIDQIINSAAKTYYMSAGRVPVPIVFRGPNGAAAGVAAQHSQDFSAWYAHCPGLKVVCPYSAEDAKGLLKAAIRDDNPVVFLENEILYGQSFPVGDEVLSDDFVVPIGKAKIERAGDHVTIVSYSRGVEFSLEAAKQLEAIGVSAEVINLRSLRPFDFESIRQSVHKTHHLVSVETGWPFAGIGSEIAAQVMESDVFDQLDAPLLRVTGVDVPMPYTQTLEAAALPTAEHVVKAVKKSLNIA

SEQ ID NO: 5959 - protein, 437 aa, Caenorhabditis elegans
MGIMKTTTLKVAEPTHLIETIQRRYDKRVRPFAESNRPVIVHMTIVLGILTEVRENQQVASFVISHVQKWRDPKLAWNPADHSGLTQVVMPRSLVWVPKLFIYNSMDTKDMLTDDRYDVRIQHTGHVKVNSPQFVSTLCRINIDLFPFDTQFCAIALASPLLSVEEMDVNATQPPVDSYFSGNAEWQVMNVTVKQMKFMEEGEYRAEVHYILHLNRRPTYYITVIVVPTFLISALSILGIFSPGSNDGPRNEKVSLGLGSLLAMTVLLDIVAGAMPKSDAIPLLGYYIMLVILLCAIGVAVSMAMLSMSRSCIQTSKMPPPHYYRLLFLNVCRVVKQNSGLNGVAMNEKPTAITPRFPDLIAIYNQLIEVARAQRTYRERIEKQKWQHRVEIEWNKIFARIDFFFLFLFEMFNVLILVLFLRCAFLPVPPLPENFSI

SEQ ID NO: 5960 - protein, 457 aa, Caenorhabditis elegans
MFFFQNSSLPLDPCNDFYDYVCSKDNRIITKLNFTNIFEDRDILKPNITFPSNGTYTPLDQILDPDRLMAWYSAINMVVTDSVDSDYFGEMSSGAKNNYLEKVLYALEKLETSNLTMTNVLYTALHANIEILKHLRLPITKENKFLHYMFDLMKENTIQEIRNSPLSGRSMAFLNLYLKDAKVLFAFLEYNNVTLLEDTKLVYETEYYRLRSLLSPGDLETEVAEKILSLGAINAAIKFMSERIPDYSPNFLFRSLLLNLESDAAQYISLIHVTVVTRSDLQQPVKAIADKLFVLAHELMHWVYPQGTWLMDSIVTRTAEKCARDEVKMMGDTDAVKPVDGWFSEEVTHEDLANIMAMRMVMKMAARKSANEKQLSLETIMSSLCVQGKPKNTVCRNHHPFELSLNTAVRQYPLFSSLYGCRAGDRMFAKREEFCKPLGGEVNLEDYKIKHETEDVG

SEQ ID NO: 5961 - protein, 191 aa, Caenorhabditis elegans
MQAIKCVVVGDGAVGKTCLLISYTTNAFPGEYIPTVFDNYSANVMVDGRPINLGLWDTAGQEDYDRLRPLSYPQTDVFLVCFALNNPASFENVRAKWYPEVSHHCPNTPIILVGTKADLREDRDTVERLRERRLQPVSQTQGYVMAKEIKAVKYLECSALTQRGLKQVFDEAIRAVLTPPQRAKKSKCTVL

SEQ ID NO: 5962 - protein, 129 aa, Caenorhabditis elegans
MQAIKCVVVGDGAVGKTCLLISYTTNAFPGEYIPTVFDNYSANVMVDGRPINLGLWDTAGQEDYDRLRERRLQPVSQTQGYVMAKEIKAVKYLECSALTQRGLKQVFDEAIRAVLTPPQRAKKSKCTVL

SEQ ID NO: 5963 - protein, 1086 aa, Caenorhabditis elegans
MDFSEASTSGDRVNGFAKPFPPKPREGAPPPAPPLAPGASTSQAPPPLQPPPVIESAEKFYVPGVEEKSKFRILSQQVEISNLNISTRSFNVRTEIVLLPCEKSLYQLDLHIGKCSLLPNEVPGSASKVTLNGVECEYSRRDFWKDLAQEKSISSLEPVLYEKLAENDYELQILIPKEVRKKIKHRKAVRLRVDTVVRDPPRGLQFVDFNEHDCHVFTYHTPHISGAREWTVCLDEPDQLALWELTFELEPHLVPVASGELEEKREVSENGKIRYKFHQTVPTSACNIGWAIGRFKLEPHPESPTIYTFSLPGLEPFVNHTTMYLDKMVEFLEEKLSCRFPYPTLKVVFVDQCTEEIQVYSSLLIVPTAMLYHKKIIDVVQEARQKLIFSIALQFFGCLISPAQWWHWWIPVSIARFLTSLYVETKLGTAEARWQLKRAMDDVCDYEHQWGKIVLSPPEPTKKLPLHVDPRHEYTASPLYVEAMLKKGFLTMRMLQRRIGLEPFMRVLHRVLTVGLDMSEKKTTPAAWRHLLTTTESFFRSVISVTGKEIPSFLSQFVRTGGHAAFAVKFDFNRKRNIVEIEIKQDDTEGNGRTQYTGPLSVVVQEVDGAFTHTIQIDGAVSHAEISCHSKGRKQRKKKVPLLTGEEIEIDLTNMDAESPILWLRIDPDYLLIREITISQPMFHWEYMLRYERDVIAQMEALERIQALPSAHSRSVIVDAVANEKFFYRIRYRAAFVLTFVQNRKSEALTVGTPVLINMFRESFGSKAATNIPRSNNFVVTAQNLQQYFVMQALPQAIARLRRQSGECHEDVQPFLLDLIKFNDNSTNRYSDDFYRAALYNSLASSVFPHDALPCHVELPENLSNDVRVLIKEFTYALNMDTVSPSWGRVVGAAALTGLYQLQKCGYLPLDSQLLWTFSHPNCCVQMRRCAITLIIDRIVNDPHAADTRMLDLSRILELAELEQDPSIRRMIPRLLAQTPPTIFGSENAANTAETAERLWKLCTNSSIDSCIRSGFLDVYYSLYALGAPPALGGPEESVGIHRAYVTVPNAASTFATSQWHNSGYEAARRSPPRRDFGDETMNLMQ

SEQ ID NO: 5964 - protein, 375 aa, Caenorhabditis elegans
MNLPSKFHQVTITDPIAGAGITFTIPTRYVNLKFLNVGAQGIVVMADDLVTTQRVAIKKMQQPFLLTMSARRAYREFILLTTLKHPNIIRLLNAFTPDTSLSSFQEVYLVMEFMTHNLHEVIHRLRLDHETLSFLVYQSLCAIKHLHNLGFIHRDLKPSNIVVNERCVLKVLDFGLARRRNVDMRMSDYVGTRYYRAPEVILGLNYSEKVDIWSVGCILAEMINHTVLFPGKDIRDQWTQISSVLRTPDDHFINQLEPIGAVYVRSLPQHLARAFNEIVPDSNFLPETENPKDHLTLHMARDLLFNMLKINPEERYSVEDALNHPYTMDDEVNAPASEIPDDEVNDIDDWTLIEWKRLIFNEVQGYQTDHDIFNE

SEQ ID NO: 5965 - protein, 587 aa, Caenorhabditis elegans
MIIGQATLRCRCLTDATKLVLDVRDLSIRSVSINGVDCDFRIAPNVYTFFGSKMSVYLPPQFQKAGTILQVTVAYGTSPDATALQWMKKEQTADKRMPYLFSQCQAIHARSIVPCMDTPSVKSTYEAEVTVPTGMTCLMSAIGQGSKGDDDTTTFFYKQPVAIPSYLIAIVVGCLEKRDISDRCAVWAEPSVVDKAHWEFAETEDILASAEEIAGKYIWGRYDMVCLPPSFPFGGMENPCLTFLTPTLIAGDRSLVSVIAHEIAHSWSGNLVTNSSWEHFWLNEGFTMFIERKICGRLVSEDYRQFMAFNGWTNSLIPAVYEQFTPTHQFTKLIQDHTNVDPDVAFSCVPYEKGSALLFYLEQKLGGSEIFEAYLKDYLKTFAHQAIDSWQWKDHLYKYFADQKEVLDTVNFDLWFNGVGMPPEKPNYGQSMVEACEVLLKKWLAADESTVGDITSEDYYAMQPLQQIELLSQLWQHDPPIEHYKLDALNKLYKLNDSQNSELLLNWLRLCIKSKWEECIPKALDFVNSQGRLKFCRPIYRDLAQWPIANKKARDVYLKGRSQMHPITAEMIAKDLHIRHSTHTVCF

SEQ ID NO: 5966 - protein, 627 aa, Caenorhabditis elegans
MEKEKVDELPPNDNWYETALPKPPVPSLEATLDRYLEYAAVVAVGQKASLATTHDAAHKFVRQATPLQEQLLEIAEKSPNWATKFWLPEMYMRVRMPTPVNSNPGYIFPKVKFETKEDHIKYTALLTRGLLEYKNLIDTKQVCREKSTGAQKLQMCMEQYDRVLSCYREPGVGEDTQIRKQKTNDGNEHVLVMCRNQTFLLHSRINGALVSYADVEYQLAQIEEISKINQNNTANIGASGVGPRDNAALFWQDMLTVEQNSKSYEWVKSALFVVCLDMEDPIDYGKNDTMSISEKEKEFVARGYSTLTGHGSSKFGLNRWYDATIQLVVSSSGVNGLCIEHSTAEGIVIINMAETAIRYAQKYFKSKMVWNDVRNVHPKSLTWHFSENSRNILKKQAEVFDELANELELEVLIFNEFGKDSIKNWRVSPDGFIQLIMQLAHYKTHGHLVSTYESASVRRFGAGRVDNIRANTQEALEWVTAMASKKESKERKLELFKKAVLKQVKVTLENISGYGVDNHLCALFCLAREREETTGEDIPSLFLDPLWSEVMRFPLSTSQVTTSLDIPDCYLTYGAVVRDGYGCPYNIQPDRVIFAPTAFRSDPRTDLQHFKKSLAGAMRDVKELLSN

SEQ ID NO: 5967 - protein, 670 aa, Caenorhabditis elegans
MFLGYCFPLDYNIRYMLRNPKMFQNFQLCVGMTPNVGQVNLNAPDGAAKDFTFDGAYFMDSTGEQIYNDIVFPLVENVIEGYNGTVFAYGQTGSGKTFSMQGIETIPAQRGVIPRAFDHIFTATATTENVKFLIYNEEVRDLLGADNKQKLEIKEQPDRGVYVAGLSMHVCHDVPACKELMTRGFNNRHVGATLMNKDSSRSHSIFTVYVEGMTETGSIRMGKLNLVDLAGSERQSKTGATGDRLKEATKINLSLSALGNDSLGGNTKTIMIACVSPSSDNYDETLSTLRYANRAKNIKNKPTINEDPKDALLREYQEEIARLKSMVQPGAVGVGAPAQDAFSIEEERKKLREEFEEAMNDLRGEYEREQTSKAELQKDLESLRADYERANANLDNLNPEEAAKKIQQLQDQFIGGEEAGNTQLKQKRMKQLKEAETKTQKLAAALNVHKDDPLLQVYSTTQEKLDAVTSQLEKEVKKSKGYEREIEDLHGEFELDRLDYLDTIRKQDQQLKLLMQIMDKIQPIIKKDTNYSNVDRIKKEAVWNEDESRWILPEMSMSRTILPLANNGYMQEPARQENTLLRSNFDDKLRERLAKSDSENLANSYFKPVKQINVINKYKSDQKLSTSKSLFPSKTPTFDGLVNGVVYTDALYERAQSAKRPPRLASLNPK

SEQ ID NO: 5968 - protein, 164 aa, Caenorhabditis elegans
MSIMRTRTLQEVFEESKLVISQLTEEEIHEFKEAFLLFDKDGNGTISIKELGVAMRALGQNPTEQQMMEIIHDVDLDGNGQVEFPEFCVMMKRIMKETDSEMIREAFKIFDRDGNGVITANEFKLFMINMGMCFDEVEVEEMMNEVDCDGNGEIDYEEFVKIFS

SEQ ID NO: 5969 - protein, 544 aa, Caenorhabditis elegans
MSFRIGRRCFSKQSYDAIIIGGGHNGLTAAAYLTKAGKKVCVLERRHVVGGAAVTEEIVPGFRFSRASYLLSLLRPVVMQELNLKKFGLRYHIRNPNSFTPIRNTHESLLLGMDMAENQKEIAKFSQRDAGNYPKYEHFISEIVHSFEQLMDYEPLDLQKPIHKLLPHLYLLFKTVQPLGLRNAVDFYELMTAPISKIMNKWFESDVLKATLGTDGVIGLAASPMDPGTGYVLLHHVIGGLDEHKGAWGYVYGGMGAVSNAIAECAKSHGAEIYTEQDVQEVLLDGNVAKGVRLSNGKELHSKIVMSNATPHVTFNHLVKKESLPEEFHRNINQIDYTSPVTKINVAVKELPNFLAKPNQGSEPMPHHQTTIHMNCENMQVVHDAVMDYKNGRYSRRPVIEMTIPSSVDRTIVDSADGHVVLLFTQYTPFSPKDGEWTEEKKTEYAKHVFSEIDAYAPNFSSSVIGYDILTPPDIQNTFGITGGNIFHGSMSLDQLYVSRPISKWSNYSTPIESLYLCGSGAHPGGGVTGAPGRLSALHALKHF

SEQ ID NO: 5970 - protein, 1827 aa, Caenorhabditis elegans
MGIKKIARELGIKGVKFFKKTACGGKREGSHDIKFCNFQFDDFSLRAEDSLIVYNGATPSATVLASFSGNLTTKKYITSSTNIVYIYMMTRTTSSSRGFSISYKRGCDLSMTDPHGEIISPGYLATEYPNDVTCTFTIEIENLKADRSLSIIPNRFDVADDDSVRIFENLVKGKALHESDGFTAKSKPEKQIDSEANRLQMVFKSSASRQAMGFNFSYSIDCPAFPTVPMVTLSTKQRSVNTKVTVECPIGFEFASGEGVSKTVECLIGGTWSQSQISTCQPIYCGAVPQIANGFVDSATNVSFGGQVKYSCHKGFFFASGKDVETVYCGELGKWGIPPACKAATCQPLAQFSNGDRRLEFGDGTGYGSVFRFDCHSGYRREGVESSLCKSDGTWSSKQPNCTKVACTHLPEVANAKIEVPDRFLFGDVARVVCNSGFTIDGPEEIRCLANQTVSSTPKCIDIDECSSGVSQCQSLGTQCVNLPGSYMCQCLDGYQPQLMCLESNPIDARSSSKWCVDSKNVGKDRKYPTKVVKFAIPMIVEQIKFANVRNGKITKISIKYSETDKTRTKKLIIDNESILDVDEDNIATLPMAIEVQVLEIEVVGLEGSPCLEVETLGCQRTSCADINECLKDNGHCDHLCINTQGSYKCDCRNGYDIFTENGQSGVNVSTGETGNNMNDFIRFNKSCVPRQCSHIGSPENGQLLSTAERFEYPMIVQFQCAFGYQMMGPDYIQCLADGTWNGTEPFCLSATCQGIEASSKSDGLTVTPNNSTISFGQNVTISCSFPNRPGKLSSPLSNYRQCIFDPQDDGRDYWLSGPAPECSFIECPAPPTMPGAVYNGDVTDRKMGSTLEFTCRQPYTVVGRSSAGDQNIKCSPDATWDLGDLRCEGPVCVDPGYPYDGQVDLESVEEGAIAKFSCKRPGFVPFPSDTLQCTLGASCVLSEDVGIVSGFVPDGAFADNSDSTNLGYEPHHARMGSSGWCGAKEDFIFLSVDLQRIYTLTTLRIAGVAGSGHLKGHVTKFQLFYKTENQHTHKPYPVEFESPAGNHNAMHHFDLKFPLRARYILFGVTEYEGNPCMKFDLMGCVAPASPSHELDSHLQIGWNGSVPQCVDMEPPKFENCPESEIFAKVDENGQLKAVEFEEPAASDNSGKIAYTQIEPLGMRTGLMITEDMDVTYTAFDSAGNTAVCVLKIRIPDTQPPVMKCPDSYTIPVGNSTKHVIFDMTTVDMVLHDTSNVSDVTFTPSEATLKIGEFEEVTAQAEDENGNRNSCKFQVAYAPEACSPASLASSNQIVKNCVHEEGAVVCSVYCAQGYRFVDPDQITQNFVCKDGRWSPRNNAPACVPIPKDPAGFHVNVGISYPVSSPVPNHCLKGYAELAAKEFDNLDKVLSSRCSSSVEVHVKLLKLDFSNQNGVLTGNYTIQVLPTEQQSVFYDLCGLTLRTIFDLNIPGANQPIQALLSLSGEAIASQTAGCPSITAKASSVVQGFACATGEVLRQEAKDRLPECMACPSGSVNINNTCMLCPRGSYQDESGETSCKPCPDGTYTLDEGSQSVGSCLAICGFGMYSSTGLIPCQLCPRHTFSGAAPIGGFRECEACPSGAYTAKLGASSASECKQACKTGTYSNSGLEPCSACPINFYQPTVGQQSCIECSNTTATQTTGESLESSCFPIDCSAKMCENNAECSVFMHRAQCHCKPGYVGDRCEMLEDVCSTQPCYNGGKCEQVGTTYKCTCPKMFNGARCQFESDECNGVKCPNGGVCHDLPGVKSTTCLCRTGFAGPQCEEITDICSTNNPCRNGARCIGEKLGRFKCQCVPGWEGPNCDKNIG

SEQ ID NO: 5971 - protein, 1372 aa, Caenorhabditis elegans
MYVFIYEWECEQTGGLKDFEWNSSWKILDDCADSPCALNATCVDLINDYKCECPTGFSGKRCHIKENLCASSPCVHGLCIDKLYSRQCLCQPGWTGENCDQNIDECAASPCQNDAKCIDEINGYMCECADGYEGVHCQHLVDHCAKQPCHNNATCTNMGATYHCDCTLGFDGVHCEMNIDECAENQCDKLGTESCRDAVNDFKCVCKPGYTGPRCDVKQDQCADSPCLNDAQCVDMGGAYKCVCKSGWTGPKCEQDNGSCAAKPCRNNGFCVSLVADYFCVCPPGVSGKNCESAPNRCIGQPCHNGGECGDFGSHLECACPASFTGKGCEFKNTGCKTCENGGKCAEAAGGLQKCECSPGFTGERCETNIDECSTAHCPSGATCVDQVNTHICVCPFNLTGVHCDKMINTNYDLQFLDPFRPTSASLYAPFRIESSALSVGLWVKFEKPHQHAAFFSLHRFDNSSQEYVRVSSNLVRLTLFPGLAAVEVPLSSSQHLNNGKWNHLLITWQSKTGAYSVIWNSLRTYSNNGYATGKQLDVMTGITLGSTALPSFVGSIARVGVWNRVIDFEEELPLMVQHCQRSEEIYKGLLVRFEGFTKIIGRVERTHKSTCGVEEKSAMQKSQSQILIEDCPSDMVISSMDRETNVTWPEPTFLSSNSKIEKIEKNLKQGQMFTWGEYDVLYTATDNATNQAQCNFKIRVGKENCVDAADPVNGVQSCESWGPQLKYKACSVECRDGFEFPRSPAVFYTCAADGKWKPNKSPSTMFRYPQCTKHVPATKVVIVRIIYGSSPACTESSKEAFTQKVQQTIDAIDSKWKMCSLTDANGCVGTQVRVECGGSKLPEEGRRRRRNPESVLASSFGVEIEIPVKRRMLVDPSSGLETTIRDALHNEILSGVLNFEKVLPNGRPDVGSLKIKEEYLCQAGQVVVRDLCVPCAPGTYHSAATGECELCPIGEYQPLTARTECFKCAPGQITASEGAISEGECKDNCPPGHQYDSLTSDCVTCGYGYYQPSAGAFECIPCGIGKTTLSEFATSEDECRDECPDGEQLSASGVCQPCQIGTYRSRGENKKCVACPPGTTTEATMSTRREQCNTPKCKPGQFLVKETKNCQFCPRGTFQNEEQESTCKLCAPDHTTAAPGATAESQCFSTNQCATGEYNCSWHANCIDLPDENDVPSYECRCKPGYRGNGTHCTDACNDFCLNDGICKKNNIGNVECICKDHFSGDRCELRFQASNNKLWIATVIVGVVVIGIIIVIIVFMISFRFNHVQDTNEKSSTLADLSPTANNILYGTPPVCEPPRAFGYYYEDDDVYETKSREMIGSGSERRPTTSTVTSMGGAMSRAIEQHKYEQRMRQAQQHMYQPGGGNDEE

SEQ ID NO: 5972 - protein, 263 aa, Caenorhabditis elegans
MFEAKLANAGLLKKIVESIKDLVTDAPFDCSETAMSLQAMDSSHVALVSLKLEVGLFDTYRCDRTINLGLSLANMSKALKCANNDDTCMLKYEENEGDSIIFTFADPKRDKTQDVTVKMMDIDSEHLGIPDQDYAVVCEMPAGEFQKTCKDLSTFSDSLNITATKAGIVFTGKGDIGSSVVTYSPSSNTDDETEAVTLEVKDPVNVNFSIKYMNQFTKATALSDRVRLSLCNDVPVVVEYPIEENGYLRFYLAPKIDDDENMD

SEQ ID NO: 5973 - protein, 205 aa, Caenorhabditis elegans
MTTPSRRRLMRDFKKLQKKLDIFGIFDKFLEDPPAGVSGAPTEDNILTWEAIIFGPQETPFEDGTFKLSLEFTEEYPNKPPTVKFISKMFHPNVYADGSICLDILQNRWSPTYDVAAILTSIQSLLDEPNPNSPANSLAAQLYQENRREYEKRVQQIVEQSWLNFGENEGDAVLKDDVEIEEIAAPGANDADDDRMDEGASGSNA

SEQ ID NO: 5974 - protein, 1862 aa, Caenorhabditis elegans
MALVGVDFQAPLRIVSRVQFGILGPEEIKRMSVAHVEFPEVYENGKPKLGGLMDPRQGVIDRRGRCMTCAGNLTDCPGHFGHLELAKPVFHIGFLTKTLKILRCVCFYCGRLLIDKSAPRVLEILKKTGTNSKKRLTMIYDLCKAKSVCEGAAEKEEGMPDDPDDPMNDGKKVAGGCGRYQPSYRRVGIDINAEWKKNVNEDTQERKIMLTAERVLEVFQQITDEDILVIGMDPQFARPEWMICTVLPVPPLAVRPAVVTFGSAKNQDDLTHKLSDIIKTNQQLQRNEANGAAAHVLTDDVRLLQFHVATLVDNCIPGLPTATQKGGRPLKSIKQRLKGKEGRIRGNLMGKRVDFSARTVITADPNLPIDTVGVPRTIAQNLTFPEIVTPFNVDKLQELVNRGDTQYPGAKENGARVDLRYHPRAADLHLQPGYRVERHMKDGDIIVFNRQPTLHKMSMMGHRVKILPWSTFRMNLSVTSPYNADFDGDEMNLHLPQSLETRAEIEEIAMVPRQLITPQANKPVMGIVQDTLCAVRMMTKRDVFIDWPFMMDLLMYLPTWDGKVPQPAILKPKPLWTGKQVFSLIIPGNVNVLRTHSTHPDSEDSGPYKWISPGDTKVIIEHGELLSGIVCSKTVGKSAGNLLHVVTLELGYEIAANFYSHIQTVINAWLIREGHTIGIGDTIADQATYLDIQNTIRKAKQDVVDVIEKAHNDDLEPTPGNTLRQTFENKVNQILNDARDRTGSSAQKSLSEFNNFKSMVVSGSKGSKINISQVIACVGQQNVEGKRIPFGFRHRTLPHFIKDDYGPESKGFVENSYLAGLTPSEFFFHAMGGREGLIDTAVKTAETGYIQRRLIKAMESVMVNYDGTVRNSLAQMVQLRYGEDGLDGMWVENQNMPTMKPNNAVFERDFRVSVAQNAIKLMDLTDNKFLRKNYSEDVVREIQESEDGISLVESEWSQLEEDRRLLRKIFPRGDAKIVLPCNLQRLIWNAQKIFKVDLRKPVNLSPLHVISGVRELSKKLIIVSGNDEISKQAQYNATLLMNILLRSTLCTKNMCTKSKLNSEAFDWLLGEIESRFQQAIAQPGEMVGALAAQSLGEPATQMTLNTFHYAGVSAKNVTLGVPRLKEIINVSKTLKTPSLTVFLTGAAAKDPEKAKDVLCKLEHTTLKKVTCNTAIYYDPDPKNTVIAEDEEWVSIFYEMPDHDLSRTSPWLLRIELDRKRMVDKKLTMEMIADRIHGGFGNDVHTIYTDDNAEKLVFRLRIAGEDKGEAQEEQVDKMEDDVFLRCIEANMLSDLTLQGIPAISKVYMNQPNTDDKKRIIITPEGGFKSVADWILETDGTALLRVLSERQIDPVRTTSNDICEIFEVLGIEAVRKAIEREMDNVISFDGSYVNYRHLALLCDVMTAKGHLMAITRHGINRQEVGALMRCSFEETVDILMEAAVHAEEDPVKGVSENIMLGQLARCGTGCFDLVLDVEKCKYGMEIPQNVVMGGGFYGSFAGSPSNREFSPAHSPWNSGVTPTYAGAAWSPTTGGMSPGAGFSPAGNTDGGASPFNEGGWSPASPGDPLGALSPRTPSYGGMSPGVYSPSSPQFSMTSPHYSPTSPSYSPTSPAAGQSPVSPSYSPTSPSYSPTSPSYSPTSPSYSPTSPSYSPTSPSYSPTSPSYSPSSPSYSPSSPSYSPSSPRYSPTSPTYSPTSPTYSPTSPTYSPTSPTYSPTSPSYESGGGYSPSSPKYSPSSPTYSPTSPSYSPTSPQYSPTSPQYSPSSPTYTPSSPTYNPTSPRGFSSPQYSPTSPTYSPTSPSYTPSSPQYSPTSPTYTPSPSEQPGTSAQYSPTSPTYSPSSPTYSPASPSYSPSSPTYDPNS

SEQ ID NO: 5975 - protein, 326 aa, Caenorhabditis elegans
MYEGESVVQLAKRMIEHLLKWGVTDAFTDKQIYTILEKAESTLKPLPAMLQVEHPITIVGDIHGQLDALIRYFDAVGYPPKVQFLFLGDYVDRGAKSFEVSLLLFCYKIRYPHLNVFNELPLCARVGQRILCMHGGISQNCNSWESFKALKKPNTPLTCDEGLQVDLMWADPTQDKCNTFAMNKQRAISVVFGQKGLDDFLKKLGLSLIVRAHEVSQEGFNFLFNKKCVTVFSAPYYCGNDTNCGAIMHVSDSYELSFTVLRPRMIATPENFEIVKLMENNYKGLMVASPDPNRGRHLQSADVPQPTPPSVQLVPPVTKPVEIKKQ

SEQ ID NO: 5976 - protein, 193 aa, Caenorhabditis elegans
MSFLWDWFNGVLNMLGLANKKGKLVFLGLDNAGKTTLLHMLKDDRIAQHVPTLHPTSEQMSLGGISFTTYDLGGHAQARRVWKDYFPAVDAVVFLIDVADAERMQESRVELESLLQDEQIASVPVLILGNKIDKPGALSEDQLKWQLNIQHMCTGKGDVSRNEMASRPMEVFMCSVLQRQGYGEGIRWLGQYL

SEQ ID NO: 5977 - protein, 166 aa, Caenorhabditis elegans
MSGIAAGRLAEERKHWRKDHPFGFIAKPVKNADGTLNLFNWECAIPGRKDTIWEGGLYRIRMLFKDDFPSTPPKCKFEPPLFHPNVYPSGTVCLSLLDENKDWKPSISIKQLLIGIQDLLNHPNIEDPAQAEAYQIYCQNRAEYEKRVKKEAVKYAAELVQKQMLE

SEQ ID NO: 5978 - protein, 1038 aa, Caenorhabditis elegans
MHRASLICRLASPSRINAIRNASSGKSHISASTLVQVVTKNSKKLHRNQSVAAAVKHEPFLNGSSSIYIEQMYEAWLQDPSSVHTSWDAYFRNVEAGAGPGQAFQAPPATAYAGALGVSPAAAQVTTSSAPATRLDTNASVQSISDHLKIQLLIRSYQTRGHNIADLDPLGINSADLDDTIPPELELSFYGLGERDLDREFLLPPTTFISEKKSLTLREILQRLKDIYCTSTGVEYMHLNNLEQQDWIRRRFEAPRVTELSHDQKKVLFKRLIRSTKFEEFLAKKWPSEKRFGLEGCEVLIPAMKQVIDSSSTLGVDSFVIGMPHRGRLNVLANVCRQPLATILSQFSTLEPADEGSGDVKYHLGVCIERLNRQSQKNVKIAVVANPSHLEAVDPVVMGKVRAEAFYAGDEKCDRTMAILLHGDAAFAGQGVVLETFNLDDLPSYTTHGAIHIVVNNQIGFTTDPRSSRSSPYCTDVGRVVGCPIFHVNVDDPEAVMHVCNVAADWRKTFKKDVIVDLVCYRRHGHNELDEPMFTQPLMYQRIKQTKTALEKYQEKILNEGVANEQYVKEELTKYGSILEDAYENAQKVTYVRNRDWLDSPWDDFFKKRDPLKLPSTGIEQENIEQIIGKFSQYPEGFNLHRGLERTLKGRQQMLKDNSLDWACGEALAFGSLLKEGIHVRLSGQDVQRGTFSHRHHVLHDQKVDQKIYNPLNDLSEGQGEYTVCNSSLSEYAVLGFELGYSMVDPNSLVIWEAQFGDFSNTAQCIIDQFISSGQSKWIRQSGLVMLLPHGYEGMGPEHSSARPERFLQMCNEDDEIDLEKIAFEGTFEAQQLHDTNWIVANCTTPANIYHLLRRQVTMPFRKPAVVFSPKSLLRHPMARSPVEDFQSGSNFQRVIPETGAPSQNPPDVKRVVFCTGKVYYDMVAARKHVGKENDVALVRVEQLSPFPYDLVQQECRKYQGAEILWAQEEHKNMGAWSFVQPRINSLLSIDGRATKYAGRLPSSSPATGNKFTHMQEQKEMMSKVFGVPKSKLEGFKA

SEQ ID NO: 5979 - protein, 625 aa, Caenorhabditis elegans
MSDDETLADVRIVLIGDEGCGKTSLVMSLLEDEWVDAVPRRLDRVLIPADVTPENVTTSIVDLSIKEEDENWIVSEIRQANVICVVYSVTDESTVDGIQTKWLPLIRQSFGEYHETPVILVGNKSDGTANNTDKILPIMEANTEVETCVECSARTMKNVSEIFYYAQKAVIYPTRPLYDADTKQLTDRARKALIRVFKICDRDNDGYLSDTELNDFQKLCFGIPLTSTALEDVKRAVSDGCPDGVANDSLMLAGFLYLHLLFIERGRHETTWAVLRKFGYETSLKLSEDYLYPRITIPVGCSTELSPEGVQFVSALFEKYDEDKDGCLSPSELQNLFSVCPVPVITKDNILALETNQRGWLTYNGYMAYWNMTTLINLTQTFEQLAYLGFPVGRSGPGRAGNTLDSIRVTRERKKDLENHGTDRKVFQCLVVGAKDAGKTVFMQSLAGRGMADVAQIGRRHSPFVINRVRVKEESKYLLLREVDVLSPQDALGSGETSADVVAFLYDISNPDSFAFCATVYQKYFYRTKTPCVMIATKVEREEVDQRWEVPPEEFCRQFELPKPIKFSTGNIGQSSSPIFEQLAMMAVYPHLRRVFYLNDSNLLSKITFGAAIVALAGFLVLKNL

SEQ ID NO: 5980 - protein, 478 aa, Caenorhabditis elegans
MNNFRFFLLFLATISMTFVYSNRVVFGFTIICQQGGNESDDTTSVIVDPDYYLLDTLNIAWMFTATAVGMCLGPAPFYFVGFLSTRVLIFTYGIMSALSSILYPLFDSLGFWPALVCRFFAGFAQASQLHFTNDLVLRWTPESEASFFFSIMLATSQFGPLFTMILGGEMCSSSFFGWEATYYILGVGTFISSTAFAYYYSDNVEKNCNLEESEKKYILAGKHSTKEKEKVPYKALLKDSTIWISLLMFTGYYLAMIVYQQYSPTFIKQVLHFTIRETGYFSAIPQLIAIFIKIGCGRLLDLFMIFFLHVKECYVKFGCGPKLTLVVPLLILESMSAFSLFLTGFLDDRVWSLIFMMIFASLHFFVPVICSRTIQIRAGQHSHFALNLNMVIAGIAQILIPLGVQAAVPENTRSQWSFVFYFLVITVVITSILYTLFSRATPAEWTMKKRASEYTIYRLSDISPPEPITIPMPRECKF

SEQ ID NO: 5981 - protein, 359 aa, Caenorhabditis elegans
MVASPHRNSTNDLLMPLLGKRIRLGDHVYKMCDSIATGPFSSVFLVEKDGIPYAMKVESQSKCLRPVLKLDHAVLRALGHQSGFPSLTSAGRTENFKYVVMQLVGPDLSMLLEFAPQQRFTSSTVYKIALQTLDRLRVLHEAGWLNRDVKAQNFAVGLGEESSIVYMLDFGLTRKYLEHNGSRSLLRPHGPSVGTFPYAPLASLGFCDQSPIDDIEGWLYMIVHLLKGGLPWHNSKRALNLPKVREWKMYCRRPGGKHYLFAGIPKGWADIFDVIVNTAPHETPDYNKIANMVLSIARNELIDLTAPFDWQVNPVLRSLVRLGPLSCGELTRIPMSSMAATPFTDQILLNSIGSPLESY

SEQ ID NO: 5982 - protein, 419 aa, Caenorhabditis elegans
MSALASKLFAKCAAGGRALQSQAVRQFSAYPIDDSMFGLNDEEIALRQSIRQFADKELAPYADKIDKDNGWDQLRPFWKKLGDQGLLGITAPAEYGGSGMNYFSHVIAMEELSRAAGGIALSYGAHSNLCINQIVRNGSEEQRKKYLPKLISGEHMGALAMSEAQAGSDVVSMKLRAEKKGDKYVLNGTKFWITNGPDADVLVVYAKTDPSKHQHGITCFLVEKNTPGFSQSPKLDKLGMRGSNTCELVFDNCEIHESQIMGGKGKGVYVLMTGLDYERLVLSGGPLGLMQAACDIAFDYAHQRTAFGQKIGSFQLLQGKLADMYTTLNASRSYLYMVAKAADKGNVSNKDCAGVILYVAEKCTQVCLDAIQILGGNGYINDYPAGRLLRDAKLYEIGAGTSEVRRLIIGRALNKEYSN

SEQ ID NO: 5983 - protein, 135 aa, Caenorhabditis elegans
MSVRHLQWTEWPDRGVPPCKLTSLELLSAIRGSKVPIVVHCSAGIGRTGTIVAIEYILEKIAENKPCPPMPELVKALRDQRAFSIQNDVQYLFIHRVMLNYFLEKYKEKYAALLTAENVAKYDKFIKDYNAAVGQ

SEQ ID NO: 5984 - protein, 613 aa, Caenorhabditis elegans
METSKEFEFRPAKETSRSKSPGGIVGRLSNFARNKARHSLSEKGSNSVGGSGGAGFDKPRKPFDTTVSLSLFSGPPKRISQMQRGAGSEIRFELNRDHEHSVADQRAHTADRIVLVQAPTLFLFISKPQETSFLENLIISGIKNFQNKLTCLPTEIGQLVNLKKLGLSENALTSLPDSLASLESLETLDLRHNKLTEVIFLQVPSVIYKIGSLETLWLRYNRIVAVDEQIGNLSKLKMLDVRENKIRELPSAIGKLTSLVVCLVSYNHLTRVPEEIGDCHSLTQLDLQHNDLSELPYSIGKLVNLVRIGIRYNKIRCIPSELESCQQLEEFIVESNHLQLLPPNLLTMLPKIHTVNLSRNELTAFPAGGPQQFVSTVTINMEHNQISKIPIGIFSKATRLTKLNLKENELVSLPLDMGSWTSITELNLSTNQLKVLPEDIEKLVNLEILVLSNNQLKKLPNQIGNLNKLRELDLEENELETVPTEIGFLQHLTKLWVQSNKILTLPRSIGNLCSLQDLRLGENNLTAIPEEIGEFLVHISSHLDSLKSLYLNDNSSLHNLPFELALCQSLEIMSIENSPLSQIPPEITAGGPSLVIQYLKMQGPYRGVVMNSQ

SEQ ID NO: 5985 - protein, 390 aa, Caenorhabditis elegans
MLYAIIAFMAVVGNLLVLYITLFRLRVRSITTYFILNLGFADLFTGIFAIPFKFQAALFQEWFLPRSLCRIVPYVETVALTVSVFTLVTSAVHEFRTMFFSKCSQMSPRSAKRCVLLIWIMAVLVSLPHGLFHNTYEFPDDNNTSIVQCLPVYPDAGWWKTYNVYLVIIQYFVPMIILDTAYTMIAVKIWSLSQSRVELDETKMATQKISVVSMVSPNTQLSQLMRTLIIVVACFSLCWFPLETYLLLNELKPEINGWKYINLVFFFSHWLAMSNSCLNPIIYGLYNVSLNFNYIFSILLFSLTVIYFLKFLEHPQSNLDKIQRGISSFVSPNWMHLATAEKFGRFEKLSKYLQMKPERRWNSSNDCQDQQEIDQIVDIPPVISTNNLSP

SEQ ID NO: 5986 - protein, 1808 aa, Caenorhabditis elegans
MLRPPFWLGLLLSLLLVFIEAQHPLQQNEDRCQDRSCYPITGNLLIGRKSQLKATSTCGSQGRQRFCIVSHLEEQTKCFYCDSRTEWKPQREPYRLSHRIENVVTEVMDDKNRNWYQSENGAQNVSISFDLEAEFHFTHLIMTFKSFRPAAMIIERSADFGKTWQVYRYFAYDCDSSFPGIPEGPPKKHTDVICTSQYSDVAPSTGGEIVYKVISPHIVTENPYADEISTLLKITNLRFNFTKLHTLGDDLLDYRPEIDEKYYYAIYEIVVRGSCSCYGHASRCIPIDPHVSPNTVMERADIVHGRCECMHNTEGLNCEKCKAFYNDLPWRPAIGDEKNECRQCNCNRHALRCHFDRAVYESSGTNSSFSKSFFSKFSYFSGFVSGGVCDDCMHNTQGKNCEQCKPFFYRDPRRTIDDPHVCLPCECDKAGSQNKGICEGEEDAERGLVAGKCYCKTNVDGNRCDRCKNGYWNLTETNVDGCVACTCNLLGTYNNEGCDKYTGMCTCKRLVTGENCDQCLPEHYGLSEHVDGCKACDCDIGGSYDNTCEITTGQCKCREGFSGRRCETADSSFYCADITHYVYEAEYANLTRGEVKTREWPSQPHEQTFTGEGFAQAVEGTIITVNPIVEVSQKYNVIIRHDGARDPVGWENIQITVVRPEAEGDGSCSDAPPSDDFLIARIYPGSRYIEVQPAICLEAGVQYELRIQFNEKRGNSHPQERAAANILIDSILLAPPTSELHIFQGSARAEQHLTEYNRYQCRHLALSLSLFKDQRNEVCERYVCPIAAALLNKTSECNCDATGSVSGICNVQGGQCECKPNVVGRRCDQCAIGTYGFGPSGCKKCDCDAVGSLGNDCDKQSGQCVCREKGIYGRQCNQCQPGFWGFPECRTCQCNDHANICDQSSGACIECRDLTTGHYCDRCQDGYYGDPRLGVGIPCKPCPCPGGPTSGYQHADTCYLRNSGNNTQDIVCNCKSGYQGERCGECAQNHWGSPREVGGTCERCDCNGNIDMAMEGSCDAATGECLKCLHHTEGAQCEHCVDGYYGDAKLKTCQRCVCNELGTNSTKGACDRVSGQCPCHDNIIGMQCDQCAENHFNLASGAGCEACGCDSNGVVLNHEGVPHLQCNIFDGQCQCKPGRGGRKCDQCEDLYWGDPTTPDGCHRCECNPTGSKSLQCHRNNGTCECQAGSGGALCNECARGYTGQWPYCNPCGECFHQWDNIMQKLQKQVHALIDTANNIEDTGVASAYDADFEKMEETLKETKKALSDANISKEDIEEMSKKLALLKKQVIAGREKLGAIETRISNITQAVDFAQKDLEHLQKEVDKVTKATIELEDKASKIKEADVLGAFNITRESASKSLDAQRRTDAAIGKLAAAENQALRASELLEKNKNDFEKQYVENEEALNEAETLLGGLESVLPKLNEQVCGASSAPCDALCGGPGSCGFCGGQSCMEGAVSKANQAKSFATEADTRLDEKQKEAEEVLSIVRDVLTETTKAKAKAEKAYEVAKNTAQRANSSRAELDKIAEEIGEFLTAQKSSPEQIRNLAEEVLGKEISLTPDQITDLTGKIKESLAKINNIDEILNETRGNKSIAANLESRAVKANKEAELLQKAMEEIREALQLADQAYNNVTSVLEEIDTMQVQARELIDKARNSTEAVEGKAQAANTTLAELEGVMSGVKVEYLQISESAKNALTTVDAALAAATNAEQKNKQIQTDLERATELLEKRMEGNVAPQQRAEKLRERAAKLLYQAQRHNDDIDNLSKDSTEMRLDDYETILADLNSRLERVTRDIHEKTDFHATCG

SEQ ID NO: 5987 - protein, 380 aa, Caenorhabditis elegans
MSSDETDDVLPKEDEMFKTKKDKYKVIALLGKGGYGAVYSVLRLSDMEKFAIKCEKATAGKKVLLMDCNVMKGATQIKSRHFCTVLDRANVKDRFNFIVMKLIGKNLWDLRQDRGDGKFTMGTSLKAASQCLVSIEHLHSFGYLHRDIKPGNFAAGRKESNEHHVIFMLDFGLCREYVKRAEGKDLRAARTTAPFRGTTRYAPLASMLQQDQSRKDDIESWLYMVVEWTSGGLPWRKLKAHDREKVLQYKQDLRTKPDILDDFLFLCPKKEFTRILKYLDTLGYYAVPDYKFIYFCVQHAANANKIKDADPLDWDPETPYMGPIEQPGDGKVIDLEVEGGASTKDFSKRNAKEKDQSDETRKGKKKTSGSPNKERTSSKN

SEQ ID NO: 5988 - protein, 311 aa, Caenorhabditis elegans
MTAPPPPLVELPPGSMVERWSITKKLGEGGCGAVYLCTDATGKYALKVEGISEAMQVLKMEVLVLGELTKRGSRHFCKIEDKGRYGSFNYVVMTLVGKSLQDLRKGTAQQCLSLACSLSVGIQSLEALEDLHNIGYLHRDVKPGNYTIGRAELNELRKVYILDFGMARKFTDNNGVIRKPRAAAGFRGTVRYAPIACHKNQELGRKDDVEVWLYMQVELTVGRVPWKEITDMNAVGQAKQAIRNTPEKMFVFPCPANELKEIMKMVDSWDYFADPNYADCYRLMKQTLANCGKPEYPYDWEPGMPLNYMVK

SEQ ID NO: 5989 - protein, 368 aa, Caenorhabditis elegans
MSCDRKDEEKKETEEKKDDESKKKDEKKEEKSKRKEDEKKEKQNIAGAVYNQMRNTILMEEGSVISGRFEVKGIIGGGGFAQIYKAWDKVRKEDCAIKVEHESQDIRRMKLEITVLLALRGSMGIPEILAQGKWQHEDNKSHYIVMQLVGRNLSDVRRALPHKRITERTLYRAMIQVLKALSLVHGAGFLHRDLKPSNCCIGAIDCTRIYLIDYGLTRQYLDKGGIVRKPRAGVGLRGTVRYMSLDAHARQDLGPKNDLVAFLYTTIECGDGYLPWSHEKTHENIIKLKQAHIGDKLCTKQPVMTKAAEYIESLNYHSIPDYEKLLALMEECNPPDLKESEPYDWQYRHLPNGTPGGTKENVTERMAI

SEQ ID NO: 5990 - protein, 310 aa, Caenorhabditis elegans
MPILSRFPKIIYSQFAEKKFIKKFNQLNIFNKQPMLIEANSPINICGDIHGQFSDLLRLFDKNGFPHRANYLFLGDYVDRGKHCLETILLLFAYKVIFPNHFFMLRGNHECSLINKIYGFYDECQRRYNKPSVYVSFEGVFSDMPLTALVGQRILCMHGGVSKMVSNFYDSVQINLNFLQLQNVSQLRAIKRPFDNPEPNTLAIDILWSDPTNFQKGWNPNSRGVSYVFGSDALRKLLDRLQIDLVVRAHQVVQDGYEFFANRRLVTIFSAPFYCGQFDNAAAVMYVNKNLVCSFVVSFWGSFRSMVETV

SEQ ID NO: 5991 - protein, 381 aa, Caenorhabditis elegans
MEFRTIRSMYDYTPTEKKHILWAVSFGTIVGIFPINMLYVQCGARLAFFSAGLLSAMTTAFTPWAASQSMWFLVALRFLQGVAYSADFAAIGIIISKWAPLDETAVFIATLTSFTAISSIITNGVSGVICESHLGWRWSFYLHAAACLIVFLTWGLVYKNDPSLHKSVSAKELGKIQKNKSDAHMKDSMQIPYRKIFTSPVVITVWLCAFTELSTLILIATYAPIYFRNVLKFDIKMIGFYLGLILAIHLPFRFVCALLSDKTRCISEMSKIHIFNTLSVGFVGISFIAFGQIPHEHNLSAVICLGVLECFTSFSSGGFYKCGTLHARQFSSIVISAIQFTKCIALFSGPALVAFFVTDESNQTQWSHVFMTLAGFTFFVS

SEQ ID NO: 5992 - protein, 484 aa, Caenorhabditis elegans
MDQPHINEKGMSILVTALFIVGETAGGGLIALPTAIVSTGAVTGAFLLLVAAVVCTYTGILLAENWTILQELYPEYRDHCRKPYPAMGLRAIGPKFAHFVSAMLQVTQFGTAVVFVLLAAKNGENMLHANFGTHVSFCYMILIVGLLVFPFTLPKSPKDFWYAVVAAMISTTISVVLIIFGTVQDYEVCHKEVFYPSFNFSKTLMSFGTIMFSYGGHCAFPTIQHDMKKPHHFSRSIIIAFIIIFIFYLPVSMSGYFVYGSSLTDSIIPSIQNINIQTIVNILISLHVSLALTITFNPLNQEFEEILNMSHDFGWQRIVARALVMLSVVFVAESVPNFGVLLDLVGGSTITMMALVVPIVFNLALTTIKKKKENKDNEEKLTIKEIFQNSDKIKLLANILILVFAIFGGVAATTSAMQTMLQSEFSAPCYARIWSENARIMEEQRQLTFTHGKIACCGMFRNISATGSEVCLDVASMAKAVSHG

SEQ ID NO: 5993 - protein, 508 aa, Caenorhabditis elegans
MKSFYCSEVKKKSLPCSEVKKEYGIVCRCNATYCDTIEPLGTVTSGKAVVYTTSRNGKRMNRSELKHTTSSTAKTKVYVNTTQSFQPVMGFGAAFTDAAGINMKMLPQTMQDQIIQQYFSDDGLGYVFGRVPMASTDFSTHEYSYDDVKFDFDLKNFNLTVEDLQYKIPFIKKAMTASGGKLKLFATPWSSPGWMKTSGRMVGAGELLGDQNGKYYQTWAQYFVKFFEAYHAQGIDFWSLTPQNEPTTGIDPLWKWQTLFFDASMERNFIKKLLGPALASSPVTKNLKIMINDDQRINLPHWPNVILTDPTAAQYVHGIAIHWYEDFIDPATVLTETHEKFPDYFLLATEACAGYFPADGPKLGSWSRAEQYANDLIKDMGNWVGGWVDWNYILDLQGGPNLAKNFVDSTIIVNATAQEYYKQPIWHVMAQFSKFVKPGAIRVGINIIEKSVDVEGLSFLNQDGTKTVVLLNKNEVLSFDVAISDVSAPNVIYDLTIQPNSLITIVYK

SEQ ID NO: 5994 - protein, 798 aa, Caenorhabditis elegans
MLFEDRQKNRSTGPTLIGFNQTQNEHENTVCPTHPESSDRILKIKEALTKTKILEKCTVLTNFLEIDDADLEVTHDKSMVKDLMESEKKTQEDINSQCEKYDSVFMTENSMKVAKDGVACVRDLTNRIMANEASNGFAVVRPPGHHADSVSPCGFCLFNNVAQAAEEAFFSGAERILIVDLDVHHGHGTQRIFYDDKRVLYFSIHRHEHGLFWPHLPESDFDHIGSGKGLGYNANLALNETGCTDSDYLSIIFHVLLPLATQFDPHFVIISAGFDALLGDPLGGMCLTPDGYSHILYHLKSLAQGRMLVVLEGGYNHQISAVAVQRCVRVLLGYAPFSIELNEAPKESTVDSCVSLVSVLRHHWNCFDYFPSRTSLRLAQWPIVNTKVIYNYDPTTRRADTGEIIQDELASTEFTASDVIPTENMETLIYFNEGDDAHFDLEEDNHPEKPARTRRILKTLRESGVLEKCVDRNCERIATNEEIRLVHTKKMLEHLRTTETMKDEELMEEAEKEFNSIYLTRDTLKVARKAVGAVLQSVDEIFEKDAGQRNALVIVRPPGHHASASKSSGFCIFNNVAVAAKYAQRRHKAKRVLILDWDVHHGNGTQEIFYEDSNVMYMSIHRHDKGNFYPIGEPKDYSDVGEGAGEGMSVNVPFSGVQMGDNEYQMAFQRVIMPIAYQFNPDLVLISAGFDAAVDDPLGEYKVTPETFALMTYQLSSLAGGRIITVLEGGYNLTSISNSAQAVCEVLQNRSMLRRLREEKEQFATKPQKIESSCIKTIREVCAVQQKYWSILKGFQVS

SEQ ID NO: 5995 - protein, 550 aa, Caenorhabditis elegans
MTSGEKLPSLKLDMNVPVRNKWHPVKVLGSGAFGKVVHVVNIVDGSDGAMKMEKYQEGNESVLKGEVEVLRALSGQKNAIQLLDSGLEPDYRFIVMTLCGMDLQKVYNLLKGQFSDSTVLRVAIRSLHAVKAVWEYYFIGTELFRTKLHEACYIHRDLKPCNVTLDYNEYSPLIFLIDFGMGRKYAKIDEGEYVIRRPRDACRFRGTIRYCSPRMHLRREQGRVDDLYAWLYMIVELKVELPWSEVVHPDRIEFLKLEKFDAAMASNPLTKSFEPIMDHLKTLRYPDRPNYLMIYELLAKMMSDLNAKHTDPMDYDVFRKKNEVTDAIKKKYQTRSRLPEKALEESATIAVLEEAFRPKTSDVPGGDQYVVKPLLKLSWGSVVAASDFPTADEVETVEEKDLKKKQDAKNQESDKRKNSDRKKKSERKKKGSKGDMILEKSKETKDHRESGRRLTDREANAVGGKSIDAKSKGNKDMEQRTIMIDKPGSITPKSKRSRTTTKIPHKTPHKSHLRKEKQESSANSKRLNVAPLVHPTVLVVPASKKKPKGT

SEQ ID NO: 5996 - protein, 707 aa, Caenorhabditis elegans
MENLIPVVNKLQDVFATLGRKEDQIQLPQIVVVGSQSAGKSSVLENLVGRDFLPRGTGIVTRRPLILQLNHVALDDESKRRRSNGTLLTDDWAMFEHTGSKVFTDFDAVRKEIEDETDRVTGVNKGISLLPISLKIYSHRVVSLSLVDLPGITKIPVGDQPVNIEEQIREMILLYISNPSSIILAVTPANQDFATSEPIKLAREVDAGGQRTLAVLTKLDLMDQGTDAMDVLMGKVIPVKLGIIGVVNRSQQNILDNKLIVDAVKDEQSFMQKKYPTLASRNGTPYLAKRLNMLLMHHIRNCLPALKARVSIMNAQCQSDLVAFGEPVEDKNRTLLQIITRFATAYTSTIEGTARNIETTELCGGARICYIFHDTFGRSLESVNPLENLTQLDILTAIRNATGPRPALFVPEVSFELLVKRQIQRLEEPSLRCVELVHEEMQRMVQHCGFTTQQEMIRFPRLYDKINEVVSGVLKERLKPTNELVENLVAIELAYINTKHPEFTEANLVTLLKEELLLDDRHGRSRNRHASTGERAVSAHGEQQLQPVPGVNGVDLNAVLQQQQQQSQNQRASNGFLGLFGNAAASSKTSPQEKQSANFLPEVPETQLGRKLTSREQRDVAIIERLIRNYFIIVRKNIQDSVPKAIMALLVNFVRDNLQSELVRQLYKPDEMDDLLAETEDMAQRRRDTLETMKALQQASVIISELF

SEQ ID NO: 5997 - protein, 308 aa, Caenorhabditis elegans
MAQELIQLNPGQQVERWSIEKKLGEGGFGAVYRVFDATGKYAMKVEGANEQIQVLKLEVSVLNELSKRGNRHFCKIEDKGRFGNFNYVVMTLVGKSLQDLNKAGVGGHMSMGCSIGIGIQSLEALEDLHNIGYLHRDVKPGNYTIGRPELNEIRKVYILDFGMCRKFTGNDGTIRKPRQAAGFRGTVKYAPISCHLQRELCRKDDLETWMYMQVELSHGTIPWQHISDMNQVGQAKQAIRNNLGTLFPPPCPQQFQDIMRMVDAMKYYDAPNYQAIYGMMRQAYGACGSNENAPYDWENGGPAAYLLH

SEQ ID NO: 5998 - protein, 368 aa, Caenorhabditis elegans
MEVDNVKPSSSVPQRNWEKENNVQNVDSIFEYNNKQQVEIRNAKPWDKDPHYFKQIKISAIALLKMTMHAKRGGNLEIMGLLQGRIDANSFIILDVFALPVEGTETRVNAQAQAYEYMTVYSEMCDTEGRKEKVVGWYHSHPGYGCWLSGIDVSTQTLNQKFQEPWVAIVIDPLRTMSAGKVDIGAFRTYPEGYRPPDDVPSEYQSIPLAKIEDFGVHCKRYYSLDVSFFKSQLDAHILTSLWNSYWISTLSSSPLFSNVEFLNNQIQDINQKLSAVDKKLQLNDRSVDGHEALMKVVTDAKAVGDELETGRISHLVKQLLFARQAGGGCGCSHASAGSPMDIAVATEPEKAGPSPSAPEPAVEMADA

SEQ ID NO: 5999 - protein, 431 aa, Caenorhabditis elegans
MTDKDLLHQKYYHGLLPREDIQEMLNKPGQFLLRTSEPVKGEKRQFVLSVVGEKNTSANHFVVREADHKVYVDKIGFPTIIELVNHYVSTKESFSTKDGTVKVVLKHAVERQKWELYHEDVELTKKLGEGAFGEVWKGKLLKILDANHQPVLVAVKTAKLESMTKEQIKEIMREARLMRNLDHINVVKFFGVAAGTEPLYVIMELADGGALDSALGKLHFPMIKKYELIYQAANGLAYIHEKNLMHRDVAARNCLYGGGQVKIADFGLSREGADYTMDLKKKVPIRWLPPETIRSGLYTPKTDVFAFGVMAWEITEDGKEPYPGFKVIEVAMKVLQGYRMPFSPEVNKEFAEFILTKCWPEKYEDRLPMKDICKWMKSSVKAQGGDTGPGGMMSKFGKKIKRSNSRESKSKSSTMTAAHGHDQGAMTAIEK

SEQ ID NO: 6000 - protein, 404 aa, Caenorhabditis elegans
MPQHKFLFTSESVSEGHPDKMCDQISDAVLDAHLAQDPHAKVACETVTKTGMIMLCGEITSKAVVDYQVLVRNVIKKIGYDDSSKGFDYKTCNVLVALEQQSPEIAAGVHVDKDSDDVGAGDQGIMFGYATDETEEAMPLTLLLSHKLNRKLHELRRSGELEWVRPDSKTQVTIEYASEGGACVPLRVHTVVISTQHSPDISLDDLRKELIEKVIKAVIPANLIDDKTIYHLNPCGSFIIGGPMGDAGLTGRKIIVDTYGGWGAHGGGAFSGKDPTKVDRSAAYAARWVAKSLVKAGLCRRCLVQVSYAIGVAKPLSVMVFSFGTSALSEEDLLTIVNDNFDLRPGKIIKNLDLKRPIYEPTAENGHFGHNNFPWEQPRNLKISADMLAKSQGPAQPDVIGIAH

SEQ ID NO: 6001 - protein, 404 aa, Caenorhabditis elegans
MSQHKFLFTSESVSEGHPDKMCDQISDAVLDAHLAQDPHAKVACETVTKTGMIMLCGEITSKAVVDYQVLVRNVIKKIGYDDSSKGFDYKTCNVLVALEQQSPEIAAGVHVDKDSDDVGAGDQGIMFGYATDETEEAMPLTLLLSHKLNRKLHELRRSGELEWVRPDSKTQVTIEYASEGGACVPLRVHTVVISTQHSPDISLDDLRKELIEKVIKAVIPANLIDDKTIYHLNPCGSFIIGGPMGDAGLTGRKIIVDTYGGWGAHGGGAFSGKDPTKVDRSAAYAARWVAKSLVKSGLCRRCLVQVSYAIGVAKPLSVMVFSFGTSALNEGELLKIVNDNFDLRPGMIIKDLDLKKPIYEPTAENGHFGHNEFPWEQPRHLQIDVELLKKIGGKTISNGNGIAH

SEQ ID NO: 6002 - protein, 624 aa, Caenorhabditis elegans
MTETDCPTCQFPSIQTRDRLNDVCQFIVPRQHNTLIVPNFGQVPVLKGDLTWLSPEVLTFLNDCVQLMTPCAVRICNGSVFEAQELRDAIANEFGNEEQQMLDRFHLKMADIGYDDVSVVTKDRLDADPGISLSNASASRTSSSGSGEGIENVRLSSHYMSQKMFDFNKTKLFDCSMSGRTMYVVPFSMGTIGSRRAVVGVQITDDPVLVLNLRTTFRVLSNIWDHIAATTNFLRCVHTIGMPRPIIRKIVTPSPVETPVGSFLVLKHDDQEVWAHGHSFGRTPRYGKTFSVHAASWLGAKQGWLAESAAILAITNPKNDTIHVCYSSLTTIDSLQLSKGLAPGWKVTVVSEKSVWLHWHDGKIYGFSPENDEMEELGSPKNLANLLTGVISEYQIQSFDPQSTKWASDVGVPISALIFANRRHDQYPLILEANTWEEGVCVAAGIRVSSMKQQKISEESVKESVEGASPRRILVECPMLRADAINFSIAKYVKHWLEMGVGVKSSSENFENPPPPQIFFTNLYQEVDGKPLWPGGVDNARIFEYIYERCANPADLSKTISSGLGIVPKTLQLSAGTNLAPLLQVDIRFWLTELNKLRAFFNLQMECSLPPQLDKVLTDLAANL

SEQ ID NO: 6003 - protein, 783 aa, Caenorhabditis elegans
MAMEKIKKFPIFSVFFLIVLMFFRKTRILKKGKSKRDFRSFFSMIRFISLAWRPLNKKILQSSKHKMSLIFRQQIGRCLSTLKDLHEEAQDDIENVVEIRKGPIDALFGTIFDIVDLAERTITESNRIEQHSTKWKLRGAEMDSKMHQAVRACQIGEIQTVRFLLNGHVSANEFDHEGCGLLHWAAINNKLDIIQLLLSHRADINLIGGNMKSTPLHWACYNSQFGAVMALVKNGADPTIKNINGETPLHLAACTGNFIIIAYLLVKFDNIKDTRDNLGRSALMMAADKSFGLFPIRIFTKVDAYLDFTDDEKGNTALHILAARQNLKGVVELICSGADDTKTDNNGVSARDLMDNKFRNLVDKQVTARNICELGTICEKVTSRWFLGQFFTATISGYLAFYFTIKDCVMIGAATGLYFLTNFWVVLGGLALTALLLFILVQRRQMDQFGCLPVTYIFWMGIAEFALLIFNSNGLVHWSVLIFVCSIWVISASFYWIMFTTILRIDYIDFSLILTNPGVLPRSTTPFKDFIKDLEEKQIDRYCFTCWIPKTSSSHHCSQCDKCVDGFDHHCPWIHKCVYRKNLRAFVFFCLTIFMFHVFYVLLLLYMIGASMNASGFGKSVLEQATAKNEEGGKLLNSADYYLSIFEALNNYFQPDFFLTRIFKNLDLENRQKQTLNDHGLMVISLILAIPHVFGAGAITCTQFSQISRHVSTIEIIRKQRLQRNSSEKTITSPEHNPWEYKQSVKTRIRNVCNLLAFDKFGDGEEIDEGHGSSSFETSSSYF

SEQ ID NO: 6004 - protein, 649 aa, Caenorhabditis elegans
MPLAYSTHDNFYESPKTPQPTWDHVHAQFPLGEPARNLDKFIEAMFQSVSPLAGVAAAPSQIAALQQIQALMTFQMQQNNLFPKIDTISKSPTPELASPSAKRMRLSPSTSSHSDVASTSKGTNGQDQSKNSPTNSDPFYTIGQSTPNTSSFLDTSNSSFGAPSTVVANPMTNYQLAFQAKLGSLHSLIGDSVQSLTSDRMIDFLSNKEKYECVISIFHAKVAQKSYGNEKRFFCPPPCIYLIGQGWKLKKDRVAQLYKTLKASAQKDAAIENDPIHEQQATELVAYIGIGSDTSERQQLDFSTGKVRHPGDQRQDPNIYDYCAAKTLYISDSDKRKYFDLNAQFFYGCGMEIGGFVSQRIKVISKPSKKKQSMKNTDCKYLCIASGTKVALFNRLRSQTVSTRYLHVEGNAFHASSTKWGAFTIHLFDDERGLQETDNFAVRDGFVYYGSVVKLVDSVTGIALPRLRIRKVDKQQVILDASCSEEPVSQLHKCAFQMIDNELVYLCLSHDKIIQHQATAINEHRHQINDGAAWTIISTDKAEYRFFEAMGQVANPISPCPVVGSLEVDGHGEASRVELHGRDFKPNLKVWFGATPVETTFRSEESLHCSIPPVPISLVRDDGVVYSSGLTFSYKSLERHGPCRIVSNY

SEQ ID NO: 6005 - protein, 772 aa, Caenorhabditis elegans
MSSRKRGITPSRDQVRRKKLSIEETDSIEVVCRLCPYTGSTPSLIAIDEGSIQTVLPPAQFRRENAPQVEKVFRFGRVFSENDGQATVFERTSVDLILNLLKGQNSLLFTYGVTGSGKTYTMTGKPTETGTGLLPRTLDVIFNSINNRVEKCIFYPSALNTFEIRATLDAHLKRHQMAADRLSTSREITDRYCEAIKLSGYNDDMVCSVFVTYVEIYNNYCYDLLEDARNGVLTKREIRHDRQQQMYVDGAKDVEVSSSEEALEVFCLGEERRRVSSTLLNKDSSRSHSVFTIKLVMAPRAYETKSVYPTMDSSQIIVSQLCLVDLAGSERAKRTQNVGERLAEANSINQSLMTLRQCIEVLRRNQKSSSQNLEQVPYRQSKLTHLFKNYLEGNGKIRMVICVNPKPDDYDENMSALAFAEESQTIEVKKQVERMPSERIPHSFFTQWNSELDGSVRMEDDGSREIPCPPTFCLTDCNDKDTVDSMYKYARKLSSLQNSSEEGPSSTLLTMIRQYMMEADYQRVEIARLKDSLNDKDEEIKKLRGFCSRYKRENASMKERIASCEQGEQENALVMEKLMEQKMEDRKIIQSQKKAMRNVRGIIDNPSPSVASLRSRFDQENVAHPTAPIQTPPPPYQTPGRAPVFKKRLEATTSTTVMSGSSSGGSGQQGYVNPKYQRRSKSASRLLDHQPLHRVPTGTVLQSRTPANAIRTTKPEMHQLNKSGEYRLTHQEVDDEGNISTNIVKVNSLVSTQKHACTVPLSFSRVLITHLS

SEQ ID NO: 6006 - protein, 775 aa, Caenorhabditis elegans
MSSRKRGITPSRDQVRRKKLSIEETDSIEVVCRLCPYTGSTPSLIAIDEGSIQTVLPPAQFRRENAPQVEKVFRFGRVFSENDGQATVFERTSVDLILNLLKGQNSLLFTYGVTGSGKTYTMTGKPTETGTGLLPRTLDVIFNSINNRVEKCIFYPSALNTFEIRATLDAHLKRHQMAADRLSTSREITDRYCEAIKLSGYNDDMVCSVFVTYVEIYNNYCYDLLEDARNGVLTKREIRHDRQQQMYVDGAKDVEVSSSEEALEVFCLGEERRRVSSTLLNKDSSRSHSVFTIKLVMAPRAYETKSVYPTMDSSQIIVSQLCLVDLAGSERAKRTQNVGERLAEANSINQSLMTLRQCIEVLRRNQKSSSQNLEQVPYRQSKLTHLFKNYLEGNGKIRMVICVNPKPDDYDENMSALAFAEESQTIEVKKQVERMPSERIPHSFFTQWNSELDGSVRMEDDGSREIPCPPTFCLTDCNDKDTVDSMYKYARKLSSLQNSSEEGPSSTLLTMIRQYMMEADYQRVEIARLKDSLNDKDEEIKKLRGFCSRYKRENASMKERIASCEQGEQENALVMEKLMEQKMEDRKIIQSQKKAMRNVRGIIDNPSPSVASLRSRFDQENVAHPTAPIQTPPPPYQTPGRAPVFKKRLEATTSTTVMSGSSSGGSGQQGYVNPKYQRRSKSASRLLDHQPLHRVPTGTVLQSRTPANAIRTTKPEMHQLNKSGEYRLTHQEVDDEGNISTNIVKGNVIPTVSGGTAVFFNDIERLTHESPSTRK

SEQ ID NO: 6007 - protein, 1581 aa, Caenorhabditis elegans
MGEIELHNFFNCKSVFLTHIKNMGREINNKTRKLEHPTRFNIAGYEFCLAKAAVLSSAMLARKNSSSRGAPGSAAGFGARESIAAISDMLSSQHKKPVRSSYVESDRVEWALKIACTISMITVCIHTPRTIELFQPLNYIILAADFISVSIFMLDSVLRIHYEGIFRCDSSYLSNRWSQFSVFISIIHLLSFLLHCYQLIDNFFPFLHLNYRAWYGAIRSIRPFIIIRLIPLVVKFKLPKNRIEQLLKRSSQQVKNVTLFFVFFMTLYAIFGIQLFGRMDYHCVQPKTDPNNVTIMDLAIPDTMCAPEGIGGYECPAPMVCMQLNLNAKGEGFYGMFNDFGASVFTVYLAASEEGWVYVLYDCMDSLPSYLAFLYFCTLIFFLAWLVKNVFIAVITETFAEIRVQFSEMWQKKEVTLDEGFRKKLEKTDDGWRLIRLDGEVEPEGPKQKLQWVSSLLRVNSVVEKKKNDTYAKKLARSAYYKNYEQFFPNPIIKTFFQMLRSMYFQCFVIIFVVINAIGNAMFVYRHDETDKPRKYNFYLFEVGFTILFNVECIIKILCYGFRNFIRRGIFKFELILCLGSSLNCVKFFYERNYFTYFQTFRLLRLIKASPILEDFVWKIFSPGKKLGGLVIFTIAFICCYSAISLQLFYSVPNLHHFRTFPQAFMSMFQIITQEGWTDFVVEVLRATDDNLVPLVALYFVAYHLFVTLIVLSLFVAVILDNLEMDEELKKVKQLRAREATTSMRSTLPWRLRVFEKFPTRPQMAAMRKFVMFQYLADSDFPMPKVRGSFTHQFAVDHSLETTDVIESDFEFPKRIMKSAGKRKISKSGLTFRQIGSTSLRCSLNNLLEKSRSMTGKFLQTAVRNKQFNMYSENGDLSRPSDSAPKKNAKQGEIDIRALQQKRQLAEITRNRIEEDMRENHPFFDRPLFLVGRASQLREFCKKMVHSKYDSQDDGTNGGAKTKKRFKEIRALIGIMPYIDWAMATVTIVSCISMLFESPWPTTGENLVMNNGYLQISDYFFVLSMTFELCVKIIANGLFFTPKAVVRDVGGVMNLFIYFTSVIFLAWMPKHVEINSLAQFLMICRAMRPLRIYTLVPHIRRVVLEFFRGFKEILLVTILMIVVMFIFASFGVQIVGGKLAACNDPTVSSRENCTGVFWQKLFVTRLEVYGKDTEAMHPKIMVPRVWTNPRNFNFDHVGNAMLALFETLSFKGWNVIRDILWSRHGPWAVVFIHIYVFIGCMIGLTLFVGVVIANYTQNRGTALLTVDQRRWHDLKARLKMAQPLHVPPKPSESARLRTKLYDLTMSRWFNQAFALLVVLNSFTLVIPWNVEEEEQRATYVFTVTALAAFMNMLFVIEIILKVIAYTFSGFWQSRRNRVDLLITVFGVIWIFLHFFVALPSSKIDVDVQVELKKFTYTFGYLVVILRFFTIASRNSTLKMLMLTVIMSMFRSFFIITALFLLVLFYAYTGVILFPMVKYGMAVSKHVNFRTASEALVVLFRCLTGEDWNDIMHDCMRSAPFCYWNEGMNYWETDCGNFYGAIIYFCSFYLIITYIVRNLLVGKFEKLTIINCYLIQSMYCYN

SEQ ID NO: 6008 - protein, 394 aa, Caenorhabditis elegans
MALPFFLLLPNAHFSSFCMHLVRKEHSTCLMGPVVSNRLHSSSFKSKHTIHKGQHQHVADFRDFAYFGNITLGTPIESTAEQTFLVVLDTGSSNVWVPDNSCGIDDKKSACTYKKKYFGTDSSSYEKDGTPFSISYGTGSASGYFGKDTLCFSDTTLCIKSQIFGQANNIAPFFANQEIDGILGLGFTDLAVHSVPPPFVNAVEQGLVDEPIFTVYLEHHGIKKEASGGYFTYGGEDPDHCGEIITWIPLTKAAYWQFRMQGIGIDNVNEHKNGWEVISDTGTSFIGGPGKVIQDIANKYGATYDEYSDSYVIPCSEIKNLRSLKMKINDLTFEIDPINLVAHPDSSECDLTLFDMYGGGFGPSWILGDPFIRQFCNIHDIKNKRIGLAHSKQQ

SEQ ID NO: 6009 - protein, 391 aa, Caenorhabditis elegans
MTTCPLPPSLDEMDLRLAADKVLNGSLINCTFQSFYDQMYQTHGVYFIFEPTPFVHPIVSQIFYGILFTLTIFLALMGNFTVMWIILYHRQMRSVTNYYLFNLAVADASISVFNTGFSWSYNYYYVWKFGSFYCRINNLMGITPICASVFTMIVMSIERYYAIIHPLKKRPGRRSTVTIIIMIWFMAFLFGVPAFLASKVDVYYFYDGYTLYENPLCLADNYPGGNESLLGQVYNNGLITVQYILPLCILSAAYYRVGVELRKDKTVGDVRHAKSVAAKKKASIMLAVVVFIFMIVWFPYNAYYLTLHLVEPIGNKMLSLYIYINIYWLGMSSTVFNPVIYYFMNKRFRVGFHHAFRWLPFVRSDKDEYQTILSQTRPSLMPPTTMAHTDF

SEQ ID NO: 6010 - protein, 667 aa, Caenorhabditis elegans
MSAPLIDKYRKMATFDWKKLKAAVEGEEHVRLKSEVVAKMKSEPVFHRDYRVLSREEQREVVHQRWKKIVEWGLFKDPYSDLENFHALTETLEAYDQGTSARLFLHGNVFGAAVKSMGTDRHKDLIQKTENNEIVGAFCLTEVGHGSNTAEIQTTATFDNGELVFNTPSVSAIKCWAGNLAHSATHVVVYAQLHVEGKNEGFHGFVIQVRCPRTFQTLPGITIGDMGSKPGCWQGVENGWMEFKNHRAPLSALLNKGCDITPDGKYVTSFKSASEKQSVSLGTLSVGRLGIIAKGMMACTFASTIAIRYSVARRQFGPVKGAENEIPVLEYPLQQYRLFPYLSAAICIRIFQKKFVGHFTEYMMRVIMGEKSDELSEFSKEVHALSSGAKPVATWLGVESLGEARKACGGHGYLQMSRLNTLRDDNDPSQTFEGENFMILQQTSNILLGKAQSIGSIETPMSTMSFLNQKPSKFSSWSSNPVNDVLSAYRYLTYHLLQTTSAEAYRLKASGKNSFEVRNEIQIHRAVNLSVAYTEHTMIHWVQQFLKEIEDQSVKPVLQKVLNLFSLFLLERHLATLYITGYASGGKFGEDLREKLRLAVAELKPEAIALVDSIAPDDFILHSALGASDGKAYEHIMEEFRKYTNEQPRWVCDLAQFLQKRSQGSKL

SEQ ID NO: 6011 - protein, 419 aa, Caenorhabditis elegans
MSKNKFLFTSESVSEGHPDKMCDQISDAVLDAHLAQDPHAKVACETVTKTGMIMLCGEITSKAVVDYQVLVRNVIKKIGYDDSSKGKQTEMYPDSNDVVSGFDYKTCNVLVALEQQSPEIAAGVHVDKDIADVGAGDQGIMFGYATDETEEAMPLTLLLSHKLNYKLHELRRSGELEWVRPDSKTQVTIEYSSEGGACVPLRVHTVVISTQHSPDISLEDLRKELIEKVIKVVIPGNLIDNDTVYHLNPCGSFVVGGPMGDAGLTGRKIIVDTYGGWGAHGGGAFSGKDPTKVDRSAAYAARWVAKSLVKAGLCRRCLVQVSYAIGVAKPLSVMVFSFGTSALNEAELLKIVNDNFDLRPGMIIKNLDLKRAIYEPTAENGHFGHNDFPWEQARKLKIDKDLRAKSKGPALVDAIGIAH

SEQ ID NO: 6012 - protein, 287 aa, Caenorhabditis elegans
MFKLKNGQEIPKLALGTYEAKGDQLFAAVDEALKVGYRSFDTAKYYENEKDLGLALKTLLPRHNICSEDIYLTSKVFPYSSKNAAELIRKDVNESLELLDRKYLDLVLVHYPRPLDTEDLNENNKMYRKDTWIALEKLHAEGKIRSIGVSNYEPHHIEEMRSYITIEPQVNQIEYHPHFQRKVLRAYCNKNEILFQAFSPLGRGNKTLLGDSTMERIALCHKTTVANVILAWIMKGKYGVVAKSVTPSRVAENYTSLSLELSDDEFEKINGLNLETPYVEDRGWFVL

SEQ ID NO: 6013 - protein, 900 aa, Caenorhabditis elegans
MPTPEDVPMDENDAGRVAEGSQDESKTPSREVLKKLLNEVEMAEMEENEMWYLISQKWWNSLIKAVRDGFVDDVGPIDNSQISECRNGSFFLKQRLAEQVDYTPVPEILFKRLERFYHIDDDRRDYIQRRVVRKDGKLCIEVYPRIVHITSARNRDIKADLVLRPDDTMVSLRERVIGELSLSTTDNIRFYVMNGENYELIDTAQSIDSYFDTVQKVVVDVEEDGEFFIKGKSATPKSLFGTQSSSSHGGNGISNSYNSPSPSTGVVTRTTPGACGLSNLGNTCFMASAFQCLSNMPPLREYFLANTYQNDINEDNPLGTHGHLAMAVGELMKGMWSGDYASINPRKFKSIIGQFAPRFNGYSQQDAHELMAYVLDGLHEDLNRIKKKPYIEDSDEDAKLPEAEYAAKSWEVYKMRNDSIIVDTLHGQLKSTLICPVCEKISIKFDPFGYLSLPLPPKEQIVKQTVIVMFLTRKWAKFSLGITDTTTVEEAERLMLDKLQPEQQHHFVFFHVPSQYHDDITMMRPGDRVRMPGREVYVAEVEHDLQVKGTRLFVAYNRIKLVRSASLPMIYSLPTGYPLTRGFLNDHVFSTTKHFFINPKAVAELGGGNSNDDDSMSGSNSADEREPYKLFVGPPGSTASLPIPPTDDPIPFPDENSHDIYSNFLQIVFQWKDLKIFNQYKGNELIEREMTVSTRRKVLLQETLDWFTTKEQLGEQDSWYCPQCKKHERATKQLALWKLPEILILHLKRFQYTKWSREKLTWEVVIPVRGLDLTDKVANPNHEKAIYDLIAVSRHYGSLSGGHYTAIGYNDREQKWFDFNDSSANPTYPPAEPYESSDPYILVYRRRKLDSNGKPIEPSAVSESLHSRPKRGAAPTISSATSSASSSRHQVDENMEMEED

SEQ ID NO: 6014 - protein, 592 aa, Caenorhabditis elegans
MLLLPGLMNNLLLFLSFFLLFSITKSAIVSTSLGQIDGDQIGSFHLFKHIPLAKPPIGKLRFQKPEPPEKWTGVRNAKAYGPACISNSSVSTSPQKWIDEDCLHINIFTSDKCLKSKDCAVVTYFHGGGLMYDSAVMFNDTYLLGTFVNQDVIIAIPAFRLGIFSHFVVEDQSIAPTNLALYDILLGVEFVKNEIHNFGGNNQKNTIMGHSYGGSIVNILTFSSKINHDLSLFQQSICMSSGHDFETLEIQIQKTNRFAKHAGCTVPSIIEKKMTTRQSDLYRMKCLQNKDALELLRVQRLLEDEGYPTYGYLVQREPLIQEIPYQEFMKSPKKIPMLTGCTRYEMDHSPAPKPIGQALGFENPEEVYMKFRKDWDDEVYEFGNHSDETQAIMVQVRVRVNNLLSKNVPAYLYEYTYPKHARHTDDLFYLMGVHRFEKDENEIELGKVYETIFMNFAKFGDPKEGFELANAENESYYEVYWDGETGERPQMKTKFEEKIINYWLKDMVEYDKHITELKNQKISIRKPVVRFYEESSKYHQYSYMTISILLIFTIFLTGYLFGRCCCVGNQDRNLYIQLDGSNIPTGHIVKNF

SEQ ID NO: 6015 - protein, 585 aa, Caenorhabditis elegans
MSPSPVWCDGTLLHAVQLSGLFPDCKTFVDMPLKHDADVTLARWNALMALAPITNDVLALFLRENFDEPEGELEECAPTDWAPMTDQFGGIIDEDYRRFAAALHAKWPTLYRKISKKVRVNPEKYSIIPVPNPFVVPGGRFREMYYWDSFFTIKGLIASGMLTTVKGMIENMIYLVETYGFIPNGTRVYYLNRSQPPLLTWCVKAYYEATGDKQFLSDVLPTLRKEFSFFQTHKTYNHPDWNTPLYRFVVETSHPRPESYREDLESAEHLDTLEKKCVLWGDLAAAAESGRDFSSRFFAVHGPYAGQLASTRTSQLIPVDLNSIICGNMKTLSEMYTVCGDLESAKYFDNEYRTLRDTIRQVLWNEEHNCWFDFDVEEGNHATSFHDTNFFPMYCDSYHEDLDSQVVVDYLTTSGAISFPGGIPVSLVNSGEQWDFPNSWPPTTWVLLEGLRKVGQEELALSLVEKWVQKNFNMWRTSGGRMFEKYNVVSPCFKVKGGGEYVMQEGFGWTNGVILDFLKNYGSKIRWQVAESCECCDVTLSRTLIKPTSPAPSSSSTARLFASELTQTPSVVSLQSMLSDGSVQN

SEQ ID NO: 6016 - protein, 981 aa, Caenorhabditis elegans
MVATTQQTPKEADKKKADDKKVPEKAEPKKEEMSEEDQKLEEDLNLLVQRLSEPDTTLYKPSLETMRTLIRASTTSMTSVPKPLKFMRPHYNKMKEIFTSIVAPDVKKLCADIISVLAMTSDERTDTINYRILGSHEPIGDWGHEYVRHLAMEMSEEWKKEGTSDARKAELLKLTQDIVSHHMKHNAEVEACDLLIEIERIDLLISYVQEVDHQRVCLYLLSCAPLTPDPDNIILIRTALQLYLKFNRYLEAVRCAIMVNDIPQVHQIFAKASDPLLRKQMAILLGRHQIFLDYEGSADSDALAELNSNAHLYEYFHSLARELDIMEPKTPEGIYKSHLEHSRPFGNSAQPDSTRMNLAAALVNGFVNCGFGVDKMMAETEEASRWFYKNKEYGMLTAAASQGLIWRWDIDTGLAQCDRFLYINDDYIKAGTLLAIGIISSGIQDACDPASALLLDHVQSDRSIMRVGSILGLGLAYANSKRETVTKNEERGVIFELKKVLSDQKPSAIPEVKGLAGLSLGLILVGTADAEAAMEMLQALMDKSETELTDPNMRFLALGIALIFLQTQDKSDVFVESLRSLPDPFGAMVSTLVEVCAYAGTGNVLKIQKLLHLCSEHYETPAAEKKTAASRGPRGPAPAAATPARPAAQPGNVNVAGTPAPTGTPAVAPAAPRRDLPGAASAATPGAPETAAADATPAPPAKPDLSSQQAVAVLGIGLIAMGDDIGSQMALRMFGHLIRYGEPVIRRAVPLALSLLSVSNPQLNILETLSKFSHDSDADTAHNAIFAMGLVGAGTNNARLVAMLRNLASYHYKDQVSLMLVRIAQGLTHLGKGTMTLNPWHSDRQLLSPSALASLLSICFSFLDANNTILNNRQHYLLYTLVLAMQPRMLTTLVEDEMKPGSLKQLNVSVRVGQAVDVVAQAGKPKTITGFQTHTTPVLLAHGERAELANDEYLSVTPHLEGLVILKKNPDYQPVVVSTKK

SEQ ID NO: 6017 - protein, 499 aa, Caenorhabditis elegans
MVRPEDFNSLELDNSLTDGETVHEMMAHKAGLTYNDFNILPGFINFGVHDVSLETNITKDLKIKAPLVSSPMDTVTESGMAIVMALYGGIGIIHGNFPKPEDQAAEVLKVKRFKQGYVMQPHCLSRDSTAFDMIQIKKKYGYTGAPVTEDGRVGSKLIGMVTSRDFDFITMDVAGQKGTPISDIMVSVDQLHLGHINDAPELSQKKLKEHRLGKLPIVNDNGELCALLCRSDLLKARDYPMASYDSKGQLLCGAAVNTRGESQYTVDRVVEAGVDVLIIDSSNGSSTYQISMLRYIKEKHPHVQVIAGNVVTRAQAKLLIDQGADGLRIGMGSGSICITQDVMAVGRAQGTAVYDVARYANQRGIPIVADGGIRDVGYITKAISLGASAVMMGGLLAATTEAPGEYFWGPGGSFNFSESDQIKVAQGVSATMKDRGSCHKFIPYLIRGVQHGMQDIGVRSLRDFREKVDNGIVKFERRSTNAQLEGGVHSLHSFEKRLY

SEQ ID NO: 6018 - protein, 583 aa, Caenorhabditis elegans
MGNFDMLIFVLLIVYSAYKSCEAGVITTSLGSINGNQIGSYQTFKKIPFAKPPIGKLRFQKPMAAEKWEGILNATEYGPACMSNSSTSKSPQKWIDEDCLHINIFTTDTCLSSKNCSVVFYVHGGELVYDSAVMFEDKYLFDTFSSRDVILVIPAFRLGLFSHFVVEDQNVAPNNLALYDILLALEFVKSEIHNFGGSSDRVTAFGHSYGGHVVSVMAFSTEINTDLSYFQRVICMSSVNVWDSLEFEIEKTMRFIQYANCSVPQDLKSRMTSFEQDSYMMECLQDIDSMELLRIQRSLEDEGHPIYSGLVLREPLIQNVLVQDFYEKPKNIPTLTGCTYKELDKFHAYHNIVETLGYENYKECDDKYRDDRKYGRFDLNKHADETFGILAQTKLKVDKQLDKGIPTYFYEYSYPKHPSHTDDLSYIMGVHAFEKDENEIHLAKSYQEMFMNFVKFGEPGGGFEMSTFENSSYFNFYWNETTGEKSSMKTNFEKEIIKYWLKDMFEYDQNITAAKQLKVAITRSAKFNVSEDQLPYLYISMLIIALIFLTGCLVGKICCVQPRDRHLYIQLDGLDHDCYTVKN

SEQ ID NO: 6019 - protein, 391 aa, Caenorhabditis elegans
MQPPNSTGQWTEIHCDWFAEMQNYQNSLYKINFDGSPIVPMYGLVCSFGALANFIVLLAFVRTANLRNLRNSFIVNLAFSDLILCVVTAPVTLYTSLNLFWPFGDWSCKFLAGVQAVNTFVSSLTLAFIAMDRVLLTLCPVRWRLAATAPLLCYGVVWIISIIVALPYALAVSSKLAPFDPWSDRATPKMLTYCNRQVPEICAEMQEAWDNAIVSKTTYTFVVLGIQYILPLAALAYAYFQIGSTIQKRSKVSRTVDTTRRMQMQNRNRRALLLLFLLVLTYAVCWAPMNIYHVLNGLEIINYSQNMYIFCHLVGISSTCVNPIVYALVNESFRNALQSMILQFRPCYVTTTGTAATNVYAYSATSKAENVTLMRDPFSTTPRPNERPDSV

SEQ ID NO: 6020 - protein, 460 aa, Caenorhabditis elegans
MNITGRIDKIQEKSLKQRNFVHKTRTEAKLLTVSENFATVLSNVDGHSIWLVPSSSGRDDDAVSLDSCQSVYSPVRHHINSGTGGGILMEPSSIHVPENYYSVTIGEAQMVVLKRYQNLRLIGSGAQGIVCSAFDTVRNEQVAIKKLSRPFQNVTHAKRAYRELKLMSLVNHKNIIGILNCFTPQKKLDEFNDLYIVMELMDANLCQVIQMDLDHERLSYLLYQMLCGIRHLHSAGIIHRDLKPSNIVVRSDCTLKILDFGLARTAIEAFMMTPYVVTRYYRAPEVILGMGYKENVDVWSIGCIFGELIRGRVLFPGGDHIDQWTRIIEQLGTPDRSFLERLQPTVRNYVENRPRYQATPFEVLFSDNMFPMTADSSRLTGAQARDLLSRMLVIDPERRISVDDALRHPYVNVWFDEIEVYAPPPLPYDHNMDVEQNVDSWREHIFRELTDYARTHDIYS

SEQ ID NO: 6021 - protein, 151 aa, Caenorhabditis elegans
MNAKFQGSSNFLIYILVTSLIAFKICVFCQQTISIGDTGVTLATMNNTIPASNFSCGANRFTEFIPQLFNSTECKNLRDPMNVCCETHDNCYNTQIGKDFCDNEFCLCLSTATEKNLCAVDAAGFCAAVRLFGETAYNTLGGLEPVSPTIN

SEQ ID NO: 6022 - protein, 416 aa, Caenorhabditis elegans
MFDKDIPSEPWYHGLLPREDIKAMLRKNGDFLVRSTEPKAGEPRQYVLSAMQSEELEDAGVKHYVMRLNPSNQIFLEAKGFETIASLVNYYMNSKEPIKKMTVLKTPILKQPWEIEHSQVELTKKLGEGAFGEVWKGKLTLKNGTVENCAIKTAKLESLNKEQIKEIMREARLMRNLDHPNVVKFYGVGASQEPLYVIMELADCGALDSYLQKNPNLLPGKKMEMIYQAACGIAYMHEKKLLHRDIAARNCLYGEGQVKIADFGLSREGNSYVMDLTKKVPIRWLAPETLKAGIYSPKSDVFAFGIMAWEITENGKEPYPDMRVSEVVGYVRSGHRMRFDPVFVDFRFGEYVTKHCWAENPDDRVNMSDVLRYLQTTFGMKPVILSLRNRTTTDDEMKTMKPPMFSMKRKDKKKPK

SEQ ID NO: 6023 - protein, 1011 aa, Caenorhabditis elegans
MSIRVSIKKYFLLNIGLIVLIIVKGSKLQKTRLSPNLLQNITTCTHLVYGSIPIDRDTGYPQYSVSDVESGYDIDNIRTFMRLRKYHPNAKLLMGVVRTKPFEDAATSVKVANGLRSHVKSKRFDGLFVTFNGIHLEYRASTSFLETISKDKKMSLTFGVTGRRVFAFDALRRLQEINDLVEYIYLDMGELPSNEELARVTHINPLFYNGSIPFEETIQGTVEELSKEGILPSRIVVGLTAGGWKFEIKETQDPLKISHGQYAENNGKRVSYQDACRARGAVIYDWQTMNEITVYRQTWMSVNLPTIKAMGEKMKWILGQKFAGIGISHALFDDPRGDCGTDPLPAHRLVMELIRNTIPANPAKCTRLCYLDPEEVEETFPIDNLKSDYCSHIVVPYFALDLSDKMIEEDKAEDLVKKIDDWRSKIVEVAPRLILSVGSKQASTIWQFLLGNDFHRKELAEGLVKAINSTNADGLEISWTSQPMVSDFDKKNLKSFINDIVAADTAKMVEIVVATSQQSAYSDFYDYEHLNKTASLIVLHSHRLHSDSLPFTGHPSPLRATSSMTNQKMSWESLLSHWVEKRVLPSKLVLSLSASTLSMQSLADVRSSAATPFGQSAFVSMLRSKKGDIHSQQEICESLKSGTGVTHWVDGAEVPYLRRYDQMVAYENTRSAHIKAVWASMEGVGGLALHNMHQDDPSAVCDNRTAFPILNALSRAQVCQTCLKQHDFKKCEQHDFVVSCNFELKRSTPVFKTDIVPYERCTEVVVEQATLTLGGNVNFNDVQQEQVVKNLTSLRSKMVKCGMVLSLSCGDSEKYLNSILGDNMTFAIGNVMNIMEKFSHYTQKPSTYYSVSLLNRLSHIALRMTDKHSVDLPFFFNHTKPEFPSTEKFVNIWKNVGLKPDKLVLELSPFGWQTGKKVGEKKKMTQGVNCVTAGNRAVYEHDYETLTGMTKHENGTINMPMIEDFRYKIGYIQREQLGGIALNVNGDDYTGICGRGSFPILKSVYSSHKCR

SEQ ID NO: 6024 - protein, 523 aa, Caenorhabditis elegans
MYIKGNAVGGLKELKALKQDYLKEWLRDHTYDLIVIGGGSGGLAAAKEASRLGKKVACLDFVKPSPQGTSWGLGGTCVNVGCIPKKLMHQASLLGHSIHDAKKYGWKLPEGKVEHQWNHLRDSVQDHIASLNWGYRVQLREKTVTYINSYGEFTGPFEISATNKKKKVEKLTADRFLISTGLRPKYPEIPGVKEYTITSDDLFQLPYSPGKTLCVGASYVSLECAGFLHGFGFDVTVMVRSILLRGFDQDMAERIRKHMIAYGMKFEAGVPTRIEQIDEKTDEKAGKYRVFWPKKNEETGEMQEVSEEYNTILMAIGREAVTDDVGLTTIGVERAKSKKVLGRREQSTTIPWVYAIGDVLEGTPELTPVAIQAGRVLMRRIFDGANELTEYDQIPTTVFTPLEYGCCGLSEEDAMMKYGKDNIIIYHNVFNPLEYTISERMDKDHCYLKMICLRNEEEKVVGFHILTPNAGEVTQGFGIALKLAAKKADFDRLIGIHPTVAENFTTLTLEKKEGDEELQASGC

SEQ ID NO: 6025 - protein, 932 aa, Caenorhabditis elegans
MSQYIKCYGRVRPSARLGAPSESLFVGGRVVTIETDNGSKRYELHHIFDSSSSQEDVFGTVAKKIVEDCVEGYNGTVFAYGQTGSGKTHTMLGPCDSWTDQELMGLIPRSVEHVFQHLDTKAKECQKLTFSVSVEFVELYNEVIYDLLNAKNKVQLRDSGKDIQLVGALSKNVDNPLDLMHLVQKGWQERSTGSTAMNAESSRSHALLIIRIKTQERTGELVKERSSILNLVDLAGSERQTHTKSSGDRLKEATNINSSLTVLGRCIRLLADPSKAKGHVPYRDSHLTHILKNSLGGNSKTAVIVNMHPDRDFAQESNSTLMFAQSCTMIMNIATRNEVMTGDQESSYKKAIQELRQEVDETREKVRTEFASQLDEAEVEQLRLKTENNSLRLENVDLRAKYDFALLKYTIGSENEQIVNEFKKIISEFSAANSSSPFECIALKNQTLQLEIEASEKRYQELQKETSALRNRYQENLDATILMQTPSAKERRSSSRPKRRETQYRPSPARMALFAEVETSEDAVLDLQCQNEKLSCELSSLKDKHEEATSKSIETERLLQGEIVALQKEVSIVSESLRKSEAVAEGYKEKVTANNLTLDKLLLHIDASRKRIAELELSSKESENRSSEELEEQRLYYVSMIEDLERKASDEYAALREELNQKTLSSNLLQVQVDELQLSNATIKKLNADLSTKAGLIRSLEDSIEKKSQMITRLEEQAVLDSSELSSTKRQLEHSRLEAIQWRKISEETTSAMQTQLKDHQKDIDQCRHKKKLEIQSMQLSLDNANARVKESEAMMKKLQNDEKQKFDMKMSEIENTFKEKLSVSLKKQEDTIRRQSLAENQGKLEVMENKNRVLSETIESLQSQHSQDTEVINAGLRTRGDRVGYVDKLRVEKKALEETISQLRSENDKLKKIMRGESANKPVLRSQTTKP

SEQ ID NO: 6026 - protein, 352 aa, Caenorhabditis elegans
MDSQKDFNLGDSSKGEKEGMQPSTGNNNNLSSNEVWSVCRAVIDEFKKEQNLMEVSAPVTVIGDVHGNFHDLYRALLARTEQDITDEQKSNFSTRQFVRDKYVFLGNYIDKGPRSIECICLLFAFKICFPQKYILLRGPHECPSVNSSEFLGVMETFSPNHFKKIHKKFNEAFSWMPLAAVVGQKILCVHGGISPRLTSWEDIRKIKRPLKDATEDPLATDLLFADTLDFDLIHIPTRKPKYEFNVIRNMSVMYNEAAVTQFCEKFNLKLIIRSHMKVPFGYRFFSEKRLITIFNSTGFQNESNYGAVLKIDGNAKITIISLLPQQSKAEVQEKAHHSDMTSECNTMSSKGP

SEQ ID NO: 6027 - protein, 345 aa, Caenorhabditis elegans
MATPDTSAAKMAGQDRQKLKVVAWLQNLVERLKGWTPGHCQKLFDEKELIQLCYRAREVFWKNNVKLELKAPVKICGDLHGQYEDLLALLELNGWPPETKYLFLGDYVDRGPFSIEVISLLFAYQVLHPDKVFLLRGNHESRPVNMQYGFFMECRKRFSNALYDAFQLAFYCMPLCAVVSDKIICMHGGISEDLVDLRFEISAIKVYAHYFGYRQLDKVERPCDVPDIGVIADLTWADPDATIQMYAESQRGAGRVFGAEAVKKFLNTHHLELVVRAHQVVMDGYEFFADRQLVTIFSAPSYCGQMDNAAAVMTVDEELVCSFTVMRPDLKKDKEKKAAVGIVPN

SEQ ID NO: 6028 - protein, 1388 aa, Caenorhabditis elegans
MGKEQFREADKALKVVGVKFAPGDCEFMRQTAHVPIFNNKLYEDVEGKLQPANYGPLDPKMGVSTKTGTCSTCGLGLTDCVGHFGYFDLDVPVFHIGFFKLTIQLLQCICKNCSSILLTPEQHRVFSRQVMNPNLDYLHRKALHKRIVAACKKGSTCSHCGLKNGTVKKAVGAVLKIAFASPVSVDELGKFATMFSSNQEVGDHVRKMKFTLLNPLFVQKLFSNIKEGDIPVLMVRSGEEKHPNDLLLTRMPVPPVCIRPSVVSEVKAGTTEDDVTMKLMEIMLTNDVLKKHKRDGAPSKTLFETWEHLQIQCALYINSEMSGLPPDMQPKRAMRAFTQRLKGKQGRFRGNLCGKRVDFSGRTVISPDPNLRIDQVGVPIHVAMTLTFPEIVNASNIEKMRQLVINGSDVHPGANYLVEKKTGNKKLLKYGKRDELAKNLRMGDTIERHLDDNDVVLFNRQPSLHKISIMSHRAKVMPGRTFRFNECACTPYNADFDGDEMNLHLPQTYEAKAEASELMNVKNNLITPRSGEPLVAAIQDFITGGYLLTHKDTFLPRAEVYRFAAALIDASAKKQTKIRIPPPAIRRPVELWTGKQLIELIIRPDKGSDVSLNLTAKNKSYTGNLELCSKDSYVIIRNSVLLAGCLDKSLLGSSSKVNIFYMLMRDYGEDAAVDAMWRLARMAPVFLSNRGFSIGIGDVRPSEQLLREKGQLVDNGYSKCSQYIKELEEGKLKAQPGCTEEETLESIILRELSTIRDHAGQVCLRNLSKYNAPLTMAVCGSKGSFINISQMIACVGQQAISGHRPPDGFEERSLPHFERKKKTPEAKGFVANSFYSGLTPTEFFFHTMGGREGLVDTAVKTAETGYMQRRLVKCLEDLCASYDGTVRSSVGDVIEFVFGEDGLDPAMMEAKDGSVVDFTHVLEHAKNIQTTKEQPIPVDKLDEVLKAEIQKKFKGKYVHFADKLSEYITQTEIKKSKKWQNGKAHCGNHETADLKTKESCKICKNLEAYKTSLLANSCLTKTQLCSFIELCYYKVARAITEPGEPSTQMTLKTFHFAGVASMNITQGVPRIKEIINAVKTISTPIITAALLDPYDESLARRVKARIEKTTLGEICDYIEEVYLPDDYFLLVKLNSKRIRLLQLEVCMESISYAIATSKVCPQMRGCKIVAHGKTMMAIRPPSTSKLSKTMTMQILKYSLANVVVKGIPSVNRCVIHADEKKGDFYSLLVEGTDFRSVLSSVGVDPRKTNFNNALVVADVLGIEAARSCIINEIIATMDAHGIGLDRRHVMLLADVMTYRGEVLGITRNGLVKMKDSVLLLASFEKTMDHLFEAAFFSQRDVIHGVSECIIMGTPMTVGTGTFKLMQKYDKKAVLKQNSPIFERLNVTL

SEQ ID NO: 6029 - protein, 1003 aa, Caenorhabditis elegans
MPFFSSYLKAHITPGPLERAQSSSHGGHGAKADLGVLLGVYLPTIQHILGVTMFIRLFWLVGIAGLGQTFLLLFLCCFCTFLTCISISAVATNGVVESGGAYFMISRNLGPEFGSAVGILFYLANTVATSMYLVGGVEILLLYIFPGLTFGGVEGQHDTSMFGTMTNSLRFYSTILLLIEFAIVAMGVKFVQMLAPVSLVCVILSILACYAGGVTKTIYPDSGQYVCMYNDRLLQSSAVLNESIPLDEICNYCNINNTFLADRVCGGRCNSTTIPHVSPFRCINGFPGFQGGQTLLENLGPNYLEKGEAAHGTQADTKSDVYQDVRTSFFVLLAIYFPAVTGIFTGANMSGDLKNPQASIPAGTIAANLTTSFVYFSLAFIFGGAIDNAVLRDKNGQSVGGQMVVALLSWPSPWVLLIGSFLSTFGAALQCLCSAPRLLQAIAKDEVIPLLSPFKKVTANNEPFLGLILTTIIAEIAILMGSMDTIAAVVDFFFLMCYAFVNIICTLHSLLGAPNWRPRFKYYHWFLSLLGAVLCFFIMFSTHWDYAIVACLLCLVIYKYVEWKGAKKEWGDGIRGLALTTAQYSLMKIEDKEPHPKNWRPQLLLLLSMQWSKEIIDVRYLNLLNLASQLKAGKGLTVVTAFLQGDPTSPDDKKKGEQVKARMDFDMNQVRLRGFAKTLVHSEDQVRGSMSTLVQSVGLGGLKPNTMLISWPVHEREEDMTEYNTFIEKVHAASINDMAIVVAKGIIDFPSAVFRMSGMIDVYWIVHDGGLCLLMGYLLKQHKVWRGCKLRVIGIAQESDNNVKMQEDLQKYVYQLRIDAKIMIVELADPEISKNAFERTLLMEERTMMMRDLQKVSGGGMSLSLPPANAPRAPSPLVTSERRANSKDSDEGTPTESEETTEKKSTSTDNEQANQETKTKKERMKALDRSKVSKMHTAVRLNELLLQHSANSQLILLNLPKPPVHKDQQALDDYVHYLEVMTDKLNRVIFVRGTGKEVITESS

SEQ ID NO: 6030 - protein, 282 aa, Caenorhabditis elegans
MSEISDAEKVRIASDFIKHAPPGEFNEVFNSVRMLLENDDLLKNKCVNAIAQYNVGQFVPVKLDGVAKQTLITPYNDLGNGRFYDEVSKKSFKYDHVRKEAADLQPHPAESGITEQWRQALQTQLDIYIDDHYAKSGTGVVFARNGVFTICIESHQFQPKNFCNGRWRSEWNVPVGDGKSGSQEMKGKILSQVHYYEDGNVQLFSEKEPVLKVNVSADFDKTAKEIIHAISEEETIYQNAVQENYANMSDTTFKALRRQLPVTRAKMDWNKAQTYRIGQEMK

SEQ ID NO: 6031 - protein, 359 aa, Caenorhabditis elegans
MAENTASENDVENVFISMDDKIKGYQVVESIGDGAYGQVFKVSKNAKKYAMKVEPNRLDGGPASITKEIEVMMELNNRGAKFFPIFETGGREPKFHMVVMTLLGENLQVLRMKGCNPKACTPGTWSRIGIQCLFVVKQMHDCGFLHHDLKPANFVWGQSDEVLTSRVFYLIDFGISSKFIRHIKGTPINQQNGFEFRTENKKVHSLVGTPKYTSPKAHAMADLGRGDDFWSLMYMIAELVKPLPWEILEAKMLEKTKLKSKLKDLYGIDAFGKIETMLQACTFHSFPNYEMIYHAFKDVFTKSGASWYDHSIGREKICRLTNDGDRMPRNHVDCSVGKNLTSDFIFERIHFNMHISRIK

SEQ ID NO: 6032 - protein, 274 aa, Caenorhabditis elegans
MARFTDKVAIITGSSNGIGRATAVLLATDGAKVTITGRDAARLEETRQAILKAGISATNVNSVVADVTTAEGQDLLISSTLDKFGKINILINNAGANIPDSQGQTRTKCSIENLTKMFQLNLQSVVEMVQKVRPHLAKTRGEIVNISSIGAGPAAQPASPYYSSAKAALDQYSRCAAIDLISEGIRINVVQPGFVSTGFSTAARGLSADESVKFYDLMGSLPHCIPAGYCGQPDHLASVIAFLVDRKVSEYIVGQTIIADGGSSLVIGCHAPRQ

SEQ ID NO: 6033 - protein, 154 aa, Caenorhabditis elegans
MSGRFSGKDAIITGSSFEIGRATALLFAKEGEKSVIEMTQKIHPHLAKTHGEIFNVSSIVALKFGSGRGPYYPLAKAALDQYIRSAAIDLISEGIRVNTVNPGVVATGFMEVATGLSSEQSQTFYDNVGSNPSAIPCGYSGRPEQIAKAIAFLS

SEQ ID NO: 6034 - protein, 277 aa, Caenorhabditis elegans
MTGRFSGKVAIITGSSFGIGRATALLFAKEGAKVTVTGRSEERLQGSKQALLDAGISDSNFLIVPADITTSSGQDALISKTLEKFGQINILVNNAGASIADSQNRAGLDQGIDTYEKVLKLNVQSVIEMTQKIRPHLAKTRGEIVNVSSVAALKFAHVRNPYYPLAKAALDQYTRSAAIDLISQGIRVNTVNPGVVATGFHESCTGLSTEESQKFYDKVGANKSAIPCGFSGRPEHIAKAIAFLADRDSSEYIIGQNIIADGGTSLVLGFHAQLPQK

SEQ ID NO: 6035 - protein, 426 aa, Caenorhabditis elegans
MTKKNWISIKNYANGFHQKLCKFDEPVTANNVKCVTIVDLRLKLELEKQKGSSFSNGILEIFYSLIYLFPLKDKSFPEMFIFENDIDMSFAKGFMTVVYIVVCLVGTPGNLWIIYKLFRAKLWSGASVQLTVSQRSRIYIFALACSDMFLLLTLPATASYNYHGTWIFGSAACYIIRSIEIFAKLFSVVLLTVMSLERYIIVCTRLRHIYRAWMSLVPLAVGTIFGVLVPTIIHYFYLQHFSVPFDPDVTWVCLPLMSNEVFNLFAQYTFVVGFIIPFAIMTACYIMLVRHVRTKYKMRRAQTTTTLAKPGKEPRYMSEVKKSIWRIAVFHFVCWAPFWGFTMLPNYIYQIDQFLHGDNEEESGGESIFLVYCRLVSNCLPYINAAGNWVLYALLNVDVRKHIYNQPKKKRKFTLKFNPVNTSSNC

SEQ ID NO: 6036 - protein, 1917 aa, Caenorhabditis elegans
MMSSGEDEEQAAADEQERTDLWQQTLQAAVAASSSQDATKKRPAQRKPLRQTNVVERSERSLLCLSLNNPIRKLCISIVEWKPFEFLILFMICANCIALAIYQPYPAQDSDYKNTLLVSHKIKKKHTKDESSNKTSLILFYGNNYKCYFKLQETIEYVFIVVFTIECVLKIVAMGFMFHPSAYLRNAWNILDFIIVVIGLVSTILSKMSIQGFDVKALRAFRVLRPLRLVSGVPSLQVVLNAILRAMIPLLHIALLVLFVILIYAIIGLELFCGKLHSTCIDPATGQLAQKDPTPCGTDTEGSAFKCQPSDSLTNMGVRWECSSNTTWPGPNNGITNFDNFGLAMLTVFQCVSLEGWTDVMYWVNDAVGREWPWIYFVTLVILGSFFVLNLVLGVLSGEFSKEREKARARGLFQKFREKQQLEEDLKGYLDWITQAEDIEPVNEDEQEDEPVAQTVVGEEADEEGEERVEDVRPSKWAARMKRLEKLNRRCRRACRRLVKSQTFYWLVILLVLLNTLVLTSEHYGQSEWLDHFQTMANLFFVILFSMEMLLKMYSLGFTTYTTSQFNRFDCFVVISSILEFVLVYFDLMKPLGVSVLRSARLLRIFKVTKYWTSLRNLVSSLLNSLRSIISLLLLLFLFIVIFALLGMQVFGGKFNFNPQQPKPRANFDTFVQALLTVFQILTGEDWNTVMYHGIESFGGVGTLGVIVCIYYIVLFICGNYILLNVFLAIAVDNLADADSLTNAEKEEEQQEIEGEDEEFEEGEDEGEEHGMDEPEGDEEMTSARPRRMSEVPAASTVKPIPKASSLFILSHTNSFRVFCNMVVNHSYFTNAVLFCILVSSAMLAAEDPLQANSTRNMILNYFDYFFTSVFTVEITLKVIVFGLVFHKGSFCRNAFNLLDILVVAVSLTSFVLRTDAMSVVKILRVLRVLRPLRAINRAKGLKHVVQCVIVAVKTIGNIMLVTFMLQFMFAIIGVQLFKGTFFLCNDLSKMTEAECRGEYIHYEDGDPTKPVSKKRVWSNNDFNFDNVGDAMISLFVVSTFEGWPQLLYVAIDSNEEDKGPIHNSRQAVALFFIAFIIVIAFFMMNIFVGFVIVTFQNEGEREYENCELDKNQRKCIEFALKAKPHRRYIPRNRLQYRVWWFVTSRAFEYVIFLIIVMNTVSLACKHYPSSRGFEDFLDVFNLIFTGVFAFEAVLKIVALNPKNYISDRWNVFDLLVVVGSFIDITYGKLNPGGTNLISINFFRLFRVMRLVKLLSRGEGIRTLLWTFMKSFQALPYVALLIVLLFFIYAVIGMQFFGKVALDDSTSIHRNNNFHSFPAAILVLFRSATGEAWQDIMLSCSDREDVRCDPMSDDYHKGGLNESRCGNNFAYPYFISFFMLCSFLVINLFVAVIMDNFDYLTRDWSILGPHHLEEFVRLWSEYDPDAKGRIKHLDVVTLLRKISPPLGFGKLCPHRLACKRLVSMNMPLNSDGTVCFNATLFALVRTNLKIYTEGNIDEANEQLRSAIKRIWKRTHKDLLDEVVPPAGKEDDVTVGKFYATFLIQDYFRRFKKRKEMEAKGVLPAQTPQAMALQAGLRTLHEIGPELKRAISGNLETDFNFDEPEPQHRRPHSLFNNLVHRLSGAGSKSPTEHERIEKGSTLLPFLTIRNSKKNKRKPRSFSPTHSLAGAEGSPVPSQMHRGAPINQSINLPPVNGSARRLPALPPYANHIHDETDDGPRYRDTGDRAGYDQSSRMVVANRNLPVDPDEEEQWMRSGGPSNRSDRRNPHLREPMLVARGAALALAGMSSEAYEGTYRPVGEGKSVRLPFSSRPVLRPAEDSRPVDRLIGQSLGLGRYADARIVGAARREIEEAYSLGEQEIDLAADSLAPLMQHVGMHDIRDINENSRSALLRPAENSSRQHDSRGGSQEDLLLVTTL

SEQ ID NO: 6037 - protein, 615 aa, Caenorhabditis elegans
MQHVLRTRGNSAQDKNKKHVPNVPPIIYDDMQVPYEKGAFLGEGGFAHCFEFRKLDCNDRLAVKVVPKVILLKSTAREKLTREVEIHRQLSHRNIVQFHHFFEDSQNVYFTLELCSKNSLMELNKQRGPLTEHEARFYTIQVAEGVKHLHNLQIIHRDLKLGNLFLNEHLQVKIGDFGLATFCEKNEKKMTRGGTPNYIAPEVLNETGHAFEVDIWAIGCILYVLLFGSPPFESRRVQETYVRIKNNDYVVPENASPTANRLIRSLLDPVPDRRPTAEAVLLDQFFKTTIEPTYPPVHQQLHKEQDVKYFAPINPVLPHVEEPISPIYQEVANEETSEIRRFVKTEQASSFGDELSQLQAQISHILQNVVASKNKSSTRFGLNHSPEATPIFWVSQWVHFPNHGIGYRLCENSSGMLFNDNTQMKVNSAGNQLTFVDENNTEQFYTMNDQVPMNLQTKINIFSNVQSYMNTHLEADTHLEAEDQCVNKVPPLRNFARLPTIQNWFETKSAVIFHLSNGTVQINFLDHVKMVLCPLLKSVTFIEENKRVSTFTFANILTNSCPKKYLSRIEYAQAKIKLLRPTNNQEHVVYVDSPCRPTTSNTAHGAPLASSRYLA

SEQ ID NO: 6038 - protein, 309 aa, Caenorhabditis elegans
MDIDELELLQEEREEQPIRYLPKVLNGGISGIVGVSCVFPMDLVKTRLQNQKGTSKYTGIADCFKKSWQAGAPGRLNQIKGMYQGASVNIFLITPEKAIKLVANDFFRHALMKDHDERLSTPRGMIAGASAGFCQVVITTPMELLKIRMQQSSDKVKATKLIWNLLTKDGGVRALYKGLGPTMARDVSFSAMYFPLFAYLDGLGPRKKDDSGDAVFWASFVSGLTAGATASLSVTPLDVVKTRIQTGGSNYNGIFHAFYRILADEGVKALFKGAICRMMVMAPLFGIAQTVYYVGSAEKILGLEKGSRV

SEQ ID NO: 6039 - protein, 299 aa, Caenorhabditis elegans
MTIDTELTNGSSESVPFVFIGGGNMAAAIIKGCQNKGFTPKSNIVIGVQTEKSAEKWRQLGYKNVFTNTLEMLERYSTAIYVICVKPQVFEEVVSSWPVNSRPEFIISVMAGVPLKVLNAKLPFVSGNTTIVRLMPNVASSIGAGASTMCYEKNEKIMNQDSHIELAREFAECVGTVELIPERCFNPAMAIGGSSPAWTFMYIESLADGAVAQGLGRAEAKRLAAQAVLGAAQMVLNSNSGFDIETQHFGSLKDMVCSPGGTTIEGVRALEKNGFRYAVMEAVVAASTKADEMAKSLAK

SEQ ID NO: 6040 - protein, 616 aa, Caenorhabditis elegans
MKFGLIHDLSSIYSIQIDTPYDCGAHGYCYPANRTSATTCSECTCSDESTQTSDTTCTAPTSCSPNPCTLSNQQCNMVNDIPTCTCAVGYTGTDCTMLTSDPCSPQPCLQNGVCSSSGGTYSCACATGFFGEQCQYSGDPCSGYCSNGGTCEMLFSDTTPYCQCPFDYYGDKCQTTRSVQTSYVGCFDDSSASFSDYYVYSTTITTGTDCRDALISYREANPTSNYAYSTMSGTTGECLFSTANALTDPPTGGGLLVALLNALLSTCAYSNLNSGFAAVYSLNDLCTPEPCGEAAGNGKCIQTSATAYTCLCNPIKTGSACQSDATLTPCASIDCGVGTCGVTDDQIGYYCLCASTNQTVACVGNPCTSEPCLYGGTCSDLGNGSYSCACLNLYMDTNCETFDSCYINKCENGGTCVPTYNLLDSTFTCQCTPDWKGTYCEEERYYCDETPCENGGECEDIIGPPNSYNCTCTPQWTGFNCTIDVDECVEDTTLCKTKDPDATCVNTNGSYYCVCSPNMFGKSCLFSNSDKIIYQILNATYGDLGPDKLDEMAQELTNDPTLVRDIVPFLIGGYSLEVRTSLSWTAADMFLWVAYEQQLIDLKLVVVFLNMKDRKV

SEQ ID NO: 6041 - protein, 575 aa, Caenorhabditis elegans
MKSKRRDDIVQFCRENTLLVMTMFSVFLGVVLGFGLRPLNLSQETLQLINFPGEIFMQVLKMMILPLIFSSLISGELKLKQLQAFEVQKSVTLAQMDAKESGQMGASTVLYYLSTAVLATILGIFLVTVIHPGDPSIKGTDISEAPSDGNVSPLDTFLDLVRNMFPENIIQATFERMQTTYVAIRPKIASKNGTSGNIIVKRSIGMTKGMNILGIIVFCTGFGIVISQLGERARIVVDFFVILDAVIMRWVVTLMWFAPLGITCLICGNLLELDDISDIASVLALYVFTVCAGLILHTIITVPLMYFFITRENPLPIFKGMIQAAVTAFGTASGSPKNIRKLTITKNDYVGATLPMSMQCLEDHCGVDRRISRFVLPLGSTINMDGNALYEAVAVIFIAQLNNVQLSLAEVLTVSITATIASIGLGSVPAGLVSILLILNTVGLPVRDVSMLFTVDWLLDRVRTAVNVLGDAFAASMVQHLLQKKLDQADARHDYKTELKGEIELLKSAATSRRPSFTMSEASKELFLTHANTAGNSRIGSRIGSRRPSSTNLHLSWRNNNIEPPYTPLPNDENV

SEQ ID NO: 6042 - protein, 751 aa, Caenorhabditis elegans
MAKSVSPEEQAAAQAADEEKTKEELEWAEKGSLLCRIKNQKVKEMALVTIKSKQFLNYYSSYWFNFVPNALKSVALSELLEVRSGYQTDNLQRASKKYEFQELAPESRCFSVIFSHAKFLHKSVDFSADSKETRDKWVSVLTHLISVAKHQRVVFNETAWLIDKFQQADTNKNGLLSFDEVWNLLKRMNLQISERYAKAIFRESEFENSRDNKLNEKEFLNFFERLTDRPDLRFVMTQASSDNVETLTVADLQRFLTEEQGFENVDLKKAEQILTTFEQTVQDKQKEKLMGLMGMRRLMQSRWGNVFKPGHESIFQDMDQPLTHYFVNSSHNTYLTGLQVKGEATVEGYISALRKGARLLELDLFDGEHGEPVITHKRTFIESITLRNSLEAIKRTAFETSPYPVILTLENHVGFVQQAVMADLFKEILGDSLYIPPKDSHRHPLSSPNKLKRKFLLRGKKIILEEDIEEPDEDDSPTDKDKHHVHPHPVAPELSALIGLPSVKLSHNIYQDVNKHPFDGSPSLSENKVYTMFEAAVPIFTYTAERLVKSYPKGLRQDSSNMHPMVSWLCGIQSVAMNFQTAGEELDLNAGLFRINGNCGYVLKPSCLLDGVDPRSMAKPKLKLGIGLFSAQYLPKSEPGKEIIDPYVSVQIFGIPRDETKAKTRIIKDNGFNPEWRDNFYFTLSCPELAIIRFCVKDFDSTSSNDFVGEFSIPVMSLRTGFSQIQLNTGYQHTLDPSASLFVRIAMEEEY

SEQ ID NO: 6043 - protein, 372 aa, Caenorhabditis elegans
MDLSKHIILISVIFVAAVESGRYRRQGLPGLGGLDGFNDLLPCNAFTRCNGKGLCLGTAKQSTCMCFLGWSGDSCDSVANLMDPFNLFSNNNNNNNNNQLFPNLFPTASSLNLLNNPFGLDDDALEMCTASDCNGNGVCVGSKKAPLCLCNLGKTGFKCEMNMDPSAPITFCSPSDCNNKGLCLGTKNSFSCACQIGYTGSRCEKTPVALCDSRDCSSNGLCIGTKDSMTCACYLGYSGDKCEKITGTMCEASDCNSNGICIGTKNLKSCICAPGYYGSRCESRFALLPGTEGMFCEAKDCNGNGICIGNKLLPMCICAPGFTGLRCELEPLCTGALQCSGNGLCIGSLKSYSCTCNLGWTGPTCAQSTLIG

SEQ ID NO: 6044 - protein, 884 aa, Caenorhabditis elegans
MAACGNPSAAVKFERLPTFAEPTHYNVRLSPCLNQFSFDGHATIDVTIKEATDVLKVHAQSLLIQSVSLITQPGDASKSLETSYDDKLNILTIKLPTTMQPQKVQLDFKFVGELNDKMRGFYRSQYKDKNGTEKFLASTQFESTYARYAFPCFDEPIYKATFDVTLEVENHLTALSNMNVISETPTADGKRKAVTFATSPKMSSYLVAFAVGELEYISAQTKSGVEMRVYTVPGKKEQGQYSLDLSVKCIDWYNEWFDIKYPLPKCDLIAIPDFSMGAMENWGLVTYREIALLVDPGVTSTRQKSRVALVVAHELAHLWFGNLVTMKWWTDLWLKEGFASFMEYMFVGANCPEFKIWLHFLNDELASGMGLDALRNSHPIEVEIDNPNELDEIYDSITYAKSNSVNRMLCYYLSEPVFQKGLRLYLKRFQYSNAVTQDLWTALSEASGQNVNELMSGWTQQMGFPVLKVSQRQDGNNRILTVEQRRFISDGGEDPKNSQWQVPITVAVGSSPSDVKARFLLKEKQQEFTIEGVAPGEWVKLNSGTTGFYRVEYSDEMLTAMLPDIASRRMPVLDRFGLINDLSALLNTGRVSIAQFVQVAASSAKEDEYVVWGAIDEGMSKLLACAREMSEDTLKSAKQLVVKMFEQTGAELGFAEQAGEDSQKMMLRSLVQARLARAGHQPTIDKFTQMFNDFLEKGTPIHPDIRLATFGVVARYGGKEGFDKLMNLRETTTFQEIERQTMVAMSQTPEESLLAQLFEYGFEKNKVRPQDQLYLFLGTGATHMGQQYAWKYFCEHIKEFLDKYGGANSSLFQRCLKFAGESFGNEKRAVEFQDFFCNCNVLSDTDRQTLARPIGQTVEAIRLNARLLESNRQIIENLLKQSNV

SEQ ID NO: 6045 - protein, 330 aa, Caenorhabditis elegans
MSDVLLNFIAGGVGGSCTVIVGHPFDTVKVRIQTMPMPKPGEKPQFTGALDCVKRTVSKEGFFALYKGMAAPLVGVSPLFAVFFGGCAVGKWLQQTDPSQEMTFIQNANAGALAGVFTTIVMVPGERIKCLLQVQQAGSAGSGVHYDGPLDVVKKLYKQGGISSIYRGTGATLLRDIPASAAYLSVYEYLKKKFSGEGAQRTLSPGATLMAGGLAGIANWGVCIPADVLKSRLQTAPEGKYPDGIRGVLREVLREEGPRALFKVIFFKRLGRCNYNLYKFQGFWPVMLRAFPANAACFFGLELTLAAFRYFGIGGHPTPSTEVVPLPHDE

SEQ ID NO: 6046 - protein, 685 aa, Caenorhabditis elegans
MGLESDKIKCKVAIMAEIKSRGNLKSSRKIFESAAAKFPNCQAIITGRVIVEENANRGAEAEKLTRDFITKNTDVSGDELIKFINYMETYDSKFGLKAAIQVAKDNLPWAGEENIDQWVNWVNLLISLKSFKSSKLFCEHGMPAARMSSNRQAYYKNNAKEQIGKEKRNEEVVSIRKDKREEAISKRRNINTQIEDDSETSTTPPGPFDANLLRLTVAAAQSSDPAEQLTAVQQARKMLSTDRNPPIDDLIGSGILPVLVQCLSSTDPNLQFEAAWALTNIASGTSEQTQAVVNAGAVPLFLQLLSCGNLNVCEQSVWALGNIIGDGPHFRDYCLELGILQPLLQFINPEIPIGFLRNVTWVIVNLCRCKDPAPSPAVVRTILPALSLLIHHQDTNILIDTVWALSYLTDGGNEHIQMVIEAQVVTHLVPLLGHVDVKVQTAALRAVGNIVTGTDEQTQLVLDSGVLRFMPGLLAHYKEKINKEAVWFVSNITAGNQQQVQDVFDAGIMPMIIHLLDRGDFPTQKEAAWAISNVTISGRPNQVEQMVKLGVLRPFCAMLSCTDSQIIQVVLDGINNILKMAGEAAEQVTSEIEECGGLDKIENLQNHENEDIYKLAFEIIDNFFSSDDETGNVEGAQSSAFGGDVPPVPDAPNGGWNFGNPSNPHGPQIFSLKASIFIFFTCYFY

SEQ ID NO: 6047 - protein, 179 aa, Caenorhabditis elegans
MGLFFSKISSFMFPNIECRTLMLGLDGAGKTTILYKLKLNETVNTIPTIGFNVETVTFQKITLTVWDVGGQKKIRALWKYYFPNTTTLVFVVDSSDIERIPEAKEELFSLLAEPELADSHLLVFANKQDMPNARSPAELTQLLDLGSLKNREWFICGTNAHSGQGLYEGLMWVKKQMKT

SEQ ID NO: 6048 - protein, 2848 aa, Caenorhabditis elegans
MALPSRKLTIANSIDHGNNGNLHIGDIISLYTESSSNQEQRGFLSTLGLVDDRCIVELKDGRPESPPKKFRDCLFKVCPVNRYAAQKHLWTEQKRFQTGDSMFDDDLMNKLKVAADKEREENESEFQKTLGNVIQYGSMVQLLHVKSNKYITVQKNSPAKRERNAMKVYLDRAGNEGSWFIIEPAYKHYAIGDNVSAGNKISLIPNSVSTTQAGHVKSQLHLSSFNLLDHQSAAEVNCLNEPTEWQVFMFLLFDENQQNSVKSGDVVRLFHADQQTFLTLDTIPKQNPPTDVVFLRMTNRPSAADATSSRALWEVQVVQTNAYRGGTAKWNKAYRFKHLATDMYLSAEPSQVQVKPAMNGRPPLLSALSQKSRPMLERTNNPMAMYSDGPNGVTNESTDTTQQNIPSVWVLGPTKSEFPEEDANLLFQLDPSTFMKSNKEVPRRSYVRLLHQSSDKWVHATNATEKQNLHYSSKNEKGWVKVICEKNRVDKETFALLPVNPDEASQSLNVRDLDFANDACKALRNFIKLIKIGQVISKESINSTTQLLIDCILFVTNSSDHLADPLKISDFSPSRDRQKLLREQEVLNQVFLLLKAPFLPRQGTTELGPLLSSPSELSDSRNEIFKTMFQLCYCLLKYSQVSYRKNQEFLAEKFGEIQEQIGFDLMAEDTMTAVLHNNPKLLEKYVKTPHVERFVELVRNNRQGKFLDYLADLCVCRGEANKKIQELICTSVLSSKHRDIFMDTKIIDGEIEVGWAPNFRKLVDIAEGAKSNSDDAEHLDYYRHQLDLLSQMCQEQQYLAIDPPPERRLMNISQQLPAELVLQCMSDNRLPYDLRGSFTRLMLHLHVVRGSPMSAIRHARLWWSIPENVNVSTYESVSVEAYSDGSRMRIGEGIAHKVLATVETYLMGLRNQSMEERQSVNSSKLTYEIVNLAKALAQFNFYSFNDLLQLTQNLLAIINEGPATEQVPSHRAMVNAIRNMSKSMMRGGNKENSKDLAKTPSVTAEEAGRTKEGRALNVKTKLIVAEILQFVMDVRRDYRITMALSWFKNVFPCDEDGSLMHSASINERMASELYDAIYRSSGHELHLDGRDGQLLLAILLQMTMSDYPPLTSIALKVFFRHFTQYQELLEDLKQVQLLVSNNDVENYRQIDRDLFILKNLTEKSELWVHGDRHHSIDTKEVDEKERTTEHDLLDHDLKSPRAFDSGDSMEALMAVLNEHYPSIRNECLQLLNRLLIKDDRNDAAVALQELSDKAPLIAYPLIRQMLVRLTGMCYRKGDPKPDTMNQQLLKNMRVYEVVLEFISVPHDKKHDHDMMKLITLSHEFLRSFCKTNKENQSRLYKFISYEKDAKEGMLRVETIEEVGTLVAIFRNNRELASNVPEELIAHIVGLIEHNSRNPIFLELLQALVCVYDKEIESGQEKVANEICAASDEVRQLYVDNASFEELEAMMKDEKESKGRSSDSRRKLKYHIELVRLLAMCTRGKNGNTELKCASQIPMDHIVRVVTAKQCLVEVKTVYLQLLLHCYIDTDAEMKDAYKTEYVDHILNNLLEDIRSLRVEKLTGAETATLEHYICHTVTEVLIKFFEAPYSALQQAKVDVHHHKKTFSEVLLELTYLEKGKLRGSKSSRNWYRVAECIKRLTKWAEEHNITLPATLAGPQMSGQTSVRQKWQQAASSAKWIGIGKRLNRQNTLNPGHRLYGTSNSMTEHTSANVVTCYHMMIGEFKFYLHPLHAAEGSVLVEVLHTPELLFPEGSALRDQCARGGVVAKLIQHCKTLMQNKQDNLCARVLQTLCKMCDCTKQQLTHQGHRVYNSSVEKGQQLRQLLLQRYFGHHNNHHPPLDRQQSKIGEVIEAVKEKKEETWSQERDLYAIQCKLNDAGASDLVTDIIIMEPSREIFLKAIHLARALLHEGNDKVQHSFYMRMKQKDIHEPFFKAILTRIQTAQNRLKSDMMSCSDSKPKVSSTVLTPLIDAGDTGFNGALFEVPQQVRHPSISEMSQLSNDLTHSIPDLAPYQDEEKSTDALPPEVALVEPILRVLQLLCENHNSLLQNFLRKQSDRTNHNLVSETLSFLDTVCGSTKGSLGVFGEIGEHNFSLITQTLATLTEFCQGPCHENQNTMAMQENGLNIIISLVLNEIKPLADDHMELALEIKSQASKLLLAIMESRHDGENANRVLRNMANMSGGPKQLVHAIKQAYEMTNSNHHMLKSISRDLFRQAEDDLKKKSGPQITVNTVTLPEINVDASGIVSIHTEKNISSSLDDKFNDDDIPSVDPREVGHNIYILAHQLAIHDGELEIWLDGSDEKKDDLTREALNYYKERTAQIEIVRRDRTLERVVFPINDICSYLTKDTKDYVYNNTERDNQGSKVTEFFDEWETMYHEMIWQRKLQDRKWLSWCAFRLPLWTRLSFHFAFIVNALVARYYPLPEHSNSSISLGNLYSWFAVFSSFLLAHYLRHDKIYLHKTSLLILASLCFLLLSSIGVTLTLYIFGILQLVNKIVHVVAFVSNKGLEDRPIAEILACRNLHYLLVYLFICILGLLVHPMIYCILLFDIIFTEETLQNVIASVTRNYQSIVWTGLLALILLYFFSILGFLYFRHDFYLEVDPVENDSSATISSGIPSETCPSEGCPGLQPSEKDDNDDEKKVKSCETLWMCILQTGYQGLRNGGGIGDVLRNPAPWEDMFIWRVAYDMTFFVVLIVIVLNLIFGVIIDTFGDLRAEKNEKEQILKNNCFICGLDRSRFDNRSVTFETHRETEHNIWHYLYYIVMLQIKDETEFTGPESYVAQCVKDRNLDWFPRMQALSLQDSELDTDQSEVKQMKDQLLQMMTLMREIISQNEESRAFMEQFQPR

SEQ ID NO: 6049 - protein, 1966 aa, Caenorhabditis elegans
MALPSRKLTIANSIDHGNNGNLHIGDIISLYTESSSNQEQRGFLSTLGLVDDRCIVELKDGRPESPPKKFRDCLFKVCPVNRYAAQKHLWTEQKRFQTGDSMFDDDLMNKLKVAADKEREENESEFQKTLGNVIQYGSMVQLLHVKSNKYITVQKNSPAKRERNAMKVYLDRAGNEGSWFIIEPAYKHYAIGDNVSAGNKISLIPNSVSTTQAGHVKSQLHLSSFNLLDHQSAAEVNCLNEPTEWQVFMFLLFDENQQNSVKSGDVVRLFHADQQTFLTLDTIPKQNPPTDVVFLRMTNRPSAADATSSRALWEVQVVQTNAYRGGTAKWNKAYRFKHLATDMYLSAEPSQVQVKPAMNGRPPLLSALSQKSRPMLERTNNPMAMYSDGPNGVTNESTDTTQQNIPSVWVLGPTKSEFPEEDANLLFQLDPSTFMKSNKEVPRRSYVRLLHQSSDKWVHATNATEKQNLHYSSKNEKGWVKVICEKNRVDKETFALLPVNPDEASQSLNVRDLDFANDACKALRNFIKLIKIGQVISKESINSTTQLLIDCILFVTNSSDHLADPLKISDFSPSRDRQKLLREQEVLNQVFLLLKAPFLPRQGTTELGPLLSSPSELSDSRNEIFKTMFQLCYCLLKYSQVSYRKNQEFLAEKFGEIQEQIGFDLMAEDTMTAVLHNNPKLLEKYVKTPHVERFVELVRNNRQGKFLDYLADLCVCRGEANKKIQELICTSVLSSKHRDIFMDTKIIDGEIEVGWAPNFRKLVDIAEGAKSNSDDAEHLDYYRHQLDLLSQMCQEQQYLAIDPPPERRLMNISQQLPAELVLQCMSDNRLPYDLRGSFTRLMLHLHVVRGSPMSAIRHARLWWSIPENVNVSTYESVSVEAYSDGSRMRIGEGIAHKVLATVETYLMGLRNQSMEERQSVNSSKLTYEIVNLAKALAQFNFYSFNDLLQLTQNLLAIINEGPATEQVPSHRAMVNAIRNMSKSMMRGGNKENSKDLAKTPSVTAEEAGRTKEGRALNVKTKLIVAEILQFVMDVRRDYRITMALSWFKNVFPCDEDGSLMHSASINERMASELYDAIYRSSGHELHLDGRDGQLLLAILLQMTMSDYPPLTSIALKVFFRHFTQYQELLEDLKQVQLLVSNNDVENYRQIDRDLFILKNLTEKSELWVHGDRHHSIDTKEVDEKERTTEHDLLDHDLKSPRAFDSGDSMEALMAVLNEHYPSIRNECLQLLNRLLIKDDRNDAAVALQELSDKAPLIAYPLIRQMLVRLTGMCYRKGDPKPDTMNQQLLKNMRVYEVVLEFISVPHDKKHDHDMMKLITLSHEFLRSFCKTNKENQSRLYKFISYEKDAKEGMLRVETIEEVGTLVAIFRNNRELASNVPEELIAHIVGLIEHNSRNPIFLELLQALVCVYDKEIESGQEKVANEICAASDEVRQLYVDNASFEELEAMMKDEKESKGRSSDSRRKLKYHIELVRLLAMCTRGKNGNTELKCASQIPMDHIVRVVTAKQCLVEVKTVYLQLLLHCYIDTDAEMKDAYKTEYVDHILNNLLEDIRSLRVEKLTGAETATLEHYICHTVTEVLIKFFEAPYSALQQAKVDVHHHKKTFSEVLLELTYLEKGKLRGSKSSRNWYRVAECIKRLTKWAEEHNITLPATLAGPQMSGQTSVRQKWQQAASSAKWIGIGKRLNRQNTLNPGHRLYGTSNSMTEHTSANVVTCYHMMIGEFKFYLHPLHAAEGSVLVEVLHTPELLFPEGSALRDQCARGGVVAKLIQHCKTLMQNKQDNLCARVLQTLCKMCDCTKQQLTHQGQQLRQLLLQRYFGHHNNHHPPLDRQQSKIGEVIEAVKEKKEETWSQERDLYAIQCKLNDAGASDLVTDIIIMEPSREIFLKAIHLARALLHEGNDKVQHSFYMRMKQKDIHEPFFKAILTRIQTAQNRLKSDMMSCSDSKPKVCKLFLQSYQMFFIGSS

SEQ ID NO: 6050 - protein, 1851 aa, Caenorhabditis elegans
MALPSRKLTIANSIDHGNNGNLHIGDIISLYTESSSNQEQRGFLSTLGLVDDRCIVELKDGRPESPPKKFRDCLFKVCPVNRYAAQKHLWTEQKRFQTGDSMFDDDLMNKLKVAADKEREENESEFQKTLGNVIQYGSMVQLLHVKSNKYITVQKNSPAKRERNAMKVYLDRAGNEGSWFIIEPAYKHYAIGDNVSAGNKISLIPNSVSTTQAGHVKSQLHLSSFNLLDHQSAAEVNCLNEPTEWQVFMFLLFDENQQNSVKSGDVVRLFHADQQTFLTLDTIPKQNPPTDVVFLRMTNRPSAADATSSRALWEVQVVQTNAYRGGTAKWNKAYRFKHLATDMYLSAEPSQVQVKPAMNGRPPLLSALSQKSRPMLERTNNPMAMYSDGPNGVTNESTDTTQQNIPSVWVLGPTKSEFPEEDANLLFQLDPSTFMKSNKEVPRRSYVRLLHQSSDKWVHATNATEKQNLHYSSKNEKGWVKVICEKNRVDKETFALLPVNPDEASQSLNVRDLDFANDACKALRNFIKLIKIGQVISKESINSTTQLLIDCILFVTNSSDHLADPLKISDFSPSRDRQKLLREQEVLNQVFLLLKAPFLPRQGTTELGPLLSSPSELSDSRNEIFKTMFQLCYCLLKYSQVSYRKNQEFLAEKFGEIQEQIGFDLMAEDTMTAVLHNNPKLLEKYVKTPHVERFVELVRNNRQGKFLDYLADLCVCRGEANKKIQELICTSVLSSKHRDIFMDTKIIDGEIEVGWAPNFRKLVDIAEGAKSNSDDAEHLDYYRHQLDLLSQMCQEQQYLAIDPPPERRLMNISQQLPAELVLQCMSDNRLPYDLRGSFTRLMLHLHVVRGSPMSAIRHARLWWSIPENVNVSTYESVSVEAYSDGSRMRIGEGIAHKVLATVETYLMGLRNQSMEERQSVNSSKLTYEIVNLAKALAQFNFYSFNDLLQLTQNLLAIINEGPATEQVPSHRAMVNAIRNMSKSMMRGGNKENSKDLAKTPSVTAEEAGRTKEGRALNVKTKLIVAEILQFVMDVRRDYRITMALSWFKNVFPCDEDGSLMHSASINERMASELYDAIYRSSGHELHLDGRDGQLLLAILLQMTMSDYPPLTSIALKVFFRHFTQYQELLEDLKQVQLLVSNNDVENYRQIDRDLFILKNLTEKSELWVHGDRHHSIDTKEVDEKERTTEHDLLDHDLKSPRAFDSGDSMEALMAVLNEHYPSIRNECLQLLNRLLIKDDRNDAAVALQELSDKAPLIAYPLIRQMLVRLTGMCYRKGDPKPDTMNQQLLKNMRVYEVVLEFISVPHDKKHDHDMMKLITLSHEFLRSFCKTNKENQSRLYKFISYEKDAKEGMLRVETIEEVGTLVAIFRNNRELASNVPEELIAHIVGLIEHNSRNPIFLELLQALVCVYDKEIESGQEKVANEICAASDEVRQLYVDNASFEELEAMMKDEKESKGRSSDSRRKLKYHIELVRLLAMCTRGKNGNTELKCASQIPMDHIVRVVTAKQCLVEVKTVYLQLLLHCYIDTDAEMKDAYKTEYVDHILNNLLEDIRSLRVEKLTGAETATLEHYICHTVTEVLIKFFEAPYSALQQAKVDVHHHKKTFSEVLLELTYLEKGKLRGSKSSRNWYRVAECIKRLTKWAEEHNITLPATLAGPQMSGQTSVRQKWQQAASSAKWIGIGKRLNRQNTLNPGHRLYGTSNSMTEHTSANVVTCYHMMIGEFKFYLHPLHAAEGSVLVEVLHTPELLFPEGSALRDQCARGGVVAKLIQHCKTLMQNKQDNLCARVLQTLCKMCDCTKQQLTHQGQQLRQLLLQRYFGHHNNHHPPLDRQQSKIGEVIEAVKGIHAFFF

SEQ ID NO: 6051 - protein, 676 aa, Caenorhabditis elegans
MAQKPHHIGVRKSWLTWHSQNLEEFRQSQPLVVAQDEVVRRFIRGFFPQNLVVSGNEVITYQKNFKIQYSIYFSYPSLQNFTFFQIVIKRRGNVLIVAGFLQYSRRLDIRRIYWMFGFAEEFLSILLKQPVKLEMAFVESEEDVCSDRANGYNFGVLTCESCKAFFRRNASKHKEIKCPFSDSCQITSASRKFCQACRLNKCFAVGMNSEWLNDLKPKSSIVSGKFKRKKPDMKNNLKVEVDDTEEDLENDDEEQISVPKALLEKLINKANEKSKDRCTCKCQCGFYPITQRLTAYEPKDTTAVNSPQDISFSHHLHHSDSFYSSSTSTLSPMSVISCAPSSHDSSGYNTSQLVTQSPTNYTVSPASIPSSITELSPQMPSQYPPMLSPFQFGVMAQMAAPANFLNFPPMPERTWTPIQAVSTVPVTETLPPNLLEQIHSKIDKYIGVLNEDEITLLEELHVQNEPLNAPLIQWHNPKSIDGVFRIIEEALRRIVNMACQLSLFRELHVDDRKNLLKSGFGELLIVRGLMAYDKSDNSWNHSFGVRGKMEVKVEVLKNPKLEEHYKAHMNLLSTFGEDVRNNEHLMLIFNAAVIFHPHVSNLRDSKRVHSTQAKYFQMLLKLLTFEYGKSRADIAYSNLLNQVVELHRVNRTLLRVFYGLDIAQLDPLIRELCSFE

SEQ ID NO: 6052 - protein, 415 aa, Caenorhabditis elegans
MLRAAGNLSKSMMKSQRRFLNLQEFQSKEILEKHGCSVQNFVVASNRKEAEEKWMSFGDHEYVVKAQILAGGRGKGKFINGTKGIGGVFITKEKDAALEAIDEMIGKRLVTKQTTSEGVRVDKVMIAEGVDIKRETYLAVLMDRESNGPVVVASPDGGMDIEAVAEKTPERIFKTPIDIQMGMTEGQSLKIAKDLQFEGKLIGVAAQEIKRLYDLFIAVDATQVEINPLVETADGRVFCVDAKMNFDDSAAYRQKEIFAYETFEEHDPREVDAHQFNLNYIGMDGNIACLVNGAGLAMATMDLIKLHGGEPANFLDVGGAVTEDAVFNAVRIITSDPRVKCVLINIFGGIVNCATIANGVVSAVNKIGLNVPMVVRLEGTNVDAAKQIMKKSGLKILTANNLDEAAAKAVSSLPK

SEQ ID NO: 6053 - protein, 381 aa, Caenorhabditis elegans
MNTSFVEPLYADVEQLEPVPLLRHSYQLTVLYTVAYGAVFFTGVLGNTFVVLAVWAHKNLNITTDYLILSLALADLFILWICLPTTLINSIFTEWLWGQFFCRLSTWANASTSFASVYTLVAVTADRYLAICHTLKYNTSWDREYTKYVIFAVWLVAAIFGIPNWYNYDLIVWQEGSYGYRLCTSQTDQKLYFLFVNLLLAFIVPFGLISGLYTRIFITVSTHRSLAVDARAREDRVKLRVATMMLTVIIVFACCWLPLYCIFTYFFFFADQRSDLFQITSMLIRPIFQWMSLLSSSLNPIIYIAYSHKYRRAFKSILLMPCKTRYERVRSTILRRHSRGFKSTATISMSNFGTEPTNLGGASSLLIELDGKQVERSTSDC

SEQ ID NO: 6054 - protein, 659 aa, Caenorhabditis elegans
MRFEEEIGSLQMLCDQFQNKINTLEKQMNEEKKDYVQKLHRLHEKNGEAIDKMKQLDHTMQAVSTKVVHLGDQLESVDQPRSRAHDAHQLMQHFDEFLSDQPLNSMIFTDPDKLLESADLVHKLYSISQELNKDKFANVQARIGQRYKVVEDLLIEEFVRSQRDEKKMAEVAKILSEFKGYSGCVDRYVDFLCQSIHPRGDGGEILADCLQLCRTQQPRISAIFPSPHTVMQKLVLNIFTGRMKETITARLRECKDTDDQEHYLRDLAYLYSSTLKMCKELEKLHISPDSAFLSTLTDSIFQRYIATYCSEELKYLNDQCSNLLQRFYESKKHVKKQIGGGLHELKRDVAARLMNVETYGGETFVAEDVAISILQETKNAFGRANQLCDKEELPRHVENIVDVLLKYLYGEHLDYAVETGLAGISLAESKTEPPAYFFSVVAKCTSVILLMIKQFEDPIFPIIKETIVEPSVAKKWQQSLRSLESKMSLGLERQLNSIVGYVKFLFSEQKKTDFRPDSQQIDIRVSPQCQLASRFLANQVAAMELGCDGENLEALQSDLATRLFKFMLTHIQQFTYNSTGAVLLLCDVGELRTLVSKWRVQNALTQWESLQALTNLLAVLPDQVNETAHSSLLENVDRQLIHDFVRLRTDFRSIKNFQI

SEQ ID NO: 6055 - protein, 485 aa, Caenorhabditis elegans
MSGGSSERVQRSVRSVVETKNNIKYGVICDAGSSGTRLFVYTLKPLSGGLTNIDTLIHESEPVVKKVTPGLSSFGDKPEQVVEYLTPLLRFAEEHIPYEQLGETDLLIFATAGMRLLPEAQKDAIIKNLQNGLKSVTALRVSDSNIRIIDGAWEGIYSWIAVNYILGRFDKENDSKVGMIDMGGASVQIAFEIANEKESYNGGNVYEINLGSIETNEDYKYKIYSTTFLGYGANEGLKKYENSLVKSGNSNDSCSPRGLNRLIGEFTVNGTGEWDVCLAQVSSLIGDKAQPSCPNPTCFLRNVIAPSVNLSTVQLYGFSEYWYTTSNFGSGGEYHYQKFTDEVRKYCQKDWNDIQDGFKRNEFPNADIERLGTNCFKAAWVTSVLHDGFNVDKTKHLFQSVLKIAGEEMQWALGAMLYHSKDLKFNLLEQLEVAQSTQQISNFFSFFVILIIVLAVALYRQLQSESTYKKYNFLRTDSKPDFLNV

SEQ ID NO: 6056 - protein, 690 aa, Caenorhabditis elegans
MSQYIKCYGRVRPSARLGASSESLVVGGRVVTIDTDNGSKRYELHHIFDSSSSQEDVFGTVAKKIVEDCVEGYNGTVFAYGQTGSGKTHTMLGPCDSWTDPELMGLIPRSVEHVFQHLDTKAKKCQKLTFSVSVEFVELYNEVIYDLLNAKNKVQLRDSGKDIQLVGALPKNVDNPLDLMHLVQKGWQERSTGSTAMNAESHALLIIRIKTQERTGELVKERSSILNLVDLAGSERQTHTKSSGDRLKEATNINSSLTVLGRCIRLLADPSKAKGHVPYRDSHLTHILKNSLGGNSKTAVIVNMHPDRDFAQESNSTLMFAQSCTMIMNIATRNEVMTGDQESSYKKAIQQLRQEKRGKSTANSSSTFECIALKNQTLQLEIDASEKRYQELQKETSALRNRYQENLDATILMQTPSAKERRSSSRPKRRETQYRPSPARMALFAEVETSEDAVLDLQCQNEKLCCELSSLKDKHEEATSKSTETERLLQGEIVALQKEVSIVSESLRKSEAVAEGYKEKVAANNLTLDKLLLHIDASRKRIAELELSSKESENRSSEELEVDELQLSNATIKKLNADLSTKAGLIRSLEDSIEKKSQMITRLEEQAVLDSSELSSTKRQLEHSRLEAIQWRKISDETTSAMQTQLKDHQTDIDQCRHKKKSEIQSMQLSLDNANARVKESEAMMKKTSG

SEQ ID NO: 6057 - protein, 455 aa, Caenorhabditis elegans
MSDQPPAENADVRQRRAPESPVTERLRAPARDDARPTSDESDMEGILQDEDRLERLTQAIPQDKGSLGVFADSMLEALPPRWRNWVVRGLFSIIMISTFTFIVTRGATWLMFLVFLIQFKCFQEIISIGLAVYRLYDFPWFRALSWYFLLTSNYFFFGESLIDYWGIVLKKDNFLHFLVAYHRLVSFALYCIGFVSFVLSLRKGYYMRQFSLFAWTHLTLLLIVSQSFFIIQNIFQGLIWFLAPVAMIICCDIMSYMFGFFWGKTPLIKLSPKKTWEGFIGGAFSTVVFGILLSLALYNRPFFVCPVQHYQTDSSNCTIPLAFQLQDYPVPRPFSFVYKILRKEPIIQLCPFVFHSIALSLFASILGPFGGFFASGFKRAFKIKDFGDVIPGHGGLMDRFDCQLLMGTFVMVYIHSFIRVPDASKLLKQIMTLEPQDQLNIFNLLQSELSKTGLI

SEQ ID NO: 6058 - protein, 433 aa, Caenorhabditis elegans
MSQNSLPSEVSNATIDKELYYHGLLPSEDVRQLLSNNGDFLLRSSEPEPGSPRTHILSVMFNNRLDDINSIKHFVVNFVDGKYFINDKMSFPSIQKMLGTYQRNNTEIKEGCMLVNPIRRQFWELEHDQITIHKKLGEGAFGEVSSGVMKFKKGMKTVQVAIKQVKLDKTGKAKIKDFLAEARTMRKLGHQNIIKFYGVGVLQEPLYLVMELAVNGALDSFLKKNEDLSVDKKTEMILQAAWGLEYIHGKPMLHRDIAARNCLYTDGKVKISDFGLTRNGTVYQIKPNTKSPIRWLAIETIKTMICSEKTDVWAYGVLCWEIFNNAAEPYPGMKPADVATQVANGYRMPPYPHAQAEIQTMMARCNAENPNDRPSMAEIAEILQRVTETPRPNFTAIAKKEAEELLLMNSVTTKTTARRKKSNVKLPKGMSKN

SEQ ID NO: 6059 - protein, 180 aa, Caenorhabditis elegans
MGLTISSLFNRLFGKRQVRILMVGLDAAGKTTILYKLKLGEIVTTIPTIGFNVETVEYKNISFTVWDVGGQDKIRPLWRHYFQNTQGLIFVVDSNDKERIEESREELHKMLNEDELRDATLLVFANKQDLPNAMTAAELTDKLGLHNLRSRQWYIQATCATQGHGLYEGLDWLSNQLSKT

SEQ ID NO: 6060 - protein, 987 aa, Caenorhabditis elegans
MGPAPYWPLGPPPNTNTSEGEKVIFDCTTYGKPTPKVTFYKNGVEIESQKDDRYLIEGTRLTIFDVKKGTYGKGDNAVYQCKSENKHGWLWTNFYLNLLAFKPQLLIDPGKEEVEAVAGKKVTLECKFFASPNAAVKWEAPMISGSKGNQIPADAYGVGKLVFSEVTAAEEGEYECIGTNKYGQATGLITLKVRKPTIVQPFPRVEEVRMAGEEMRLACDATADNQLEVKYEWLVDGKSLPEDRISSGHYKIDDDHSLVISNPTQDDTAKYKCVVSTKLDQVEKEIKIQFKDVPVAVHSAWVQTCDKNSLTAFIKFEHYESIHTIAPIKEFWVQYQIDSETEGSQWRTHPVPSAAHPNDKIDNNLRHTTGDATVSLQPFGKYVFRVIARNSVGDSAARLAKDQCETPAKQPDKNPDEVAAKGTSPENIIVQWKPMSREEWNGADFHYVVKYRPKDEDQRVGDWKEVAVEDPFADRVTVNLDDEKDVKPFQPYEVQVQAVNSEGRTNVVPETVEGRTGEGVPSSIPSGLRVLEKSGTTVTLAWNGVDPQTANGNFTGYKITYWVDEADQDSDDSSEDDEDDEKRKFRWKRSIRVKRQSGIRKTVVFGPSATQGTLTDLKPATLNHAYIQVTNGAHEGSASDTIDFQTDEGVPSPVRSLRAYPMNSKVGGEKGVVVLVWKKPRQTNGKLARYEVEYCKTQNGKLVEKSCPRKQIDADSKEIRITGLENETPYRFILRAHTSAGEGDPNSSDATTLPETTAAGVDPGVPSLVENAIGDKYFNVSFRPAKYDDESRAPVGNTYEVQYKPQDADEWETVKPADDGLTVHVDGLSPGTKYDVRVAALQVDPEGGETTKTLSGISKITTTGTSSRERNVYLLILLLLILLLLLIICCICCVVCRQRGQNYPVSQREREQGREPILGKPDYKTDDDEKRSLTGSKAESETDSMAQYGDTDPGVFTEDGSFIGQYVPQKSLMPAERPEKGSTSTFV

SEQ ID NO: 6061 - protein, 583 aa, Caenorhabditis elegans
MEQLDVEDWEYWGDEYLEEEPTYAIRPGTRVVKVERVPMMRGDLRTSGATSSSGPATSYIIRPSDKQPTVSSGGSQNGDSVCAVCGDGIAKLHYGVLACYGCKGFFRRTLTGKYRYACRFSNNCIVDKFQRNSCRYCRFQRCIQAGMDPKAVRPDRDQTGKQKVPRIKKKQIDEELLNHMMRLQGDDWSRKLPVETRILLMQLMSIEDKVVKGDNNMSAQNTAKDPKSISLREMFESKPALDGRRMEIGYEPFRMARTEELGVIAHRRAIAAVDWVDSLTEIADAVDTEDKVALVKSCYSPLTIFNFSARTAQNTKNPDILCLCSHSFVPRRLPPEFNETNHLSNFLIDRTLNELVAPLRKLNLKEEEIVPLKAIIILNPNAKGLSEHARHAISELRDKVQDMLFQIVKELHPIYSASSRFGNLLLLLPTITTLSGLMSENMHFCQALGGRASGDNLLAEMFGDRTFDDQLISSSISPPLFENPAEICLESISPPMSDRRFVRRVDVATQTNDDLLSSGPYLPHSNSCSSMLNAGYSPPMLSTSPFPLLDDNDSAFQNDISLTELNGCEEFFSQLMDQPIIDS

SEQ ID NO: 6062 - protein, 487 aa, Caenorhabditis elegans
MADDKSFDVNMFLKRHLIVKSWANYRQLEYTKSELIQLIDLVTPALKEDNSLAQISPPVTIVGDIHGQFHDLIRILNYNVPKDDAKKKSGYGFCNNRFVFLGDYVDRGSHSIECISLMFALKIIYQTNYILLRGNHETRAINYAYGFREELVNRLGPADGKEVWEKFNEVFAYMPLACLVGEKILCMHGGISPRLNTLEDIKNIDHPLFEIGNDSLAQDLLWADPTDGQGLIAVSQTPAYPKNIVRGLSVVFNEAAVHDTCKRLGIKLIVRAHQMIPEGFKFFADQKLLTIFSAPRYMNETDNHGATLKVETNGRLSIGRLRNMKALHPNVAADEITRGDDMPSGAKVAKKKSNSMTVSASKSSSSSNSHGKGKNKKMPALITDILISMDDRFLYISFWLHGDIQYDISDPLNVKLNCQVYIGGSIHTESNVKVLEDEKPIEALYVKGRKIEGGPQMLQLSLDGKRLYVTTSLYKKWDDQFYPEHVK

SEQ ID NO: 6063 - protein, 501 aa, Caenorhabditis elegans
MASVPSSSSLPVSHVRRHEDVSTPSAPPTKRSNNQSQPPESYEPNTWLQQQREQEQQKKLAAENIKKQSIEATGNNEMVGEEEEDILSKPCGPHKRRFQFVMIRNITFAIPEGYDVEPNSIEYLGGGSFGNVIKTSAVCRDGLRRYVAIKKMREPFFDPHHARRIFRETKLLQLMRHDNIICALDIYTPDEENDFRDVYVVTEFAGRSLYQILKQQRDYGRRVLTDEHIKFIIYQIIRALKYIHSANIIHRDLKPGNLALTDDSDLMILDFGLARSLEKKDTSLTQYVQTRWYRSPEVIYWKIDSYTNLADMWSLGCIAAELLTGEPLFPGDEPNAQYQRITQLCGSPDEELLTKIENDNSSAIKAVIQSYTTHKRRNFRDVFSAHNPSEDFIDLLEKLLVLDPEKRITVEEAIQHPYLAEFSLPEDEPRADHIFDLDDSQARTRFEWRGKAQRSRNRILHTCKFEKQQMQKYFITDAVWKEIMNYKRLSSSPLIPGEADR

SEQ ID NO: 6064 - protein, 448 aa, Caenorhabditis elegans
MGMSATMGDSASIPGVFFADFGPAPPEITPEGYHEVELNKTKWVLPQWYNSLKPLGEGAYGVVCTAEYEPTGDRVAIKKFFRPFQSTIHAKRTYRELKLLRTLQHDNVLEMIDVFTPDPDASSLNNVYFVSVLMGSDLQNIMKIQRLTDEQIQLLIYQVLRGLKYMSHQNFNSTIILKKLMHPFQRRNTRFRLYIHSAGIIHRDLKPSNIAVNERCEVKVFLSFSQLSFLILSFFKILDFGLARAQDAEMTGYVATRWYRAPEIMLNWMHYTQTVDVWSVGCILAELVSGRPLFPGDDHIDQLTKIMSVVGTPKEEFWSKIQSEEARNYIKNRSPIIRQDFVTLFPMASPYALELLEMMLILDPDRRISVSSALRHDYLREYSVPNDEPVAMDTVINSIVTIDPAEERATTLSDWRELIWNEIRLFQNSARRLSFVSCTDTEEEPMKI

SEQ ID NO: 6065 - protein, 367 aa, Caenorhabditis elegans
MQPSEDEDSMPRNNEEFKTKKDRYKVLALLGKGGYGAVYSVLRLSDMEKFAIKCENAAACRKALYMDCNVLKGAAKIQSRHFCTVIDQAAVKNRFNFIVMKLIGKNLWDLRMDTAECRFTKGTSLKAASQCLISIEELHRFGFLHRDIKPGNFAVGRKESNEHHTIFMLDFGLCREFVKRGEGRLRTQRAKSQFRGTTRYAPINSMLEIDTGRKDDIESWLYMVAEWTSGGLPWRKFKATEREKVLKYKKDVRTDKEIMADLFYNCPLKEFERILKYVDELDFYSEPDYKFVYCCLQHAAAASKIKDTDPLDWDPNVPYMGPIETIGDGKVIELDVDQGMSTEVSFNKTGRDRETADATKRVEIKKK

SEQ ID NO: 6066 - protein, 308 aa, Caenorhabditis elegans
MFQPTIFVFSFLIPLVSAQCGPGAIYQASGSRCLNVFRTASSFQSAEEICATLSGHLVSIHNTIDNTFISSQAQKYFDGGVWLGAKTTAPDVTNPLNWYWTDGSNFDYQNYKVGQPSPQGDTACMQLQTGTAKWQTTNCTAQLPFICSYSSSVTPTCPSVTIPSHCPSGYTWYDETDFCYKNTVRFTSFNDARSSCQADGGDLASIHSANENQFLVDLSKAGITNKDKSHSDDVFIGLVYQNSKWQWTDGSAVNFLNWGDGEPNNMDKEWWTSLVADPHEDKNTENTRWNNVAQIDMRAFICKKAPLH

SEQ ID NO: 6067 - protein, 577 aa, Caenorhabditis elegans
MKKLKRRLSAAFRPGSNNNVSITSSGGSYYDSDCEGRNNIVIGYGMMSAPLHGRTWTLSESMSHLSDKNGAILEECAVVDPTALLRVSRGGTAGRRYDTNVNYINGMHVPPPRTHSLYYPRGYNSRRNSYYGSNASVVQESMILGSDGESVEVSPCTSDQTPTGVPPRYIVNVKMRQKTARKWSEEEIQKRLSLPADLRLPVAVVDKLNRTPTLDQPLTRKNRRASLSEIGFGKLETYEKLDKLGEGTYATVFRGRSILTNKFVALKEIRLEQEEGAPCTAIREVSLLRNLRHANVVTLHDIIHTDRLLTLVFEYVDRDLKQYMDSCNNAMQMNNIRLFLYQLLRGLAYCHQRRVLHRDLKPQNLLITAKGELKLADFGLARAKSVPTKTYSNEVVTLWYRPPDVLLGSTDYSTHIDMWGVGCILFEMIAGRALFPGGTPTEQLGLIFRTLGSPRPDRHPTICEKPTFYPYANRHYNPDPLCRQIPRIDAHGFELLMKFLQYEGKDRVSAAEAVKHPFLRTIAVKCCHLRDEQSVLEADGIHIERELLASDHHHSSRRHHRGTLVKDKYRMHSSHHT

SEQ ID NO: 6068 - protein, 265 aa, Caenorhabditis elegans
MSSASQCGLRYVEVNARDAAKSRIARVVGGFETVPGAFPWTAALRNKATKAHHCGASILDKTHLITAAHCFEEDERVSSYEVVVGDWDNNQTDGNEQIFYLQRIHFYPLYKDIFSHDIAILEIPYPGIEFNEYAQPICLPSKDFVYTPGRQCVVSGWGSMGLRYAERLQAALIPIINRFDCVNSSQIYSSMSRSAFCAGYLEGGIDSCQGDSGGPFACRREDGAFVLAGVISWGDGCAQKKQPGIYTMVAPYLSWISAIINGQPV

SEQ ID NO: 6069 - protein, 182 aa, Caenorhabditis elegans
MNIRCARVDDLMSMQNANLMCLPENYQMKYYFYHALSWPQLSYIAEDHKGNVVGYVLAKMEEDPGEEPHGHITSLAVKRSYRRLGLANKMMDQTARAMVETYNAKYVSLHVRVSNRAALNLYKNTLKFEIVDTEPKYYADGEDAYAMRRDLAKWAEERNIEPADREAYTTAKTTDDKKKNRS

SEQ ID NO: 6070 - protein, 873 aa, Caenorhabditis elegans
MGSLSRSEEMRFCQLIVEKDAAFNIVAEIGKQPYVQFKDLNPNVNSFQRTFVKDIRRYDEMERKLRFLESQIVKDEIVIPGRVDTGDYTILPTSELNTLEGTLTELEKDVKSMNDSDSQLKANFMDLKEWDAVLDKTDEFFQGGVDDQAQEELENLDEEGAVPRVEKGPVNYLVGIIRRERLNGFERVLWRACHHTAYIRSSDIEEELEDPGTGEKVHKSVFIIFLKGDRMRSIVEKVCDGFKAKLFKNCPKTFKERQSARNDVRARIQDLQTVLGQTREHRFRVLQAAANNHHQWLKQVRMIKTVFHMLNLFTFDGIGRFFVGECWIPLKHVEDVRKAIEVGAERSGSSVKPVLNILETSVTPPTYNETNKFTAVFQGIVDSYGIATYRELNPAPYTIITFPFLFSCMFGDLGHGCIMLMAGLWFVLREKNLQARNIKDEIFNMFFGGRYIILLMGLFSIHAGIIYNDMFAKSFNIFGSGWKNPYNASEIEGWINRTEHGKEMLVELAPEDAYDHAGGPYSFGVDPIWNIAENKLNFLNSMKMKLSVILGISQMTFGVILSFFNHTYNKSKIDIFTVFIPQMLFMGCIFMYLCLQIILKWLFFWTKEATVFGQIYPGSHCAPSLLIGLINMFMMKDRNAGFVVDGGKVNGEYREVETCYLSQWYPGQSVIEMILVVIAVICVPVMLFGKPIHHVMQQKKKAKELHGNATVRANVVSDSSEIVLNGGSKKEGAAHEEHGHGGHEDESFGDIMVHQAIHTIEYVLGCVSHTASYLRLWALSLAHAQLSEVLWHMVFVTGGLGISGTAGFIAVYVVFFIFFVLTISILVLMEGLSAFLHTLRLHWVEFQSKFYLGLGYPFVPYSFKTALQEAEAA

SEQ ID NO: 6071 - protein, 467 aa, Caenorhabditis elegans
MSTLVNALGFFTSSTPAAAATKDVRSKEEILKRRKDTIGSKCQIFYSDDPFMVSRASMQYLYDEKSNKFLDCISNVQHVGHCHPKVVEAISKQLATSTCNVRFVSTQLTDCAEQILSTLPGLDTVLFCNSGSEANDLALRLARDYTKHKDAIVIEHAYHGHVTTTMELSPYKFDHGSTVSQPDWVHVAPCPDVFRGKHRLADNELTNEDKLYAAGKQYSDDVKSILNDVESRQCGVAAYFAEALQSCGGQVIPPKDYFKDVATHVRNHGGLMIIDEVQTGFGRIGRKYWAHQLYDDGFLPDIVTMGKPMGNGFPVSAVATRKEIADALGGEVGYFNTYGGNPVACAAVISVMKVVKDENLLEHSQQMGEKLEVALRDLQKKHECIGDIRGVGLFWGIDLVKDRNTREPDQKLAIATILALRKSYGILLNADGPHTNILKIKPPLCFNENNILETVTALDQVLTLMNR

SEQ ID NO: 6072 - protein, 313 aa, Caenorhabditis elegans
MSGGGDSKPIDKKKEDKKGFDTRKFLIDLASGGTAAAVSKTAVAPIERVKLLLQVQDASLTIAADKRYKGIVDVLVRVPKEQGYAALWRGNLANVIRYFPTQALNFAFKDTYKNIFQKGLDKKKDFWKFFAGNLASGGAAGATSLCFVYPLDFARTRLAADVGKANEREFKGLADCLVKIAKSDGPIGLYRGFFVSVQGIIIYRAAYFGMFDTAKMVFTADGKKLNFFAAWAIAQVVTVGSGILSYPWDTVRRRMMMQSGRKDVLYKNTLDCAVKIIKNEGMSAMFKGALSNVFRGTGGALVLAIYDEIQKFI

SEQ ID NO: 6073 - protein, 540 aa, Caenorhabditis elegans
MTSTPSSSSSSSLEQETLLKPEDVEAVVQTPIVPKKSLEMMVEEKKVGSLDDFITLRWYCMLVLLMAELTAFTATASSKVMVFAGANPAVIGCGGTPLNGCHELAAFRNETNLCEPDLRYQFKSVQVEFNYICEDAKKVKNTITVQTFGVLVGAAIFGQVSDTFGRRKALLISTLGNGLFNWITAYSPDLFYFMVWRTLAGVFTGGVTVVQMVFMVENIPRKDRMWIQNSITWSPNLILFPFVAWLCQDWRTMSVVIAASSIATFLACLILEESPRWLIQKGRIEEARKSLIRIRKTDKLYDETFEKQLDEVLHVEAEKHARSSKKAKKYTFIHLFCTWKMIAQSLTFITGITCTTFIVYSLMYNMEKLSGSLYWNLAIMGASRWIINIAVSIADYKLPWFGRKMINQIAMICTLFALLMIAVYLYFGYNGQLIAIGTVAAVSMCSQLFIAKYMMVNELYPTAVRNLAVSAVSTMSRIGSMFSPQLFYLSDYAEWIPYAVLFSCQLYDFIVLSLFLPETKGVILENHLPPKHKRIFGKRS

SEQ ID NO: 6074 - protein, 94 aa, Caenorhabditis elegans
MTTGNNDFYYSNKYEDDEFEYRHVHVTKDVSKLIPKNRLMSETEWRSLGIQQSPGWMHYMIHGPERHVLLFRRPLAATQKTGGNVRSGNAVGVR

SEQ ID NO: 6075 - protein, 581 aa, Caenorhabditis elegans
MSVFKCLPTIYFLPLVRECRIRAFETIGNALRLNSFLRNLDATQIEKISSAMYPVEVPAGAIIIRQGDLGSIMYVIQEGKVQVVKDNRFVRTMEDGALFGELAILHHCERTATVRAIESCHLWAIERNVFHAIMMESAREKTMSFKRHLKYSARFGGYPEEVLLRIAEFCTEMRYDAREELVVKPQYVYLVCRGSVLCDDQGEVSKIVAGQDFELRCGRKGRFERFFVLEGPAHLIKMHVEQLCKALDTTDLDDEIRPRASSTIEEADVELEDLQRVSTLGMGGFGRVELVRSASSRTYALKIMNKAHIVETKQESHVVSERRILMQCDNDYIVRMYKTYRDSEKIYMLMEPCLGGEIWTILRKKGRFDNDLTRFYCAGAMEALEYLHRKNIVYRDLKPENMLLDRNGWPKLVDFGFAKKLKNGGRTWTFCGTAEYVAPEIVLNKGHDLSVDIWALGIFMCELLTGSPPFSSTDPMVTYNAILKGLEKWAWPRFVTKEAIDMMLSLCKYEPTERLGFGDIGEIRHHIWFDNFDFVGFRAHRIRPPFIPSVANDIDTSNFDTFPAFDNFASGSDESGWDIDF

SEQ ID NO: 6076 - protein, 1321 aa, Caenorhabditis elegans
MVVTRGLDNDVDDEREAWKQSILRAKDVMPEKVINTASGPLVALLEGTSGHHHWTETNHPRPTFCNYCREKLNGVPWHGYTCDICKVKAHRKCRDNLTEQCKWTNQSSIPQHLQFISPENSILPHQWMEGNLPMPSKCSVCEKPCGSVRKLIIFFLVPFEKKTSNFLQFQFKFLKKNKKMYDYRCIWCGCCVHDTCIGNLARACSLGHSALSVISPLAMKEVTPNGTAVLREEAYGGDSPGGSPLIVLINAKSGDSQGQRIIKKFRRILNPIQVFDIIATGPDFALTFFSHLESFRVLVCGGDGTVGWVLSAFDRLNLHSKCQLAILPLGTGNDLARVLGWGHAFYDDTLLPQVVRTMERAHTKMLDRWSVLAIEGPQADAVRRYEELVIEKVRTFLEAEQTWDIIHAANQLCTTIRDLVHSVSHTYSDLENNKLKLDDESRLGGSDTMTENCNTLLGKLDRLMKSLKEDANCLEESGFEPGDDDDCSTGDEMLKKRDSVVNRANSLKKAFREVISMAEKGIDQHYRDPNTACTKRERFRKKRSKTTPSVLTISHSNLSSSSACSPPCSPAGEDPPQDDQKEFRSASCKATFEISHSQSSSSAVLTALFNAQSARTYDELEKPSIGTVHPPTPGATREPSTAYDDDEENENVENRKEIDQKSNSKKSSVSTPEDITKGSPDRPRIYSDTTLNKNMEKMKSQSLHPICSSADKMKQSHSDSSLYADYEHLEGSSSGCGAGASGSTLSPARASDSATWSRIKERKRTVGSDLGLSSSSHLRSTQYKEMCVMNNYFGIGLDAKIALEFHNKREESEKTRSRSKLFMWYGILGGKELMHRTYRNLEQRIKLECDGVPIDLPSLQGIVILNIPSYSGGANFWGRNKDGPEFTVQSFDDRILEVVALFGVIHVATSRVPNAVRLQNHRIAQCRHVRIVILGDEPIPVQVDGEPWLQPPGIMQIVHKNRAQMLARNPVFDATLKKWEEQKEKASTTTAPSTPTALGAPTSDIISFLTRAREFLRLIEGEIARLGVSSVLLQSLDDANAIVKGGASGEEDPEAIDDLEEREETVASVERVVELLEDHFGFPERTRAPVGQPKLGPTPHFNFEIHGDDPDHWRYIINSIRQDMDREEAAIREARKQDLIAGKPKRSRFTAWFHKRFGTRSAPFAFANIPYWTSEEVCAWLSSIGMSEYGSTFRKNDIQGSELMHLERSDIMDIGITKIGHVKRLQSAIVDLRAQNQRARRAQARKKRVAKDYKPDHSGPSGAGGAVDKRKESSAERYADGQPSTSSTGATTSSGKTRRIPPKDGESAPAVMQMDPASTDC

SEQ ID NO: 6077 - protein, 1372 aa, Caenorhabditis elegans
MVVTRGLDNDVDDEREAWKQSILRAKDVMPEKVINTASGPLVALLEGTSGHHHWTETNHPRPTFCNYCREKLNGVPWHGYTCDICKVKAHRKCRDNLTEQCKWTNQSSIPQHLQFISPENSILPHQWMEGNLPMPSKCSVCEKPCGSVRKLIIFFLVPFEKKTSNFLQFQFKFLKKNKKMYDYRCIWCGCCVHDTCIGNLARACSLGHSALSVISPLAMKEVTPNGTAVLREEAYGGDSPGGSPLIVLINAKSGDSQGQRIIKKFRRILNPIQVFDIIATGPDFALTFFSHLESFRVLVCGGDGTVGWVLSAFDRLNLHSKCQLAILPLGTGNDLARVLGWGHAFYDDTLLPQVVRTMERAHTKMLDRWSVLAIEGPQADAVRRYEELVIEKVRTFLEAEQTWDIIHAANQLCTTIRDLVHSVSHTYSDLENNKLKLDDESRLGGSDTMTENCNTLLGKLDRLMKSLKEDANCLEESGFEPGDDDDCSTGDEMLKKRDSVVNRANSLKKAFREVISMAEKGIDQHYRDPNTACTKRERFRKKRSKTTPSVLTISHSNLSSSSACSPPCSPAGEDPPQDDQKEFRSASCKATFEISHSQSSSSAVLTALFNAQSARTYDELEKPSIGTVHPPTPGATREPSTAYDDDEENENVENRKEIDQKSNSKKSSVSTPEDITKGSPDRPRIYSDTTLNKNMEKMKSQSLHPICSSADKMKQSHSDSSLYADYEHLEGSSSGCGAGASGSTLSPARASDSATWSRIKERKRTVGSDLGLSSSSHLRSCRNMLSGFAGGSLIAEILLLNARVLSQMSSRRNSAANIANQIPTSDCQTPFTQYKEMCVMNNYFGIGLDAKIALEFHNKREESEKTRSRSKLFMWYGILGGKELMHRTYRNLEQRIKLECDGVPIDLPSLQGIVILNIPSYSGGANFWGRNKDGPEFTVQSFDDRILEVVALFGVIHVATSRVPNAVRLQNHRIAQCRHVRIVILGDEPIPVQVDGEPWLQPPGIMQIVHKNRAQMLARNPVFDATLKKWEEQKEKASTTTAPSTPTALGAPTSDIISFLTRAREFLRLIEGEIARLGVSSVLLQSLDDANAIVKGGASGEEDPEAIDDLEEREETVASVERVVELLEDHFGFPERTRAPVGQPKLGPTPHFNFEIHGDDPDHWRYIINSIRQDMDREEAAIREARKQDLIAGKPKRSRFTAWFHKRFGTRSAPFAFANIPYWTSEEVCAWLSSIGMSEYGSTFRKNDIQGSELMHLERSDIMDIGITKIGHVKRLQSAIVDLRAQNQRARRAQARKKRVAKDYKPDHSGPSGAGGAVDKRKESSAERYADGQPSTSSTGATTSSGKTRRIPPKDGESAPAVMQMDPASTDC

SEQ ID NO: 6078 - protein, 1544 aa, Caenorhabditis elegans
MGTTVRVSPNSQSESLQILVNDEDLQPGMPPATYQYILTGLGATIFAVDQRGFVYLNVPKIDADPPNPSTYQLNVEAREVNTVPTRRSEPVTITIHILDINDNSPQFEQPIYMANTTASGDERDVVKVVATDVDSGAFGQVTYTIAQVTNGGEDKFRYETATNMLVATGNLVPGERYQVVIEAIDGGGRSSQAIVIVLALDPMHQTFSSLAPLPGMETFMPNPLAMATTPGTMVTSAESEETIQTFVTEVNENTPPNTVVVSLGDESSRELTYFNVVGGNEEGKFAIDDAGTIVTAEELDREKTAMYSLQVETRSRNPDQHLYWTLVQVTVMDVNDNAPTFTDPQPIRLRLSIDDIEQLTGNMIIGRIGVEDADADDNGRLELRIMPPHNKLFAISNDGILSVNGDFTAAHFGEHDLTVVARDHGEPSLETRARVQISIFGTLITMATVAPTNEVFEYTSSVEEEPQTTNPDEHLQTVTTSPSTKNQVSQQIFSSFPAPQVEQTGAPVEPEFPQFPTFPTLSPHPQIDEETEEDEEVTDEYPDTVATVPTVTVAPDYSEEYGQEASSSSSTILPDVQGVWSEISELPSENPITYTESPITESTAPAPETSPETAPEITPERGSSAENELYPTEIAPENVEKPTELAPDLSETTENTENQWLPDVVETSQVELPSLPTTKMAPPQPVPTQSPPLPTPKRLAPVFKPSQITVQIDENESQVEITKAHATYPDGLSGTITYVLHKGDPSLFSVSSYSGSVNLLRALDAETNSTVTIQISTSEAQTLEVDPKLAHFVSITINVADKNDWIPNFESASYEFDVKEDTLPGTIVGQVNAFDQDRDEPNNRIRYRLLSAGGLEAHFNVNAESGLITLARPIDAFAGEKITLRIEGADSGMLPLSSTTTVLINVVATSSHLIPDASPVSNTPNEGELQFSLRNYTASVSEAVRPPHLVQVLSVMNKPTDTRFIICNIISGNYRGAFGITAGNDGNCELRTQMELDRETVERYLLNITVTAGAQTDYALVSITVLDVNDNVPRFVYDSDLGLTTYFGAVSSVANAFTRVLTVKAEDADLGNSSLVNYALDPLSAHSKYFSISPFGEISTKQSMSTILSRNRLQFFEFRVSACDSPISGQQLCSKADVVVNVIGSTNRFKMIIYGLNPQQLKKHEKDLVKSTRQFTGSCNLLTIEKMIEHTAIENQIRTDIYWYAVNPTTKKICKKQDIRKLFETSNVQLIAGKVQPWFRLERISEDAGDEGNMSSGGILSTNWKTSNILLIILAVTVALGAIIGICAVCVFWSRYKTAQRNASNFSHSYPQKLGPIYHPTMMGVDPRTEYDYETQNVNMLISDEDLTMKSGSIGVPAHQRMTLMGAGGGPGMGGPGGPQNGQGNQSYRTYGYRPAHSTAYEGDFSIEESMYAINPSGRLDPITNSHLNNNSTNRLHSSLAQIFMQPINVMLAVLLALASFAQGGRSVAPAGAVTEPTVTQAVPEGSGLSSDVTDRPNIDSTDVVSNATSVEDLLGSSTNANNTGTFNSRTFVIAPMMILALVQ

SEQ ID NO: 6079 - protein, 526 aa, Caenorhabditis elegans
MRCAEKLSKPFRYTHLSSKKAVKLCVKLFLDHDKETRKKWTNKMIELLKKQTLQSSLISEELIRDTFRQCKSKGTQDAGKLLNVFDAFSLQPYDFDADLRKMVLRKEKTSLAADSSSFSHAARQRFFIVKQRAMRCASLKNFKFTTCEILGSSTKHLQSVVVLGMLTQQKADCYHIEDLSGSVEVEFKEDTKFHHALFHEHSIAIFEGTFENSVLTVNEVAMVPVESAEVTRKELSSNENWFGGDDKIAFRCSDRLRSALAKQEDTSLVFLSDVFLDDKKVMKAVFKLLQGYKDQPPVAIVFCGNFCSRPRQTDTIDLLDRGFRWLANQLTPLRKDYEKTQFIFVPGPDDPFVDTVLPRPHLPSLLFKHISPIISCTFASNPCRIQFASQEIVVFRSDLIKKTCRHSINSITVESIPSRYARSVLSQAHLCPLPQHITPVLPDFSHSLSLHPLPDLLITADRFETFTEKVVGADTIVSNPGSFSRSNYTFHVYYPCQNRVEASQIPVSELDDHSNIKNVIIFFFLF

SEQ ID NO: 6080 - protein, 1274 aa, Caenorhabditis elegans
MSEEIDENTMKEEQEEEERDEIEEKEEKPDAQQQELLNIRIPTQTKKSLKRKHIKTDFGAEDLDENVLEAQRLEKQRLERLEKIKPENDHIQQMESLFLAGASEGQLPQLDLQDDDFEEMFGFSVENDNKKYRYGDEEKPEPMFHLQEPSTSRGHVDVVDLTLDDSDDDCLITDVKSVMPQVVPGRRMRWAQAEKDRIDADQMDIQHNIEARRLKKMRSAKDLESTEKKEGRLLVNAGHPEEDPDIFVISHLTHVLQPHQLGGIRFMYDNTIESLGEYKKSDGFGCILAHSMGLGKTIQVITFSEIFLRATKAKKVLVIVPINTIQNWYSEYDKWIPKFSDTGDRIRSFEVFLLGDGVKTFDQRVNLIEQWDQTGGVMLVGYDMFRLLIKMTLPKKQKKGRPKLNLSGISSGFSKDSSEDQKLRDEELEFETGFTSGGRVRQEAYSLIRSALLEPGPDLVVCDEGHKIKNITAEISMTLGAINTKRRIVLTGYPLQNNLLEYFCMIDFVRPKYLGTRKSFIDRFEKPIKNGQCVDSSPDDVKIALQRTHVLVELVKGFVQRRTHHLLKKILPESKEYVLLLRKSQIQRQLYRNFVLWAKNEIAANNDAVFNPLMAFSACSKIWNHPDILYRLVEQKKRAEEDKKRVEQMKFAQLQQQQQQQQQQLQGMMMMGNNGMMPGFGAQFHPQQNGMMMQNGSWHPNNYQMPSPFNSIPSNPSTPTSSSTSKSAKKTKKPRGSKKAPKSDEEDEEVEKESRMKYDWTFELFEKYQEGVLENGYKIVISLEILDESTQIGEKILIFSQNLTALDMLEEILKKRQIRGKDGPGQRWEKNRNYLRLDGTTSGADREKLINRFNSEPGLSLFLISTRAGSLGINLVSANRCIIIDACWNPCHDAQAVCRVYRYGQQKKTFVYRLIMDNSMERSIFNRQISKHGLQQRVVDDAQVDANISQKELETLLMYDEAQDVNHDKWNTDDWDFGDPVLDSITKRMSQMFAGKPFLHETLIMESEQSLSEQEKREAQLLFDRERRMENYDPLSGLSSSNFYNNAPGSSMGMMGPPPVPMFNNNMQNSFNNHWQQSPNQLAPNFGSYPPQQFPQPMPNMSQFPPHGPSPQIPSIRPSPMPHTLRMNVSQFHHQGGGHTMTSFNNGYPNNNNGGAIGNPQQMLPPRDPSAFPGAVMSKIPSFSPAGAVQQLITDRQLVFPIVGHRDQLHQVQANTPIQLVVPKNGYYVKLRDGTILDAVGSVFENHARQLRDMYLSKNFNHDPQQVQEVIDLD

SEQ ID NO: 6081 - protein, 491 aa, Caenorhabditis elegans
MLETEHANTEVHELCRQMIARIEKYGTLEGFSDSDILEVLKTIKEILEPLPCLIEIIAPVVVFGDIHGQLGDLLQFTNEVGRPPDFQYLFLGDYVDRGPNSLEVTVWLFCMKILFSKKVHLLRGNHEVRRVNTMYGFKEEMMRKRNSHLWKVFNDVFAELSICASINRKILCMHGGISPKIESWDSLTGMTKPRVHGDCEHGLIVDLIWSDPNRKDDTIQFNKMRGISTLFGKSVVDNLCTTLAIDLIIRAHEMKEVYVFHLYLSSMKGHTFEFDNRLLTVFSAPYYSGHNSNLGSVATISKSLKLRIVTLKPNKGYDRSKLDKRTLHDFEKNFQPLDENPRKNISCQFNVPPNGQKMSPFLGEYSMFAHETQFCKKDNETPVKKPYSSNQDEDHSVLDMIRKTQKGYGVEPQKSGAAPKVRSTAGFLYAKKFFHVYNISRDKVMSLESIRKKLGMTTSTTPPPPRTPSPDAPLAQSPPIPRSPPSSTENA

SEQ ID NO: 6082 - protein, 1471 aa, Caenorhabditis elegans
MRRKNFIRRFQMQQSSNILKHLENHEVFCKTELKTCQINDDSPLFISTSIDNSMNLKILVEKKPYFTGSVTGYKLYYTNDSSQTNEEYEKWMHQEALSNQNSYNFVIDANKHEIVSGDVYRVRATVFFNNVESVPTGVISINTRQSIPKAPLIVNTKILYNSSVLISFVPADDVNAIENYTLMYKQMEAEEWKSLNFKSDFDGKVLLDGLIPNHTYEIKIFVTGGIVQGTPSNLATFTTNSTALALVKTEPDEEYTADPQTNEPLSITCTVKSVSKASVLWKVNGIKVSVDSSFYTVVTSVHEDFIESTIRAKSRTRSAKFTCLATNDAGDSSKEVNVIIKGPGSPPSEITLVAEKRGYTISWKPPSHPNGKITKYVVYHTLNREDPLSDWRKIDLDGSEKMVRIIMDTEESFYGRVQAATELGPGIISDIVAMERDTQPISVESDLFGVSATTMVVNPRETLSIQCTARGKPRPSISVAISDRKNASQVEVDVWSRLQATSSAGIVSAVHNFSVLTSKFVHCRAKNSAGSNYSTMELKVDKPGDAPTQIQVLSVNALDALVVWHSPQFPNSPITSYIVLVSNDDKEDKSTWLQYESNAKETQINRMLLPTGNLEKSTEYFVCVRAKNAAGIGPTSSLISFITLNGGPDSPPDNLKVLINEANQVIVYWNTPNSTTEVTGYLIYYTRDLSLSNDDYKNWQFVEMNNNSTRYKFDLSVGLKPKTFYRVRISGKNSHADGPASEVVEFETAYSEVPIPTDLKTEVLDDNTIHIKFNAVRDPDDHSKALGEYRIDLAATDDVLHALWKQIEPKSIKIDEISSMVDVEIDGDSVEKNQMYWVKVTARLDNPSWGMHSSKPRWFRTGHGKLMTSVTLEGAPLIEKEPNLFEELSVTCTGMGSPAPIITWEWMNKSIENGTEGWNILNIQIDDTTVVSKITRNNIRESGDLTCLANNNEGSSSASVEIRVLGPGNPPENIILTAYRNQINVTWQESTLPNGDIMKYIVYYSENENDDLSDWNKFETAELETYVETFGPHTKHFIRVQAVSDRGPGIISNVLSCISDVLYETIHLEIVASNILDFEAEPNQNVEIRCKGTGKPQPELFYQFANETEQNFVEVETNDMDLFEAKAPEINSRRNVTVTCRASNKYENVTISKVIIIKRPGEAPTNISWSFEEEYDSTLYINWNPIENANGEKLEYNLYLSNYKTKVSGPPVKIPDIPLDVNISLRVSAENEYGEGEKTFPIWIPTPNGGPKTAPILSSLHAQDSKVYIFWVEPRLPNGEIQNYTIYIQKENESENEEHSIDKEWKKFIYGSNITHVIIGVDDGLEENERYQMKMTATNQRHEGPETKVYTFDLISFDENDVIDNFTAIVINSTVFVEVGNPIYTKYNIYIREDGNNQTVKHEIDVESGKTTFEFPFQLDHTLSYTIKMSGMKLGRESPPSEEIDLEFISSPSPTPIISGSRRKVIKEPPL

SEQ ID NO: 6083 - protein, 188 aa, Caenorhabditis elegans
MREYKIVVLGSGGVGKSALTVQFVQGIFVEKYDPTIEDSYRKQVEVDGQQCMLEILDTAGTEQFTAMRDLYMKNGQGFVLVYSITAQSTFNDLMDLRDQILRVKDTDEVPMILVGNKCDLEDERVVGKDQGQNLARQFGSAFLETSAKAKINVSEVFYDLVRQINRRYPESGRRQGQSNKQCCSCVIM

SEQ ID NO: 6084 - protein, 269 aa, Caenorhabditis elegans
MPSEEGSVVRWLVCGATAGLAVDIGLYPLDTIKSRMQSKQGFIAAGGFKDIYRGMISVLVGSAPGAAIFFLTYKYINGQMKQVIEERNALVDAVSASLAEIAACAVRVPTELCKQRGQVNKNERLTLICKEIMETKGIRGFYRGYGSTVAREIPFSIIQFPIWEALKRAVANKKESGRCSPLEGAACGSVAGFIAAGLTTPLDVAKTRIMLTKNGPAPGILSTLKEVYTSNGVRGLYSGVVPRVMWISGGGFVFFGAYETAMHFTKFLD

SEQ ID NO: 6085 - protein, 583 aa, Caenorhabditis elegans
MITADNLKTPIFSATRCTNDHLPAYKSFLHRTRFLLLLLVILLNATVYSNTILINFSVICMSEEKISTMFNGSHNDYEVLREAIATSMNDFRSIWFTFSSIKQSIMFMMSPLGSLLAMYPTWMLIMKFGYRRICSTTCLISTFLTAFLPWSIFFGFPYVATCQFLLGATAPSALLLVPSVIRKWSTRKNDHFCFLVLFTFQQVRVCLFNRSSGALSGISPAALYPIAAYISKTFVGWPVIFYFQSIFSCIVTTVFFYFYKETPIRHANVSDNELQKIQRNEAVRGNIDYKKMFLCHQFQSVCFSIFIYFMTFSFFVQYLPSYLYDIMEQSVEKTAWTVSLIIIVHLILKIFISRIFEKNPLLTNIYSIKFLQFSSFAGSAVIMITLFVTKFHFDIQLILYAAIFAFLSLTWPSVFKSSNIISNKYYLPVMVRIHVVLFYFGSFASNILPLVLGRNTESWNNWRWIWLVFAVLLIGSVILFWLTFQFEKSDWDIVIPVEPPQPPRPEDIAPVSHPRPCQFSTSFDDEIVVSIISRGLDRCDTCKKHGIDARIHPSNESEVIPTRKMFDELLQQNQEDTLTVTRF

SEQ ID NO: 6086 - protein, 400 aa, Caenorhabditis elegans
MSHEVSTTPAAELAAFRARKVALITGISGQDGSYLAELLLSKGYKVHGIIRRSSSFNTARIEHLYSNPITHHGDSSFSLHYGDMTDSSCLIKLISTIEPTEVSIVIHTELQIFQASRRQTKMSVCVLRFFCTSVYHLAAQSHVKVSFDLPEYTAEVDAVGTLRLLDAIHACRLTEKVRFYQASTSELYGKVQEIPQSEKTPFYPRSPYAVAKMYGYWIVVNYREAYNMFACNGILFNHESPRRGETFVTRKITRSVAKISLGQQESIELGNLSALRDWGHAREYVEAMWRILQHDSPDDFVIATGKQFSVREFCNLAFAEIGEVLQWEGEGVEEVGKNKDGVIRVKVSPKYYRPTEVETLLGNAEKAKKTLGWEAKVTVPELVKEMVASDIILMKSNPMA

SEQ ID NO: 6087 - protein, 445 aa, Caenorhabditis elegans
MIFTLLSTLPVLIITTELDYSELVHSAELVSSSSYIHHKTNKKPDNCTRDTDIIDRLLNGTGYNKFRIPQEEGMTVVVEIWIQAITSIDELTNDFDMDIYITETWLDPALNFQTMTPCKGNLSLNHQVLDRLWTPNSCFINSKVAQIHNSPFRSVFLMLFPNGTVMVNYRVRVKGPCSLDLSNFPLDLQKCSLIYESFNYNRQEVEMRWSDAEHPVFNLSKIMLPDFDLFEIQTERRQEPYPAGMWDELHVTIIFERRFIWYFMQAYLPTYLTIFISWISFSLGSRAIPARTMLGVNSLLAIVFSFGNIMRNLPRVSYIKGIDVWMLVSMTFIFCSLLELAIVGFMVRDETVAKKKQQKKISGNISREESPHGIISERRFMFPPGCSESSKSLSSCTSGWTPERIDSISSVMFPFSFFVFNIIYWFYYIHRKEIIKQNLINRVDG

SEQ ID NO: 6088 - protein, 485 aa, Caenorhabditis elegans
MKYRVQLFKIFYSNFRLFARGGRVCESSSIRYVHLVDKTSQRRIAQVQPKSVFVPETIVTTLPNGFRVATENTGGSTATIGVFIDAGSRYENEKNNGTAHFLEHMAFKGTPRRTRMGLELEVENIGAHLNAYTSRESTTYYAKCFTEKLDQSVDILSDILLNSSLATKDIEAERGVIIREMEEVAQNFQEVVFDILHADVFKGNPLSYTILGPIELIQTINKNDLQGYINTHYRSGRMVLAAAGGVNHDAIVKMAEKYFGELKHGDSSTEFVPATYSPCEVRGDIPDLPMLYGAMVVEGVSWTHEDNLALMVANTLMGEYDRMRGFGVNAPTRLAEKLSQDAGIEVFQSFNTCYKETGLVGTYFVAAPESIDNLIDSVLQQWVWLANNIDEAAVDRAKRSLHTNLLLMLDGSTPVCEDIGRQLLCYGRRIPTPELHARIESITVQQLRDVCRRVFLEGQVSAAVVGKTQYWPVNEEIHGRLIRMQ

SEQ ID NO: 6089 - protein, 532 aa, Caenorhabditis elegans
MVRIKINRKTLFILFIAYMQLLVFLALYLNLAGPAELLNPRRQKFFGTNSANRQNSNETYGTPKATKLKRAPPVFQGPTNERQKAIVRAFQHAWSGYKKYAWGHDELRPVSKRFDDSFGLGLTIIDSLDTAIIMGLEEETRDGVEWIRENLNVSPARSVNVFETTIRVLGGLLSGYHLTGEEALLEKATQLGDNLIKAFTKSSSLIPKSDVNLDNGNACSPNRDLSSLAEATTLQLEFRDLTALTGDQKYEDVAFGASEHVHNVGCKKMDGLCPFYIDGKGEFKKSSITLGARADSYYEYLIKQWLQTKKSIDWLRDDFIQSIAAMKKHLYRQSQPNSIWFLGEITELAQFYPKMDHLVCFLSGSLVLSHLNGLDHDNEHLEMAKNIGNVCHKMYENPTGLGPEIIHFNMEDSSDMTQADTYVKNLDAHSLLRPEAIEAWFYLYRVTKDKKYQEWGWKAFESIEKYAKVETGGYSSIDNVLRKKIKRRDKMESFFLAETLKYLYLLMADDQEILPLDRWVLNTEAHPLPIYN

SEQ ID NO: 6090 - protein, 517 aa, Caenorhabditis elegans
MHIIPPGIYRVDVLILISYQMCHFFSIQQLFPIFLNYTPKTNCIQTAQGKVCYDVPKSKCLEYNENFPNLCANLTGTALSDCHTEKSHSYYSSAAMEFEIYCRPGWKDFRPAFVQYVGVLIGNIILGYVADQIGRKKTFILSMLIGIPSLSLSATFNSIAAFYIFRALTGIGIAGTMIVGWAYFSELVSPHQRFKLRTFSNWANARIMLTLVALFTGEWRLSSHVSAVISLITLAIVYFILPESHIWLRKKGRYEEAEVSRKRIADLAGIEFVPMPPPEKAADNVEPEKAVNICTVFADPQLRKNILILWLMWFVTGMTAYLTDLCGGDMTKNFWVGQFLSGILLSVIMGFADGYLPWMGRRFVLLCSQSLAIVFFGCVIAFLFAGEKGQWYYTAVYLASFVFTSIVWEPCYLCASELMPTDVRATSTASCSIVGRFANIGASMLSGLKTVYEPGVHMISISLGLTNVVAAYFFLQETKNCSLDKAGTSAAKPAEKANEQEMKDLINKGEEEDVEKK

SEQ ID NO: 6091 - protein, 248 aa, Caenorhabditis elegans
MTTMGEDEAPALPKKSPLPEKIDEADVDDDPDDKVIKIVVVGDGASGKTSICQRFAKESFDKSYHQTLGLDFFSRRITLPHEMQVLVQVWDIGGQSIAGEMIDKYLTGANIVFLVYDVTNSKSFENAVDWLSVVKKNTKSSETPVKLVLMGNKTDLEERRVVSVEAHKNFATSNDMMPTYVSAKTGDTVFLTFRQAVAEVLNVGLSRAEVEADIEIVQGSVIEQPKQSDASYARRSDQSRSTSVCSIT

SEQ ID NO: 6092 - protein, 1413 aa, Caenorhabditis elegans
MTGGKGEIGHLHIMSQLKRIEKTKCEVPSLNNYSEDLCTLTQPNAATVLNALKIRYTSNVIHTFCGLFCVVINPWRNIPIYSDEVKQLYQLQNDLPPHVYSVAQNAFHGILKGGRNQSILITGESGAGKTENTKKIIDFILSSSVSNNTIGDCVVTSGVLLEAMGNARTTHNSNSSRFGKFIRIEFDENSKLIGAKIECYLLEKSRVVFQSDGDRNFHIFYQMLSNYFDNPHKSFLKLSKKVNEYKYLRNDDSMIDDAETAKMTDEAFTRIGLSEEEKIWIFQILSAVLWIGDIKFGERSGLDVSFVESMQEVDNIAELLEMKSSKLVDALTQPTIKVHDKLIRKNQNLAKTLSSASAMAKILYERLFGWIVKRCNDAFSVDDTESTCRLSRFIAVLDIAGFEIIEKNSFEQFCINYTNEKLQQFFNHFMFAKEQSDYLEEGIKWTQVNFANHLQPTIDLIEKPMGILSFLEEECVVPNGSEKSLLEKLCSNLSNDSSFKKSKQTQKCSTIRHFYVQHYAGEVHYNIDGWLDKNRDNVETSVLDILSQSTHPLLKLLFPPVPVNNLKTRRGTITNSTVSFLYKNQLQCLLDTLNSSSAHFIRCVVSNYEKLPGKIDAPLVLAQLKCNGVLEGIRICREGYPSRLSHSEFIERYSLLMKNKEQSKGASEKEKCTLICQDAQVRKERYAVGKTKLFCKVGVISELETKRNNYISSFIILIQANIRYLNIQKDLIERRKKLEAVVTIQDNVRQFAELSQWPWYRIYHLTRGLIPRNRDKERIEELENEKLKLEEEIQEMEIKNEEALKENLKLSMLLDREKSEKVKVQKELEEVEKQGREKLLEKEREFRKTMEEMEQNEEIFNVLERKYNEQHKKVMKMNDVLREYERKIEQLNMEKTDLENENQKLRETQNRQDSHYSNLEKEVMEKSSLIDELQNQIQKLSDENNEQRLTIAKLETALEDEKARFARQNNTIGDMQKLISELNEKIARFDNIALNERNSTRKIEREKEKLNEELTTAKEIIQKQAKKIDELKEECRKRKNEASRLERKLEDKEAMMADCVKELKDSHKERLKEMEQKVEDVKRKNSKLENENSTQKSQIETFQRESSVDSDYGRSSSGRLSTLGRQYSLTSIGSFSSIRTVGLGSRKDSISDMTSSMYSLRRRDSTYDMTSSTIGLQRSPSTSQVMEKERRILELEKEKAAINTDLQLVKRELDVYKSQLSAVESEKESLQTANRKQSNQLQETTRQLNSAQKNADNLALRLKKALADCDEWKKKHEESIVESKTEILMERKRAMDRAEACEKETELKQSRMATIESARMELGGELARTQSELDRCRQIIIQLEENLKSQESLGNSFGRHQTNLNFEIENLRDENCALKAKIRRQYKQIELLTQQDETNDELNHFENKVERLL

SEQ ID NO: 6093 - protein, 412 aa, Caenorhabditis elegans
MAAQKIQGGDIVEMQGDEMTRIIWDLIKEKLILPYVDLNVHFFDLGIEHRDATDDQVTIDAANATLKYNVAVKCATITPDEARVEEFKLKKMWKSPNGTIRNILGGTVFREPIIVKNVPRLVNTWSKPIIIGRHAHADQYKATDFVVPGAGKLEIKFVSADGTQTIQETVFDFKGPGVSLSMYNTDDSIRDFAHASFKYALQRKFPLYLSTKNTILKKYDGRFKDIFAEIYPEYEAEFKAAGIWYEHRLIDDMVAQAMKSDGGFVWACKNYDGDVQSDSVAQGYGSLGLMTSVLVCPDGKTVEAEAAHGTVTRHYRMHQKGQETSTNPIASIFAWSRGLAHRATLDKNSALETFANNLEAVCIETMEAGFLTKDLAICVKGGNASAVTRTDYLNTFEFLDKLAENLAKKQAH

SEQ ID NO: 6094 - protein, 288 aa, Caenorhabditis elegans
MAQHPLVQRLLDVKFDTKRFVAIATHGPKNFPDAEGRKFFADHFDVTIQASILYMVVVFGTKWFMRNRQPFQLTIPLNIWNFILAAFSIAGAVKMTPEFFGTIANKGIVASYCKVFDFTKGENGYWVWLFMASKLFELVDTIFLVLRKRPLMFLHWYHHILTMIYAWYSHPLTPGFNRYGIYLNFVVHAFMYSYYFLRSMKIRVPGFIAQAITSLQIVQFIISCAVLAHLGYLMHFTNANCDFEPSVFKLAVFMDTTYLALFVNFFLQSYVLRGGKDKYKAVPKKKNN

SEQ ID NO: 6095 - protein, 798 aa, Caenorhabditis elegans
MRICFLLLAFLVAETFANELTRCCAGGTRHFKNSNTCSSIKSEGTSMTCQRAASICCLRSLLDNACDSGTDIAKEEESCPSNINILGGGLKKECCDCCLLAKDLLNRNEPCVAPVGFSAGCLRSFNKCCNGDIEITHASEIITGRPLNDPHVLHLGDRCASSHCEHLCHDRGGEKVECSCRSGFDLAPDGMACVDRNECLTRQSPCTQSEDCVNTIGGYICQRRISRLVPHRHRANRIGNAPRRMRDDPYSRAGEYREASQANTEFGCPMGWLFQHGHCVDIDECATLMDDCLESQRCLNTPGSFKCIRTLSCGTGYAMDSETERNNCFLIILNNTFNCKYFFVEDVDECNLGSHDCGPLYQCRNTQGSYRCDAKKCGDGELQNPMTGEYIDECVTGHNCGAGEECVNTPGSFRCQQKGNLCAHGYEVNGATGFCEDVNECQQGVCGSMECINLPGTYKCKCGPGYEFNDAKKRCEDVDECIKFAGHVCDLSAECINTIGSFECKCKPGFQLASDGRRCEDVNECTTGIAACEQKCVNIPGSYQCICDRGFALGPDGTKCEDIDECSIWAGSGNDLCMGGCINTKGSYLCQCPPGYKIQPDGRTCVDVDECAMGECAGSDKVCVNTLGSFKCHSIDCPTNYIHDSLNKNRCNRQPSACGLPEECSKVPLFLTYQFISLARAVPISSHRPAITLFKVSAPNHADTEVNFELQLKTTIVGAPNVLPAIRANFLLQKGEKRNSAVVTLRDSLDGPQTVKLQLLLRMSKKGKNFNTYAANLIVDVAAHKRHNTVHPPLMKIR

SEQ ID NO: 6096 - protein, 798 aa, Caenorhabditis elegans; identical to SEQ ID NO: 6095

SEQ ID NO: 6097 - protein, 373 aa, Caenorhabditis elegans
MINETEETCDRYIDKHPDMTNEPTVLVTFSLLYLHIFLLGILGNSAVLYLTMKHRQLQTVQNIFILNLCASNVLMCLTSLPITFITNVYKQWFFSSPVCKLIPLVQGASIFVSTFSLSAIALDRYNLVVRPHKQKLSSRSAMMIALLIWVISVVVCMPYGWYMDVEKLNGLCGEYCSEHWPLAEVRKGYTFLVLITQFLFPFATMAFCYYNIFSRLRQRVETKLKKLSERSQLLENSTTCGTTNHIVSINAVSKGHIVYQGNNTFLEITFLNVFFVLMYGSSSKWSGKQTKISCSCSTKKDNYYFIVHEVEVNPRNQLTSSKLHSFECRIVVRQVNLPTCDFVSNYTVFHCIFQKNCFQHHVFYLIYTYFVCQ

SEQ ID NO: 6098 - protein, 493 aa, Caenorhabditis elegans
MTAEKEPLKSREGDEAPQNETEGKGKGLEKSLTLFNGVSMIVGCIIGSGIFVSPTGVQEQAGSVGLSLIVWLISGIFTAIGAYCYAELGTLIKKSGGDYAYIMEAFGPFVAFIRLWIEAIVVRPCTVTIVALTFAIYGLRPFFPDCAPPDVVAELLAILLIVLMTAINCISVRLATIVQDWFTIAKVVALCLIILTGLGLLFFGESQYKDSFENIFENTSQDFTKVSLAFYSGLFAYSGWNFLNFIVEELQNPKRNLPLAIAISITSCTVIYVLTNVALYTAISPDEMLESPAVAVLFANKLYGKFAFIMPLCVACSTIGSANGVIFTSARLFYSGAREGQMPAVLTMINKKTKTPIPAVILTGALSIAYLLASKDVYQLINYIQISYWLAIGTAIAALFWLRRTMPDASRPIKVPLIWPAIFLAGCIALVLIPMVAAPRDTGIGLLIMLSAVPVYGIFIGWKNKPKWFNEFIDSSTVFIQKLFMVVDEDKED

SEQ ID NO: 6099 - protein, 1249 aa, Caenorhabditis elegans
MPIIAIILVVCFIGRLIVYFWKREPKGENGKKDAKEFGCSLGDLRGLMEARGAEAIVRLSTEHEGVEGLCKKLKTDSLVGLNGEQADLDRRRHVYGANTIPPAKSKGFVRLVLDACKDPTLVILVLSGFINLALSFYEPTSAAEDATQHLVNATTAAILANGTFMSTTEAPSEGHGTAWIEGVAILLCVIVVVLVTAVNDYSKERQFRSLQEKIETGQKFSVIRNGEAIDVPVSDLVVGDIARVKYGDLLPADGFLIQSNDLKIDESSLTGESDHIKKSIESDPVLLSGTYAMEGSGKMLITAVGVNSQTGIIMTLLGAGKAGIGDDDSTSTSSSSSSSSSSSGSSSNGSSDSSKSGDDDLTAKSVLQAKLSKLALQIIYCGTTIAIIALIVLVTRFCLDHYVFEKNEFSLVDIQMFVKFFIIAVTILVISIPEGLPLAIALALTYSVRKMMHDNNLVRHLDACETMGNATSICSDKTGTLTTNRMTVVQSYINGNHYTSQEAQPHGANLPGSTGPILMEAISVNCAYNSMIVEPTKAGEQIQQLGNKTECGLLGFVNRLGGDYAAIRKKFPEHDLTKVYTFNSSRKCMMTVVPYAENGQNIGYRVYCKGASEIVLGRCTYLIGSDGKPHQLTGDRLKEITSTIIHEMANSGLRTICVAYKTIIKKGTRDVEKTEIEFAEDSDIDWDDEDAMYQNFTGIAICGIQDPVRPEVPVAISKCKKAGITVRMVTGDNIMTARAIAMSCKILEPGEDFLALEGKEFNERIRDENGKVSQAKLDEIWPRLRVLARAQPADKYTLVKGIIDSKATPQREIVAVTGDGTNDGPALKKADVGFAMGIAGTDVAKEASDIILTDDNFTSIVKAVMWGRNVYDSISKFLQFQLTVNVVAVITAFVGAVTVSDSPLKAVHMLWINLIMDTLASLALATEQPTDELLERKPYGRKKSLISRTMVKNILCHALYQLIIIFVIFFYGDTIFGIKTGLYAPLFAPPSQHFTLVFNAFVMMTVFNEINARKVHGERNVFKGLASNRVFCVIWVTTFIAQIIIVQFGGAWFSTAPLTLQQWIVCLVLGFSTLIWGQIVATIPSKKLPKAWKVGKGEVQPANLHINGDYNVRARSRAVTLRRSGKSLWVRGMFIIGNHLRVLRAFGMEKSEKAAFGRTAPAMTAEAAERWRASYRKYRHQKHQEKKATAETAESVKSADWAKEQKEKKKTFKQIKQVARGKSLDKDSKKHHKKRKDQTNVDMEDIELN

SEQ ID NO: 6100 - protein, 444 aa, Caenorhabditis elegans
MHYSKIATIKFVFRTLTELKLFFFQHYIPSHPTHVRVDMWVQEVTSVSELTQDFEIDLYINEFWEDPALVYEDMNPCKRNISFDDKVLQRLWLPNTCFINSKSAAIHESPFKNVFLMVFSNGTLWTNYRMKLTGPCDMKLKRFPFDKQKCYLTFESFNYNTGEVRMQWNQPYPVILLKRIELPDFKLVNFSVIAVEQMYPAGWWDELTVAFVFERRYGWYVLQGYIPTMVTIVISWISFYLGPRAIPARTMLGVNSLLAMTFQFGNIIRNLPRVSYVKAIDVWMLSGMLFIFLSLLELAVVGFMSRNEGLPPKVKKRKRQEDDDEGFSWKSMQTSPHLELRQFWVDKRVNSLRNDSAVPPVEDYAPMELEQPYQNITKRREKRKWMSGLRKKWRAMRELRPETVDFYSAIFFPTAYMLFNISYWSFYLTSLSEYFDEDVNIDQP

SEQ ID NO: 6101 - protein, 452 aa, Caenorhabditis elegans
MAESKFSILKGEEFTGLKCRVCGDSRAGRHYGTIACNGCKGFFRRSIWEQRDYVCRFGGKCLVVQEYRNRCRACRLRKCFTVGMDARAVQSERDKHKKNPKDSNNEGSTSPQYPTASTPISIPSTSTSQTPTSSVNSYNFQNIPGIVSRSFSENLIMRDNSVPVMETSQSAALSHVPLVRYLIDLEKATDNLIDENCDFMSMEFDQLCRVDVTIEAAFRQPGVVAKRTPPRWLALERLTTLEDVHIAWCRSFVLCIDYAKIMKDYQELSPTDQFTLLRNRVISVNWLCHTYKTFKAGCDGVALVNGRCNHYFRILSEHLMEDLVIPMREMDMDEGEFVILKALILFRAHRRLSEEGRAHIKRVRDKYIEALYQHVQHQHRHFSSVQTSMRISKILLLLPSIEHLSQQEDDNVQFLALFNLANLNGLPYELHSSIKQHIPNGDDSDDTQVCFF

SEQ ID NO: 6102 - protein, 253 aa, Caenorhabditis elegans
MLYAIIIIGSWLMTTCGIFVFLTLSNTEKPLGYGRYSDSLATTRTLPPTISWMIQGFPSFIIPFYLYWTNQHLTEYGSFLTCLMTFHYAYRSFVYPFIINSDNQSPVKIVIMAFGFSVLNGFIQGTWNAFYQPEFDTLHPKFFVFLGAWLFVIGFITHCVSDLHLITLRNDYLNSYSIPRGHYFEYISCPNYFGECLQWIGYALAARSFPAIAFAFFIVCNLAPRAMSHHKWYQKMFGEQYPRDRHALVPGVW

SEQ ID NO: 6103 - protein, 313 aa, Caenorhabditis elegans
MTGGGDSKPIEKKKEDKKGFDTRKFLIDLASGGTAAAVSKTAVAPIERVKLLLQVQDASLTIAADKRYKGIVDVLVRVPKEQGYAALWRGNLANVIRYFPTQALNFAFKDTYKNIFQKGLDKKKDFWKFFAGNLASGGAAGATSLCFVYPLDFARTRLAADVGKANEREFKGLADCLVKIAKSDGPIGLYRGFFVSVQGIIIYRAAYFGMFDTAKMVFTADGKKLNFFAAWAIAQVVTVGSGIISYPWDTVRRRMMMQSGRKDVLYKNTLDCAVKIIKNEGMSAMFKGALSNVFRGTGGALVLAIYDEIQKFI

SEQ ID NO: 6104 - protein, 474 aa, Caenorhabditis elegans
MFRLSSILVFHFLRRNLKTSSKFVRRMVSLEVPTESPCISRRAPSEECEIAFSHDDPTLMWKDRTTDCVDLKKVFSKFDSSAPISGEILFRARFLCAKYLGGAWRKVKIEEFRIRAITGGMSNLLFLVELPAHLTPIQMEPEKALLRVHCQSDIDQLLSESVVFTLLSERNLGPKMLGVFPGGRFEQFIPSRALQCLEISKPGLSKLIAPIVARVHTLDAPIPKEPQTLQTARQWLERFKKTPAGERPIEMYLTQAKVPKSDYPSTITVAQLERELNFVEFFLQHSHSPVVFSHNDLQEGNFLLIDGYKLADDGTVLTPDGKPTNDDPLSLIDFEYCSYNYRGFDLGNHFCEYGYDYNEAEAPYYKIHQHYFEVEKERKVFCEAYLDEVYKMRACGDNPHFPSDLVTGDREKDLNKIIEESILFMPVSNIFWVCWSLINAEESSIAFDYGAYGRDRLALYFHQKKNLEKYLSNL

SEQ ID NO: 6105 - protein, 368 aa, Caenorhabditis elegans
MSHLNYETRLPLGQATIDHFMGLPAHPTKCQATYVWIDGTGEHLRAKTRTINTKPQYLSEYPIWNYDGSSTGQADGLNSDRYLRPVAVFPDPFLGGLNVLVMCDTLDHEMKPTATNHRQMCAELMKKVSDQQPWFGMEQEYLIVDRDEHPLGWPKHGYPAPQGKYYCGIGADRAFGREVVETHYRACLHAGITIFGSNAEVTPGQWEFQIGTCLGIEMGDQLWMARYILHRVAEQFGVCVSLDPKPRVTMGDWNGAGCHTNFSTIDMRRPDGLETIIAAMEGLKKTHSEAMKVYDPNGGHDNLRRLTGRHETSQADQFSWGIANRACSVRIPRQVADEGRGYLEDRRPSSNCDPYLVTAMIVKSVLIN

SEQ ID NO: 6106 - protein, 233 aa, Caenorhabditis elegans
MLVVFLFIRFYVISPSWSKIQKISMMCVQKVEKISNNSKIKKTTKRDAKPKKPKMWRVIAQKLVETIAHEMKISEIMDLSFRYLNTLEIEVNGEKMTVFNIISFIEYLGTYNICINYAEFKNFPTDGVLRKALFEAVQRISKKTILFQIFDDTISFDEISLIALFKESSSVAPVVLKDYLKERVPVNAKYIELHLNSLETSVLPKFFRKKLMELINFKVINWALIALRVRDVD

SEQ ID NO: 6107 - protein, 454 aa, Caenorhabditis elegans
MVLREQEHEPFFIKIDGKWCQIDDAVLRSHPGGSAITTYKNMDATTVFHTFHTGSKEAYQWLTELKKECPTQEPEIPDIKDDPIKGIDDVNMGTFNISEKRSAQINKSFTDLRMRVRAEGLMDGSPLFYIRKILETIFTILFAFYLQYHTYYLPSAILMGVAWQQLGWLIHEFAHHQLFKNRYYNDLASYFVGNFLQVSHIFNNGFSSGGWKEQHNVHHAATNVVGRDGDLDLVPFYATVAEHLNNYSQDSWVMTLFRWQHVHWTFMLPFLRLSWLLQSIIFVSQMPTHYYDYYRNTAIYEQVGLSLHWAWSLGQLYFLPDWSTRIMFFLVSHLVGGFLLSHVVTFNHYSVEKFALSSNIMSNYACLQIMTTRNMRPGRFIDWLWGGLNYQIEHHLFPTMPRHNLNTVMPLVKEFAAANGLPYMVDDYFTGFWLEIEQFRNIANVAAKLTKKIA

SEQ ID NO: 6108 - protein, 473 aa, Caenorhabditis elegans
MVVDKNASGLRMKVDGKWLYLSEELVKKHPGGAVIEQYSIPPLNKNIETRGIITTRGSSNALDILYFYRNSDATHIFHAFHEGSSQAYKQLDLLKKHGEHDEFLEKQLEKRLDKVDINVSAYDVSVAQEKKMVESFEKLRQKLHDDGLMKANETYFLFKAISTLSIMAFAFYLQYLGWYITSACLLALAWQQFGWLTHEFCHQQPTKNRPLNDTISLFFGNFLQGFSRDWWKDKHNTHHAATNVIDHDGDIDLAPLFAFIPGDLCKYKASFEKAILKIVPYQHLYFTAMLPMLRFSWTGQSVQWVFKENQMEYKVYQRNAFWEQATIVGHWAWVFYQLFLLPTWPLRVAYFIISQMGGGLLIAHVVTFNHNSVDKYPANSRILNNFAALQILTTRNMTPSPFIDWLWGGLNYQIEHHLFPTMPRCNLNACMKYVKEWCKENNLPYLVDDYFDGYAMNLQQLKNMAEHIQAKAA

SEQ ID NO: 6109 - protein, 1026 aa, Caenorhabditis elegans
MADLFDEFIEPGVKNEIMDVEEAPENPMEKLDSAKKRQAREDMTNLLANMHNDVGVGNFDEATSKRARVEEEEEVEEARMENIIVHTIRTDNENCTHEVAIPPNAEFAELRENSGTEPAKYYPFQLDAFQKQAILCIDNNQSVLVSAHTSAGKTVVATYAIAKCLREKQRVIYTSPIKALSNQKYRELEEEFKDVGLMTGDVTLNPDASCLVMTTEILRSMLYRGSEIMKEVGWVVYDEIHYMRDKERGVVWEETIILMSKNIKQAFLSATIPNARQFAQWVASIKQQPVNVVYTDYRPTPLQHWIYPVGGEGMYEVVNVKGEFREDKFRDAMSGLATAGDSAGSFNKRRTGGGTQGDSNVLKIIRSVASNDGLNCIVFSFSRKECESYAISLKDMDFNKDHEKGMVKSVYESAIAQLSPEDQKLPQILNILPLLRRGIGVHHSGLMPILKETIEILFGEGLVKVLFATETFSMGLNMPARTVVFTSARKFDGSDNRYITSGEYIQMAGRAGRRGKDDRGTVILMVDSAMSADDAKQIIKGATDPLNSQFRLTYNMVLNLMRVEGMAVSWIINNSFHQFQSYAKIPEIDKKCVQVERKIASFNFPWENEMRTLVDLQDQLEATRQRIIQIQREPKYIVGFLHAGRLFKVKSGDRDFKWGILNQFKKEQNPDDRNDQIYLCDMMIAINTEGRFDPTNPATLVPGFDLPKRRWIRVPMTIDRITAISAVRLKVPADIDKPDGQMRLDGMMAAATKRFGNQIPLLDPIQDMEIKTVEMKELIAREKSLEGRLETHSMTKRDNMKDLKKQFEQKQDAVKELNALKAERKSVQSTLHLEELNNRKRVLRRLGYLGNDDALVLKGSVACELSASDELILTEMLLKGIFNTLDVAQTAALLSCFVFQDKCAAPKLATELQTCLSELHEQARNVAKVSNECKMEVMEDKYVSSFNPGLMDVVYQWVNGATFSEIVKTTDVFEGSIIRTLRRLEEVLREMINAAKALANKELEQKFEDARKNLKRDIVFAASLYL

SEQ ID NO: 6110 - protein, 517 aa, Caenorhabditis elegans
MGRGEACEKSQEKTFTGSVGNSRVHNLKCYHGVRRRKKSRKNLMRGERPGTFLFRSCFVKSGVALALFLSVKVRAGDSDANIHHYQVEDRAGEYYLMQELMEKEELVTRESKAFPTLEELIGHFQHHRLACKIRLGRPLKRPSWQLRHNSVVYDDTGKLGSGNFCIVYRGMLRKQGKIIPVAIKVSKNSDKESAALMETRNLLLAEARIMMNYNNINVIRIYGVACDVPPFMVCMEFCSGGSLEDALKKYGKDMEEFERQILLIDAARGMRYLHDKKCVHRDLASRNCLISFDGIVKIADFGLSKTLEKDQKAFKEALKEAPLAWLAPECIQRESEFSTKTDVWAFGVVIFEVYNNAEKLFAGEEDIAILRKIKKANMPTIENRTKVPAMQAVLSSIWTRKPDDRPEMQKVLEKLVAALVPIQPDDLKRLQINSLKGVSRTQMPNTDLEMDVSVVNEEVDQDGSEKNRKVKGGSKKKTGNRHNRSGKRTPKQEESPKSKKPVPLRNTVRKGPGATSE

SEQ ID NO: 6111 - protein, 487 aa, Caenorhabditis elegans
MLVDPRFDAFFKLEQIDDYKYDGADTSPSTSNGLPETSNGGRLICDVCGDVAFGKHYGINACNGCKGFFRRSVWSRRQYSCRFGGDCPVVKEHRNVCRSCRLKKCFEVGMNPDSVQNERDRNAKNGGMGGPMSSPTQSSLCKELTISNGQIKRKRLRPETVEKTTQTDGKLEINDDFDFENMQQNPTPPGLLPLKIERISTPPSDLPVPMDFSIHSAVLDIEQKVFYNCPVAVDNSINATKTPITLPFEVVFRQPHLVCNRYPMRFSNTRVLTPEDLIDGWRRHFTYYSDWCHAMDEFKALSPEDQIVLAKKKIILHGWLVHAYYSYKSGCNGICFANGAAHLPEGGHPSITEFYKECMPRYLNYVIYPMHNFQMDDAEMVLIKCIMFFSSESGLSAAGRQIVSAAREKYLSALYNYGRANKCTTSAQATLRIAKFMIMLSAITSLTHLMNEGVHVTSLFNIIEFDELIQATHKTTPPQHSPPAPMG

SEQ ID NO: 6112 - protein, 688 aa, Caenorhabditis elegans
MLGVFQKRCASTAPLIRPIQRVLVANRGEIAIRVQNTARKMGIETVAVFSDADRNSLFVKKADKAYHIGPPLAAESYLNMDKIINSALRSGAQAIHPGYGFLSENAGFAEKCAQAGLVFIGPPAQAIRDMGAKNVSKQIMEDAKVPVVKGFHGEDQSDANLKKKSAEIGYPVMLKAVYGGGGKGMRIAWNEAEFEEKLASARNEAKKSFGNDEMLVEKFVEKPRHVEVQVFGDHHGNYVHLWERDCSVQRRHQKIIEEAPAPNMEHDTRVKLGESAVRAAAAVGYVGAGTVEFIMDPRGEFYFMEMNTRLQVEHPVSEAITGIDFIMGDWKLSNNLISGTDLVEWQLRVAQGEKLPLKQSEIPLNGHAFECRVYAEDTRKGAFMPTAGRLNYVDFPEDARIDTGVVSGDEVSIHYDPMIAKVVVWGQDRAVAAAKLESALARTRISGLPTNIDFVRRVLAHPEFAAGNVYTDFIPDHQKELFAESETPAEIYVESAVAHALAALQKSDAGVFQNLSFFRMNLSPKYIFKIDGKDVSIRFDSDSRLTVSYDGNSYETLLNDIESTTDGSFKFTLEANGRRWSTVVKNLGNSLMVNGVGQNEYETPQIHETFDSLSGGAASHSAVAPMPGIIEKILVKPGEQVTTGQALVVMTAMKMEYIIRAPEDSTVEHIKCQAGKNVPKNAVLVQFA

SEQ ID NO: 6113 - protein, 533 aa, Caenorhabditis elegans
MSQTRTHEQVLAKEPWYHGLLPREDMKQLLTQRGDFLVRFTDPKVGEPRKFVLSVYVGVIEDIRHYVIREHNNKFAVDKKWFSSIADLLNYYHRSKEPVAGGPETVIIRPIGREPWEKQHSDVTLIKKLGEGAFGEVQLGEIRIGNTVKKAAIKLAKLESLTKEQIKEIMHEARLMRKFKHPNVVTFYGVAAGQEPLMVIMELADNGALDSYLKKNIGSLPISKKHTMVLQAGLGLEYLHSLQIIHRDIASRNCLYGNGQVKISDFGLSREGYSYRMNPHKKVPIRWLAPEVPRTGFYTPKTDVFAYGVMCWEVYHDGIEPYPGMKVAEVLPRVQNGYRMPFEANVPPAIVRFITYRICAGAEEERVTMSEAVRELLTLEGFDQAPGSNSYFELPDHIPMENIEQPKKIQVSNILPYMSKPVAPPFEPERQEKTQEMRKSMSNSAEEGVKKNRRPVRTRIRNGNSPSPGFKSQSRSAAENQNKSNLKAVQKKKNNKQSSSISGDAPSTFSVLGVFGKKKNTADRSDLKKLEEF

SEQ ID NO: 6114 - protein, 533 aa, Caenorhabditis elegans; identical to SEQ ID NO: 6113

SEQ ID NO: 6115 - protein, 586 aa, Caenorhabditis elegans
MFQFGWDNYMEHAFPADELDPIHCRGRGHDHDNPDNINVNDVLGDYSLGLIDTLDSLVVFGDADEFKRAVNLVIKTVSFEKNTTVQVFESTIRVMGGLLAAHMIAADKTNRFGPFYMSDYGGELLTLAHDLAGRLLPAFDGTATGIPYTRINLQKGILPGTTNSTCTSGAGSLLLEFGVLSKLLGDDTYERLARRVNEKLWNLRNEVTGLHGNLIDIQTGEWLGHLAGLGAGIDSFYEYMLKSYILFGNQRDLDMYNESFARITTYMRRGRSRCSSLEGDIPIYVNVDSRDGSTSNTWIDSLQASFAGVLVLAGEVDEAVCHHALYYAIWKKYGVLPERFNWQLQAPDVSFYPLRPEFVESTYLLYTATKNPFYQHVGLEILDSLETITRVKCGFATVHDVIDGSLEDRMESFFLSETLKYLYLLFDVDHPINKEQQESVLFSTEGHIFPISPLFNLPPTPPSQYDPPLKPLPRTNSSFCETATDFTFGTPPLRHSQMRELFKVIGVDSVLHDCDGRFLMGLVLIAKRNKPLIAMMAAILFTVAVFLATRFVAFDCSYLVVFKCKLIFSIFSQLSGIFILFLCVQT

SEQ ID NO: 6116 - protein, 306 aa, Caenorhabditis elegans
MSTSASLSPAALQKRSDAQKFAIDLLIGGVSASVSKTVVAPIERVKILLQVQYSHKDIPADKRYNGIIDAFVRVPKEQGFVSFWRGNMTNVIRYFPTQAFNFAFNDLYKSILLKNMKRENNVLSYSVRTLVSGGLAGCSSLCIVYPLDFIRTRLSADINHHTKREYKGLVDCTMKTVKNEGFSALYRGFAISLQTYFIYRSVYFGLYDAIRNTINTDKKKLPFYASFAIAQGVTVLSSYLTYPWDTVRRRMMVKGQLSTSKAFSAARKIVHEEGVRGLYKGALANIFRSAGGALVMALYEEIHKHM

SEQ ID NO: 6117 - protein, 399 aa, Caenorhabditis elegans
MSVTVEQEAYEMPADNKKVMLKIEEVHLHSCGVFSNVYKGILREPHEKNIAIKKSWPEKGERNFEFIFLTGRERTKHKNVIHMIFAFSHSYGTKVCESYVFDYMPNTLAEVIRQKLTDLDIRLYTWQIFSGLKYLEEHRVVHRDLKPVNILVDHDTGFLKISDFGSVKIIVKGKANNHYQVTRFYRPPELLQKAMEYNCTVDVWSAGCIMAEMVKRRVVFPGRDSAQQMKLYCRCFGVPTEQDILAMKGERLENELWKFTKGFGLQRLVTEITPDQLQFIKRILVYTPEKRLHGKQLLQDDFFQTKTPRQSVLLYWSRLTTGIRGFQTVRRATLMRMFFREDQHLSRRNRRWLVMSNRMRTTLTIDVVGHQVKIVDHRRLRRLLLSVPNRTETRQRNRQ

SEQ ID NO: 6118 - protein, 399 aa, Caenorhabditis elegans; identical to SEQ ID NO: 6117

SEQ ID NO: 6119 - protein, 366 aa, Caenorhabditis elegans
MPSEKEDDVMKNVTFAEGKKFGDWKIGKTIDEGGFGKVYIATSISDPKKVAALKAESNEIEGGSAIKLEAMILNKLNANGPVPHIPVVHLCAKRKLYCYMVMTLLGRNLRKLKSTNLVVNNGFSRGTWSRIGIQCLYALKYVHDNGFIHRDVKPQNFLLGNETDSERARIVHILDFGLARPFAVFHARENKWIARRARGTAEFRGTLRYTSPNVHLRKEQGRVDDVWSLLYVIIELNGGKALPWQTDSQRERVEQMKLNLPAKVVMSNMPACMDKVMPHLASLDYYQRPDYHMIFKCFWQVMENEKITPSSKYDWEKDEPDKSVPPASWENPAGPFFQSDPLGINAPPTPAEAALTEKSGKKHGKK

SEQ ID NO: 6120 - protein, 553 aa, Caenorhabditis elegans
MCTQDEECSAPGGDKGKEKEEHTVVPRGKEEKEKKPGTKPSPISPAFKGTPKERPNCGKTKNETSGKKLRSNDVSPDVKDRLQLSEHGPSKTCIKDFQWLEDFITKMPCFHGFIGREDLMSVLKNVGDFLIRTSVQPNKHEVEKMKKNQADVKVLGNLSREKCAKKEKEKEEKLAGMGDVGRREFVISVYCKDKEKPATDKPQYTPIRNLVIKRDNGMVHVEPLRKFKTLTEFFGYYQKNSGICKETDFQLITPIPLSNWEFIHEDIALQQKKLGEGAFGEVRIGKMKLKSTKKTVEVAVKMLRNAEVVIREQVGELLHEARVMRMMDHKNVLRSYGIAVLKEPLYLMTEMCACGALREYLRENQETVTLAEKLFFVVGSSRGVQYLHSQKTIHRDLAVRNILLIHKRHDPAITNSTVSMGTFLFQPKISDFGLAKISERYEMKEQCKIPVRYLAPETLESFIFTTKTDVFSFGCVIWEIYENGNQPHDGKNAQTIRNLTKKNQFLKLTNSAPSELRKLIEERVFTSDPENRCSMTTIVQCAEKIEKPPVGMK

SEQ ID NO: 6121 - protein, 373 aa, Caenorhabditis elegans
MAVDKKEEEKDPMDNVRFKIGKRFGSYTIEKSLDEGGFGQVYLVRDNSGKRFALKAESNDMEGGSAIKLEALILRKLNDGESVIHVPKLLLSGKRKKYCYMVMTLLGKNLKCLKNKRPKERFTRGTWSRIGIQCLYGLKYMHDCGFVHRDIKPQNFMMGNEDDKERARIVHILDFGLARSFAKFSESSKTWSARRARGTAEFRGTLRYTSPNVHFRKEQGRVDDIWSLLFVLIELNGGLPWQNVQKREEVEAMKMIMTDQDVMLNMPPCMCDIIPHFRTLDCYMRPDYLLVFKALWQVMLNEGQTTSSRFDWETSDPDPSISPADWENPDGRFFKLDKIGINGPPPMDKCAAESTQQGDALKSDKGRSVNQKK

SEQ ID NO: 6122 - protein, 532 aa, Caenorhabditis elegans
MGMKKDLLLVLTIESVVLGVVLGFVIRPFNPSNDTISLIGFPGEIFMQIVEMMILPLIMSSVISALAQVRARDARRIGIVTIIYYMITTFLATFTGIILVSSIHPGDPELIHELGEGTLENTALSTLDTFLDQIRNMFPENIIQATFQQVQTEYMPIKPSRVRNATSMNMTSEVLHKQTLTYTNEMNVLGLIVFCSGFGIILSILGDQARLMINFFIVLDAIIMRWISALMWCYPIGILSLVCKNIIDIDNLTETAQALAMYVVTVICGLMIHSLLTLPLLYFLVTKKSPFAFMTGMLQALATAFGTASSGATLPVTFRALEENLKIDRRVTRFVLPLGATITMDGTALYEAVAVIFIAQLHNIKLSLMDLVTISITTTVASIGSGSVPAGLDTIVIVLTTVGLPAKDLSLLLTVDWLLDRIRTSVNVLGDSFGAGIIHHLTRSSLLEADTDELIRQIREDIDILNNPHQDTLPISHHSVQSTIQNTQNAMQAPHVYSKSARASFAPIPNEEERKALLKESIALNKSDTHIV

SEQ ID NO: 6123 - protein, 200 aa, Caenorhabditis elegans
MVHYKLTYFNARGLAEISRQLFHMAGVEFEDERINEEKFSQLKPTFPSGQVPILCIDGAQFSQSTAIARYLARKFEEELQADEVVDTFKDFIESFRKFVIAVLSGESEEILKNIREEVIKPAVKTYTAYLKAILEKSSSGYLVGNELTWADLVIADNLTTLINAELLDIENDKLLKEFREKIIETPKLKEWLAKRPETRF

SEQ ID NO: 6124 - protein, 652 aa, Caenorhabditis elegans
MLTPRDENNEGDAMPMLKKPRYSSLSGQSTNITYQEHTISREERAAAVGRHEGFRGCTIWFTGLSGAGKTTISFALERTLNKLGIPCYGLDGDNIRHGLCKNLGFSKEDRQENIRRVAEVAKLFADSGMICLAAFISPFQEDRLDARKIHESENVKFIEVHVSTTLEVCEQRDPKQLYKKARAGQILGFTGIDSAYEPPENAEIILDAGKDGVQQCVQKVLDHLESKGLLPEQIPDVPAVRELFVSDDLTVAELLKESQNLPTVELTKVDLQWLQVLAEGWATPLSGFMRERQYLQSMHFGQLLDLKHKVAFVGEKSDDKEDSWPMMDDINQSIPIVLPISDDVKKGLEGVTRIALKYNGQVYAILSDPEIFEHRKDERVCRQFGTNDPRHPAVAQVLESGNWLLGGDVAVVQKIQFNDGLDKYRKTPNELRAIFAEKNADAVFAFQLRNPIHNGHALLMRDTREKLLAEHKNPILLLHPLGGWTKDDDVPLDIRIKQHEAVIAERVLDPEWTVLSIFPSPMMYAGPTEVQWHARSRIAAGIQHYIVGRDPAGIQKPGSPDALYETTHGAKVLSMAPGLSALHILPFRVAAYDKTAKKMSFFDTSRKEDFENISGTKMRGLARNGDTPPEGFMAPTAWEVLAGYYKSLQNSN

SEQ ID NO: 6125 - protein, 325 aa, Caenorhabditis elegans
MVQEQMKLTGTLEGHTGWVTQIATYTRNDKTTVLSSSRDKTILVWDVDSVAPVDEGPIGRPVRSLTGHNHFVSDVVISSDGQFALSGSWDKTLRLWDLNQGVSTRQFISHTKDVLSVAFSADNRQIVSGSRDKSIKLWNTLAQCKYTITDDCHTDWVSTVRFSPSNRDPVIVSAGWDKVVKVWNLGNCRLKTNHIGHTGYVNTVTVSPDGSLCASGGKDGQAMLWDLNEGKHLYTLPGNDVINAMSFSPNRYWLCAAVGSSIKIWDLEDKKEIEELKPEIASSGSSRGSSPQCISLAWSQDGQTLFAGYTDNIIRVYQVSIRASN

SEQ ID NO: 6126 - protein, 357 aa, Caenorhabditis elegans
MTDRNELIGVAIRVVAAAAVSFLSVRYLVKYLDPNYSVNEESKKKVAQLFHELGIDRQIELSEHEIRIATQFVGGEDVGADWDEIGRTENCFAKKKKNFTGGCEELVAELKDRIILPLRFASQSGSHLLSPPRGILLYGPPGCGKTLLAKAVARAAGCRFINLQVSNLTDKWYGESQKLAAAVFSVAQKFQPTIIFIDEIDSFLRDRQSHDHESTAMMKAQFMTLWDGFSSSGDQIIVMGATNRPRDVDAAILRRMTARFQVPVPNAKQRSQILNVILRNEKINNTVNLGEIAQAAEGLSGSDLKEVCRLALLARAKATVASGGSVNQLLPLEQSDFESAVHKYMRAAHLLVEETLD

SEQ ID NO: 6127 - protein, 483 aa, Caenorhabditis elegans
MLPRLAKSSLIQQVRGVSAIANAEPSGPSISTSIPGPKSKALKQEMDKVHQTTSVRFHVDYEKSFGNYVVDADGNALLDVYTQISSLPLGYNHPDLVKVASQPHLITSLVSRPALGSFPRTDFADGISHALTSIAPKGLKAVQTMLCGTSANENAIKTAFIWYQAQRRGGLGPDALHLESCMNQQKPGTPNLSVMGFEGAFHGRSLCMLSVTRSKPIHKVDIPAFDWPIAKFPRYKYPLDQNVAYNKKQDQECLADVEAKISEWKRRDNDVAAIIVEPIQAEGGDHYGSPAFFQGLRDITSKHGIVFIVDEVQTGGGATGDIWAHDHWNLSSPPDMVTFSKKLLTGGYFYGEHLRVKEAYRIYNTWMGDPTKLLLLEKAVEVIKRDGLIEQSREVGAEFQKRLGELQASSGGKLDQARGRGTFAAVDFPSGSLRDKFVDLAISNGLHCGGCGDRSLRFRPSLVYTKKHLDLTFDLLDKTLKGL

SEQ ID NO: 6128 - protein, 1156 aa, Caenorhabditis elegans
MSRAFNLSLSTILLESCHSKERSSVTLTLLQVYLGSHLKTTNGKCIYTILNSIVVSPSCIITQLALVNCSPNGVTFQNYWKLSKHVVQLDILADSSRQWWVSDGRYQLIRPFYTLRVSPVTPEDSGTYRCRLETDPLFSSPQSTATQELAVMVKPVAPSSPEIKTFTNRSITLVWTHNAARAHRPILRFSVSVRTVSDNTRFVMAAPSNATTVIVDNLSPYTLYAFSVRAENSAGSSDFGPETTFRTLGESPNRPPQIQKIRNITSECVEVTITPPDEMNGELDKYLVLIQAVNETIPRKMTFDKPTSTPLTICALSPSTDYALAIEADNGFGTSPQATLVFHTEDSVPNWSPSTITTLPVVGKPEITVLWPAPPLNATEKVIKYHLYYKAKNEDQWKIEHLNVSPNGVKSKLFKYRLVDLNPNTQYRIRVSASTIKGEGAQSADSVAQTDVGEPGTVTFKDLNFDCKNGVKLRWNYEPSVNSKKSPTFTVKVTNQTTSLQFNTTMLSLDIIDLSLYDEYTLRIIVLERSTIDNSTILIGKYSDSHQFILKDKCSYQSSFCSPGEKCAKLTSSAGNPRYISVLIVIFAIIIFAFICFVIVHFARGSMNFKHLLKKKEKCVYLEEISPLVYDSAGQEDIPVELFYGYVEDLNRNDSLKFKTQFQILESQTSGIDSVDSGESNSSSDENSQKNRYNNIGAIEATRIRLNSPTGNDYINANYVDSCNERNAYIATQAPLPSTFSDFWSMIWQERSNIIVCITNMVEDGKRKCDQYWPSQQDSPQTFGNYQVTLVSESTNAHFSHRILDLKIAKAVPAVERKVHQLHFMGWPDHGVPSSVFPLLSFVHYTSDIHSTGPVVVHCSAGVGRSGSYILVDSMRRHLISFRRLNVQGHLTHMRRQRAKLVQTLEQYIFCHEAIRQLIRHGITRVHSDLFMRYLHYLSEENLNGKTRMQLQFEDICDCKHQPRCLIESDVITLPGYHRSDEFMVGSWGNECEDLWRLTWQQKVQTIVILNQRDSFWRKLPSCIYDGEIQLQHGDNFVLLQKDDQQLEIENVQKQRITYHDAPLLILAHKYPPSVPSPTDSTSTLSLSILFNDDTALAFSICAATTLACQLETTGCVDVVQVLSSYTEIQCGIFASKQEIEIIYEKMSQLVGGTRV

SEQ ID NO: 6129 - protein, 385 aa, Caenorhabditis elegans
MGKAMAICFGLAGIETFLVVRNEQRCKQELEVMYAREKSFKRLNDKRIEKINANLKITSDFHKLSNCDLIVESVIEDMKLKKELFANLENICKSTCIFGTNTSSLDLNEISSVLRDPSNLVGIHFFNPANVIRLVEIIYGSHTSSQAIATAFQACESIKKLPVLVGNCKSFVFNRLLHVYFDQSQKLMYEYGYLPHQIDKIITNFGFLMGPMTVADMNGFDVMEKLKKENGLEPNPIEKEMWRLKRYGRKTNKGFYKYDDKTQRKENDTEMEQIIRRVSQNAKSNIQIINDQDVINFMLYPTVNEGYRCIEEGVISNESLIDIMFILGFGWPIHSGGPMRFGKTEGLDKIANMLVHWSSLEPKESAYIVADALKTANNKLMSSKL

SEQ ID NO: 6130 - protein, 468 aa, Caenorhabditis elegans
MDKVPQAVRDYLMEAHQLAAQWSLPNDRGDYINSKSIPIKSVAVIGGGTMGRGIAIAFCLSGFETYLVEVNNKAAEFCKNELEITYKREKAFRRLNDSKVEKLRKNLQITTDFQKLNNCDLVSFCFYFQKKKKEKFQIVEAVFEDMKLKKELFTKLDKICKPSCIFGTNTSSLDLNEVRFKLTIPKEHVHFQMSSVLRDPTKVVGIHFFNPANLIRMVEVIYGSKTSSKAVATAFEACRSIKKLPVLVGNCPAFVFNRLLGVYLNQSQKLMYEYGYLPHQIDKIITNFGFLMGPLTVADMNGLDVMEKLKKENGWPASDFEKEVWRQKRYGRKTNKGYYKYDPNTHKKENDIEMEQLIRKFSSAASPNIQILNDQDAVNFLLYPMVNEGLLCIEEGIIHHESLIDIMFILGFGWPVATGGPMRFGWLQGIEKVASTIILWNSLEPNDRTYKVAATLQNVDRKNFAAKL

SEQ ID NO: 6131 - protein, 618 aa, Caenorhabditis elegans
MTVSEQLRNDLEDAANRMRISSIEMTCASKSGHPTSSTSAAEIMSTLFFSEMKYDVAEPKSASADRFVLSKGHACPILYAAWEEAGLLSHEQVLSLRKIDSDIEGHPTPRLNFIDVATGSLGQGLGVATGMAYVGKYIDKASYRVFCLLGDGESAEGSVWEAAAFASIYKLDNLVAIVDVNRLGQSQATSLGHDVETYKARFAAFGFNAIIVNGHNVDELLAAYETARSTKGKPTAIIAKTLKGKGIEGIENEDNWHGKPVPEGTVNAIKARFHGSQKGKLVAQKPINDAPAIDLHVGSIKMAAPEYKKGDKVATRAAYGTALAKLGDASPRVIGLDGDTKNSTFSDKLLKKHPDQFIECFIAEQNLVGVAVGAQCRDRTIPFTSTFAAFFTRATDQIRMAAVSFANLKCVGSHVGVSIGEDGPSQMALEDLAIFRTIPGATVFYPTDAVSAERATELAANTKGVVFIRTGRPALPVLYDNEEPFHIGQAKVVKQSAQDKIVLVGSGVTLYESLKAAEELEKEGIHATVIDPFTIKPLDGKTIAEHALKVGGRVVTTEDHYAAGGIGEAVSAALADYPTIRVRSLNVKEVPRSGPPDALVDMYGISARHIVAAVKNFQ

SEQ ID NO: 6132 - protein, 391 aa, Caenorhabditis elegans
MPILGIAKRSLCTHKWLYNLNLHSINLFLPIESKMSAQASRQKKSDQEQRAADQALLNAAIEDNAMEQDENFTVIDKLESSGISSGDISKLKEAGYYTYESLAFTTRRELRNVKGISDQKAEKIMKEAMKFVQMGFTTGAEVHVKRSQLVQIRTGSASLDRLLGGGIETGSITEVYGEYRTGKTQLCHSLAVLCQLPIDMGGGEGKCMYIDTNATFRPERIIAIAQRYNMDSAHVLENIAVARAYNSEHLMALIIRAGAMMSESRYAVVIVDCATAHFRNEYTGRGDLAERQMKLSAFLKCLAKLADEYGVAVIITNQVVAQVDGGASMFQADAKKPIGGHIIAHMSTTRLYLRKGKGENRVAKMVQSPNLPEAEATYSITNHGIEDARED

SEQ ID NO: 6133 - protein, 480 aa, Caenorhabditis elegans
MLNQGLGILARRASSQTRYGNLLILNNCKTIFKTSLAVQDRSFFFGKRREPKCDLKNQSIVQADGSRKSAWLGDEPLRHEWFSGILTTYTGIRRGPTVGGKEMLGKRVMKNGKLEWEWITYDQAFEISDNVSQAIRKLGIDTGDETNIGIYSKNRPEWILSDMAIHNFSNVSVPLYDTITNDDMHYITNLCEISLIFADSEDKTTRELSNSHKLVRDKSYLSNLKYIVQFDNVSDEMKRVAEKNNFQLWSFNEFVEMGKKQKHRPHVPPTPETLATISFTSGTTGRPKGVMLTHLNLCSTTMAFEEFEHVEGEQDSYLSYLPLAHMYERHCTLEHTLKSDRKIIFSKIGFSRGDPDLLVEDIQALGPRTFATVPRVLDKIYKSVMKQIQNKPVKKMILNSAIAYKLYHYKITGKATRDTLVDKYILHKIQMMLGPNIKQFLIAAAKTDKSLLKFARGAFGIEVLELYGQTETAFNYSNFH

SEQ ID NO: 6134 - protein, 783 aa, Caenorhabditis elegans
MRRAIHFYRLHEEGYSFPIVEYHFEIFSILYYSKLESKSVNKLFYPISVQDRGFFFGKRRVPRCDLKNQSIIQEDGGRKAAWLGDGPLQHGWFEGVLTTYSGIRRGPTVGGKEMLGKRVMKDGKLEWEWISYDQAFETSDHASQAIRKLGIEIGEESKIGIYSNNRPEWILSEMAIHNFSNVSVPLYDTITNDDMHYITNLCEISLMFVDAEIKTKQLIRDKSYLSSLKYIVQFNECSDDIKEMARENDFRLWSFNEFVEMGKKQKHRPHVPPTPETLATISFTSGTTGRPKGVMLTHLNMCSATMSCEEFENEAGVQDAYLSYLPLAHIYERLCLLSNFMIGSRIGFSRGDPKLLVDDVQALAPRSFATVPRVIDKIHKAVMKQVQDKPLKKMILNAAIAYKLYHYKMTGKATRKTWVDKYVLHKIQMLLGPNIRQLILGAAKSDVSAMRFARGAFGVEVLEGYGQTETSGPTTLQLVGDTRIGCVGPPMACAMIKLIDVPELGYSVDKNGGEVLVKGHNVTSGYYKNPEATASSFTEDGYMKTGDIGRFTAEGSLQIIDRRKNVFKMPQGKFVAPDLTESLYTSSSFVQQIYVHGDMEKPWLVAIVVPDPEVIIIILYCFREFHICEVRFFCVSFIADNDCEMNIDTGDSKPLIENEIENDKNVNTRMKPIFVRFHGVAYLASYALTKHNINGKTYEQLCNIPILADDVLRQFVELTEEDKRPRYEGVYGVHLTPVAFSAENGLTTPTLKNKRNAIAQFFKAEIDGMYKKIETSELSNLAK

SEQ ID NO: 6135 - protein, 708 aa, Caenorhabditis elegans
MQLQQINSGAFSVVRRCVHKTTGLEFAAKIINTKKLSARDFQKLEREARICRKLQHPNIVRLHDSIQEESFHYLVFDLVTGGELFEDIVAREFYSEADASHCIQQILESIAYCHSNGIVHRDLKPENLLLASKAKGAAVKLADFGLAIEVNDSEAWHGFAGTPGYLSPEVLKKDPYSKPVDIWACGVILYILLVGYPPFWDEDQHRLYAQIKAGAYDYPSPEWDTVTPEAKSLIDSMLTVNPKKRITADQALKVPWICNRERVASAIHRQDTVDCLKKFNARRKLKAAISAVKMVTRMSGVLRTSDSTGSVASNGSTTHDASQVAGTSSQPTSPAAEVYPNVLLFNPQKFPRNCVHPFTTHPYYSPKESSKKKLFFTLLFEVCPHTSRSHILLRDNTKNIYHPYHCFTNKMSNYERAAPSSHGSSTTKKIANAIADLVIRRSSPSIRRKTEADVHNSNRNRKVSAPANLQHALVPVIDVVVATGALASSSVDNLSASTSSDLGRNLLNKKEQGPPSTIKESSESSQTIDDNDSEKGGGQLKHENTVVRADGATGIVSSSNSSTASKSSSTNLSAQKQDIVRVTQTLLDAISCKDFETYTRLCDTSMTCFEPEALGNLIEGIEFHRFYFDGNRKNQVHTTMLNPNVHIIGEDAACVAYVKLTQFLDRNGEAHTRQSQESRVWSKKQGRWVCVHVHRSTQPSTNTTVSEF

SEQ ID NO: 6136 - protein, 547 aa, Caenorhabditis elegans
MQLQQINSGAFSVVRRCVHKTTGLEFAAKIINTKKLSARDFQKLEREARICRKLQHPNIVRLHDSIQEESFHYLVFDLVTGGELFEDIVAREFYSEADASHCIQQILESIAYCHSNGIVHRDLKPENLLLASKAKGAAVKLADFGLAIEVNDSEAWHGFAGTPGYLSPEVLKKDPYSKPVDIWACGVILYILLVGYPPFWDEDQHRLYAQIKAGAYDYPSPEWDTVTPEAKSLIDSMLTVNPKKRITADQALKVPWICNRERVASAIHRQDTVDCLKKFNARRKLKGAILTTMIATRNLSSKRSYRLTLGAEKLVISMKNIEYWQVLLNKIFATYKIKMKQCRNLLNKKEQGPPSTIKESSESSQTIDDNDSEKGGGQLKHENTVVRADGATGIVSSSNSSTASKSSSTNLSAQKQDIVRVTQTLLDAISCKDFETYTRLCDTSMTCFEPEALGNLIEGIEFHRFYFDGNRKNQVHTTMLNPNVHIIGEDAACVAYVKLTQFLDRNGEAHTRQSQESRVWSKKQGRWVCVHVHRSTQPSTNTTVSEF

SEQ ID NO: 6137 - protein, 346 aa, Caenorhabditis elegans
MSFSLEMPQMLPAPRDCYAVPGKPGHSEPLTVVGWEHMDLKLFYPSALFSSWSIRTALYPLAVLRSQLQLQKQNTVYRSTFHAYSDISKREGFRGLYRGFWITVPQIGCSFIYSTIFEKCRAVLHEQGIQSVGGVAAVAGGLASFATQSIFVPTDIIAQYMMIYKNTDKLTAGHDKSVIDGVRNHVKNGSGLGTSVIKAIYKTDGILGFYRGFWASTAVYVPQMLTFWPSYYWMLGLFNKVPYRTLHPATNRSLLFDQAVAATLGGVISTVATNPMELFRVRLQVHRGSYSKTLETMLRDEKTAVFTKGLTPRIIANSMYSGLVVVGYEIVKRLCAKEEYKHRVKW

SEQ ID NO: 6138 - protein, 346 aa, Caenorhabditis elegans; identical to SEQ ID NO: 6137

SEQ ID NO: 6139 - protein, 352 aa, Caenorhabditis elegans
MGHCTSKDQKEGKRLNRRIDEQIKKDQSMSLRIIKLLLLGAGESGKSTILKQMRILHKDGFSQQDLEMIRPVVYSNCIHSMLSILRAMFHLQIEYGEPDRVRDSQLVFATVHANKEELTEELAAAMQRLWHDPGVRECYRRSNEYQIDDSAKYFLDNLPRLSSPNYVPSEQDLLRTRIKTTGITEVLFELKGLTFRVIDVGGQRSERKKWIHCFDNVNAIIFISSLSEYDQTLREDNCTNRMQESLKLFDSICNSPWFADIHFILFLNKKDLFAEKIVRSPLTVCFPEYKGQQNQTECINYIQWKFEQLNRSSQREIYCHHTCATDTNNVQFVLDACLDMIIAKNLKSMGLC

SEQ ID NO: 6140 - protein, 431 aa, Caenorhabditis elegans
MRIYFLPCYLKISILCSFVLSINTLSRSLTVSSQGVGALIGCLIVSPISKFGAKDVLMRLNNVILIAGVYTGLACAFAPLYLQQIIPKNIKGSMSCFLHIAVCFGSSLGAIFSLPFMFGSETTWPILVVLPAGFGIIMLAASYFIPDTPNNLLQMGRYTEAIESIKFYYDIEDSDEDEIIKEYWDMVPEMPEQLSLCSAFSNSSIRRGILLGMVVSATQIFSGSMVTISYSTEMFEAVSFIDILVPFLPALGSILSILLTIPALRWVETRGRRPLLLKTLMFCIIANVFLLIFTLISSDSSGWASWGFAAAFFMYGIGYNLGVGPVAYFLPAELVPPEAASASLGAAVAVNWICTITTTLFYYPLSKTVGGWSYLIFIIPTSIFSMILWRLLPETKFHYKIDPLEIRLLTDLGPSIAPNYGTLDLDEPTLF

SEQ ID NO: 6141 - protein, 399 aa, Caenorhabditis elegans
MKLREFNFYHGFLPREDLHSTLHNSGDYLIRVSEVVEGETKVNRECRNVVIKRVGNKCFCEPTRTFESVTDLIKYYTDNSGSCSNGRFQLKNPILQQPWEYMHSDVTAGKVLGEGAFGKVFSGTLKLKDGSSAEVAIKMTKVSAFLSKIKIKEMMNEARFIRNFNHKNVVRLYGVAHDEQPLYILLELVKGGSLQDHMKKAKATGTVVPIAEKVRFCIGAARGIEYLHQNNCIHRDIAARNCLLSEKEVKITDFGLSRNGPSYKIKAACKLPVKWLAPETLSSLCFTFATDVYSWGITCYEVFADGAEPYEGIPNATVKADVLNNKFIQMPPHCPDSIKKYMSTFIFVDASCRASMTMAIGDFERMTVMSETGASDPGTKNKFMKILKKKKKEKESKND

SEQ ID NO: 6142 - protein, 472 aa, Caenorhabditis elegans
MLHAMRPVLLVAALLAVTAHAFLGFGSGSTHKDDAEWGHYHNQAQLEAKLGEINEKCPEITTLYEIGQSVEGRPLVVIQFSTTPGEHIPTKPEVKLIGNMHGNEPIGRELLLRFAETLCNGAINNDKEIVQLLNSTSIHILPSMNPDGFELALGTEPAQRQWLTGRSNINGVDLNRDFPDLDSIFYELQKIGVPKFDHLLSLFEDNVDRQPETIAVGQWTLSLPFVLSANFHEGDLVANYPFDAAIDENSQKTAYSASPDDGTFRWLAKSYADNHAHMSKNDHAPCDGTSQDAFARQGGITNGAKWYSVAGGMQDFNYLATNAMEITLELSCEKMPEGSQLPRFWEDNQKSIFEYVWKSHSGVKGMVVDAMTGEPIKRAVVWIRNGTETVPVKHPVTTWSEGDFYRVLPAGKYEIIVAAEGYDIAAKNVTVENKVRDSALVVNFALSPAADEPSENEQEQIAELVNEIARRR

SEQ ID NO: 6143 - protein, 535 aa, Caenorhabditis elegans
MASTSAGQNSAAKPDTTNTTTTASNNNRERERDLKQFTERFVKTVQFPVSERLTVDQVYDRRTGKPRHEVLRDHFIKEGRIEEEAAIRVIQECSSLFRNEKTMLEIEAPVTVCGDIHGQFYDLMKLFEVGGSPATTKYLFLGDYVDRGYFSIECVLYLWALKICYPTTLFLLRGNHECRHLTEYFTFKQECKIKYSERVYDVCMESFDALPLAALMNQQFLCVHGGLSPEIHTLEDIRRIDRFKEPPAFGPMCDLLWSDPLEDFGNERNSEQFSHNSVRGCSYFYSYAACCDFLQHNNLLSIIRAHEAQDAGYRMYRKSQATGFPSLITIFSAPNYLDVYNNKAAILKYENNVMNIRQFNCSPHPYWLPNFMDVFTWSLPFVGEKVTEMLVHILNICSDDELMAECDDTFEGGVGSARKEVIRHKIRAIGKMARAFSVLREESESVLALKGLTPTGALPMGTLQGGSRGVREVAAESGCDSGHLIQSFEEARRLDKINERMPPTMATPPAQSPSQSPIPSRQTTPQPPQNGPSNS

SEQ ID NO: 6144 - protein, 182 aa, Caenorhabditis elegans
MYRQGTNQSVCSDADEFTPEELQEFAQAFKLFDKDGNNTMNIKELGEAMRMLGLNPTEEELLNMVNEYDVDGNGKIDFGEFCKMMKEMNKETDQELIRLAFKVFDKDGNGYITAQEFKHFMTTMGERFSEEEVDEIIREVDKDGDEQIDLDEFVNMVAPIVSDGTKTDPFLEPTASTNPPTK

SEQ ID NO: 6145 - protein, 248 aa, Caenorhabditis elegans
MQHRIMMFLVLFSVIPSIFGLTELGIRSKRQTHICGTYPNQFYSMFPCEYWTSQTVRNPYTCANGGRKIGVGCYYNYQCTPYAANSVCLNNCCCTNPVVTTRAPIIPTTTTRSVSALAYCYNGQRTQVRCTTSVDCAAGQTCMNGICCTTTGNEYTGSCGGLPAISACGTGQTCGSFRCTSSNYCCECQYGRTAGLCSNGCPTGYSCNSNTGNGYCCATCASGRPPFGSCFNGLCASGYTCQAGNICC

SEQ ID NO: 6146 - protein, 3672 aa, Caenorhabditis elegans [sequence omitted]

SEQ ID NO: 6147 - protein, 431 aa, Caenorhabditis elegans
MNDPLDSLSNDEFEIIETFDQINCLHHDFEISSHFLKLWVNFLKSIYLLFHNRGFLKIQKKIPAETEDREDQWSIQQSIRIEPISIQMPNTLQSQRAPSPVGSKAPESLKDEDPDRTPEASIVETPLLTETLKEDRTPMSTPLASLVNSSQSPEFTLQNMSIVSESECSNNSSLVNVADVESTEIALRTSLLLVSELKSQLQAAKMSESTLLKSNSNHEIEENKKLSEKMEVMKNEFELKMQESAASVEKVIQEKDSAIEQLKVQLAQSQQVAELWKQGAEKNSNAQYSDSKTTIDRLLEENSKLRNLVDEEVARRLEESERRKLAEDQLKHARGGSVFDPPASFVASQLAERTTYSLNLEHELITLRKELEETKEALKKSVEESSNKDEIVSALHEDQQESTRMLASNEQVINSLKQKCRQLGVLEDFSS

SEQ ID NO: 6148 - protein, 807 aa, Caenorhabditis elegans
MSSSANLTCKNGILIPALETTPRNAILYLAGLFYCFLGIAIAADIFMCSIEQITSATKKVKKQKKAGQLVAKEEDEEIDEQYDYVRIWNPTVANLTLMALGSSAPEILLSIIEIVGNGFKAGDLGPGTIVGSAAFNLFCISAICVFAVGTQTKRIELYRVFVVTAFFGTFAYIWVFLVLIVITPNVVDVWEAILTLLFFIILVVVSYAVDAQIWKKKKSSDLQEELEMAQHDGKVDDQPEKLSDEIKKWASNLSLNKEENDVIVDATPSVDTVRRWTRSISHTYPSLSDEDQAKILAYRVSRTMSHDRLYYRIRAIRQLSSSWRKSEEEEVLKMENQESTDSASRRKTFVEFSARVYRVDATDETVSLKIERKGNMESKFTVSYATVNGLAKKDLNFLFKSETLQFNPGELHKTISIQLINAANWRPNDVFYVHLKIQDVDEDSKICLGACNVAHVVKENAGFSRSFVTRRGGKLKKPLQVHYETEDVTAKQGDDYTAVKDGILGFEGQEYEKYIDIDVIDDKMDEKDEAFIIELLKVDEPGVSIGTRRKATITIISDDNVLKNITNVRKLMGHYMRQLRPGKATWKEQILNAVSVNAGDLANATVSDCILHALAFPWKFAFAFLPPPTIFYGYPCFVVALIGIGLVTAVVGDVASIFGCMVGLKDAVTAITLVALGTSLPDTFASKIAAESDDTADNAVGNVTGSNSVNVFLGLGLPWVIASLYWASKGESFRVDAGDLGFSVTVFMICSVLFLVVLVLRRKLKAFGQGELGGPFGTKTLSALFFVGLWIVYVGLSIWKMYRKTTN

SEQ ID NO: 6149 - protein, 807 aa, Caenorhabditis elegans; identical to SEQ ID NO: 6148

SEQ ID NO: 6150 - protein, 361 aa, Caenorhabditis elegans
MLRATNNRRTSNNVEKDSLQMAKHGNGPLKPVNAQGLQTKREAREILALKPSNPAPVETAQKSQRINLQDAETKCLAMADDIYKYLVHHEKKYLLEECFMEGGEPTPKMRRILVDWLVQVHVRFHLTPETLHLTVFILDRMLQKKVTSKADLQLLGISAMFVASKFEEVYLPDIHDYEFITENTYSKKQILAMEQTILNSLNFDLSCPSSLVFLRCLSRILSENDASPIDNQAFCYTYNISKCLGELALLDSVMASTPRSHIASASMIIALEVHPVDGIEAENAVSVICKQLGASKKVIEDAVALLAEVSYKNFKQGKLVAIKNKYQSSKLAQVSNLMTDDVLEKINRMGQNAKVDASEME

SEQ ID NO: 6151 - protein, 366 aa, Caenorhabditis elegans
MSLNSILQFIRSIRPSTMRRCFSTATNYFEIHLKNELAGIKNAGTFKTERVIQGRQGVLVKVTGSDKPVINFCANNYLGLSSHPEVIAAGQKALETHGAGLSSVRFICGTQDIHKELEQKIAQFHGTEDTILYAACFDANDSRFRLIVTDGVFSMDGDVAPLGDITSLAEKYNALLFIDECHATGFFGKTGRGTAEAVGGRPDVINSTLGKALGGSMGGYTTGPKPLIDLLRQRSRPYLFSNSLAPSIVGSSIKVFDLLMNDSSFIGSLQTNVSHFRKSMAANGFTILGNDPTHPICPVLLGDAKLAATMADELLKMGIYVIGFSFPVVPKGKARIRVQISAAHSKQHIDQLIEAFATVGKKLNVI

SEQ ID NO: 6152 - protein, 366 aa, Caenorhabditis elegans
MDLFCAAELAELCHRARELIWSEPIFLKLEAPICVMGDIHGQFDDLLAMLDMNGWPLSSQEFEALKDITVRSRETGKRPQSEPHSTQPESSNDVKPPVAAPKSVNKEVTTGYKRYLFLGDYVDRGPFSMEVVILLTALKLAYPDRIYLLRGNHESRSVNTSYGFYREVNYRYDAQLYECFQNMFNVFPFCAVINNTIMCMHGGISEHLTSFNQFSVFKRPLEIPDVGVLTDLTWADPDPTEKGYKPSARGASFVFGPPALRAFLKKLDLQMVIRGHQVVEDGYEFFDGRRLVTIFSAPNYCGQNDNTAAVFSIDKKLKISINVFRPESRDKKPTLLTINHELFFFQFFVIKFTTKQRDFVISVLPF

SEQ ID NO: 6153 - protein, 484 aa, Caenorhabditis elegans
MAEADIAVIGLAVMGQNLILNMNDHGFTVCAFNRTVKLVDDFLANEAKGTKIIGAHSIEEMCKKLKRPRRVMMLIKAGTPVDMMIDAIVPHLEEGDIIIDGGNSEYTDSNRRSEQLAAKGIMFVGCGVSGGEEGARFGPSLMPGGNPKAWPHLKDIFQKIAAKSNGEPCCDWVGNAGSGHFVKMVHNGIEYGDMQLIAEAYHLLSKAVELNHDQMAEVLDDWNKGELESFLIEITANILKYRDEQGEPIVPKIRDSAGQKGTGKWTCFAALEYGLPVTLIGEAVFARCLSALKDERVRASKQLPRPQVSPDTVVQDKRVFIKQISKALYASKIVSYAQGFMLLAEASKQFNWNLNFGAIALMWRGGCIIRSRFLGDIEHAFQKNKQLSNLLLDDFFTKAITEAQDSWRVVVCAAVRLGIPVPAFSSALAFYDGYTSEVVPANLLQAQRDYFGAHTYELLAKPGTWVHTNWTGTGGRVTSNAYNA

SEQ ID NO: 6154 - protein, 484 aa, Caenorhabditis elegans; identical to SEQ ID NO: 6153

SEQ ID NO: 6155 - protein, 305 aa, Caenorhabditis elegans
MATICELVQLPVGSECGKWTILKKLGEGAFGAVYLVSQKEKPKVEYALKVEAESDPLGLLKMEVAVLLEVKKQKIVGRHFLELADRGNLPQKFNYMVMTLVGKSLQDLRKTAPFNKFSMGTAISVARQSLEAVEDLHNIGFLHRDIKPGNYTIGRKEMHELRKVYMLDFGMARKFAREDGTLRNPRARAGFRGTVKYAPLACHIQREQCRKDDIESWLYMVVEMTCGRLPWRNLTESDDVGVFKKECKTTRLRCLFGGCPREFTEVFPILDKGKFFDAPEYTTIYELLEKAMVNTKSNEFPYDWE

SEQ ID NO: 6156 - protein, 513 aa, Caenorhabditis elegans
MSLHSSSEHSSATTNISHLCGLRISERPQKTRKTGVICTIGPACSDVETLRKMINTGMNIARLNFSHGTHEAHAATIKTIREAAENAPFPVAIALDTKGPEIRTGMFANNMKEVQLENGKSVRVSTDPSMEFAATSSHIYADYRNLPKVVQPGSRIYIDDGLISLIVESCEETAVICTIENGGALGTRKGVNLPGTIVDLPAVTSKDIEDLLFGVEQGVDIIFASFIRNADGIHKIRQVLGEKGKHIYIIAKIESEDGVTNCDEIIEASDGVMVARGDLGIEIPAEKVFLAQKMLIAKCNLAGKPVICATQMLESMITKPRPTRAECSDVANAVLDGVDCVMLSGETAKGDYPVEALAIMHNICKEAESAFFHMKHFEELILHTKKPTGMTHTTAIAAVSATITCRAVAIILITTTGKTARLCSRYRPPVPIITVSRDERISRQLHLHRGIFPVYYPKGRIDEWDVDVEERVQYGVNLGKTRGFIHLGDPLIVITGWKQGAGFTNTMRIVVAT

SEQ ID NO: 6157 - protein, 331 aa, Caenorhabditis elegans
MLRVTTSIRKTTKNAVGPRTNLEEVLNCIAMAEDIYNYLVHHEKKYVLDDSFINGGNVNSKMRRILVDWLIQVHLRFHLTPETLHLTIFVLDRIIVKNIVSKAEFQLLGVAALFVASKFEDIYLPDILEYEMITDNTFSKKQIMAMEQTILNALNFDLSCPSSLVFLRCISKTLTENDVNPIDKEAFYYVHNISKCLGELALLDSVMSTVPRSHVASASMIITLNVITVDGINPKTAASMIRKQLGASKQDIYDAIALLAQVAYKNFRHQKLCAIRVIYFYKMFTQFCFQEKYQSSKFGRVSYLMTDEILEKIHRMGRNVEASEAETSEME

SEQ ID NO: 6158 - protein, 887 aa, Caenorhabditis elegans
MKIAIIGQSAFGVDVYKELRKNGHEIVVVFTIPDKNGREDLLAVEAAKDGVPVQKPSRWRKKNPETGKFETLPEMLELYKSFGAELNVLPFCTQFIPLEITEAPAKKSIIYHPSILPKHRGASAINWTLIEGDEEAGLSIFWADDGLDTGPILLQKKCKVEENDTLNTLYKRFLYPAGVAAVAESVELIATGKAPRIVQPEEGASYEPYITTKPELAQIDWSKTQRQLHNFIRGNDKVPGAWAVLNGEKVSFFGSKLWKPKKLPDDAVEVFVSEVPGGKVLVEDRGLLLPGSDGRWVIVDTVKIGTKTVPASKYGQGADQVQELVLTDEEKSTVAKLKKIWTGILKTQVSSDTDFFESGASSADVTRLVEEIKFNTGAELESGQIYAGPTLGENIDIVIRNLRGEGGISVTYDPIVLNVNNMELKFPHDQFIDGKFVGSSDGRTFKTINPATEKPICELPLATVADVDRAVRAAKKAFERGEWRQMSARERGKRLYKLAELMEEHKEELATLESLDAGAVYTLALKTHVGMSIDVWRYFAGWCDKIQGKTIPISNARPNKNLCLTLREPIGVVGLITPWNYPLMMLSWKMAACLAAAKIKLIEISGVINIVTGSGSLVGNRLTAHPDVRKIGFTGSTEIGATVMESCAKSNIKKVSLELGGKSPLIIFADADLEKAVKQACGAVFFNKGENCIAAGRVFIAKSIHDDFVKKLVEEAKQYQIGDPLDRSTAHGPQNHLAHLNKLVEYVEKAVAGGAKVEVGGKRLEREGLYFPPTILSNIDDENFAASEESFGPIMCVSSFDDDDIEDVLRRANDTEFGLAAGVFTRDSSKSLRVAEALHAGTVFVNTYQKTDVAAPFGGFKQSGFGKDMGEEALNEYLVTKTITIEY

SEQ ID NO: 6159 - protein, 887 aa, Caenorhabditis elegans; identical to SEQ ID NO: 6158

SEQ ID NO: 6160 - protein, 139 aa, Caenorhabditis elegans
MKTAVIVGLLCLLAIAYAADEQKIDKLQIGVKKRAENCVQKSRKGDQLHMHYTGTLLDGTEFDSSRTRNEEFTFTLGQGNVIKGWDQGLLNMCVGERRILTIPPHLGYGERGAPPKIPGNSVLKFDVELMKIDRDGEEL

SEQ ID NO: 6161 - protein, 147 aa, Caenorhabditis elegans
MALKRIQKELQDLGRDPPAQCSAGPVGDDLFHWQATIMGPPESPYQGGVFFLTIHFPTDYPFKPPKVAFTTRIYHPNINSNGSICLDILRSQWSPALTISKVLLSICSLLCDPNPDDPLVPEIARIYKTDRERYNQLAREWTQKYAM

SEQ ID NO: 6162 - protein, 364 aa, Caenorhabditis elegans
MEHEVGAKPMLPPGTTCDQFVLQKMLSGGGFGQIFEASIYGSSNEKSVVKVEGQNAMFQLLYNECSCLKSLNTAFNPNNLPGASPFLRFHGYGGIDGFRWLAMERCGENLSDLRKDTPLGRFSVTTSLFIFYKFIEALQMMHSIGWLHRDVKPANVCVDLKSRRHLYLLDFGMSKIYVEKDGTLKARRTSAPFRGTLRYVSVNIHRRQDASRWDDIWSAFYIATENMVGHLPWRRMGDAMKVEEKKVSSDLSRLIYGSDRSRPKCMEYIENELNNSQSDPSYFYVPPAYDKMLQQIAGDLRLRNLSMDTVCLDWMTRQYKPTDQYVAHNPYAVLSRRVNAITPQKMHKKMDKIERQFERSVCFY

SEQ ID NO: 6163 - protein, 760 aa, Caenorhabditis elegans
MRFLLVGFVALLAVSAFIPNVYAEDEIEDAPKETKEETREEDSIKLDGLSVSQIKELRSKAEKHEFQAEVNRMMKLIINSLYRNKEIFLRELISNASDALDKIRLLSLTDPEQLRETEEMSVKIKADRENRLLHITDTGVGMTRQDLINNLGTIARSGTSEFLSKLMDTATSSDQQQDLIGQFGVGFYAAFLVADRVVVTTKNNDDDQYIWESDSASFTISKDPRGNTLKRGTQITLYLKEEAADFLEPDTLKNLVHKYSQFINFDIFLWQSKTEMVEEAVEEEPATTEDGAVEEEKEEKKTKKVEKTTWDWEKVNNVKPIWMRKPNQVEEDEYKQFYKSITKDSEEPLSHVHFSAEGEVSFRSILYVPKKSPNDMFQNYGKVIENIKLYVRRVFITDDFADMLPKYLSFIRGIVDSDDLPLNVSRENLQQHKLLKVIKKKLVRKVLDMLKKLDGAQFDDFWSEFSTNIKLGVMEDPSNRMRLAKLLRFQSSNDADKTTTLAAYVERMKEKQDAIYYMAGTSRKEVETSPFVERLIAKGYEVLFLTEAVDEYCIQAMPEYESKKFQNVAKEGVTIDDGEKAKEAHKGLEEEFKPLTDWLKETALKDLIEKAVVSQRLVKSPSALVASSYGWSGNMERIMKSQAYAKAKDPTQDFYATQKKTFEINPRHPVIKELLKRVTASEEDTTAASTAKLLFETATLRSGFSLQDQVGFADRIEAVLRQSLDVSQDAQVETEQHIEEAEPEPEAAEETTIEEEHSEL

SEQ ID NO: 6164 - protein, 1474 aa, Caenorhabditis elegans
MSGRPAFEQFTAQPPQPAGEVVAQQAGDGAQGQELTISKLENAITSMEEQGLQNDHRHAKAVLLKQKLQSGLPDAVPGQENGGNQQITPAQLNQLRAQVSAYRLLARNEQVPANLIADAVMLRPKVTTLLPEPYEYPGEAENGEKLPYDLMKIFNLHQIRCNRPTTISVPSGIDPVGMLKQRENMIQNRIGLRMKLLNNLPADIPDHMKLKAEIELRALRLVNLQTQVRSEVMACLKRDTTLETALNPYAYRRTKRQSLREARVTEKLEKQQKMEQERKRRQKHTDLMQAIIQHGKEFKEYHRNNLLKMAKSRKAVMTYHQNNERERKKDEIRNEKLRMQKLMQEDEEGYRALLDEKKDQRLVYLLQQTDEYVDSLCSLVRQHQNTEKKKKKEDKKIEKGNQMDEEARVHVRERSTGKALTGDQAPKTEEIEFWLETHPEYEIVPRDQLSDDEEEEEEEAPVEPEEEKDDQYAGMDEETKAKMILEKARNEEDEYDQKTKKQMADYYATAHKIKEKVVKQHTTMGGGDPNLLLKPYQIKGLEWMVSLYNNNLNGILADEMGLGKTIQTISLVTYLMEVKQNNGPYLVIVPLSTLSNWQNEFAKWAPSVTTIIYKGTKDARRRVEGQIRKGAFNVLMTTYEYVIKEKALLGKIRWKYMIIDEGHRLKNHNCKLTLMLNGFFHAQHRLLLTGTPLQNKLPELWALLNFLLPSIFSSCGTFEQWFNAPFATTGEKVELNQEETMLIIRRLHKVLRPFLLRRLKKEVESQLPDKTEYVIKCDQSALQKVIYRHMQKGLLLDAKMSSGARSLMNTVVHLRKLCNHPFLFPNIEDSCRAYWKVNEVNGTDLMRVAGKLELLDRILPKLKATGHRILMFFQMTSMMNIFEDFLNFRRYTYLRLDGSTKPDERGDLLTQFNAPNSDLFLFMLSTRAGGLGLNLQTADTVIIFDSDWNPHQDMQAQDRAHRIGQKKEVRVLRLITANSVEEKILAAARYKLNVDEKVIQAGKFDQRSTGAERKQMLEQIIQADGEEEEEEEVPDDETVNQMVARSEEEFNIFQSMDIDRRREEANQLHRKPRLLEEHEIPDDILKLSFDYEEMERAREEGREVVDQTPNQRRRRREVDYSSDLLSDEQFMKQVEEVEDENNQAVAERKKQRKRKMAGLDENDDSMDDVVLQHKKKKTDPELAEKINEMLDVILEYKNEDGELIADVFQTLPTRKELPDYYQVISKPMDFDRINKKIETGRYTVMEELNDDMNLLVNNAQTYNEEGSEIYVSSETIGKLWKEQYDKFMNPPKPVEEPVKKKEPSTPSTSSSRPSTSGTPSVSDLQRTQQATAQQMLMLMTHMQSLPPAQAQQFQQALMTQTGGNQALMLQYMQSAMLAQRAQASTKVTPKKDEKKETSSSVKTEEAKKDDEPSTSSASAPPPKKKKESEDSEDPMEEDEEEEIIGQKKEPASSRRKSRPTRRFSNEDEEEEDDE

SEQ ID NO: 6165 - protein, 1474 aa, Caenorhabditis elegans; identical to SEQ ID NO: 6164

SEQ ID NO: 6166 - protein, 258 aa, Caenorhabditis elegans
MSALRSTKGLVALVTGGASGLGKGAAEVLAKAGAQVAILDLPQSKGADVAKEIGGIFTPASVTSEEEVRAAFAKVQAEYGRLDALVNCAGIAYAFKLYSVQKKKHVDFEKIRQTIDVNVLGTFNVIRHGVALMGEHEKDANGQRGVVINTASVAAFDGQTGQSAYSASKGAIVGMTLPLARDFAGDGIRFNTIAPGLMDTPLLSSLPEKVKSFLAQLIPNPSRLGHPHEYGALVQHIIENQYLNGETIRFDGALRMPA

SEQ ID NO: 6167 - protein, 1260 aa, Caenorhabditis elegans
MCSYTISYYKVRVIIFLCNSAKIIFRQNPSAEFYNVADNLDSLLQPIDAPANIIAQVDSNGKIIGFVENERIIVGSANTSMSINRAPYKQRSLHTTAGNSIKGSPGNVPFLPGFLEELDDLLAGETTAKSTSGEESKFLSFKDDATLLNTIPTIGQIVLPNHSSVKKPAETPKSINIEEMDMFDLLDMVTSNEYIIHTVAAPVKKSESIESEETPEDDKKVSENEIDEIEIPIIPGNTEKVIEIFGAATEPTKEKFEFAQRLVLSADEEDEYKRLVPTMARKYPFSLDPFQQSSVLCMERGESLFVAAHTSAGKTVVAEYAIALCQAHKTRAVYTSPIKALSNQKFRDFKQIFGDVGLVTGDIQLHPEAACLIMTTEILRSMLYNGSEVIRDLEWVVFDEVHYINNEERGHVWEEVLIMLPAHVKIVMLSATVPNCVEFADWVGRIKNRKINVISTDRRPVPLEHFLYTGQDGKTQKDLFKIIDRSGQFILKGYNDAKDSKAKIYEKEKAGGAGGRGTQRGGGRGGGGNGGGRNWPGKNDKNIYLNLINYMKCSDQLPMVVFVFSRKRCDENAQMLASMNLTTEVEKQHVRLFFSQCVQRLKGSDKELPQVLTMRDLCLRGFAVHHSGILPILKEVVELLFQKGYVKILFATETFAMGVNMPARCVVFDSIMKHDGTERRMLNPGEYTQMAGRAGRRGLDLTGTVIIICKDSTVPQPDVLKNLISGQALRLESKFRVTYSMILNLLRVEQLKIEDMLQRSYVESDSLRESKEKRKSLVDTKNAIQTMSTIECSTCSPNSQLRDYHDALAVFLRKSEHIWPKLNDENVINKLLCSGRFLIVNSAQQQLQNECVLLIKELNNKTLQILVASADADETTNKNAAAIGFSKLPKSELSWLTEENSLLSTSKFGTRGAAHCSTNIRSFRLCEIPLSGIVAVMKKCAKGVQSGEILQEYNMTQIPRFRDRELSENVKKLLQQITTAVPGLKSGEIETYTWKELGSFCQNLDTSFDTDLLEKLEYNLNLPQSFPARHCTRFDEHFSVLRDRIRIERKIESLEYELSSDALLLSEEYHNRLKVLEALNFVEQKMVSLKGRIGCEIHHQELLITELILDYKFHQRSPAELAALLSTLTCQYNSGREMQFGGDTVFGEISESVKSVLTRLESVASKHKSQISDLGCEIRFDLMEVVYEWANGTPFYQIMEMTDCQEGLIVKCIQRLDEVCKDVRNAGRIVGDPALVEKMEEVSASIRRDIVFAASLYTTV

SEQ ID NO: 6168 - protein, 340 aa, Caenorhabditis elegans
MSVFSQLAESSKQNPFSLPVRSGNCASAVSAPGQVEFGSGKYYAYCALGGVLSCGITHTAIVPLDLVKCRIQVNPEKYTGIATGFRTTIAEEGARALVKGWAPTLLGYSAQGLGKFGFYEIFKNVYADMLGEENAYLYRTSLYLAASASAEFFADILLAPMEATKVRIQTSPGAPPTLRGCAPMIYKAEGLTGFYKGLPPLWMRQIPYTMMKFACFEKTVEALYQYVVPKPRAECSKAEQLVVTFVAGYIAGVFCAIVSHPADTVVSKLNQDSQATAGGILKKLGFAGVWKGLVPRIIMIGTLTALQWFIYDSVKVALNLPRPPPPEMPASLKAKLAAQQ

SEQ ID NO: 6169 - protein, 340 aa, Caenorhabditis elegans; identical to SEQ ID NO: 6168

SEQ ID NO: 6170 - protein, 380 aa, Caenorhabditis elegans
MGDLIQLSVGTKVKKWQIDKKLGEGAFGAVYKCSNPKGDLFALKVEGKDEKIQLLKMEVYVLNELKKAGGRHFCNIEDKGQVDNFNYVVMTFVGLSLADLRAISPTKKFSMGTAISIARQSLEALEDMHNIGYLHRDVKPGNYTIGRAEVNELRKVYVLDFGMARKFAHEDGTIKKPRNVAGFRGTVKYAPVSCHAGRELCRQDDCETWLYMVVELTKGSLPWRNMTEIQDVGNEKRAIRRDPIVKKKMFGGCPREYLDILEAIDKGQFFDEPNYERIYYLLREAMKNTGSTEYPYDWEQSLMKKTKEEQEKKKKGVVDQTEKVIKKKEVELAEGKSHKETKEVTKVSKEIVEEKKEEKKEEKKEEKKEKYEDDKKEELY

SEQ ID NO: 6171 - protein, 416 aa, Caenorhabditis elegans
MMTAVSQMSVPSSRILLDVDCRVCEDHSSGKHYSIFSCDGCAGFFKRSIRRHRQYVCKNKGSPSEGQCKVDKTHRNQCRACRLRKCLEIGMNKDAVQHERGPRNSSLRRQQMMFDHGSSPNSPEMGSESDAIILPTSSMNRDTVAGTAARIFFALVGFCQNPLNGVPKERQMTMFQQNWAALLVLHATETRAITSKQIRTETISGSSEQRNAVANAFEIIERLQLDNREYMMLKHFTMWRDTPSAIQIVFQLASIQNFTHRTEPTRYIQCINAIAAIPTTSIIDVLFRPSIGSASMPRLIQDMFKPPQQPTPTSLFPMANFNLNFLLKQEKTETEEGEDIEEEDDATSSNQFDENSSTDDRSVGELDPVQLFLALNSSTQPSSASSPSSSRPRHSIRSITELLSIQEEESVNVEEV

SEQ ID NO: 6172 - protein, 173 aa, Caenorhabditis elegans
MKEYKIVVLGNGGVGKSALTLQYVQGIFVHTYDATIEDSYRKLSKVDAENARLEILDTAGTVKLSIQEIQHMLIQEQFTGMRETYYRTAQGFVLVFSLAETSTFENLKQTFTDIIAIRGKEVPMILVGNKSDLAETRQVDESEAHNFAEKLKIPYFETSARLNQNVSEVGIYL

SEQ ID NO: 6173 - protein, 646 aa, Caenorhabditis elegans
MLRSSNLCRSITASRGKHALTGDDYQYLEKSEIPSYHFQKSLRRLPIPKLPDTVNRYLASSKAVLSPDVFAKTEATIRSFEANEGPKLQEALLEYDKAHRDTSYISEPWFDMYLRARVPVAVNYNPFMMYAPDPNPKFNDQLTRATNLAISYARIKRSLDENLLGPEVFHMNPKKSDTKLFRTICKTLPPSLSWFGAVAFKAFPLDMSQYKSLFCGSRIPKKEKDMLYLDASQKHFVAFYKGHPYAVRIFDDDGKLLDAEDVHASLAWILSNGKEAAPESSIGSLTSLDRDSWAEARVELENAGNGEYLKKIDGGLFAICLDDLKTEEHKRLVQSLLIGDDARNRWFDKCFQTIIDANGQATINFEHSWGDGVAVLRLMEESFKDTNKNHFVSPDDTPKSHNPAHVQALEFKLTDSLKSKISDAQKKHVSANSDLDFATMEFEGLNRDLIKKTKLSPDSVMQLAIQMAFYSLYKEFVPTYESCSTAAFLKGRTECMRSATSATRAATLAILEENRKDVRQLLTDCSTQHFQLVKEASMGQGYDRHLLGLKITAQRLSQPTPDFFQDPGYTRMGHFVLSTSTLSTDTIVFGGFGPVVQDGFGIGYNVVPNKLGAVISSNKSKRDAAAFSNALYKSLDILRGHLLDPK

SEQ ID NO: 6174 - protein, 646 aa, Caenorhabditis elegans; identical to SEQ ID NO: 6173

SEQ ID NO: 6175 - protein, 342 aa, Caenorhabditis elegans
MSPLPENTLIGMCNPLLDIQTTVEKAFLDKWGLKENDAILCDDKHNDMFTELTRDFKVEYIPGGAAQNSLRVAQWILNAPNRTVFFGAVGKDQYGDLLASKAKEAGVNVHYQINETVKTGTCAALINGTHRSLCAHLAAANTFTQDHLQKEENQKIIEQAKYFYVTGFFITVCPPAILQLASHSAEFNKTFTLNLSAPFISQFFFDKLSEIIPLVDVLFGNEDEAAAFAKANGWETTCVKEIALKAAALPKKSTKPRLVVFTQGPEPVIVVEGDKVTEFPVTRLPKEEIVDTNGAGDAFVGGFLSQFIQGKGVEASVTCGSYAAQEIIKKHGCTVPSVCKYH

SEQ ID NO: 6176 - protein, 405 aa, Caenorhabditis elegans
MAENTASENDVEKVYIAIDDKIKGYQVVESIGEGAYGQVFKVSKNAKKYAMKVEPNRLDGGPASITKEIEVMMELNNRGAKFFPIFETGGREPKFHMVVMTLLGENLQVLRMKGCNPKACTPGTWSRIGIQCLFVVKQMHDCGILHHDLKPTNFVWGQSDEALTCRVFYLIDFGISRKFIRHVKGTPINQQNGFEFRTEKKKVHSLVGTPKYTSPKAHAMADLGRGDDLWSLMYMIAELVKPLPWEILEAKMLENTKLKSKLKDHFGMDGFGKIETMLHACTFNSFPNYEMIYLAFKEVFNKSGVSWLDPYDWEGKNMPSYKRWRQHAEKQRPLFAWEQPDVGSYFRKDPFTTVQNANVTGKTTKKKKHGKETTDETTVETCEEINGSVKKPQKGTELKKAVFHK

SEQ ID NO: 6177 - protein, 522 aa, Caenorhabditis elegans
MACKRHSVSDPISKDLVECLRESMQRDLKFETPYVFVIFGASGDLAKKKIYPTLWWLFRDNLLPVNIKFIGYARSDLTVFKLRESFEKNCKVRENEKCAFDDFIKKCSYVQGQYDTSEGFQRLQSSIDDFQKESNNQAVNRLYYLALPPSVFNVVSTELKKNCMDHGDSWTRVIIEKPFGHDLKSSCELSTHLAKLFKEDQIYRIDHYLGKEMVQNLMVMRFGNRILAPSWNRDHIASVMISFKEDFGTGGRAGYFDTAGIIRDVMQNHLMQILTLVAMEKPASLNAEDIRDEKVKVLKAAKVVELKDVVVGQYIASPEFDHPEASQGYKDDKSVPADSTTPTYALAVVHINNERWEGVPFFLRCGKALNEKKAEVRIQFKEVSGDIYPSGELKRSELVMRVQPNEAVYMKLMTKKPGMGFGVEETELDLTYNNRFKEVRLPDAYERLFLEVFMGSQINFVRTDELEYAWRILTPVLEELKKKKVQPVQYKFGSRGPTEGDELMKKYGFIFTGTYKWVAPKL

SEQ ID NO: 6178 - protein, 1091 aa, Caenorhabditis elegans
MSSPRRTRIMFDTSSDDSQSDEKIDDFICRSSPQRQSKESDDQEDSVVDESMKSVNSPIVNTPSSTASHCTNSFATSTPKSKSNASTRLGSSYGSSRSSSQNHESHDRSRSFVQYDENKPLTPISKKLAESTDLRSKAQLRERLLRKSLKQNAEDSSPTRAASGGGWGSSADVKKSPEVSTGLFETALSPIAKSDRRSSEYNSSTFLNVQKVATSTAINDIGGREEIVDESFPAPRTTAKQDDSDIIEVTPEKVVSNEKRKSGIAINLDDSDIIDVTPVKTTSSRPPEPQRPRLPTSPINSEYAKLSYKELLAKKNKVMGLISLSLDLPDGGRRVIKQFQELDDEVERRKEMGLAEEIVDDDEDDEIFVIEDDEPSHRQVAPKFPSGSVMTQNGLLPKRHIVDPLKAPQPDFNAMLEKDNKKMMSGKMTDEKYKRIQLVSDRVVRQLAEATHTIPDETELTDTPKGFKLELMPHQKAGLTWMRWRETQPQPGGILADDMGLGKTLSMISLIAHQKAARRARREDGNDDKDKEKRKVVKEQGLIPSNGTLIVAPASLIHQWDAEIDRRLDDSVLSTYMFHGTKKQRDIDARRLARYDVVITTFNLIANELIEKIRTKSKADDSSDGESDSNHTGIRRAVGKDDSVLAQICWSRVILDEAHTIKNRQSLASKAVCRLSAFSRWCLSGTPIHNNLWDLYSLVRFLRIRPFSDDKYWKESIMPMKPIMADRVNLLTKNLLLRRTKDQTCAVTNQKLVQLPPKNVEVHELELDGDEAQAYEIMMEAAKKFVKKLLQDSNDMKNHGFIPRRNRRAGKEGEVQNPFNFGPRDLAAGSNFEKMSCVLMLLLRLRQACVHFNITKTGVDMDAFSLIGGDNAEEANVDDLNELLEKTMNMTLGNGDNEERDKPRATTRIFDPDYLSCKIKNTLEIVENIMEKKEKVVIVSQWTSVLNLIEIHIKSSGFKYTSITGQVLVKDRQERVDSFNREKGGARVMLLSLAAGGVGLNLTGGNHLVMVDLHWNPALEQQAFDRIYRMGQKKDVFIHRLVTKGTIEQRVVMLQKDKVALASSVLDGNATRKMNKLTTADIKMLFGLNEK

SEQ ID NO: 6179 - protein, 1091 aa, Caenorhabditis elegans; identical to SEQ ID NO: 6178

SEQ ID NO: 6180 - protein, 397 aa, Caenorhabditis elegans
MFTSTLAPMVLALLENDTSIIATTQSSMSPEILEYIKFAKGIYQWLVPLTIVILLVAILGNGLIVLSSPWLSSPVSPYLKLCISLAAADMWAATLLISGLIVNSYLPVVTGYKKTSLCFDALLEMFRISGMLTSDMHLFALAINQFLGTMYPLKYKIMVTTRRLRYIVFCLWFVPLLFVFGWFVAKEDDGLRHANCSFNFYRRFPFRITIFLIFMLPLISTLIIYGCILVKLLKAKVEFESYCTDRKIDISQNSQNSQNGQNGSKNSKTPASRSYSTRSTNVYSKLKLVWTTLLIVSTFSLSWGLCVLYFVIVCEEGCMLIYNENIGLYLSLFLSSSVNILVMLKLASNPFIYTLRIKAIRSSVDQFINKIRRRPIDPKSFYVHSLVPTTTMEPTAI

SEQ ID NO: 6181 - protein, 710 aa, Caenorhabditis elegans
MCGIFAYLNFLAPKKRSEIVDILVQGLQRMEYRGYDSAGIAIDGSNDIENPHSKIALLRKRGKVSVLNDYIKENNEKLNMDMEYNIHCGIAHTRWATHGSPRDVNSHPHRSNDNNEFLVVHNGIITNYREIKEYLEKKGHKFESETDTEVIAKLTQHVHDRYPDFSFRQLVETVIQQLEGAFALAFKSSRFPGQLVASRRGSPLLVGIKSNSTLHTSHFPVSYSKGRCFMSNNATHLREETSFVETPNNILDLSIAVRNPSGSAKLPDNNSTTRPFDSTDFEVEYFIASDAAAIIEHTKQVLFLEDDDVAFVEDGSLTIHRISRHADSGEQKREVQLLELEIQEIMKGSYKTFMQKEIFEQPESVVNTMRGRVLPSGQVVLGGLKEYLPAIKRCRRLIMVACGTSYHSAIACRQVLEELSELPVVVELASDFLDRETPIFRNDVCLFISQSGETADTLMALRYCKPRGALTIGVTNTVGSSIGRESHCGIHINAGPEIGVASTKAYTSQIVSLLLFALTISEDRISKMKRRAEIIDALNNLPILIRDVLDLDDQVLKIAEQIYKDKSLLIMGRGLNFATCLEGALKIKELSYMHCEGIMSGELKHGPLAMVDEFLSICMVVCNDHVYKKSLNALQQVVARKGAPIIIADSSVPESDLAGMKHVLRVPRTVDCVQNILTVIPLQLLSYHIAELNGANVDRPRNLAKSVTVE

SEQ ID NO: 6182 - protein, 484 aa, Caenorhabditis elegans
MIDNYLLRYQFFHGFVLQELQLILLKTNGDFLLRLSHQPEKNAKKPTTPDKSATDPIPLTRVILVLSVNITQKTGTTRSFYGDLEDVKKENMDMHLFIEETAGKWTSFYIERRFKFPTIDELINYYKVNPICYHNTRVFLKRPIVLQDWELRAEGIDMTPKKLGEGAFGIVYLGRWAQPFSVDQKEFHKWCDVAVKTVKNDDSRAALLEVMHEARLQLQLRHKNVLAFRGVFLLKKPIMLVSEFCEKKLFENHFPYGSLKDYLQKSKVSVDEKLRFCLGSSCGLEYIHFKGLIHRDLATRNILVSADKTPKIADFGLAKHASSYKMRKATKIPVRYLAPETLSSFVYSTKTDVYTFGLVIWEIFANGQEPYMKAQPHQECVAPKNTQLRGRHIKELIRKELFVKFNQEAPVALQQYVAAKLFVVDDKKRPDMPEVGVTSNSSAPYDVSGINVPGRHVEGGLDKDEILVQDVVTKIDLLGVLSFK

SEQ ID NO: 6183 - protein, 376 aa, Caenorhabditis elegans
MEGGRNCVMTVQQWQPEYNDMNQIRAIFSLLYLLVWVGAIVGNTLVLYVLTFNQVSLSVRTVFVGCLAGSDLLMCLFSLPITAISIFSRVWVFPAIFCKLIGVFQGGTIFVSSFTLTVIALDRCVLILRPNQEIVNFPRAVFIVFCIWLLGYSLALPVGIYSDIAVYDEICGTFCEENWPDFNPDTGRSGIRRAYGLSVLVLQFGIPALISSICYWMISRVMSDQLARRRGHNIRPESETKLVNRKTRANRMMIVMVVGFVLAWMPFNAVNLYRDLFGISKWYSTVFALCHVCAMCSAVLNPIIYSWFNPQFRQSITTLFKGTDEARLIKKKPQSTSKMVSYPTNFSEIRKETEIASTKTKITIAENDYRAGDQLL

SEQ ID NO: 6184 - protein, 639 aa, Caenorhabditis elegans
MATETCSLLSVGQSEYGAAASMISALEAVDPVTLTWHNISIHAEKSGKQILENVSGIAKPGQLLALMGASGAGKTTLLNMLLSRNLRGLETSGSVKVNGHELGRGITAISGYAQQDELFVGTLTVKEYLDIQAKLRVNGDSEKRRRRVGNVMSQLGLYKCQNTRIGTIGGQKGISGNTEKRCGEMRRLTFACELLSNPSILFCDEPTTGLDSFMAESVVQVLSNLAKSGRTVICTIHQPSSQLYLMFDRVMFMAGGKTAFLGSPRDAIQFFEDAGFACPRNFNPADLIIHTLAVMPNEEDKCRQRIEVIYTKFQNSSYGRTLKFGVEKSDEGQRPSERHKTGILTQIGALLERSAIDTWRNPSLTRAKVIQKSIMGLFIGLLYLQSPLTSIGISNLNGALFYLVCELTYSTIFGILNFLPADFPLVSREYHDEMSYFPFIILRILYYGDPEKCVFNWRQNNTKHFRIHGFAAKYLMGPNFEIRIILRLHNIFEKLEFQVLYACLIAFLIEQSSSACGIMISCISPSLPIAMSTAGPMLTLLSLTGGLYANVGALPSYISWIQYLSWFRYGFEAFAINQWSSVNEQNTTIWTDEKRDSVLSQLSFRAEMFYPDLFIMSAFILIFYTIGYAGLALRVSKAR

SEQ ID NO: 6185 - protein, 451 aa, Caenorhabditis elegans
METAWSNILNYKNVSDRYILTEKDKKGAFTRQYFEVYEARLKELKPRILENAEREIGKGKFTHSQLSDAKQDEEIFVVGVIVKRIAARPSILKSLLNEDKVAYDDYEEDAEEDEVKRYAGSIEDRIELESDKQTVRLEGNISMDECATGCCVGVLGKLGKEGVFHVNRLVWPSVKVPKKVAVDGTIAFVSGLDLTGDLEDDRLTISGLEFMADWMNVQVGNENQCPPIDRLVVIGPLVETKSNGCDVQSVVRTLTLSRAEKHSSTASLITVDKIINSIAEKPLVNTVDVTPGVGDPCSSMWPLPPIHRVCLPRCGMSDKKVNLVTNPYEFEVNGLRVMTMSGENVSELLRTSLKWTGADAIENIIKWQHVAPNCPDTLDAFPVAERDPLIMDITPHVIICGNQPHAEFRHIPIDGSNCLVVCLPKFSKTRVACFLNLSDLSLKWQNFDHQF

SEQ ID NO: 6186 - protein, 184 aa, Caenorhabditis elegans
MTEYKLVVVGDGGVGKSALTIQLIQNHFVEEYDPTIEDSYRKQVVIDGETCLLDILDTAGQEEYSAMRDQYMRTGEGFLLVFAVNEAKSFENVANYREQIRRVKDSDDVPMVLVGNKCDLSSRSVDFRTVSETAKGYGIPNVDTSAKTRMGVDEAFYTLVREIRKHRERHDNNKPQKKKKCQIM

SEQ ID NO: 6187 - protein, 305 aa, Caenorhabditis elegans
MPSSIYRYETIQVAGRGAFGLVVIARDTLTSKRVAIKRIMVPNVSKVSLAREISCLRNLHHRNILKLLDCFPSADLMSIVTEEVPYTWYYTQILSGIAYLHSKEIMHRDIKPENILVTSRNVVKIADFGQACFYMPKDPNQEYDVNVATRWYRAPELLFGSKKYKPDVDIWAIGCILAELVRGKPIFPGRSELEQISIIFGVLGTPNEDNWPNWRTMPDANKLLFEPKEPRNNWTEILLCKEISNNFTEFLGSHLQFFKRLKASELLKEPWIKQGLPLVEPNYRISKKSTRRNQRDALPPLHVFL

SEQ ID NO: 6188 - protein, 248 aa, Caenorhabditis elegans
MSDTVEELVQRAKLAEQAERYDDMAAAMKKVTEQGQELSNEERNLLSVAYKNVVGARRSSWRVISSIEQKTEGSEKKQQLAKEYRVKVEQELNDICQDVLKLLDEFLIVKAGAAESKVFYLKMKGDYYRYLAEVASEDRAAVVEKSQKAYQEALDIAKDKMQPTHPIRLGLALNFSVFYYEILNTPEHACQLAKQAFDDAIAELDTLNEDSYKDSTLIMQLLRDNLTLWTSDVGAEDQEQEGNQEAGN

SEQ ID NO: 6189 - protein, 318 aa, Caenorhabditis elegans
MAAAPPSADPLDKALIVDVDQWIEQLYECKPLSENQVKTLCEKAKEILEKEPNVQEVRCPVTVCGDVHGQFHDLMELFKMGGKSPDTNYLFMGDYVDRGYYSVETVSLLVCLKIRYKDRVTLLRGNHESRQITQVYGFYDECLRKYGNSNVWKYFTDLFDCFPLTALVDGQIFCLHGGLSPSIDTLDHIRALDRIQEVPHEGPMCDLLWSDPDDRGGWGISPRGAGYTFGQDISETFNHSNGLTLISRAHQLVMEGYNWSHDRNVVTVFSAPNYCYRCGNQAAMVELDDDLKYSFLQFDPAPRRGEPHVTRRTPDYFL

SEQ ID NO: 6190 - protein, 339 aa, Caenorhabditis elegans
MTVKTRSNIAKKIEKDGGPETQYLAVDPNEIIQLQEESKKIPYKMEIVWRNVALFAALHFAAAIGLYQLIFEAKWQTVIFTFLLYVFGGFGITAGAHRLWSHKSYKATTPMRIFLMILNNIALQNDVIEWARDHRCHHKWTDTDADPHNTTRGFFFAHMGWLLVRKHPQVKEQGAKLDMSDLLSDPVLVFQRKHYFPLVILCCFILPTIIPVYFWKETAFIAFYTAGTFRYCFTLHATWCINSAAHYFGWKPYDSSITPVENVFTTIAAVGEGGHNFHHTFPQDYRTSEYSLKYNWTRVLIDTAAALGLVYDRKTACDEIIGRQVSNHGCDIQRGKSIM

SEQ ID NO: 6191 - protein, 284 aa, Caenorhabditis elegans
MPGTRFSGKVVLISGSSKGIGQATAVKFAAEGAKIVLNGRSADDVEKTRKLCMEVGAKPWDLLPTVGDITNEDFVKMMVNTVIHNFGKLDILINNAGTLEVDMTGKEGWEMGVDVMDRSWNSNFKSVLMLTQAAMPHLIKTKGDIVNVSTFLSSGPIGVMSMPYYAVPKAALDQMSRSMAHEYMLKGVRLNTVNPGLVSTSFFARLPGVGDDNARKMENYVQSKTEYIPLGRVCQASDVAETILFLADRKVSECIVGQSIIIDGGSRLCCNIDMSDFKEQMAKA

SEQ ID NO: 6192 - protein, 284 aa, Caenorhabditis elegans; identical to SEQ ID NO: 6191

SEQ ID NO: 6193 - protein, 830 aa, Caenorhabditis elegans
MPITKDGPFCLKVMNKDKKSVAKFLRNEPKRSYKQTGLASLFGCCSDTEDTMEVLDDNGLIIATSFLHHDQFRGILITMKDPAGKVLIGIQASRDQKDVFAVSGPDNRYLGEIRQKIISSGNSTDNYKGVACWFSTEVSLNVKVFFMAAAFLIEIDYFSETKSRQAPFRTPEADYLNPIIKTPPHNERVPKMKTNISKTRKKKGKVSDASKDSRPSETKKETLMMPEIHHTKHFDSIGGEEQAFAKKEKVEEFKPTEAVKEEVDVNGMSRDQFRNAAKKVVDYLMKQDESIRAARCSPALKPGYLKALLPPKAPQKAEDIDDILEDYHKLIVPGLSHSSHPNFHSFYPAGNSFHCLLADLLGGHIGDAGFYWTSNPALTELEVLMMDWLGEMMALPKEFLLFPEASRGGGCMQRSDTESNFLVLVAARTDMIRRMKQRDKRLRSSDILARLVAYTSSDARRSIKMKMAAEVAMVKMRVLPTDQNFILRGDTLHAAIMADIERGLIPFFVGANFGTSGPCSFDHLHELGPVCREHGTWLHVDAAYAGTALICPEIRGLMRGIDWADSFCTTPSKLIIAVCDVCCLWVRDRHKLQHASLENHPDLPFKGLPTSQRVGALKIWFMIRSFGVENLQNQIREHIRLGQVMTKILQKDLRFEVCNKVVMGLICFRAKSNDMFNKALLYRCNETGNVSLASCVLQNKFVIRMCINSPKCSEEDLDSAYKLICNEYDILKPFQYRIEVMNQAELETFIRDPAKIHSSAEVSRRFPVVNPLEPCRSLAQISSQMHTAEYADPPGKSNKSPQVAAKGELPSAAPPSSRTPNSDISEKSDR

SEQ ID NO: 6194 - protein, 536 aa, Caenorhabditis elegans
MLSTLSRGARSVAVRSYSAATLDAHSQVLDEQKPMEEQVNPSFYKMVDFYFNKGAEVIAPKLAEELKSNSLSQKDKKNLVSGILGAIKPVNKVLYITFPIRRDNGEFEVIEAWRAQHSEHRTPTKGGIRYSLDVCEDEVKALSALMTYKCAVVDVPFGGAKGGVKIDPKQYTDYEIEKITRRIAIEFAKKGFLGPGVDVPAPDMGTGEREMGWIADTYAQTIGHLDRDASACITGKPIVSGGIHGRVSATGRGVWKGLEVFTNDADYMKMVGLDTGLAGKTAIIQGFGNVGLHTHRYLHRAGSKVIGIQEYDCAVYNPDGIHPKELEDWKDANGTIKNFPGAKNFDPFTELMYEKCDIFVPAACEKSIHKENASRIQAKIIAEAANGPTTPAADRILLARGDCLIIPDMYVNSGGVTVSYFEWLKNLNHVSYGRLTFKYDEEANKMLLASVQESLSKAVGKDCPVEPNAAFAAKIAGASEKDIVHSGLEYTMQRSGEAIIRTAHKYNLGLDIRTAAYANSIEKVYNTYRTAGFTFT

SEQ ID NO: 6195 - protein, 372 aa, Caenorhabditis elegans
MPATNRRISLGSPKDLREVKFFDEEPIPDVPPKGARVKVCYAGVCLTDREVSNTKQARITNGIKDTSLFPGYEVSGIVESFGAECTPGDYDLTIGDKVIVWPTDEMCSHGYADYVAVPTLHFLVKIPETLSMHVASILPAGATWALSAVLQARPIVEAFSQSKGFCNILIVGAGGLGLWLLKLAKHFLAINNDKKIRLMVADAKEERLSLAERNGADFVVHWDDSEFEEYLIMRTKDVARTGVNVVFDFVTSPRTVTRSLKCLAEGGVLFVGGLSGLDVQLPIKHVAKNRLAIMGVTRGSIEQLKNLVNLIAGGQIDAPDYRVYPVDQASAVLKQLSMSEVEGRAILEVCDPSSALDADQSGGVPIPAATSE

SEQ ID NO: 6196 - protein, 696 aa, Caenorhabditis elegans
MKPKKEVRKDALPRPEFKSWYDLLFSVVNLCIGLSNFLIFLAKVHEYRGGAFILAYGLILIMLGYPVLYLELIIGQFHRCSPWIFIRRCAPILQGFGFMALVSAVTILYPYQYSVARAFKFLLSLARYRSQDMPWSTCGNWWNTETGHIVFQNKCVNETKIKMEAVESAEIQYLRNVIHRIGVSHMSFTNFNYGIAYSIFIIWLTISFVQNRVNTRTTPLIYVHEYIKEASLIFLLFQIPTVFAFLICHFLLVRSLHLDGAIEGVQEMLRIEWAELLYSKIWIDALNLVVQSLSIGIGGHTVMASFAPPEKNTFRVATLAVILDTGLSIIISATVYSILGYTRFILGRKSVYDLTVLPNGLLLTHSTFPVLLRQVAANSWLWVFLYYSTLVVVGWKSCALIMKTITVTIADIFNIKMKTYFFDCLCIFVSMVIATSGLFLCFESGPLYLTMIQDIQTVATGIFITAELFIVLELYGLDTIYGDIHELMGQPSNDQWSRAYTWPIWKWRWTTAPAFSIIFAVSAFFRPFPSPENDLEYYYFYDLIQFFILFFVIVSPFGFAYYSYLKMWHHFEKFEKEKQFNSSILWHRQLHLRSWNRIEKEMSEEQRNFAHQHLPEKESEDLEEFWKLVYRPFFETPSHETVMMPIIPKSKEIVKPRQASKKRSKKRSKKDEFLTFEVIYLYNGSWIYKTIFSDVL

SEQ ID NO: 6197 - protein, 492 aa, Caenorhabditis elegans
MSSDPSLLSWNGIRLLLICSLLTAMTNFPSGFSHTSVNTAVHKLNEYLNNSFTERYRPLDHEEVSLLKSGINSAWYLFQVVGAMSSPFLCDNYGRKVAFALSIAFMTLAGAMQMLASFTPYSEVLIAGRLIAAVFSPLSDAALILYLQEISPSSLRGTMSSLYSTGYSTMCLLGMLLGHEGLLGHSLSVLLFVPVIPGILSTAFILWMPDTPKFLLLVKKDKVAALKSLRFFQGSLPDQTLLIDSMEHHHKEDANNNNNSEEKADSATSVMHILKKPHLRKAMMLSVSAAILTLPFYPILQNSTFFFTDMGVDMKTSQLASSFMMVVLTISSICSTLIIDKLPRRILLLTCGSCTVLFLTIFAVSEQMHQKSIAMGACFGFIMSYGIGVGPVIWSIPPELSPLADRSMMFCLVYSIHSCLVVVTNFATIPLFMSIGAFSFVLLFAIPSAFALVYLLVCLPETSGREIHVIINELKGIVEDKEPSRDVITSIA

SEQ ID NO: 6198 - protein, 809 aa, Caenorhabditis elegans
MGRVSGTKKTSMKQKKKRKCHENWKNRKTKSDKATVFIKGEYHKTLKESRPEQLFSAVYSSWRTDSGVIFSFSQSNMAESEEYARVISFNNDHDELIIYQETVTDVGGVIWDSALMTIHYFFKYPKPFEGKKVLELGSGTGVGGIALAALGADVIITDLPERLALIEKNVEANRKLTGNRIKVQVLDWTKDRIPEGLDMNMAPPHPRDPSTAANYEQVTVSHYALKWKVDFEKKHIAGDVSITLDVKQDTERIVLDTRDLSVQSVALNLNGEPKKAGFTLEDNQALGQKLVITTESLKSGDRPVLEIKYESSNNAAALQFLTAEQTTDRVAPYLFSQCQAINARSIVPCMDTPSVKSTYEAEVCVPIGLTCLMSAIGQGSTPSECGKRTIFSFKQPVSIPSYLLAIVVGHLERKEISERCAVWAEPSQAEASFYEFAETEKILKVAEDVAGPYVWGRYDLVVLPATFPFGGMENPCLTFITPTLLAGDRSLVNVIAHEISHSWTGNLVTNFSWEHFWLNEGFTVFLERKIHGKMYGELERQFESESGYEEALVRTVNDVFGPDHEYTKLVQNLGNADPDDAFSSVPYEKGSALLFTIEQALGDNSRFEQFLRDYIQKYAYKTVSTEEWKEYLYDSFTDKKVILDNIDWNLWLHKAGLPPKPKYDSTPMQACKDLAAKWTTEGSEAPTDGEVFAKMSNSQKLAVLDAVRVNKTMFGDRMPALTATYKLDQAKNAELKFSWLMLGLETKWSPIVDASLAFALAVGRMKYCKPIYRSLFGWSATRDRAISQFKANIPNMHPITVKAIQSLLK

SEQ ID NO: 6199 - protein, 695 aa, Caenorhabditis elegans
MDSKSEEAEPLLKPKNVEDEGLITSLDVDPTQKSRSPTPKPTPIPVLINDTPVASEIEQVEKELAHSSERFRKPKTLSVTNDTESARIPSQVKTNAKKLVFQNIQAVVLKKKGVRQEILKKIDGVARPGELTFIMGSSGAGKTTLLNILTGRNLKNIETDGDIMINGRNMISNEMKKLSAYVQQDDVFIGTLTVRETLRFAAKLRSPSALGATELDSIVDELLVMMSLKKCENTKVGTMTEKSLSRGERKRLAFACEILTDPPILFCDEPTSGLDSFMSHQVIKALRQLTIEGKTVICTIHQPSTSVYHMADQLILLSQGHVAYAGPAKQVDAFFGRCGYPIPKFVSSPDHFMRVISHKSFETEDDYNKRIEKIVLEHDIMKKEQSTHSTLSSSRREHPETAPFTFPRTWTAQFFFIFQRSSIQLWRERSVLLVKLIQTLIMSIMIGSTYYGLEIDKKSLPSFKGFAFVSVQMMHMLFMMPAMTVFWKDYPVVVREFQANMYSPSAYYLAKTTADSIQYLVFPVIFSGILLGMTSLPYSVVIITNYLIINILLSLNACSVGQSFAAMCGHLATGMTVLPIVCVPLMVFGGFMITYEAIPWYFLPFAWVSWYKYGFEAITIVYFNHNSTISGCESNSSVATLKMSIDSNCTTGIEFIKAQAFEETHLWLDYTVILAVILFWKILGALLFTWRIRRA

SEQ ID NO: 6200 - protein, 650 aa, Caenorhabditis elegans
MKLEELVTVMLLTVAVIAQNLPIGVILAGVLILYITVVHGDFIYRSYLTLNRDLTGLALIIEVKIDLWWRLHQNKGIHELFLDIVKKNPNKPAMIDIETNTTETYAEFNAHCNRYANYFQGLGYRSGDVVALYMENSVEFVAAWMGLAKIGVVTAWINSNLKREQLVHCITASKTKAIITSVTLQNIMLDAIDQKLFDVEGIEVYSVGEPKKNSGFKNLKKKLDAQITTEPKTLDIVDFKSILCFIYTSGTTGMPKAAVMKHFRYYSIAVGAAKSFGIRPSDRMYVSMPIYHTAAGILGVGQALLGGSSCVIRKKFSASNFWRDCVKYDCTVSQYIGEICRYLLAQPVVEEESRHRMRLLVGNGLRAEIWQPFVDRFRVRIGELYGSTEGTSSLVNIDGHVGACGFLPISPLTKKMHPVRLIKVDDVTGEAIRTSDGLCIACNPGESGAMVSTIRKNNPLLQFEGYLNKKETNKKIIRDVFAKGDSCFLTGDLLHWDRLGYVYFKDRTGDTFRWKGENVSTTEVEAILHPITGLSDATVYGVEVPQREGRVGMASVVRVVSHEEDETQFVHRVGARLASSLTSYAIPQFMRICQDVEKTGTFKLVKTNLQRLGIMDAPSDSIYIYNSENRNFVPFDNDLRCKVSLGSYPF

SEQ ID NO: 6201 - protein, 729 aa, Caenorhabditis elegans
MSIEAVWGTLQDGLNLLYRREHMSKKYYMMLYDAVYNICTTTTLANSNNNSPEFASEFLYKQLENYIRTYVIAIRDRISACSGDELLGKCTIEWDNFKFSTRICNCIFQYLNRNFVSKKVEDKNGEIVEIYKLALDIWKAEFFDNFKVKTIDAILELILLERCGSTINSTHISSVVECLTELDIYKVSFEPQFLDATKLFYKQEVLNSKETVIEYMITVENRLFQEEYRSRRYLGPSTNDLLIDSCESILISDRLKFLHSEFERLLEARKDEHLTRMYSLCRRVTHGLEDLRVYLEKRILKEGHETLQRLAKDSGLKTTPKEYITKLLEVHEIYFNLINKAFDRNALFMQSLDKASKDFIEANAVTMLAPEKHRSTRSADYLARYCDQLLKKNSKVQDETALDKALTVLKYISEKDVFQLYYQNWFSERIINNSSASDDAEEKFITNLTATEGLEYTRNLVKMVEDAKISKDLTTEFKDIKTEKSIDFNVILQTTGAWPSLDQIKIILPRELSTILKEFDTFYNASHNGRRLNWAYSQCRGEVNSKAFEKKYVFIVTASQLCTLYLFNEQDSFTIEQISKAIEMTAKSTSAIVGSLNPVIDPVLVVDKGNEKDGYPPDAVVSLNTKYANKKVRVDLTTAIKKATADRETDAVQNTVESDRKYEIKACIVRIMKTRKSLTHTLLINEIISQLKSRFTPNVQMIKICIEILIEQLYIRRSENEHNVYEYLA

SEQ ID NO: 6202 - protein, 1321 aa, Caenorhabditis elegans
MLRNGSLRQSLRTLDSFSLAPEDVLKTAIKTVEDYEGDNIDSNGEIKITRDAKEEVVNKVSIPQLYRYTTTLEKLLLFIGTLVAVITGAGLPLMSILQGKVSQAFINEQIVINNNGSTFLPTGQNYTKTDFEHDVMNVVWSYAAMTVGMWAAGQITVTCYLYVAEQMNNRLRREFVKSILRQEISWFDTNHSGTLATKLFDNLERVKEGTGDKIGMAFQYLSQFITGFIVAFTHSWQLTLVMLAVTPIQALCGFAIAKSMSTFAIRETLRYAKAGKVVEETISSIRTVVSLNGLRYELERYSTAVEEAKKAGVLKGLFLGISFGAMQASNFISFALAFYIGVGWVHDGSLNFGDMLTTFSSVMMGSMALGLAGPQLAVLGTAQGAASGIYEVLDRKPVIDSSSKAGRKDMKIKGDITVENVHFTYPSRPDVPILRGMNLRVNAGQTVALVGSSGCGKSTIISLLLRYYDVLKGKITIDGVDVRDINLEFLRKNVAVVSQEPALFNCTIEENISLGKEGITREEMVAACKMANAEKFIKTLPNGYNTLVGDRGTQLSGGQKQRIAIARALVRNPKILLLDEATSALDAESEGIVQQALDKAAKGRTTIIIAHRLSTIRNADLIISCKNGQVVEVGDHRALMAQQGLYYDLVTAQTFTDAVDSAAEGKFSRENSVARQTSEHEGLSRQASEMDDIMNRVRSSTIGSITNGPVIDEKEERIGKDALSRLKQELEENNAQKTNLFEILYHARPHALSLFIGMSTATIGGFIYPTYSVFFTSFMNVFAGNPADFLSQGHFWALMFLVLAAAQGICSFLMTFFMGIASESLTRDLRNKLFRNVLSQHIGFFDSPQNASGKISTRLATDVPNLRTAIDFRFSTVITTLVSMVAGIGLAFFYGWQMALLIIAILPIVAFGQYLRGRRFTGKNVKSASEFADSGKIAIEAIENVRTVQALAREDTFYENFCEKLDIPHKEAIKEAFIQGLSYGCASSVLYLLNTCAYRMGLALIITDPPTMQPMRVLRVMYAITISTSTLGFATSYFPEYAKATFAGGIIFGMLRKISKIDSLSLAGEKKKLYGKVIFKNVRFAYPERPEIEILKGLSFSVEPGQTLALVGPSGCGKSTVVALLERFYDTLGGEIFIDGSEIKTLNPEHTRSQIAIVSQEPTLFDCSIAENIIYGLDPSSVTMAQVEEAARLANIHNFIAELPEGFETRVGDRGTQLSGGQKQRIAIARALVRNPKILLLDEATSALDTESEKVVQEALDRAREGRTCIVIAHRLNTVMNADCIAVVSNGTIIEKGTHTQLMSEKGAYYKLTQKQMTEKK

SEQ ID NO: 6203 - protein, 1236 aa, Caenorhabditis elegans
MSSFSNVGFVPHDGENEEDAINLAPKSSESFPAEDSIFADGSPRHRTLFDSKKRFKLRPPLLASTPRVICRFQQASSGSSAPYFTREPTFQPIQEFIEMSEHFHDITENSQGYRFLNTKEPFSRHHSALHHPRLSFDVLPKVIDFSRRWIGRARDTLYRLSVAYSGQEELGIERARDELDDRREHINLSEIFGGSHSQENSCSSGGVFNLNFDKSIEDRQLSFENIDLDSTSPQSTNDVIWLRDMTTVSTISEPILHPSSKISFTSSSPSPQRNPKNEAQKNSSSKREETSMFRSDPMKLYQMILVKEAAFECVAEIGKHGNVQFVDLNAKMSLYSRTFVKQMRRCEEMERKLRFLEKQVITCKPGLDPKSIDYTDLSAPTQAEMIQLEHKLDQLEREFLDLNNNDYALRKNLNSSKEFLQVMRLVDEFFQVHKEEEAKARFERSATTDDIEMFSKSFGFGGLPSSNEMPLTPLLGSDDNAWFVAGVLPLDKKESFERVLWRACRRTAFVRTSDASFTVNDPVTLEPLQKCVFIVFFKGESLRLIVEKVCDGFNATQYPCPKSSKDRKMKMSETEGRMNDLTVVIDTTQTHRYTILKDMSFEIPIWLKNIQIQKSVFAVMNMFTVDTNGFLAGECWIPAAEEDDVRQALHDGFKASGTEVEPILNELWTNAPPPTFHRTNKFTNVFQSIVDSYGVSQYCEVNPAPYTIITFPFLFAVMFGDAAHGAILLLAALFFIRNERKIESKKIRDEIFNTFYGGRYIMMLMGIFSIYTGFLYNDAFAKSFNVFGSGWSNSYNETQLDWWIARSYRKHREYSLELVPEKSFDIEKTYPFGVDPIWNIADNRLSFLNSMKMKASVIIGITQMTFGVFLSVLNHIHFKSYIDIISNFIPQVIFLSCIFIYLCIQIIVKWIFFSVNAENVFGFEYPGSHCAPSLLIGLINMFMFKKRNEGYLNENGEVYSNCHLGYWYPNQRLVETILISISLACIPIMLFGKPLWVRFVTSKRHKLQENKSLKSLRRNGTTVSAPTSPVVDAGPPRFEDAELLLADELDIGEDIHHSLSDIFVHQAIHTIEFVLGCVSHTASYLRLWALSLAHAQLSEVMWHMVLIQGIHTVDHIENETIAMCLKPVVACVGYFSASAIFFFCLTSLLYGKTYEKEKAFFIFASLSLSILIMMEGLSAFLHALRLHWVEFQSKFYLGTGHPFHAFYLKESLENAQLITEETDRLADISSGQHLHI

SEQ ID NO: 6204 - protein, 327 aa, Caenorhabditis elegans
MSDEEEEDVNFKPGTEISSTKANYTVVRLLGEGGFGAVYLVQDNKSKKQSAMKVERKIEKRKHSKLKMEIAILKLVGSGKHFTQIVDRGKKDKEGFFFLVMELVGKSLADLKADRPDKVFSFATGLGVSCQCLEAVEELHKTGFIHRDLKPQNYACGLDEKRHNIYILDFGIARKYLNTKNELKTPRETVGFKGTVRFAPIACHRNTEMGPKDDCESWFYLLLDLIVPSGLPWRKLSDKHEVLKEKEECRKDKRSSLFAGLRQTDYLSKVLDYIDGRAYQDRVDYQFIYKNLAEACKVCNLDIDSPYDWELQKPEKTSKEPTSSKMP

SEQ ID NO: 6205 - protein, 327 aa, Caenorhabditis elegans; identical to SEQ ID NO: 6204

SEQ ID NO: 6206 - protein, 380 aa, Caenorhabditis elegans
MLLFSAFLIFGFSIGFSEEASCRHPHERFIGTRCYAFVSKKHTYNTAKEYCDSHGYSLATVDNAITSNFLASSAATEFGSNNGQFWIGLSRKKDYELFNWDDGTIVSYTNFEAGFPNKQDFVAENVRNGRWQTLAEHKELEFVCSYDPTATTSAAPTTIPPTTTTTRAPTTTTVRKTTQTTATTMTTPKPTTTVSTTTTTTVPPTTTPKACPQGFVLFEPTQKCYIVLVYGNDSDYPDVPDDAPFLTRENQRCAKYGATVATIHSSDLNDLFRSLIYERFNDTRYATIGLRNIDMKTISGKWQWFDGTSPDYLNFGNMFPKTGDYIAQTSSQGFWVSYTHTAPNEGVVCSKNRKSERGFTGLVDIDQAAIKKLELQTYLK

SEQ ID NO: 6207 - protein, 295 aa, Caenorhabditis elegans
MHFLLLITSLFSSFLLVSSSIANCNYGDIEYDGYCYTFVNQRLLFPDAQTHCATLGGVLVRVRGDQDGRWLAAIAGTEFHATYGNFWIGLQLVDGQWEWEDASTSTYKNWAPGYPFSGYDYVGAQLSNAKWVTVRSSLMLPFICYYQKGHNRNQLTTPAPSQNPGGICTGAELLLEHRCYSFIPTLLPYAAAKQKCESIGKTLAIFDDQMQINFVTSVSVSKFSMNYGSFWVGLTKNTADNTFHWADGNVNSLKNWTPGYPFQHQTVVSQQVSNGKWKTSETDTLLPSVCSGYLQ

SEQ ID NO: 6208 - protein, 1431 aa, Caenorhabditis elegans
MFRKLINLLRKDVLLMRRSKTWTAFEILLPLLFLIAPPVVYEALREGPGLKSGGNWSPAREVNINDVTHKYSLKCGSPRIDNFENFFEDYSVEWNSVTQSLTNKTKHDRESIIAAVRNCTNFAYILQADKSSTIILPSEDGRKEYGFYRYIYLINKILFGLAERTSKTARVENFNSQLYTLPVDSSSSTGKLLVFTIFPLIFGICMTMPVLATARTLVTEKSSVTPYLSTIGLPIWIFYMEHFIFGVLKTTFLITLFSILWPLLFEPVSMYVLIGIFFYTFNVISFAVFFSSIFPFPKRIVEALILIWLFSFILPMIYPAYGGLTWVVSLTPNYALKNFLGAIVLAEEGSGVAISHLFWSKTTTLQCSAVYVGFMIFNTVWMLISAIFIEKLITSVGHFVLKTFWGVFAKGNGKESKMVKEKDVGDRSTILNCQEKLDGRLNAVADIELSGLVKVYTNGEKAVNGLSLRAIRGQVSILLGHNGCGKSTTFGMITGMHKATEGRVIIGGIDANSHRAAARKMIGYCPQYNPLYDKLTVMEHLKLVNALKGGSKLTFKVEADSLLQQIELTDKRDTLAKNLSGGMKRKLCVCMAMIGGSRVILLDEPTAGMDPSARIDVQRMLALVKADRTILLTTHYMDEAEKLGDWIFVMSHGKMAASGSNHYLKQKYGSGMLLTIVFKNIHDPKKSYESAYSVCKAVCSTAVVKDERGQMMEISVSESEKSRLPTLLKILEAITDGNNSTPEFKALGANVQDNARKLELATIGISMSSLEQVFIKIGDDCDNMINGTTGANRQKERSEKFKRLIQEKIKPPRRGFRKVLMVIIALLQKRAYYLYQLFSSLESDSSKLIEMESLDLSQYPESTILVQVEDEKDNRLMEYLNNFPNLYKIKVDYNADVDRLVRKYSMGFQQLGFVIKVDKLGNTLVYYGKEESDVFNKKPEILMNLLASCIIVIIFYSFLLYFVSLVYLTASLINTPTKGSLLLYVFCLTTYMMYFLIVLATKGSDRYRDLFMCITHFVNPTVGFIMGIYKIAASTYENSGLAETMHNSASLWDFNGLVIELAFIIAAAFLFTLLLCCITMKPIRRACFLCCHRRSRLRQRMKYKGLESCRAVQEEEAMVQNIDKADKILVINGLIKDFGKFRAVNGLSVTVDHEECFGMLGANGAGKTTTFDIITGLTMPTGGRVTIDGHDISRTIHIGYCPQFDAMLQQISCRETLMIMAKFQGYANVSEVVDLVLDCVGMADFGNKLVKNCSGGQKRKISVGIALMSRATCIILDEPTAGIDPRARREIWDIIHEMREQAKCSIVLTSHSMEECEALCTRIGILRNGEMIALGTSQSLKSQYGNTYMMTLILNKLEDRKSVCQIVKADMPYATLKTPESSLTTSIVWEIPKKKSDKWSVKYDQVEALARKVRARDYTLTLQRKQKNSEI

SEQ ID NO: 6209 - protein, 508 aa, Caenorhabditis elegans
MTLFEPSTSGNRMGYRGSSNSSSGVGSGGSGSLMTQSIGGPNKHLSASHSTLNTASTHDMMHSKIPKSPSNESLSRSHTSSSGGSQGGHNSNSGSNSGFRPEDAVQTFGAKLVPFEKNEIYNYTRVFFVGSHAKKQAGVIGGANNGGYDDENGSYQLVVHDHIAYRYEVLKVIGKGSFGQVIKAFDHKYQQYVALKLVRNEKRFHRQADEEIRILDHLRRQDSDGTHNIIHMLDYFNFRNHKCITFELLSINLYELIKRNKFQGFSLMLVRKFAYSMLLCLDLLQKNRLIHCDLKPENVLLKQQGRSGIKVIDFGSSCFDDQRIYTYIQSRFYRAPEVILGTKYGMPIDMWSLGCILAELLTGYPLLPGEDENDQLALIIELLGMPPPKSLETAKRARTFITSKGYPRYCTATSMPDGSVVLAGARSKRGKMRGPPASRSWSTALKNMGDELFVDFLKRCLDWDPETRMTPAQALKHKWLRRRLPNPPRDGLESMGGLADHEVCFIIF

SEQ ID NO: 6210 - protein, 384 aa, Caenorhabditis elegans
MTDDKKMFDINEFLKRHLFVKNWVNYRQQSYTKYELMQLIESVEAALSVDDTLAKISPPVTIVGDIHGQYPDLVRVLCNQNSKEDAKKKAAYGFCNSRFVFLGDYVDRGHHSIECISLVFALKVVYPTNYILLRGNHETKSINYTYGFREELVNRLGPIDGFEIWERFNVAFSWMPLACLVGHKILCMHGGISPKLHSLKEINEIDRPVAEILPDSLAQDLLWADPADGQGAMTVRSTPEYVPNGVRGLSFIFNEAAVRDTCKRLNINLIVRAHQMIPEGFKFFADQKLLTIFSAPRYMNETDNHGATLRVETDGKLNIGRFRHKKLLHANSADEITRGDDIPNLERKKSGSMPVKHLKTSSSSSPSHSNGKSKGGEGLSLGKI

SEQ ID NO: 6211 - protein, 354 aa, Caenorhabditis elegans
MALWVDKYRPKDLLGKDGVDYHIEQANHLKFLSADCMPHLLFCGPSGAGKKTRIKCLLRELYGVGVEKTQLIMKSFTSPSNKKLEIQTVSSNYHIEMTPSDVGIYDRVVVQDLVKEMAQTSQIESTSQRSFKVVVLCEADSLTRDAQHGLRRTMEKYANNCKIVLSCESLSRIIEPLQSRCIIINVPAPTDEDVTKVLRKVIERESFLLPENVLQKIVEKSEGNLRRAILMTEALRMENESGVAESVVIPVPEWEIYIQETARLILQKQSSDMLLKVRERLYELLSRCIPPTVIFKKLLEHLLPKCPPQIAREVVSEAAKFEHRLVLGQKAIFHLEGFVAAFMDIYLTNASKPK

SEQ ID NO: 6212 - protein, 1139 aa, Caenorhabditis elegans
MSTRWRYYNSKRGNGFRGRGRGRGRGTSLTAVALPRDDNFHKGAQDGAYFKDMPMDPEQFRDETVLSLSFAQGMLGAAYYEQSSQLLKIMNDISEDLEFRFLKRLIDDVKPTLIIANRSQDLEFIKFLTTRYDPQEKIYEDGTTEEGTSEDTVPTWDSSLAYSTDETTAEKEEKEEDEDDDDEGLPAKLNKLPNNFFRMSRAIERLKAMAGSHDSSMTEEDKYIIIKMRFDIEAVNMIRSFGALLLFLDETRMGVTDDPLSVTSPIKSIKTFTLGNLVEIDFNTIQALDILPKETENKKTFGQGRSLYQLMDKCRSTVGKKCLRKWFRNPTTDRDDLVSRQKCVHYFKQVIIFKVEYRNLWEIFLNHSKFSPDSEYLSEKIFLKKRSLILYFSLKSRFSNAEFSRQRRHVSIYEICVYLRDFQSLSDADFHFSTSFFHFRRFCQDWNAEVTAKLSSILGRVKALNVLNSNQSVFQKFQSGTAQLIHWECFVSTVNALVEILNIIRQTPISKEFPVESDLLREVSEIAVIAGSIINFAESKIQGRVTVMNGIDEELDEIRDTYENMPMVLTAIAKQEEARLGLPPYSNVACVYIPLVGFVLSVPRDYGVESQPDMTLLYSTHEDLRVRNATTSRLDDEFGDILMRLIDSQTAIILTLKTRVMKKKRSIIKLLSIASRIDVLISFGLIAAQNGWNCPALVDEPVIEAVELYHPISVLVVKKSFVPNQVSSGRDGIKASIITGPNACGKSVYMKSIGIMVFLSHIGSFVPARHAKIGIVDRIVTRMFTVDSVLDGMSTFAKDVEQVALALRKATGNSLVIIDEFGKGTMTEVGLSLLASVMTYWMNRGADRCPHIFLSSHFHALPNYIPLETNIATFLTFTVLREAGGKIKYLFRMTPGLVDCSFALSVAKEEGIPPPVIGRACRIYKALKAGTLLKEIKAEVSNDNEKQLVEDMDVVLADEDGFMAAVESFVKRKKTSFCESSMRNVSEEIEKERSEASTPASKSRSTITARSNSVLSSRSMASVDQLSVLDALLPKKKKKKVTGSSMESSMSPDPFQEEDEGTEGEEDQISAPVSRPTLPSVQKYASEEEKQQSIKKVLAKNLRFYFFSSIFQFLKLKIDFQGKKRRKKIQKIYFFSNFV

SEQ ID NO: 6213 - protein, 523 aa, Caenorhabditis elegans
MMLGGGGGCGAGGTWLGFLVFLAVSLRNHSTCEDIDAEDRLMVDLFRGYNSLVQPVRNRSELPMIVKIGMQLVLLINVDEKEQVMHTNVWLTMKWDDFQLKWDPRDYANITQIRVAPEKVWLPDIVLFNNADGNYEVSFMCNVLILSTGTVLWVPPAIYKSSCIIDVEFFPFDDQLCSLTFGSWTYNRDEIKLDFLTSDRVDFSEYSTSSIWDMMDGPAVLTSDRSRIEFQIRIRRKTLFYTVVLILPTVLMAFLNVTVFYLPTASGEKMGLTMNVLLSIVVFLLLVSKILPPTSSSIPLVAKYLLLTFVLNIITIMVTTIICNIYFRSPITHRLPPWVRKVFLDILPLLMCMQRPHRKNVIQRSHRRLLETGPSVEENPMRSGEHHPLCRHTHNQYELSNVAFSNTLMIFRDSCRRVRIQSDELDDELSPEAQRAIDAIEFITENRRDEEITKQFRDDWKFIASVVDRFLLYGFFGATVGGTIGIIFTAPSVFETFDENATLVKLKQLYDMGLANDTVLGIF

SEQ ID NO: 6214 - protein, 376 aa, Caenorhabditis elegans
MTIATKVNTNKKDLDTIKVPELPSVAAVKAAIPEHCFVKDPLTSISYLIKDYVLLAGLYFAVPYIEHYLGWIGLLGWYWAMGIVGSALFCVGHDCGHGSFSDYEWLNDLCGHLAHAPILAPFWPWQKSHRQHHQYTSHVEKDKGHPWVTEEDYNNRTAIEKYFAVIPISGWLRWNPIYTIVGLPDGSHFWPWSRLFETTEDRVKCAVSGVACAICAYIAFVLCDYSVYTFVKYYYIPLLFQGLILVIITYLQHQNEDIEVYEADEWGFVRGQTQTIDRHWGFGLDNIMHNITNGHVAHHFFFTKIPHYHLLEATPAIKKALEPLKDTQYGYKREVNYNWFFKYLHYNVTLDYLTHKAKGVLQYRSGVEAAKAKKAQ

SEQ ID NO: 6215 - protein, 472 aa, Caenorhabditis elegans
MDDSLGVSEVVMIPFMKREVLQQISPYMPGIELRDVEGCKRYSSYNQSPSELLLRIWSSKGYSTTHLYQLFAKTKLIRLMRMMRSQVHEKYHYLENKVTNSTSRVSKQMVQPPGSQSASRLKKTEIKESSPSPAAAAASQLSRSNTDDTLRVAIEGTLPVTYCELLEATNGFAVSNVIGKGGYGTVYKGELKGTGGIVAVKRLHSGNDTSQNGSRERLRQSLTELRTLARFRHDNILPIYAYSLEGSEPCLVYQFMSNGSLEDRLLCRKGSVPLTWIQRKEISIGAGRGLGFLHSFGKTPIIHGDIKTANILLDKHMEPKIGDFGLCRDGHVEAEAMEKHPLIASHIKGTLAYLAPEFITSKILTTKLDVYSFGIVLLEIASGQRAYSDSRETRGLVEYCQVNKELAAHRKIPVREIFIDRRAPPLVGDEEKSFLDALIEVGLAGANNDRKVRPTMSQIVEYLCKNSIPPVV

SEQ ID NO: 6216 - protein, 331 aa, Caenorhabditis elegans
MVNEESTDASENQEEPDELSPRTKAFAPTLEKEHKLKFDKILGSGSYSRVARATWGDKKLEVAAKVINITPTREKDDYIKKFLPREKEIVKLLKHDNVCRLYEMISFPDHIIFVTEFCAGGDLLRKMKKIKTMSEENAKFTFRQFIAALMHLQSYNIVHRDLKCENIFLDKYENVKLGDFGFSRILKPGEKSGTFCGSRAYVAPEILRGREYSGNAVDVWSTGVILYIMLVGTMPFDDRDPTRMIERQLAHKIKFGKTCTASIHSKALILEILQPHAPNRPTYKAICESEWLKNQPYYMKPNEPPKLPSPSTATTTPTGPQKPKDSKRHHG

SEQ ID NO: 6217 - protein, 308 aa, Caenorhabditis elegans
MAAELVQLNPGQQVERWSIEKKLGEGGFGAVYRVFDATGKYAMKVEGANEQIQVLKLEVSVLNKLSKRGNRHFCKIEDKGRFGNFNYVVMTLVGKSLQDLNKAGVGGHMSMGCSIGIGIQSLEALEDLHNIGYLHRDVKPGNYTIGRPELNEIRKVYILDFGMCRKFTGNDGTIRKPRQAAGFRGTVKYAPISCHLQRELCRKDDLETWMYMQVELSHGTIPWQYISDMNQVGQAKQAIRNNLGSLFPPPCPHQFQDIMRMVDAMKYYDAPNYQAIYGMMRQAYGACGSNENAPYDWENGGPAAYLLH

SEQ ID NO: 6218 - protein, 408 aa, Caenorhabditis elegans
MFSINSSGPNDQYNNQERVKQSNEEELLRLKAEKLAEELRKEKERKHSFIPSSAPSLQNNMDRLNSLLYDFSSDIQEPAHRDYTPQPVMTATAVYKFEPRSARELPLNRGDIIRIIREVDGYWMEGERNGRSGIFPTSYVQINTGNQGDSQKMRAIYPFTARSDTELSLKRGEIITRRRQIDSNWLEGSNQIGIVGIFPASYVEPIEQVEQHIPTIVPNRPKTPKIEDQVYNQVYKPNETVIMQSNQGYYDKAAVVPNNKVRFDLPSGSDSNLQMSLNPHQNQFPPTHTQTSTQQPSNYGMKKIEYEREKVVEEVPPMHMDQYRKLNDEPKNPKKDTNILMNAASLIPKGSEMYRAVYPYQPQKEDELQLYTNDIIFVVEKCDDGWFIGTSLRTGDFGIFPGNYVKRH

SEQ ID NO: 6219 - protein, 564 aa, Caenorhabditis elegans
MKIPVALVLTIIIEFFQSKSNTELVRALVVLRLCGIQTLVNQNQIILNTMRRVLGKNLFKKTLKNTFFGHFVAGETEEEVRHVVEKLRNYGVKSILDYSVEADITSQEATDKTVKGTSVATVKPAAMTPVVDAKTLETTRERYTVHEEFGDRRQGVSSARTYFYEGEEQCDKNRDIFKDSINAVASATKNEGFVAVKITALGRPQLLLKLSEAIVQTQNFFKALTGGMSLQEGRLTSQEFYKRLGELGVKTDTESVKKFFDEVDFDSDGIVDLHGWNHILDDHVKLGQLFQVLNIKTGSLEPLIQNLSNEEEQEFRNMVRRTLDVAEYAIEKGVRIMVDAEQTYLQPAISKITIEMMKKYNKGRGNIFNTYQAYLKGTLQNMEADMQVARREGWHFGAKLVRGAYMEQERARAKAIGYEDPINDNFEATSKMYESCLTRIADEVHRRGKTNVSVMVASHNEDTVRFALNLMKEKCISPSERVMCMAQLYGMCDQVSFSLGQAGFSVYKYLPYGPVEEVLPYLSRRALENGSVLKKANKERDLLWKELKRRISSGEFKARSSSSS

SEQ ID NO: 6220 - protein, 490 aa, Caenorhabditis elegans
MAIIVAFGSSFSFGFQLLITNPAQGAFIKVSSNANCCFCSNLWSAFLNASKHSNNPDDNELSHLENEWSFIVAIFFLGSATGAFLIKTVAERFGRKKGVIVSLFAQVTSSMLTIVSFWIVNHILFIFARFLMGVGITISMGIAAMFVTESSPAYCRGVSSLINGVLLQLSITVGAVMAMPNVLGNETHWWYLYLFQLIINTTVLVILPWVHESPSYLASQDIKHHELHAMFKAKIVASVKFYHGISDPEAEVFADNLIETHQITRSQESIISVWKSPFNRRGTLLGMMVTFSMAMSGITVINAFAFEILMNVGMKQDTAAIANAAICFFSFAGILVSTKIIDHFGRRPLLISTFGCLAVVNVVIVGLMYTFAETQNQIVSYFLISAICMFNFLFAMGPGPLSMFITGELVPQNCRSASSVWTNAVMAVVRFLILTFYLPVKNMTSEFMAYAIFFVVPMIVAVLVIFFLLPETKGRNVEEIREEYERKSLL

SEQ ID NO: 6221 - protein, 972 aa, Caenorhabditis elegans
MNGNGENGTDEKQKLLSVVGVVSEEVVEMNRVSSARFQVSKTDEDEKTSDDNLRKLKSGSEPPPPTQNHEAVTLVTRKMSATGRFMVTSDTNPGQLVAEVADELGIDVPIDPPAEKSPASRAKGVHFSVGDKDSGSMSEDGDEKRNITHENQTTFNMKSWRNMKTIEHPPIIDFYRNSIDTDGVFNRPSMAQLIHGKEHKEQDLGFEELNAQHHHLEDSPVHETKNEYRMEKMHAPPSQNRVKFGWIQGVFVRCLLNIFGVMLYLRVSWVSGQAGVGLGSCIVLLASVVTTITALSTCAICTNGDVKGGGAYFLISRSLGPEFGGSIGIIFSIANAVGAAMYIVGFAESFRDVLIDYNIGTIFDGGLWDVRVIGFVTCVILMGIVFIGSEFESKMQLGLLVILLVSIANYVFGSFFPPNEIAMNRGATGYSLDTLQSNFMPHFTENNTFFSVFSVYFPAATGIMAGANISGDLANPQQAIPLGTLLAILVTTIVYLLTVWMTGSTVVAFSNGTEPAVFNNSYFVPPDCTPDCPFGLVSYYQVVEMSSFWGPLITAGIFAATLSSALASLVSAPKVFQAVCKDRLFPRIDYFAKTYGKNEEPKRAYVLGFFLAMGIVAIGDLNVIAPIISNFFLGSYALINYACFDQSFADSPGFRPGFTYYNMWISLVGALLCVFVMFIIDWFSALVTFFCFGAIFMYLLHRKPDVNWGSSTQAHSYKNALSAMIKLSTTEEHVKNYRPQVLVLSGNPASRSCLVDFANNITKGSSLLVCGQVVPYEPSDRVYMVMKRLDENINVWLRKRHLKAFYRAVANSNFRKGAQSLIQLTGIAKMKPNIVLMGFKSNWYKGGPTETNLNEMNEYFGTIQDVFDWNMAMCVLRNGQVGLDFSEAMRNLNLIEPNRLNVPPIEEKEKEKEKTNENSPETVHLIEKDETARTDKSGDDGSSRLSYRGSCRSVEMFQRINAFYINGSDKLS

SEQ ID NO: 6222 - protein, 972 aa, Caenorhabditis elegans; identical to SEQ ID NO: 6221

SEQ ID NO: 6223 - protein, 648 aa, Caenorhabditis elegans
MTRSEKTRHFGNQNYEKLRKICIKKKQPFVDTLFPPTNQSLFLEQRQSSDIVWKRPGELHPDPHLFVEGASPNDVTQGILGNCWFVSACSALTHNFKLLAQVIPDADDQEWSTKHAYAGIFRFRFWRFGKWVEVVIDDLLPTRDGKLLFARSKTPNEFWSALLEKAFAKLYGCYENLVGGHLSDALQDVSGGVAETLHVRKFLKDDPNDTELKLFNDLKTAFDKGALVVAAIAARTKEEIEESLDCGLVKGHAYAVSAVCTIDVTNPNERSFTSFIMGSKRKQNLIRLQNPWGEKEWNGAWSDDSPEWQNVSASQLSTMGVQPANSDSDDGDFWMPWESFVHYFTDISLCQLFNTSVFSFSRSYDEQIVFSEWTTNGKKSGAPDDRAGGCHNFKATFCNNPQYIFDIPSPNCSVMFALIQNDPSEGLKKREPFVTIGMHVMKVENNRQYRVHTAMHPIAISDYASGRSVYLHLQSLPRGRYLLIPTTFAPKEQTLFMLRVYSDEHIHFSPLTKHAPKLGLLKCKSAQSVTRLTIHGVDFNSASTGTHNVYAILKDSRKSFRTKTLSGVKSIQWDEQFLFHKSKNRQQYKIEVWEDRKMARDHLLAQSVIIALIDNENRDTTLQLTDPRGTVIGTVSVTVSAFDDPMYL

SEQ ID NO: 6224 - protein, 464 aa, Caenorhabditis elegans
MSLSRTTQLPFAKRQFFQVLARNYSNTQDADLVVIGGGPGGYVAAIKAAQLGMKTVCVEKNATLGGTCLNVGCIPSKALLNNSHYLHMAQHDFAARGIDCTASLNLPKMMEAKSNSVKQLTGGIKQLFKANKVGHVEGFATIVGPNTVQAKKNDGSVETINARNILIASGSEVTPFPGITIDEKQIVSSTGALSLGQVPKKMVVIGAGVIGLELGSVWQRLGAEVTAVEFLGHVGGMGIDGEVSKNFQRSLTKQGFKFLLNTKVMGASQNGSTITVEVEGAKDGKKQTLECDTLLVSVGRRPYTEGLGLSNVQIDLDNRGRVPVNERFQTKVPSIFAIGDVIEGPMLAHKAEDEGILCVEGIAGGPGVAYKIGKFPFVANSRAKTNNDQEGFVKVLADKQTDRMLGVHIIGPNAGEMIAEATLAMEYGASAEDVARVCHPHPTLSEAFREANLAAYCGKAINNV

SEQ ID NO: 6225 - protein, 633 aa, Caenorhabditis elegans
MRISCSKSVPFSDLININTGAAGEIVDKNDDEEENRLPLSEHLWEIVKLCGKQWRWFVPAYTLLILDCALNLIEPALYGQMMTNAIQMKSFDIIKRACLLLALIQFSEATCKSACYFFMQYAEKLTARNIRIQLFRSILHQEISFFDENKTGQLVSRITHDSESISNTLPVHIETLVNNLFMFFGSIPIMFCYSWQLTLTSFIEFPITLLMTRYYGLAVEKLSEKENDATAASNETVEEVLSAIRTVRSFAAENFEQKRYTKNTEDWFKISTKTVTLGTIYNYFWALMLRSQDVIRYLYGGYLALNGRMAPEALLTFIFYHWRLHTAINAFSSLFSGVMKTIGLSRKVIHLINRKPQLDYDFGTETPEIQGKIEFEVVEFAYPTRKTVNVINGINLSIESGKTVALVGPSGNGKSTLVSLIQQFYTPQSGRILTDGIPIQNINHQHYHSNIALVAQEPTLFSGTIRENILFGIENGTEEAMLKAAEMANVHEFVSKMDDGYDTKCGEKGVQMSGGQKQRIAIARALIRNPRVLILDEATSALDSESEGMVQEALNKCAKERTVIVIAHRLSTVRKAQKIAVIENGSVKEMGCHDELMENQDGLYYKLVSKQLGSIVDTNIFNCFDMLIFFVLF

SEQ ID NO: 6226 - protein, 873 aa, Caenorhabditis elegans
MNFYDFKFVFYLAISWCNLLEVDGITVAEQLKDVLMEGYDSSIRPVNNERDILIINISMNTMSVLTLDPAEETINFSSEFILQWKDEFLFWNKSDYNITWLKLKESFLWTPDTTVSTSIDTNYLIDASERYVSVKHDGTVRQSIYAVFTNLCDMNVDKFPYDQQTCMIKMGPWSYTTQEVTCIVGRDIAPNDTDFGDFHGNSEWDFEGIVSSVGETEDPDVNFTFSEVHFALTVKRRPQFYVWVLLIPTYIITVVCIFGLFTPTANHGLREERVNLGITTLLSSAVILQIVANAMPKTSELPLLGNFILAEIFVVAIGVLFAVLVLTLHQRAHTREWRPPAWMLWILRMTGSSKFLSRNITKIRHKSSTAERIHYTGEGAYLFKNLDESLQSVREYIQEEDRDYFRELTYVKFFDRLDFLLLFIFQVGNALVTLFLSFLAFLKRKKILQSGYDSSIRPVINERDTLFINISINSMSFLTLDPAEETINFSGEFILQWKDEFLFWNKSDYNITWLKLKESFLWTPDTTVSTSIDTNYLIETSERYVSVKYDGTVRQNIYAVFTNLCDMNINEFPYDQQTCMIKMGPWSYTMKEVTCIVGGDIERNETTGSSGNFSIAFFHCMNFVVKFLLQKFQGNSEWDFEGIVSSVGETEDPDVNFTFSEVHFALTVKRRPQFYVWVLLIPTYIITVVCIFGLFTPTANHGLREERVNLGITTLLSSAVILQIVANAMPKTSELPLLGNFILAEIFVVAIGVLFAVLVLTLHQRAHTREWRPPAWMLWILRMTGSSKFLSRNITKIRHKSSTAERIHYTGEGAYLFKNLDESLQSVREYIQEEDRDYFRELTYVKFFDRLDFLLLLIFQVGNALVTLFLVKQ

SEQ ID NO: 6227 - protein, 185 aa, Caenorhabditis elegans
MLAMVNKVLDWIRSLFWKEEMELTLVGLQNSGKTTFVNVIASGQFTEDMIPTVGFNMRKITKGNVTIKLWDIGGQPRFRSMWERYCRGVNAIVFMVDAADEEKLEASRNELMQLLDKPQLDAIPVLVLGNKKDLPGALDERQLIERMNLSSIQNREICCYSISCKEKENIDITLQWLIDHSKAQR

SEQ ID NO: 6228 - protein, 786 aa, Caenorhabditis elegans
MATKEELLSLGLSDSKVAETLKNVKLTETIGSIVKLASESGEISKQKGTLLYQLATKLKPQVAAHTPLVVKYIMNDGIKTEPQLSAAIEYLLSHTVKGIQVPDFEKSCGVGVVVTIDDIEAAVTKVIGQHREKIVAERYSFPAGKLLGELRALLPWADGAITKKEVDLRFLELLGPKTAEDLAPKKKEKKPEGPKPSKDAAAAATAPGTKNQKEASPEEFADGAETMDELLRTRAHFHKVGENFKQDGYVTTPKTAELLKAHVAAVGGKVVTRFPPEPNGVLHIGHAKAININFGYAKAMGGVCNLRFDDTNPEKEEEKFFSAIEDIVHWLGYDPARVTHSSDNFQQLYLWAVKLIQKGLAFVCHQKVEEMRGFEVQLSPWRERPIEENIQLFEDMKNGKFDEGEATLRLKLTLEEGKVDPVAYRIKYVPHHRTGNQWCIYPTYDYTHCLCDSIENITHSLCTKEFQSRRSSYYWLCNALDIYCPVQWEYGRLNVNYTVVSKRKILKLITTKTVNDWDDPRLFTLTALRRRGIPSEAINRFVAKLGLTMSQMVIDPHVLDATVRDYLNIHAPRTMAVLEGLKLTIENFSELNLPSSVDVPDFPSDPTDPRKHSVSVDREIFIEKSDYKPDDSDKSFRRLTPKQAVGLKHIGLVLRFVKEVKDAEGHVTEVVVKAEKLSEKDKPKAFIHWVAKPVSCEVRLYDRLFKSKNPEDAQLVPGGFLSDINPDSLTVVYNALIDQSIAKSKVYDRFQFERIGFFCVDRDSTSSTLVFNRTVMLKDGGASGKN

SEQ ID NO: 6229 - protein, 245 aa, Caenorhabditis elegans
MQAIKCVVVGDGAVGKTCLLLSYTTNAFPGEYILTVSHFLSGHLRKIRRKNLKKNLKKNLSILFYLKNHEKLNSFFKKRQLLSVNVFDTYSTNVMVDGRPINLSLWDTAGQDDYDQFRHLSFPQTDVFLVCFALNNPASFENVRAKWYPEVSHHCPNTPIILVGTKADLREDRDTIERLRERRLQPVSHTQGYVMAKEIKAVKYLECSALTQIGLKQVFDEAIRTGLTPPQTPQTRAKKSNCTVL

SEQ ID NO: 6230 - protein, 118 aa, Caenorhabditis elegans
MRVKTFYYNPASFENVRAKWYPEVSHHCPNTPIILVGTKADLREDRDTVERLRESRLQPVSHTQGYVMAKEIKAVKYLECSALTQIGLKQVFDEAIRTGLTPPQTPQTRAKKSNCTVL

SEQ ID NO: 6231 - protein, 620 aa, Caenorhabditis elegans
MATKDALIAEEGTNFGGSSSGDIAVFDKTAEVVNFELEPKPIGLTKEQLEKYRNDPFWKPVRTILFVLFWLAWVLMFAGAIAIVVLSPKCAEKQKPDWWQTKVSYQLLTATFYDSDNDGVGDFAGISQKIDFLRKIGVTTVYPTPVIKIHKDEYFNSYDVVDHNSVDERFGTEEQFKELIDTVHNRAMYLVMDLPVSTIDLSHPWFESRDESKFVIAKPTDPGFNESNFYPFHGANNIKYLGYPSSQNPVLNWKNADVKSTINGAIQKFLDLGVDGFHIDHISQLAVDSKGRPNHDEAVKVLEELTKSVQIYVESRDELVDKKIVLFSSLKDVEDLHVKATETGLLHYVIDNSFANLDEKKCQPHVAKCVHDALNAAYQRHEVEKYRKPVAKYTPHWQFSNSEASRLASRFESATAHLLSFLQLTLPGANSVYYGQEYGLKDAMSKNGEFKQMGVMQWYPAGKDHHGFSGNDAPIFFPESDDKLELDNYNTQFETENSALKIYRKLAKLRQRDEALIVGETVRDELINEDVILFSRYVQAVNNTATGSTFIVALNFGDKEQKIDFSIEPASKLIPSNKDLLNAEISVVTANVTDYRVRDHHNFVESPLVLPPKQAVLLKL

SEQ ID NO: 6232 - protein, 369 aa, Caenorhabditis elegans
MSHLNYETRLPLGQATIDHFMGLPAHPSKCQATYVWIDGTGEQLRAKTRTFNLKPQYLSEYPIWNYDGSSTGQAEGLNSDRYLRPVAVFPDPFLQGHNVLVMCETLDETMKPTATNHRQNCAAIMKKVAEHHPWFGMEQEYLIVDRDEHPLGWPKHGYPAPQGKYYCGVGADRAFGREVVETHYRACLHAGINIFGTNAEVTPGQWEFQIGTCEGIDMGDQLWMARYILHRVAEQFGVCVSLDPKPKVTMGDWNGAGCHTNFSTIEMRRPNGLNAIFEAMKGLERTHSEAMSVYDPNGGRDNLRRLTGRHETSQADKFSWGIANRACSIRIPRQVADETKGYLEDRRPSSNCDPYLVTAMIVKSCLLSD

SEQ ID NO: 6233 - protein, 640 aa, Caenorhabditis elegans
MSKHNAVGIDLGTTYSCVGVFMHGKVEIIANDQGNRTTPSYVAFTDTERLIGDAAKNQVAMNPHNTVFDAKRLIGRKFDDPAVQSDMKHWPFKVISAEGAKPKVQVEYKGENKIFTPEEISSMVLLKMKETAEAFLGTTVKDAVVTVPAYFNDSQRQATKDAGAIAGLNVLRIINEPTAAAIAYGLDKKGHGERNVLIFDLGGGTFDVSILTIEDGIFEVKSTAGDTHLGGEDFDNRMVNHFCAEFKRKHKKDLASNPRALRRLRTACERAKRTLSSSSQASIEIDSLFEGIDFYTNITRARFEELCADLFRSTMDPVEKSLRDAKMDKSQVHDIVLVGGSTRIPKVQKLLSDLFSGKELNKSINPDEAVAYGAAVQAAILSGDKSEAVQDLLLLDVAPLSLGIETAGGVMTALIKRNTTIPTKTAQTFTTYSDNQPGVLIQVYEGERAMTKDNNLLGKFELSGIPPAPRGVPQIEVTFDIDANGILNVSATDKSTGKQNKITITNDKGRLSKDDIERMVNEAEKYKADDEAQKDRIGAKNGLESYAFNLKQTIEDEKLKDKISPEDKKKIEDKCDEILKWLDSNQTAEKEEFEHQQKDLEGLANPIISKLYQSAGGAPPGAAPGGAAGGAGGPTIEEVD

SEQ ID NO: 6234 - protein, 1657 aa, Caenorhabditis elegans
MSDLGDENSSDPDSNKIDEFVKMLEGGRSIKRILVANNGLAAMKCLISIRQWLQNQFGTSGVVSFVCIATEDEMRSASHYLKLADEIVMAPAGSNSKNFANCDVIIRLAVEAQVDAVYVGWGHASENPELCRRLELNNIIFIGPSEKSIIASGDKIVSTIIAQSIGMPTVTWTGSGVKVEECVDFEHYHELRSKATIRNVKEGLEAIEKYGIGVPMMIKASEGGGGKGIRKCENMDDFKRLFKEVELEFPNSPIFLMKCMDGARHVEIQILGDKHGDVIALSSRDCTIQRRCQKVIEEAPASIVPGEVMQKMKKDAIAFANFVGYYSAGTVELLFIPTTNEYFFLELNPRLQVEHPCTESICDVNVPALQYQIAMGRKLKDIPCIKRFREREATGNAGGVHCMAARVTCEDPNDRFLPSTGTVRSLKFNSTSKAWAYFSLSDGSTVHEFADSQIGHVFARGRDRNEAIANLKHGLQNLKIDATFPTQSDYLIDLLSLEKFKSNQYDTQWLDKRIASKEGQKLTLSIDHLIAISAAAIGRSKIRRAFEKYEHQLKTGKIVLPIELSRCTELDLLMNNLKYTLKVFEETSMKYHVRMGEQETTVKMLQYGSQTLAIHQGKSTDFCLEKSDDFYFIKIGGNKLKFPITDTNDATCLRSPYTGKFLEYKVQPGEFVEVGQTYAQIESMKMVFDVVTKIVPGRLIPIAKEGDLINPGSILGRLEIDKQVQDQLPTSEKFSGKMKGWKMEEKSYFERAKLILEGRGPLDYPVDSLISGLFYSKECGDDATLSNEQTHELLERFLETEQYFDARDSFDESVQNMIKSNVDVLDFENVVDQIYSNSHLRTKEKLIFGVLSHISKSQVEPDFFIPILWKLFELNHLKEVNILTARILYRSIEHQDFTVKSCKIVTHKSGFSDCVASMKFENDTDVSISNCIDQALIEFVNYSSEYSKLKFVANRIKIANNSDNYIVSDIENLILKRQKQLEDAEVKEVFIQRAGGSLRFVNEFGVFRTEVLHNSDESSEFSPPDKRDFKRSLARQNRTTYIYDFPRMFAWVASGSSKEPLDTWSSTVQVQELVIDDESSELRFISDLKELEARATEGANSCSVVAWLLNIHIDQKNMEFVLIGNDVTHQVGSFAQPEHRLFEMASKLAREKQIPRINISCNSGARIGLARDVLDVLKVKLKSNGHDFDYLYVDATEKERIGSQIVYKQHENELRIKAVKGKKNEYIGVENLMGSGAIGGETSRAYREIPTYCYVTGRSVGIGAYTARLARRIIQHEKAHLILTGSAALNTLLGKKVYASNNRLGGIEIMRSNGIAHATVSSDLAGVAKLVHWMQYLPATQSEFPFFRCFNDQSPSTELEAVGVTKDEMQLDVKNLFEGFNGKQGLFDTDSFDEIRSSWAASMVTGRAKLNGLPVGVIASQWKSYEKLLLADESVENSEEMITSKAGQVWYPESAFKTSQAISDFNRESLPLIMIASLRGFSGGRKDMSDQVLTFGAHIIDELSQYQQPSAFKKGCVEFADMHDRWQRMDHVGAIRQVVTLQKTRDVFWKILRREMILIEMARRFQKAPIYPKPSLSEALDWVQKKIDGVDNLEQFYNQFFSEAVSAEIEESKQKFDQFIATWQDFFFIFLLKYFSIFLFYFIFLLNDFLSRIPFFI

SEQ ID NO: 6235 - protein, 706 aa, Caenorhabditis elegans
MTSPTQRRSPSDSSAAEDQRIATTIVRDSGSSKEIEESQADPCRGAWGNQIEFLLSTLGMAVGLGNIWRFPTRAYNNGGSAFLVPYVACALLFGLPAVYLEFLLGQYHRTTAPIIFRRFAPILQGVGWMAVAVSSLVAIYYIIIIGWSTVYMASIVMGHTSKWNRCGNSWNNAESCVDSGLQPLCASFNATGNETSPVWANLSSEGRGKFYIYLNTSCYDKVDLEFNKTKMIAATEQYFFDYVVKPTDGFLEFSSINFKSFFGMNACWLIVVLILWKGVGYMGKASYVIVTLPYFIIILLFFRGITLDGAEDGIYYYLGNPDWSKVFMPATWGEALKQLCFSLGIGYGGLIGMASFSKPNNNCFRDALIVIIGDTMMSLVGGAAVFSTLGFLAKKKGCSVAEVVNDGFSLAFVAFPEALGRMPLPELWSFLFFLMLFFLGISTEVAYVNVFCSSICDQFVNLRKRKWLVAVLWCLVLYVLGVVMVTDGGFYWFIMFDEYAAGVSSCCAVTAEVLIVAYVYGRRNQLADMKEMFGESKNKCTSWIGQHSPYFGFNWMFVTPVLGSILIVLASIRQYPYQTDENKPNMYPLAFDIVGWAVCLLPMALVPIFAFCAFVEFKRKGHDLRALFMKQRQLKSFGRIYQTMASKDRAKQKILPDREPWDDAPTGHQFVASPDFQSSSQSTRSERPSERSNYLNSAASVHSKTQ

SEQ ID NO: 6236 - protein, 330 aa, Caenorhabditis elegans
MKQNNEINDTLVPLTGKRLRLGDHEYKLSAPIATGPFSSVFLVEEDGVPYAMKVEAEKSCVRPVLKLDHAVLTALGNQTGFPSLMDSGRTDSFKYIVMQLVGPDLSTLLEFAPQNRFSQSTIYKIALQTLDRLRVLHHAGWLNRDVKAQNFAVGFGEESNIVYMLDFGLTRRFLELDGSRHLLRPWGPSVGTFPYAPLSSLGFLDQTPADDVEGWLYMIIHLLNGLPWHNSKRSLSLAKVREWKMYCRRAGGRTQLFRDIPDGWSDVFDIILKTSYQEYPDYTKILNKVMSMLVNPVLRSLVRLGPLSCDELTSQTCGTPRATRMVISPI

SEQ ID NO: 6237 - protein, 398 aa, Caenorhabditis elegans
MQTYHEFQQPNGTFFTVPVRYVNVQPFQFDKPFVVHAFDQVLGRPVVIKKVMLPDSLHDRQPWRRAQRELNCMLNIEDDNVVKMYSTFTPAENPLKMTEFYIVREYMHGTMKNLSASTFNEGGHRTVKSIFFDICRGVQYLHAMRISHRYFISKLVYFVTERQDLKPENILMNQEGDVKLCDFGHSNKEDPTSNTPYIVQRFYRAPEIICETTDNNKTNVDIWSLGCILAELLTGHVLFRGKDHIDQFILMVQFLGNAGPSFYSQMNEHARNFLLRYNLDQYQAPINFYSRFPDTVFQGVLQFEPKECDMSRDLLFRMLVINPDDRLNIQMVLSHPYLREIWGEIVAEDVIPEPQPPNELLRFFDFQPYSSPLDMREEIFQKIKNFGNQYNIMNESKN

SEQ ID NO: 6238 - protein, 586 aa, Caenorhabditis elegans
MVVSSGIFLIIPRILGKLIDQFDSNTGVQKAEEVFTMKIAKYFKEQPMSLVGLLAIGALATAAKVYCLQIAGVNIVGSLRKMVYSSIIRQDMTFFDKNMVGEIGSRHAADTVIVGYSVSSSLRAGVRAVLVGVGSIGMMLMTSLELSTVSFLTAPIVMGIFKMFGRVQQQCTWQLQEVAADVNQTAIERMANMKTIRMLSAEQQSIDEYCKKGELVLDISKTEALAKGSLIGSFQFTGYSAFSSILFYGSHLINTGHITYGELSSFCLYAVLAAASLSNISGFYNEVMKGLGASSRLLELKNAQPIMNLNSGIKKTDITTSIQFENVSFAYAGRKKTLENISFDIPRGKITAVIGPSGSGKSSIANLMLRLYDPADGRVTVDGVDLRDLNATTWRHAIGTVGQEPVLFTCSIRENILMGTEHPEKVSQYELEEAAQLANALDFIQGFENGFETMVGEHGCKLSGGQKQRIAIARALISKPKIMILDEATSALDATSDYLIRMTLDNLLKNHNLTVLVIAHRLATMQQADQVVYVNRGRIEGQGTFDEMMKIQNSIVEQEARRRGIPMNEQMSRVNTPVARGFSLKF

SEQ ID NO: 6239 - protein, 337 aa, Caenorhabditis elegans
MLAGSQALRHLSTAAQNQGACGPAVKLLLIQYGLENRKIDGTGPKNKNILKGDVMKIVEAEKLKPVAHHAHAPKETHIENKSIEKKSDIFGANNRSLRHHQDIPLSNIRATIAKRLTASKQQIPHEYQGVDVRIDDILALRQKLKKSGTAVSLNDFIIKAAALALRSVPTVNVRWTPEGIGLGSVDISVAVATPTGLITPIVENSDILGVLAISSKVKELSGLARESKLKPQQFQGGSFTISNLGMFGSVTNFTAIINPPQCAILTIGGTRSEVVSVDGQLETQKLMGVNLCFDGRAISEECAKRFLLHFSESLSDPELLIAEPLSPELDFDFSRLL

SEQ ID NO: 6240 - protein, 522 aa, Caenorhabditis elegans
MSRWKVVILCLLSFMFEIGHASFQCNPKTYDGAFLNIVCVCNATFCDEIEPIGEIAEGKAIVYRSSLDGDRLKRMSMKMKEKLRKNESVNVTITIDASERFQNIFGFGGAFTDSAGDQFVSLSETLQNYIVDSYFGKNGLEYNIGRVPIASCDFSTHEYSYDDVHDDFELKHFALPDEDLKLKIPFIKKAIEKTEGNIQLFASPWSAPGWMKVTGRMRGGGAMRNDKRVYQAYADYFFKFFEAYSSHAITFWGLTIQNEPSTGADMAWRWQTMNYTAETMRDFLKKYLGPKLKENKLTETLKVMVLDDGRGLLPGWADTIFNDPEATKYADGVAVHWYGNLYSPAVLLDITQRHHPTKFIFGTEACAGYFGHHGPIMGDWFRAESYADDIITDLNHHVTGWTDWNLCLDETGGPNWAYNVVDSPIIVNRTAQEFYKQPMFYALGHFSKFLPRGSTRVFTKIEGNLAVSATSVVIEGGRRATVILSKASNSLLTRIVDSSTGFSIVLNLPPRSIHTVIWKKRK

SEQ ID NO: 6241 - protein, 522 aa, Caenorhabditis elegans; identical to SEQ ID NO: 6240

SEQ ID NO: 6242 - protein, 248 aa, Caenorhabditis elegans
MSTSVAENKALSASGDVNASDASVPPELLTRHPLQNRWALWYLKADRNKEWEDCLKMVSLFDTVEDFWSLYNHIQSAGGLNWGSDYYLFKEGIKPMWEDVNNVQGGRWLVVVDKQRRTQLLDHYWLELLMAIVGEQFDEYGDYICGAVVNVRQKGDKVSLWTRDATRDDVNLRIGQVLKQKLSIPDTEILRYEVHKDSSARTSSTVKPRICLPAKDPAPVKEKGPAATTSPSNPGTEATGTSPATPTP

SEQ ID NO: 6243 - protein, 623 aa, Caenorhabditis elegans
MSKTTRPISLNRIVQRNVRYCAKQLEYFLFPVLTREVVFFLTLWTVLDALEMNFMNLAPKSLEVMAFGIIGTSLLAQTLVSLLIGTVTALTVITVIRCSLIMMLYYNGWLFEEIGKKPSYATTAFFVILGFISKRATFFSYQGILPWLLPPKVEDTVAKYLQTMKPILGEKEFLELSEQAEEFKSTIAGGLQNKLWMKWAVSKNYLSDWWKEVVYMRYRDSLIRTNVGCADVIYQKTTSNQAARAAYVTLNRQHFCNDIFKSEKMKPVSLGGIPLCAQQYAEYYRTLRIPHETSDKMIRLPDAKHIAVYHKGCWYKIDIFHGKRMVKPSELEKSFQEILDSNDHISQQGEKYLSALTIGPRDLWARIRTEKFSKGGVNQESLSFIENSLEIVFLDEEERFFDEDDSTKYGREYARALHGDGYMLWCDKPSVYIFSKNGRFSSNAEHSPCDAMIYVQVREYIKYHEQFESPYGPDGHCVGSIEHVPKAERLCWDMDKETLDAIDEAFIISKGVADDFSNANVVFTEYGKDFMKKAKVSPDAYIQMALQMAYFKDQGKFEQTYEPAVMRLFKEGRTETVRSCSIWSCDFVRTMLKKDVGAGKKLEKLKEACDHHQDYYRTAMAGK

SEQ ID NO: 6244 - protein, 280 aa, Caenorhabditis elegans
MAQRFTDEVAIVTGSSNGIGRATAILLASEGAKVTITGRNAERLEESRQALLKVGVPSGHINSVVADVTTGAGQDVLIDSTLKKFGKINILINNAGALIVDPEGKTNTSTGVETCLKTFQLNFQSVVEMTQKIRPHLANTHGEIVNVSSVGAGPAAENRFPYYSAAKAALDQYSRNTAIDLIPDGIRVNIVQPGFVATGFTTAASGMSPDASAKMYEGIGANTSCIPAGYCGRPEHLASVIAFLADRKASEYIVGQTIIADGGTTLVRGRNVALATRRAE

SEQ ID NO: 6245 - protein, 398 aa, Caenorhabditis elegans
MKKSLFRNNFYFKMYLRSFYTTISPWSQRFLKDNSARSGVKPLVFVYFLKFYWKFLNFALKLWSPVSTRHIFIKYEKLKVDDGKRTRKFHSRTNALEVVRGIDLSGKTYAITGTTSGVGTETARAFILKGAHIVMINRNYAASETLKQSLLCETPDARIDIVQCDLSSLASVKKTAEEYLTKKWPLHGLILNAGVLGRKEKTTADRFEAHFGINHLAHFLLIKELLPVLRSSAPSRIVILSSTLSKFTSINPDSKIEEKLGTLCPKNATEWYYRLYAKSKMCNMLIAFKLHRDEFENGISVYSVHPGSAVRTNLHRDVPFWSIFNFLSIPFTKNASQGAATSLYCAVHPEVQELSGRYWESCWDDELNLDEKVARDEELQEALWEYSEELVGKCLNSC

SEQ ID NO: 6246 - protein, 687 aa, Caenorhabditis elegans
MAGIAQSTTSPASATTEKPIYNVVRFLSEGTYGQVSLYESSKNPDVKIAVKQISTAGQSERFVEHIKTEFAIHKGLSKIGGHRNVISMMEMRKGSDCYTLLKEYADGGDLFKKLETEGEQYSENAQCFFKQLISGLKFIHEHEIVHRDIKLENLLLMKSKSNLVPDTLKIADFGLATEYMVDGEELMLVDNCGSPPYAAPEVYSKQGHRGPPTDVWSSGVILMAMLTAGLPWDCAHRKDVDYAAWIDKKFRTDNLWNDISDRALALLRKILCVNVSERVSIEQIEADPWFTFDYAKRIASQKPSARSCYIPKTMSATESTTTTPPASTEKYQVLGLLGKGTFGKVLLIELESLPGEAVAMKEIEASGEHVEQITLNVKKEYILTKRLSAPGHENVIRFLSIRTMPEHYFLIMEYADGGDLFDKISSEYRLTSSQAHGYFKQLIAGLRYIHSKGVTHRDIKPENLMLTKAGVLKITDFGLGTLHIIKGEESLMDTRCGTPQYAAPEVLVGNQYRGPPVDIWSAGVVLINMLTGHSPWKKACNFKTQYFSILILNFKFAWIFQISQIKSMQSDASYTRWFNDECTERDAWSDLGARVITLLCSILAHNPTHRAPIELIEQDHWFQFGDEETVEITSASSTSCNSEAKSSRKRKIEQTIESRQILMDTDFCWILGKLGVDFFFNLRGVLG

SEQ ID NO: 6247 - protein, 484 aa, Caenorhabditis elegans
MAYLQVVPPPISPLSVLANHPDRPYEVLKPLGQGSFGQVALVSNRRYPEMLAALKRIVITGQDREYIDAIRKEITIQESLTGHENVIQVLGKESDAQFCYMFLEYADGGDLYEKITSGCSFSLEEAHSYFKQLVNGLKFLHCRDVAHRDIKPENLMLTHSGKSEMRHLKIADFGLATWYRYKGAELIFEQRCGSVEYVAPEIYTGAQYRGPQIDIWSAGVVLLAMLTRQLPWEFPCMTNKRYFFWMKNRVAHIDAWNELSCRAKKLLWKMLSPGSENRATIEEIQSSACNRLLLGSILLNFRHNLLLWLRLLILLLSFLSLFLFLLLGLLLLSSLVLLSSVILLLFIISTILLLIFFLFLLFLLFLLLLFLLLLLNIFLLRGFLLLLLLFLWNFLLRLLFFLDYRLCWMHQSPRKRKLKALLKCLKVRQRVEIKICARQVPQCARMVEEVSRKVDEACVIKVLKMQNACRARRSRHEPRLLYSV

SEQ ID NO: 6248 - protein, 534 aa, Caenorhabditis elegans
MTSNMSTCKQFLSTKKKSKDSYEFIENLGEGSFAEVVLVAKVGTPNKMFAMKEISIVGKDECFMESIKRECSIQKRLSKSRHLNMIHLFEIRTNPENYQLILSYADGGDLFEKINQHGGLGSDEAHRYFKQLIDGLRFIHEEGVTHRDIKPENLLLTKSGILKIADFGFATMHRFNGAEQMLNAYCGSPPYIAPEVLTGIDYRGPAVDIWSAGVVLIAMIAGAVPWEQADHFDIFQSRYCSFRRNGRKGAWSRMSQQVISLLRKILLQAELRATISMIEEDPWFIYGEEVDAENKENGRTMSAIPITSTPTSRPRKEYKVVEHLCKGSFGQVHLCELTRNPSVKVAVKEVAVSGKSRKNLTAVQKEYKIHRRLSKIGHENVIQMMKMIETPKFYSLVMEYADGGDLFDELKEQEKFSRKDAHSYFKQLIKGLKFIHEQGIVHRDIKLENLLLVYSESEDDPGTLKITDFGLATKYRKDGEEIMLSEDCGSKPYAAPEVCTGNDYRGPPVDIWSAGVVLMTMLVGEHSWKVANKE

SEQ ID NO: 6249 - protein, 1317 aa, Caenorhabditis elegans
MNSATSATLISVVFWMLLYFWYAFFSSIDQTNPYPLGYRLINCINPDIALNYGLQLLAAYETQADGLKWGELFTPPSPDNNLTFGHALIALIVDGIIMIILTWYIEAVIPGGEGVPQKPWFFVLPSYWFPNSGSKTVDSSDQFQQIQYADHVKLEKEPTDLIPTINVVNLTKTYGTSFFKKLFDCKFGKSGEKRAVSNLNLKMYPGQCTVLLGHNGAGKSTTFSMLTGVASPSSGSAYVNDFDIRTSLPKIRREMGLCPQYNTLFGFMTVMEHLEFFAKLKERTWDPEEAREILARLRIDFKADFMAGALSGGQKRKLSLAIALIGGSEVVMLDEPTSGMDPGARHETWTLIQREKERRTILLTTHFMEEADLLGDRIAIMAHGQLECCGSPMFLKQQYGDGYHLTIVYDTTSTPDVSKTTDIIREYIPEAHVFSYIGQEATYLLSATHRPIFPKLFKELEDHQTQCGITSFGVSITTMEEVFLKVGHTADERYNYEHGIENDISEMIEKDDPILQDLRAQVRVTGFTLQMQHAKAMFYKRAIFFFRKWTQFLPQLVFPVAYLVLMVFTSQVLPSVKEQDPQTISLAPFSDTKKAGHLVSDSGNYVTLLGGSQNLSSMVQGTVTQLGVTQTVVDITSNVEKFIMDQTNAMGSRTFGLHYALGFVPSMFNFSTVSVPSLKISFAVCVAGYSQFLITERKKKSKHMQLLSGIRPWMFWLTAFIWDAAWFVIRILCFDAIFYIFNITAYTHDFGVMLILTLSFLLYGWTALPFTYWFQFFFESAPKGFMMVTMYHILTGMIGSIAVPIISQTSSLDAGYLWSIIFAWLFPTYNISQIATVTFQNENVRIACKKLDCTIPMFKAVTACCGTASERLYVDNVLFVGNRKGILVYVIFLAVQGFIYWIWVFMRENDQFTKLFALIRCRKADNPIWDITDTDKVDERDVEDSDVIAEKSVVQRLANNNKTALVSNNLVKWYGNFNAVKGVNFHVNSKDCFGLLGVNGAGKTSTFQMLTGENSISSGDAYVNGWSVKNNWREAGANTGYCPQYDAIIKEMSGEETLYMFARIRGIPEKDIPKKVNAVIHAIGIGMYASRQIKTYSGGNKRRLSLGIAIVGLPDVLLLDEPTSGVDPKARRIIWNILNRLRDLGTALVLTSHSMDECEALCTELAIMVYGKFRCYGSCQHIKSRYGSGYTLLIRLKNRNDAEKTKSTIKQTFRGSVIKEEHVLQLNFDIPRDGDSWSRLFEKLETVSTSLNWDDYSLSQTTLEQVFIEFSRDAGVSSDSEFDGASSTGSANSRGKQNGYTNRALTIESDAESAMYF

SEQ ID NO: 6250 - protein, 1802 aa, Caenorhabditis elegans
MGALGQLRLLLWKNWLQQLRSPWFALFELVVPLILIGASFGLLIGFSGQFETTYTERKYAAWPVSGSAYDLIMPTDPDDPIKSAIVEPYFLFNSQLTCQFLNTYTIGVNKYRMDIIFAYAPMTDATKQIMDKIQNRYTANDLLNPVAAYIKGLYNITAVPVLNTNMTYKGFTTEGEMVSWMQGQFQSECDNPLLAGIVFDDSIAKDLKNPDKRDFTYTIRLSNTHRRSRNAFGDNSYPWDTSVSFAVQYVSGPINPDDNDGGSPGYWQEGFMTVQRAVDVAITEIITGEDAQLTPLLDSYQVSRFPFPGYSTKIIEIGAFFMPVIVIFSFMTSVIYIVRAVVVEKEDRLKEYMRVMGLSQFINWVAHFIINYAKLTFAVIVLTILMHFVALKSDMTLMFVFLMIYAFDVVYFAFMISSFMNSATSATLISVVFWMLLYFWYAFFSSIDQTNPYPLGYRLINCINPDIALNYGLQLLAAYETQADGLKWGELFTPPSPDNNLTFGHALIALIVDGIIMIILTWYIEAVIPGGEGVPQKPWFFVLPSYWFPNSGSKTVDSSDQFQQIQYADHVKLEKEPTDLIPTINVVNLTKTYGTSFFKKLFDCKFGKSGEKRAVSNLNLKMYPGQCTVLLGHNGAGKSTTFSMLTGVASPSSGSAYVNDFDIRTSLPKIRREMGLCPQYNTLFGFMTVMEHLEFFAKLKERTWDPEEAREILARLRIDFKADFMAGALSGGQKRKLSLAIALIGGSEVVMLDEPTSGMDPGARHETWTLIQREKERRTILLTTHFMEEADLLGDRIAIMAHGQLECCGSPMFLKQQYGDGYHLTIVYDTTSTPDVSKTTDIIREYIPEAHVFSYIGQEATYLLSATHRPIFPKLFKELEDHQTQCGITSFGVSITTMEEVFLKVGHTADERYNYEHGIENDISEMIEKDDPILQDLRAQVRVTGFTLQMQHAKAMFYKRAIFFFRKWTQFLPQLVFPVAYLVLMVFTSQVLPSVKEQDPQTISLAPFSDTKKAGHLVSDSGNYVTLLGGSQNLSSMVQGTVTQLGVTQTVVDITSNVEKFIMDQTNAMGSRTFGLHYALGFVPSMFNFSTVSVPSLKTFFNNFGLYTPALAITFTDSMILSQKQKKQYSFTAVNHPLPPSTQDTLKNTNRSDGAAFLIAYGLIVSFAVCVAGYSQFLITERKKKSKHMQLLSGIRPWMFWLTAFIWDAAWFVIRILCFDAIFYIFNITAYTHDFGVMLILTLSFLLYGWTALPFTYWFQFFFESAPKGFMMVTMYHILTGMIGSIAVPIISQTSSLDAGYLWSIIFAWLFPTYNISQIATVTFQNENVRIACKKLDCTIPMFKAVTACCGTASERLYVDNVLFVGNRKGILVYVIFLAVQGFIYWIWVFMRENDQFTKLFALIRCRKADNPIWDITDTDKVDERDVEDSDVIAEKSVVQRLANNNKTALVSNNLVKWYGNFNAVKGVNFHVNSKDCFGLLGVNGAGKTSTFQMLTGENSISSGDAYVNGWSVKNNWREAGANTGYCPQYDAIIKEMSGEETLYMFARIRGIPEKDIPKKVNAVIHAIGIGMYASRQIKTYSGGNKRRLSLGIAIVGLPDVLLLDEPTSGVDPKARRIIWNILNRLRDLGTALVLTSHSMDECEALCTELAIMVYGKFRCYGSCQHIKSRYGSGYTLLIRLKNRNDAEKTKSTIKQTFRGSVIKEEHVLQLNFDIPRDGDSWSRLFEKLETVSTSLNWDDYSLSQTTLEQVFIEFSRDAGVSSDSEFDGASSTGSANSRGKQNGYTNRALTIESDAESAMYF

SEQ ID NO: 6251 - protein, 279 aa, Caenorhabditis elegans
MTRFAGKSVIITGSSSGIGRATAVLFAKNGAQVTITGRNAEKLEATKKKLLKVVKTPDSVNVVVANLTDAQGQDQIIQSAVKKFGKIDILINNAGANVVDGTVNTDQSIDLYHKTFQINFQAVVEMVKKTKKYLIESKGEIVNVSSIAAGPQAVSMSPYYAAAKAALNQYTRCVALDLIKQGVRVNSVSPGIIATNFMGAMGVPEQAQKKIVNLFASEKGCIPAGVPGKPEDIAELIVFLSDRKRSFYIVGQSIVADGGTSLISPMESQNLEDVMELGT

SEQ ID NO: 6252 - protein, 247 aa, Caenorhabditis elegans
MNRFSGKSVIVTGSSSGIGRATAVLFAKYGAQVTITGRDAGKLEATKKKMLKVMKNPENVCVVVANLTDSDGQDEIVQSALDAFGRIDVLVNNAGANVVDGTFNTDQSTELYHKTFQINFEAVIEMVKKTKNHLIESKGEIVNVSSVAAGPQALAPSPYYAASKAALDQYTRCVALDLILQGIEENFTSNRACIPAGVCGKPEDIAELIIFLADRKRSSYIIGQSIVADGGTSLVSGLTAQNIQRNN

SEQ ID NO: 6253 - protein, 366 aa, Caenorhabditis elegans
MSFSLINSTFTEAQFGIKLLSDLTSDQLTPCVFSPVSILLSLALVHLGAKGHTRHDIRNSVVNGSTDEQFIEHFSFINKLLNSSVNDVETLIANRLFVSPEQAIRKAFTDELREHYNAETATIDFKKSQEAAKIMNQFISESTKGKIPDMIKPDNLKDVDAILINAIFFQGDWRRKFGEPAESNFSISATENRLVPMLRETRDYFYNKDDEWQVIGIPFKDKSAWFAIFLPTRRFALAENLKSLNAAKFHNLINNVYQEYIFLTFPKFKMDYKINLKTALAKFGLAELFTEQADLSGIGPGLQLASATHQALIEVDQVGTRAAAATEAKIFFTSASSDEPLHIRVDHPFLFAIIKDNSPLFLGTYT

SEQ ID NO: 6254 - protein, 359 aa, Caenorhabditis elegans
MSDNATSQTDFALKLLATLPHSGSVVLSPLSISLGLALIHAGACGSTQKELEDVLGGSRIFEEFSGLMEAVGDTDNGVETKIVNRVFVNQAYTIHQDYLETVEKLYKASGESLDFSQTEQAAKTMNTFVENHTNGKIKDLIPADSANNAFAFLVNAMYFKADWQSKFAKESTTGREFFTSEAESRQIPFLTELDEHRDYTEDVLFQVLSLKYADPKFTLAIFLPKQRFGLVDALEKINGEYIQNLLNDLKSSYVSVQIPKFKIEKELDLKETLEAIGIKEIFAEGADLSGIADKVFISSGIHKAIIEVDEDGTTAAAASAFKVQLEMMIMAEPTQFVADHPFLFAVLFENHTLFLGVHA

SEQ ID NO: 6255 - protein, 320 aa, Caenorhabditis elegans
MTDAAIAEKDLGNAAYKQKDFEKAHVHYDKAIELDPSNITFYNNKAAVYFEEKKFAECVQFCEKAVEVGRETRADYKLIAKAMSRAGNAFQKQNDLSLAVQWFHRSLSEFRDPELVKKVKELEKQLKAAERLAYINPELAQEEKNKGNEYFKKGDYPTAMRHYNEAVKRDPENAILYSNRAACLTKLMEFQRALDDCDTCIRLDSKFIKGYIRKAACLVAMREWSKAQRAYEDALQVDPSNEEAREGVRNCLRSNDEDPEKAKERSLADPEVQEILRDPGMRMILEQMSNDPGAVREHLKNPEIFQKLMKLRDAGVIQMR

SEQ ID NO: 6256 - protein, 466 aa, Caenorhabditis elegans
MTQSSIHSEKMCLPKLPYYRFIVMMVAFFCLMSIFSNYTIMNFAFICMKNDMQGAVQGANGTLQSIYDYTSTGKAQLIWAVAIGTIIGTVPYNWMYVKYGAKNVFLSAGIISLVATSCTPFAAGNSYWLLLAIRLIQGIAYAADFAVIGIICVKWAPHDEVAFFVSVLTVFSPFATVITTAVTGFLCTSSLGWRFSFYVHSIAGALCFVLWYFVYSDDPLSHSSVTSRELANIQKGKSAAHFSKRREIPYLKMITNSALACTWFNAFMDLSMSIMIITYSPIYFHTIEQTAFIIGITNFAQLPFKFGAAFISDRITSINPKAKMLIFNTISCGIVSILFGGLGFISKDQKWVAMFLLIAVNCLMSTNCAGFYQCGRHVSQQFADVVIAAIQFCKCLALFFVPAIVAATVTDESDRGQWSHAFLVMSGLLLVANFSAYFFFTDQPADFTKCEEPHEFPLKKSIEAHD

SEQ ID NO: 6257 - protein, 335 aa, Caenorhabditis elegans
MLKLLPSLLFILAASAVVLPRNKLFINHINSAQKLWTAEHYTTPFEVKNLMKVEHVAAHLDKDIKLAETADSIPDSYDVRDHWPQCISVNNIRDQSHCGSCWAVAAAEAISDRTCIASNGDVNTLLSAEDILTCCTGKFNCGDGCEGGYPIQAWRYWVKNGLVTGGSFESQYGCKPYSIAPCGETIDGVTWPECPMKISDTPKCEHHCTGNNSYPIPYDQDKHFGASAYAIGRSAKQIQTEILAHGPVEVGFIVYEDFYLYKTGIYTHVAGGELGGHAVKMLGWGVDNGTPYWLAANSWNTVWGEKGYFRILRGVDECGIESAAVAGMPDLNRRN

SEQ ID NO: 6258 - protein, 344 aa, Caenorhabditis elegans
MWKLSAILLVAAASAVVIPGHREAPALTGQALIDYVNSAQKLWTAGHQVIPKEKITKKLMDVKYLVPHKDEDIVATEVSDAIPDHFDARDQWPNCMSINNIRDQSDCGSCWAFAAAEAISDRTCIASNGAVNTLLSSEDLLSCCTGMFSCGNGCEGGYPIQAWKWWVKHGLVTGGSYETQFGCKPYSIAPCGETVNGVKWPACPEDTEPTPKCVDSCTSKNNYATPYLQDKHFGSTAYAVGKKVEQIQTEILTNGPIEVAFTVYEDFYQYTTGVYVHTAGASLGGHAVKILGWGVDNGTPYWLVANSWNVAWGEKGYFRIIRGLNECGIEHSAVAGIPDLARHN

SEQ ID NO: 6259 - protein, 335 aa, Caenorhabditis elegans [sequence omitted]

SEQ ID NO: 6260 - protein, 149 aa, Caenorhabditis elegans
MADQLTEEQIAEFKEAFSLFDKDGDGTITTKELGTVMRSLGQNPTEAELQDMINEVDADGNGTIDFPEFLTMMARKMKDTDSEEEIREAFRVFDKDGNGFISAAELRHVMTNLGEKLTDEEVDEMIREADIDGDGQVNYEEFVTMMTTK

SEQ ID NO: 6261 - protein, 205 aa, Caenorhabditis elegans
MAAMNPEYDYLFKLLLIGDSGVGKSCLLLRFADDTYTESYISTIGVDFKIRTIELDGKTIKLQIWDTAGQERFRTITSSYYRGAHGIIVVYDITDQETFNNVKQWLQEIDRYACENVNKLLVGNKCDLTAKRAVETQAAQDYAGQLGIPFLETSAKSSTNVEQAFLTMASEIKSRMGPVQGAGGAPGVRITGSQPVQDKKSGGCC

SEQ ID NO: 6262 - protein, 299 aa, Caenorhabditis elegans
MVQSGNENPKPLVAIFGAGMMGSGIAQVCLQAGYPVNLYGRSEKKLLEARETIKKNLIRVASKKKTDVPMEPAALEEIAQIQLDLLQIHTDIPSAAEDAAMAIEAVAENLDLKLDIFQTIQKTCPQNCMLITNTSSLKLSQMLPVIQNPALFAGLHFFNPVPVMKLVEVVSTDETSPETTNFLFNFCKEIKKLPVAAKDTPGFIVNRLLIPYLMDSIRMLERGDATKEDIDTAMRFGTSYPMGPIELCDYVGLDVLQSTLKIFRETIPGDARFAPIPLMDKLVAEGKLGRKTKQGFYTY

SEQ ID NO: 6263 - protein, 576 aa, Caenorhabditis elegans
MNAVVASQNKNDRSFSNMESESSSNVEKSEKENHHQSLPDENWTPFLFFCISSIALASFQDGFQIGCINAPGPLIIDWIKKCHFELFGEVLSQYQADFIWSVAVSMFSVGGMFGSFCSGFLADKFGRKSTLLYNNILALLAAVCLSTSKLFNFYPMIVFGRFLVGLNCGITSGLVPMFLTELAPANLRGKCGSFHQLNISVAIVLSQALGLPQIFGTQVGWPYIFACVAIPTFLQLATIPFCVESPKYLISKLNDREEARRILEKLRGHTKVDEELEHMVQETMVTVEPLHQPGYVSLFKGDNQWPMIVSILMMFSQQFSGISAVTFYSTLIFKRNGLSGNEPMYATVGFGCIKLIATFGCLFLIDHPKFGRKRLHIAGLSGMCISSILIVITLTLSNAGYHWASYMNVLFILSFVVTFAFGPGPIPWFFTSELFDSATRGRAAAVSATSNWVANWMVGLTFLPINNIIHQYAFLMFTFFTFTFAIFTWKFVPETKGKSPSAIRKDLQNASFDYSSPSRPSRTFFSPIWIWVQLWLRSTNVSWIWWIWWRTSRASYWKEVGRREELFADFLYLIVI

SEQ ID NO: 6264 - protein, 293 aa, Caenorhabditis elegans
MSSGVMVDPDVQTSFQKLSEGRKEYRYIIFKIDENKVIVEAAVTQDQLGITGDDYDDSSKAAFDKFVEDVKSRTDNLTDCRYAVFDFKFTCSRVGAGTSKMDKIIFLQICPDGASIKKKMVYASSAAAIKTSLGTGKILQFQASGVKVDPSCKNAYDLLHNKHQHSYIIFKIDKNDTAIVVEKVGEKNAPYAEFVEEMKKLVEDGKECRYAAVDVEVTVQRQGAEGTSTLNKVIFVQYCPDNAPVRRRMLYASSVRALKASLGLESLFQVQASEMSDLDEKSVKSDLMSNQRI

SEQ ID NO: 6265 - protein, 152 aa, Caenorhabditis elegans
MASGVKVDPSCKNAYDLLHNKHQHSYIIFKIDKNDTAIVVEKVGEKNAPYAEFVEEMKKLVEDGKECRYAAVDVEVTVQRQGAEGTSTLNKVIFVQYCPDNAPVRRRMLYASSVRALKASLGLESLFQVQASEMSDLDEKSVKSDLMSNQRI

SEQ ID NO: 6266 - protein, 165 aa, Caenorhabditis elegans
MSSGVMVDPDVQTSFQKLSEGRKEYRYIIFKIDENKVIVEAAVTQDQLGITGDDYDDSSKAAFDKFVEDVKSRTDNLTDCRYAVFDFKFTCSRVGAGTSKMDKIIFLQICPDGASIKKKMVYASSAAAIKTSLGTGKILQFQVSDESEMSHKELLNKLGEKYGDH

SEQ ID NO: 6267 - protein, 307 aa, Caenorhabditis elegans
MSFDLESCENSESSGCSIEDKLPSKNCLIRGKDSVYAVGKKVAQGRYGAVYEVLRRSDGKPFACKLEICEAHSHGLDQDYSVMTKAAKRGAENLVRMIDRGKIEEHFKFIIMPLLGENLMNLRFLFEDGRFSLSTGLRLALFAIQPIQSLHQLGYVHRDIKASNFCIADPQMLHQNPEALKLCLIDYGICRSFKDKSGELKTPRTDIKFRGTNRYASLAAHYGDEQSAKDDMESWFYMMIELISGNLPWSFMHRDQHKEVEFHRIQAYLMGLKYQNTVDYTFISEMVQLAMRNNGVRMNEKFDWQED

SEQ ID NO: 6268 - protein, 309 aa, Caenorhabditis elegans
MKLELNVEVLPPALFIFLLITFSVGRSFIKGGRGTDAGEAIASHMDVDKVAFTGSTEVGKTIMKAAAESNVKKVTLELGGKSPNIVFADADLEEAVRQSHHALFFNQGQCCSAGSRTFVEGKIYDEFVAKAKELVEKTVIGDPFDENTTQGPQIDESQVETIMKYIESGKKEGAQLVTGGVKHGDQGYFVKPTIFANVNDQMKIAQEEIFGPVMIVIRFDSMEELIEKANNTIYGLAAGVVTNDLNKALQVANTIRAGSVWVNCYDVFDPAAPFGGFKQSGIGRELGEYGLAAYTEVKTVTIKVPQKNS

SEQ ID NO: 6269 - protein, 257 aa, Caenorhabditis elegans
MASPATKFLTDRVALVTASTKGIGFAIAKQLGAAGASVVVCSRKKENVDEAVAALRLENIDAHGTTAHVGNKSDRTKLIDFTLDRFTKLDILVSNAAVNPHYGDLMKVTDSQWDKLLDLNVKSAFELTKEAVPHLEASGRGNVVFVSSVAGYSPMNEIGAYSVMKTTLTGLSKSLALNLARRNIRVNSIAPGIIQTDFSQVLFSDESEKQKWLSQIAQRRFGDPDECAEAVAFLVSDEASYISGETIGINGGMHARI

SEQ ID NO: 6270 - protein, 577 aa, Caenorhabditis elegans
MMRPPIILLKDGTENKQGKGQIISNINACQVVADSIRTTLGPRGLDKLIVDSKGATTISNDGATILKLLDIVFPAASTMVDIARSQDAEVGDGTTSVVVLAAEILKQMKPFIEDGVHPQLLIRAIGKACEKTLKNLADLEIKINGETELREMLVKCAATTLSSKLVSQERLFFANMIVDAVNTLDAHLPLNMIGIKKVNGGNLHESRLIKGVAFQKAFSYAGFEMQPKKYSNVKVALLNIELELKAEKENAEMRLTNVSDFQAVVDAEWNILYDKLQKIHDSGANVVLSKLPIGDVATQWFADRDMFCAGRIPQDDLDRLMSACGGSVLTTVSQIDDSVLGKCGKFYEQQVGSERYNFFEDCSKAQACTLLLRGGAEQFIAETERSLHDAIMIVRRAKKNDSIVAGGGAIEMELSRLIREHSKGIEGKDQAFWMAYGQAFEVFVVFLPFFRLVKADFKLRRNQKIHFFHQKHPKKKLISEIFQIIPRQLCQNAGLDALDVLNKLRHRHAQGEKWAGIDIHREAVGDNLVACVWEPSIVKRNAITAATEAACLVLSIDQTVKNVRTPSGGAMPGLPGQ

SEQ ID NO: 6271 - protein, 437 aa, Caenorhabditis elegans
MSLHRIVEAQRAYFNTGATKPAEFRKEQLLQLKKLIEENRAALTEVVWKDLRRRHEVTEPMELGGSLEEIAYYLKNLDDWMKPTYVEPTVATLPTDKPYIVKDPKGVVLVISPWNYPVSMVLLPMIPSIAAGNTIVIKPSELSENTAILFEKLIPKYFDPKYVTIVNGGIPETTELLKERFDHIIYTGCPPVAKIIMAAAAKHLTPVTLELGGKCPVVVEDDADIEISAQRIARGKWLNCGQTCLAPDYILVSSATKPKFVAAIQKCLKEFYGGNAKESKDYSRVINQRHFDRISALLDESKGVVLAGNEESRDRSDRFIPPTVLDVEKTDPFMHDEIFGPVLPIITVKNLCESIDFINKGEKPLAAYIFTKDEAKVQRFLNETTSGGVTVNDVIMHVAVITLPFGGVGVSGMGRYRGKFGFDTFTHEKSVLQRVFA

SEQ ID NO: 6272 - protein, 647 aa, Caenorhabditis elegans
MVQKKMLTHPELFSRLVDGPERIRESVQVPKPITGCPDGITKTVWDVLTRSAQLNPNAPLFGESVNGRHVYTTYREAVEEATIIGSGIVAIMQKNQSTNKLIGIAGIHSRKYMHTMHGISGFDLTTVPLYHQSKLETLCDIIDNCKLEIIFCENAKRAEGFLSSKLGDRLRSLKTLIILDKTTTLQKHDDVEVMSLDEFKEIGKRNKRNPVKPKPETTYVICHTSGTTGRPKGVEMSHGSLVTSVSGIFTSWTIAYKWKFGLEDTYFSFLSLAHIYEHLIQTLTIYFGGKIGIYDGNTATLIPQIQKLEPTIVSLVPRLLNKLYEAVHDGVAKKGFIARKLFDYAKKTKARQLQRGVLRYDTFFDKIVFKKLKLMLGGKLKVLTSGGAPITKEVKTFTRYAYGCPLVEGYGQTECSAAGTLTLPWDTTYGNVGGPAPWAQVKLVDVPEKNYFSMNDEGEVCFRGNAMMTGYFQDPELTAKTIDSEGWLHTGDIGKWLPTGGLQIIDRKNEMFKLSQGDFVSPIQIEAIYANSPLITQIYVTGKTERSFLVGIVVLDLPRFKQLPLVKALDGKESIEMIMENKEVKNAVIAELNKYAKQNGLQTIELIRNEFTEENGLITSTLKNRRKILEDYFAPQIAKMYKEVEAL

SEQ ID NO: 6273 - protein, 518 aa, Caenorhabditis elegans
MNVSDPSKNEYSKEIRRTVSSEIIGQSRSPMTLENQPVSPMTKRRRLENMDRTITEQMVEDEIVATAISPPSQPKNVVVPIPQDFAAMLTNSWTKPIRGPMTEKKKLKINETFNKLTQQLADATHTIPAETDLTETPDGFLVDLMPHQKAGLCWLLWRESQPHSGGILGGDMGLGKTLSMISLIVHQKAARKTRKDAGDDAIAPESLVHHWEAEIARRLKQDLLSVLVYHGNRRHINPKDLKKHIELDYDLEDEHNPCSKLRPRVCPKADKNSSPLARIAWSYVILDEAHIIKNRNAQCSEAACKISAFSRWCLSGTPIHNNMRRKKIVHLMEKNIVIHKLEMVGQEAKGFAMMMEAALSLSPNGLLFCVSCKDIQEGGHGYTSITGEVAIKDRQERVDSFNQEKGGAQDMLLSLTAGGVGLNLIGGNHLIMVDLHWNPALEQQACDRIYRMGQKKEVHIHRLIVKETIEQRVMSLQEKKLALAASVLEGSATRGMNKLTNSDIRTLFGLDEEFELDT

SEQ ID NO: 6274 - protein, 381 aa, Caenorhabditis elegans
MISAIGTLFAENSLESDVILEKVIELGSDYLRGGWALVEKSEVTVTQITGGQSNILYLATSASTKLSPDTPSCFLIRIHRQAPSQVFTETVVFSVLSERGLGPKLYGFFPGGRLEEFLPSRTLDVDSIKLPEIARQVGSLYPKYHDIEVPISKSAGALKFIKENLEGYKALGGKVLKMCPHSVKYDSMPSELTVEQIEQEIATFERWCKVFDETIVFSHNDLAPLNVLELNDTKEIVFIDFEYSSYNWRGFDLCMFLCENAFDYRDPTPPGLVIDQDYMENHPNLQIFCEAYIDTQYKMKTANPKQKFPLTEGRAAEVESLMLECKFFIPLVNMFWAVWSLRQHLAKYEIGMDLDVIASDRFSMYFHLKEQSRAIYEQFKK

SEQ ID NO: 6275 - protein, 497 aa, Caenorhabditis elegans
MIIILLLTFLTIYFVYELYWKRRNFPPGPCPLPVFGNLLSIANPPPGYKAFERWTKKYGDVYTFWIGNTPHIMINTWDKIKETFIRDADTYTNKVVLPMVTLSRGGEYGIIDSNGAMWREHRRFALSTMRDFGLGKNLMQENILMEVQDVFARLDAKLGSETDVPEVFDHAVANVVNQLLFGYRFMGPKENEYQELKHIIDSPAEIFGKLHIFLAMNIPIFAKLLPESLYEGPIKTFRDTTLAFFNKQIEAHRHRIDFEDLNSESTDFVETFLKEQKRRESEANSKNLNFSNIQLLNVCIDLWFAGLNTTTNTITWAISYVLHHPEVQDKIHEELDKVIGSDRLITTADKNDLPYFNASINESQRGINILPLNLQHATTRDTVIDGFKIPKGTGVVAQISTVMNNEEVFPDPYTFNPDRFIDENGKLKKVDELAPFSVGKRSCPGEGLARMELFLFIANFLNRYKIHPSKEGLPSMAKGSGPVVAPRLFTAILTRRF

SEQ ID NO: 6276 - protein, 493 aa, Caenorhabditis elegans
MIILLVFTAFLAFLFHELYWKRRNLPPGPIPLPFMGNILTMLLNKPGYECFRNCTKKYGDVYTFWMGKTPFVMISSYDLLKDTFVRDGDTYKDKYPQPLNQKIRGGNYGIVESNGHLWSTHRRFALTTLRDFGLGKDLMQEKILIEVEDIFKKFDAQLGLEQDVSVVMNNAIANVINQNIFGYRFEGDKEEDFKKLRELMEYQETAFATFKVYVEAFIPKVGALLPGRSLNELLEEWRDNFYTFFDTQIENHRKKIDFDSQESLDYAEAYLKEQRKQEALGEFELFSNKQLSNTCLDLWLAGLSTTNTTVNWTICYVLNHPDVLQKMNEEFDQVVGSDRLVTMGDKNNLPYFNAVLNESQRCANIVPINLFHATTKDTVINGYPVKKGTGVIAQISTVMLDEKIFPDPYKFNPDRFIDENGKPIKIEQLIPFSIGKRQCPGEGLARMEMFLFLANFFNRYKISPSSKGFPNLDKKDNVGVFPKDLHAILNKRN

SEQ ID NO: 6277 - protein, 500 aa, Caenorhabditis elegans
MILLLVFTAFLAFLFHELYWKRRNLPPGPIPLPYMGNILTMLMNKPGYECFRNWTKKYGDVYTFWMGKTPYVMISSYDLLKDTFVRDGDTYKDKYPQPFNQKIRGGNYGIVESNGHLWNTHRRFALTTLRDFGLGKDLMHEKILIEVENIFKKFDAQLGLEQDVSVVMNNAIANVINQNIFGYRFEGDKEEDFKKLRELMEYQETAFATFKVYVEAFIPKVGALLPGRSLDVLLEEWRDNFYSFFDTQIENHRKKIDFDSQESLDYAEAYLKEQRKQEALGEFELFSNKQLSNTCLDLWSAGLSTTYTTVTWALAYVLNSPEVLEKMRSELDEVVGKDRFVTTADKNDLPYMNAAINEVQRCANLLPVNVAHATTRDTVINGYAIKKGTGVIAQISTVMLDEKVFPDPYKFNPDRFIDEHGKLIKVEQLIPFSIGRRQCPGEGLARMEIFLFVANFFNHYQISPSSEGFPSIDKSDRVGVFPKKFKAILNRRFYGPSKEI

SEQ ID NO: 6278 - protein, 475 aa, Caenorhabditis elegans
MILLLLSAAVCLFLFHELYWKRRSLPPGPTPLPFMGNTLAMLLEKPGYECFRRWTKQFGGVYTFWMGNIPYVIIGSYDLLKETFVRDGDTYKDKYPQPFNEKLRGGMYGIVESNGHMWSTHRRFALSTLRDFGLGKDLMQEKILIEVEDIFRKYDAQLGKEQDIQVVLNNAIANVINQTIFGYRFDETNQEEFERMRHLVEYQEKQFATVKVYVEAFVPTIGKFLPGKSLDQLLDDWRNSFYTFFDTQIENHRKKIDFDSEESQDYAEAYLKEQKKQEALGEFELFSNTQFSNTCLDLWLAGVSTTNTTVNWTICYVLNHPDVLQKMNEEFDQVVGSDRLVTMGDKNNLPYFNAVLNESQRCANIVPINLFHATTKDTVINGYPVKKGTGVIAQISTVMLDEKIFPEPYKFNPDRFIDENGKPIKIEQLIPFSIGKRQCPGEGLARMEIFLFLANFFNRYKVILESVNYLKILGI

SEQ ID NO: 6279 - protein, 452 aa, Caenorhabditis elegans
MQMNTLTLNFTVICMDDIVEDFHMFHNSTETHWFERSTEKSLLFSGVAIGGLIGLVPSVPQISSIGLRNTQTISGFISGLGSFLFPLAVSVGFYTSFLCRVLQGIGAAVLFTAVGVVPGVWAPKSEANTFMSILACAFQLSNVICMPVSGLLCESAVGWRSIYYISGAITFVLYTVFWFTYTDDPKLHRNVSQKELRKISTGKVEKIKEPVPYFAVSTDPTVIISWISLFGGNMGFYVLCIYGPTYLREVLKFDVKETGFLTALPFILSAIAKFSAGRISDKLTGLSERARFVFFASIFQIGLVAGLVVMAFTTNRVIAQIAFNFAIVSSGLNIMGVVKFADLPKNLIFVNLPICQFAGSFREILYKIETLKVRCLQHVHYTLTVMSFTAYASQFLSPTLVSIICPNYTNEQWKTFFLVISGLIVACNAGFPFLARSDAAGYTKKQEPTVKC

SEQ ID NO: 6280 - protein, 571 aa, Caenorhabditis elegans
MSKQPIDGPLDAEKKEVTVAVTAAENFEEQVEEVGKVTPPDGGYGWVVVAASFLVNMAVDGVIYTCGKILVPIWADQFGSTSVAGAVISILTGCYYLAGPLASSFVNVFGIRSVAIAGSILATTAFLLSRFASTIWELYLLFGVLGGIGFGCMYLPSIVILSTYFAKKRSVATGIAVCGSGIGTMVFSTINGPVFDYFGKDVGSFMVYLAAIAISGSLFSLLFAPLKATEHQVKKVAKMVRNYEGKPEEPTQRLLEDVRNDLEELNRPGHNADTFYAGNAPVSRSRSNTCSFLGIFLFKKIQNCLKFRETIKNRKKLDRKAAESAEAHVVHATEHHTVHHVVKKSKFTKFKESLCSVLDKDLLFSPSFMTLAVSGTFTVLSFLVPFVYLALAMKQKNPDFTDAELSLPVTLIGAFNIMFRIGCGMVADHPKMSALQVSNVATIIAGTSMLFVPFCTELWHYVVFCIPFSAGVACFAALRSVICVELIGVEKLSNAFGILMVFMGIGAVVGGPIAAQIKDITGNYDISFYVMGIIFAFSGVMTIRLPELKAWEESKKLARAGTEMRVISEAS

SEQ ID NO: 6281 - protein, 478 aa, Caenorhabditis elegans
MRRVGDAEEKIEKSDEMSENSRKTSKILCCNLTRYLILILTLTCLTLLQMNSLAFNFTVICMSDVSDDYHITHPNETHWFEDSNMKSLVFSSMAVGGLLGLLIAMPLMHRVGVRLVLSICGVFSILGTILFPLAVEWNFFSVLVVRFLQGLGISMVFTVLGSVPTAWAPNNESGTFLAVLSCAFQWSNVICMPISGFLCESSWGWRSIYYLFGIVTIVFFLAFYFFYTDSPTDHRNVSNKELSLILQDKTVTHKEPVPYLAICKDPCVLVTWMSNIGGNLGFLTLVLYGPTYLREVLNFEVRGTGFASALPFLLSAAVKSIAGQLSDRCDFVSERVRFTICGIVARLGLAIGYIGMATTSSRLVAQIAFTFSIAVSGLNIMGTVKCLQLRCKQHVHFAVSVIALMAYVIQFGAPILVGIICPDNTAEQWGWFFLIVGIIVFVTSAPFPWFTTAEPADYTLSREKQLEIAKHKELQECC

SEQ ID NO: 6282 - protein, 446 aa, Caenorhabditis elegans
MISFQLLLRIVVLHFLMGLAMAQQKQLIKYLFRDYHKELRPVKDESSGPTNVTVQLYFKQIQKVHENDQIITLYCWIEEYWQDEFLTWNPSDFGNIKSLHVPSEMIWKPDLLVYNNANMNIKENEMQTNVQIEHTGKISLFRAIITDITCDLQMEKFPYDQQICFIMLASWSYDGSQIMLNTAEQPTEAPLDIKNTTNLAILNHYIPNMEWKLVDFRYRNNLKYYDCCPNPYPDISYFFAIKRNPSYYLFTLIIPSAFITIVTVIGFFTPHSSTGENTEKVSLGVTALLSLAIILMMVSDKLPATSNSVPLLGQYYIGLIFIMFLATYCTTFTLGIQMQGNAGRPITRRLRSFLLSIRMNRNSFVQWFFGRELMNTQESIKMRLKKYHNKTASLIEQESIDSSKLLDPAMYNVVVDVLSSVQSIRQDLTSQEHLKRIRKEWQMLAR

SEQ ID NO: 6283 - protein, 424 aa, Caenorhabditis elegans
MEQWKVMVLICMYGAVKEFRPTEPYMYEYQHTVLNMSEQTLNSQVYPIWTYSYLITLIPAFLLTDVFLYKPLLVFEAFSYFLCWVIFVFGKSVWSQQVLEVFYGWATATEIAYFAYIYVKVPKTEYKSATAFTRAALLVGRFLAYALAQLLIGLNWTSYSTLNIISLVAMTIAVFLALILPGVEWKEAYEKKLEDNNVQGNLKEIVDQSSYMDYLRMFFVGLRHNLMAIYRNPLILKWSVWSALSSCIFYQVTNYTQTLWGTLPESANRYNGITEALVPLLGIPADLITRQLNVNWNRWGDLLLAVGSIGQAGLLFWMSQSHHIVVLYLSYIFYRVIYQLTTTIAQSTLAFSLDSRLFGLLFGINTFVALLLQSILTAVVIDWQKLDIRPQFVVYSCYHLVVAFGFAIIFGIWASRRFFKTSTN

SEQ ID NO: 6284 - protein, 382 aa, Caenorhabditis elegans
MVQMYFSDCHDLEYHYAGVQKFMAKWLCNLEKVFMGVVCELPFASIIYDYAAEVSILSVLVNLLHFSILTRKPMRTSSINILMAAVALFDIFSSLIYIHVFLEEHNYLFFTCHIRYTFGTALTRILLSAVKDYSRKCSTWFIVFIAFIRTLIIRNPLSSIYESLAKPRVSAIIIAIVCAASLPISTIKSFEFLIAKGPFLNICAGKIFYYLLTEGPLFMANNLLFGKYFYIFNSLVSDVIPSLLLPIVTCLLLQGIRRAGKIRARTSPSGQNSYWKTTGLVFCVTFMFFLVEFPYGLSIGFQWVLNDVYGVKNILSYCGYMFPVFITGNSCTHLVVCFLMSSDYRSTAISVFSCVYFNQERRHAQRVQVNTSLHPTALPPVN

SEQ ID NO: 6285 - protein, 474 aa, Caenorhabditis elegans
MKQGFLIYYSRLLLDFRAFFCRALALAIFFVQFSICITQLVQKLFICVNTTFLCAERGEMITGGTKILRNTFQSIKLEDNRKIFIFHKMFGKLISLLGLVALCSAGQFSISVEKSGSLREQLIREGRYGQELARIQQLSTGNVSFFDHFDEYYTAGVRIGTPAQHFQVAFDTTSSNLWVFGVECRSQNCHGGRGRRDREYNRTASSTFVAGTSSFNLPYDGGHVSGNVGKDTAQFAGFTIQSQDFGIGTAATRLFGETFDGVLGLGWPATALNGTSTTMQNLLPQLDQKLFTTYFTKSNMHNGTAGGDIMFGAIDTTHCQSQVNYVPLAYNSFWSYSVDGFSIGTYSRTQTETTIPDTSSGWTGVPNVVLAGIVKATGATYDWNHQAYTLPCSSTATLPDMVFTIGGNSYNVRAVEYVVNLNLPNGQCALSLFGTAASQSGPAWILGDNFLRSYCHVFDFGNSRIGLAKAIQNY

SEQ ID NO: 6286 - protein, 383 aa, Caenorhabditis elegans
MTEKLTILLALLVFCSAGQFSISLEKSVPLREQLIREGRELARLQQLSTGNESIYDHFDEYYTVSVRIGTPAQHFEVALDTTSSNLWVFGVECKSQSCQVLKYIRIREYNRTASSTFIAGTSNFVLPFNDGDVSGDLGKDNIQFAGSKIQNQDFGIGTDATRLSGVTFDGVLGLGWPATALNGTSTTMQNLLPQLDQPLFTTYFTKSSVHNGTVGGEITFGAIDTTHCQSQINYVRLAYDSLWSYSIDGFSFGNYSRNQTDTAIPDTTSSYTGVPNLVLAEIVIATGAQYDWNHQAYTLPCSSTATLPDLVFTIGGNSYNVRAVEYVVNLNLPNGQCALSLFGTFSSPSGPLWVFGDNFLRSYCHIFDFGNSRIGLAKAIQNY

SEQ ID NO: 6287 - protein, 213 aa, Caenorhabditis elegans
MGNSNSSILSDAEMREIMDETQCKVCVIIAKQFTPKNTISVNKHQILRLYTRFASLDKNGQGYLSRDDFLNVPELAVNPLGDRIIDAFFTLGDSDGDSKSGQLTFRQFVRILAHFQPISKVKDNALNSRKDKLRFAFKMYDLNKNNYITREEFKVILNSMVGANITSDQLDKIADKTLEEADQDRDGKISFEDFCRAMEKTDIEEKMSMRFLN

SEQ ID NO: 6288 - protein, 258 aa, Caenorhabditis elegans
MKTPAYKIMMFLGICDVISVLIDSIANGIFAFYGVTYCNYPTLIYVLGAFSLSTWMGCCASSLVLAVIRVSDLNSTNTFKKSFDGGKINYVLLVCFAYVFYGTFFTKPVIYNTGYMTWVFDPNIGKSSSNYVNYIHISNNSMVAILSISFYGYLASIYLRGNSTANASKKLSNMQIKILLQSFLFCFFHSVSALLYAYMQLFVGTSTLILIGHLTWICDSGSVCIVYLTLNRTIRQSVKRLICPGSQKVIQVSSLSNR

SEQ ID NO: 6289 - protein, 517 aa, Caenorhabditis elegans
MLTHHLKSSIHTTAGLRAATSAANNIISQANLQSDISKVLFIDDGRKITYGDFVQRAGQYATALTEKYKIKKGDRVMARVSKTTDTAALYAACLQIGALYVPVNPALTQSEAAHYVKDAKPSLWITCKDDADQIAMFQRVLKTVCIDNPVEVINEKVLADEAGKRKACTMIEHVEKSNAATICFTSGTTGAPKGAVLSHGALTNNTNALVQEWGFTENDVNLHCLPIFHAHGLYFSLHCSLFSHSSVIWRPNFDAEDCSKHLKNATVFMGVPTFYSRLLATNNFNKESFEKIRLFISGSAPLSVPTLEEFEKRTGQVILERYGMTEAGVIASNPLKGKRKAGTVGQALKGVQCRVTENGEIEIKSDSIFSEYWKNPEKTKEEFTEDGWFKTGDVGSLDKDGYLTIGGRSKDMIISGGENIYPKEIEDAIDSIEFVKESAVIAAPHPDFGEAVVAVVVPKNMVEDEQKFEEDLIEMLRKKLAKYKVPKKVILLEELPRNHITKVRKDILRASYNKLFS

SEQ ID NO: 6290 - protein, 496 aa, Caenorhabditis elegans
MVLNIILVVVVAFLFHHLYWKRRNWPAGPTPLPLIGNLLSLRNPAPGYKAFARWTAKYGDIYTFWLGTRPYILVSSYEALKETFIKDGETYADKKPMAFQESFRGGSYGVVETNGPFWREHRRFAIHQFRDFGLGKDRMEQRIMLEVEDIFNNCDKTIGEGVDLTDIFDRAVGNVINQMLFGYRFDETRADEFRTIRAFFNFNSGEFASFSMRVQFFLPWMGYIMPGPTILDRFKKYQKGFTEFFGTQIENHKKEIDFELEENSDYVEAFLKEQRKREASGDFESFSTKQLSNMCLDLWFAALMTTSNTMTWCFAYTLNYLDAQQKLHEELDRVIGSERHINTADKPNLPYTNAYINEIQRTANLVPLNLLHMTTRDTVLKGYNIPKGTGVVAQISTVMYDENVFPEPYIFKPERFLDDDGKLKKVEQLVPFSVGKRQCLGEGLARMELFLFIANFFNRYRVVPDANGPPIIDKAVLGGMHTKEFKAILQRRHVSE

SEQ ID NO: 6291 - protein, 494 aa, Caenorhabditis elegans
MNFLLVLTLIVIISVQSRQENVSLDPCNDFYDYVCSNDTRSITELNFTSLFEDREILVNPNISFPNNGTYITFDQILSPYSLMMWYMVVKSMDTPTVGSEFFDEATREYATKKNNSEKFSFALENLENLNLTLTNVFYNSLYANIEVLNQLNLPASEENEYLHHIFDLMKNNTIEEIWSSSLSNKSKKEFEKELNKSKVIFGLLDYNNVTMLEETKLIYETEYYRLKSLLSSNDLDTEIAEKIIRLGATDTATKNLGKRIPGYTPQFLFSAFASNMANEAFNQNSNIYCGIVTRSDLQEPILTIADTIFVLAHELMHFVYPFGIRLLPSNVTKAANKCTQDEVKMMGDSDAVKPIDGWFSENITHEDLPNLLGLRMVMKMVARKSANEEQLKNALETILSGLCIQGKPKNSILPNHHPFEISINTAVRQYPLFSSLYGCRLGDRMFAEPEKFCNPLGGDVNLEDYKIKNDTEDVGGFFNYIMDTANAFNFSFTN

SEQ ID NO: 6292 - protein, 445 aa, Caenorhabditis elegans
MSANKPPGQLQILHLPQPNETFFNNGTYTSLENLVNLSNLTQWCVEMEVLSLGYYNYIADGLNSSEKLKEVMKRLDGLNSTNVNIFYNALHANVEILNQMNIPVVEENQFLHNISETLKIRIRAELESSSISDKAKTHIKKSIETSKQFYAFYDHNDVKVFETAKLTYETEYYRLKSLLSPEDIQRKVSESILRIGATTASMEYLMSMIPGFDVNFLFHAIIASPENDAFQYNGGNHLLTVITRNDLTQQEKTMADTYFITTHEIMHLIYPVANSYINESVWSGALECTLRDVKMLGETDAVKPVDGWYNADIGYEDLINVMAMRVLMKMAAEKSVNEQQLKEALETVIGGLCKHTGRKNELIPDHHPLEISRNAAVRQYPLFNSLYGCKAGDRMFAKPNEYCKPLGDPINVEDFLIKNETRKDAGGFFKDVLNTAERFNFTYGL

SEQ ID NO: 6293 - protein, 558 aa, Caenorhabditis elegans
MSSLIQNPFENFQNVTLDPCNDFYDYVCSNDTRSITELNFTSLFEDREILVNPNISFPNNGTYITLDQILSPYNLTMWYMAVKLMDTPTVGSEHFVETSREYAKKKNNSERFSFAVEKLENINLTNKFKKFFEKRFSKFNCNLAQNLYSTFKKFRRGNSYFNFFKNIGKEIMKLISTNIFYNSLYANIEVLNQLNLPAAEENEFLHHIFDLMKNNTIEEIWSSALSNESKKEFEKELSKSKGFFGLLDYNNVTMLEESKLVYEAEYYRLKSLLSPDDLDTEIAEKIIRLGASDTAIKNLRIPGYQPVFLFSAFASNMANEAFNQNSNIYIGIVTRNDLQQPISTIADTFSVLAHELMHFVYPFGIRLLPSNVTKAANKCTQDEVKMMGDSDAVKPIDGWFSENITHEDLPNLLGLRMVMKMVARKSANEEQLKNALETILSGLCIQGKPKNSILPHHHPFEISINTAVRQYPLFSSLYGCRLGDRMFAEPEKFCNPLGGDVNLEDYKIKNDTEDVGGFFNYIMDTANALEQKIASAKEQKIASAFFCFISFFQQLPSD

SEQ ID NO: 6294 - protein, 561 aa, Caenorhabditis elegans
MTTEGTSTHFIVSSSSRSDHQGHKQGLLWEAGAISAIFLVVDHQEPESHRAAYPWCFAPLDLRNNIFWVPVSFLQIIDGLMFQLPDPSDETFSKCSEFKLIRTGVAELFLSIACDRRSSHSPLSRIEELEVHQPNETFVNNGTYTSLEDLVNISNLTQWCIEMEVLSLGYYNYIADGLNSSEKFKEVMKRLDGLNSTNVNIFYNALHANVEILNQMNIPFSVENQFLHNISETLKIRIIAELESSSISDKAKTHIKKSIETSKQFFAFYDHNDVKVFETAKLTYETEYYRLKSLLSPEDIQRKVSEPILRIGATTASMENLMSKIRRFDVNFLFHAIIASPENDAFQYNGGNHLLTVITRNDLTQQEKTMADTYFITTHEIMHLIYPVANSYINESVWTGALECTLRDVKMLGETDAVKPVDGWYKPEIGYEDLINVMAMRVLMKMAAEKSVNEQQLKEALETVIGGLCKHTGRKNELIPDHHPLEISRNAAVRQYPLFNSLYGCKAGDRMFAKPNEYCKPLGDPINVEDFLIKNETRKDVGGFLKDVLNTAERFNFTYEL

SEQ ID NO: 6295 - protein, 459 aa, Caenorhabditis elegans
MLVWILATTSMIMCAQMTPEASLSLTSQVYSRINPNISFSNNGSYTTLNQILEPDRLMKWYMTVKSLDTAIVDMEYFFETHYEYIKKKNNSEKFSFMVETLKNVNLTLTNIFYNSLYANIEVLNQLNLPASEENKFLHHIFNMLKNNTIEEIWSSSFSDESKKEFDKKNWKIQNDLDTEIAEKILRLGAIDTATKYLAKRIPGYEPEFLFSAFASNTENEAFKHNSAIYSGIVPRNDLQQPMLAVREYSTLILMFMSVMGVNPFCWLTIADTFSVLAHELMHFVYPSGTELLTPNVTKAANKCTQDEVKMMGDSDAVKPIDGWFSKKVTHEDLANIMGLRMVMKMAAKKSVNEEQLKNALETILGGLCIQGKPKNSILPHHHPFEISINTAVRQYPLFSSLYGCRPGDRMFAEAEKFCNPLGGEVNLEDYKIKNDTEDIGGFFNYIMDTANAFNFSIEN

SEQ ID NO: 6296 - protein, 460 aa, Caenorhabditis elegans
MNFLLVLTLIVTISVQSRQDNVSLDPCNDFYDYVCTNDTRIITKLNFTSLFEDREILVNPNISFPNNGTYITLDQILDPDSLMIWYLKIELLNTTTADFDYFFKMHSEYVKKENKSEKFSFVMETLENVNVTLTNIFYNYLHANIEVLNQLNLPAAEENKFLHHIFNLLKNNTIEEIWSSSFSDESKKEFDKKNGTTQNDLDTEIAEKILRLGAIDTATKYLAKRIPGYEPEFLFSAFASNTENEAFKQISAVYAGIVTRSDLQKPMLAIADTVFVLAHELMHFVYPSGKELLTPNVTKSANKCAQDEAKRMGDSDAVKPIDGWFSEKVTHEDLANLLGMRMVMKMVAKKSASEEQLRNALETILSGLCIQGKPKNSILPRHHPFEISINTAVRQYPLFSSLYGCRSGDRMFAEPEKFCNPLGGEVNLEDYKIKNDTEDIGGFFTYIMETANAFNFSFGN

SEQ ID NO: 6297 - protein, 605 aa, Caenorhabditis elegans
MTSFPNSYGHEKQEEAGLEVHQFYPLVEVGCFQHLKFFLCTMYTPICQENYDKPILPCMELCVEARSKCSPIMAKYGFRWPETLSCEALPKMSDQMSTGNICAAPPDTPKKQHKGHHHKNQNQNQNQNHNYSPDGPEVGISKIDNEVIAGPSECQCTCNQPFQFVASEKSKVGNVTNCAYSCHSPALAESHSLVSNWMAFWSITCCVLASFTFLTFLIETDRFQYPERPIFMLAFCQLMVAVGFMIRYFVGHEEIACDSMRIKGADDNSGSLCFVVFLLTYFFGMAASVWWVILSLTWVLSAASKWSPEAISSFSFHFHVVGWCLPAIQTVLVIVFNAIDGDPITGICYVGNTDLQFQRIFVLFPLLVYFIVGVLFLVIGFCNLWSIRNEVQKQHPSLESAHKITQLMSKIGIFSLLYTIPSLLIICVLFYEQNHRSLWEQSQLCSCSPKQTIEFHDKNYSKSLIFPQNFASKIVNFFPHFLFKNSNFQLKFFSEKNLNLLSKSFSENLNFRQIFFLKKCDSSLIISLIKTCCMCILGWTSGFWVCSTKTLSSWKNAICCLGSSRSLPKYQPADILYAKSDMSSSQFYNTSLRHNHLYGGIPDKL

SEQ ID NO: 6298 - protein, 124 aa, Caenorhabditis elegans
MRFKLVGMTSMMIKKIRENLPNNPTVPDILLMERFLIGKFEFVVAKPTPSWLGSCFAKRINLTKFIFSFFMFNKHNFSLFVLTFNNKKQYSRTRSSSPSVPTPPTVEPQRMGTTVTPLQCDACN

SEQ ID NO: 6299 - protein, 448 aa, Caenorhabditis elegans
MPACILTYFPAYCLDFSHTNSDKKEKFSLSFGSHGLYKQALIVLLIGFLCLASLCSNYLIINFTFICMKHDLSDGFTEINGTKYSIYDYTSKDKTWIIWSVAAGTIIGTIPLNMMYVKYGARIPFLIAGLVSCIATALIPLSAQWNFFFLIFLRFVQGFCYSADFAAIGLMTVRWAPLSETALFVAVLTCFNGIASTFTNFATGLICESSLGWKWAYYVHAIVGFVLFGLWLLVYIDHPQETKRVSRKELQKIQKNKSEAHLSKKCDVPYMKLVTSPVILCVWANAFFELTAAIMFSTYIPLYLHEVLKFGVTETGFYASLILGISLPVRFVFALISDKLKFVSEIFKIHTFNTISVGLSGLFFACIGQFSHVVITAIQWMKCLALFVAPALVSIFVHEESNRLQWIWVFLIVGGLMIITNIVAFFILTDKPASWTGSLESEESLEKL

SEQ ID NO: 6300 - protein, 482 aa, Caenorhabditis elegans
MTIQTLFTLHCLYRTFFNLKVAFFLGSAGLTMMLLNNYYRFIVLLVGFLCLASLCSNYLIINFTFICMKHDFSDGFTEINGTRQSIYDYTPDDKKWILWAVAAGTIIGTVPMNLLLVKYGARFPFFLSGIVSCISTSLIPFAAKWNFAFLIILRFIQGFSFSADFAAIGLLAVRWAPLAETAIFVAVLTCFNAIASMITNMATGLICVSSLGWKWSYYLHSIVGAILFVLWYFVYIDHPQDTRRVSGKELQSIQKNKSEAHLSKKCDVPYIKLATSPVILCVWANAFFDLTAAIMFSTYIPLYLHEVLKFGVTETGFYSSLIHGICLPVRLCFGIISDKIQFISEPVKIQIFNTISVGGSGLFFASIGLIPMEYRGWSVFSCIMTMSCIGVNPGGFYKVAVLHSRQFAHVVLTAIQWIKCLALFVAPALVSIFVTNESIRQQWIWVFLIVGGGMVITNILGFFFLTDKPAEWTDTDEPLEKL

SEQ ID NO: 6301 - protein, 494 aa, Caenorhabditis elegans
MFFILVLVLTGISIYLFHLLYWKRRNLPPGPTPLPLFGNTLPTLFDIPGYKTFGKLKEQYGDAYTFWMGKDPYVMICSYDLLKETFIRDADTYKDKDYNPIDEKIRGGIYGILQTNGHVWNTHRRFALTTFRDFGLGKDLMQQKILIEVEDMFRKLDENIGEEQDVPTVLYNAVANVINQIIFGYRFEGVKQEEFTKLKELMEYLETAFATLKIYVEIFVPWIGKLLPGKSLDDVLNYWKDTSYEFFNSQIENHRLKIDFDTEESLDYAEAYLKEQKKQKAQGEFELFCDKQLSNNCLDLWTAGLSTTIITINWTICYIMNTPGVQEKMQEEMDKVVGGGRLVTTADKNDLPYMNAVINEAQRCGNIVPLNLLHCTTKDTVINGYSVKKGTGVVAQISTVMYDEKIFPDPYTFNPDRFIDDNGKLVKIEQLIPFSIGKRQCLGEGLARMELFLFIANFLNRYHISPGSSGLPSLDKSKGITPRKFEPVLSRRHA

SEQ ID NO: 6302 - protein, 526 aa, Caenorhabditis elegans
MILILILSAIVAIFTVNLWRARQKLPKGPTPLPLIGNLHQLIYNAWKNGGIVQGFNEFKKQYGNVFTIWMGPIPSVHIADFDVAHETHVKRANTFGHRFSNGGMDYIREGRGIIASNGEFWQEHRRFALTTLRNFGLGRNIMEDKIMEEYRYRFKDFKNTHFKNGGIQVNASSCFDLLVGSIINQLLVSERFEQDNKEFERLKTSLAKGLEKVSIFEAFMPVWVLKSKLMRWRTKTTFEPFDFIFGLVERGIQKRVSAIKNGTHIPSEEGEDFVDAFLIKMEKDKNEGIQSTFDLETLAVDLYDLWLAGQETTSTTLTWACACLLNYPEVVKEIRKELTEVTGGTRSLSLTDRPKTPYLGATINVGVSHYFEISEIQRIASILNVNIFRLMEEDSIIEGQPISAGAVLTTQLAMLHTDEKTFKNHTEFRPERFLENNNLEKRLIPFGIGKRSCLGESLARAELYLASEMCVFDTLNEFFSFQITGNMILDFDFESVGAAPRIQTPTPFALMKRPPSYDIRFIPRSK

SEQ ID NO: 6303 - protein, 408 aa, Caenorhabditis elegans
MVSSDVPKTQRALIFESYGGPLEIKQLPIPQPNEDELLVKMEYSGICHSDVHTWLGDFHYVSKCPMIGGHEGAGSVISVGSKVKNWQIGDKVGIKVSQTLNSSSLNFNIFQLVQGNCLNCEYCQTGHEPLCPHVWNIGVQKYGTFQEYATIRDVDAIKIPKSMNMAAAAPVLCGGVTAYKALKESEVKSGQIVAVTGAGGGLGSFAIQYARAMGMRVVAIDHPSKEAHCKSLGAEWFVDAFGTEDIVAHIREITDGGAHGVVNFAAAKVPMEKALEYVRKRGTVVFVGLAKDSKILVDTIPLIFNAVKIKGSIVGSRLDVNEAMDFVARGAVNVPLELVKLEDVAEVYTKMHDGKINSRQLLSVFLNPIIFLSNVVKQETFLGDFVNFCKFFTLFVSSSLFPEKSNSH

SEQ ID NO: 6304 - protein, 730 aa, Caenorhabditis elegans
MKTTTYNTDWAAEKTKIRSFFDEYYVDNEDGSGKAFPYRDQVFEIARRDKQAIVVNVDHIKESDIPDALELSEAITSNTKRYEVLFKDTISDMIQDYLGDKQAPVIDALDAYMFQRLHMDRNEGAANEEVSLQDKRKKYPPQLLQRFEVYFTTDDAAHETCVRNIKATEIGHLVSMKGVVIRATEVKPCVEVMTYTCDTCAAEVYQPVKGMQFTPPVNCPNKECVEAKANGRLHMQLRGSKFVKFQELKIQELSEQVPVGSIPRTMTVHVYGEMTRKCNTGNVVHVSGVFLPIMQSGFRPTGGLVADTYLEAHYINNLDDNPTFNGVQSAELEVLRRKGDNYETLAASIAPEIFGHVDVKKCLLMALVGGNDNSSNGMKIRGCINVLMMGDPGVAKSQLLGYVNRLAPRSQYTTGRGSSGVGLTAAVMKDPVTGEMSLEGGALVLADGGICCIDEFDKMMDHDRTAIHEVMEQQTISIAKAGIMTTLNARTAIIAAANPAYGRYNPNRSIEQNVDLPAALLSRFDLILLMQDKADRENDKILAEHITYVHQHGCHPNREKKDLISLETLREYISLCKTYTPTVDPALRERIVEAYVEMRRDARYSSDPTFVSPRMILGIVRMATARAKLRLSTIVDESDVEEALRLMQFAKDSLRPEQNKIEKRMAPVDAAFAVLRELYHADNAPIAISNAIQRCARKGISEVALKKCLDQYTANGLLVMDRQNIVFAMN

SEQ ID NO: 6305 - protein, 496 aa, Caenorhabditis elegans
MTVDSIPLNTGAQLPLFGLGTWQVKDEAELTMSQKNNWKIKTDLKNVIFGQKRKTQKKSDTAHLYQNEHIIGKVLHEYISSGKLKREDIFVTSKLPFTAHAPEDVPKCVESQLKALQLEYIDLYLIHCPFPFKHQEGSFAPLMENGELAVTEIAHIDTWRALEKLYKEGKLKQNVEKLVANILLTIHALGVSNFSCNQLQALYDAAEVKPANQQVECHIYWPQQELRALCKKLGVTVTAYAPLGSPGRKAARPDGVWPEGDPLLEPIVKQLAAKYHKTAAQILIRHLTQHGISTIPKSVSPDRIVENISTFDFKLSDEDMHTLNSIETRTRLFIADLIFSRQWAGKSSVVQTKSALQLAISSIAGFEKFRQSAIPAIAEIAEIVDCRTFSAIFKPNYISEIEKIANWFLVFTLSSIHSSHTTTLTPPKFQKLGSDFTRLLAQLFQFFSIIIFKPTAILGIFQKFMILEILRFTKNLTENFEKSDFFVVFQILYLIM

SEQ ID NO: 6306 - protein, 437 aa, Caenorhabditis elegans
MSSLSIPRQSLYYVNKVTEGRSVSNVQVVSPCQKQGQTYVTAFTPLTSNVQVHTSLEQLSTIRNADVLIFNNALSQIITNADLLTDFLKNATNATAIGGTVIIREDLKDCSDKRQVARLTDYFDVFRTTDSDGNNTGLDLYTVDQVEHSNYVEQNFLDFIFVFRKKVFAPTTDATITFRDFLDKTQYTNTGIDAYEWMFGVNFISPGGYDENLKIIKRFGDFKPGQTMLDIGVGIGGGARQVADEFGVHVHGIDLSSNMLAIALERLHEEKDSRVKYSITDALVYQFEDNSFDYVFSRDCIQHIPDTEKLFSRIYKALKPGGKVLITMYGKGYGEQSDKFKTYVAQRAYFLKNLKEIADIANKTGFVNVQTENMTPRFKEILLEERGHLEQNEAEFMSKFTQRERDSLISGWTDKLGYIEKDNHNWNFFLAQKPFPK

SEQ ID NO: 6307 - protein, 720 aa, Caenorhabditis elegans
MVCREEFFKFYFRILFSKNEAKRIRKLLWNEEVELKIVVDQSGASINTLSIHPVTCWSLGILDSQLVKTSFTITTDHGKSSNIERVMKVQTSTSVKIGSLRISRCDVFNLFGPDLVKNVAVDNITPNFKFHETPIPISEDAKLSLMRQPSVAKNIRLEKHHLKQILKSANVFYKNDVIRITNYNAYTDKTTHLFYKLDVSSSPCIMDSSTAVYETSAVSQSLPFSNFLLKNSLTSSMRTTVFRMTQIYSAQKTISKKALVLLVTGASGSGKRLMSRVFASETHRNFFEVDGYEMVCENASTSEAKWTSWWEKAKLLQNCVLFIRNSNVLAIDQFNALDRRILQYMEQKLSEPSKITVIFSCNTDTMSSMPANVKNLALYTFSAEFMDENDRKTWLQYYLNEKLANHVAKKTSGFTLAELEKLVKNGKKVKIEEKEEKVYEDLIDKRNSNFADAIGAPKIPNVRWEDVGGLEETKQTVLESIRTNLFGSRALKRSGIILYGSPGCGKTLIAKAVATEFKIAFLSVKGPELLNKYVGQSEENLRKVFERAKQASPCVIFFDEIDSLAPNRGRNGDSGGVIDRIVSQLLAELDKLHNSPLTKVFVMGATNRPDLLDNSLMTPGRFDKLVEVKPGEDVESKTKILEAVSRKMRFEEDVDLREIASKVDEKMSGAQLFSIISNAGMAAIVETIQSIEDGKTENQSIRVAQRHLLESVKRFHETKY

SEQ ID NO: 6308 - protein, 457 aa, Caenorhabditis elegans
MGSVTSKTNDELESFLNKRLGGSMTSSNKTVSVLLGAQWGDEGKGKIIDYLIENHKINVTARCQGGNNAGHTVVANGRKYDFHILPSGIISPTCFNVIGNGVVVNLDAFFSELAHNGILEESGWEKRIMISSEAHLVFGVHSQVDGRQEDSLAAKNKIGTTNRGIGPTYSSKCFRNGIRVADLMADFEEFSEKYRRLVEHYKKQFPSIEVNVDEELAKFKQHREKLAELKLVGDTVGFIHEQRNAGKQVLVEGANGALLDIDFGTYPYVTSSNSTVGGACTGIGVPPTAVGNVIGVVKAYQTRVGTGPFPTELFDSDGEKLQTIGKEVGVTTGRKRRCGWIDLFLLRRSAMINGYTAIALTKLDILDTFPTIKVAVGYKLNGQVLSSPPAQANAWGAIEVEYKEFEGWNEPTVGVRKFEDLPEKCRQYVKFIEDFIKVPIVYIGVGAERESLIVRQQ

SEQ ID NO: 6309 - protein, 657 aa, Caenorhabditis elegans
MLSARSFLSSARTIARSSLMSARSLSDKPKGHVIGIDLGTTNSCVSIMEGKTPKVIENAEGVRTTPSTVAFTADGERLVGAPAKRQAVTNSANTLFATKRLIGRRYEDPEVQKDLKVVPYKIVKASNGDAWVEAQGKVYSPSQVGAFVLMKMKETAESYLGTTVNNAVVTVPAYFNDSQRQATKDAGQISGLNVLRVINEPTAAALAYGLDKDAGDKIIAVYDLGGGTFDVSILEIQKGVFEVKSTNGDTFLGGEDFDHALVHHLVGEFKKEQGVDLTKDPQAMQRLREAAEKAKCELSSTTQTDINLPYITMDQSGPKHLNLKLTRAKFEQIVGDLIKRTIEPCRKALHDAEVKSSQIADVLLVGGMSRMPKVQATVQEIFGKVPSKAVNPDEAVAMGAAIQGAVLAGDVTDVLLLDVTPLSLGIETLGGIMTKLITRNTTIPTKKSQVFSTAADGQTQVQIKVFQGEREMATSNKLLGQFSLVGIPPAPRGVPQVEVTFDIDANGIVNVSARDRGTGKEQQIVIQSSGGLSKDQIENMIKEAEKNAAEDAKRKELVEVINQAEGIIHDTEAKMTEFADQLPKDECEALRTKIADTKKILDNKDNETPEAIKEACNTLQQQSLKLFEAAYKNMAAKNSGGDAQEAKTAEEPKKEQN

SEQ ID NO: 6310 - protein, 351 aa, Caenorhabditis elegans
MIFQMYESQYEDLRGTIYGPSSPDFHPVQASETLRSSLHGLETKDQTIINTVLYHNNFQRQKILGAYEDMYSRKLLEDLEEECGGFFFEMCQALFKPAPNYDAQCVYKSLSNRHGDRSVAIEIACTRSPRQMRALRDTYQIDYRKSLDKDLTVKVEGVVGKMMHLLLCNNREEGLGVRVNDELVDKHVKILMTTTIDDIAKNVNLFEELFIGHSWKHIGTVLDKVDEARKDVQDIESIIRRNKNIHSEIRLILLTIARVSRNIQIYFAEKLRTAMTAERVDQSTIIRICVSRSEIDLQDISLEYKRKYQRPLEHDICQSTSGEYTRMICTLLSGFNNLENSFAPTPESIEE

SEQ ID NO: 6311 - protein, 1050 aa, Caenorhabditis elegans
MTLLFGVKRWLRRGDEASDSKADASKEVNQQNLSLSFNEHHLDMRQLSEKFSMSKLDIVDPKVSRGLSKQVAAERLESDGRNALSPPKVISNWKLFLRQFKNLLWILMFGAAALSLVAYIYDPSDLTNLCVGIFIIVIIFVMCIVSFFEEKKGVEVVRAFQSLMPLSCQVIRDGVEQTLNPEELVVGDIVVVRSGCKVPADIRVIACTDFYLETSSITGEAEPLEFNSAMADQKTSIFESYNIAFNGSFCVDGEGYGIVIRTGERTVIGQIASMTLDQKEQKCKFQVEIGRFVKFITVMAIIMAVIIFSVGLGINKGHDVIRYFVTGFLMVIIANVPQGLPTTVTTELTIIARRMAKKNVFLKKLEKIDSVGATTLIASDKTGTLTKNCMTVTDLWYNNSYNSGRPENRRRSTKTRFSITSNPAQSFDAPLSDLLSVVCVCNKARIENTVTVNRPPPNVDSELDMSMYRIQPVKEMTIVGNPSEVALLRYASAMLDAKELRESFQVVFEIPFNSVRKYHLILATNKNTWNQVDKNDDVEFVVMIKGAPEVLIKNCSTMNINGESKELDLKRMEDFNEAYEAFGDEGCRVIGFAQKKFRARASTVFSLKSNTVPMEDWDFLGMSAIMDPPRDDTPKAIKACKAAGIKVYMVTGDHKSTATAIARQIGMIDTEEVSRVDHNQQIIRRSNSQDWAVITGSELPALTQKQWDELLQHRYIVFARTTPEHKLMIVTESQKRGECVTVTGDGVNDAPALKKADVGVAMGLAGSDVAKQAADIILLDDNFSSIVAGIEEGRLLFDNLRKTIAYTMAHMWPELVPVILNFFFGFPLGLTPVQILSIDLISDIPPAVSLAYEGPEADIMLQPPRKKDTHLVTKGLITYTYLFMSIFISIGCVCAYLLSYYINGIGPWELAFTASTYFKHGAANFTTAKGVILNEEQQMYMANQAAAAFHISLVLGQAFHLWMCLTRRVSIFAHGLGNIVAIFAVIIDLLLICIFTFVPGVKYIFGSQPPPWQCWLVPIVVGVWIWIFNELRKLGIRKYPKNKFVRLTKW

SEQ ID NO: 6312 - protein, 748 aa, Caenorhabditis elegans
MPPVNSKHEWPYPEVKRFPGGLERFSYRTYNWFENRLWPIRPIPFLAATTAVTALQVRSLGLEHIKEDAQKLLKPLAISIGSVYTSIFILRHILKYFYFSYKGYLFENPKKPSIRTMIWGVLRKVLLTIAPPQLSSCDRLLPNLPLPALQDTVDRYVDSMKHLMSEEDYDQLLEMSRKFVSNEGRSIQRYAWFLHKFTDNYVTSLWEQYIYMAGRYPLLINSSVAQCTMYGESDLIQAYQVARLIYIETIANLALDRQKYMAIGEGLMSTRHYRNIYNGCRIPGKQYDSFQWNKPAKHVILVHDCTWYKVDICDSNGQLYTVDQLAKIVAEVMGRDDKSKGYLRNIASLTTDRRTEWCSNRQKFFLENKHNQKLLQQIETAQFVMSVDGDLNWGVETTEQLSKYMKDMLAGSGSNRWVDKTMNYAVDASGRAGATGEHSPCDGAELDHLCENVLNVDKQVLVSPSTEEQLEIIKMTFTEKNSLRLAQKLDFQEVDGMETEVNRCFEQHHKASDDLHMHSIAFTDFGKGRVKKCGISPDGFLQMAIQLANYYDQGKFVLTYEPGSVRFYANSRTETLRPVTDYSCKFVQAMLSDESTQKERRDLLKKACEAHVENCKEVMTGKGVDRHLFVLCVLAKGLGYSSPFLEEYANQKWLLSTSNIPNMTNSVDEDISEDNIMLGASFGAVAQDGYGICYRFAGNRAIMVHITSYHSSPATDSDRFGQHLREAIHTLADLFDDEPSNNNVSKNV

SEQ ID NO: 6313 - protein, 234 aa, Caenorhabditis elegans
MISVTTISAIMLLFSLCGFTINWAIVIIMIKVTKLQKPFAILTVGLAIADGTFSALYLFYATPMVFFESDILSNYSSVCGYVLMICYSASTTFHFMISLNRILAVYKPMLYRMMFSVLFTFCIVMGIYSYALTIITLFFQICSTILDFLAIGKVLKISSKTEKHSKELSLLKQSISQTLFVLAIVCSFTWGPRFIPDIDYTFIFSSILWSSVHMFDGNPKELFQKRPATGIQRC

SEQ ID NO: 6314 - protein, 166 aa, Caenorhabditis elegans
MKVFIVLAALIGCYVYAQDAQILPVGGQVGGGQRLPCRGRNEEYKTCGTACEPSCTNPNPMCTKQCINNVCQCRSGYVRNEITRQCVRQAQCSRPGTGFGSSTPFPSQSPQRCGRNETFRTCGSSCEPSCTTPRPQACTMQCIVNVCQCSEGFVRGPSGCVRQRDC

SEQ ID NO: 6315 - protein, 578 aa, Caenorhabditis elegans
MSLSFYWGIGCLLLSIVEGGFLVNLTPEKNSQILNAPCGPIRGNIYKHKNGTKIVDGYLGIPFAKAPVGALKFKKPVAAEKWTEPRDCYEYGPGCPQTGRFAALTAKSTAAFAEENCLTLNVFAPRWKLAEFPKGLPVLVYIYGGGYEIGFTSYMDDYSLTGTLPLKDVIVVTMNYRLGPLGFLTIADGIANGNYGLWDQTLALQWVQDNIASFGGNPESVTLSGTSAGATSTDFLSLSPHSNQLFQRSISMSGTAFCNFAIRPKDVEVGVCKEFAQFQGYTGTDSQSLFDWYMAQNVSKFKEVAGFQSTAAGAVPFIPNFDGDFFPKPFDILRREAPKKDALITVVTMESVGMIIFNPLFANAYNNFEGFINETYGPDVTDYYADVKKKLTGFYLKDVNASDKATVNRRVVDYVSDSVFNSGTLDAVKSYVKYGNKVYLGSFNYFNDATKDMVELMQPFKEASHSSDFKYYFGSGVMANFTPTDEEMEVMDMSGTLMANFVKYGDPNGKSGTKPWKPYTILKPNMYYKIDYPTCEMSDNFQNGRLRIYDDINKNSKKYQQIVYGKVSKRVVINARAG

SEQ ID NO: 6316 - protein, 453 aa, Caenorhabditis elegans
MGGFLSHLKPEQNSKILNSTCGPIRRNIYEHGEKIVDGYLGIPFAKAPIGELRFKKPVEAEKWTEPLDCYKYGPGCPQSGYLGATLVPKGYVELNEDNCLTLNVFAPRWKVTELPKGLPVMVYFYGGGFEIGFSSLYNDYSLTGSLPLKDVILVTSNYRVGPLGFFTTGDDVARGNYGSWDQTMTLQWVQKHIKSFGGDPDNVTIFGTSAGGASVDLLSLSPHSNKYFHRFIPMSATAYCPISIRSKDVEALVFRELKKTSINNSDSKSLLQWYQSQDSEKFLDVANFNRPASGFMSFVPNFDGDFFPKPFDELRKEAPKFDAIVSVTEYEGLGFLSLFPNQETPEQILAAAFGKDILVGDYYFNTGALATAKSLTKHGSNVYLTSFNYYNPENQTPTAENLPFKAASHGSDLRYILGDDPGKFLDEELKIMDMMCTFLSNFEIILRSKSLVL

SEQ ID NO: 6317 - protein, 435 aa, Caenorhabditis elegans
MPNGFPVMVYFYGGGFEVGFSSMFDDYSLTGTLPLKDVILVTPNYRIGPLGFFATGDDVSRGNWGLWDQALALQWVQKHIKSFGGDPSNVTISGTSAGGASVDFLSLSPHANKYFHKFIPMSGAATCPFGIRSKDVEGLIFREFAKHHGYAGNDSESLLHWYQSQDAEIFLKAEGFKCPASGMFSFVPNFDGDFFPKPFDELRKEAPKLGAIVSIGEYEGLGFEDFYAGQKTPQQMLSAALGPDVVKNREEVVKKAEESYLKNAGNGNEKNVAKTLVEIYGDYYFSVGAFDTVRSLVKYGNTVYLYSFNYFNPNTPIVFGKNRPFNAGNHGSDLRYIFGEGTGEFSKEDRQVMDMMGTYQTNFAKYGNPNGKGVSVPWEKYSLDNPGRYFKIDYPKCDMADNFLDGRYKIIDEVNEHGIQYQEMVLERFYNTDMM

SEQ ID NO: 6318 - protein, 545 aa, Caenorhabditis elegans
MGGFLSHLKPEHNTEVLNASCGPIRGNIYEHDDKIVDGYLGIPFAKAPIGELRFKKSVEAEKWTEPLDCYKYGPGCPQSGALGAMIVPQASAIREFAEDNCLTLNVFAPKWKSAEFPNGLPVIVYFYGGGFEVGFSSMFDDYSLTGTLPLKDVILVTPNYRIGPLGFFATGDDVSRGNWGLWDQALALQWVQKHIKSFGGDPSNVTISGTSAGGASVDFLSLSPHANKYFHKFIPMSGAATCPFGIRSKDVEGLIFREFAKHHGYAGNDSESLLHWYQSQDAEIFLKAEGFKYPASGMFSFVPNYDGDFFPKPFDELRKEAPKLDAIVSVAEYEGLGFEEFYPGQKSPQEVLTAALGPEVVRNREEVVKKAVEAYLENIEDKSGEKIGKKLVEIFGDYYFSVGVFDTVRSLAKYGNNVYLSSFNYFNPETPIMFGENRPFNAASHGCDIRYILGDGIGEFSKEDRKVMDMMGTYLTNFAKYGNPNGKGVSIPWEKYSLDNPGRYFKIDYPKCEMADNFLDGRYKIIDEVNEHGIQYQEMVFGKIL

SEQ ID NO: 6319 - protein, 890 aa, Caenorhabditis elegans
MFLGISIVADRFMSSIEVITSMERTIVVKRPGLDPMAVQVRIWNDTVSNLTLMALGSSAPEILLSIIEVIARGFEAGDLGPNTIVGSAAFNLFMIIAICVVVIPKGEIRRQKHLDVFCVTATWSVFAYVWLYLILAFFSPGEIEIWEGALTFIFFPLTVFTAYMADIKLIQNKFLPHRYRRGSHGQMIATEAEEMKMLENGTQGDPALKAFEEHRQEFIELMREIRKQNPHITPTELQKQAEYEMISRGPKSRAFYRVQATRRLIGGGDIVKKRIDKEHNKALDALVQAQEKQSRDNTCKIFLDPAHYTVLESVGSFDVVVGRDGGPDGLTVMVDYFTEDGSANAGSDYIPVKGTLTFYPEDKHQKVTIEVVDDDVFEEDEHFYLRLCNLRVRTKDGIIIDPTRIGGLPVAQLEMPNTATIMILDDDHAGVFGFEHDHFQVVENCGHLSLQMKRHSGARGKVIIPFRTVEGTASADKHFEMKEGEIVFEDNQTEALVEIGIVDTEQYERSDYFYIELSPPIWAKKMNDLSRIQERFQRRMERKRGSSVASESKDSNTENALAPAEKSTRAASVDLLQPSSDPRRSSQTNSPHLTSRFRNRLGSWIAGMKGGNGDDEVTTSLTPSQLEIAEMGKPRLGEFTKCQITIRESKEFQGIVDRMIKNANTRIMLGTHSWREQFMEALVVSAGDDDDDEGEDGEDGEEKEPEEPGCMDYVMHVLTVPWKLTFATIPPTDYFGGWATFVVAIFMIGVLTAVVGDLASQFGCWVGLKDAVTAISFVALGTSVPDTFASKVSAVQDKYADNAVGNVTGSNAVNVFLGIGIAWSMAAIYHWNQGTKFLVDPGNLGFSVLIFCTEAVLCIIVLVLRRNKKVGGELGGPIALRLTIFVEHNR

SEQ ID NO: 6320 - protein, 545 aa, Caenorhabditis elegans
MVEAPSFRMICVAVITSIAGSFHFGFNLVLTNPSQEAFLNFMNQTLAKRFDGGLSDNTLQNIWSFVVAILFLGALAGSFSIRLIADWIGRKNGLYISIAVGVLAGGMSIASKFIPLFELYIASRIVMGWSVSVSLGLSALFLSEASPKQNRGAIGMMTGTCVQLGTVCGSVIAMPQIFGTEDLWWLIYATEIGIMLFFGAALPFFPESPGFLIQRGATEAATKSIAYYYNCEIDEAEKHLNEIKEEQKNSTKNFKMMDIVRKKSLRDKAFIGVVVTFAMSFSGVAVINAFAFDILKDTGLKVLEASLANDAISVVSMISSIVAAVIVDRNGRRPLLLISFAGILVCNLIIFALMFTFYKFEWCFYVAKIFLIFLGLKIAITLHKKLVSIFQNHVLGFILICFICIFTFFFALGPGPLCYFINAELVGQAARSAAQSWASVIQMLSRFVIVTAFLPMKNQLGEAWSYLILFVAPVAASLVYLYFSLPETKNKNPFEVEEAIEDLPKFPLCGKNRVYDRKQSQEMVLSRQMQLVVDYGSIESLSYRL

SEQ ID NO: 6321 - protein, 492 aa, Caenorhabditis elegans
MSVFIVALSVFIISYVISFYWKVRKYPKGPFPLPFFGNLLQFPADNIQEHLDKLSKTYGPCFTVWTPLPAVVLTDYEHIKEAFVTQGDAFVNRAQRLPEILFQPHPNTGVVFSSGDNWKIQRRTALKILRDFGLGRNLMEEQVMRSVHEMLAQLEHISDKKNVDMYWPIQLCVGNVINESLFGYHYKYEDAGRFEKFVKVVDRHLKIAQGNASLLVSAFPWLRHLPVIGNLGYHSIKNNIKSYQQFIEEEVTSQLKNYDGESEPENFVHAYMQQMKQTGNPNLDMTNLCASVLDFWLAGMETASNSLRWHLAFMMKYPEVQDKVRNEIFENIGTARLPSMSDKQNMPYTQAVIHEVQRCSNMVPILATHMNTEDVLVKEHNIPTGTLLFAQIWSVLKNDPVFEENSKFNPDRYLMPDGKTLNKTVLERTIPFSVGKRNCVGEGLARMELFLIFSALIQKYEFIPKTNVDLKPVYGGVITVKPYLCELVPQNA

SEQ ID NO: 6322 - protein, 718 aa, Caenorhabditis elegans
MELDVESTSITQLRSHCETCFPLMEEVVPRRERYVDLLEFSNFNGIPYPVVDPSRKPRRFLADFRYSWSIPLIHHYPNVEKDVLSSKRVHRVISKLKEQNDEQKNRAVQFFTEISARLSKFICKCCSYVLYKVFRRLMDKLLVCKEEMEVLYEAEQTGIPMVYLPLHRSHLDYLLITWCNWHFGLKLPHIASGDNLNLSGLGWLLRATGAFFIRRRVDPDDERGKDQLYRAILHSYIEQVLSKDMPIEFFLEGTRSRFGKALTPKNGLISNVVEAVQHGFIKDCYLVPVSYTYDAVVEGIFLHELMGIPKVRESVLGVFRGIFSGFSKSKQCGVVRMHYGRPIRLTEYLATITASLSSNHRTRPVRMTKLSTSFSYRELVPWHRTHSETVDDRTMIRAIGFHVVYEAQMMCSISPVAVVSCLLLAKWRGKVSRSTFERDCEWLCEKIIAEGGDVVGYQSKKTKGSALVKYAFEKLESCVEVTDEYVSPKESHSSFITLAYNKNSVICRFSIKSVIALTIVSRPSGTKLSIDQIVEDALSLCDWLQFEFMFCRPCDSLRELVHNVLGQKEWSDPIHGFLRSEIEDDGFLDAGGALNSGTLRVRDAKSRETLQFFANLVRPFVQSLYLISSFVVSEKCPTEPTSDNNIIRQLCQQSLAGDIDLPFAPLLESINSDSFKNALRVLKDKGLLQRSTPNSTARSGNSRLAELISNLERVLEVK

SEQ ID NO: 6323 - protein, 347 aa, Caenorhabditis elegans
MSLRSLLNILLIVAFWIVGGNCDASSDTEIIKKLLGKGYDWRVRPPGINLTIPGTHGAVIVYVNMLIRSISKIDDVNMEYSVQLTFREEWVDGRLAYGFPGDSTPDFLILTAGQQIWMPDSFFQNEKQAHKHDIDKPNVLIRIHRDGRILYSVRISMVLSCPMHLQYYPMDVQTCLIDLASYAYTENDIEYRWKKTDPVQLKKGLHSSLPSFELNNVSSFKIRKRLSYASGINAKLPPVSYTKAIDVWIGACLTFIFGALLEFAWVTYISSRSFYKRNKNCSSRNSLLIETKQALIIPNTVVAQFPEHPEESYFLLSSYVSTLSTGPSIHNITHRKPNEIVQLISKF

SEQ ID NO: 6324 - protein, 340 aa, Caenorhabditis elegans
MLFFICLIPGVTKTVKRRVQQMSIQVIREGRGLVVEAPTGIGKTYAFLIPAIEAALENRQSNCFESTKPSPSILIMASTSALVDQLFNRCELILGLQCMDNVEPIRDIKIDKLVANHPFTKGQCDIAFCTIGKLKATIECGDVCLDNLKTIILDEADKMIDNCAFVPDINWILDQLKEENLENLQSCFFSATYNKNANGTIALTVLQMRMLGEDDPCKDGPYNETIAIFCETVQRVTQVTMTLRQLGYNFKPVCSMITKNQQLVTVNDLEFRKIHGVVCTNILARGIDVSSVKHTIIMEMSADFDTYKHRIGRVSISGFLFGFNIGSRPSCAEHEKTSEC

SEQ ID NO: 6325 - protein, 439 aa, Caenorhabditis elegans
MFGGGSSGPVDTTLYTTLNVRPDASQADIKKSYFKLAKEYHPDKNPDHGDKFKEISFAYEVLSSPEKRRLYDARGLEGVQGGGAGGGGGGFPGGLFSHFFGGAGGDDDDDDDDMGGHPFGGLFGGMGGMGRGGPRRRKFQDTVHPLNVTLEELYVGKTSKLKLSKKALCKTCEGSGGKKGEKYKCDACRGRGVKTIVQQIGPGMLQQMQVHCDACKGSGGKVPAGDKCKGCHGEKYENVSKILEVHVLPGMKHNDKITFKGDGDQSDPDGEPGDVVIVIQQKDHDIFKRDGDDLHMTKKLSLNEALCGYNFLIKHLDGHPLVLSSKQGDVIKPGVIRGVLGKGMPNKKYPELKGNLFVEFEVEFPKEHFLDDEKAYAVLKSCFPTSKVVNVTPAAAEVSLMEYDEKKYSRGRGGDAYNEDSDEEQHGGHHGQGVRCQHQ

SEQ ID NO: 6326 - protein, 374 aa, Caenorhabditis elegans
MGQAKLRLTRYWMLARFATSVGFIENFLCSTKSQIRWFFIDLTRVCSISRFSAFFIQFSLINVRCLFTKFSFCFHLLVGVVRCNMFGGGSSGPVDTTLYTTLNVRPDASQADIKKSYFKLAKEYHPDKNPDHGDKFKEISFAYEVLSSPEKRRLYDARGLEGVQGGGAGGGGGGFPGGLFSHFFGGAGGDDDDDDDDMGGHPFGGLFGGMGGMGRGGPRRRKFQDTVHPLNVTLEELYVGKTSKLKLSKKALCKTCEGSGGKKGEKYKCDACRGRGVKTIVQQIGPGMLQQMQVHCDACKGSGGKVPAGDKCKGCHGEKYENVSKILEVHVLPGMKHNDKITFKGDGDQSDPDGEPGDVVIVIQQKDPSLICSE

SEQ ID NO: 6327 - protein, 527 aa, Caenorhabditis elegans
MSVSVRIVLIVIIGCGITVQKESEKGDSSIKPSIAIVGAGISGLSTARRLIELGIDDFDIYEGLDRIGGRIHAIPYKDGFLQMGAQFINGAQNPLYKIANRLGLLADVVSDTAHVDNAHFAFGNQNVQEKDIKTFLDFTSKLDPKYRSIAKHDEKTARRYTFKEIFTLDYMHFLKSQNFTDQQTNVFDSLARSFRSYWEFEWAADWSTLSVHVLKEWNDYGPECESFATNKIGFKAILDDIAAPIPRKAFNFNSRVENINLDSNTGKIKLTVSDRAVPTEYDYIIVTSSLGVLKKYHHKMFTPPLPRQKIEAIEKIGFGGSCKVFFEWETPFWSNNTYSIAPLPVKGMIRDKLDAFEDETTILQVVDWAPNVLSAWYAGRGHQLVDNMSEEELKQRITKLMRDMYNDKSIPEPSKIIRTQLTKNELLLGSYSYMTQVQALSHISHSQLAIPVKLEGRPKVLFAGEATHHRLFQTTIGGYLSGRREADRAVNDWFGRWNQTTKLEVVDETLINDQRNIPIISQPITSI

SEQ ID NO: 6328 - protein, 1091 aa, Caenorhabditis elegans
MWLSKQQPHDVNALLAEKQELRKQLDREQNEKQELFMQINSMIAKLADSGDQDEINRLKSDVNSLKRELEAEKIASNAEAARLKSELQKAKNEIQDSIKDGDSEKDAMEQEIENLQRQLNIKTASLQSLMLAKSDSSKTDKLSEENETLKLKVEDLQKQVSSFMSQMQDKNSEIQKMKDAISVNDVSRQNMDSLSEKLSEMDRTLREEQQQKSQLRSQTETLKNALSTSESTLSMLKDKLAQFEQNALDLKNENAQMKTSTRESILFESGRIKELQQALSDEKDNNAILNVQLREKDGKIDRIQVDLLAAESRAQQAEEDVRDMKERIITSKKDDDSNNLLQDELRRTEEKYQQAQKKIENLDETIKQQETQIRDLGRSLDEAKRQLQKMSEQRQNEEVARQGEDSARSMEEKATKEEIKKLKSQVQLQQQLEQDLELQKKRVQELTEQRKVLESKASVADEFGTLMSSLNSLREENRQYEEETRSLQTNIRTLQDEVYQHQDAITEWKNRAEKAEEYIEKENHRVQNASSSHDADITRLENEKTQMEEALEKADQEKDQAIREASESVRVMKREMTEASITSDRQIQSLKEKVDSLTRELESSRRRMEQLQEDQTKFLGSHDETKAEMMKDLHEAQDEIEKLTNQAGQLKSKNETLTTELEDSQNLCERLKAQYEKADKKYEETKVQLREAEDLADRLQAAQILSGNVESKFSDMQKESKIEMERILDNHNKELEKLREELKKSHTEHTSLESVLEEQQNELAQLQDQLREEKEQSSNLLVLNQKIEKSEKEKERLEEQIRSHTSQNSDTSKTISDLEDKISELLKTNDLLALDVQKLSKSLDSKDQQLKEAEDEKNLMLEEVQALQNATPSDSAEIAELTTENARLAGELLKSHSAAERSLQMEKEKISKQFEERLKTANLEKTRLASELQMADSRKNTLEKQVDELQSQVETAERNRRRDLHQLDMVREELHQVKNDNEKLKSSTPIAPPRSNTRTISNMSAMTNWTQADFSECEDLTRLRTEIDKQKRLIIVLRRKLQGLQQDFFFHYNYCDSFRCFFYITYQFLYHSQSALPKIHINAHFVVPMVL

SEQ ID NO: 6329 - protein, 260 aa, Caenorhabditis elegans
MFRNQYDGDVTVWSPQGRLHQVEYAVEAMKQGSATVGIKSETHAVIVALKRAQNDLSSHQKKVYEIDTHAGVSIAGLLSDGRILARYLQTECSSWRWDYKQAVPIKKLAESMQLKLQANTQYYGRRPFGVGILIAGYDKDGAHIIQTDPSAEVVSMHGTSIGARSQSARTYLERNVDNFEKSTPEQLIVHALLALRDTLPAEENLNAQNTSIGIVGKDSPFSLLEDAQVAVHLNQVSTHPRTTGGAAAAAAPGGAEPMQM

SEQ ID NO: 6330 - protein, 263 aa, Caenorhabditis elegans
MKIAQSKLFQGKNRLSSKLFKNSYLNCRRNEANGMQPRSIEVGGRHFSDIKCAFSKLIFLFLSTILISKMFAPSRKPAATANQLRASSRISNLEGNRTLDENARRNRRNRQLDGLEQDNSHDDPHANLVWNKNAPKFDDEMIGGPSAKKAKKVKEDKSGIVHGEKARRRKLARPEFNKQRFKKSFNAHVIEQSKAILDSAEPDYRRVNAYQLSSAPPSEKPARKFCAVCGIISKYCCTRCGAKYCSLPCRDVHNDTRCMKWLA

SEQ ID NO: 6331 - protein, 528 aa, Caenorhabditis elegans
MSYPWSNKNGEAASSSKTTVAPPLSPPRYEKVLDFSTLDTQRHRYEVRDQANQRAVVSSAKAESSMIDKFCKENTRIQTNPGIDLPDDYGTDAIVANAIGDQRIVNNLKCVHVTTFNAVQQMSIQVIREGRGLVVEAPTGIGKTYAFLIPAIEAALKNRQSNCFEYTKPSPSILIMASTSALVDQLFNRCELILGLQCMDNVEPIRDIKIDKLVANHPFTKGQCDIAFCTIGKLKATIECGDVCLDNLKTIILDEADKMIDNCAFGPDINWILDQLKEENLENLQSCFFSATYNKNANGTIALTVLQMRMLGEDDPWSVIICPRMSGYITQRVVRVGRGRPNDIRSHPWVIKMGIIRKLIDDDLKETGCSKDGPYNETIAIFCETVQRVTQVTMALRQLGYNFKPVCSMITKNQQLVTVNDLEFRKIHGVVCTNILARGIDVSSVKHTIIMEMSADFDTYKHRIGRVGRDGCGGKSTVLVEHHQLQGGPASNVIEQLYNFMKESKEDIPQWMQEWIVARRNNNIDSWA

SEQ ID NO: 6332 - protein, 462 aa, Caenorhabditis elegans
MSLGQLSYTPVTDVGIGAIELYFPQNFVDQNDLEKFNNVSSGKYTIGLGQQQMGFCSDNEDIVSISLTVTRKLIETYKISTDSIGCLVVGTETMIDKSKSVKTALMDLFPGNSDIEGVDIKNACFGGAQALLHAIDWVTVNHPLDKKNAIVVVADIAIYEEGPARCTGGAGAIAFLICPDASIPIDRQFSACHMKNTWDFFKPITPIPSEYPVVDGSLSLSSYLEAVRMTYTYFISKVNRHTTGIDGLNSFDGVFLHSPFTKMVQKGLAVMNYTDSQLRHKQLNGNGVDHKLDENDRAGLAKMIELSAQVWKEKTDPYLVFNRRIGNMYTPSLFAQLLAYLAADDCVTGEKSILFFAYGSGLASAIFPGRVRQTSNLDKIRQVAIRAIKRLDDRIQFTPEEFTETLQKREVFLRSKEIPKSPSETSLFPNTYFLDNMDKLYRRSYTLHEEPNGVQNGNGIHH

SEQ ID NO: 6333 - protein, 326 aa, Caenorhabditis elegans
MSLERVFLKKTLAEFFCQNFVKSLQAVSCVSRDDVIKFSKDFMAGATAAAISKTVIAPVERVKLILQLQNSQTTLALENRYKGIVDCFIRVPREQGFLSFWRGNWVNILRSCSQESLGLSFKEFFRKYSLEGVDPKTQHSRWLVGNLVAGGGSGCATLATIYPLDFIRTRLAIDLGKRKSDREFTGMFDCAKKIIKSDGVPGLYKGLIPSLQYMIIYRGAYYGLFDTTAPYMNSDGKMTFTEAFLVGQVVTLIAAMTSYPLDTVRRRLMMGAGKKTLPFNNTISCIKYIYTKEGPKAFFHGALVNAIRGTGAALVLAIYNELQKYM

SEQ ID NO: 6334 - protein, 1067 aa, Caenorhabditis elegans
MSLSLLSKFSRGVPSPALAHIAKRTFSSVNFSQILRRPQNSSLRLRLVRNISNSNPLPKMTEAGKNIVLKRHDLIVKGAQDAREYRGLELTNGIRVLLVSDPTTDKSAAALDVKVGHLMDPWELPGLAHFCEHMLFLGTAKYPSENEYSKFLAAHAGSSNAYTSSDHTNYHFDVKPDQLPGALDRFVQFFLSPQFTESATEREVCAVDSEHSNNLNNDLWRFLQVDRSRSKPGHDYGKFGTGNKQTLLEDARKKGIEPRDALLQFHKKWYSSDIMTCCIVGKEPLNVLESYLGTLEFDAIENKKVERKVWEEFPYGPDQLAKRIDVVPIKDTRLVSISFPFPDLNGEFLSQPGHYISHLIGHEGPGSLLSELKRLGWVSSLQSDSHTQAAGFGVYNVTMDLSTEGLEHVDEIIQLMFNYIGMLQSAGPKQWVHDELAELSAVKFRFKDKEQPMTMAINVAASLQYIPFEHILSSRYLLTKYEPERIKELLSMLSPANMQVRVVSQKFKGQEGNTNEPVYGTEMKVTDISPETMKKYENALKTSHHALHLPEKNEYIATNFDQKPRESVKNEHPRLISDDGWSRVWFKQDDEYNMPKQETKLALTTPMVAQNPRMSLLSSLWLWCLSDTLAEETYNADLAGLKCQLESSPFGVQMRVSNRREAERHASLTLHVYGYDEKQALFAKHLANRMTNFKIDKTRFDVLFESLKRALTNHAFSQPYLLTQHYNQLLIVDKVWSKEQLLAVCDSVTLEDVQGFAKEMLQAFHMELFVHGNSTEKEAIQLSKELMDVLKSAAPNSRPLYRNEHNPRRELQLNNGDEYVYRHLQKTHDVGCVEVTYQIGVQNTYDNAVVGLIDQLIREPAFNTLRTNEALGYIVWTGSRLNCGTVALNVIVQGPKSVDHVLERIEVFLESVRKEIAEMPQEEFDNQVSGMIARLEEKPKTLSSRFRRFWNEIECRQYNFARREEEVALLKTIKKDDVLELFDKKIRKDAAERRKLAVFVHGKNEDQEAVNTIIKKNAESGKKEKEVLYSDQLRQFLPLYGRPIAAIDLKPIGVDPLEHQETTKSKY

SEQ ID NO: 6335 - protein, 473 aa, Caenorhabditis elegans
MINNNSKILFHMIFDSISTLASATFSKRTNVRHISSFVFFHKTRYLIMILSLLCMTVGQMNSLSFNFTVICMEDVVVDFHSNNRTDLHWLEDPSQKSWIFSGVAIGAVIGLLPLVPMLDNIGLRITFTLFGIISAASSLLFPLSVHMGFYAVFIVRILQGIGTSILYTVVAYIPGIWAPKTEMGTFLAVLSCGFQLSNIICMPVSGILCESDWGWRPIYYIFGSLTILVYMVFFFLYADAPKNHFHVSSKELSMICAEKKPKKGKESVPYRAICFDKCVLATWLSMCGRNVAFYVLVLYGPTYLREVLHFDVKGTGWAAALPFVSCAIVKFASGQLTDRLTMFSEKTKFVTCTLISMIGLAAGFVVMSLTSSRTIAQISYTFAVTLSGITIMGTVKCLQLRCQQHVHFATVVVAFMACIWQFLVPLGVGYLCPNNTPEEWSFLFFIVSGIVLIVNIPFPFLTTAEAADYAKRF

SEQ ID NO: 6336 - protein, 980 aa, Caenorhabditis elegans
MDKEVTNIVLKRHDSIVKGAQDDREYRGLELTNGIRVLLVSDPTTDKSAAALDVKVGHLMDPWELPGLAHFCEHMLFLGTAKYPTENEYSKFLTDNAGHRNAVTASDHTNYHFDVKPDQLRGALDRFVQFFLSPQFTESATEREVCAVDSEHSNNLNNDLWRLSQVDRSLSKPGHDYAKFGTGNKKTLLEEARKKGVEPRDALLQFYKKWYSSNIMTCCIIGKESLDVLQSHLKTLEFDTIENKKVERKVWNENPYGPEQLGKRIDRKFFAHLIRHKGPGSLLVELKRLGWVNSLKSDSNTIAAGFGILNVTMDLSTGGLENVDEIIQLMLNYIGMLKSFGPQQWIHDELADLSDVKFRFKDKEQPMKMAINIAASLQYIPIEHILSSRYLLTKYEPERIKELLSTLTPSNMLVRVVSQKFKEQEGNTNEPVYGTEMKVTDISPEKMKKYENALKTSHHALHLPEKNEYIATNFGQKPRESVKNEHPKLISDDGWSRVWFKQDDEYNMPKQETKFALTTPIVSQNPRISLISSLWLWCFCDILSEETYNAALAGLGCQFELSPFGVQKQSTDGREAERHASLTLHVYGYDEKQPLFVKHLTSCMINFKIDRTRFEVLFESLKRTLTNHAFSQPYLLTQHYNQLLIVDKVWSKEQLLAVCDSVTLENVQGFAREMLQAFHMELFVHGNSTEKEAIQLSKELMDILKSAAPNSRPLYRNEHNPRREFQLNNGDEYIYRHLQKTHDAGCVEVTYQIGVQNKYDNAVVGLIDQLIKEPVFDTLRTNEALGYIVWTGCRFNCGAVALNIFVQGPKSVDYVLERIEVFLESVRKEIIEMPQDEFEKKVAGMIARLEEKPKTLSNRFKRFWYQIECRQYDFARREKEVKVLKSIGKDDVIALFDKKIRKNAVERRKLVVLVHGKIDDQETLNRIIKKNVESGKKEKEILNLDQLRQSLPVYDLPNAAIDLKPIGVDPLEQKESATVQ

SEQ ID NO: 6337 - protein, 845 aa, Caenorhabditis elegans
MTEADRNIVLKRYNSIVKGPQDERECRGLELTNGLRVLLVSDPTTDKSAVSLAVKAGHLMDPWELPGLAHFCEHMLFLGTSKYPLENEFTKFLSDNAGSYNACTEPDHTYYHFDVKPDQLYGALDRFVQFFLCPQFTKSATEREVCAVDSEHLSNLNSDYWRILQVDRSLSRPGHDNRKFCTGNKKTLLEDARKKGIEPRDALLEFYKKWYSSNIMTCCIIGKESLDVLESYLRTLEFDAIQNKKAESKVWAEFQYGPDQLAKKIDVVPIKDKKLVSIIFPFPDLNNEYLSQPGHYIAHLIGHKGPGSISSELKRLGWASSLKPESKTIAAGFGYFNVTMDLSTEGLEHVDEIIQLMFNYIGMLQSAGPQQWIHEELAELSAIEFRFKDREPLTKNAIKVARNLQYIPFEHILSSRYLLTKYNPERIKELLSTLTPSNMLVRVVSKKFKEQEGNTNEPVYGTEMKVTDISPEKMKKYENALKTSHHALHLPEKNEYIVTKFDQKPRESVKNEHPRLISDDGWSRVWFKQDDEYNMPKQETKLAFTTPIVAQNPIMSLISSLWLWCLNDTLTEETYNAAIAGLKFQLESGHNGVHEQAGNWLDPERHASITLHVYGYDEKQPLFVKHLTKCMTNFKIDRTRFDVVFESLKRSLTNHAFSQPYMLSKYFNELLVVEKVWSKEQLLAVCDSATLEDVQGFSKELFQAFHLELFVHGNSTEKKAIQLSNELMDILKSAAPNSRLLYRNEHNPRREFQLNNGDEYIYRHLQKTHDAGCVEVTFKFGVQNTYDNALAGLISQLIRQPAFSTLRTKESLGKNSYPHLIKYSKYLERKLLRCHKMNLRRKFPE

SEQ ID NO: 6338 - protein, 225 aa, Caenorhabditis elegans
MAWRSSGSTNSELIDNLRNNRVFASQRAYDAMKSVDRGDFAPRAPYEDAPQRIGYNATVSAPHMHAAALDYLQNHLVAGAKALDVGSGSGYLTVCMAMMVGRNGTVVGIEHMPQLVELSEKNIRKHHSEQLERGNVIIIEGDGRQGFAEKAPYNAIHVGAASKGVPKALTDQLAEGGRMMIPVEQVDGNQVFMQIDKINGKIEQKIVEHVIYVPLTSREEQWNRN

SEQ ID NO: 6339 - protein, 1046 aa, Caenorhabditis elegans
MSTVMEMSTTRAEIRSVLVKHWRSLDKARLHTIHLWLLLYAAAQIFIEYYFSEVYAVLMLEADDRPQSKENHEKVKKWSPFCFYASIFFIAYLILTCFAIRIRQPKEGMGLVLVSLSLCVLLPAFSWILHLPVVIFVSRERIHTNEHDHSALYTSLCIASVIQFFILPRHRRIFFVVAVSWIVANFLLIVAINWDALNVNTLFMCSCLSLFLHQGVIALVGVVADSNEAGNRAEIARKLTEAVYRRTELETLKDRQEQLLLSVIPAYLADQVSKSIIQSSSTGSTVEVPRTGKNNTKNHKLFHDLHVQVHDNVSILFADIVNFTVLAAQLTAKDLVRTLNELYSKFDRDAQRLQCMRIKFLGDCYYCVSGMPVNRPNHADMCVVMGLEMINTIKQVRIATGVDVNMRIGVHTGSVLCGIMGLRKWQFDIWSDDVTLANHMESAGVPGAVHITKSTKDMLLGDYCIVDANTDDPHVVSYGQPTYHILPDKTSAIERTASIYRNSRLSTSPALQSRMSMKAKVSKMVEFWGAETPFANFTKKKFSASHDPALITDEIARRPTYINTIPSMTLIENNLTNFSFNNINSMFNCELPTIPASPKLLWPFSRKSITCNLSDCVLLTFVCIPSAFANLLLCSLYCPSDVLQQISLQQFFTIIGLAMLSLLGRVCSYAGPLITMVAFLLSSCIPIGPHIIIKKSKLEGVMAFNSLIFLPSCVSHLVSVFILYRLPYSHRCFLFFADFVIFQVLLSLFPAYGAEVYVGYMGYHLSVVSISLSLLVVLLFFIDWITNYERKRESACHVSFQNEERDVETMQDINKILIENILPSSVAAKFLSPDRAVNELYARQHENVCVMFASIPNFKDFWSEWDTNRKLECLRLLNEIVCEFDKLLSKPKFSSVEKIKTVGSTYMAAAGLNESEADYDDIYLEKQNSGKYNNNIRHGNMAFRNANLMIEFALAMSQILDALNRDSFQNFELRIGMSVGPLVAGVIGAQKPQYDIWGNTVNLASRMDTHGEPRKIHATTDMGRVLQTGGYRVQSRGKIRVKGVKV

SEQ ID NO: 6340 - protein, 388 aa, Caenorhabditis elegans
MLELIYILPLLCFVYFLFRRFVLENFYVESSGKYVMITGCDSGFGRLLATSLLDKHVNVFAACFTQQGMASLHSEWKLKKGPKGQLYTLQLDVTSQASVDSAKSFVTKILKEQNSKLWGLVNNAGIFSIHGPDDWCSVDEYASSLNVNTLGAVRMCHAFVPLIKKSRGRIVTMGSTAGRLHGLYVAPYVTAKFAVEAYMDCLRLEMRPFGVSVHILEPGCFKTELLNNDAQRMRIQKIWNSLSVETKEEYGEDYRNDFERAWEAGVNVVANPNIGWVVDCYSHALFSWWPRLRYCPGWDAIFMFIPLSIFPTALQDWILAGLYKLNPGPSLTPAVLVKNKKRRSAIQWIQFLSQIAIIPLLYTIFFVKNTQKQTVETSTHHHNVTVSE

SEQ ID NO: 6341 - protein, 443 aa, Caenorhabditis elegans
MGQQQSGFGGRGNDRGAGDGEKKEKKKYEAPIPSRIGKKKKGSKGPDAASKLPAVTPHARCRLKLLKSERIKDYLLMEQEFIQNQERLKPQEERQEEERAKVDELRGTPMAVGSLEEIIDDQHAIVSTNVGSEHYVNIMSFVDKEQLEPGCSVLLNHKNHAVIGVLSDDTDPMVSVMKLEKAPQETYADVGGLDQQIQEIKEAVELPLTHPEYYEEMGIRPPKGVILYGCPGTGKTLLAKAVANQTSATFLRIVGSELIQKYLGDGPKMVRELFRVAEENAPSIVFIDEIDAVGTKRYDSNSGGEREIQRTMLELLNQLDGFDSRGDVKVLMATNRIESLDPALIRPGRIDRKIEFPLPDEKTKRRIFQIHTSRMTLGKEVNLEEFITAKDELSGADIKAMCTEAGLLALRERRMRVTMEDFQKSKENVLYRKKEGAPEELYL

SEQ ID NO: 6342 - protein, 143 aa, Caenorhabditis elegans
MKAILVFALIAISIISVNAGMMTGGSVEQDASQKEYSDKAWKAVKGINDQASNNGPYYYAPIKVTKASTQVVAGISTKLEVLVGESNCKKGELQAHEITSSNCQIKDGGSRALYQVTIWEKPWENFEQFTVEKIRDVTADEQF

SEQ ID NO: 6343 - protein, 395 aa, Caenorhabditis elegans
MKSLCLLAIVAVVSAEVYFKEEFNDASWEKRWVQSKHKDDFGAFKLSAGKFFDVESRDQGIQTSQDAKFYSRAAKFDKDFSNKGKTLVIQYTVKHEQGIDCGGGYVKVMRADADLGDFHGETPYNVMFGPDICGPTRRVHVILNYKGENKLIKKEITCKSDELTHLYTLILNSDNTYEVKIDGESAQTGSLEEDWDLLPAKKIKDPDAKKPEDWDEREYIDDAEDAKPEDWEKPEHIPDPDAKKPEDWDDEMDGEWEPPMIDNPEYKGEWKPKQIKNPAYKGKWIHPEIENPEYTPDDELYSYESWGAIGFDLWQVKSGTIFDNIIITDSVEEAEAHAAETFDKLKTVEKEKKEKADEETRKAEEEARKKAEEEKEAKKDDDEEEKEEEEGHDEL

SEQ ID NO: 6344 - protein, 2783 aa, Caenorhabditis elegans
MVRQIEKTVLNTVLTINSIDSQDQGEFALKIKNRCGEDKYAIGIQVTDRPAAPGKPAVEDQNVDSVRLRWAAPTNDGGSPVRNYTVEMCTEKGKTWTKAEVTKQAFITLFNLVPGESYRFRVRADNTFGQSEPSDESELVVVKNVSRVVEEPKKKEVKVKEQESVDYERVAKDSEPSEYKTIDIHRLPNDLQAKYIIHEELGKGAYGTVYRATEKATGKTWAAKMVQVRPGVKKENVIHEISMMNQLHHEKLLNLHEAFDMGNEMWLIEEFVSGGELFEKILEDDSLMSEEEVRDYMHQILLGVSHMHKNQIVHLDLKPENILLKAKNSNELKIIDFGLARKLDPKKSVKLLFGTPEFCAPEVVNYQPVGLSTDMWTVGVISYVLLSGLSPFLGDSDEDTLANVSASDWDFDDPSWDDVSDLAKDFICRLMIKDKRKRMSVQDALRHPWITKMQPKLDKSGVPARQKRNFLSLKRWSDDLLPIGRLAKRGAIFRRLTMDGVFERNIAFDTDAAPSVKKQLEDIVANVGDLIATLSCDVDGVPSPKVQWYKDDKELTVPSMKYDSFYNEGLAELTVKNIVESDAGKYTCRATNDLGSIMTHAKLSVKADEKKKKKSKTSPAVIEKKKDRKTSKVVVIEEMIDMPPNFHHLLQDDEAKIGEPKILVVTNTTLPEPTVDWYHNGEHISINDSNYLRKHDKGRYELHILSVDSTDEGKWKAVGKNAFGECESEAKLTVVIPDGQYAPSFGKQLSDVKCSESDILKLEVNIQANPAPEINWFRNESEIEHSQHHRLQFDDGSGNYSLTIIDAYAEDSGEYKCVAKNKIGKAHTVCCVRIEELLSKRSKKIDGSKAPRFRMQLPTPREVPQGADLTLVCSVSGTPHPNIKWTKDDKPIDMSNKQVRHENGVCTLHIIGARDDDQGRYVCEAENIHGVAQSFSVVEIKEAVDKDHVRPKFLEPLVNCSTCEGNEMVLECCVTGKPIPTITWYKDGLKLIIENRMLQYTDRKGVSRLNIMNVVMNDDGEYTCEAVNSLGKDFTHCTVKVVDMGLSKTRLTPVRSRSRSRSRSPSVVGGEIQRPPVVTRPLADATVTEGNRELLEVEVDGFPTPTIEWYHDGKLVAESRTLRTYFDGRVAFLKIYEAHEEHNGQYVCKVSNKLGAVETRAIVVVEAPDAAEHVTQMPTFVKKLQDVVLKTAGETATFTCQSYANPAAQVVWLHNGKALQQTKSNYKTRLFDDNTATLVIENVTDELCGTYTAVANNQFGDVHTSAQLTISGSEAKKIAASLPYFIIELKPKINVVEGATLSIQADLNGSPIPEVVWLKDNSELVESDRIQMKCDGVNYQLLVRDVGLEDEGTYTITAENEKGKIRQNTEVSVTKSKEVKEKKEKKKVEKKDEGKKKPGRPGLPRPSGASKTEQVTMAFDAPSEGPADSYEVERRCPDQREWVSCGSTKSLELEIKGLTPNTEYIFRVAGKNKQGLGEWSEMTSTLKTASVGQAPQFTISPQSKIIANRDDEFEIAVEFSGTPTPSVKWYKENLQIVPDEKIDVATTSTSSILNLKSQEENGTFNCLIENELGQASASCQVTIFNKPASLQSTPDHSLERNLVPTLQKALNNESAQAGQQIMLTCRISSRSESTVAWFKDDERIESAGRYELSSDKKSNHKLVCHAVQSQDTGKYRCVVTNKYGYAESECNVAVEDVTKFIAPSFSATLSDSTAILGHNITLECKVEGSPAPEVSWTKDGERISTTRRIRQTQDENGNCKLSISKAESDDMGVYVCSATSVAGVDSTSSMVMIAKTTGTDSHLVIAQTADEKHEKPRFTRAPPSLIEVNESGQFTLIAKAVGEPKPTVTWLKDGREILRTNRIYHHFVTGDGESHLIAECVVSKTSGIFSCKAENPNGTVIAETQVIVQRMKPANQLANVAPKFTIPLTDMGIVNGHPTTLSCNVTGSPEPTLEWIYIDDSGHKINLTSSTTDWTECRFGKVAELKSERVLREQRGTYQCIATNSSGQATTQCYLLVGELSDEPAGPPRFVKCLQDTWTPLKESIEFSVELAGFPTPDLTWYHNEKKINEGKDVKITFPSDTTSVLSIKNVSLASLGMYFVEASNIHGVLRTAGRLNVSDERRKAEPPQFKHVLEPVLAVQPKVAFSEEHPRASSSAATARVKKGAAPMFLQGLEDMDLKAGASAAVAGKLGRKLRPHRSTTNDADKLAKALAQSLRLDEPRASIDSRPESAANAALDEVRAAINSRNKRVCRPKFMVKPKPRKVLEEYKSLRLKTAISGNPMPQVHWDKEGIILETGNKYSIYNDGDFYYLEVHHVSTFDKGFYNCTAANNEGIITCTSEIDVLPNKEDSAAQVAKRKSRKEAKAPNFIEVLPGRSQANLNESLCVECSVSAYPCASIIWTRNSVRLLPQADRYTMSYDGECASLKFISVTPGDEGTYACEAVNELGSAVTNMNLQVSGVDPNAAEGIPPLFRFEKIKSVRKVVDGSRVELAAELVQASEPLQIRWLRNKVTIVDSPSFSYSRSENMVFLTIADVFPEDGGEYTVEAKNQSGIARCTMQLDVRNNERSVADEAPRVFDFEPTTRSDPGVSVELRAKVIGHPDPMRNEGDKFILRIANVTRADAGKYELTAINPSGQANAELELTVVQSTKTVGAKPKFNESPISVQTCEKNRAELRASFSGTPAPACRWFYNGNELIDGLDGYTITSSDTNSSLLINSVDKKHFGEYLCTIRNQNGEELANAMILSEGECRKHPRIDIVFVCNSFIFSVVHVLLISISRGVR

SEQ ID NO: 6345 - protein, 528 aa, Caenorhabditis elegans
MAIAISQAVLAHRNSAATFTVPGSTEQLKFHNYRVTGNMISGAAQQHKKRLVPLRRTDAMTVAERRNYQILDDIFRSGASDCFQQVSSADNGSPQFLKLNIGGTSFMILIDAILRADTTTFLSRFVQLTHTARLKVADAYISADDAYYFQRSPTSFEAVFQYYATGVVHRPSEICPASFLSELDFWRISHQHVGSCCADIIPQKREEEKEEEKVDDTTFDKLMCGKLRRRMWTFLERPGSSMQAKAFELSSTLFVAISVMGLSFGTIPDFQVTHLMPPHNETVVLPNGTVTVVQKVEQMRVEHPAFVFTERICIAFFTVEYCLRFFAAPRKLRFALKPLNLVDLLAIVPFYLELLLTLCGVDDRKLRDLRWAFLVVRILRVLRVIRIIKLGRFSSGLQTFGMTLQRSQKQLQMMTIVLLTGVVFFSTMIYFLEKDEEGTPFTSIPAAYWWCIVTMTTVGYGDAVPATTMGKIIASAAIMCGVLVLALPITIIVDNFIKVAQDEQQAEQQKNDQQSEQLALEAMLNAHD

SEQ ID NO: 6346 - protein, 2109 aa, Caenorhabditis elegans
MSMISDEENTSHQLLSNVLLTDKEVPITATYNEDLSRAESFRRFFESAETTVKVTELYQGESVEAQFQQPEKREQVSTSNTDVMFVNQKVDVMESTVSTVGNAVRQSVSSSTNSWDYMFNDPFPESQEINVIENELYEPRVPLLPQKLSYKGQEIFANTNTVERNSKAGAKAKGEVENLKKCVETLLLFDAEMDMKDIKESSPKKEIISKKDQQSLDDQIKVTQQILKDVERDLNKMERTSPGKSLSPNKRTFAPKDVEDIEAAIFSISDQLADRQSSEEALREALQEMILSNSSPMKELSRNNETSKPEVLKSEIQKIPEVETKISEVYPIVKLKQAISAIENSLLEDTEVTEIMKRKGSDKDKRKATRIKRVPSAHSARITPITSNLRDRLNQLHQLTVSEDSGSLKQNEEAKEIQELFVKIEKEINTIAELCKEKMTKKGADTVTHVLNSVLQHVASIINVILVAQDHQPIEVHAETTKTAEVSVWYSFDVHPESEDIIGIVDEEPTNRRPSSTPRGSTRSSNLTTSQDSQATTKMTVSSEDTIEAPIAPPRKGRSLSRDAERLLEIQPRAPPRRSRQSGDTLSPEPTPVLTLVKSDETPAPVRPPRSRSRHSGDELAETSPEAQPIRPPRSHSRHSGDELEEVQPVRPPRSKSKTADANCLQIESMDESQYSLSCIHIQKTNFAFTNSTHETSNASVVVDLRNMAQLECTVQSLDDLASIQMLCEESDYPSDTDRSLLLAGTVRYFNRASPSLHEVSPSLNMESVSMDLKPETEPEEIVQDVYVNVELHSVPSLSSLVEVNPNTLMQTLASEKSSLKAAEEDEKEGEEEGEEEVTADVSFIGRSVLSTETLDVVLEEKDMSQMNSTLPLDYERAFSSNTIRETDILSDESITVDSSYHKSPEPTVDFARSQVKSEEVTENFSLIHKPARRRVTGIVVNSLIYTIAANIAEDNTFDVDVVQEPQRYNISIKVIEDIVDFTSLTIMSDCEDDPPADVLVLKQDTSKLQALSYDDISVATTRTGITVSIVARSLNDGIYASLEEIAWGEVEMTVPDIMQMSTEEKSSLQFNVTVSESNLEEAKSLKSQVSFRSSQNSVSEMDNTISSTATISIPSYVVKLESTATITCELNNYLPKNCTIDWYCGKTKIIIDHEQFDRISHDLLEVLIIRSVEAINGNLYSLKINEDLFPVAYLIVENTNLTTSANILTRPETQFVMEGQPTVITVELDDPNVIVNWLKDRRPLHENERIRLETDGQGNHRVIIPNTCVGDQGTYLALTSSESVAITLVVEERIEEKEVMVIASGTESEEDDVQEYLVPPGSTATIACELEECELKRSIRWLRDGKDIRFEQGKTEHVQNGLKHYLVVHDATSLDSGLYKTERSEEQCEETIIPRGVVATIQCQTSEPQESIQWSKDGNIIPSDISRFEFRSLDNNQSHEMVISNISWSDAGVYSVLINGKSSFVSKIVVVESELITQSVEEEPEAEPEIDVSLHIVESEQIIELNVPQSPKLGASHETLVPIGQDDIEVIDKQEAAPVVESIEETSSIGSEEFEIIEKFTEEEVPKVAEPSEPTQADVPKIAAPLEQSQIQQEVPTVAAPSEPTQADVPKEAAPSEPSQADVPKVAAPLEQTQIQQEVPMVAAPLEPTQADVPKVAAPLEQSQIQQEVPTVAAPSEPTQADVPKEAAPSEPSQADVPKVAAPLEQTQIQQEVPMVAAPLEPIQEEVPKEAAPSEPTQEDVPKGAAPLEPTQEDVPKEAAPSGPTQEDVPKEEAPSEPTQEDVPKEAAPSEPTQENVPKEAAPSEPTKDVPKEAAPSEPIQEEVPKEATLSEPTQEQSEVSKRSEPVEPTQIQQAASEEETPLEETNETVVQTNEDVKEAEVPENAEAQKVVDSSDLQVAASEIAHLAIDEAVLETSNQPSQFDSLQEQKPSVVHENEHVRSVCVDLTFSRDSEQIVSDVIVAEVGYDEDECSTIADTITSLSSSPLYTAPVFTERLPSSACFANSKLTLEVMFSGVPQPTISWLIDDHELVSDGERISIKCENGVSAIRFFNVDRNAGGFLKCRATNCAGQVETSCEIVAADEISVISDSSITSSTRPHFVVPLPER

SEQ ID NO: 6347 - protein, 1548 aa, Caenorhabditis elegans
MAEPPPDDSAPVRLKTLENIYMDGPSKKPEALSFETLIDSLICLYDECCNSTLRKEKCIAEFVESVKTVISKAKKLRLSRDDFEVLKVIGKGAFGEVAVVRMRGVGEIYAMKILNKWEMVKRAETACFREERDVLVYGDRRWITNLHYAFQDEKNLYFVMDYYIGGDMLTLLSKFVDHIPESMAKFYIAEMVLAIDSLHRLGYVHRDVKPDNVLLDMQGHIRLADFGSCLRILADGSVASNVAVGTPDYISPEILRAMEDGRGRYGKECDWWSLGICMYEMLYGTTPFYSERLVDTYGKIMSHQDMLDFPDDEIDWVVSEEAKDLIRQLICSSDVRFGRNGLSDFQLHPFFEGIDWNTIRDSNPPYVPEVSSPEDTSNFDVDVCEDDFTPCETQPPRVLAAFTGNHLPFVGFSYTHGSLLSDARSLTDEIRAIAQRCQGDAELMEKSVDGFMVELENEKAELVQKLKEAQTIIAQHVAENPRSEEDRNYESTIAQLKDEIQILNKRLEDEALAQQQQKPKDEIVAESEKKLKELKERNKQLVMEKSEIQRELDNINDHLDQVLVEKATVVQQRDDMQAELADVGDSLLTEKDSVKRLQDEAEKAKKQVADFEEKLKEIETEKIALIKKQEEVTIEARKSVETDDHLSEEVVAAKNTIASLQATNEERETEIKKLKQRMDEERASHTAQSEQEMKQLEAHYERAQKMLQDNVEQMNVENRGLRDEIEKLSQQMAALPRGGLNEQQLHEIFNWVSEEKATREEMENLTRKITGEVESLKNNSPLTTSNYIQNTPSGWGSRRMNNVARKDGLDLQRQLQAEIDAKLKLKAELKNSQEQYLTSAARLDDTEKRMASLMREVAMLKQQKNIENSSDSAFSSTMGRGDLMISMNNDYEMSNSSLMRQEMISRQSTPSYENAILLHDHQVPKRVDDLRYKQKPMKTASGIFSPVSISAMERGHNFERMKIKTPTKCGHCTSILIGLDRQGLFCQSCQYACHVSCAERVSQSCPVPEEERRPLGMIRHAEQNKMQDVKNEIRLVLDMRDPDFTVCGVSEADVIHAQKGDIPKIFRVTTTQILNSSSEYSSSSKFYTLFMAETEEEKRKWVVALSELKTLLRRSKLADRKAFLVKEVFDVTTLPSIRVAQCCAIIDRSKIVIGFSDHGLYCIEISRQLLIPVGGEKENKQRCVETVEYDEAEQLLMMIVGPAKDRHVRIVPSAALDGRDLKWIKVNDTKGCHLLAVGTNNPGGRAGFFAVAFKKSVTIFQIDRSEKRHKKWKDLAMPGTPQSIAIFNGRLYVGFSHSFRSWSLVGVDSSPVGSGDASGAVLQHISLVNMEDTSLQFLNQQTSYEAKLIVNVPGSPDEYLLVFNMIGLYVNEMGRRSRLPEVMFPTQAKYFAYHEPYLCVFSENEVDIFNVTLAEWVQTINLRSAKPLSGDGILSTCLCNDSPIFVLLQNVLQDQDSIEVPVNLASGSTDGRKVTRRKFTFRTIGKDDRSASERRSHIQISTPSDFMHIVHMGPAPVMELQQNFIDLQSNHSHTSSDKDSLNRSVNND

SEQ ID NO: 6348 - protein, 539 aa, Caenorhabditis elegans
MGTCFSILKSGKSENAIVRIQQGFLEGFCVQTAKGDLCDVFHGIPYAEPPIGKLRFQKPQPPKAWEGIRKCNKYPNRSIHKEMPWDKALPSANQSEDCLYLNVFAPKIREDKNICKLLVSREIIVVTFHYRLGFLGFLSTGDDVCPGNYGLFDMLEAMRWVHANISSFGGDPENITLSGQSAGAAAAGLLSFSPLTKGLFKRKIVMGGNSYCHWATTSNHHIREYCKKWAKRLGWKPQLNYANKREESVDIFNFFYGLPTSKLGMTMFFSNTIFKECHLHFHFHLLQLLIKRFSHTTGNFSEKLKSMCPQLLVAESAIGLLRGTEKEIDSAIDVLSRKNGLSRSKIETMTEKVYGDSPALRADLKARKMLFVQLISDIFANYGIYRFMRDCQQRSVECYGYSFDHRSKRMWGWLQHVAPFTGGTHTSEITYLFDCNALSTPLGMSKTDKVVSGMTADYYTNFVKFGTPNGLNSQLPKWERISPDDEHMKLISIKPEPEMKTVVYGYRMQHFEDCLQQPEVPPGGIKIDESQEIVQKHDE

SEQ ID NO: 6349 - protein, 658 aa, Caenorhabditis elegans
MYFSTSSSSNLPAWYYLKGPRFGGESPLPFCQFSPPVRQNQHFTKLKLKPRKNYRCKFKMPQLLLPIKKARVRTSSNQSNMGTCFSNLKSGKSENAIVRVQQGLLEGFRVKTAKGDLCDVFHGIPYAEPPVGELRFQKPQPPKAWEGIRKCNKYPNRSIHKEMPWDKALPSANQSEDCLYLNVFAPKIREDKKYPVLFYIHGGGYVMDSAERYTAKNICKLLVSREIIVVTFHYRLGFLGFLSTGDDVCPGNYGLFDMLEAMRWVHANISSFGGDPENITLSGQSAGAAAADLLSFSPLTKGLFKRKIVMGGNSYCHWATTSNHDIREYCKKWAKRLGWKPQLNYANKREESVDIFNFFNGLPTSKLGMTMFFSNTIFKECQLPLAPVIDGEILPHDLKVLRETQEHVPSLVGGGEYEALLFCAIGLLRGTEKEINSAIDVLSRKNRLSRSKIEAMTEKVYGDSPALRADSKARKMFFVQLISDIFANYGNYRFMRDCQQRGVECYGYSFDHQSKQMWGWLQHVVPFTGGTHTSELSYLFDCNYMSAPLGMNKTDKVVSGMTADYFTNFVKFGTPNGPNSQLPKWERISPDDEHMKLISIKPEPEMKTTVYGYRMQNFEDHLGMLYEEKDKSPFSPRGNFKPSIVSSGSDNSLHIMVN

SEQ ID NO: 6350 - protein, 578 aa, Caenorhabditis elegans
MGTCFSNLKSGKSENAIVRVQQGLLEGFRVKTAKGDLCDVFHGIPYAEPPVGELRFQKPQPPKAWEGIRKCNKYPNRSIHKEMPWDKALPSANQSEDCLYLNVFAPKIREDKKYPVLFYIHGGGYVMDSAERYTAKNICKLLVSREIIVVTFHYRLGFLGFLSTGDDVCPGNYGLFDMLEAMRWVHANISSFGGDPENITLSGQSAGAAAADLLSFSPLTKGLFKRKIVMGGNSYCHWATTSNHDIREYCKKWAKRLGWKPQLNYANKREESVDIFNFFNGLPTSKLGMTMFFSNTIFKECQLPLAPVIDGEILPHDLKVLRETQEHVPSLVGGGEYEALLFCAIGLLRGTEKEINSAIDVLSRKNRLSRSKIEAMTEKVYGDSPALRADSKARKMFFVQLISDIFANYGNYRFMRDCQQRGVECYGYSFDHQSKQMWGWLQHVVPFTGGTHTSELSYLFDCNYMSAPLGMNKTDKVVSGMTADYFTNFVKFGTPNGPNSQLPKWERISPDDEHMKLISIKPEPEMKTTVYGYRMQNFEDHLGMLYEEKDKSPFSPRGNFKPSIVSSGSDNSLHIMVN

SEQ ID NO: 6351 - protein, 554 aa, Caenorhabditis elegans
MGGFLSHLTPEQNVEALKASCGPVRGNIYKHDDVIVDGYLGIPYAKPPVGELRFKKPVTVDVWTEIKDCYKYGPACVQTGGFEQIAGPRTPTPEEAGCLTLNVFTPRNASSEFKNGRPVMVYIHGGGYELCASSDFCAYSLSGTLPLKDVVVVSINYRLGVFGFLTTGDNVCPGNFGLWDQTLALKWVQKHISSFGGDPNCVTVFGQSAGGASTDLLSLSPHSRDLFQRFIPISGTAHCDFAIRASENQAKIFREFAEFHGFSGRDSSALFKWYQEQSPETLSNVKGYKKSISGFLTFIPNLDGDFFPKPLDELRKEAPKKQMMTGVTEYEGLMLASMNPAFSPADVGLTLMPQGIYGKDVVSNPDEIQKIFYEKYVEGVDKSDELAMRKKLCEALGDEFFNVGVIQAAKNAAKHGNEVYFYTFEYVNPDSFGMWDGMMPFKAAVHCTELRYLLGEGVYSKFEPTEEDRKVMETTTTLFSNFAKYGNPNGKGATAEIWEKYSLNRPERHYRISYPKCEMRDVYHEGRIQFLEKIDGDSDKYQELVYGKKKSAKI

SEQ ID NO: 6352 - protein, 504 aa, Caenorhabditis elegans
MGGFLSHLAPEHNSDILKATCGPIRGNVYKHVSREAIFSDIWTEPKDCYKYGPVCVQTFSFGGLTIPRETSPEEAGCLTLNVFSPRQPSLEFKTGGRPVMVFIHGGGFEFGGSADYCDYSLSGTLPLKDVVVVSINYRLGVFGFLTTGDSVCNGNFGLWDQTLALKWVQKHISSFGGDPNCVTVFGQSAGGASTDLLSLSPHSRDLFQRFIPISGSAYCEFALRTSKSQAKIFREFAEFKGFTGGDSTTLLEWYKNQSSETLSDLRKEAPKKQMMTGVDEYEGVIASMNPEFSPADAGLALFPKGVYGNDTAENPEEMHKLFYEKYVEGVDKSDDSAMKKRLCEAFGDLGFNLGVFQSAKSSAKYGNDVFLYSFEYYHSDGFGMWKDLLPFEASMHGTELRYLLGEGFYSKFDATKEELEVLEKTTTLFSNFAKYGNPNGTGVTDEIWEKFNLNNPERHFRISYPKCEMRDIFSGGRMPFLEKLEEKSLKTQELVYGTKKFTNN

SEQ ID NO: 6353 - protein, 511 aa, Caenorhabditis elegans
MAEQRANKTSRCSISSVLFRAHSPLSSASAFNPCFVRSGLSASFPKSDSLCTLTDASFNPMQLLFLLLFTPYTIVGESPDFCPQHPVYGKEPEEDCAQASDPNELPKSPLEKWFTKQMFEDLFPKSNIGMGPHPCLPYSYESFIMAARYFPEFGAAHPNKQFKADEHHKRDVATFFAHALQETGENDASVYNNTDLTLEQAHECFYRGGFYNWFERGPNSTFLSPAAPGFSPFDGKRCTDEGRYCKSDPIIDFWYPCNSDIESHSDKEYHKGCYFGRGALQLSWNYNYGLFQQFLLTKGVKVDLIENPNLVMTKMDPPLAMMASLWFYMTPQPPKPSMHQIVTGDWKPSSKNRRAGYQGAIFGPTSLIINNECGGEDPDEPGGPGESRRIKAFKWFCKYFKVPVGSERTLSCKGMLDGFDAVQHMYSWHPDWGNMWKSQSCDCAPAPYGGPLPYYDPKLYPHEFTKQNDRNRLRCVYSMYESPETFRLDAGNSPCLKHKPKIRLTKTGIRG

SEQ ID NO: 6354 - protein, 528 aa, Caenorhabditis elegans
MAFTELVETQRKYFRTGETKPVKFRKQQLLKLKKFIEENREALSEAVWKDLRRRHESTEILEIGMTIQEIDYFLKNIDDWVKPTHVEKTFTTALDKPVIEKDPKGVVLIISPWNYPVSMILLPMVPAIAAGNTVVIKPSELSENVAATFEKLIPKYFESKYVTVVNGGIPETTDLLKERFDHILYTGCPPVAKIIMTAAAKHLTPVTLELGGKCPVVVEDDADIDISAKRIAWGKWLNCGQTCLAPDYILVNSTVKPKLVAAIRKYVNEFYGEDVKASKDYARMINQRHFDRISGLLDKTQGAVLIGGERDRADLYIPPTVLDVEKSDPFMHDEIFGPVLPIITVQSFSESLEYIADGEKPLAAYIFTRNEAKVKRLLNETSSGGVTVNDVLMHITVDTLPFGGVGVSGMGRYRGKYGFDTFTHEKSVLHRGFFGESLLAARYPPLSQQKLDQMRRLTGKRISLNLMNVATLPIVMASFVFGMLFQLTSTNSITNKYRKNNTSFSSFSASRHKIETCWWRWQTRNGVQ

SEQ ID NO: 6355 - protein, 309 aa, Caenorhabditis elegans
MVENNTLIITGGVVVVSSIAIYIYLKATNTCPFSLCKKSKKRTLVDDSVKYPLPLIEKFEISHDTRKFRFGLPSKDHILGLPIGQHVYLTANIDGKIIVRPYTPVSSDEDLGFVDLMVKVYFKNTNEKFPEGGKMSQHLESLKIGDTINFRGPQGNIVYKGHGLFSIKADKKAEPKNRVFKHLSMIAGGTGITPMLQVIAAILRDPTDTTQIRLLFANQTEDDILCRQELDDLAKEHPTRFRVWYTVDRPPVMWSYSSGFINDSMIKENLFPPGDDSAVLLCGPPPMINFACIPNLEKLEYDPANRLLF

SEQ ID NO: 6356 - protein, 303 aa, Caenorhabditis elegans
MVENNTLAITGGVVLISSVSLFLYLRQLRAEKKSKRTLEDDSVKYLLPLIEKFEISHNTRKFRFGLPSKDHILGLPIGHHVYLSANIGGKLIVRSYTPVSCDLDLGYVDLMVKVYFKNTHERFPDGGKMSQHLESLKIGDTVSFRGPHGSIIYKGSGLFTVRMDKKAEPKNRFFKHLSMIAGGTGITPMLQVIAAILRDPIDATQIRLLFANQTEDDILCRKELDELAEKHPTRFRVWYTVSKASKDWRYSTGHINEEMIKEHLFPSNEESAVLLCGPPAMINCACIPNLDKLGHNSENYLIF

SEQ ID NO: 6357 - protein, 746 aa, Caenorhabditis elegans
MSSNKKKTVRSPYPFPTKFPSPIEQASYKTYNWIENTLWPIKPIPFVATTVALAATLHYKYPENAILDLLPKFGSEVAEIAKTTAVAAIGSYAGVFTLRKLLKHFYFSYKGFLFDNPKKPCLKTKIWGIVRHILSISPPILESCDRLLPSLPVPALKDTISEYLDSMKHILSEQEYEIVAKQAHEFLENEGKKLQRYTWIYSLFTDNYVTSFWQKYAYLHGRYPLMINSSVAHCDLLRDKEATRAHRAARVTWIEVMSHLAIDRQQYKALGDGLVCTRHYKNMYAVTREPGKKIDQLILHGIQKHIVVVLRGKYYKIHVVDDKNNIYTVEQLTKIFHEMISRDEKEEGVIGKIAALTHDTRDSWHRNRQKYFLGNVKNAQILKEIECAVFFFTLDENDDYGYDEKKPEVLSNFLANCLSGDGTNRWVDKSLNYICSKNARCGGTTEHSIADGAEFDHIMENFVYVDLEVLKYKSIEEQEKMAVIEENDKKSLKLATPLNFEVPDQEMLSEITRCYDAHQIAKNDLDLYALAFRDFGKGRIKKCGVSPDAFIQMAIQLANYRDQGKFVLTYEPASARFFANSRTETLRTVNDHSCEFVEAMLNANETKEAKIALLKKACETHVLRNKKCMVGQGVDRHLFVLYILSQGTGIQSPFLDNYINQKWKLSTSHVPNVTNQCDEDTDSDNTWLGACFGAVAADGYGICYRFGGNHGIFANITSYHSAANTDSTKFAKLLSESFHELSNLFV

SEQ ID NO: 6358 - protein, 469 aa, Caenorhabditis elegans
MASATGGWQALESNPETINPFLSKIGVSGVECVDVFSFDDEMLQFIPTPQLALILCFPSSGVREFRAKQYEEVEKNGKKPDGIFFMNQKKEIGHACGTFSLFHSLANLENRVNLGNGKFSKWFEKAKLVGEGERSDLLLADTDLAEAHKETAEEGETEHPEHVAYHFITYVNKNGQLFEIDSCSPFPRPLGATTDSTMIRDAFSTSIKDLMDNVQKLSFSAMALNLFSFKQRYICLVIESISMTTKGKGGWQALESNPETINPFLKKIGITGLECVDVYSFDDEMLQFVPTPQLALILCFPSAEAREFLSKQYEEVEKNGEKPEGVFFMNQSEEIGNACGTFALFHSLANLENRVNLGKGKFAKWYEKAKLVNEDERSDLLSGDTDLAEAHEETAEEGETEQSDHVDYHFITYVNKNGQLYEIDSCAPFPRPLGATTDSTMIKDASTAIKELMNNVKNLSFSAMALVGK

SEQ ID NO: 6359 - protein, 216 aa, Caenorhabditis elegans
MAAPWTPLESNPSVINPMIEKMGVSGVKTVDVLFFDDESIGKPQHAVILCFPEYKKVDEIMKPIYEQAKAADDSVFFMKQKISNACGTFALFHSLANLEDRINLGDGSFAKWLAEAKKVGIEERSDFLANNAELAGIHAAAATDGQTAPSGDVEHHFICFVGKNGILYEIDSRRPFAREIGPTSDATLVKDAGAACQHLIEKLDNVSFSAIAVVNQ

SEQ ID NO: 6360 - protein, 336 aa, Caenorhabditis elegans
MSAPLRVLVTGAAGQIGYSIVIRIADGTVFGKEQPVELVLLDVPQCSNILEGVVFELQDCALPTLFSVVAVTDEKSAFTGIDYAFLVGAMPRREGMERKDLLAANVKIFKSQGKALAEYAKPTTKVIVVGNPANTNAFIAAKYAAGKIPAKNFSAMTRLDHNRALAQLALKTGTTIGNVKNVIIWGNHSGTQFPDVTHATVNKNGTETDAYAAVGDNAFLQGPFIATVQKRGGVIIEKRKLSSAMSAAKAACDHIHDWHFGTKAGQFVSMAVPSDGSYGIPQGLIFSFPVTIEGGEWKIVQGLSFDDFAKGKIAATTKELEEERDDALKACDDANI

SEQ ID NO: 6361 - protein, 623 aa, Caenorhabditis elegans
MSQVAAMDLRVLTQFDIASLEEDRKKMLYEEPISLEEAALNANDVMVAPSRKSYVHGCSTVPLLFETVGDRLRSAVDQVPDKEFLIFKREGIRKTYSQVATDAENLACGLLHLGLKKGDRIGIWGPNTYEWTTTQFASALAGMVLVNINPSYQSEELRYAIEKVGIRALITPPGFKKSNYYQSIKDILPEVTLKEPGKSGITSRNFTCFQHLIMFDEEDKIYPGAWKYTDVMKMGTEEDRHHLSKIERETQPDDSLNIQYTSGTTGQPKGATLTHHNVLNNAFFVGLRAGYSEKKTIICIPNPLYHCFGCVMGVLAALTHLQTCVFPAPSFDALAALQAIHEEKCTALYGTPTMFIDMINHPEYANYNYDSIRSGFIAGAPCPITLCRRLVQDMHMTDMQVCYGTTETSPVSFMSTRDDPPEQRIKSVGHIMDHLEAAIVDKRNCIVPRGVKGEVIVRGYSVMRCYWNSEEQTKKEITQDRWYHTGDIAVMHDNGTISIVGRSKDMIVRGGENIYPTEVEQFLFKHQSVEDVHIVGVPDERFGEVVCAWVRLHESAEGKTTEEDIKAWCKGKIAHFKIPRYILFKKEYEFPLTVTGKVKKFEIREMSKIELGLQQVVSHFSEL

SEQ ID NO: 6362 - protein, 1475 aa, Caenorhabditis elegans
MDESPIFDNENKRSAGNKRQQTESPFSAATPKSRLGREPKRIFGTSSGNMADSNLEETCLEHDSRPSSASSITPADNTSLLDLSTVTALATDDASFVGTNDASITPGSNVDVNLEQSELYDTSNCTSNLSMVQESDETDADATLSNDFDNQLALDGETTPTASRTPMSQILSRECTPTVSNPQLLTEIAKGVDQPTKPVRDVPQSPVLPVKGHIDFSLHEFEMLEQNSEHEESIKLLQSQIELLRQSHSQQLSEIQEARIFEEKMLTQQVDSAMKKAKSDREAAKAREQVLEKQVQELRLKLEEPDEEKNQLVHNLAALNAQIEELTQKALKVDSMQQGATASEDRIRELIGGHQEAIKQLENTKQMNESLQRDLVEKEARFSEEMERIRTESQTTSESLKYEHELVRKMMIEDMEKLEAEVLALKSQQANLEIQEFHDKIKQLELEVQLSSENKEKLQAELMVVQEKASENIKNAEEKVNGLEAEVEKLRFEATNNSRVVELEQQLEEFRSLMIKEISDLENQLEAAKLESGSTSEPNAQLEASQATIQELTSEMKMQLEEVKRQSDENNSLNVHLTSSNEKIAELTSSLEMVAAQLLSSQQETDVAVTKVENLELKMEEAHRMYLLDIELSRVKIDELQSSIEVLSKLEREVQSSNLQNEELKLSLRNFEELQADLAMSKAKNEELEQQIEDSSREFSVITEASKEMKLKWDSSEAQMSEMIASLAAFQEEMQSTQADAVASEDKVKQVESLLENLKEPLEELNNLRANLKDSNDKILDLQSQLELAQQSSDLADRLQEDLRTSDARVQELNIQVSELEQQIEVSSREFSVITEANKEMQLKLDSSEAQISEMTASLTAFQEEMQSTRADAVASEDKVKELESLLENLKEPLEELNNLRANLKDSNGKVLELQSQLDLAQQFSDLTDRLQEDLRTSDARVQELNVQVSDLQSELETARQDTNAVQVVMEALKSEQGESYEALRAELDAAVQEKGRSSDLVTSLEGKIQELETAIESSTAENVQKSKTIQDFTDKVSLLESQICELKSQNEQMEIDTNLNMDQLSEMSSQLESANAELIELTRTSAETIDKLRGEVEKSTKAMMDQEEHLAELVAKIESRDVENADQAAKHKEEQERLQSVIDTLRTSQSTIEESQAKSEELNSRIKELQASIEFAQKALADTENAKQEKVEELEKVQEQMLNLVQAFEVEKASIRLEWNSSLSNANEKLEAAEEALSQKENTIVTLESRIETISQQFEARLEEANVWKSQAMQLGTLTQSLSQMQRQLGEMHEKMEASDRRVIEVEEQAQHDITLIQVENKEQSEALEQAHSRILELEEKLVRAEIEIQRLEKVCDAFDDDEREYKDKIMTLQSEIKQLKGVKTPPRVMGLIEQARLGVKQLSRESSLVEPQNSAHEDAFEDAQNSFQDRLQTMSNTTARQIDASNHHPEDHVLEKSARETPSKKNRSNCQHQ

SEQ ID NO: 6363 - protein, 335 aa, Caenorhabditis elegans
MKYLILAALVAVTAGLVIPLVPKTQEAITEYVNSKQSLWKAEIPKDITIEQVKKRLMRTEFVAPHTPDVEVVKHDINEDTIPATFDARTQWPNCMSINNIRDQSDCGSCWAFAAAEAASDRFCIASNGAVNTLLSAEDVLSCCSNCGYGCEGGYPINAWKYLVKSGFCTGGSYEAQFGCKPYSLAPCGETVGNVTWPSCPDDGYDTPACVNKCTNKNYNVAYTADKHFGSTAYAVGKKVSQIQAEIIAHGPVEAAFTVYEDFYQYKTGVYVHTTGQELGGHAIRILGWGTDNGTPYWLVANSWNVNWGENGYFRIIRGTNECGIEHAVVGGVPKV

SEQ ID NO: 6364 - protein, 109 aa, Caenorhabditis elegans
MDAQGDAGAQGGSQGGPRPSNKRLQQTQAQVDEVVGIMKVNVEKVLERDQKLSQLDDRADALQEGASQFEKSAATLKRKYWWKNIKMMIIMCAIVVILIIIIVLWAGGK

SEQ ID NO: 6365 - protein, 431 aa, Caenorhabditis elegans
MVYIHGGGYECSASRDYCDYSVAGTLPLKDVVVVTLNYRVGILGFFTTGDTVCPGNFALWDLTLGLNWIQKHIESFGGDPGNITIFGQSAGAACVDLLALSPHSRDLFNRVIVMSGGALCEYAVRTANSQAKVCYEFARHLGYDGTNSQTLFNWMKSKPLEEIEKMNGFQVPASGILAWTPNLDDDFFPKSLDELRIGAPKKDIMMGFAEHEGLFFEFLIKDPTPPLEALKLYVNEYYKKDTGDHFEATRNKIIEFYSRNVEDTDEKSTKERLIDFVGDALFTAGVFDNAKNCLKHGNNVWLYIFDYCNPSGFGNQEEFMTFVAPTHCTDLRYVLGEGLYSDFQPTEEEHKMIEKMTTIYSNFAKYGNPNEHGSSEWEKFTLDNPRRHFQISYPRGKMRNDYHPDRMKFLELIRAKNQNLENVVYGRGLNS

SEQ ID NO: 6366 - protein, 547 aa, Caenorhabditis elegans
MGGHLSHLKPKPLLNVLNSTCGPVQGNLYRHVRIPRNHYFFISKNKVFKGNEEVHGYLGIPYAQPPIGILRFKKPVSADVWTETRDCTKYGPRCPPSGMLYENLQLPNTDIPDEANCLSLNVFCPQWEIKQSAKHPVMIFIHGGGFELSASKDYCDYSLSGTLPLKDVIVVTVNYRVGALGFLTTGDDSCRGNFGLWDLTLALKWVSTHISSFGGDPKNVTLFGQSAGAVYLFHKLIIMSGSAHVPFAIRTEENQALVCMEYARSRGFSGSGSAELLEFFENLPIEKLLEKTGLKHTVSIDLSFAPNLDGDFFPKPLEELRRETRKKPVIVGMMEDEGLITAFADGDFTTCEENFKRRVESEYRGDVVENPENVQKNIMNFYTNYCDESEERKLVDYIGHSVYNAGVLLSAESLARAGNCVYFYVFDFWNPDGFGPVGSIVPFKGAAHCSELRYIIGEGVYSKFDANEKDLKMMEYMTTMFTNFAKYGNPNIPGVTNWETYTEGSRHFHIDSTDSEMKDSFQENRCQFLKQIQEQSKRYQHIFYGKK

SEQ ID NO: 6367 - protein, 565 aa, Caenorhabditis elegans
MGGYLSYLKPEPLGTVLNTSCGPVLGNLYRHGDKEVHGYLGMPYAKPPTGEMRFAKPVPADDWTETRDCTKYGPRCPPSGQGLEKGMFVNPDEPDEANGLSVNVFVPGWESSEYKNARPVMVYVHGGGFEISSSREFCDYSISSTLPMKDVILVTMNYRLGILGFFTTGDEVCPGNFGLWDQTLALQWVQKHIASFGGDPNNVTLFGQSAGGACVDLLTLSPHSRGDITIEIMIKNYIYLDLFQKVVPMSGSAMCEFAMRTAENEAHVFDDILARLGFTGSGSKERLEFMRSLPCDKITGKTGYTYKQSGFMSLCPNYDGDFFPKPLDELRKDASKRILMTGIVGNEGLLFAFDRNTPYKDYTDLLRLKIEEDYKEDVVDDVEGIRKEIFEYYTKNISEGDEEAIMRKAAEFVGDSIFHTGVRATAQNAAEHGDEVWLYNFDYCNPDGFAPLKGYLPYIEPTHGMELRYLFGDGIISKFEPTEEELKMLDKFTTMFANFAKYGNPNETGSSAWEKFDPARPGRHYRISYPNSGMEDEFSGGRWKFLEEIRKKNKSFQQNVYGKKI

SEQ ID NO: 6368 - protein, 479 aa, Caenorhabditis elegans
MSIISNKYRVLVVFIGFLCLVSVCSNYVVMNFTFICMKNDMSFTRDDRGNETSPVSLFDYTPNEKKYIMWAVAAGTIIGTFPVNYVFVRFGGRWTFFLAGVISVIATTLIPLAAQTSFHALLAARFCQGLAFAADFAAIGLLTVRWAPLSETAIFLGALTSFTNFSSVLTNAVSGAICEGFGWRTAFYAHAVMGSVFFILWAIVYNDDPEKKVSADELRKIRKNKSEQHLKTKNVEVPYRKLLTSPIVLCVWLNAFAEMSIIVFLHTYAPIFFNRILKFSVAQTGFLLALSVFIPLPLKLVGGIISDKAKCFSERGKMLFFNTISVGLVGVLLGCLGFIPQSLHYVSVVLFSVIFSCLCLNVAGFYKCATLHTRQFAHVVISTIQWMKSVALITGPALVAAIVKNEESVGQWRTVLCILGGIMFVVSFSNKYFENNDIQKKLTIANILALCVFTDKPAEYTMADANEKTVKYEVNAEEP

SEQ ID NO: 6369 - protein, 452 aa, Caenorhabditis elegans
MLGRRAVSVHRFLSRAARQSVTAASSAQPSLQAKTSLLEPLVQNVRITSSANFHMSAVRMSDVITVEGPAFAESISEGDIRWLKQKGDHVNEDELVAEIETDKTSVEVPAPQAGTIVEFLVEDGAKVTAKQKLYKLQPGAGGGSSSAPAKEEPKSAPAKEESKPAPAKEDSKPAVTAAAPPKPVSGDIPKSAPPVARPPSTPSSSTPVGAVPVTRVVVPKGVDPSHAITGARDEVRVKANRMRMRIAQRLKDAQNTYAMLTTFNEIDMSSLIEMRKTYQKDFVAKHGVKLGMMSPFVRAAAYALQESPVVNAVLDENEIVYRHFVDISVAVATPKGLVVPVLRNVESMNYAQIELELANLGVKARDGKLAVEDMEGGTFTISNGGVFGSMFGTPIINPPQSAILGMHGPEIRPIMQIALTYDHRLIDGREAVTFLKKIKTAVEDPRIMFMNL

SEQ ID NO: 6370 - protein, 361 aa, Caenorhabditis elegans
MLTSAFNCTQFTVPYPEPGTDEAGNSTIPWLMTTVSIPAVSLLYIHFLSCFAFFANIMIVKVLSHKEMIRSGVNVTMLLIAVCDFGCSIAELLKLFLWSYSDKYISYPTAYGRLVIYYLAAAFHASSLYLAVGMAFCRVKSLNFANRNNDLWQSPNYAVRVACALCAPVFLITTFILFMNVVKNTEEEGIHLDISDLSLFSECLFLKIYFIARNTIFPIAPCVLMLILSFTLLKKFDEGKRSAQNAAASQKGKKDKIDRSSRFIQFVLVIFLITESPQGVFKILSGIMMIDYINYFQNLTIFINILAFFNSTTSFIIYSSLSAKFRKIFAQLFFPTHILETIYLKRSTNVVHSVAHASRPF

SEQ ID NO: 6371 - protein, 355 aa, Caenorhabditis elegans
MVDELNCTQFSIPFPNPGTDEANNISLIRFIIFAVEHYRPYHYYLLSSLIVFSFFANILIVIVLSHKEMRHSGINVIMMFIAVSDFGCAVTGLMQLFIRNYSDQYMLFITAYLQLFVDYLAVVFHASSLFLAAGMALCRVMALNFSNRLKDKWQSPRYALRVTCAVYITVLTVSTLIVPVNEVKKTDDGEVYIDTSDFSLAYGCLLMKIVLVFVGICFKLIPCTLMLILSILLLQKMDEGKRSSVPINRNHKKRVDQLDRSSQLIQTILIVFLITEVPQGVFSIIGGIEVIDYLNYYQNLTIFMNVLSFFNTTTSFIIYSSLSAKFRRIFAQTFLPKNLLNMYMVTVAHFSKINF

SEQ ID NO: 6372 - protein, 491 aa, Caenorhabditis elegans
MEVFKQNLKKKLTQPNSPREHSFPGEPANDTISQLVLRRLFDDNYNKNTVPLKTSATVVSVEFGIQNIAQVSEISASFTLDLLFSQIWHDPRLRFDHLTNCLQNLTLGYSMVEKLWTPNVCFVNSKKTEIHSSPTPNIFLMIYPNGTVWVNYRLQVQSPCMVDLVLFPMDIMNCELIIESYAYNAAKVKLNWREWQPVFSIAKSKLSDFTLYGLQWTKNSFEYAAGQWDQVSSFCSLNCFSKMDGFQLTVSLTFSRAYGFYILQMYIPTYSSVFLSFVSFWIDLKALPARITLGVSSLMALTFQYGNVAKNLPRVGYVKSIDVYMVLTTAFIFLTMIEVAFVCYLDSENNLRRKERQAEKKKERVAVLQRKKDRKKNNYGATTVTNANAAESDLRSNYDEPFSQNGTTSHKISISRQANNMFESLHALAQFGLLTDDDDENTKWTAQNVDKFCRKAFPLSFCFLNLIYWCYYLYQNYLAKAEALAQMTPPS

SEQ ID NO: 6373 - protein, 381 aa, Caenorhabditis elegans
MGVCQSFVLTDEMKDQIKVNKEIEKQLEKKKNMQLEQTVLLLGPGESGKSTVMKQMRAMTGNYTKTELHERKVLIIQNLCQFSEMLLEYVREYILEMTEDDDKRYTVMCEELKMAVIHDGIMRPELADTLKEFWGNSAIQDAYSKRDTFHLTDSAKKMFQLIQKHVSKMSEMFLKIFFYVTHFFDNIDRIKLPGFEPTNQDIVHIRVPTTGVAQVEVIMNNIKLMICDCGGQRSERRKWYHFFDEADAVLFVAAISEFDQKLAEDEETNRMHESIRLFWTVFNGKFFKKAAVILFLNKIDLFEEKVKHVKIKDYFPKFEGANTVSEGTKFFRRQFREGIHPDFKKRMYTHETCAISDQVQIIINTVIDTVIQDNLKDTGMI

SEQ ID NO: 6374 - protein, 2326 aa, Caenorhabditis elegans
MSSVDDEHHPSIEVDIPDVYESASDCEKTEDCTYLGSILKAKKSLRKTKKVASPGIYPGSAGALSSLSNGLADENRSPTSAEVSDSVCGQKSINSVDLRFRGLRDERELVQKKTFTKWVNSHLVRVSCKVQDLYMDMRDGKMLLRLLAVLSGERLPKPTPGKMRIHCLENVEKGLQFLRNQHVHLENLGSHDIVDGNSRLTLGLIWTIILRFQIQDITFEDADNHETRSAKEALLLWCQMKTAGYPNVNVKNFSTSWRDGLAFNALIHKHRPDLVDYDNLQKSNALYNLQSAFDTAENQLGLAKFLDAEDVNVDQPDEKSIITYVVTYYHYFNKLKQDNIQGKRIGKVINELMENDKMINRYETLSSDLLEWINAKIQLLNERHFENNLEGVQRQLTEFNDYRTQEKPPKFDEKGELEVLLFTLQSAMRANNQRPFVPREGKLIADINRAWQSLEKAEHERELVLKEELIRQEKLEQLAARFNRKAEMRETWLTENQRLVSQDNFGNDLSSVEAATKKHEAIETDIFAYEERVQAVVAVAGELEAENYHDQAKINERKENVLQLWNYLFQLLLARRVRLELSMAIQKIFHDMLLTLDLMDDIKSRLLSEDLGAHLMDVEDLLQKHALLESDINIIGERVNNSIAQAQRFRNPDGPDGSGYKPVEPGTIDERSDVLQKRYKELLDLAAERKRRLEDNKRLCQFWWDVAELEHGIKEQEQVLSSTDTGRDIVTVSHLLAKHKNAENNLRDLEKYLDRLDVSGKELQDESIPGSDNIPPRLAEIRDYINKLKELSASRKERLAGGVEYYQFFTDADDVDRYLYDTLRVMSSEDVGKDEGTVQLLLKKHDDVHDELQNFDQHIKVLHAKAESLPQEAREHPDIRQRLDTTLKQKAELENLSQLRKQRLIDALSLYKLYSDADSVESWIDEKGKLLATLVPGRDIEEVEIMKHRFDTLEQDMKNQEAKVTNVNDLARQLLNVEHPNSDDILHRQNKLNARWAQLRDMVDQKRNELERAHRLETFRIDCQETVTWIEDKTRVLEDSDALTNDLSGVMKLQRRLSMMERDLGAIQAKLDSLHKEADDIERERPQEAQAIREDIKRIHQVWDILNKKVREHEAKLDEAGDLQRFLRDLDHFQAWLTATQRQVASEEEPQSLAEAEQLLNQHAAIREEIDGYAEDYKKMRAMGDRVTQDQTDPQYMFLRQRLAGLQEGWEELQRMWDNRQHLLSQGLNLQMFLRDAKQAEVMLSQQENYLAKDDIPQSLEQAENQLKRHQDFITTMDANDEKIRAVGMFGDQLCQDGHYAADKIHKKARNIDERRGANREKAQEVLKKLKDALSLQQFLSDCDELREWIEEKMIRAQDETYRDAKTITSKFVRHQAFQSELAANKERLDQLKHAAINLGDDKPEYHGTIDPQIEELATQWDELEKTTEEKGQKLFDANRQQLYVQSIADMKEWATQLENEMTREDQPGDLTTVNVAMQKQHLIETEMIKKAQHIDQLMEMEPQLEELHPDELENIKAHRLAVQEQLQRLQAPLDDRRKALERKKAAFQFGRDVDDEKLWISERLVLAKAQNLGESLPDCHRLQKNLQLLSNEIDNHEPWINQICNNGQELIDEGHANGPAFEKKIQELRSAWQELKEAVKDRKGDLGESEKAHQFLYDCGEAEAWMSEQELYMMQDERGKDEFSTKNQIKKHERLQSDIDKFADTIRALATKAHKFVEEKSPLTEQIQVRQAQIEKLYAGLQDLSKERRKRLEETLELYALHREIDDLLQWIADKEVVAGSQENGQDYEHVQMLQERFQQFARDTENIGSERVANANDGCDTLIGHGHTDAPTIALWKDSLNEAWENLLELMDTRAQILEASRLLHKFYHDCRDCLSRIMEKTHAMPDDLGRDSSSVGALSRKHQNYLKDIAAIGEQVAQIERDAAELRDGYAGDKALDIGSRESEVVKAWRHLRGLCDARTSRLMDTSDLFKFMNMVRDLLLWMDEVKREMNSQERPKDVSGVELLMNNHQSLKAEIDAREENFNACISLGRDLLNRKHYASSEIEKKLIKLTTERAEMMRRWEDRWEYLQLILEVYQFARDAAVAESWLFAQEPYLISKEYGRNLEETIKLIKKHEAFEKSAFAQEERFLALEKLTTFELKETQHREEETAKRRGPAHIGSPSRSTPAAETSFGAQDDGAKQGEAFEGTLIRKHTYESLDRKAANRSWEKLYAVLRQNELSFYKDPKHRDESVHGEPPMALPGCSVNVASDYQKKKNVLSLRLPIGAEYLFQCGSEEDMQRWLTELQVATGQAQLEEASRSQTLPAEGSATKKKGGFFSRGKK

SEQ ID NO: 6375 - protein, 308 aa, Caenorhabditis elegans
MTAAPTIIQLSNGDRVNRFTVFKKLGEGTFGAVYAVRDDAGAEHALKAELATEKIPLLKLELYVMQKLSMKGPKHMATLIDKGRHENFNYIVMKFLGKSLQDAKKTGPDGHLTLGSAIGASIQCLEALEELHWCGFLHRDVKPGNFCLGRAELGELRKIFVLDFGLCRKFVDDRNVMLQPRRKAPYRGTPRYAPIASHNRAEHGRKDDVESWFYMLVDFTNAALPWKVVNEIPQVGEMKKNSRFDPLVTQLLAGCPVDEYRLIMNHIDGLSFFMEPNYGLIYSTLKRLMQTRNIQEFPYDWEAEYAVK

SEQ ID NO: 6376 - protein, 422 aa, Caenorhabditis elegans
MISQFEIIGDNKIGVLPKQVDQLQMCRDIAASKDLQENDSSFMLVDLDKIIERFQLWKRELPMIEPFYAVKCNTDLVLIRILASLGCGFDCASKDEIDIVMGTGVSAERIIYANPCKTRSFIAHAMDRDVKMMTFDNPEELLKIAKLHPNAEMILRIAVSDPTATCPLNLKFGADPIIAAPQLLKTASEEGINVVGISFHVGSGCNDASAYRNALQHAKNLCEIGEGLGFKMDIIDMGGGFPGAEHHNPFEKIAETIRDALDEFFPDTNKRLIAEPGRFFAAGPFSLVANIIHATEVPASKITKDPKDCADHGYMYYINDGVYGSFNCILFDHAHPIGSPLFDTDRNEKFMSTIWGPTCDSLDLVEDKKLMPKMNVGEWLYYPDMGAYTLAAATTFNGFSKPVPMYVMSEEMWESIRDSTHV

SEQ ID NO: 6377 - protein, 5107 aa, Caenorhabditis elegans
MYLACLSSCSSNDKLAFDVGVQETNEGEACWWTIHPASKQRSEGEKVRVGDDVILVSVATERYLHLKKGKTEEEASLMLLFCGRNVLLLFHQHMAYSKGYMVIASFHQTLWNIQSVSSGSMRTRNMGFLFGNDVLRLFHGNDECLTIPENWSEHPQHNMVIYEGGAAVTQARSLWRVELIRMKWHGALVGWEQVFRIKHITSGRYLGVLDNSVQLYHKEKADFDLTAFVMCQNKDPKKQMLDEKEEEGMGNATIRYGETNAFIQHVKTQLWLSYQTTEVTKKGLGKVEEKKAVALKDGHMDDCYTFFMALEEESKSARVIRKCSSVLNKFLKGIDALQLEGNQSTDWTRVDLNEVLKLMEDLIEYFAQPNDEQDFEEKQNHLRALRSRQDLFQEEGVLNMILDTIDKFSQMEALPDFAGLIGEETHVKWEQISTYLYLLVAAMIKGNHYNCAQFASAQRLDWLFGRLSNPQSAEGILDVLYCVLTESPEALNMINEGHIRSVISLLEKVGRDPKVLDVLSSLCEGNGMAVRSSQNLITQYLLPGKDLLLQTSMRDHVSSMMPNVMLGVVEGSALFRKWYFEAEVEHIETMTKQTPYLRIGWANSVGFKPFPGSGDKMGCNGVGDDFYSYGFDGKSMYFGGKSRRVGHKLLEKGDVIGCSIDLTIPEIKFSVNGTYMSGSFKKFNIDGYFFPVMSLSAKVSCRFILGGNQGRLRYGPPTGFSAVVEAVNGELQITDCLSFGDLGKNIFSGPQTIFNNLEPFIPTPIDVSATQLNHHATEMHQKYAENLHELWAMRKIELGWSYGETRSETSRKHPCLTKFEYLPETEKKYNILLALTTMKTIEALGYHLITEDPPCRLRAVRLGPNFQQQNGYKPGPLDTHEIQLPAELQPLTEALARNTHNIWAKEKIKRGWTFGLSEHVDATQKRSPHLVPYEQVDERIKQANRESAAENIRALQLFGIFLEPPAHEHDEVAEKELRARKDNTRTYRAEATYAVCGGKWYFEFEILTAGYMKIGWMDIGSTPEIQLGADDRSYAFDGYLGRKWHQGAETYGKEWKIGDVVGCFLDLNDRTISFSLNGELLLDPSGSEMAFDNVVCGDGLVPAMTLGSGQRGRLNFGQQSNSLKFFTTCGLQEGYEPFCVNMYRTMPMWFAKQLPRFEDISTLKSGSILEVSRIPATGNSPPCLKILQKVTISEGGPSEKAKMEYIKLSLPVKCNDTFVKNKDKETIRRQLQEYKPRSQSVVSQIRAPGIPKEFDDNKEKKGFLRSMLGSKDSHESDDDRRSRTNSKQPSVDGDEPPAVRRSLLELPHDERQIAEDSMRDLNDRHSEKPKKGGLLSRLRDSSNTRKNFRDSDRRKEEKAAQLRQMKANSRSFDAGSLDTSTLPTGQKDVLASSEMPLSGPGRQLTIKRSSIKKNKKGKKAEIALEKMEREKKGSIIPMDAQLDVLQEGDAHALVHHKDKVDEYYYGIRIFPGQDPSQVWVGWVTTQYHYYNVNFDGSQGVRKCRFSEADHHGTTVDSVQSQNCYMVNVSELLATTPDVANTKVSGTLIGCIIDTSIGELSFQVGSTDTGIKFKLEPGAMLFPAAFVTPTATEILQFELGRIKYTFPLSAAMFKSCEKSLVPFCPPRLTVEQIESVYWARVPNETLRTTALKLSEVRGWSVLCNDPVRIMSVYIPEKDQSLDILEMIEMPDMLEFHRQTLNLYCKLASHGNHKVAHTLCQHIDEDQIMYAIKSHYLSGPMRQGFHDLLIGLHLMSHTAARNSMAKEYVIPLVPQLQIKNVLDPDSESRYPQITGESVSMLSQMASEPVKKHVSREDEMKLLPPSVDFEALKKHVMESLQSATHHAVMNCRDLIGGDNTNHFEPLFKLFDQLLVIGLINDEELECLLRLIHPQAFDENYETGTTQKGLTQLELAEPVKIQLVSILDHLCDIQLRYRIESLVAFTEGFVGELQSDQCKRYMEIKQTDMPPAEAAKKTKEFRCPPKEQMFRLLMCKVKEERDPELMEEDADVDQCPMAEGLQQQLRDFCELLVGKIGNVKEGDSDDQLALIESEEGSWVDSFARIVVKVPPPVLEEGMEMQKKGTQNFREIIVTMLREWAQADFIESKSLIRNMFRLLLRQYSGIREIRDAMSQTYVFHERNEKDVTDFLVYLIQIRELLTVQFEHTEEAILKRGLWKLMNNRIFFQHPDLMRLLSVHENVMSIMMNILTAQQGTVEHEGDELKEKAPIKDASEMVVACSRFLCYFCRTSRQNQKAMFEHLSFLLDNATMLLARPSLRGSVPLDVAYSSFMDNNELALALKEEELDKVAVYLSRCGLQPNSELITKGYPDIGWDPVEGERYIDFLRFCVWINGENVEENANLVIRLLIRRPECLGVALKGEGQGLFSAFKEAIALSEDIRLLENDSHPSLLSSGLLGENPTYPSKDAEGEDYIDLGAATLDFYSSLVDLLAKCAPDPMAIQAGKGDSLRARAILRSLISLDDLGQILALRFTIPNLAAPSIEAVRRANAVQASHTQKAVMAHTFAMVASLASEVSNTRRSQTFTSGTNLAKRGLPCVEEVDTDDSKSSDYASVHTSFSSGNELFAPKAEKEKVDVLKLNENKYPIIQRRRSSRFNPIDNTGPLPGLLPNHKGSVLLFLDRVYGIDQQDMLFHVLEQSFLPDLRAATMMDSPRALESDTALALNRYLCNSVLPLLTNHSHFFADAEHHSALLDATLHTVYRMNRLKSLTKNQRDAVSDFLVAITRELPPAMMIKLLKKVITDILTMNDMNVLVPLRLITLHYERCGKYYGSGNHYGVASEQEKRLSMLLFDAIFDTLGSRPYDPELFGKALPCMTAIGSAISPDYTLTSGLEDVRNKRREEEGAWIPRTVDVSRCEINRDLEKMTELFAEHFHDSWASRKLEKGWVHGDLYSRANFTHPRLKPFALLKDFEKSFYKERCSECLKALMAWNYSFEMMDRDANDRASAARTLSGTSISNFAPKPIDLSSMTLEKDMVNAAEKMAEHSHLIWAKKVMNDLNTKGGFMPIPLVPWDLLTDFERRKDRFRASEILKFLQYHGYHVNCPKDEQSQNDRLKSEGERTSVEKRFAYNLLEKLITYLEQASLKMKSVKPSQELTRRNSFKKEGQDVKFFEKVVLPLMHAYFNAHKNYFLEGSSIVQTGTASNKEKEMVANLFCRLAALLRIKNRAFGSVAKITVKCLQGLTQALDLRTLVKVNSDIVRTSLLTFFNNCADDLYASVNELKDGGQYSLIRGQALKSWNSFEFANQMIVPVLTTIDQLKNLSVDDIQAACYKILDSLYMVTGLSSSISHRKSISGESEKHRPGLGQCLAAFASCFPVAFLEPEFNKSNKFSVLAKSQDQSVQVQEMLQNLSTHIPHLEKLLTDLETVANNNTMYSDVPNVYDVDLPLMCSYMAHWFSVGPDGKRDKEDQRASVVQTTSVSCDHINRIFNALLKMIRNHVGIENAPWLCRVNFFAVQIIQNVTSDPVREFVLPIAERLRRMSEKAYKEEEHMRTHPDDADEGTVAEDNARLVRDTYAFFPILMKYTDLHRAQWLKTPTWETDGVYENVAVIFRIWSQSQHFKREELNYVAQFEEDAAATGGGDMKTGKAAIAERKKKRREGQDKMKEYFDRNGRPIIKKDKHAASIVIACLKRLLPVGLNVFGGRELDIVQQSKEKFIQKETEEKIREFIKGLLEIPVKTDPTDKNAWQLSLYRKIGKSQMRGKDEMSQDAVIEKIFNMGQVSAILHTTEHPQMQLSQAWKKVVSTQRKRAVVACFRMVPLYGIPRHRGINFFLPAFSRLWMEEEDAGQDQLIADICSGVEEEEGPRIEIIMEEGVPIVASSEDTKEKETNPDPLKQLIRCFQRAATSEETAASAIHEDSLYIRFADVMAKSIHIEEEDGEDGEEGEIDQAAKEEQSQALRGEQAVLASRGAAIMCLMYLSASGGEPNEMVAQTLQLGIHLLSGGNVEIQKMLIEYLQLKKDVRFFTSMAGLMNKCSVLNLEMFERQIKVPTDTAEGLGMGAELASGDNQNLNDADFTCSLFRFLQLTCEGHNLEFQNYLRTQPGHTTSVNLINCTVDYLLRLQESVMDFYWHYSSKEVIDEGGKEYFLRAIQVCSQVFNTLTESIQGPCVGNQMTLANSRLWDAINGFFFLFAHMMEKLYKNSTQLELLREFLNLQKDMIVLMLSMLEGNVLNGSIGKQMVDALVESQPSVEKILKFSDMFLKLKDLTTSQAFQDFDTNQDGWISPKEFQRAMESQKMYTVEDITYLMMCTDVNNDGKVDYMEFTERFHNPARDIGFNLAVLLVNLKEHITNDPRLEKIIEKAQTLLEYFDPFLGRIEIMGSSKRVEKIYFEIQESWLEQWGKQQIRDSKNSFLFNVLQDDGGDQGKLEAFINFCEDTIFEMQHAAAISSGDSDTKMERAIKQRDYFLQQTSADHISETFKSGYNYGISAASALSPQNISTTMRNVSSSVRQMSWTQLLYAVIILFIRAGLAIGWAGYLLLMTIFRFGYFLTTSSEEEEAARQEKEQAKMNNEHPSFNPPIIQEFHHSHVGVTAFGVGMNADHLNVNSLPDFVPPERPETPETVLEEEKPLNQETSPPTSPTSPASKAPSIYESIGAPQMVQLQSEADFQQGQYEPKIAESNSTKSRGSILNMLARNFKTIEKITLYLAFFINVILLFHRVDISHAENAEAASEGDDDEDALESIFITGMQFPYVEYEITGWMLAQILYWISVLHLSTSFALLVSFYQLKIPLITFKREKEIARKLMFDGCWITEEDSEELGIVDTFMWYLDRIVVSAKSFPMMYWDKFVRRKTRSKFKDQVDEETLTSILGEEKMSTDSSYDYRYSCWLWIGVILTNGQFLYRVGYLLCSACGVFLSPFFYAFHLIDVVLSFPMLKAILQSVTHNLQQLILTIMMTLVVVYLYTVIAFNFFRKFYVQEGEEGEEPDRKCHNMLTCFIYHFYAGVRAGGGIGDELESPYGDDLEYPRMFYDISFFFFVIIILLAIMQGLIIDAFGELRDQQESATEKLESSCFICDIGKETFDRMPRGFEIHTTKEHNFANYLFFLQHLVNKDETEYTGQETYVREKYDNRDWDFFPVGECFVKQYEDQLLQS

SEQ ID NO: 6378 - protein, 338 aa, Caenorhabditis elegans
MTVKTRASIAKKIEKDGLDSQYLFMDPNEVLQVQEESKKIPYKMEIVWRNVALFAALHVAAAIGLYELVFHAKWQTAVFSFALYVFSGFGITAGAHRLWSHKSYKATTPMRIFLMLLNNIALQNDIIEWARDHRCHHKWTDTDADPHNTTRGFFFTHMGWLLVRKHPQVKEHGGKLDLSDLFSDPVLVFQRKHYFPLVILFCFILPTIIPVYFWKETAFIAFYVAGTFRYCFTLHATWCINSAAHYFGWKPYDTSVSAVENVFTTVVAVGEGGHNFHHTFPQDYRASEYSLIYNWTRVLIDTAAVLGLVYDRKTIADEFISRQVANHGSEESRKKSIM

SEQ ID NO: 6379 - protein, 352 aa, Caenorhabditis elegans
MGSVREYYLTNYTKCPRCDTFLCTWQEVAYTFHSITIFSLPFYIFGGYCILYKTPKEMKMYSRTCLVDIFLNVLATPYLFFPTLSGFSVGLLNFLRVPPKIQVWLVFQSLNWMLFSMTMLLENRHNSILFNRFQITKNRTKIIYYLVRYLSGLIYSMSLLFFIPEDQNSALLQVLTKIPCPSQEFFTASDVFVLCIDENYVTFLALFTGIGVLTEIAQIVFFLACCVYYLFVSVRSFASKKTRQMQVKYFASIILQISIPMGFMMPTVLYIFLSLSYKFYNQALTNLSILHASLHDLLSTFMVLLIHAPYRHFIFSFFKKLDTSVSTSEVRDESVMATQITIKQVSMSPVTN

SEQ ID NO: 6380 - protein, 601 aa, Caenorhabditis elegans
MHHVLCATLFIVIINVHLTSTQLNIRKIQHNDNTRRQQQRNRKSEPYDQYSHLTDTGEVSDQLKYYTHSFEQKVRETVRDEEYMLKNLWYDPEYVIHDLCEPHKSGGQTGELKWSESGDRLLKVIGNGVVEDGYNMFMAPGQSQGKRTDVHVAVYIESMSSFKAQSMDFEVDMYLAMGWFDRRLAHNCTHPILVTSKPEDACYYSYQHLLSPNILFQYFQLIADRIWYPDLYFVNSKYAYLQEVTTPNLMVIVYPDGLIFKTMRLDVTLSCMMDLKLFPLDYQECPLTIQSFAYIEQIVNLTWRDDPPNFPIGFNPDIKLNDMQITNKRFVKCAGPYPMFRGEAAWSCIQGYIVMKRLVLFHIIQTYIPTEDQLIKIIDSFQKKTGMLVSISWMSFWLDPRASPARISLTITSLLTLTTMSNGARQDLPQVSYIKALDIWLTFSQALIFLVLLEYSFVSYYMTKRTTDCSHRNMFYEERVQECKREEKARKSIVNNNKPVIANNTEGSDLNRNKKSQQFSLTHGISACLNESSALMSVTPVPSRLFTKFDTNKPCARCSEKNERIAFKIDEYSRWLFPTVFSLFCVSYWLYFTWRSSASEG

SEQ ID NO: 6381 - protein, 261 aa, Caenorhabditis elegans
MLKSIIASALFAICWAANDRSWTTDEGVKIEIIKKIGDSKCKIKSESGDQLEQFYKLSDKEGKVIGSNFGQKPYTFTLGKGEVIHGMEIAMEGMCVGEQRKVIIPPEQGFDEDGDEVEGKGETLYYFVELKSIFRPKPGAKWITDEGVHIHITHEVEGCTEKAQAGDTLHQQYTLNLEDGSFIDSSWSRNRPFIFKMGSGQVIKGMDIAMEGMCQGEKRKVVIPPELAYGENGRPPAIPGNSYLHFDLSLEKLVRPGKEEL

SEQ ID NO: 6382 - protein, 417 aa, Caenorhabditis elegans
MHLLIFVLFYFFNSYSVTSSKVPVCTNEFTLINNKCLKLFTTPANHSAAEKTCRKYGATLVTVKNENDNHAISTFAGTSASLLWIGLYCFGNDPSKCLWDDSTGSADVYDNFASGFPLVDIGKCVYYSVQGALTGKWLTENCDLSSKAFMCELPTTFSDSCIYNYNGYCYDYYAEASFVVAQNTCEQFCGDLATIHTANENRYILTVAQHYPSSTIVRIGATWPASNVYQWVDGLPWEYKNIDLTGPRGGDCMVMSTRPPSPVAAGYWFGASCTDERNFICKRPAGLQCVGTPPSVTISPIQDNPSFCNSTNLLAPGVVTSPNFPRNYNNNAFCTYQLSTLGSYNILLRFAPFSLGTSDYVIVYDGESASSPVIGNYSGTLVPFSLISSSNNLLVVFNGNTGGQGFSARYTSYAPLI

SEQ ID NO: 6383 - protein, 303 aa, Caenorhabditis elegans
MYKLEFPLYVVISYIALAIIGILGNFTIILITITNKCLHSRCYILIALMACFNFVYCIYAAQLRVMILINESVMSSSTCFLISIYGIFAMNMQSLLALFIGIDRVYVIVYPGKYAKLSINYYYLMVTLCALISLLVTFCKFVFYSDEVVTNCLLSTALHGIPFKIWQFMNFFITVAVIFVYSLAHINFQTLKKSTVHMKTAKSVDRIMKSMLIVIAFYVCTWTLGLCGMFLSQFLQADDIHAFIIQKLSGWLVLSNSSLNVFIYFWRTPDYRKAILKLFGISKSVVDSRIHVSYMPNNPVAIF

SEQ ID NO: 6384 - protein, 329 aa, Caenorhabditis elegans
MALFLQSETDFGLSLLRQQNLTESFVFSPFSIALALSLVHVAAKGETRDEIRKALLNGATDEELEQHFSNISAGLLAAEKGTEIKKHLLKRLTISSVKIPKVTSKQLSTRTVSVNVYLVAVLTNALYFKANWQTKFKKESTYKREFFSSENSKRETEFLHSRNSNRKYSENGQFQVLSLPYKDTSFALSIFLPKTRFGLSEALQNLDSVTIQQLMSNTSNTLVNIAMPKWKIETALGLNRGLMAVGIEKAFTDSADLSNFADGIYISQAAHKALIEVDEDGTVAAAATTISSSVGSVQRTEKPIEFTADHPFLFILSKDNHPLFIGVHN

SEQ ID NO: 6385 - protein, 366 aa, Caenorhabditis elegans
MGLLLHSETDFGLSLLRQQNLTESFVFSPLSIALALSLVHVAAKGETRDEIRKALLNGATDEELEQHFSNISAGLLVAEKGTEVNVANHIFSRKTFTIKKLYLNDVKKLYNAGASQLNFEDQEASAEAINNFVSENTKGHIKKIINPDSISEELVAVLTNAFYFKANWQTKFKKESTYKREFFSSENSKRETEFLHSRNSNRKYSENGQFQVLSLPYKDTSFALSIFLPKTRFGLSEALQNLDSVTIQQLMSNTSNTLVNIAMPKWKIETALGLNRALMAVGIEKAFTDSADLSNFADGIYISQAAHKALIEVDEDGTVAAAATTISFSLTSVFIPAEEPIEFTADHPFLFILSKDNHPLFIGIHN

SEQ ID NO: 6386 - protein, 535 aa, Caenorhabditis elegans
MGQWKVMILICLYGAVKEFRPTEPYMYEYQHTVLNISEHTLNNVLLYKPILIIEALSYFACWMIFVFGRSVWCMQLLELFYGWATATEIAYFAYIYVKVPKEDYKSATAYTRAALLVGRFLAYTLAQLLIGLNWADYMTLNIINLVSMTFAVFLAAILPHVPWRNAYQKKLEDKKSVTDLESLVSEAKYSDYLKLFFVELHQNLYTIYKNPLVLKWSIWSALSSCIFYQIINYTQTLWGTLPEKENKYNGIPEALVPLLGIPADLITRQMNVNWNRWGDALISVGSLLQAGLLFWMSQSHEIIILYICYIIYRVIYQLTTTIAQSTLALTLDSRLFGLLFGINTFVALALQSILTAIVIDAEKLAIRAQVDFHLNKNILFGSFSVCEFGRAMGNAGKGKRPTEYNVEEDEFAPRHQREVDPEQEAQRQQVLGDRQRRMDRVAEPHWVHRMELEPTVSHWLDRKPLMYDFQFPCILQICLVPNAKKKLIDFEGICYILYGHLRCPTEECFFKDFQPFEISLSRRNVKINRDRLESK

SEQ ID NO: 6387 - protein, 155 aa, Caenorhabditis elegans
MSFPFSIFLLAFLLAPVAAIPCPTGFTRLVTTGQCLKMIVAPLSYSDASAKCKSLGAKVLTIQNAIQNNAVLSFATASATGNDKDYWLGLQCTTASSSSCNWADGSKFSFDGFAEGQPNNSLGTCVFVGNRGQTAGQWFSAECGLVKTNVICEVN

SEQ ID NO: 6388 - protein, 564 aa, Caenorhabditis elegans
MGGHLSHLEREENSEKLNASCGPIRGNAYRHNDKIVDGYLGIPYAKPPVGELRFKKPVPAAIWTETRNCTKYGPRCPQSGAFPEMINFQKEDIPDEANCLTLNVFAPRWESEEFKNKRPVMVYVHGGGFELSASRDYCDYSVSGTLPLKDVVVVTLNYRVGILGFFTTGDSACRGNFGLWDQTLALKWVQRHISSFGGDPQNVTVFGQSAGGVSVDMLSLSPHSRVMIRNLHKLNSSKLPDLFQKVVPMSGNALFEFACRSSKNAAKGCIEYIRHIGYSGSDNSNEILDWLRHKPIEEMEKLQGFQLPITGYFIYQPNIDGEFLPKPLDDLRRESPKKSMMIGVAEHEGLFFTFNDDKRPANRILQELIYVSFKEDTGKEFEDTRDKVYKYYTRGVDPTDEKKLKEKLVEFLGDFIFNGGAIATAQASLKYGNDVWFYVFDYTNPAGFGCLDEIMPFVGPTHCTDLRYLLGEGLYSDFKPDDTDWKMIDEMTTLYTNFAKYGNPNGNEGAGSWEPYTLVNPERHFRIGYPQGEMRNEYHKGRWEFMKGIRDRNNVLNEVVYGIL

SEQ ID NO: 6389 - protein, 360 aa, Caenorhabditis elegans
MLLLLSRVLVNVMVLMCFGGILTNFISFYIYTRKTFRKKSINVLLAALSMSDLCVCVLAIPVFASTQLQQVIPPTITAMIMVYLYPVTIMFQSVSVWLLVSITIDRYLAVCHPFMVNTYCTRNRALITVGVVVIFSVAYNLIRIWEYTINFDVAPENRTIEDLVVPKLRANPHFLLWYQNVATLVSQFAFPLTVLCVLNIQVARTIIEASEQRRELVASVKREHSTAKMMIMVVLVFLVCYIFSFILNIWEILDKETFGGDIGWFMNDINNVLIVVNSTSAIVFYYKYSTRFRNQARTLPGIRWYASMSKFNVYDTEATSNRTMVTRYKESMISIRGTSTRLSSSHNLLYKPSYSKPCDI

SEQ ID NO: 6390 - protein, 1140 aa, Caenorhabditis elegans
MAVSAMEVLSEAKRQFAQGDRIDVTLLDQVVEIMNRMSGKEQAEANQILMSLKEERDSWTKVDAILQYSQLNESKYFALQILETVIQHKWKSLPQVQREGIKSYIITKMFELSSDQSVMEQSQLLLHKLNLVLVQIVKQDWPKAWPTFITDIVDSSKNNETVCINNMNILSLLSEEVFDFGSQNLTQAKEQHLKQQFCGQFQEVFTLCVSILEKCPSNSMVQATLKTLQRFLTWIPVGYVFETNITELLSENFLSLEVYRVIALQCLTEISQIQVETNDPSYDEKLVKMFCSTMRHISQVLSLDLDLAAVYKDASDQDQKLISSLAQFLVAFIKEHVHLIEVTDEPLTEAKILMRESHDYAIQLLLKITLIEEMEVFKVCLDCWCWLTAELYRICPFIQPSTLYGMMSQVREHPRRQLYREYLSQLRSTMISRMAKPEEVLIVENDQGEVVREMVKDTDSIALYRNMRETLVYLTHLDNKDTEVKMTEKLASQVNGGEFSWKNLNRLCWAVGSISGTMVEEDEKRFLVLVIRDLLGLCEQKRGKDNKAVIASNIMYVVGQYPRFLRAHWKFLKTVINKLFEFMHETHEGVQDMACDTFIKISIKCKRHFVIVQPAENKPFVEEMLENLTGIICDLSHAQVHVFYEAVGHIISAQIDGNLQEDLIMKLMDIPNRTWNDIIAAASTNDSVLEEPEMVKSVLNILKTNVAACKSIGSSFVTQLGNIYSDLLSLYKILSEKVSRAVTTAGEEALKNPLVKTMRAVKREILILLSTFISKNGDAKLILDSIVPPLFDAVLFDYQKNVPQAREPKVLSLLSILVTQLGSLLCPQVPSILSAVFQCSIDMINKDMEAFPEHRTNFFELVLSLVQECFPVFMEMPPEDLGTVIDAVVWAFQHTMRNVAEIGLDILKELLARVSEQDDKIAQPFYKRYYIDLLKHVLAVACDSSQVHVAGLTYYAEVLCALFRAPEFSIKVPLNDANPSQPNIDYIYEHIGGNFQAHFDNMNHRSEFFTKNMKENKIKNRKIYSPNQGCRFLRKNCIAKMLIFSREKEQNSKKNLLFFVKFRIDQIRIIIKGFFSFNTEISSMRNHLRDFLIQIKEHNGEDTSDLYLEEREAEIQQAQQRKRDVPGILKPDEVEDEDMR

SEQ ID NO: 6391 - protein, 717 aa, Caenorhabditis elegans
MPAFFCLPMACQRQVDSIDRSQSNLQAIPSDIFRFRKLEDLNLTMNNIKELDHRLFSLRHLRILDVSDNELAVLPAEIGNLTQLIELNLNRNSIAKLPDTMQNCKLLTTLNLSSNPFTRLPETICECSSITILSLNETSLTLLPSNIGSLTNLRVLEARDNLLRTIPLSIVELRKLEELDLGQNELEALPAEIGKLTSLREFYVDINSLTSLPDSISGCRMLDQLDVSENQIIRLPENLGRMPNLTDLNISINEIIELPSSFGELKRLQMLKADRNSLHNLTSEIGKCQSLTELYLGQNFLTECFSWQNWTIDSESAKNFKNSAKIKIQKFNFFSIFRFQDLPDTIGDLRQLTTLNVDCNNLSDIPDTIGNCKSLTVLSLRQNILTELPMTIGKCENLTVLDVASNKLPHLPFTVKVLYKLQALWLSENQTQSILKLSETRDDRKGIKVVTCYLLPQVDAIDGEGRSGSAQHNTDRGAFLGGPKVHFHDQADTTFEENKEAEIHLGNFERHNTPHPKTPKHKKGSIDGHMLPHEIDQPRQLSLVSNHRTSTSSFGESSNSINRDLADIRFIDAPASAQNGVREATLSPEREERMATSLSSLSNLAAGTQNMHTIRIQKDDTGKLGLSFAGGTSNDPAPNSNGDSGLFVTKVTPGSAAYRCGLREGDKLIRANDVNMINASQDNAMEAIKKRETVELVVLRRSPSPVSRTSVSRPCEY

SEQ ID NO: 6392 - protein, 558 aa, Caenorhabditis elegans
MSRRTDSLCLDEYLSSELKKRTHILECAWNQEHDDDEEEEEVKVDQGSEETTSSHDIYGDVGKRAPNEFEKIDRLTTIKVYIAWLALFVFAHIREYVTRFGFVKDLSSKENAKMKDFVPLFSDFEAFYQRNCYIKVRDVFERPICSVPGATVDLVDRVSHDGNWTYEYPGTRTNVINVGSYNYLGFAQSAGPCAEQSASSIDREGLSCCTTVHERGRSVSQAKLEKLVAEFLGVEDAICFSMGFATNSMNAPCLVDKHSLIISDKYNHASLILGCRLSGASTKVFEHNDMESLERILRDAIAYGNPKTHRPYKKILIIVEGIYSMEGSICNLPGIIALKKKYQAYLYLDEAHSIGAMGKTGKGVVEYWGCDPKDVDILMGTFTKSFGAAGGYIAGSKRTVDHLRAASPTGYYSSPMSPPIAQQIYTSMSIIMGKDGTKDGAQRIERLARNSHYFRMKLKQNGFIVYGSNDSPVVPMLIYFPTMCGFYGREMLARNIGCVVVSFPATHMTEGRVRFCISAAHTKEQLDEVLETVNLLGSMSRSKFSKRSHLYKNQKIEW

SEQ ID NO: 6393 - protein, 1060 aa, Caenorhabditis elegans
MGFLLGVVRSLRQRREAADSENSSFKEATHKDLSSSFVEHQMHIAQLSERFFHSKIDIVEPKKSKGLTKQEAAQKLKTDGKNALSPPKTISNMELNLLWVLMFGAAALCFLTYIYDPTDALNLYVGIFIVAIVFIMCVVSFFEEKKGVEVVRAFQTLMPTSCQVIRDGKEILLNPEELVVGDVVVVRSGCKVPADMRIIACTDFFLETSSITGEAEPLEFHSKTADAKTSIFESYNIAFNGSFCVDGEGYGIIIRTGENTVIGQIASLTLGQKDKKCKFETEIERFVQFITVMAITMATVIFTIGLLVNGGNDVIRLFVTGFLMVIIANVPQGLPTTVTTELTIIARRMAKKNVFLKKLEKIDSVGATTLIASDKTGTLTKNCMTVTDLWYNNSYNSARPENQGRTTKKRNLNAINTIGWYDAPLKDILSVICVCNKARIENNLTTKVRPPRVDSELDLTVYKSQPVKEMLISGNPSEVALLRYASGMLDAMEVRDSFHVVFEVPFNSVRKYHLILATTEATWAEIDDKKKVNADVEFILMIKGAPDVLIKSCSTINIDGVPMELNGKRMDDFNEAYETFGDEGCRVIGFACKKFRAPATSTFSIKSNTIPMDNWDFLGMSAIMDPPRDDTPRAIKACKEAGIKVYMVTGDHKSTATAIARQIGMIDTEEVTNLDHNRQVIRRTNSQDWAVITGPELPGLSEKQWDALLEHRYIVFARTTPEHKLMIVTESQKRGECVTVTGDGVNDAPALKKADVGVAMGLAGSDVAKQAADIILLDDNFSSIVAGIEEGRLLFDNLRKTIAYTMTHMWPELVPVMLNFFFGFPLGLTPVQILSIDLITDIPPAVSLAYEGPEADIMLQPPRKRETHLVTKGLITYTYLFMSIFISVGGVVAYLLSYYLNGIYPSELAFSSNDHFKVGASNFTTYNGVVLNAEQQVFMAAQAAAAFHIAVVVGQAWHLWMCLTRRVSIFVHGMANIVAILAVIIDLLLICLFTFVPGVQYVFGSQPPPWEVSKALDFKTLISCWLVPVIVGIWIWIFNELRKFGIRNYPKNKLVRLVKW

SEQ ID NO: 6394 - protein, 348 aa, Caenorhabditis elegans
MASGYRSLDGMHRLLTMISFFLLLENFAARLDIDELILKVLSVGHPEKSLTKTVKEHELIQLCQMAKKSFLDQPVMLEVDAPIKVCGDVHGQYSGKCSFTLTGKFIIIIDVIRMFSIARFPPHSNYIFLGDYVDRGRQNLELITLFLCYKIKFYDRFYMLRGNHECPAVNRVYGFYEECNKRYASTRLWLAFQEAFAAMPFTGLISGRILCMHGGLSPKLTNLDVLRDLTRPMDPPSPSLHIDLLWSDPDNSVIDWLPNVRGVSYIFGPNVVKKQIETLGIDLIARAHQVVQDGYEFFAEKKLVTIFSAPHYCGQFDNSAAIMNVDDNLICSFHVLRPSNRKAKQPAN

SEQ ID NO: 6395 - protein, 1974 aa, Caenorhabditis elegans
MTHEADPGWQFLRQSPEQLLAATTKKFDSKKNVWVADPEEGFIAAEIKSSKGDTVVVVTSKGVEKTIKKDDAQQMNPPKYEKTEDMANLTFLNDASVLHNLRQRYYSMMIYTYSGLFCVVINPYKRLPIYSESVCQMYLGKRRNEMPPHLFAVSDEAYRNMTNDRENQSMLITGESGAGKTENTKKVISYFAMVGASQQSNKKKSKKDKAQVSLEDQIVQTNPVLEAFGNAKTVRNNNSSRFGKFIRIHFNTGGKVAGADIEHYLLEKSRVIKQAPGERSYHIFYQIYSDAVKGLREKLFLTRPIKEYTFVSQAEVTIDGVDDKEEMLITDEAFDIMKFTATEKSELFAITAGIMHMGELKFKQRPREEQAELEEGKEGELACKLYCVESEKFINALLKPRVKVGTEWVNKGQNLDQVNWAVGALAKALFARMFSWLIRRCNKTLDAQDLSRDFFIGVLDIAGFEIFDLNSFEQLWINFVNEKLQQFFNHHMFVLEQEEYKREGIQWEFIDFGLDLQACIELIEKPLGIVSMLDEECIVPKASDLTLASKLNDQHLGKHPNFQKPRPPKGKQAEAHLAIVHYAGTVRYNVKGWLEKNKDPLNDTAVTVLKANKGNQLMADLWADYATQEDVAAAAKDGKKAVGKKKGKSASFMTVSMMYRESLNKLMHMLHQTHPHFIRCIIPNELKKAGMIDANLVLNQLTCNGVLEGIRICRKGFPNRMPFLDFKQRYAVLAADAAKAGKDPKDAGEKISAALIKDGSLKQEEFQCGLTKVFFKAGVLAHLEELRDEALGKIMAKFQCACRHYLAQCEYKRKLDQKVGLIVLQRNIRAWCTLRSWSWFKLFGRVKPLIKGSKKNEEFEALEKKFKVLEEEKTQEERKRKDMEAENARLEAEKQALLIQLEQERDSSAEGEERSAKLLAQKADLEKQMANMNDQLCDEEEKNAALTKQKKKIEQDNEGLKKTVSDLETTIKKQESEKQAKDHQIRSLQDEIQSQDEVISKLNKEKKHQEEVNRKLLEDIQAEEDKVNHLNKTKAKLESTLDELEDTLEREKRGRQDCEKQRRKVEGELKIAQELIEELNRHKHEQEQVIKKKDIELSSIQSRLEDEQSLVAKLQRQIKELLARIQELEEELDAERNSRSKAEKARNEMQMELEELGDRLDEAGGATQAQIELNKKREAELAKLRQDLEDAAINSETSMAALRKKHNDAVAELSDQLDTIQKMRGKLEREKNDKQREVDELQQSADVEAKQRQNCERMAKQLEAQLTDMTLKSDEQARLIQELTMGKNKVHNENQDLNRQLEDAEAQLCALNRIKQQQHSQLEELKRTLDQETRERQSLHSQVSNYQLECEQFRESLEEEQDAKTDVQRQLSKANSEIQQWRAKFEGEGVSRAEELEETRRKLTHKVQEMQEQLENANQKIGTLEKNKQRLAHDLEDAQVDADRANSIASSLEKKQKGFDKVLDEWRRKCEALVAEVEQSQRETRAAATETFRLRNQLEESGEQTEAVKRENKALAQELKDIADQLGEGGKSVHDLQKMRRRLEIEKEELQQALDEAECALEAEEAKVMRAQIEVSQIRSEIEKRLQEKEEEFENTRKNHSRTIESMQVSLETESRGRAELLKTKKKLEGDVNELEIALDHSNKLNVDGQKSMKKLQDTIRELQYQVEEEQRSLSESRDHANLAERRSQVLQQEKEDLAIIYEQSERTRRQAELELAEVKDSVNELSNSNSLLLATKRKVEGDLQLLQSEIEEAMSDAKTSDEKAKKAIMDASKLADELRSEQEHASNLNQSKKTLESQVKDLQMRLDEAEAAGIKGGKRQLAKLDMRIHELETELEGENRRHAETQKVLRNKDRKCRELQFQVDEDKKSQERMYDLIEKLQQKIKTYKRQIEDAESLASGNLAKYRQLQHVVEDAQERADAAENALQKLRLKGRSTSGVFGPRGLAHSMSTTGVNMRRGGSRGAFLDEDFAEE

SEQ ID NO: 6396 - protein, 452 aa, Caenorhabditis elegans
MSPVSLLLLLLFPLSTFQQREDCTVQPPSPRHPNIVILMIDDLGYGDIASYGHPTQEYTQVDRMAAEGTRFTQAYSADSMCSPSRAGFITGRLPIRLGIVGGRRVFVPYDIGGLPKSETTMAEMLQEAGYATGMVGKWHLGINENNATDGAHLPSKRGFEYVGVNLPFTNVWQCDTTREFYDKGPDPSLCFLYDGDDIVQQPMKFEHMTENLVGDWKRFLMTRLAQDQHERPFFFYFSFPQVHSTQFASKRFRGSSKEALRSDGIDISDELRGESEDVEGSLGKARPIIYYCNTHLMAIRMGDYKVHYKTSPIFFNNSVDPNLDYFCPNGKPKSDWYVSQVCPDEHLQKHYPPLVFDLIRDPYEQYPLQNTVKSQEIRFQAMQRLSEHKSSLVKVKNVLGSYNKTLIPCCNPPSCKCDKLSRPTEFDESRPDYVGLVPDLEKTEYELLHRFF

SEQ ID NO: 6397 - protein, 269 aa, Caenorhabditis elegans
MDGTSRVEYITPPVNICGDIRSRYGDVLDIFKTCGWPFEQKYVFLGNLIDGGKFSLETLVILLCCKICYPQNFVILRGFYEHELVKSDRSFIGELRVRFPDSNKWQALNAIIKSLLKRLPVMTVLNRKLLCVNGMVTSNIKNEKNVVSVKNGNMFENHNTRVEVQFLDIDIPSPVTPNKIDEESKIIKELLKSMDMSMMINSNNVVREGYRFTLKNQLITITSGTKLQKNYNNRGVVMMMDRHNKVNFKSIQGIDGEDRTDLASVPLRC

SEQ ID NO: 6398 - protein, 366 aa, Caenorhabditis elegans
MALLLQSETDFGLGLLRQQNISESLAFSPLSIALALSLVHVAAKGETRDQIREALVKGSTDEQLEQHFANISAALLAAERGTEVKLANHVFTRAGFKIKQSYLDDVKKLYNAGASSLDFDNKEATAEAINNFVRENTGDHIKKIIGSDSINSDLVAVLTNALYFKADWQNKFKKDSTFKSEFFSSADSKREIDFLHASSVSRDYAENDQFQVLSLPYKDNTFALTIFLPKTRFGLTESLKTLDSATIQHLLSNVSSTSVNVQIPKWKIETKLGLEEALQSLGIKKAFDNDADLGNMADGLYVSKVTHKALIEVDEEGTKAAAATTVSISLKSAMFVMEEPKDFTADHPFFFVLSKDNHPLFVGLHH

SEQ ID NO: 6399 - protein, 339 aa, Caenorhabditis elegans
MHEFLSKSEAEFALKLLHQQDHSQSFVFSPIAISLALYSLYEAARGETRSQIHDCLFKNATDGEMVTHFSNVSTALSAMKKDPQVKICNHIICRNGIKTESLCLDKVKLLYNCEVSSHDLDNEKETIKTINKLIRENTDGHIKKINTKISIDKDQVVVFLSAACFEAQWQNKFHKLSTSKKEFFCTANSHRNIKFLHATGANRKYCENDKFQVLSLPYTDSSFEMTIFLPKEQFGLAEALKTLGTSTIQELKSNVSNYLVNVQIPIWRNETEIDLNSTLQAIGITKILNESAYIGNFAENVHISEFIHKAIIEVTKRFLIIFPISSSFFASFKDFFYKL

SEQ ID NO: 6400 - protein, 571 aa, Caenorhabditis elegans
MSYIYLLLGYFLVSPAFCVSKPKVTTPYGPIVGFEHKSTVTGSKYHVFLGIRYGNPPDHIYRFQKPEPVEKWPHINHDATHFRASCIPSLRSELEEQVNYSEDCLFLNIVTPPDAKEKKLPVLVFIHGGGFQFGDTSMIGYQKAADNFVSKDIIFVSIQYRLGPLGFFTTGDSEIPGNMGLWDQTLALQFLHEVLPDFGGDPDRITLAGHSAGAASVSALLYSPHSDHLFSQAIQLSGSIFSESNLDRNVVDDSRKLAKAAGCPQEDSKELRDCIEIRTVDELLDAMESIGELLPGPRTKKFHPYFDKDFFPYDIEKMSRKAPKKRTMQGLVSLESGLSVLYPVKLAKLLGVPKESWSTYSKDNLVDFIRSQVAVEQEFGTASARFSGLVEEFYLSGPMTGNSSFYLNAFANLLSDLQYNIPTLHEVELKLQHGWDTYLYIIDYDSETTKDPTHPIKGPFHASELRYLFNFNGMDTIPFNDKDKKFENYFVNAIVNFINTGTPSTKALLWPAVSKSQPFANLLLNDKPSVQTSFRQEAYELWQSDIAKTVGADLMKKRLPASKATFRHSEL

SEQ ID NO: 6401 - protein, 343 aa, Caenorhabditis elegans
MPLNNPPSKIHSKITLIMSGKENTAPVIDDQKAEVISLTEDSRPQRVDQAREESCWSLDDFDVGRPLGKGKFGNVFISREKKTKRIIALKVLFKTQLLQLGVSHQLKREIEIQYHLRHPNILTLYGYFHDDKRVFVILDYASRGELFNVLQSQPGHKVNEVIAGRFVRQLANALHYCHSKGVIHRDIKPENLLLDSKLNLKLADFGWSVVADHSKRHTLCGTMDYLAPEMVSNQPHDFNVDIWAIGILLFEMLVGYAPFANQTGDKLIARIKECKIYIPSVVTDGAASLINAIIKKEPQERLPLVDIMAHPWIKEMKQREDIEVPLFISTLTKSSRNNSTANQ

SEQ ID NO: 6402 - protein, 350 aa, Caenorhabditis elegans
MRSIILIISLFVFVSGLVHQSKILWKPSKRIEMLRSGEWATYKKHLERQRNRNPWQLQSLPQNVNDFADFEYLGNITIGTPDQSFIVVLDTEQIVSRNTNLTRYCEATGENQLAIPKTTFGIANQVSADLKNDATDGIFGLAFTTLAVDGVVPPLINAIKQGILDQPLFSVFLEHRGTLTNVGGGVFTYGAVDTTNCEPVIGYQPLSSATYFQFKANRFRLGKYLNAKVVDVISDTGTSFLGGPSVVINEIAKQAGATYYILGEAYVIDCDATPGPLEVTIGGHDYQIEHYNYIADVGDGTCVMALFPMDFGGFGPSWILGDPFIRQYCNIYDIGNFRMGFAPSLQPAPK

SEQ ID NO: 6403 - protein, 389 aa, Caenorhabditis elegans
MKTFILLAVLGLASASVHQHKIVWRESKKMGMIRTGQYPAYLEYQRNLRAVSPNVLANLPQNVNDFGDFEYLGNITIGTPDQGFIVVLDTGSSNLWIPGPTCKTNCKTKSKFDSTASSTFVKNGKSWTIQYGSGDAAGILGQDTVRFGAKGDSQLSVPTTTFGIASKISADFKNDATDGILGLAFTSLAVDGVVPPLINAINQGILDQPLFSVWLEHRGAANNVGGGVFTYGAIDTTNCGALVAYQPLSSATYYQFKAAGFKLGSYSNTKTVDVISDTGTSFLGGPQSVVDGLAKAAGATYDDFNEVYFIDCAAQPGTLDITIGTNTYSIQPVNYIVDAGNGQCLFAAFPFDFGGFGPSWILGDPFIRQYCNIYDIGNKRMGFAPSLQK

SEQ ID NO: 6404 - protein, 395 aa, Caenorhabditis elegans
MKTTLLAFVAILGMCSATVVQHKLIYRESPKMQMMRRGEWGAYVQHKAALRDANPAVFASAPQNVNDFGDVEYLGNITIGTPPQQFIVVLDTGSANLWVPGSNCDGTCKGKSEFDSSKSTTFKKNGQSWQIQYESGSAKGIMGVDTVAFGGASEQQLLVPSTTFGIASHISSNFKNDAAEGILGLAFTSLAVDGVTPPLINAINKKILDQPLFTVFLEHKGTAKNVGGGVFTYGAVDTTNCGPVIAYQPLSSATYYQFVADGFKLGSYSNNKKSQVISDTGSSLIGGPSAVINGFAQALGAKYHSDDDAYYLPCSTSKGTLDITIGGNVYSIEPVNYILDVGMGDTCVFAAFSFDFGGFGPSWIFGDPFIRQYCNIYDIGQQRIGFAKSLQPSSK

SEQ ID NO: 6405 - protein, 393 aa, Caenorhabditis elegans
MKTTFVALVALLGLCSATVVQHKLIYRESIKMQMMRRGEWGAYVQHKAALRDADPAVYANAPQNVNDFGDFEYLGNITIGTPPQPFLVVLDTGSSNLWVPGPSCDGSCKGKREYQSTKSSTFKANGKPWQIQYGSGNAKGYLGEDTVAFGAVTEKQLPVPSTTFGIATHISSDFKNDAAEGILGLAFTSLAVDHVVPPLINAINQGLLDQPLFTVWLEHKGSANDVGGGVFTYGAVDTTNCGPVIAYQPLSSATYYQFVADSFKLGSYSNSKKYQVISDTGTSFLGGPKAVVAGLASALGATYHSNDDSYYVPCATNIGTLDITIGGKVYSINPVNYIVDVGMGDTCVFAAFAFNNFGFGPAWILGDPFIRQFCNIYDIGGQRMGFANSLQAN

SEQ ID NO: 6406 - protein, 530 aa, Caenorhabditis elegans
MELCTDDAFPEKQHHPFLHIRSRRLHVVLMLMYAFFCMCQMTAHIGLSLSCMCNSTAVALMNTNNATLVEGTESTILMSILENKTSESQELGGGDDGESCTKLEGKVIKDYGGTFIWSVSWQGYIVSAAFLGGFIFSYPAGVLVDRFSARHILSVAILMLTIASLLMPVLSIYIGEKGAFAGRFVMGISETMLIPSINSMVTKWIPINEKSLAASVFTAGNQLSGMFGNILVAELCASSFGWSSIFYSASLFGISWLVLWHLTVRNSPHNTRWIHKRELDYLANNIPPKHPSSVVKKTPWRDMLTSKVFWSLMFNSVMGNMMIALIFVYIPVYFKDVLMLDVQSNGFYSAIPHISNLIAKLIWGYLMDKMRHKKILSPSATVKLSQFASMMGISVSCFFLRYMNCATPFYALVLLSSVSAFFGLSISGFYTSLLSIAPSHIGTLTSLATVIGFVGRMFTPLMISYYKTVGTAEEWGHVLLIYVFASATGGIIFLLFGSGDVQNWDYSKRHNTARPNALVAPKSDKDLEDF

SEQ ID NO: 6407 - protein, 251 aa, Caenorhabditis elegans
MEEPLVPLRYIILFLFLSIIGMIGNLAIVIITYKYKTLQSKCCILIAIMAFFNFIFCIYLSMIGLFIGLDRLFSGFDYICMLNVDFRYSTIPVYQYEDIVLTVCYPTTSMYGVPLSIWLGMNFSIAVVVIFVYGGAHIKCRKLKNANSHVKLVESVNRILKSMIVVISLYVCTWFLALLVLKMDNPFVIALESVTGSLILCNSSMNIFIYFWRTPEYRKAILQFYGEITFKSKEASRIQVSFIPKNQLVLI

SEQ ID NO: 6408 - protein, 356 aa, Caenorhabditis elegans
MGLCQSEEEKVGTLKSRAIDKEIKQLQTSEERTVKLLLLGAGECGKSTVLKQMRLLTSKQYTDEELLTQAKLVYTNIVIEMDHLVKAMPAAGLNFSDPMREHDVHMLTLYIKDMQHKNFQQDAADHVEKLWKDPVVKRLYAERKELNIRDIGDNTEYFFENLPRISKEDYHPNATDTLLLRTKTTGIVEVGFEIKKVKFRVFDVGGQRSERKKWIHCFEDVNAIIFIAALSEYNEVLFEDETTNRMIESMRLFESICNSRWFHNTNIILFLNKKDLFEEKIKKENIHKAFPEYRGEQNYAETVAFIKTKFEALSNNPKKTFYVHETCATDTNQVQKILDSVISMIIQSNLHKSGLY

SEQ ID NO: 6409 - protein, 310 aa, Caenorhabditis elegans
MSDDYDEEEVTFKTNTEISSKKANYVIDKLLGEGGFGAVYKVKDSKTGNFYAMKVEKKQEKKPSKLKMEIMILKLVCNERQTSHFTKIIDRGKKDKEGFFFLVMELAGSSLADLKRNRGKAFTCPTGLSVSQQCLEACEDLHKHGFIHRDLKPANFACGADDKQHTIYILDFGISRRIINNQNKLKTPRVTIRFKGTLKFASLSCHKGIEMGWKDDCESWFYMLLDLIVPFGLVWRGANDKDTVCKLKEEARGKKEMFQGIKCGVELNKIIVYIDKLQYQDHVDYQYIYKTLVDACDTCGGNMDAPYDWE

SEQ ID NO: 6410 - protein, 253 aa, Caenorhabditis elegans
MPTSLAFLIVLLVSTVNSLDLNDISELKFRFDQFQKKNSLKSILLLSNLNSKFLKDAVEKIKTNPTTISTTTLLTTTTPEYVTFTIVDPGAMLIDCPGGCPTGWQYLNSKCYKVLIHFHCLSLKVQLQKFDAAVTYAGATSACAAQGAELVTIDSFDENDALRKAFDTNALVDETKETWIGLKSLSGAWQWADGSSATYTNWAPSQPSSNGLCVQMITDSLSNATYKYQRGGWKTYGCGKTSASYICEKGASA

SEQ ID NO: 6411 - protein, 451 aa, Caenorhabditis elegans
MVFGENQDLIRTHFQKEADKVRAMKTNWGLFTRTRMIAQSDYDFIVTYQQAENEAERSTVLSVFKEKAVYAFVHLMSQISKDDYVRYTLTLIDDMLREDVTRTIIFEDVAVLLKRSPFSFFMGLLHRQDQYIVHITFSILTKMAVFGNIKLSGDELDYCMGSLKEAMNRGTNNDYIVTAVRCMQTLFRFDPYRVSFVNINGYDSLTHALYSTRKCGFQIQYQIIFCMWLLTFNGHAAEVALSGNLIQTISGILGNCQKEKVIRIVVSTLRNLITSNQDVYMKKQAALQMIQNRIPTKLDHLENRKFTDVDLVEDMVYLQTELKKVVQVLTSFDEYENELRQGSLHWSPAHKCEVFWNENAHRLNDNRQELLKLLVAMLEKSNDPLVLCVAAHDIGEFVRYYPRGKLKVEQLGGKEAMMRLLTVKDPNVRYHALLAAQKLMINNWKDLGLEI

SEQ ID NO: 6412 - protein, 501 aa, Caenorhabditis elegans
MSSVHPISDGIPSQQRPLTYRWFPSWRFMTSIMLCFCFGCVHLMNSNMGMAIVCMVNSSATYDNETYPENAAPLLDWSSDEQGYIFSAFNAGLLVMLFTGGMADKFNAKYMILVSVAIASLANFTLPWMAPISVYWAIFSRFLVGFADALLQPAMNSLITRWFPTSERSYALGLATGGRQIGTLIIIPAAGALCSQTEIFGGWPSIFYLSGFIGVLFIFSYIFLGADKPSKQSCISDNELKFITISNQSEDVGKKRTERKVPWKNILKSGAVWASVISLVCHEFPLMTLIMFLPSYLHDVHHYHSTENGILSALPTVSLWFAKIGSSYLNTWLQKNTTWKKDTICKVLNSIGSIGLGVFLLAATFLDNEHAWMAVLFLCLSMASAGLHTPGCQLALVSVAPAYSGAVTGFTFFFVAVSGIIHPIITKMIVKDRTAAEWNLVFYISTVIAIFPIIIFNVWGSTEVQWWAKSKASMQQEPNNKKMSKSSKASSSPSIDSIDMA

SEQ ID NO: 6413 - protein, 314 aa, Caenorhabditis elegans
MYFSLNLDENLLIMIIVIAYTLQFLYHLIKISLNIFGVYIFYTPIDLKRTAGASWAVVTGATDGIGRSYALDLARRGFNIFLISRTKSKLVKTKKQILNKYSDIEVRYAICDFTRVSYEDYKRLLHSLNEVDIGILINNVGMCFDNPEVLHRVEGGIDTLTNVINVNILPLTAGILPQMMARKSGIIVNIGSAAGSIHMAKWSVYSATKKYIEWFTSILQKEYENEGIICQTITPLLVSTNMIKNPLSSIFCPNSDSFAKSSLNTIGNSSSTTGYITHQIQFELIKFVPEIIIDLFVKNLNNQLLDYQLDKKRV

SEQ ID NO: 6414 - protein, 559 aa, Caenorhabditis elegans
MLLPILLHFLLLITQLNGSPAEVRLINDLMSGYVREERPTLDSSKPVVVSLGVFLQQIINLSEKEEQLEVNAWLKFQWRDENLRWEPTAYENVTDLRHPPDALWTPDILLYNSVDSEFDSSYKVNLVNYHTGNINWMPPGIFKVSCKLDIYWFPFDEQVCYFKFGSWTYTRDKIQLEKGDFDFSEFIPNGEWIIIDYRTNITVKQYECCPEQYEDITFTLHLRRRTLYYSFNLIAPVLLTMILVILGFTVSPETCEKVGLQKVKMCFFYYSCVLAKLNLISKAFSKRKGKTNNVLPKTRKSGKLKISVSLAICIFLTIMSELTPQTSEAVPLLGVFFHTCNFISVLATSFTVYVQSFHFRNQHVHERMDFWVFLLFFSYQNIKFQMRFILLEWSPWLLRMKMPDRENNFQTLTESWKGRNRRESMARTAFEYADGPVTQIHSMGIMLKDNFEELIYQVKQEKIADEKGIERLRVLQKIYDHVKIHVDEYSNRSSFSIRIKYCFFQMIREHDDDNDEDSRVALEWRFAAIVVDRLCLLAFSLLIVVVSIIIALRAPYLFA

SEQ ID NO: 6415 - protein, 498 aa, Caenorhabditis elegans
MSVCTLLISCAILAAPTLGSLQERRLYEDLMRNYNNLERPVANHSEPVTVHLKVALQQIIDVDEKNQVVYVNAWLDYTWNDYNLVWDKAEYGNITDVRFPAGKIWKPDVLLYNSVDTNFDSTYQTNMIVYSTGLVHWVPPGIFKISCKIDIQWFPFDEQKCFFKFGSWTYDGYKLDLQPATGGFDISEYISNGEWALPLTTVERNEKFYDCCPEPYPDVHFYLHMRRRTLYYGFNLIMPCILTTLMTLLGFTLPPDAGEKITLQITVLLSICFFLSIVSEMSPPTSEAVPLLGIFFTCCMIVVTASTVFTVYVLNLHYRTPETHDMGPWTRNLLLYWIPWILRMKRPGHNLTYASLPSLFSTKPNRHSESLIRNIKDNEHSLSRANSFDADCRLNQYIMTQSVSNGLTSLGSIPSTMISSNGTTTDVSQQATLLILHRIYHELKIVTKRMIEGDKEEQACNNWKFAAMVVDRLCLYVFTIFIIVSTIGIFWSAPYLVA

SEQ ID NO: 6416 - protein, 498 aa, Caenorhabditis elegans
MGKPIVCLILLLASLHTVVSKVLPINEEDQLLYEKFARHGVEKFNQQSNDAYKWELDRTWEVERKLSGGIHYSIFVTLVKTDCKKGQTDVEGKKCRKTDTLKKCQVEISRRVKRHGYGLKDIVHIRNCEEEFTRNIDKFDHRKIQLTHDDSITVQELRKAKIIRPRDYVIWNSFLDFVDRHEKKYTNKREVLKRFRVFKKNAKVIRELQKNEQGTAVYGFTKFSDMTTMEFKKIMLPYQWEQPVYPMEQANFEKHDVTINEEDLPESFDWREKGAVTQVKNQGNCGSCWAFSTTGNVEGAWFIAKNKLVSLSEQELVDCDSMDQGCNGGLPSNAYKIGKFVVSDNYCFLVFYHKTTKEIIRMGGLEPEDAYPYDGRGETCHLVRKDIAVYINGSVELPHDEVEMQKWLVTKGPISIGLNANTLQFYRHGVVHPFKIFCEPFMLNHGVLIVGYGKDGRKPYWIVKNSWGPNWGEAGYFKLYRGKNVCGVQEMATSALVN

SEQ ID NO: 6417 - protein, 389 aa, Caenorhabditis elegans
MGIISIIFLLIGSSTAAVLEHQLIWKESRMIEMIRNGEYPAYLEYRDRMVASRSSNLATVVQSTTDYVYYEYMGNITVGTPDQNFIVVLDTGSANLLIPGTNCTTYCEKKRLFNEKASSTYIATNRPWQIKYASGDAYGTLGIDTVKIGGSGEAQLAIPRSYLGVADTVGSDFKWSPKEGIFGLAFTALAVDNITPPIINAINQGLLDQPLFTTWFGQRGAPGTSASGAFTYGGLDKNHCGPVIGYAELTNARHFQFQATGFSLGSYVSTTTYEVITDTATSFLCGPQAAIDNLAKAAGATWDPTNQVFNIPCDADAGPIKMKIGQFNYVIRANNYILKIDTNSCLFAAIPQNYAGFGPSWILGGPFMRQYCNVHDIGQKRVGFCLSLA

SEQ ID NO: 6418 - protein, 1459 aa, Caenorhabditis elegans
MTVPNDSTTEGPSSTVTNSASSETPCNSETQTSDGTSPMTVSSDSTTAGPSSTATNSASSETPCNSETQTSDGTSTMTVPNDSTTAGPSSTVTNSASSETPCNSETQTSDGTSTMTVPNDSTTAGPSSTVTNSESSETPCNSETQTSDGTSTMTVPNDSTTAGPSSTATNSASSETPCNSETQTSDGTSTMTVPNDSTTAGPSSTATNSASSETPCNSETQTSDGTSTMTVPNDSTTAGPSSTATNSASSETPCNSETQTSDGTSTMTVPNDSTTAGPSSTATNSASSETPCNSETQTSDGTSTMTVPNDSTTAGPSSTATNSASSETPCNSETQTSDGTSTMTVPNDSTTAGPSSTATNSASSETPCNSETQTSDGTSTMTVPNDSTTAGPSSTATNSASSETPCNSETQTSDGTSTMTVPNDSTTAGPSSTVTNSASSETPCNSETQTSDGTSTMTVSSDSTTPGPSSTATNSASSETPCNSETQTSDGTFTMTVSSDSTTAGPSSTVTNSASSETPCNSETQTSDGTSTMTVSSDSTTPGPSSTATNSASSETPCNSETQTSDGTSTMTVPNDSTTAGPSSTATNSASSETPCNSETQTSDGTSTMTVPNDSTTAGPSSTVTNSASSETPCNSETQTSDGTSTMTVSSDSTTAGPSSTATNSASSETPCNSETQTSDGTSTMTVSSDSTTAGPSSTATNSASSETPCNSETQTSDGTSTMTVSSDSTTAGPSSTATNSASSETPCNSETQTSDGTFTMTVPNDSTTAGPSSTVTNSASSETPCNSETQTSDGTSTMTVSNDSTTAGPSSTATNSASSETPCNSETQTSDGTFTMTVPNDSTTAGPSSTATNSASSETPCNSETQTSDGTSTMTVPNDSTTAGPSSTATNSASSETPCNSETQTSDGTSTMTVPNDSTTAGPSSTATNSASSETPCNSETQTSDGTSTMTVPNDSTTAGPSSTATNSASSETPCNSETQTSDGTSTMTVPNDSTTAGPSSTATNSASSETPCNSETQTSDGTSTMTVPNDSTTAGPSSTVTNSASSETPCNSETQTSDGTSTMTVSSDSTTPGPSSTATNSASCETPFVYSHKFCKYDSTTAGPSSTATNSASSETPCNSETQTSDGTSTMTVPNDSTTAGPSSTVTNSASSETPCNSETQTSDGTFTMTVSSDSTTAGPSSTVTNSASSETPCNSETQTSDGTFTMTVSSDSTTAGPSSTVTNSASSETPCNSETQTSDGTSTMTVPNDSTTAGPSSTVTNSASSETPCNSETQTSDGTSTMTVSSDSTTAGPSSTVTNSASSETPCNSETQTSDGTSTMTVSSDSTTAGQSSTATNSASSETPCNSETQTSDGTSTMTVSSDSTTAGPSSTVTNSASSETPCNSETQTSDGTSTMTVSSDSTTAGQSSTATNSASSETPCNSETQTSDKTSTMTFPSESTTAVSTSSAANNTSQF

SEQ ID NO: 6419 - protein, 395 aa, Caenorhabditis elegans
MNTIMSNYTKMLPDAEDSVQVNIEIHVQDMGSLNEISSDFEIDILFTQLWHDSALSFAHLPACKRNITMETRLLPKIWSPNTCMINSKRTTVHASPSENVMVILYENGTVWINHRLSVKSPCNLDLRQFPFDTQTCILIFESYSHNSEEVELHWMEEAVTLMKPIQLPDFDMVHYSTKKETLLYPNGYWDQLQVTFTFKRRYGFYIIQAYVPTYLTIIVSWVSFCMEPKALPARTTVGISSLLALTFQFGNILKNLPRVSYVKAMDVWMLGCISFVFGTMVELAFVCYISRCQNSVRKGSLHRNGPPSPLNLQMTTFDSEIPLTFDQLPVSMESDRPLIEEMRSTSPPPPSGCLARFHPEAVDKFSIVAFPLAFTMFNLVYWWHYLSQTFDQNYQ

SEQ ID NO: 6420 - protein, 355 aa, Caenorhabditis elegans
MSLNTTASSSLNSHSYDMVEVFAMIMLPLILIGIFGNIISIYVYSRHHMNKNTIGFLLLSLSTIDLIVLITAMPSFGTYKFPFFPGYHEIGSVHTIFSAFCLIYFYPLMCMGKMMGQYIIVLISVERWFAVCRPLQVQIWCTQKNTIRAMTCIIAISILFNAPRFFEFKANLITGVIGFGLAHISKNEWYFYLYYGIRAIIFDALIPFSIIAVTNIQVIQQLRKSNEERKLMTTQQQKDNKTTTMLLVMIFMYAICHFLCTSVKFINLFSHNYVQFQFVIFKIIHHISNVLLVFYSASTFFIYLIFSEKYRNVLSTCVTCRNTDELTVSSRGRQNTKTTRSNSQNGYTAIKNEKT

SEQ ID NO: 6421 - protein, 169 aa, Caenorhabditis elegans
MNFQLFIFFALLAFARSGVLKNTENMPISHTDALCGSIKCPDNYRCELPVSDLECGSEDDCSVDPKCVPIPIRKPECEGDEELKACGSACEPTCDNENPECDLVCMTNVCQCKKGLVRDSATGKCVEKNKCSKCTLECSENEKCELVELTCEEKPCQIVDVCVAQHTTE

SEQ ID NO: 6422 - protein, 145 aa, Caenorhabditis elegans
MSLYHYFRPAQRSVFGDLMRDMAQMERQFTPVCRGSPSESSEIVNNDQKFAINLNVSQFKPEDLKINLDGHTLSIQGEQELKTEHGYSKKSFSRVILLPEDVDVGAVASNLSEDGKLSIEAPKKEAIQGRSIPIQQAPVEQKTSE

SEQ ID NO: 6423 - protein, 143 aa, Caenorhabditis elegans
MLMLRSPFSDSNVLDHFLDEITGSVQFPYWRNADHNSFNFSDNIGEIVNDESKFSVQLDVSHFKPEDLKIELDGRELKIEGIQEKKSEHGYSKRSFSKMILLPEDVDLTSVKSAISNEGKLQIEAPKKTNSSRSIPINFVAKH

SEQ ID NO: 6424 - protein, 143 aa, Caenorhabditis elegans; identical to SEQ ID NO: 6423

SEQ ID NO: 6425 - protein, 145 aa, Caenorhabditis elegans; identical to SEQ ID NO: 6422

SEQ ID NO: 6426 - protein, 512 aa, Caenorhabditis elegans
MFAFSKGPAGSSTYDRVAQKFQDGYEKMRAAIEMDELTKHAGSIQEKLRTAELYKEARSLLKEANEFNIMDIPETRRSEIRDKRQNMMKLEKSAQDRLIAICNEVDPNVKQSRSATVGPSRPASAARVTPRPTRATAPEKKNAAKAKENDENRHVCSRGDRCGAHHQPVTKKSDTVHPEPPVQASNRKMETVKRVKVDKASLPMHQNPVNRAALLNGVDKVIGERLLDEVLDNTGVRMDDVAGCHSAKAALEEAVILPALNPNLFKGLRQPVKGILLFGPPGNGKTLLAKAVAGESKQMFFNISASSLTSKWVGDSEKTIRGLFQIARNAQPSIIFIDEIDSILCERSEKDAEVSRRMKTEFLVQFDGATSSADDRILVIGATNRPHELDDAVLRRFPKRIMLNLPDEEARKELITKTLKKHNMMDGLISSDIRYIASNTSGFSNSDLVALCKEAAMVPIREIDRSKLSMTDGEKIRKIRASDFDTALRTIRPSTSQKIMSKLSDFSRSFGC

SEQ ID NO: 6427 - protein, 709 aa, Caenorhabditis elegans
MPIYSKLLKEGKWSDYKLQQDQLRSDAYAAGVDDYEHAGYVGKITVGSPPQEFRVIMDTGSSNFWIPDSTCDTKATSCHKVLPAPNYSAIPGNFFPKFGPFQLLTQLLPTSNPKFAQVLPNFNNSSYGSDSASGILGFDTVSFGGISESQLIVPDTVVATAEDIDGIMGLGFLANSQQNIYPPFVNAVGQKLVDPIFHVYLGNRPNRAGQITFGGQDTQNCAKVKQYHPLTTGAAYQFYMTSVSSGAYSARNGWTALSDTASSIIYGPKAIVAGIADAAGATNLFLLLALVAAALAAVVQVPLVKIEPYRNRLIREGRWVQYRKDREIRRFMMNKQSNDMSVGQYVNDYEDEAYVGNITIGTPQQQFKVILDTGSSNLWIPDITCGTKPENCSTVPACRGIICQFECDDQACCGAGANYTDSCFYQNKFDASKSSSYKTNGRNFIIEYGTGSARGFLGQDTITFGGIGEPQLAVPNTVFGQATSLAAFFEGQPLDGILGLAFKSIAVDQITPPFINAINQNLVDLPLFTVFLEHEGDQNGVQGGVYTYGGIDTKNCGPVIAYQPLSSATYYQFKMSAIGSGSYHSSKGWQVISDTGTSLIGGPKAYVSAIADAVGATWRDDYGVYILPCSAKINTLDITIGNQVYNIDSSNTIIPLGDGSNNCIYAIFPFSSGGFGPSWILGDPFIRQYCNIYDVGTQRVGFAKSLQSK

SEQ ID NO: 6428 - protein, 506 aa, Caenorhabditis elegans
MSTSCDLWSLRSVRLRVVIAIALALTIEGLMRSNLNMAIVCMLNSTALTDGKPMIASLNTSIEPATPLCPLLQFGESKVVEHKGTIFWTSQDRAIIFAAFYAGGLVATLASEVLNRYIGATRSVLYGGIANVVGTFLTPFVASQTNFGTFPIILLRFVMGFGQGVLWPCMLVLIAQWFPVNEKSTALAIATTGNQLSVVIAMFATAELCQLPWGWPMAFHVYAVCGIVMCIIWYMMVYDSPCHADKKLSRDELHYITTERVRLRPQHPNWMALMKSPVVWAIAASSFAHNYVTVGTITYLPLYYKTVLNMSLTSNGLWSALPFVLQLISKVFYAGMAESARKRDWSDINRITKFCNSSASFGIAICFGLLCLCDCSQRGAAIFLICLAMCFVSGYIPGYNTSAVTIAPGQTAAIAAFSRFWGQIASSVAPYHIGAYTKQGTADEWKIVFAVIAAICVVTGIFFQCCGTASLQDWDSTHSKAPIEVAREELIDSSKLDDSLRITTVE

SEQ ID NO: 6429 - protein, 421 aa, Caenorhabditis elegans
MNEEVPLIESPVAGPVPNGSVVRPPDIVFVNVGGRRARLNSDIIIRRLATSRLAVFCEKSHVERLTDCDAFFESTSEYYFERSPIIFEYVIDFYVTGKLHRPMDICPIRLRYELDYWRIPTPFMSPCCILEENNNIAGKMSTEKAFVDSSLPSSCFDKVVLGPQRLKLYRLMENPRSSSGAKIFSVGSALFVLLSLLGLILSSMPELQDENKEPHYLLHWLELLCMVYFTFEYLARLLVNPKKAEFIRSPLNVIDLLTVLPFMIEAFNELQWMKEFRGAMLVVRVMRLARVARIFKLARYSTGLRAFGETMKKSAAELSMLGMFLVTGVITMTTVGYGDLVPITAGGKVVAALASVCGIIVLAFPISMIIDKFAESTGGWSGGDGDEEQGHMIVHRTVHPLNNGAPAAQPVKKKSKRYVGF

SEQ ID NO: 6430 - protein, 343 aa, Caenorhabditis elegans
MSSAVTSTSDSTAPGNSQTFKKIATKVFIQQVLPLRTSIIYFQYFLSCTAALVAETVTYPLDITKTRLQIARNKFTKGGIWMVQVTYDIIRREGAMALWTGVAPAITRHYIYTGIRMGAYEQIRLLTFNKEVEKSFPLWKSMLCGAFSGLIAQFAASPTDLVKVQMQMEGLRRLQKQPLRYTGATDCFRSLYRTQGFFGLWIGWMPNCQRAALLNMADIATYDSVKHGLIDNFELKDNWLTHAVASACAGLAAAIVSLPSDVVKTRMMDQIRHELDAKMMHKKNTHVDLYKGVVDCYIKIIKNEGFFSLYKGFLPSYIRMAPWSLTFWVSYEEIRKWTGASSF

SEQ ID NO: 6431 - protein, 354 aa, Caenorhabditis elegans
MGLCQSAEDKELTLKSKAIDKEMMQNHMSQQKVVKLLLLGAGECGKSTVLKQMRILHDHGFTAEEAEQQKSVVFNNTLQAMTAILKGMEALRMTFDKPIRENDAKFVMESHKMLQEAKVFPEELANAIQALWNDKAVQQVIAKGNEFQMPESAPHFLSSLDRIKLPDYNPTEQDILLSRIKTTGIVEVKFQMKSVDFRVFDVGGQRSERKKWIHCFEDVNAIIFIAAISEYDQVLFEDETTNRMIESMRLFESICNSRWFINTSMILFLNKKDLFAEKIKRTSIKSAFPDYKGAQTYDESCRYIEEKFDGLNANPEKTIYMHQTCATDTDQVQMILDSVIDMIIQANLQGCGLY

SEQ ID NO: 6432 - protein, 1019 aa, Caenorhabditis elegans
MQNRRSSLSSRPKGVRIWHRHPTLVWIGATLEEDITFQTRNVRIRLEDDTEVEYAIKSLDQLPFLRNPAFLVGKDDLTLLSYLHEPAVLHNLQVRFVKGSSIYTYCGIVLVAINPYADCSHIYGEEIIQVYRGAGKSAREMDPHIFAVAEEAHFDMGAFGKSQSIIVSGESGAGKTVSAKFVMRYLASVAASKTRNGGTTSIEARVLASNPIMESIGNAKTIRNDNSSRFGKFIQINFCERGRRIVGAEMKTYLLEKSRLVFQAPGERNYHIFYQLCAARNHQVLKDLHLGPCESYSYLTQGGDSRIPGVDDKADFEALLKALQLLGFDEKQMSDVFRLLAGLLLLGNVHFENGEGSSAVSASSCQEISRLCREFWKISESDLRIWLTRREIRAVNEIVTKPLTKNEAVRSRDALTKMLYSHLFGWLVDKINEALNEKDKLDGTNQKKRPDRFIGVLDIYGFETFDVNSFEQFSINYANEKLQQQFNQHVFKLEQEEYIREEIEWVRVDFHDNQPAIDLIEGPVGMINLLDEQCKRLNGSDADWLSQLQNSTELKRNPQLAFPKVRSNDFIVRHFAADVTYSTDGFVEKNRDAIGEQLLDVVVASKFPFIRTVIGSTAPTSVSSSSSSSTPGKRTIKKTVASQFRDSLKELMSVLCSTRPHYVRCIKPNDSKISFDFEPKRAIQQLRACGVLETVRISAAGFPSRYPYEEFARRYRVIYTKEAALWRDKPKQFAELACQQCLEEGKYAVGKTKIFLRTGQVAVLERVRLDTLAAAATVIQKMWKGFLARRKYETMRRSLLIVQASLKAFLAFRRIKYLQMHRAVIVMQSAVRGYLERRKYEQIRDSIIGIQAMFKANRVRRYVEKLRYEKSAITIQAAWRGYLARREQIANRKKVVMVQCAVRKWLAKRRLRELKIEARSVGHLQKLNTGLENKIIELQMRLDIASETMCKHEIFALSSQSKSLRTNERIVKKVVVSKTATLNEHELPSPFTICFICSSEYLIEFRQLCRQCMCRNELP

SEQ ID NO: 6433 - protein, 544 aa, Caenorhabditis elegans
MPHDSTYPPVKISERPYHEMLLDAIDKTIADGKNKIAFVSGDNPKHFITFEQLRKDAFAVAMYLHSIGFKKDVAAVVLPNVWHYTSFFIGCAINGGAVSGASALFTDYELQRQFVDSRAKVVFTYEDFLPKVLLAVKQSPNIQKIIVIPKPVGSSLPAGVVSWNEVVSTPVTALPQVPIDVHNDLLVLPYSSGTTGPPKGVMLSHYNFTSMISMYLAIDKSHILDVLDPNWDCYNEKALLFLPFYHVYGFGLLNHCLLKGMTGIVMSHFEPNNFLTAVQNYKVRCLCLVPPIMVFLAKHPICDKFDLSSVQMIMAGAAPAGKDLIEELKRKYTNLKYIQQGYGMTECSMASHLPDLRNDQPYGSVGKLASNLVMKIVEPGTDREQPVNQRGEICVRGPTIMLGYLGRPEATASTVIDGWLHTGDIGYLNEDGNLFIVDRLKELIKVKGLQVPPAELEDLLLSHPKIRDCAVIGIPDAKAGELPKAFVVRADNTLTEQEVKDFVKPKVSPYKQLEGGVEFIEEIPKSAAGKILRRFLRDRSSAKL

SEQ ID NO: 6434 - protein, 332 aa, Caenorhabditis elegans
MDKTLDVTNLFPGTQVFLIIDVDSISIQLKVYKWTIEKKIAQGDFNFIYMCNGSSNMSNYKQFALKCESAQSPLQMLKVEAFVLQTIAKRGSRHFCDIEDIGKFQGIHYIVMHMIGRALVDYMKTSMSGAISVNCALSVGIQLIEALEDLHNCGFIHRDLKPSNICFGRKDRNELGKLYLLSFGISRRYLDSKNQMRKPRDNVEFRGTVRYASLNCHQLQELNRKDDLESAFYVIVEMITGQLPWKGLPDGAAVARVKQQSRHPSAIALFLRAPCPMEELREVMILIDSYNYFTAPDYVNICNILRRAMRRSPQPEHPYDWEQGGTNSLGDV

SEQ ID NO: 6435 - protein, 756 aa, Caenorhabditis elegans
MEQKFKKGKDHGVGVLTSGGDSQGMNAAVRSVVRETIRQGHRCYLIREGYNGLINGNIELAKWAHVANVTHLGGSMIGTSRCDEFRTTDGRKKAAAIMFDKRIFHLIVIGGDGSLMGAQKLKEEWGRFGEELFAEGKITEEVANEGRELHLAGIVGSIDNDCIESDKSIGSDTALHRICEAIDGLVMTAQSHQRVFVVEVMGRHCGYLALTAAIAVEADYVFYPEIPPDEKWPEQLCHQLGSVRKMGKRQNVIILGEGVTNSKGQRIDVRQVKEEIETRLQLEVRIATLGHLQRGGAPSFLDRLIGLRMGYEAVQEVLKGKEEKEGAVVTGQKTIAKVMCLRGHNIQRNELSRVIRQTETANEEIMQRHSDLACRLRGFGFLDKQTYLNFVSIPLSTTMPSRTKTFAVVHIGSPCAGMNAATYSFTRMANHSGIQVIGIKHGWDGLKNKDVKLLTWANVQGWAQFGGSMLGTKRQLPSEMDLIAEGLNSNNVDGLVIIGGFMAFESALILQQNRSEYTCLSIPIVVIPATISNNCPGTCMSLGVDTALNEICRQVDNISQNAIGSKNKVMIIETMGSRSGFLATMTALSTGSQFALIRQVETNEKDLEKLAIETKERLDSGNLEKFLLIRSEGASDEIYSPDVKKIFDKVMKNKYGVRITNLGYSQLGGHPSCFDRQMGIRMGVRAFEGIVNPVKMGDRDCCVIGLRGSSLRYVPVQGLGKKVCFEHGVPHNMWWLDLHPLVEAMTKKPQEAVLSS

SEQ ID NO: 6436 - protein, 374 aa, Caenorhabditis elegans
MASLLALFFIQIFIFTVTSFDVGANFEDSFFEINIDRNNPEKLYKEFEDFIVKYKRNYKDEIEKKFRFQQFVATHNRVGKMNKAAKKAGHDTKYGINKFSDLSKKEIHGMYSKFGPPKNNTNVPKFNLKNLRVKRQMEGLPKTFDLRNKKVGGHYIIGPIKTQDSCACCWGFAATAVAEAALTVHLKKAMNLSEQEVCDCAPKHGPGCNGGDPVDGLEYIKEMGLTGGKEYPFNVNRSTQLGRCESEKYDRELNPLELDYYAIDPFNAEYQMTHHLYLLNLPISVAFRTGASLSSYLSGILELADCDDEKGGHWHSGAIVGYGTTKNSAGRTVDYWIFRNSWWTDWGDDGYARIVRGEDWCSIESHGYGARIPE

SEQ ID NO: 6437 - protein, 416 aa, Caenorhabditis elegans
MYQSAASARYTNSAQRAVEVQVFSHKQKMAVRINKLIFILKTPLSNVFRKHEELSKMRYLINALFEAMRNRENPTKWESYKQVITAVSAYWVFSIGLVFLNKYLLSSVQLDAPLFITWYQCLVTVFLCLFLSKTSKAYGLFKFPSMPIDAKISREVLPLSVVFVAMISFNNLCLKYVGVSFYYVGRSLTTVFNVVCTYLILGQKTSGQAIGCCALIIFGFLLGVDQEGVTGTLSYTGVIFGVLASLSVALNAIYTRKVLSSVGDCLWRLTMYNNLNALVLFLPLMLFNGEFGAVFYFDKLFDTTFWILMTLGGVFGFMMGYVTGWQIQATSPLTHNISGTAKAAAQTVMAVVWYSELKTLLWWTSNFVVLFGSGMYTYVQKRVMDKKNSGASPASEAKSDKVKLLGRDGNAAEESV

SEQ ID NO: 6438 - protein, 291 aa, Caenorhabditis elegans
MELTRLIPPEDVETLLFHAFSIFNKQPMLIEVNSPINICGDIHGQFSDLLRLFDKNGFPHRANYLFLGDYVDRGKHCLETILLLFAYKVIFPNHFFMLRGNHECSLINRQYGFYEECQRRYNKPSVWHSFQGVFSVMPLTALVGQRILCMHGGVSKMLQNVSQLRAIKRPFDNPEPNTLAIDILWSDPTNFQKGWNPNSRGVSYVFGSDALRKLLDRLQIDLVVRAHQVVQDGYEFFANRRLVTIFSAPFYCGQFDNAAAVMYVNKNLVCSFVVLRPRKKIARRRMMPAVN

SEQ ID NO: 6439 - protein, 866 aa, Caenorhabditis elegans
MYQIHYVDSHLSIGKEFQTLSETLRTFQANYIFLTLQILSVIESKKLQNSIPFLKCSVPFLVLKHSEKLKSITFQKVGPFVELLTAKKHLKIFVLYILALILGTPLFLPSSNRLVGLKNVIKNCFKVIQLQKMEAGETWNVSLEWPPPSLDLSTITQTPSTIVGSGIPLNYAGLSLIVIPLITLLGNLLVIISVLRYRALQSAINFLILGLAVADLLVAIIVMPYAVYVYVTNGDWYLGNLMCDIYMASDVCCSTASILLLAVISFDRYRAVSLPIQYSRQSQNVKRVWTLIAVIWLVSLTLASPMVFGVNVRPPDANPYECRFYNAEFSILSSMISFVIPCFLVLFVYIRIIIALKKREKAAKMRREKNTIAHGLTMRPDTGEEQVDEEAAGRIVAGPDEREFGNSSTPRSSLESLSENVNVITNDFVSENCTTFSRRSSYADDSQPTSSQTSSGDGRSYSIKGQKRFRNLSRNYSTKHHRKVVKVNRGNSRNNSRTASITNQSDDALIPAIIRTISRKSPRLFRRDKTDIKKHSMILANPITEPPKEYRRVSMPIHPTNSQTETETISASRDIENLPTTTISRSTTANSAELLGSPDDFEKFPALITETVLEDVLAETREGCFMQPTVSFALTVREMEGNALNNLKGCSVESSRRVSQVDPPLAIQILTRPSLPRKFLKFFFTSKYVFLLHQKMFFETLPYFADLDLQRMDSIGTTCSSKTRADSLRSVDSKGSKKSNRNGIAVKLVKRAIKHEHSLKRKVSKAQRKEKRATKTLGVVVGVFLVCWVPFFVINILNAVCILLNKDSCQVGYDLFFYCTWIGYMNSFMNPIIYTIFNTEFRRAFKSIIFGRNSTRHHFSNKQAHV

SEQ ID NO: 6440 - protein, 1295 aa, Caenorhabditis elegans
MEESTNDGDENKPATGKKRQQLESPFSAATPKSRLGKESKRFFGRSAMNLADGNLEETRIEPDSRHSSTSTSDSILDDSSISNFSTLAPPNTSVDDNSVCEPPRASSAHDVDPNLEQTKVYSEDSISKDCSIADESFATDGDVTLANDFFQQATIQDLENTPSTPLRSQTQVGDESTPTAPSPLRSKIPIESEVVQSTSVESVQSTSQHEKSRIEYSLYEFEMLEKNIEHDEVVKDLQLKIELLGEKHRQTLVEIKEAREVEEKMLMQQVEEAVKKTKSEREAAKTLEQLLEKRIEELEMKLTEPNGEKLQFEHQLEELKSRCEELTDKALKVDVMQHSIEDYEKKFVELQEMKEEADEQLQKAKEDIETLQMKYVELETTINKEVFSNSEIETLKSEHEIVRKLMLDEIHRLENEMSALQPKNDTTELEELQKTLDDLKIDCCNLTSKMLELQSELVEVKEKATSEIGEAVQKNGELLEQINSLRVENAKLVDMEGQLNDAHRKAEDKDVRISELLTTIESLRQDSEASDKLLMDSESTQNEYSLALENTVSELETMRREYKASVDKVCSLQLELEEIQHETSVELEEAEIRIKELELAQEEAVKTGSSQLKKLEIVQEDCQKLRDQLKEEQIQQLVSLRETSEVMHQESARHQEEKYQIQSKLMSTEAEVIELRSSIDSLQAEVRVQSDSAADQKHILEDYLRKIRQAEETNEKLRSDLASSEEQILDLKNQQESLIDDLKEKLHSAESTNQELQVSLEMLKIEVSNARQKVMESEVLKESFEALQLELSASQEVSRSVVDAAVQEKDGLLRLVDTLKLKIEDTEKSAQDLQQSSVEEIKQLQLDLQNFKQNAEVLESLNEKLNSSHKRDMVALASQLEELQHKLVVGESQVENVKEELIGAKIMNKEMVDELNAKLGDALEGMEELKKSLEVSEAKVQRREEELIAQVSKHRDQQEQLQLTLDELKSAQHSTETSRSQSNELAARIEELEASISFAQKALQDVEDVKHQQDIQISEANEAMVKLKQDFETERTSLQNEFNQTVSADKEQLGHAEQMIAQKEKEIITLQARIEAMSQQFEERLEASNVWKTQAMNVGTLTESLSQLQVQLQQMNEKLVASDKYAVEVEQQAQHDITVIQEEKNEQSAALEEALSKIAELEEQLGRAQKEIVRLEKVCDDFDDVERELKDAISKLQSEIKQLKGIKKPPKVMGLLQQARLGVKPLSREHSHAEPPEPVVEDKFEDAQDSFQEEFSHSPDAITSSTVLHPDDHLQETTAVETPSKKANRSNCNQQ

SEQ ID NO: 6441 - protein, 924 aa, Caenorhabditis elegans
MTAGSSWIVPIILLATPLAVQMVKRDDFKTCEQSAFCKQHRAITVRRGSQNHHNWSLQEPTGYELLADSITHHGAVWTANVRNSQNTLKINVIGLADSTVRVQIDEPESAIRKRYVPNPALVSLPEELEFSSVENGDQEAKIIGGNKKLKVVVTYKPFLVSIFNEFDELVAQLNRDGKLKVEEFRTKEEGKEYPEGFWEERFKGFTDHKQHGSSSVGVDISFVNFKTAYGLPEHADAFALRNTVGNSDPYRLYNLDVFEYELNNPMALYVSIPYILAHRANRSVGALWFNAAETWVDTQSSVTSKGLFGKMLDKVTGSSDNVPHFDAHFISESGLVDVFFFVGPTVKDVQRQNSKLTGVTPLPPLFSIGYHQCRWNYNDEQDVATVNQGFDDHDMPMDVIWLDIEHTDGKKYFTWDKHKFPTPNDMVDKVAAKGRKMVTIVDPHIKKDDGYYVYKDAKDKGLFVKRVDGSDFEGHCWPGSSEYLDFWHPDTRSYWKDQFAFDRYTGSSSNLHIWNDMNEPSVFSGPEITMDKESIHYGGIEHREIHNMYGMMYTSATFDGMIARTGGKERPFLLSRAGFIGTQRTAAIWTGDNTADWGHLEIAAPMTLSLSIAGVPFVGADVGGFFGNPDEQLLSRWYQTAAFQPFFRAHAHIDTRRREPWLFSEQTQQIIREALRTRYALLPYWYTLFQQHTENGVPPMRPLFYEFENDDLLLEEQKQWMVGSGILARPVVEKDTFNVQVKLPRGEHKTERWFEWVSGNEVRGESIYVDAPITFTPIYQRGGTIIPTWQRIRRSATLMKDDPITLFVALDSNENSNGEIYLDDGNTHDYQSGQFVKASFKYTTLSKNSAMLEGEHLDGKYAAKNWIERVVVRGVESSPKKVEITRVSDPVQSLEFSYDHDSKVLVIRKPEALLTSSFKVHIEF

SEQ ID NO: 6442 - protein, 137 aa, Caenorhabditis elegans
MFDEDSDGLIETDDVSHVLRSFGLNPSQTELQLVSEQTAKKNGRVSFDDLLPRVVLAIQNEEWKDDTPKQIHAAFQVITSNNYVQKDTLLQLLTSIGEPLTPQEVKQFLNHVSIRANGDIDWVSYVKDTCEMITSRD

SEQ ID NO: 6443 - protein, 293 aa, Caenorhabditis elegans
MYDEVDEKCVPCPRGEFQDEHGRTTCKTCPDSTTTVGTGTQKKEQCVHVCPSGYFYDTSSKMCETCGLRGYQPKSGQDRCIPCPDGTVPIYQNSTTIGHCLDKCRAGMQRSSDGSTCEPCPIGSFKSADDMVCMMCPTGRTTLSKASKALSACHIKICFPGTILDHSTFKCEPCDFGTYMDEYDGRICKTCPVSTTTYQQGANTAKMCEWTNQCKASTHNCHWLAACIDLPDENHKKMYSCKCKPGFVGNGFHCVDACEGFCLNGGSCLKTGRGETKCLCASGFAGKRCQATE

SEQ ID NO: 6444 - protein, 889 aa, Caenorhabditis elegans
MALKAEDGEGCTCKQTKRYGQPECCCMGLIVSQLPTNLTADVGYLYLHNTSISVITPNFFDKFPSIRELEIDNSAHLEHIDGSSLSVLSKLRKLSVVKCPNLREISGKLLVNNTRIQNVILKNNGLATMPSLRMTDAHHVLLDRIDLSGNKIKFISDSKVRNVKARTVVLSENKLIEISGYAFTESQFLKLKLNNNPDLRSLSVDAFKNMAGLQTLDLSHTSIDTLPINGLKKLKTLILNDVPTLKSLPSVLSFTDLETAHFTYPHHCCLFKYVDDVTMNDNGKYQRNAKEIHKRICDKREQQKVARRRKRETSGIDFLDMLLKEWTDNSTYTGPDDADDDELPPFVEIGAEPCQSIGEEVQKYYSNITCYPQPDALNPCENIVGYPFLRIAVWVVCLAAIVGNIIVWALLGIVYEKRMRMHYLYMINMSVADMVTGIYLAVLAIADAKMSDEYYRHAVWWQTGWGCRAAGFLAVFASELGIISMFLIAFEMSYNTRQSFRGRRLSPKVGVLLMIGGWLFAIIMAILPWFDVSSYSESSVCLPLRAATIFDKSYLIFGLSFNFLAFAAMALSYGFIVKMLKENETREEDRALITKMTVLVVTDLICWFPTLFFGFTATIGFPLLSLSSAKFVLVFFFPINAFANPFLYVFFTEVIQHRVRSKTLPVIRRITTGPLNAASSLSNFYHSQPPGAHRRSRDEPTSPSGMHLAVTQVRQTTSLNSTPRGSDVSRASDGMLFDYDRRASASPRVSFDIPISPTTPRSDRKNRISLLKRIVSSIPEVSDLSEHSSESHHEHVPHPRRKLRSSLNRILALGRRQEGSADSGRGSIASSAGSRDQNERVSLTSNASSILSPLLSPTNSNILILPPEPSKNRRKSTPAIPLLVVSDCS

SEQ ID NO: 6445 - protein, 838 aa, Caenorhabditis elegans
MFLPPPHKLFPFFLVFLNLVDTKDEPVFVKNNEDICLEDVDPGPCQYYQVQWFWDKQVEECKEFHYGGCMGTKNRFSSKQQCVKQCKYKMFNPVAVPDLCLLDADQGHCGDERNGHWWYFFNQESGECEKFFYYGCGGNDNKFYSLHMCRKVCGERLSPQIACDHCDLRTSFCKSNSKFNYTCECRSGYEKNQYGECIDIDECRGYKAVCDRNAWCVNEIGSYKCECMASYRGDGKHCTYVGLGRSSIDCKDCSMHATCMNGVCQCKEGYEGDGFNCTDVNECLRRPEMCNKNAECINREGSFICTCLEGYAGNGYNCTVSKNSCLDKFDHDYKDTCGNENWRPHFFFNHQTRMCEQFWYDGCRGRSRNIFSEYDTCTTMCEETNVLTRAEVCWDKFDMNYRNQCMNGQWQQRYYFDHASLTCRQFWFDGCRSDSRNIFDDELTCQWLCESQPMYKSRSCLEDFDEGLKKECNGGRWRHQWYFDKGSKKCFSFWYDGCKGANENIFQDELSCLHTCENPAKKDPKKPWHNNDKFKMKEIIGDIYKPNLTDTCLAKNPCKNNGTCIFVWKKDTHYCKCQPGFHGNNCDKVVDYDPCAEKPCLNGATCQIKYNDDDVDEKPTFECFCAAGFGGPKCDQRPCESNPCLNNGTCRTTKGYSTYFCECANGFGGKNCDVSIGNTPPEEKFGKNVEQISSGKEEWIAQMRQRLKETGGGIGGASGSGLKSENGTMGGSSGEKSGEKKSGKNKKSKATQVADEPYKDPATRKREREEREKKEAEIQAAEEEEKQRKEYEEDAQRKKAEEMELEAKKALEAANFGLKTDFSMSLLTILMAFVLREF

SEQ ID NO: 6446 - protein, 479 aa, Caenorhabditis elegans
MKVLPLERNLETPPHLTTRLLATSVVATFAGGFHFGYLISAVNPLSEILQQFIVDNLQNRYSYELSSSQLSLIWSSLAGCLFIGAMIGAYISIFLLQSIGPRNSLLLAAILQLFSAPVFGLAYSLRLCELLPISRILSGIAFAIGISAQGVFLTEISPAKFRGLTNSLSGLIGNCAFLLAATLGTPYVLGTVTQWKYIFFIETIPCVLHILVNITTFHDSPTYLLSIGKISEGESAIKVYYGETCHIKKIMEDLRIIDNGVKEKSLRQILKDKGCAQALSLAVAINFSVAFSGIVAISFFGTFLLQTIGFSPEGSAVANSLCSFASIVSALLAAIAMDKIGRRPLLITSLLVLALINIFMMSLVFLYDSTKDSFLAWPFLALFVLFTFVFSIGIGPAAVFIGAELAPPGTISKMQSYSTSVQFAGSFICPIIYLQLVESIGGFAFMLFIVPLTITAAYFYMYLPETKGKSPVEIYGLLQ

SEQ ID NO: 6447 - protein, 479 aa, Caenorhabditis elegans
MLFPAFSILLISFFSLLSVVTTKTQYWCHGDGVLNNQHTCRFFTIVIDAGSTGTRLHLYKFIHDPAIASHGMPFKVEKEIFQEVKPGLSSFAKSPSSAADSLEPLLQRARKEVPHFMWEKTPITLKATAGLRLLPGDMADDILESVEERIFNSGFFAAFPDAVNVMPGSDEGVYSWFTLNILLETLFTDEPTVGHKPAAHRSVAAFDLGGGSTQLTYWPNNEAVFSEHVGYERDIDFFGHHIRLFTHSFLGNGLIAARLNILQLETDNEIESTHQLITSCMPEGYQLTEWEYALKFWNINGSSSHSFESCYGTTKNFVESSEIMHLRELKGSPVYLFSYFFDRALNSGLVKGNEGGKIELRQFKEAAEIACRREKTEIDDGSHWMPWQCLDLTYIYSLLRDGYQFEDNQPLVLAKKIKGMEVSWGQGLAFATANEFQLTEGAIKTALSSEPNSTVVDQIFDLVYSGTNQVLSYFNIISV

SEQ ID NO: 6448 - protein, 396 aa, Caenorhabditis elegans
MSTISPDIVTNSTEEVAECSRNETYDFNRYALIVYVGTPIAVAGVICNWILFRLFTKSKSTKSPALYLLLLAVLDLLMDLLYIPFFTVDALAIYHKNEFLYHIWHDYAMFVFGLSRLVQFASTYIILCATIERFIVVAEINSLDFLISSTGRFVTIGITFLGVAILRLPAFFEYFITYRPDCPLYENYDYTPILASWEHYQMFNFYVMTVLHIFVPFALLLMLNISIVVVTKRKLTGIGWAVTTFIDMPKVSEMIRKESINSNKRRRDELRYATWTMVSIATTYLCCSSLSLFIGILENVWPENTLLFQEDGSSTKFYTFASDAVSILVAVNSLLRIVVYSLCSPNFRKQLVKEYPCLKCLTCGSDGDEKAKKIKEEKKLFIGYQNLIMGARVDML

SEQ ID NO: 6449 - protein, 347 aa, Caenorhabditis elegans
MSQDNLSAVLYGVDDLRLEQVPIPKPGPNQVLVKVHTVGICGSDVHYWTHGAIGPFVVKEPMIVGHETSGIVSEVGNEVKHLKVGDRIAMEPGLPCKLCEHCKTGRYNLCPEMRFFATPPVHGTLSRFVVHDADFCFKLPDNLSFEDGALIEPLSVAIHACRRGNVQMGHRVLVLGAGPIGVLNLITAKAVGAGKVVITDLDDGRLALAKKLGADATINVKGKSLDAVKSEIITALGDQQPDVCIECTGAQPSIETAITTTKSGGVIVLVGLGADRVEIPIIESATREVDMRGIFRYVNCYPTAIELISSGKLNLSGLTRAHYKLEETQEAFKRTQKADVIKVFIQC

SEQ ID NO: 6450 - protein, 447 aa, Caenorhabditis elegans
MTRIKSVILTVFLIFAHNSIVSAVDYGNASSCPKAAKYGTGPPESCTQPTDPNNMPASELESWFTREMFEDLFPFANLGWGPSSCWPYSYDAFKIASRYFPEFGTSINVNNTVYTADENKKRDLAAFFAHAVQETGENNIALYDTLSDQDASNCFYRGGFYNWFEGGPTSSFLDPKTPGYTPADGNSCASAGLYCSASDQITYFYPCSNSTISNTAAPYKGCYFGRGAIQISYNYNYGQFQDWLRTVNIKVDLLKEPNLVMTKMDPPLAVLASLWFYMTPQPPKPAMHDIVMGNWNSGAKNAAAGYDGPIFGPTSLIINNECSGEDPTNPGGPGESRRIKAFKWFCGYFDTPTGPEATLSCKNMPVPLDQIFYNLSYQPDWTSTWKDVPCTCAPASYGGLIFYYDPDYYPSSFAAQNDYNRIKCIASIYANPSMYSMDNKTSPCLNY

SEQ ID NO: 6451 - protein, 556 aa, Caenorhabditis elegans
MKNTHVDLICVFLSIFIGIGEAVDVYTNHFHVHLKEGGGLEDAHRIAKRHGFINRGQVAASDNEYHFVQPALVHARTRRSAGHHAKLHNDDENAEASYDFSSNDPFPYPRYTDDWFNSHGTRCAGEIVAARDNGVCGVGVAYDGKVAGIRMLDQPYMTDLIEANSMGHEPSKIHIYSASWGPTDDGKTVDGPRNATMRAIVRGVNEGRNGLGSIFVWASGDGGEDDDCNCDGYAASMWTISINSAINNGENAHYDESCSSTLASTFSNGGRNPETGVATTDLYGRCTRSHSGTSAAAPEAAGVFALALEANPSLTWRDLQHLTVLTSSRNSLFDGRCRDFPSLGINDNHRDSHGNCSHFEWQMNGVGLEYNHLFGFGVLDAAEMVMLAMAWKTSPPRYHCTAGLIDTPHEIPADGNLILEINTDGCAGSQFEVRYLEHVQAVVSFNSTRRGDTTLYLISPMGTRTMILSRRPKDDDSKDGFTNWPFMTTHTWGENPTGKWRLVARFQGPGAHAGTLKKFELMLHGTREAPYNLIEPIVGQTNKKLDTVQKAHKRSH

SEQ ID NO: 6452 - protein, 652 aa, Caenorhabditis elegans
MKNTHVDLICVFLSIFIGIGEAVDVYTNHFHVHLKEGGGLEDAHRIAKRHGFINRGQVAASDNEYHFVQPALVHARTRRSAGHHAKLHNDDEVLHVEQLKGYTRTKRGYRPLEQRLESQFDFSAVMSPSDPLYGYQWYLKNTGQAGGKARLDLNVERAWAMGFTGKNITTAIMDDGVDYMHPDIKNNFNAEASYDFSSNDPFPYPRYTDDWFNSHGTRCAGEIVAARDNGVCGVGVAYDGKVAGIRMLDQPYMTDLIEANSMGHEPSKIHIYSASWGPTDDGKTVDGPRNATMRAIVRGVNEGRNGLGSIFVWASGDGGEDDDCNCDGYAASMWTISINSAINNGENAHYDESCSSTLASTFSNGGRNPETGVATTDLYGRCTRSHSGTSAAAPEAAGVFALALEANPSLTWRDLQHLTVLTSSRNSLFDGRCRDFPSLGINDNHRDSHGNCSHFEWQMNGVGLEYNHLFGFGVLDAAEMVMLAMAWKTSPPRYHCTAGLIDTPHEIPADGNLILEINTDGCAGSQFEVRYLEHVQAVVSFNSTRRGDTTLYLISPMGTRTMILSRRPKDDDSKDGFTNWPFMTTHTWGENPTGKWRLVARFQGPGAHAGTLKKFELMLHGTREAPYNLIEPIVGQTNKKLDTVQKAHKRSH

SEQ ID NO: 6453 - protein, 741 aa, Caenorhabditis elegans
MQFDEEWSKADPIVHALLHQKSVTPAAWQDLFYHVYKITSWVDDGPLKIRDILTRCINDYVHEANKRIRSLQTDGSLLIGYIKEWNRFYQQANILPLPFKKIDESSRRRSVPETPEESIRTVMLEKWNEIIFMNISEQLLVEALRLVKEERDGNIIDAQNVIGIRESFVALNDRAGEDPLLVYRQSFERQFIEQTTEYYKKICGNLLNELGVLEYMVYADKKLEEEQQRAKRYLEMNSPTSGKHMEKAVIALVESFEDTILAECSKLIASKDVERLQRLYRLIRRTRSGIDTVLKCIDTHIRTEGLNDMRNNAENLSTDPERYVQQLLLMFDKFSSLVREGFCDDARLLTARDKAFRAVVNDSSIFKTEMMNKKGRTLSVESKCAELLANYCDLLLRKTQLSKKLTSEEIDEKLNQVLLVLKYVENKDVFMRFHRAHLSRRLILEMSADQEKEEMMVTKLRECGMPSDAVNKLSRMLQDIELNKDMNSSFKKALTGTNNNKSIADSINMKVLNGGAWGRGGSERIRFSLPRELEDFVPEMVFGTANGGRFDLECTTFQMAVLFCFNDRAHDKISLETLRLATELPDAELNRTLLSLVAYPKMRYQILLCDVPSTTVTARDFTDSTKFLINHDFNVVKNGKSQQRGKVNLIGRLQLSLEANAEKEHESIVALRELRVQEGIVKILKTRKTYTLAQLTMELVEILKPLFIPNRKIIKEQIDWLIENKYMERRADDINTFVYIS

SEQ ID NO: 6454 - protein, 195 aa, Caenorhabditis elegans
MGNSSSLMLRDEEIEEIMSETEFNRNQIVRLYSRFLSLDKKGQGFLSRDDFLNVPELAVNPLGDRIVDAFFTLASSNGDNEEQQLNFRQFVRILAHFQPISRVKKNALNSRKDKLLFAFKMYDLNKNDYITREEFKVILNSMVGANITSDQLDKIADRTIEEADADRDGKISFDEFCRAMEKTDIEEKMSIRFLN

SEQ ID NO: 6455 - protein, 541 aa, Caenorhabditis elegans
MSMTSLSTKSRRQEDVVIEGWLHKKGEHIRNWRPRYFMIFNDGALLGFRAKPKEGQPFPEPLNDFMIKDAATMLFEKPRPNMFMVRCLQWTTVIERTFYAESAEVRQRWIHAIESISKKYKGTNANPQEELMETNQQPKIDEDSEFAGAAHAIMGQPSSGHGDNCSIDFRASMISIADTSEAAKRDKITMEDFDFLKVLGKGTFGKVILCKEKRTQKLYAIKILKKDVIIAREEVAHTLTENRVLQRCKHPFLTELKYSFQEQHYLCFVMQFANGGELFTHVRKCGTFSEPRARFYGAEIVLALGYLHRCDIVYRDMKLENLLLDKDGHIKIADFGLCKEEISFGDKTSTFCGTPEYLAPEVLDDHDYGRCVDWWGVGVVMYEMMCGRLPFYSKDHNKLFELIMAGDLRFPSKLSQEARTLLTGLLVKDPTQRLGGGPEDALEICRADFFRTVDWEATYRKEIEPPYKPNVQSETDTSYFDNEFTSQPVQLTPPSRSGALATVDEQEEMQSNFTQFSFHNVMGSINRIHEASEDNEDYDMG

SEQ ID NO: 6456 - protein, 546 aa, Caenorhabditis elegans
MSMTSLSTKSRRQEDVVIEGWLHKKGEHIRNWRPRYFMIFNDGALLGFRAKPKEGQPFPEPLNDFMIKDAATMLFEKPRPNMFMVRCLQWTTVIERTFYAESAEVRQRWIHAIESISKKYKGTNANPQEELMETNQQPKIDEDSEFAGAAHAIMGQPSSGHGDNCSIDFRASMISIADTSEAAKRDKITMEDFDFLKVLGKGTFGKVILCKEKRTQKLYAIKILKKDVIIAREEVAHTLTENRVLQRCKHPFLTELKYSFQTNDRLCFVMEFAIGGDLYYHLNREVQMNKEGFSEPRARFYGSEIVLALGYLHANSIVYRDLKLENLLLDKDGHIKIADFGLCKEEISFGDKTSTFCGTPEYLAPEVLDDHDYGRCVDWWGVGVVMYEMMCGRLPFYSKDHNKLFELIMAGDLRFPSKLSQEARTLLTGLLVKDPTQRLGGGPEDALEICRADFFRTVDWEATYRKEIEPPYKPNVQSETDTSYFDNEFTSQPVQLTPPSRSGALATVDEQEEMQSNFTQFSFHNVMGSINRIHEASEDNEDYDMG

SEQ ID NO: 6457 - protein, 395 aa, Caenorhabditis elegans
MDSQGRKVIVVDNGTGFVKCGYAGTNFPAHIFPSMVGRPIVRSTQRVGNIEIKDLMVGEECSQLRQMLDINYPMDNGIVRNWDDMAHVWDHTFGPEKLDIDPKECKLLLTEPPLNPNSNREKMFQVMFEQYGFNSIYVAVQAVLTLYAQGLLTGVVVDSGDGVTHICPVYEGFALHHLTRRLDIAGRDITKYLIKLLLQRGYNFNHSADFETVRQMKEKLCYIAYDVEQEERLALETTVLSQQYTLPDGRVIRLGGERFEAPEILFQPHLINVEKAGLSELLFGCIQASDIDTRLDFYKHIVLSGGTTMYPGLPSRLEKELKQLYLDRVLHGNTDAFQKFKIRIEAPPSRKHMVFLGGAVLANLMKDRDQDFWVSKKEYEEGGIARCMAKLGIKA

SEQ ID NO: 6458 - protein, 301 aa, Caenorhabditis elegans
MSVFTNVVGGAFKFSDGYEMPKIGLGISRIETQQDLDVSIEAALKSGYRQFDTANLYKNETFLGNSLKKYLPQFGLTREDVFITTKVRTLNENTVEETEKQLANSLATLQTDYVDLLLIHYPRDRDTGNDDDYEINKSRRKIVWQTLEKAKESGRVRSIGVSNYEVYHLVEMFEYAKIRPVLNQYEYQPYLTRPTLKKFCDLNNIVVQSYSSLCWGDKEILQEKPLVDLCQKYNQTPQAILYAFAHCSNTSMIPKSATPSRIHDNLHNTIKIKLTEDELKSLRSLDKGKSFPQIGQTWRCL

SEQ ID NO: 6459 - protein, 1071 aa, Caenorhabditis elegans
MEDVDLGKDRTQLIDFVYANGNGSASNLNNRNNIPLSEKAAKEPLQTQPQEAPPAPKPKVQKQKPPVKPKKRIACSPGSAICLFLLAVAAIIFAAFLGHYLTKQNYEMMQFKSANESMTTCKNFTRSHKKHQDIVNEEDADENASIKQPTKEELALPKNVQPVWYDVSLSPKVGGNGTMGLAHVKLNIEEPTNKIVLNAKDIEFTRNLEKIQLSKEVTKRAKKSVDSGTNSTSEMPEGSGEEAMATTATTTTTESTTPVSSFVDTGIKVTNIEFDENLEKVTLTLDQELKKGSTVVLKIPFTSKVSNNNGLKEYKYKNSEGKEQSMFTTQPSYSYLRHVFPSFDQEAFKAPAAITLMHSKGSIVVANTGVKTKDDGDAQTSTLNKVLDPDFVIGDLVASEVNTTSGITIRIWTRPEVKHSTEQSLDYANQAIDAMEHILQSRLESKSLDIVAVPGFQTGNRVSPSFIVLPEEDILYNEQSNDINQKTRIARMISNRIAAQWFGGITNPEEFGTFWLNEALPRFLEVEALEKILDINSDDLWTYEMEKILERDATATSQPLRVKNVFSSADIAEIDHEFIGKKGAAVLRMIQKSVGVNVFNKAIRSFVSSYRSAYPYDDGLWKSFEKALGGKLKGWNNEPLDVAKFVNTWVDQIGFPLVSVEKLDDETVELSQERFKNDHKTKEQFKFRNAKYWFNWEVPLLPLNTSDSIYLNTDSNGVYRVNYEEKRWNDIAKQLEKSHGKLSERTRARLISDVFALANSGALPFETALNVTSYLPMETATVPWLIATRIFKKLTERLEGAPIQDKLNSFIYQKIHKKFEEISSSPGEASSNYLKNRLYANLLDLMAIVKPEKSNEKLNELFVEGFLAPCQFSGNFSSDCSEVPGDLREKVYCNGVEFGNDTVFETVRELAEKEVDGAEKDLLQNSLACFRDPRALRRLILDNLNSTSTVTLLLRKMNSRPVGKEIATNWIIDNWSTVLKKKFKNDPETLNAIADAGIILDNEREKSMIETFMEHHHKSTHGIESLDKKIEEATTDIYWRKQKINELNDYLDGKMKGPAKDDEMESSEEQE

SEQ ID NO: 6460 - protein, 198 aa, Caenorhabditis elegans
MDEEERTSSRGWMREFKYPSNLRDITEEARISLSSVAHFDELLHESSELAWRTNMSPPHRALFTFSKKTDISYVMLFLDYSRDESYCPQEVRIDLGDGTNDWWLKMYRRVDQPKGWVKIPIHDAFGNPLRVMSLQMTIMKNHEKGRDCVVRHFRVLGPFRSRYDSMNRMILGPSAVLEARPGTEPIKDAIMNHYQSMR

SEQ ID NO: 6461 - protein, 207 aa, Caenorhabditis elegans
MAKEEDEKCLKCIFVGNAAVGKTSMIVSYTTNVYPHNYVPTAFDNFSVVVLVDKKPIRLQLHDTAGQSSFDTLRPLCYTDADVFVIVYSVVDLQSFEDVSHHWYPEVTKRNPGTKLILVGTQADQRWQVRGNTVTQLRGKALADRLGAEFFECSALTQHNLKQMFDAAILAGLEGKKNREKRSNFYTKSSKIKERVARFITRTRNLI

SEQ ID NO: 6462 - protein, 187 aa, Caenorhabditis elegans
MENKLKLVVVGDTYTGKTSLLVAYTKKQFLDNYTTTVFDNWAVSVHIDNKNYAVNLFDTAGQGNYEQIRCLSYPHANVFLVCFSMIDRKTLESCRSTWIPEIRKYAGDNVPIMLVGTKNDLVDDADSRNTVTEDYAKRVAHEIGCHKFYSCSALTHKGLKRVFDESFLAAVGVKLEEETPNPCCTIL

SEQ ID NO: 6463 - protein, 591 aa, Caenorhabditis elegans
MEITCFFEIFSSNANSSQFPADIFSLQTRRRGGVIVHIGLLIYMFVALAVVCDEFFVPSLSVITEVLAISDDVAGATFMAAGGSAPEFFTSLFGVFVAQDNVGVGTIVGSATFNILCVLAFCTLFSRQVLHLTWWPLFRDMSFYTLSLFLLLIFFGDEVIEWQEALVMFSMYIAYGFFMKFNGFLELKTKQFLFRKVGIGSEIAPETIVDAAAGCTPRSPHSLGAQGPRRSFPMIHGGQEVRKSIAQLVIGDEDDTSSSSSSSSSERSNKIKPVSNGVPEIRQNGRTIMVKPANDPDAKFNNQNSIKTVITPIDFGDDHTIVINNNNNGKRKNGNNGTYLTPVEAINPSNGHLELAQTNGNPVPPIALDNLSIASSTAEKPLDLSWPEANHKKLIYLFLAPITFPLAYTLPDVRKPSLRKFFAITFIGAILWIAAYSYLMVWWANTIGETFGIPTEIMGLTILAAGTSIPDLITSVIVARKGLGDMAVSSSIGSNLFDVCVGLPIPWLIHFAIGVFKSEPTQNISVTSNGLVCSLGLLFAMLIVLLTCVAISRWKMDKFFGLLMIFSYCGFCMLCILLETGHLKCPLRNSC

SEQ ID NO: 6464 - protein, 591 aa, Caenorhabditis elegans; identical to SEQ ID NO: 6463

SEQ ID NO: 6465 - protein, 468 aa, Caenorhabditis elegans
MTISRADLQIASSAEPKTHGNLNESFAPEIRQTASTIASLSIFGTPSDQECQPIPVVPRSSSSDELRVWRVTSAGLVEVDAKTMGAFLDKPKTDKTNVHGEGNGIRYGMSSMQGWRICMEDSHIAEAIMSQSSPYKDWSFFAVFDGHAGHHIANRASSQLLEHLISSEEFREMTKTLEENNGVLTDSTLKLLEKGIKKGFLSFDEISKTSNDISKSGCTAVCAIVTPTHFIIGNLGDSRAVVAGKNEIFGTEDHKPYLEKERKRIEGAGGSVMIQRINGSLAVSRAFGDYEYKDDPRLPADQQLVSPEPDVYIRERNLENDQFMVVACDGIYDVMTNEELAEFVKDRLSVHSDLREVCDDVLDECLVKGSRDNMTMVVVCFPAAPEVNIHRKEAEEAWVSRVKTVINQFLDEAVAAEDFKQEEDMVTLKSILDKVTANGLLPTDLRVPEHTVTTLAQKILTQRDIKHV

SEQ ID NO: 6466 - protein, 277 aa, Caenorhabditis elegans
MARFSGKSVIITGSSNGIGRSAAVIFAKEGAQVTITGRNEDRLEETKQQILKAGVPAEKINAVVADVTEASGQDDIINTTLAKFGKIDILVNNAGANLADGTANTDQPVELYQKTFKLNFQAVIEMTQKTKEHLIKTKGEIVNVSSIVAGPQAHSGYPYYACAKAALDQYTRCTAIDLIQHGVRVNSVSPGAVATGFMGAMGLPETASDKLYSFIGSRKECIPVGHCGKPEEIANIIVFLADRNLSSYIIGQSIVADGGSTLVMGMQTHDLMSVLSQ

SEQ ID NO: 6467 - protein, 223 aa, Caenorhabditis elegans
MSRIENESGFLSSDAASVGSEDDKVEMKKRNGTIPKEDHLKSMCNAYQSIIQHVGEDINRQGLLKTPERAAKAMMAFTKGYDDQLDELLNEAVFDEDHDEMVIVKDIEMFSLCEHHLVPFMGKVHIGYIPNKKVLGLSKLARIVEMFSRRLQVQERLTKQIATAMVQAVQPSGVAVVIEASHMCMVMRGVQKINASTTTSCMLGVFRDDPKTREEFLNLINKR

SEQ ID NO: 6468 - protein, 360 aa, Caenorhabditis elegans
MEETGFQFDVYMYLLPLIVIFGLSGNVISLVTIFHSRLRRVNANIYLIVLTLADSIFLTGILLICFKVDWIAYEYCVGLEYVLMTASYISSWSTAALTIERYLAIAHPLSHMKYGHVDRAKVMLYWVPIPFVLQLFQFFSLEPATEERKCALKEANYQIIAQAVDTVLCYVVPCGIIVVLNILVALQVQKSQEHFMAETKKSNSRRTGGSSSSSGTWTRILWVMPLVFVVLNTPFYSPPSGDTRSELFVTVYNTAHYMYYMNTAIDVLVYAFSSANFRKTAVIAWKRILCPGYAERQKGKVLVTDQTSRISYRMTSERSTIRFPNTPSRANSPKLTASNAVSVPLLGTEIQGSSKESTAI

SEQ ID NO: 6469 - protein, 491 aa, Caenorhabditis elegans
MERRVAFRPPPIGESRSTTITHDSGSNADTYMRLNVGGKSYYVRAELYTSEWTRMHELLDSSHEERLKMVDGFDSKTGEYYLERNAKLTDHVMDFFVTGSLHKPQNVCVERFKEELEYWKIKPDQLSTCCQIPSEHHVRKLSRGTSFNEDDYVTDFDGACFAGPRLAMWKFLEDPQSSVFAAVFALLSVFFVFASVVGLILGSMPEFQADSSNAATYHVMHVRSRPNDYGNKFGNDDDVAPNELLKDFVYKPTDSPNLPLTILEYICIGWFTFEYLVRFTIYPRKRQFVKKTLNIIDLSTILPFYLEICLPLFGVESRLKEFTGAMLVVRVLRVLRMARVFKLARYSTSLQTFGHTLQSSITELSMLSMFLITGIVFFSTIMYYLEKDEPHTDFYSIPAGCWWCVVTMATVGYGDAKPVTTLGKLVATSTSICGIIVLAFPISMIVEKFATAQQRAIEDQQIQQGQKSFFFNFWNKIIRLCKHLLLVNILY

SEQ ID NO: 6470 - protein, 481 aa, Caenorhabditis elegans
MTDQVFGKVSKVVCVGAGYVGGPTCAMIAHKCPHITVTVVDMNTAKIAEWNSDKLPIYEPGLDEIVFAARGRNLFFSSDIPKAIAEADLIFISVNTPTKMYGRGKGMAPDLKYVESVSRTIAQYAGGPKIVVEKSTVPVKAAESIGCILREAQKNNENLKFQVLSNPEFLAEGTAMKDLANPDRVLIGGESSPEGLQAVAELVRIYENWVPRNRIITTNTWSSELSKLVANAFLAQRISSINSISAVCEATGAEISEVAHAVGYDTRIGSKFLQASVGFGGSCFQKDVLSLVYLCESLNLPQVADYWQGVININNWQRRRFADKIIAELFNTVTDKKIAIFGFAFKKNTGDTRESSAIHVIKHLMEEHAKLSVYDPKVQKSQMLNDLASVTSAQDVERLITVESDPYAAARGAHAIVVLTEWDEFVELNYSQIHNDMQHPAAIFDGRLILDQKALREIGFRTFAIGTSPDQAYNLFGTAGY

SEQ ID NO: 6471 - protein, 329 aa, Caenorhabditis elegans
MSNDGDLNIDNLITRLLEVRGCRPGKPVTMSEAEIRALCHKSREIFLSQPILLELEAPLKICGDIHGQYNDLLRLFEYGGFPPEANYLFLGDYVDRGKQSLETICLLLAYKVKYPENFFLLRGNHECASINRIYGFYDECKRRFSIKLWKTFTDCFNCLPIAALIDEKIFCCHGGLSPDLQNMEQIRRVMRPTDVPDTGLLCDLLWSDPDKDVTGWGENDRGVSFTFGPDVVAKFLNRHDLDLICRAHQVVEDGYEFFAKRQLVTLFSAPNYCGEFDNAGGMMSVDETLMCSFQILKPSEKKAKYQYQGMNSGRPAVGGGRPGTTAGKK

SEQ ID NO: 6472 - protein, 401 aa, Caenorhabditis elegans
MNPSNCWENVGASCSTFDNPNVLSETNRLLSVSFSVFFRFQKIVPPSIIPIQMMRRKNSSSSFGELNIDQLISTLVSVKPWHKTLDVTENEIRMVCVLARQIFMHQPMLLELEPPLKIGGDIHGQFADLLRLFNLAGYPPESNYLFLGDYVDRGPKSIETIVLLLCYKIKYPNNFFLLRGNHEVANLNRIYGFYDECKRRYSVKLWKCFQDVFNCMPVAALIDNKIFCCHGGLSPNLRSLDQLKRLSRPCDVQETGLLCDVLWSDPDATVVGWAPNERGVSYVFGVDVLAQFLQKMDLDIVVRGHQVVEDGYEFFGRRGLVTVFSAPNYCGEFDNAGAVMNVDENLLCSFQILKPQSQLVMDAALAEKQNNFVANLAGMANIKIEQKPQPMIQKRFRRGML

SEQ ID NO: 6473 - protein, 401 aa, Caenorhabditis elegans; identical to SEQ ID NO: 6472

SEQ ID NO: 6474 - protein, 772 aa, Caenorhabditis elegans
MSATGKVSRPIQVFTRANYFFKLIFQFKVRKYNSLTVERIFIRAMCGSDDSFDDFVPDSQEPASSRTRNQDHLDDDEVPCSQRPDAANDTMVEDLDEGDEPAHDESEDIIKILVATDIHCGYGENKANIHMDAVNTFEEVLQIATEQKVDMILLGGDLFHENNPSREVQHRVTQLLRQYCLNGNPIALEFLSDASVNFNQSVFGHVNYYDQNLNVGLPIFTIHGNHDDLSGKGLTALDLLHESGLVNLFGKHSNIQEFIVSPILLRKGETRLALYGIGSQRDDRLVRAFKNNSISFLRPNAGAEDWFNLFVLHQNRPRRAMHRSTGNFLPESLIPQFFDLLIWGHEHECKPDPQYVASSEAVGDGFYILQPGSTVATSLTPEEALQKNAFLIKIKGRKFASKPIPLQTVRPMVCDELLLDKIPPGSRPILKTDRPKHTDGRYIDEIAIEAKINEMITTAKAKRRPRQPELPLIRLKVIYDGDWLNITPANAKRIGLRYENVVANAVDMVFIKKNNKPKEGKLQTENEKNITEMADEMGQVSATNLQTIINDYFINQPLVDQMTVLKPIGIGRALEQYSAIEEGGLATSANRNFDSCLMHQIDVVRKTLKKMPLPPINDPSDLDKFRDLITKDLYDMKKADSERFKNPVADVEMEEDEDDPQYYMPPQSTSRTNYASGSEDEVANSDEEMGSSISRHSKQPTTRGRGRGARGAGASRETTRGRSNKVVSTRQIDSDGFEIINDSPSPPPASRSTRGKARGKSAPSKKRDLSFF

SEQ ID NO: 6475 - protein, 284 aa, Caenorhabditis elegans
MSRFTDKVAIITGSSNGIGQATARLLASEGAKVTVTGRNAERLEETKNILLGAGVPEGNVLVVVGDITQESVQENLIKSTLDKFGKIDILVNNAGAGIPDAQGKSGVNQSIDTYHKTFELNVQSVIEMTQKARPHLAKTQGEIVNISSIGAGPAAQVASPYYSIAKAALDQYTRTAAIDLVPEGIRVNSVSPGAVSTGFSAVSRGLTEEKSKAFYDYLGAQRECIPRGFCAVPEDIAKVIAFLADRNASNYIIGQTIVADGGTSLILGAHAHGAKMMQAVFKEL

SEQ ID NO: 6476 - protein, 231 aa, Caenorhabditis elegans
MGDHYGFSLTTFSPSGKLMQIEYALNAVKNGQPSVGLRAKDGVVLATENVGSVLTDDQPKVEQISKHIGCVYSGMGPDFRILVKKARKIAMEYEMMYGEEMPTIQLVTDIAAVMQEYTQSGGVRPFGASLLIAGWDKNPGRPLLFQCDPSGAYFAWKATALGKNDVNAKTFLEKRFSEALELDDGIHTALLTLRESFDVGMNENNVEVAVCNSTGFHRLTKQQVHDHLGTL

SEQ ID NO: 6477 - protein, 278 aa, Caenorhabditis elegans
MTRFAEKVAIITGSSNGIGRATAVLFAREGAKVTITGRHAERLEETRQQILAAGVSEQNVNSVVADVTTDAGQDEILSTTLGKFGKLDILVNNAGAAIPDSQSKTGTAQSIESYDATLNLNLRSVIALTKKAVPHLSSTKGEIVNISSIASGLHATPDFPYYSIAKAAIDQYTRNTAIDLIQHGIRVNSISPGLVATGFGSAMGMPEETSKKFYSTMATMKECVPAGVMGQPQDIAEVIAFLADRKTSSYIIGHQLVVDGGSSLIMGLHCQDFAKLLH
